United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 87

SEQ ID NO: 3971721 - RNA, 14 nt, Human herpesvirus 4 [Epstein-Barr virus]
ucuuugcaauuugc

SEQ ID NO: 3971722 - RNA, 18 nt, Human herpesvirus 4 [Epstein-Barr virus]
ucuuuugcucuuaaccau

SEQ ID NO: 3971723 - RNA, 14 nt, Human herpesvirus 4 [Epstein-Barr virus]
ugaaaagccacauu

SEQ ID NO: 3971724 - RNA, 14 nt, Human herpesvirus 4 [Epstein-Barr virus]
ugacauauguacaa

SEQ ID NO: 3971725 - RNA, 15 nt, Human herpesvirus 4 [Epstein-Barr virus]
ugaccaagcuaccag

SEQ ID NO: 3971726 - RNA, 21 nt, Human herpesvirus 4 [Epstein-Barr virus]
ugaccuccuacacguuugccc

SEQ ID NO: 3971727 - RNA, 18 nt, Human herpesvirus 4 [Epstein-Barr virus]
ugacggucgccauugccc

SEQ ID NO: 3971728 - RNA, 12 nt, Human herpesvirus 4 [Epstein-Barr virus]
ugacgguggugg

SEQ ID NO: 3971729 - RNA, 17 nt, Human herpesvirus 4 [Epstein-Barr virus]
ugacuacaauguuccuu

SEQ ID NO: 3971730 - RNA, 14 nt, Human herpesvirus 4 [Epstein-Barr virus]
ugacugacucuccc

SEQ ID NO: 3971731 - RNA, 21 nt, Human herpesvirus 4 [Epstein-Barr virus]
ugacuggcagaaaggcuggcc

SEQ ID NO: 3971732 - RNA, 21 nt, Human herpesvirus 4 [Epstein-Barr virus]
ugacuguaaucacuggcaaag

SEQ ID NO: 3971733 - RNA, 22 nt, Human herpesvirus 4 [Epstein-Barr virus]
ugagccaggcuuucuaugccug

SEQ ID NO: 3971734 - RNA, 20 nt, Human herpesvirus 4 [Epstein-Barr virus]
ugaggacggugucugugguu

SEQ ID NO: 3971735 - RNA, 15 nt, Human herpesvirus 4 [Epstein-Barr virus]
ugaggcaauggccac

SEQ ID NO: 3971736 - RNA, 22 nt, Human herpesvirus 4 [Epstein-Barr virus]
ugaggguugguguccucccggg

SEQ ID NO: 3971737 - RNA, 19 nt, Human herpesvirus 4 [Epstein-Barr virus]
ugagucaucccguggagag

SEQ ID NO: 3971738 - RNA, 15 nt, Human herpesvirus 4 [Epstein-Barr virus]
ugaguccagggcccu

SEQ ID NO: 3971739 - RNA, 14 nt, Human herpesvirus 4 [Epstein-Barr virus]
ugagugcccagggc

SEQ ID NO: 3971740 - RNA, 22 nt, Human herpesvirus 4 [Epstein-Barr virus]
ugauacucaccaagauuguucc

SEQ ID NO: 3971741 - RNA, 13 nt, Human herpesvirus 4 [Epstein-Barr virus]
ugaucagggagaa

SEQ ID NO: 3971742 - RNA, 14 nt, Human herpesvirus 4 [Epstein-Barr virus]
ugauccuguacaaa

SEQ ID NO: 3971743 - RNA, 17 nt, Human herpesvirus 4 [Epstein-Barr virus]
ugaugcuugugcuccug

SEQ ID NO: 3971744 - RNA, 15 nt, Human herpesvirus 4 [Epstein-Barr virus]
ugauggcaaaggucc

SEQ ID NO: 3971745 - RNA, 13 nt, Human herpesvirus 4 [Epstein-Barr virus]
ugauggugcagag

SEQ ID NO: 3971746 - RNA, 22 nt, Human herpesvirus 4 [Epstein-Barr virus]
ugauuaggcacuggacacacau

SEQ ID NO: 3971747 - RNA, 20 nt, Human herpesvirus 4 [Epstein-Barr virus]
ugcaagucaggauucucuaa

SEQ ID NO: 3971748 - RNA, 16 nt, Human herpesvirus 4 [Epstein-Barr virus]
ugcaaugcccacccac

SEQ ID NO: 3971749 - RNA, 14 nt, Human herpesvirus 4 [Epstein-Barr virus]
ugcaccggagccug

SEQ ID NO: 3971750 - RNA, 18 nt, Human herpesvirus 4 [Epstein-Barr virus]
ugcacgccaacagcgacc

SEQ ID NO: 3971751 - RNA, 15 nt, Human herpesvirus 4 [Epstein-Barr virus]
ugcacggcccuccag

SEQ ID NO: 3971752 - RNA, 14 nt, Human herpesvirus 4 [Epstein-Barr virus]
ugcacucucucccc

SEQ ID NO: 3971753 - RNA, 20 nt, Human herpesvirus 4 [Epstein-Barr virus]
ugcaggccuggacagcacaa

SEQ ID NO: 3971754 - RNA, 15 nt, Human herpesvirus 4 [Epstein-Barr virus]
ugcagggugcacaga

SEQ ID NO: 3971755 - RNA, 21 nt, Human herpesvirus 4 [Epstein-Barr virus]
ugcagguaaaccuucugucug

SEQ ID NO: 3971756 - RNA, 16 nt, Human herpesvirus 4 [Epstein-Barr virus]
gggacuggcggcacug

SEQ ID NO: 3971757 - RNA, 20 nt, Human herpesvirus 4 [Epstein-Barr virus]
gggcaaaacucacaggacau

SEQ ID NO: 3971758 - RNA, 19 nt, Human herpesvirus 4 [Epstein-Barr virus]
gggcacgagauggcccagu

SEQ ID NO: 3971759 - RNA, 22 nt, Human herpesvirus 4 [Epstein-Barr virus]
gggcagaaccaucagcucgccc

SEQ ID NO: 3971760 - RNA, 16 nt, Human herpesvirus 4 [Epstein-Barr virus]
gggcagccagagccag

SEQ ID NO: 3971761 - RNA, 18 nt, Human herpesvirus 4 [Epstein-Barr virus]
gggcaggaggggcaggag

SEQ ID NO: 3971762 - RNA, 20 nt, Human herpesvirus 4 [Epstein-Barr virus]
gggcaucuuaucagagaggc

SEQ ID NO: 3971763 - RNA, 18 nt, Human herpesvirus 4 [Epstein-Barr virus]
gggccacugcaggcugga

SEQ ID NO: 3971764 - RNA, 20 nt, Human herpesvirus 4 [Epstein-Barr virus]
gggccaggcugucgccagcc

SEQ ID NO: 3971765 - RNA, 20 nt, Human herpesvirus 4 [Epstein-Barr virus]
gggcgcaccuguguccuggg

SEQ ID NO: 3971766 - RNA, 22 nt, Human herpesvirus 4 [Epstein-Barr virus]
gggcggcucaggaucagggcca

SEQ ID NO: 3971767 - RNA, 21 nt, Human herpesvirus 4 [Epstein-Barr virus]
gggcuggugggcucccucugg

SEQ ID NO: 3971768 - RNA, 22 nt, Human herpesvirus 4 [Epstein-Barr virus]
gggcugguuggggagcuacaga

SEQ ID NO: 3971769 - RNA, 21 nt, Human herpesvirus 4 [Epstein-Barr virus]
ggggaguaaggccgcugccag

SEQ ID NO: 3971770 - RNA, 23 nt, Human herpesvirus 4 [Epstein-Barr virus]
ggggcaaagccagcgcacccggg

SEQ ID NO: 3971771 - RNA, 16 nt, Human herpesvirus 4 [Epstein-Barr virus]
ggggcaggaggggcag

SEQ ID NO: 3971772 - RNA, 17 nt, Human herpesvirus 4 [Epstein-Barr virus]
ggggcaggaggggcagg

SEQ ID NO: 3971773 - RNA, 21 nt, Human herpesvirus 4 [Epstein-Barr virus]
ggggccaaaagggcucugacc

SEQ ID NO: 3971774 - RNA, 22 nt, Human herpesvirus 4 [Epstein-Barr virus]
ggggcuaaccaaggacaacagc

SEQ ID NO: 3971775 - RNA, 19 nt, Human herpesvirus 4 [Epstein-Barr virus]
ggggcucaaggaggggcgg

SEQ ID NO: 3971776 - RNA, 19 nt, Human herpesvirus 4 [Epstein-Barr virus]
ggggcucauggaggggcgg

SEQ ID NO: 3971777 - RNA, 14 nt, Human herpesvirus 4 [Epstein-Barr virus]
ggggcuggccugcc

SEQ ID NO: 3971778 - RNA, 13 nt, Human herpesvirus 4 [Epstein-Barr virus]
gggguggaggcug

SEQ ID NO: 3971779 - RNA, 15 nt, Human herpesvirus 4 [Epstein-Barr virus]
ggguacaagucccgg

SEQ ID NO: 3971780 - RNA, 18 nt, Human herpesvirus 4 [Epstein-Barr virus]
ggguauucucagaugcag

SEQ ID NO: 3971781 - RNA, 15 nt, Human herpesvirus 4 [Epstein-Barr virus]
gggugacacagugcc

SEQ ID NO: 3971782 - RNA, 16 nt, Human herpesvirus 4 [Epstein-Barr virus]
gggugaccuggcucag

SEQ ID NO: 3971783 - RNA, 16 nt, Human herpesvirus 4 [Epstein-Barr virus]
gggugaggcggugccu

SEQ ID NO: 3971784 - RNA, 22 nt, Human herpesvirus 4 [Epstein-Barr virus]
gguaaguuuucccuuccuuuaa

SEQ ID NO: 3971785 - RNA, 22 nt, Human herpesvirus 4 [Epstein-Barr virus]
gguacaugggccacugcaggcu

SEQ ID NO: 3971786 - RNA, 19 nt, Human herpesvirus 4 [Epstein-Barr virus]
gguagccuugggggccugg

SEQ ID NO: 3971787 - RNA, 18 nt, Human herpesvirus 4 [Epstein-Barr virus]
gguagugauuuggacccg

SEQ ID NO: 3971788 - RNA, 17 nt, Human herpesvirus 4 [Epstein-Barr virus]
gguauucucagaugcag

SEQ ID NO: 3971789 - RNA, 13 nt, Human herpesvirus 4 [Epstein-Barr virus]
gguauuuggacga

SEQ ID NO: 3971790 - RNA, 18 nt, Human herpesvirus 4 [Epstein-Barr virus]
ggucaaguaccagcuggu

SEQ ID NO: 3971791 - RNA, 16 nt, Human herpesvirus 4 [Epstein-Barr virus]
ggucauuagaugcugc

SEQ ID NO: 3971792 - RNA, 22 nt, Human herpesvirus 4 [Epstein-Barr virus]
gguccagaagcagauagccggc

SEQ ID NO: 3971793 - RNA, 13 nt, Human herpesvirus 4 [Epstein-Barr virus]
gguccgugcggcu

SEQ ID NO: 3971794 - RNA, 18 nt, Human herpesvirus 4 [Epstein-Barr virus]
ggugaacacuugggcacg

SEQ ID NO: 3971795 - RNA, 15 nt, Human herpesvirus 4 [Epstein-Barr virus]
ggugaaggcucgacg

SEQ ID NO: 3971796 - RNA, 19 nt, Human herpesvirus 4 [Epstein-Barr virus]
ggugagaaguugguggugg

SEQ ID NO: 3971797 - RNA, 16 nt, Human herpesvirus 4 [Epstein-Barr virus]
ggugcaccagcuccag

SEQ ID NO: 3971798 - RNA, 20 nt, Human herpesvirus 4 [Epstein-Barr virus]
ggugccauuguuuaccgcca

SEQ ID NO: 3971799 - RNA, 19 nt, Human herpesvirus 4 [Epstein-Barr virus]
ggugccgacaccggggugc

SEQ ID NO: 3971800 - RNA, 16 nt, Human herpesvirus 4 [Epstein-Barr virus]
ggugcguggucgggag

SEQ ID NO: 3971801 - RNA, 14 nt, Human herpesvirus 4 [Epstein-Barr virus]
gguggaggcugcgc

SEQ ID NO: 3971802 - RNA, 12 nt, Human herpesvirus 4 [Epstein-Barr virus]
ggugggcugcug

SEQ ID NO: 3971803 - RNA, 13 nt, Human herpesvirus 4 [Epstein-Barr virus]
ggugggcugcuga

SEQ ID NO: 3971804 - RNA, 14 nt, Human herpesvirus 4 [Epstein-Barr virus]
ggugggguggugua

SEQ ID NO: 3971805 - RNA, 14 nt, Human herpesvirus 4 [Epstein-Barr virus]
ggugguggcagcag

SEQ ID NO: 3971806 - RNA, 17 nt, Human herpesvirus 4 [Epstein-Barr virus]
gguguagugggugggca

SEQ ID NO: 3971807 - RNA, 13 nt, Human herpesvirus 4 [Epstein-Barr virus]
gguguccagcgcu

SEQ ID NO: 3971808 - RNA, 16 nt, Human herpesvirus 4 [Epstein-Barr virus]
gguuauggcagagcuu

SEQ ID NO: 3971809 - RNA, 23 nt, Human herpesvirus 4 [Epstein-Barr virus]
gguugucuucccagacucugcuu

SEQ ID NO: 3971810 - RNA, 22 nt, Human herpesvirus 4 [Epstein-Barr virus]
gguuucaauuuugggagcucca

SEQ ID NO: 3971811 - RNA, 21 nt, Human herpesvirus 4 [Epstein-Barr virus]
guaacccuguagucaccugca

SEQ ID NO: 3971812 - RNA, 14 nt, Human herpesvirus 4 [Epstein-Barr virus]
guaagcauggggcu

SEQ ID NO: 3971813 - RNA, 21 nt, Human herpesvirus 4 [Epstein-Barr virus]
guaauccuugggugaccuggc

SEQ ID NO: 3971814 - RNA, 22 nt, Human herpesvirus 4 [Epstein-Barr virus]
guaccagcccuuuuuccagugg

SEQ ID NO: 3971815 - RNA, 14 nt, Human herpesvirus 4 [Epstein-Barr virus]
guaccagcuggugg

SEQ ID NO: 3971816 - RNA, 22 nt, Human herpesvirus 4 [Epstein-Barr virus]
guaccagcuggugguccgcaug

SEQ ID NO: 3971817 - RNA, 16 nt, Human herpesvirus 4 [Epstein-Barr virus]
guacccgccaagcacg

SEQ ID NO: 3971818 - RNA, 18 nt, Human herpesvirus 4 [Epstein-Barr virus]
guacccgggucccgccuc

SEQ ID NO: 3971819 - RNA, 13 nt, Human herpesvirus 4 [Epstein-Barr virus]
guacuaacacgca

SEQ ID NO: 3971820 - RNA, 12 nt, Human herpesvirus 4 [Epstein-Barr virus]
guagaugagccu

SEQ ID NO: 3971821 - RNA, 19 nt, Human herpesvirus 4 [Epstein-Barr virus]
guagccgaauaucuggagg

SEQ ID NO: 3971822 - RNA, 23 nt, Human herpesvirus 4 [Epstein-Barr virus]
guaguaggcacaucuggaccugg

SEQ ID NO: 3971823 - RNA, 21 nt, Human herpesvirus 4 [Epstein-Barr virus]
guauugcgcuggccgagccug

SEQ ID NO: 3971824 - RNA, 12 nt, Human herpesvirus 4 [Epstein-Barr virus]
gucaaggccucg

SEQ ID NO: 3971825 - RNA, 18 nt, Human herpesvirus 4 [Epstein-Barr virus]
gucaaggcucugcacagg

SEQ ID NO: 3971826 - RNA, 14 nt, Human herpesvirus 4 [Epstein-Barr virus]
gucaaggugucaau

SEQ ID NO: 3971827 - RNA, 20 nt, Human herpesvirus 4 [Epstein-Barr virus]
gucacaaccucacugucauu

SEQ ID NO: 3971828 - RNA, 15 nt, Human herpesvirus 4 [Epstein-Barr virus]
gucacggaugcugca

SEQ ID NO: 3971829 - RNA, 23 nt, Human herpesvirus 4 [Epstein-Barr virus]
gucacgugaccuuuuccgccggc

SEQ ID NO: 3971830 - RNA, 13 nt, Human herpesvirus 4 [Epstein-Barr virus]
gucacuccagcca

SEQ ID NO: 3971831 - RNA, 23 nt, Human herpesvirus 4 [Epstein-Barr virus]
gucacugagaaucuccugugcuu

SEQ ID NO: 3971832 - RNA, 13 nt, Human herpesvirus 4 [Epstein-Barr virus]
gucacugauuuug

SEQ ID NO: 3971833 - RNA, 16 nt, Human herpesvirus 4 [Epstein-Barr virus]
gucagcacagccagag

SEQ ID NO: 3971834 - RNA, 23 nt, Human herpesvirus 4 [Epstein-Barr virus]
gucagccuugcccccgccagcgc

SEQ ID NO: 3971835 - RNA, 20 nt, Human herpesvirus 4 [Epstein-Barr virus]
gucagcuguguacgugccuc

SEQ ID NO: 3971836 - RNA, 21 nt, Human herpesvirus 4 [Epstein-Barr virus]
gucaggucgcggaccaggguc

SEQ ID NO: 3971837 - RNA, 13 nt, Human herpesvirus 4 [Epstein-Barr virus]
guccaucccggag

SEQ ID NO: 3971838 - RNA, 20 nt, Human herpesvirus 4 [Epstein-Barr virus]
gucccaaacauaaaugcccc

SEQ ID NO: 3971839 - RNA, 20 nt, Human herpesvirus 4 [Epstein-Barr virus]
agagauuucauccucagagg

SEQ ID NO: 3971840 - RNA, 18 nt, Human herpesvirus 4 [Epstein-Barr virus]
agagcauaugccgguggc

SEQ ID NO: 3971841 - RNA, 19 nt, Human herpesvirus 4 [Epstein-Barr virus]
agagccccuuuugcccccc

SEQ ID NO: 3971842 - RNA, 12 nt, Human herpesvirus 4 [Epstein-Barr virus]
agagcucuggag

SEQ ID NO: 3971843 - RNA, 22 nt, Human herpesvirus 4 [Epstein-Barr virus]
agagcuggaugguguuggagac

SEQ ID NO: 3971844 - RNA, 18 nt, Human herpesvirus 4 [Epstein-Barr virus]
agaggacacgcuggucuu

SEQ ID NO: 3971845 - RNA, 23 nt, Human herpesvirus 4 [Epstein-Barr virus]
agaggcgggaauggccgccaccc

SEQ ID NO: 3971846 - RNA, 21 nt, Human herpesvirus 4 [Epstein-Barr virus]
agagggcagacguuaguaaca

SEQ ID NO: 3971847 - RNA, 22 nt, Human herpesvirus 4 [Epstein-Barr virus]
agagucuaucaggaccugggag

SEQ ID NO: 3971848 - RNA, 12 nt, Human herpesvirus 4 [Epstein-Barr virus]
agauagggacca

SEQ ID NO: 3971849 - RNA, 19 nt, Human herpesvirus 4 [Epstein-Barr virus]
agaucaucccacugggacg

SEQ ID NO: 3971850 - RNA, 15 nt, Human herpesvirus 4 [Epstein-Barr virus]
agaucgugaggccug

SEQ ID NO: 3971851 - RNA, 18 nt, Human herpesvirus 4 [Epstein-Barr virus]
agaucgugaggccugaga

SEQ ID NO: 3971852 - RNA, 21 nt, Human herpesvirus 4 [Epstein-Barr virus]
agaugaccaugauggugcaga

SEQ ID NO: 3971853 - RNA, 17 nt, Human herpesvirus 4 [Epstein-Barr virus]
agauucagacgagucug

SEQ ID NO: 3971854 - RNA, 19 nt, Human herpesvirus 4 [Epstein-Barr virus]
agauuuucccacugugccu

SEQ ID NO: 3971855 - RNA, 20 nt, Human herpesvirus 4 [Epstein-Barr virus]
agcaacccccggcucucagg

SEQ ID NO: 3971856 - RNA, 16 nt, Human herpesvirus 4 [Epstein-Barr virus]
agcaccggagccacca

SEQ ID NO: 3971857 - RNA, 14 nt, Human herpesvirus 4 [Epstein-Barr virus]
agcacuuugaaaga

SEQ ID NO: 3971858 - RNA, 16 nt, Human herpesvirus 4 [Epstein-Barr virus]
agcagaugugcccaag

SEQ ID NO: 3971859 - RNA, 14 nt, Human herpesvirus 4 [Epstein-Barr virus]
agcagcagcccggc

SEQ ID NO: 3971860 - RNA, 20 nt, Human herpesvirus 4 [Epstein-Barr virus]
agcagcccggccgaggccug

SEQ ID NO: 3971861 - RNA, 16 nt, Human herpesvirus 4 [Epstein-Barr virus]
agcagcgcggcagagg

SEQ ID NO: 3971862 - RNA, 22 nt, Human herpesvirus 4 [Epstein-Barr virus]
agcaguagcuugggaacaccgg

SEQ ID NO: 3971863 - RNA, 15 nt, Human herpesvirus 4 [Epstein-Barr virus]
agcauaugccggugg

SEQ ID NO: 3971864 - RNA, 14 nt, Human herpesvirus 4 [Epstein-Barr virus]
agccaccccagaca

SEQ ID NO: 3971865 - RNA, 21 nt, Human herpesvirus 4 [Epstein-Barr virus]
agcccaagaagaagcccaccu

SEQ ID NO: 3971866 - RNA, 16 nt, Human herpesvirus 4 [Epstein-Barr virus]
agccccagccccuccu

SEQ ID NO: 3971867 - RNA, 17 nt, Human herpesvirus 4 [Epstein-Barr virus]
agccccuaggccugcca

SEQ ID NO: 3971868 - RNA, 22 nt, Human herpesvirus 4 [Epstein-Barr virus]
agccccuuuugccccccuggcg

SEQ ID NO: 3971869 - RNA, 16 nt, Human herpesvirus 4 [Epstein-Barr virus]
agcccgccagccaccc

SEQ ID NO: 3971870 - RNA, 22 nt, Human herpesvirus 4 [Epstein-Barr virus]
agcccuucuucguuaugcacuc

SEQ ID NO: 3971871 - RNA, 14 nt, Human herpesvirus 4 [Epstein-Barr virus]
agccggggguugcu

SEQ ID NO: 3971872 - RNA, 16 nt, Human herpesvirus 4 [Epstein-Barr virus]
agccuacccaugacca

SEQ ID NO: 3971873 - RNA, 14 nt, Human herpesvirus 4 [Epstein-Barr virus]
agccuccgggccgc

SEQ ID NO: 3971874 - RNA, 17 nt, Human herpesvirus 4 [Epstein-Barr virus]
agccugacucucaugua

SEQ ID NO: 3971875 - RNA, 23 nt, Human herpesvirus 4 [Epstein-Barr virus]
agccuguucauagagaaagggaa

SEQ ID NO: 3971876 - RNA, 21 nt, Human herpesvirus 4 [Epstein-Barr virus]
agccuugcguggugcuguccu

SEQ ID NO: 3971877 - RNA, 17 nt, Human herpesvirus 4 [Epstein-Barr virus]
agcgaagaacacuccac

SEQ ID NO: 3971878 - RNA, 17 nt, Human herpesvirus 4 [Epstein-Barr virus]
agcgccuccucgcaggc

SEQ ID NO: 3971879 - RNA, 17 nt, Human herpesvirus 4 [Epstein-Barr virus]
agcgcggcagaggccuc

SEQ ID NO: 3971880 - RNA, 15 nt, Human herpesvirus 4 [Epstein-Barr virus]
agcggggcugggugg

SEQ ID NO: 3971881 - RNA, 18 nt, Human herpesvirus 4 [Epstein-Barr virus]
agcucaaccgccagggcg

SEQ ID NO: 3971882 - RNA, 16 nt, Human herpesvirus 4 [Epstein-Barr virus]
agcuccgccaccuccg

SEQ ID NO: 3971883 - RNA, 14 nt, Human herpesvirus 4 [Epstein-Barr virus]
agcuccgugggccc

SEQ ID NO: 3971884 - RNA, 14 nt, Human herpesvirus 4 [Epstein-Barr virus]
agcuccuugugcag

SEQ ID NO: 3971885 - RNA, 20 nt, Human herpesvirus 4 [Epstein-Barr virus]
agcuggaggccauccuccuu

SEQ ID NO: 3971886 - RNA, 20 nt, Human herpesvirus 4 [Epstein-Barr virus]
agcuuaaagagacucaggcc

SEQ ID NO: 3971887 - RNA, 12 nt, Human herpesvirus 4 [Epstein-Barr virus]
agcuucaaguua

SEQ ID NO: 3971888 - RNA, 18 nt, Human herpesvirus 4 [Epstein-Barr virus]
agcuuugaugaggcugaa

SEQ ID NO: 3971889 - RNA, 21 nt, Human herpesvirus 4 [Epstein-Barr virus]
aggaagaguaccccagugacg

SEQ ID NO: 3971890 - RNA, 15 nt, Human herpesvirus 4 [Epstein-Barr virus]
aggaaggggccucgg

SEQ ID NO: 3971891 - RNA, 18 nt, Human herpesvirus 4 [Epstein-Barr virus]
aggacauguuugggggag

SEQ ID NO: 3971892 - RNA, 16 nt, Human herpesvirus 4 [Epstein-Barr virus]
aggacccauauugggg

SEQ ID NO: 3971893 - RNA, 19 nt, Human herpesvirus 4 [Epstein-Barr virus]
aggacccccgcgucacugu

SEQ ID NO: 3971894 - RNA, 13 nt, Human herpesvirus 4 [Epstein-Barr virus]
aggacccugggcc

SEQ ID NO: 3971895 - RNA, 13 nt, Human herpesvirus 4 [Epstein-Barr virus]
aggacgcuguccg

SEQ ID NO: 3971896 - RNA, 16 nt, Human herpesvirus 4 [Epstein-Barr virus]
aggagaauagagggga

SEQ ID NO: 3971897 - RNA, 18 nt, Human herpesvirus 4 [Epstein-Barr virus]
aggagacacggcucuguc

SEQ ID NO: 3971898 - RNA, 16 nt, Human herpesvirus 4 [Epstein-Barr virus]
aggagauccgccagga

SEQ ID NO: 3971899 - RNA, 12 nt, Human herpesvirus 4 [Epstein-Barr virus]
aggagcaggagc

SEQ ID NO: 3971900 - RNA, 21 nt, Human herpesvirus 4 [Epstein-Barr virus]
aggagcaggagcgggaggggc

SEQ ID NO: 3971901 - RNA, 18 nt, Human herpesvirus 4 [Epstein-Barr virus]
aggagcuccgagagcucc

SEQ ID NO: 3971902 - RNA, 19 nt, Human herpesvirus 4 [Epstein-Barr virus]
aggaggauggccuccagcu

SEQ ID NO: 3971903 - RNA, 15 nt, Human herpesvirus 4 [Epstein-Barr virus]
aggaggggcaggagc

SEQ ID NO: 3971904 - RNA, 16 nt, Human herpesvirus 4 [Epstein-Barr virus]
aggaggggcaggaggg

SEQ ID NO: 3971905 - RNA, 19 nt, Human herpesvirus 4 [Epstein-Barr virus]
aggagugccucugggugcu

SEQ ID NO: 3971906 - RNA, 20 nt, Human herpesvirus 4 [Epstein-Barr virus]
aggagugccucugggugcug

SEQ ID NO: 3971907 - RNA, 18 nt, Human herpesvirus 4 [Epstein-Barr virus]
aggaugagaccaguggca

SEQ ID NO: 3971908 - RNA, 13 nt, Human herpesvirus 4 [Epstein-Barr virus]
aggaugaggcuga

SEQ ID NO: 3971909 - RNA, 20 nt, Human herpesvirus 4 [Epstein-Barr virus]
aggauggaagagaggggcag

SEQ ID NO: 3971910 - RNA, 17 nt, Human herpesvirus 4 [Epstein-Barr virus]
aggcauuaccaugucau

SEQ ID NO: 3971911 - RNA, 23 nt, Human herpesvirus 4 [Epstein-Barr virus]
aggcauuuuuggugcugccuggg

SEQ ID NO: 3971912 - RNA, 16 nt, Human herpesvirus 4 [Epstein-Barr virus]
aggccaauuggcacuc

SEQ ID NO: 3971913 - RNA, 17 nt, Human herpesvirus 4 [Epstein-Barr virus]
aggccagguagcccagc

SEQ ID NO: 3971914 - RNA, 16 nt, Human herpesvirus 4 [Epstein-Barr virus]
aggcccaacagcaccg

SEQ ID NO: 3971915 - RNA, 13 nt, Human herpesvirus 4 [Epstein-Barr virus]
aggcccaggaccu

SEQ ID NO: 3971916 - RNA, 21 nt, Human herpesvirus 4 [Epstein-Barr virus]
aggcccccgggugggcugguu

SEQ ID NO: 3971917 - RNA, 23 nt, Human herpesvirus 4 [Epstein-Barr virus]
aggcccuaauucagccaccuccc

SEQ ID NO: 3971918 - RNA, 15 nt, Human herpesvirus 4 [Epstein-Barr virus]
aggccgcugccaggc

SEQ ID NO: 3971919 - RNA, 16 nt, Human herpesvirus 4 [Epstein-Barr virus]
aggccggcugacaugg

SEQ ID NO: 3971920 - RNA, 23 nt, Human herpesvirus 4 [Epstein-Barr virus]
aggccucucucgaguucucuagc

SEQ ID NO: 3971921 - RNA, 14 nt, Human herpesvirus 4 [Epstein-Barr virus]
uccgugggcccaga

SEQ ID NO: 3971922 - RNA, 17 nt, Human herpesvirus 4 [Epstein-Barr virus]
uccuacaacucagcccc

SEQ ID NO: 3971923 - RNA, 17 nt, Human herpesvirus 4 [Epstein-Barr virus]
uccuagaaacugugcca

SEQ ID NO: 3971924 - RNA, 19 nt, Human herpesvirus 4 [Epstein-Barr virus]
uccuaggcacggccucgug

SEQ ID NO: 3971925 - RNA, 14 nt, Human herpesvirus 4 [Epstein-Barr virus]
uccucaaggauggc

SEQ ID NO: 3971926 - RNA, 14 nt, Human herpesvirus 4 [Epstein-Barr virus]
uccuccuguuucug

SEQ ID NO: 3971927 - RNA, 20 nt, Human herpesvirus 4 [Epstein-Barr virus]
uccucguuaguccaagagaa

SEQ ID NO: 3971928 - RNA, 17 nt, Human herpesvirus 4 [Epstein-Barr virus]
uccucugccuggccggc

SEQ ID NO: 3971929 - RNA, 20 nt, Human herpesvirus 4 [Epstein-Barr virus]
uccucuuacaccagaggcca

SEQ ID NO: 3971930 - RNA, 16 nt, Human herpesvirus 4 [Epstein-Barr virus]
uccugcacuauauucu

SEQ ID NO: 3971931 - RNA, 21 nt, Human herpesvirus 4 [Epstein-Barr virus]
uccugcaggggguucuugcua

SEQ ID NO: 3971932 - RNA, 23 nt, Human herpesvirus 4 [Epstein-Barr virus]
uccugugugaccccucacuuugu

SEQ ID NO: 3971933 - RNA, 14 nt, Human herpesvirus 4 [Epstein-Barr virus]
uccuugucugcugc

SEQ ID NO: 3971934 - RNA, 14 nt, Human herpesvirus 4 [Epstein-Barr virus]
ucgacgcuguuuug

SEQ ID NO: 3971935 - RNA, 18 nt, Human herpesvirus 4 [Epstein-Barr virus]
ucgacuuuaugccccccg

SEQ ID NO: 3971936 - RNA, 15 nt, Human herpesvirus 4 [Epstein-Barr virus]
ucgcaacacuguaua

SEQ ID NO: 3971937 - RNA, 19 nt, Human herpesvirus 4 [Epstein-Barr virus]
ucgcuggcauacucuucau

SEQ ID NO: 3971938 - RNA, 14 nt, Human herpesvirus 4 [Epstein-Barr virus]
ucguccgccuacug

SEQ ID NO: 3971939 - RNA, 22 nt, Human herpesvirus 4 [Epstein-Barr virus]
ucgucguucaggaacagccucc

SEQ ID NO: 3971940 - RNA, 17 nt, Human herpesvirus 4 [Epstein-Barr virus]
ucgugcuaagcguccug

SEQ ID NO: 3971941 - RNA, 19 nt, Human herpesvirus 4 [Epstein-Barr virus]
ucgugcucuucauguccac

SEQ ID NO: 3971942 - RNA, 14 nt, Human herpesvirus 4 [Epstein-Barr virus]
ucguucaggaacag

SEQ ID NO: 3971943 - RNA, 12 nt, Human herpesvirus 4 [Epstein-Barr virus]
ucuaaugauguc

SEQ ID NO: 3971944 - RNA, 16 nt, Human herpesvirus 4 [Epstein-Barr virus]
ucuacaaugccagggg

SEQ ID NO: 3971945 - RNA, 16 nt, Human herpesvirus 4 [Epstein-Barr virus]
ucuacucgaccagcac

SEQ ID NO: 3971946 - RNA, 20 nt, Human herpesvirus 4 [Epstein-Barr virus]
ucucaggccucccagucuau

SEQ ID NO: 3971947 - RNA, 15 nt, Human herpesvirus 4 [Epstein-Barr virus]
ucuccaccuguguaa

SEQ ID NO: 3971948 - RNA, 18 nt, Human herpesvirus 4 [Epstein-Barr virus]
ucucccacccuguacacc

SEQ ID NO: 3971949 - RNA, 21 nt, Human herpesvirus 4 [Epstein-Barr virus]
ucucggcacccaggcagccuu

SEQ ID NO: 3971950 - RNA, 23 nt, Human herpesvirus 4 [Epstein-Barr virus]
ucucuaaucccucugggagaagg

SEQ ID NO: 3971951 - RNA, 21 nt, Human herpesvirus 4 [Epstein-Barr virus]
ucucucccccgggcgcugccu

SEQ ID NO: 3971952 - RNA, 12 nt, Human herpesvirus 4 [Epstein-Barr virus]
ucucuggcugug

SEQ ID NO: 3971953 - RNA, 17 nt, Human herpesvirus 4 [Epstein-Barr virus]
ucucuggcugugcugac

SEQ ID NO: 3971954 - RNA, 18 nt, Human herpesvirus 4 [Epstein-Barr virus]
ucugaaaacugccuccuc

SEQ ID NO: 3971955 - RNA, 14 nt, Human herpesvirus 4 [Epstein-Barr virus]
ucugaggcggcugu

SEQ ID NO: 3971956 - RNA, 19 nt, Human herpesvirus 4 [Epstein-Barr virus]
gaauaaggcucugaagcaa

SEQ ID NO: 3971957 - RNA, 23 nt, Human herpesvirus 4 [Epstein-Barr virus]
gaaucaugucugacgaggggcca

SEQ ID NO: 3971958 - RNA, 15 nt, Human herpesvirus 4 [Epstein-Barr virus]
gaaucucugccaacu

SEQ ID NO: 3971959 - RNA, 19 nt, Human herpesvirus 4 [Epstein-Barr virus]
gaaugccaagagccccucc

SEQ ID NO: 3971960 - RNA, 13 nt, Human herpesvirus 4 [Epstein-Barr virus]
gaauuauuuacca

SEQ ID NO: 3971961 - RNA, 19 nt, Human herpesvirus 4 [Epstein-Barr virus]
gacaaaauggggucugugg

SEQ ID NO: 3971962 - RNA, 23 nt, Human herpesvirus 4 [Epstein-Barr virus]
gacaaaauggggucuguggcagu

SEQ ID NO: 3971963 - RNA, 23 nt, Human herpesvirus 4 [Epstein-Barr virus]
gacacaccgccaacgcucagugc

SEQ ID NO: 3971964 - RNA, 17 nt, Human herpesvirus 4 [Epstein-Barr virus]
gacacagacuuggccuu

SEQ ID NO: 3971965 - RNA, 20 nt, Human herpesvirus 4 [Epstein-Barr virus]
gacacccacggaagcccucu

SEQ ID NO: 3971966 - RNA, 21 nt, Human herpesvirus 4 [Epstein-Barr virus]
gacaggcacaacggcugugac

SEQ ID NO: 3971967 - RNA, 19 nt, Human herpesvirus 4 [Epstein-Barr virus]
gacaugcugaugugcugcc

SEQ ID NO: 3971968 - RNA, 22 nt, Human herpesvirus 4 [Epstein-Barr virus]
gacauuucucauaauggugccu

SEQ ID NO: 3971969 - RNA, 16 nt, Human herpesvirus 4 [Epstein-Barr virus]
gaccaauacccaggau

SEQ ID NO: 3971970 - RNA, 16 nt, Human herpesvirus 4 [Epstein-Barr virus]
gaccaaugccaaagcu

SEQ ID NO: 3971971 - RNA, 14 nt, Human herpesvirus 4 [Epstein-Barr virus]
gaccacucaggaag

SEQ ID NO: 3971972 - RNA, 18 nt, Human herpesvirus 4 [Epstein-Barr virus]
gaccaucacauggggcau

SEQ ID NO: 3971973 - RNA, 18 nt, Human herpesvirus 4 [Epstein-Barr virus]
gacccaaagugagggggc

SEQ ID NO: 3971974 - RNA, 18 nt, Human herpesvirus 4 [Epstein-Barr virus]
gacccccgggcgccccca

SEQ ID NO: 3971975 - RNA, 21 nt, Human herpesvirus 4 [Epstein-Barr virus]
gacccuccugucaccaccucc

SEQ ID NO: 3971976 - RNA, 20 nt, Human herpesvirus 4 [Epstein-Barr virus]
gacccuucugcugcugcugg

SEQ ID NO: 3971977 - RNA, 13 nt, Human herpesvirus 4 [Epstein-Barr virus]
gaccgcccaccga

SEQ ID NO: 3971978 - RNA, 21 nt, Human herpesvirus 4 [Epstein-Barr virus]
gaccggaucgaaggagagcug

SEQ ID NO: 3971979 - RNA, 14 nt, Human herpesvirus 4 [Epstein-Barr virus]
gaccgugccauccu

SEQ ID NO: 3971980 - RNA, 15 nt, Human herpesvirus 4 [Epstein-Barr virus]
gaccuacgcugcccu

SEQ ID NO: 3971981 - RNA, 14 nt, Human herpesvirus 4 [Epstein-Barr virus]
gaccucuacacgcu

SEQ ID NO: 3971982 - RNA, 11 nt, Human herpesvirus 4 [Epstein-Barr virus]
gaccuggaaau

SEQ ID NO: 3971983 - RNA, 13 nt, Human herpesvirus 4 [Epstein-Barr virus]
gaccugugucugu

SEQ ID NO: 3971984 - RNA, 15 nt, Human herpesvirus 4 [Epstein-Barr virus]
gaccuguugcuucag

SEQ ID NO: 3971985 - RNA, 13 nt, Human herpesvirus 4 [Epstein-Barr virus]
gacgaggaggaag

SEQ ID NO: 3971986 - RNA, 15 nt, Human herpesvirus 4 [Epstein-Barr virus]
gacgcggugcugacc

SEQ ID NO: 3971987 - RNA, 18 nt, Human herpesvirus 4 [Epstein-Barr virus]
gacgcuguccgccaggac

SEQ ID NO: 3971988 - RNA, 21 nt, Human herpesvirus 4 [Epstein-Barr virus]
gacgggcaucuuaucagagag

SEQ ID NO: 3971989 - RNA, 23 nt, Human herpesvirus 4 [Epstein-Barr virus]
gacgggcaucuuaucagagaggc

SEQ ID NO: 3971990 - RNA, 17 nt, Human herpesvirus 4 [Epstein-Barr virus]
gacggugggcaugacac

SEQ ID NO: 3971991 - RNA, 12 nt, Human herpesvirus 4 [Epstein-Barr virus]
gacggugucugu

SEQ ID NO: 3971992 - RNA, 20 nt, Human herpesvirus 4 [Epstein-Barr virus]
gacucccauguaagccugcc

SEQ ID NO: 3971993 - RNA, 22 nt, Human herpesvirus 4 [Epstein-Barr virus]
gacucccauguaagccugccuc

SEQ ID NO: 3971994 - RNA, 15 nt, Human herpesvirus 4 [Epstein-Barr virus]
gacuggcggcacugu

SEQ ID NO: 3971995 - RNA, 17 nt, Human herpesvirus 4 [Epstein-Barr virus]
gagaaugacagcaagga

SEQ ID NO: 3971996 - RNA, 19 nt, Human herpesvirus 4 [Epstein-Barr virus]
gagacacaucuggaccaga

SEQ ID NO: 3971997 - RNA, 22 nt, Human herpesvirus 4 [Epstein-Barr virus]
gagacguguguggcuguagcca

SEQ ID NO: 3971998 - RNA, 17 nt, Human herpesvirus 4 [Epstein-Barr virus]
gagacuggcaacuccuc

SEQ ID NO: 3971999 - RNA, 21 nt, Human herpesvirus 4 [Epstein-Barr virus]
gagaucucuugcgcccaggca

SEQ ID NO: 3972000 - RNA, 19 nt, Human herpesvirus 4 [Epstein-Barr virus]
gagcagagguugggccacg

SEQ ID NO: 3972001 - RNA, 20 nt, Human herpesvirus 4 [Epstein-Barr virus]
gagcaggagcgggaggggca

SEQ ID NO: 3972002 - RNA, 22 nt, Human herpesvirus 4 [Epstein-Barr virus]
gagcaggagcgggaggggcagg

SEQ ID NO: 3972003 - RNA, 17 nt, Human herpesvirus 4 [Epstein-Barr virus]
gagcaggaggaggggca

SEQ ID NO: 3972004 - RNA, 16 nt, Human herpesvirus 4 [Epstein-Barr virus]
gagcaggaggggcagg

SEQ ID NO: 3972005 - RNA, 15 nt, Human herpesvirus 4 [Epstein-Barr virus]
gagccggcggccucg

SEQ ID NO: 3972006 - RNA, 19 nt, Human herpesvirus 4 [Epstein-Barr virus]
gagccggggguugcuucau

SEQ ID NO: 3972007 - RNA, 18 nt, Human herpesvirus 4 [Epstein-Barr virus]
gagccugagccacaccca

SEQ ID NO: 3972008 - RNA, 22 nt, Human herpesvirus 4 [Epstein-Barr virus]
gagccugccggaguuuucuccc

SEQ ID NO: 3972009 - RNA, 16 nt, Human herpesvirus 4 [Epstein-Barr virus]
gagcgcacgugacaga

SEQ ID NO: 3972010 - RNA, 13 nt, Human herpesvirus 4 [Epstein-Barr virus]
gagcggcaagggc

SEQ ID NO: 3972011 - RNA, 16 nt, Human herpesvirus 4 [Epstein-Barr virus]
gagcgggaggggcagg

SEQ ID NO: 3972012 - RNA, 22 nt, Human herpesvirus 4 [Epstein-Barr virus]
gagcggggagauaauguacaga

SEQ ID NO: 3972013 - RNA, 20 nt, Human herpesvirus 4 [Epstein-Barr virus]
gagcuccgagagcuccgcca

SEQ ID NO: 3972014 - RNA, 15 nt, Human herpesvirus 4 [Epstein-Barr virus]
gugaguccagggccc

SEQ ID NO: 3972015 - RNA, 17 nt, Human herpesvirus 4 [Epstein-Barr virus]
gugaugcuugugcuccu

SEQ ID NO: 3972016 - RNA, 14 nt, Human herpesvirus 4 [Epstein-Barr virus]
gugauuaggagcag

SEQ ID NO: 3972017 - RNA, 17 nt, Human herpesvirus 4 [Epstein-Barr virus]
gugcaaggauggaagag

SEQ ID NO: 3972018 - RNA, 15 nt, Human herpesvirus 4 [Epstein-Barr virus]
gugcacccggcugga

SEQ ID NO: 3972019 - RNA, 13 nt, Human herpesvirus 4 [Epstein-Barr virus]
gugcagcuucucc

SEQ ID NO: 3972020 - RNA, 14 nt, Human herpesvirus 4 [Epstein-Barr virus]
gugccauggugcca

SEQ ID NO: 3972021 - RNA, 13 nt, Human herpesvirus 4 [Epstein-Barr virus]
gugcccaagccug

SEQ ID NO: 3972022 - RNA, 17 nt, Human herpesvirus 4 [Epstein-Barr virus]
gugcccaccagagggug

SEQ ID NO: 3972023 - RNA, 12 nt, Human herpesvirus 4 [Epstein-Barr virus]
gugcccagggca

SEQ ID NO: 3972024 - RNA, 15 nt, Human herpesvirus 4 [Epstein-Barr virus]
gugccucagauagcc

SEQ ID NO: 3972025 - RNA, 16 nt, Human herpesvirus 4 [Epstein-Barr virus]
gugccucgguggccug

SEQ ID NO: 3972026 - RNA, 19 nt, Human herpesvirus 4 [Epstein-Barr virus]
gugcgguuauaacugccag

SEQ ID NO: 3972027 - RNA, 16 nt, Human herpesvirus 4 [Epstein-Barr virus]
guggacucggccacac

SEQ ID NO: 3972028 - RNA, 18 nt, Human herpesvirus 4 [Epstein-Barr virus]
guggauggggucauuuau

SEQ ID NO: 3972029 - RNA, 20 nt, Human herpesvirus 4 [Epstein-Barr virus]
guggcacacauuacggugcu

SEQ ID NO: 3972030 - RNA, 13 nt, Human herpesvirus 4 [Epstein-Barr virus]
guggccaggcccg

SEQ ID NO: 3972031 - RNA, 21 nt, Human herpesvirus 4 [Epstein-Barr virus]
guggccggugcugccagagcc

SEQ ID NO: 3972032 - RNA, 13 nt, Human herpesvirus 4 [Epstein-Barr virus]
gugggguggugua

SEQ ID NO: 3972033 - RNA, 14 nt, Human herpesvirus 4 [Epstein-Barr virus]
guggucgugcugcu

SEQ ID NO: 3972034 - RNA, 23 nt, Human herpesvirus 4 [Epstein-Barr virus]
gugguuuccaugacgcugcugcu

SEQ ID NO: 3972035 - RNA, 21 nt, Human herpesvirus 4 [Epstein-Barr virus]
gugucugugguugucuuccca

SEQ ID NO: 3972036 - RNA, 23 nt, Human herpesvirus 4 [Epstein-Barr virus]
gugugaagauugucacagcugcu

SEQ ID NO: 3972037 - RNA, 16 nt, Human herpesvirus 4 [Epstein-Barr virus]
gugugaagggcagggc

SEQ ID NO: 3972038 - RNA, 17 nt, Human herpesvirus 4 [Epstein-Barr virus]
gugugcucuuucuucau

SEQ ID NO: 3972039 - RNA, 23 nt, Human herpesvirus 4 [Epstein-Barr virus]
guuaugcacucugaccaggacau

SEQ ID NO: 3972040 - RNA, 15 nt, Human herpesvirus 4 [Epstein-Barr virus]
guuauugaaaccacg

SEQ ID NO: 3972041 - RNA, 21 nt, Human herpesvirus 4 [Epstein-Barr virus]
guucaaaccggaggaugcccc

SEQ ID NO: 3972042 - RNA, 15 nt, Human herpesvirus 4 [Epstein-Barr virus]
guuccaggcucucca

SEQ ID NO: 3972043 - RNA, 23 nt, Human herpesvirus 4 [Epstein-Barr virus]
guuccccccagccugaggaacau

SEQ ID NO: 3972044 - RNA, 16 nt, Human herpesvirus 4 [Epstein-Barr virus]
guucccuaagcagcug

SEQ ID NO: 3972045 - RNA, 19 nt, Human herpesvirus 4 [Epstein-Barr virus]
guugccgugguugggcaga

SEQ ID NO: 3972046 - RNA, 13 nt, Human herpesvirus 4 [Epstein-Barr virus]
guugggguccuca

SEQ ID NO: 3972047 - RNA, 17 nt, Human herpesvirus 4 [Epstein-Barr virus]
guugggguccucaagga

SEQ ID NO: 3972048 - RNA, 23 nt, Human herpesvirus 4 [Epstein-Barr virus]
guugucacgucacucagcuccgc

SEQ ID NO: 3972049 - RNA, 19 nt, Human herpesvirus 4 [Epstein-Barr virus]
guuugagaaucugggcugg

SEQ ID NO: 3972050 - RNA, 18 nt, Human herpesvirus 4 [Epstein-Barr virus]
guuuguacuucuucucug

SEQ ID NO: 3972051 - RNA, 18 nt, Human herpesvirus 4 [Epstein-Barr virus]
guuuguccagcagggccu

SEQ ID NO: 3972052 - RNA, 14 nt, Human herpesvirus 4 [Epstein-Barr virus]
uaaaauucuggauc

SEQ ID NO: 3972053 - RNA, 15 nt, Human herpesvirus 4 [Epstein-Barr virus]
uaaaccuucugucug

SEQ ID NO: 3972054 - RNA, 20 nt, Human herpesvirus 4 [Epstein-Barr virus]
uaaauucuccugccugccuc

SEQ ID NO: 3972055 - RNA, 16 nt, Human herpesvirus 4 [Epstein-Barr virus]
uaacacgaaugcccag

SEQ ID NO: 3972056 - RNA, 22 nt, Human herpesvirus 4 [Epstein-Barr virus]
uaacacuacuuguuucuggaau

SEQ ID NO: 3972057 - RNA, 24 nt, Human herpesvirus 4 [Epstein-Barr virus]
uaauacgcccgacaauaaaguuga

SEQ ID NO: 3972058 - RNA, 12 nt, Human herpesvirus 4 [Epstein-Barr virus]
uacaaccaagcc

SEQ ID NO: 3972059 - RNA, 14 nt, Human herpesvirus 4 [Epstein-Barr virus]
uacaccuggcugua

SEQ ID NO: 3972060 - RNA, 20 nt, Human herpesvirus 4 [Epstein-Barr virus]
cacgcuuuugucugccugga

SEQ ID NO: 3972061 - RNA, 22 nt, Human herpesvirus 4 [Epstein-Barr virus]
cacggagcagggcaacauugca

SEQ ID NO: 3972062 - RNA, 20 nt, Human herpesvirus 4 [Epstein-Barr virus]
cacggcgucaaacaggugag

SEQ ID NO: 3972063 - RNA, 19 nt, Human herpesvirus 4 [Epstein-Barr virus]
cacggcgugccagaggccc

SEQ ID NO: 3972064 - RNA, 16 nt, Human herpesvirus 4 [Epstein-Barr virus]
cacggucauucugccg

SEQ ID NO: 3972065 - RNA, 14 nt, Human herpesvirus 4 [Epstein-Barr virus]
cacgucgucagaga

SEQ ID NO: 3972066 - RNA, 21 nt, Human herpesvirus 4 [Epstein-Barr virus]
cacgucguucaugagaggcgu

SEQ ID NO: 3972067 - RNA, 16 nt, Human herpesvirus 4 [Epstein-Barr virus]
cacucacccccgagga

SEQ ID NO: 3972068 - RNA, 17 nt, Human herpesvirus 4 [Epstein-Barr virus]
cacucccuuagccacac

SEQ ID NO: 3972069 - RNA, 22 nt, Human herpesvirus 4 [Epstein-Barr virus]
cacugaauuuauacccagugag

SEQ ID NO: 3972070 - RNA, 21 nt, Human herpesvirus 4 [Epstein-Barr virus]
cacugaccugguuaacagacu

SEQ ID NO: 3972071 - RNA, 18 nt, Human herpesvirus 4 [Epstein-Barr virus]
cacugauaauacgcccga

SEQ ID NO: 3972072 - RNA, 17 nt, Human herpesvirus 4 [Epstein-Barr virus]
cacuggcuuaugcgugg

SEQ ID NO: 3972073 - RNA, 18 nt, Human herpesvirus 4 [Epstein-Barr virus]
cacuguugcgcccggccc

SEQ ID NO: 3972074 - RNA, 21 nt, Human herpesvirus 4 [Epstein-Barr virus]
cacuuuguacagacuuuuggc

SEQ ID NO: 3972075 - RNA, 15 nt, Human herpesvirus 4 [Epstein-Barr virus]
cagaaaaucgcagca

SEQ ID NO: 3972076 - RNA, 16 nt, Human herpesvirus 4 [Epstein-Barr virus]
cagaacaucacugcca

SEQ ID NO: 3972077 - RNA, 12 nt, Human herpesvirus 4 [Epstein-Barr virus]
cagaagccccca

SEQ ID NO: 3972078 - RNA, 17 nt, Human herpesvirus 4 [Epstein-Barr virus]
cagacaugguguagaca

SEQ ID NO: 3972079 - RNA, 21 nt, Human herpesvirus 4 [Epstein-Barr virus]
cagaccagccccucaucccug

SEQ ID NO: 3972080 - RNA, 23 nt, Human herpesvirus 4 [Epstein-Barr virus]
cagaccccggguugguggcacug

SEQ ID NO: 3972081 - RNA, 17 nt, Human herpesvirus 4 [Epstein-Barr virus]
cagaccugaucagggaa

SEQ ID NO: 3972082 - RNA, 22 nt, Human herpesvirus 4 [Epstein-Barr virus]
cagacgcgauggcacacgccag

SEQ ID NO: 3972083 - RNA, 18 nt, Human herpesvirus 4 [Epstein-Barr virus]
cagacuccggggguccag

SEQ ID NO: 3972084 - RNA, 16 nt, Human herpesvirus 4 [Epstein-Barr virus]
cagacucucuucagug

SEQ ID NO: 3972085 - RNA, 18 nt, Human herpesvirus 4 [Epstein-Barr virus]
cagagcaaaagcaauaaa

SEQ ID NO: 3972086 - RNA, 21 nt, Human herpesvirus 4 [Epstein-Barr virus]
cagagcccagaggaggccccg

SEQ ID NO: 3972087 - RNA, 23 nt, Human herpesvirus 4 [Epstein-Barr virus]
cagagcugagugcccagggcaga

SEQ ID NO: 3972088 - RNA, 17 nt, Human herpesvirus 4 [Epstein-Barr virus]
cagagcuguguuucccg

SEQ ID NO: 3972089 - RNA, 22 nt, Human herpesvirus 4 [Epstein-Barr virus]
cagaggaggacaugugcauggc

SEQ ID NO: 3972090 - RNA, 13 nt, Human herpesvirus 4 [Epstein-Barr virus]
cagagggugagcc

SEQ ID NO: 3972091 - RNA, 20 nt, Human herpesvirus 4 [Epstein-Barr virus]
cagauagccggccaggcaga

SEQ ID NO: 3972092 - RNA, 20 nt, Human herpesvirus 4 [Epstein-Barr virus]
cagauagugaacguggaggu

SEQ ID NO: 3972093 - RNA, 12 nt, Human herpesvirus 4 [Epstein-Barr virus]
cagaugugccug

SEQ ID NO: 3972094 - RNA, 13 nt, Human herpesvirus 4 [Epstein-Barr virus]
cagauugccuucu

SEQ ID NO: 3972095 - RNA, 21 nt, Human herpesvirus 4 [Epstein-Barr virus]
cagauuucuaguuaccacagg

SEQ ID NO: 3972096 - RNA, 17 nt, Human herpesvirus 4 [Epstein-Barr virus]
cagcaacgcccagggac

SEQ ID NO: 3972097 - RNA, 15 nt, Human herpesvirus 4 [Epstein-Barr virus]
cagcagcagcagugg

SEQ ID NO: 3972098 - RNA, 21 nt, Human herpesvirus 4 [Epstein-Barr virus]
cagcagcagcccggccgaggc

SEQ ID NO: 3972099 - RNA, 11 nt, Human herpesvirus 4 [Epstein-Barr virus]
cagccauggcc

SEQ ID NO: 3972100 - RNA, 16 nt, Human herpesvirus 4 [Epstein-Barr virus]
cagcccggccgaggcc

SEQ ID NO: 3972101 - RNA, 16 nt, Human herpesvirus 4 [Epstein-Barr virus]
cagccgcggccaucac

SEQ ID NO: 3972102 - RNA, 19 nt, Human herpesvirus 4 [Epstein-Barr virus]
cagccggguccgugcggcu

SEQ ID NO: 3972103 - RNA, 17 nt, Human herpesvirus 4 [Epstein-Barr virus]
cagccugcuccugagaa

SEQ ID NO: 3972104 - RNA, 22 nt, Human herpesvirus 4 [Epstein-Barr virus]
cagcgaagaacacuccacagau

SEQ ID NO: 3972105 - RNA, 23 nt, Human herpesvirus 4 [Epstein-Barr virus]
cagcgagagcgacgaggaugaag

SEQ ID NO: 3972106 - RNA, 18 nt, Human herpesvirus 4 [Epstein-Barr virus]
cagcgggggaccacauac

SEQ ID NO: 3972107 - RNA, 17 nt, Human herpesvirus 4 [Epstein-Barr virus]
cagcucaaccgccaggg

SEQ ID NO: 3972108 - RNA, 22 nt, Human herpesvirus 4 [Epstein-Barr virus]
cagcuccagggccagcaaaacc

SEQ ID NO: 3972109 - RNA, 15 nt, Human herpesvirus 4 [Epstein-Barr virus]
cagcucggccagcag

SEQ ID NO: 3972110 - RNA, 18 nt, Human herpesvirus 4 [Epstein-Barr virus]
cagcuggcggacuacaag

SEQ ID NO: 3972111 - RNA, 17 nt, Human herpesvirus 4 [Epstein-Barr virus]
caggaagcuggccaggc

SEQ ID NO: 3972112 - RNA, 10 nt, Human herpesvirus 4 [Epstein-Barr virus]
caggagcagg

SEQ ID NO: 3972113 - RNA, 19 nt, Human herpesvirus 4 [Epstein-Barr virus]
caggagcaggagcaggagc

SEQ ID NO: 3972114 - RNA, 22 nt, Human herpesvirus 4 [Epstein-Barr virus]
caggagcgggaggggcaggagc

SEQ ID NO: 3972115 - RNA, 21 nt, Human herpesvirus 4 [Epstein-Barr virus]
caggaggaggggcaggagcag

SEQ ID NO: 3972116 - RNA, 14 nt, Human herpesvirus 4 [Epstein-Barr virus]
caggaggggcagga

SEQ ID NO: 3972117 - RNA, 21 nt, Human herpesvirus 4 [Epstein-Barr virus]
caggauuucugcguccuggua

SEQ ID NO: 3972118 - RNA, 23 nt, Human herpesvirus 4 [Epstein-Barr virus]
caggcacccccucugaggaccug

SEQ ID NO: 3972119 - RNA, 20 nt, Human herpesvirus 4 [Epstein-Barr virus]
caggcauuuuuggugcugcc

SEQ ID NO: 3972120 - RNA, 20 nt, Human herpesvirus 4 [Epstein-Barr virus]
caggccccccgcaccagggc

SEQ ID NO: 3972121 - RNA, 15 nt, Human herpesvirus 4 [Epstein-Barr virus]
caggcggaggcacug

SEQ ID NO: 3972122 - RNA, 19 nt, Human herpesvirus 4 [Epstein-Barr virus]
caggcuacaacaggcugcu

SEQ ID NO: 3972123 - RNA, 15 nt, Human herpesvirus 4 [Epstein-Barr virus]
cagggacauccccag

SEQ ID NO: 3972124 - RNA, 20 nt, Human herpesvirus 4 [Epstein-Barr virus]
cagggcaacauugcagggcu

SEQ ID NO: 3972125 - RNA, 14 nt, Human herpesvirus 4 [Epstein-Barr virus]
cagggcagagaggc

SEQ ID NO: 3972126 - RNA, 16 nt, Human herpesvirus 4 [Epstein-Barr virus]
cagggcagagaggcgg

SEQ ID NO: 3972127 - RNA, 23 nt, Human herpesvirus 4 [Epstein-Barr virus]
cagggccaagacauagagauggu

SEQ ID NO: 3972128 - RNA, 18 nt, Human herpesvirus 4 [Epstein-Barr virus]
cagggccaggcgacgcuc

SEQ ID NO: 3972129 - RNA, 13 nt, Human herpesvirus 4 [Epstein-Barr virus]
cagggggccgggc

SEQ ID NO: 3972130 - RNA, 15 nt, Human herpesvirus 4 [Epstein-Barr virus]
caggucgaccaccuc

SEQ ID NO: 3972131 - RNA, 15 nt, Human herpesvirus 4 [Epstein-Barr virus]
cagguggcugcugcc

SEQ ID NO: 3972132 - RNA, 19 nt, Human herpesvirus 4 [Epstein-Barr virus]
caguacucggcuagccuga

SEQ ID NO: 3972133 - RNA, 14 nt, Human herpesvirus 4 [Epstein-Barr virus]
caguagaggacacc

SEQ ID NO: 3972134 - RNA, 22 nt, Human herpesvirus 4 [Epstein-Barr virus]
caguagcuugggaacaccgggc

SEQ ID NO: 3972135 - RNA, 20 nt, Human herpesvirus 4 [Epstein-Barr virus]
caguaugcucgaagcauugg

SEQ ID NO: 3972136 - RNA, 16 nt, Human herpesvirus 4 [Epstein-Barr virus]
cagucaccuuccagac

SEQ ID NO: 3972137 - RNA, 22 nt, Human herpesvirus 4 [Epstein-Barr virus]
caguccaggggccacacagccu

SEQ ID NO: 3972138 - RNA, 19 nt, Human herpesvirus 4 [Epstein-Barr virus]
caguccuugugucucuauc

SEQ ID NO: 3972139 - RNA, 18 nt, Human herpesvirus 4 [Epstein-Barr virus]
cagugaugaacaccacca

SEQ ID NO: 3972140 - RNA, 23 nt, Human herpesvirus 4 [Epstein-Barr virus]
cauaacgguggugggaggcccag

SEQ ID NO: 3972141 - RNA, 17 nt, Human herpesvirus 4 [Epstein-Barr virus]
cauaaguccucauggca

SEQ ID NO: 3972142 - RNA, 19 nt, Human herpesvirus 4 [Epstein-Barr virus]
cauaaguccucauggcagg

SEQ ID NO: 3972143 - RNA, 21 nt, Human herpesvirus 4 [Epstein-Barr virus]
cauauucuauuucaaaacaag

SEQ ID NO: 3972144 - RNA, 19 nt, Human herpesvirus 4 [Epstein-Barr virus]
aggcggaagaccaggagcc

SEQ ID NO: 3972145 - RNA, 12 nt, Human herpesvirus 4 [Epstein-Barr virus]
aggcggaggcac

SEQ ID NO: 3972146 - RNA, 21 nt, Human herpesvirus 4 [Epstein-Barr virus]
aggcuacaacaggcugcugaa

SEQ ID NO: 3972147 - RNA, 14 nt, Human herpesvirus 4 [Epstein-Barr virus]
ugccuccagagccc

SEQ ID NO: 3972148 - RNA, 14 nt, Human herpesvirus 4 [Epstein-Barr virus]
ugccucugggugcu

SEQ ID NO: 3972149 - RNA, 16 nt, Human herpesvirus 4 [Epstein-Barr virus]
ugccugccucugcucu

SEQ ID NO: 3972150 - RNA, 17 nt, Human herpesvirus 4 [Epstein-Barr virus]
ugccugccucugcucug

SEQ ID NO: 3972151 - RNA, 17 nt, Human herpesvirus 4 [Epstein-Barr virus]
ugccuggcgcuuugcua

SEQ ID NO: 3972152 - RNA, 18 nt, Human herpesvirus 4 [Epstein-Barr virus]
ugccuggcgcuuugcuau

SEQ ID NO: 3972153 - RNA, 19 nt, Human herpesvirus 4 [Epstein-Barr virus]
ugcgaaacuugggggcagg

SEQ ID NO: 3972154 - RNA, 22 nt, Human herpesvirus 4 [Epstein-Barr virus]
ugcgacggcuuuagccuggccu

SEQ ID NO: 3972155 - RNA, 22 nt, Human herpesvirus 4 [Epstein-Barr virus]
ugcucucagcacuuugccagca

SEQ ID NO: 3972156 - RNA, 15 nt, Human herpesvirus 4 [Epstein-Barr virus]
ugcucucgcacucuu

SEQ ID NO: 3972157 - RNA, 21 nt, Human herpesvirus 4 [Epstein-Barr virus]
ugcugaauauugccagcgccu

SEQ ID NO: 3972158 - RNA, 20 nt, Human herpesvirus 4 [Epstein-Barr virus]
ugcugaggcccguccccuga

SEQ ID NO: 3972159 - RNA, 13 nt, Human herpesvirus 4 [Epstein-Barr virus]
ugcugcagcacua

SEQ ID NO: 3972160 - RNA, 21 nt, Human herpesvirus 4 [Epstein-Barr virus]
ugcugcagguaaaccuucugu

SEQ ID NO: 3972161 - RNA, 21 nt, Human herpesvirus 4 [Epstein-Barr virus]
ugcugccagagccucugccac

SEQ ID NO: 3972162 - RNA, 19 nt, Human herpesvirus 4 [Epstein-Barr virus]
ugcugcuagccgcccuggc

SEQ ID NO: 3972163 - RNA, 16 nt, Human herpesvirus 4 [Epstein-Barr virus]
ugcugcuggucauggc

SEQ ID NO: 3972164 - RNA, 17 nt, Human herpesvirus 4 [Epstein-Barr virus]
ugcuggccgcagcuggc

SEQ ID NO: 3972165 - RNA, 20 nt, Human herpesvirus 4 [Epstein-Barr virus]
ugcuggucauggcggacugc

SEQ ID NO: 3972166 - RNA, 21 nt, Human herpesvirus 4 [Epstein-Barr virus]
ugcuucgcauuacaccauccc

SEQ ID NO: 3972167 - RNA, 21 nt, Human herpesvirus 4 [Epstein-Barr virus]
ugcuuuuaacucuuaaaacuu

SEQ ID NO: 3972168 - RNA, 18 nt, Human herpesvirus 4 [Epstein-Barr virus]
uggaagagaggggcaggg

SEQ ID NO: 3972169 - RNA, 24 nt, Human herpesvirus 4 [Epstein-Barr virus]
uggaccgaacugauggcaaagguc

SEQ ID NO: 3972170 - RNA, 13 nt, Human herpesvirus 4 [Epstein-Barr virus]
uggaucuggggcu

SEQ ID NO: 3972171 - RNA, 15 nt, Human herpesvirus 4 [Epstein-Barr virus]
uggaucuggggcugg

SEQ ID NO: 3972172 - RNA, 16 nt, Human herpesvirus 4 [Epstein-Barr virus]
uggaucuggggcuggc

SEQ ID NO: 3972173 - RNA, 17 nt, Human herpesvirus 4 [Epstein-Barr virus]
uggcacgacuguuccua

SEQ ID NO: 3972174 - RNA, 16 nt, Human herpesvirus 4 [Epstein-Barr virus]
uggcacgguccagaag

SEQ ID NO: 3972175 - RNA, 17 nt, Human herpesvirus 4 [Epstein-Barr virus]
uggcagaaaggcuggcc

SEQ ID NO: 3972176 - RNA, 20 nt, Human herpesvirus 4 [Epstein-Barr virus]
uggcagcagcucuggcacug

SEQ ID NO: 3972177 - RNA, 17 nt, Human herpesvirus 4 [Epstein-Barr virus]
uggcagcaguggccagc

SEQ ID NO: 3972178 - RNA, 13 nt, Human herpesvirus 4 [Epstein-Barr virus]
cuccagggccagc

SEQ ID NO: 3972179 - RNA, 22 nt, Human herpesvirus 4 [Epstein-Barr virus]
cucccagucuauccaggaggag

SEQ ID NO: 3972180 - RNA, 15 nt, Human herpesvirus 4 [Epstein-Barr virus]
cucccgcacccucaa

SEQ ID NO: 3972181 - RNA, 14 nt, Human herpesvirus 4 [Epstein-Barr virus]
cucccguacccacc

SEQ ID NO: 3972182 - RNA, 16 nt, Human herpesvirus 4 [Epstein-Barr virus]
cuccggcugcccgucu

SEQ ID NO: 3972183 - RNA, 12 nt, Human herpesvirus 4 [Epstein-Barr virus]
cuccucagccuc

SEQ ID NO: 3972184 - RNA, 16 nt, Human herpesvirus 4 [Epstein-Barr virus]
cuccugccugccucug

SEQ ID NO: 3972185 - RNA, 15 nt, Human herpesvirus 4 [Epstein-Barr virus]
cuccuuagacugagc

SEQ ID NO: 3972186 - RNA, 18 nt, Human herpesvirus 4 [Epstein-Barr virus]
cucgacgcgggcccgggu

SEQ ID NO: 3972187 - RNA, 18 nt, Human herpesvirus 4 [Epstein-Barr virus]
cucgcccacacagcgcca

SEQ ID NO: 3972188 - RNA, 22 nt, Human herpesvirus 4 [Epstein-Barr virus]
cucgccgcuaguugguccaggg

SEQ ID NO: 3972189 - RNA, 14 nt, Human herpesvirus 4 [Epstein-Barr virus]
cucggcacccaggc

SEQ ID NO: 3972190 - RNA, 16 nt, Human herpesvirus 4 [Epstein-Barr virus]
cucggggcuggggaga

SEQ ID NO: 3972191 - RNA, 17 nt, Human herpesvirus 4 [Epstein-Barr virus]
cucgguggugggcugcu

SEQ ID NO: 3972192 - RNA, 17 nt, Human herpesvirus 4 [Epstein-Barr virus]
cucguaaaaguccagcg

SEQ ID NO: 3972193 - RNA, 17 nt, Human herpesvirus 4 [Epstein-Barr virus]
cucgucguucaggaaca

SEQ ID NO: 3972194 - RNA, 23 nt, Human herpesvirus 4 [Epstein-Barr virus]
cucuaaaaaucaaaacuuuagag

SEQ ID NO: 3972195 - RNA, 20 nt, Human herpesvirus 4 [Epstein-Barr virus]
cucuaagacccgucgggcca

SEQ ID NO: 3972196 - RNA, 16 nt, Human herpesvirus 4 [Epstein-Barr virus]
cucuaccuuccacgac

SEQ ID NO: 3972197 - RNA, 15 nt, Human herpesvirus 4 [Epstein-Barr virus]
cucuaucaaggaaac

SEQ ID NO: 3972198 - RNA, 15 nt, Human herpesvirus 4 [Epstein-Barr virus]
cucuccagccacggc

SEQ ID NO: 3972199 - RNA, 12 nt, Human herpesvirus 4 [Epstein-Barr virus]
cucuccagcccc

SEQ ID NO: 3972200 - RNA, 17 nt, Human herpesvirus 4 [Epstein-Barr virus]
cucugauggccuggaga

SEQ ID NO: 3972201 - RNA, 21 nt, Human herpesvirus 4 [Epstein-Barr virus]
cucugcuuucgcgcagagccc

SEQ ID NO: 3972202 - RNA, 22 nt, Human herpesvirus 4 [Epstein-Barr virus]
cucuggcugugcugacccuucu

SEQ ID NO: 3972203 - RNA, 20 nt, Human herpesvirus 4 [Epstein-Barr virus]
cucuggggucucaggccucc

SEQ ID NO: 3972204 - RNA, 14 nt, Human herpesvirus 4 [Epstein-Barr virus]
cucugggugcugag

SEQ ID NO: 3972205 - RNA, 21 nt, Human herpesvirus 4 [Epstein-Barr virus]
cucuggucgcccccucugccu

SEQ ID NO: 3972206 - RNA, 17 nt, Human herpesvirus 4 [Epstein-Barr virus]
cucuucauguccacuga

SEQ ID NO: 3972207 - RNA, 19 nt, Human herpesvirus 4 [Epstein-Barr virus]
cugaaaaugacaggcugcg

SEQ ID NO: 3972208 - RNA, 18 nt, Human herpesvirus 4 [Epstein-Barr virus]
cugacacagacuuggccu

SEQ ID NO: 3972209 - RNA, 11 nt, Human herpesvirus 4 [Epstein-Barr virus]
cugacagagcc

SEQ ID NO: 3972210 - RNA, 21 nt, Human herpesvirus 4 [Epstein-Barr virus]
cugacagagccgugucuccug

SEQ ID NO: 3972211 - RNA, 14 nt, Human herpesvirus 4 [Epstein-Barr virus]
cugaccacggccca

SEQ ID NO: 3972212 - RNA, 13 nt, Human herpesvirus 4 [Epstein-Barr virus]
cugaccacucagg

SEQ ID NO: 3972213 - RNA, 20 nt, Human herpesvirus 4 [Epstein-Barr virus]
cugacccucgcgccccaucu

SEQ ID NO: 3972214 - RNA, 15 nt, Human herpesvirus 4 [Epstein-Barr virus]
cugacccuucugcug

SEQ ID NO: 3972215 - RNA, 17 nt, Human herpesvirus 4 [Epstein-Barr virus]
cugacccuucugcugcu

SEQ ID NO: 3972216 - RNA, 22 nt, Human herpesvirus 4 [Epstein-Barr virus]
cugacccuucugcugcugcugg

SEQ ID NO: 3972217 - RNA, 20 nt, Human herpesvirus 4 [Epstein-Barr virus]
cugaccgaauggggcagugg

SEQ ID NO: 3972218 - RNA, 21 nt, Human herpesvirus 4 [Epstein-Barr virus]
cugaccggcucggccacgcug

SEQ ID NO: 3972219 - RNA, 13 nt, Human herpesvirus 4 [Epstein-Barr virus]
cugacgcuccagg

SEQ ID NO: 3972220 - RNA, 17 nt, Human herpesvirus 4 [Epstein-Barr virus]
cugagccugagccacac

SEQ ID NO: 3972221 - RNA, 19 nt, Human herpesvirus 4 [Epstein-Barr virus]
cugaggaccuguugcuuca

SEQ ID NO: 3972222 - RNA, 13 nt, Human herpesvirus 4 [Epstein-Barr virus]
cugaguaggcuug

SEQ ID NO: 3972223 - RNA, 13 nt, Human herpesvirus 4 [Epstein-Barr virus]
cugaguucuacaa

SEQ ID NO: 3972224 - RNA, 21 nt, Human herpesvirus 4 [Epstein-Barr virus]
cugauaaaguuguccugggcu

SEQ ID NO: 3972225 - RNA, 15 nt, Human herpesvirus 4 [Epstein-Barr virus]
cugauaauacgcccg

SEQ ID NO: 3972226 - RNA, 23 nt, Human herpesvirus 4 [Epstein-Barr virus]
cugauaauacgcccgacaauaaa

SEQ ID NO: 3972227 - RNA, 15 nt, Human herpesvirus 4 [Epstein-Barr virus]
cugauaaugucuuca

SEQ ID NO: 3972228 - RNA, 22 nt, Human herpesvirus 4 [Epstein-Barr virus]
cugauaaugucuucaauagaca

SEQ ID NO: 3972229 - RNA, 12 nt, Human herpesvirus 4 [Epstein-Barr virus]
cugaucagggaa

SEQ ID NO: 3972230 - RNA, 17 nt, Human herpesvirus 4 [Epstein-Barr virus]
cugaucugggagaugag

SEQ ID NO: 3972231 - RNA, 14 nt, Human herpesvirus 4 [Epstein-Barr virus]
cugcacaacacaac

SEQ ID NO: 3972232 - RNA, 16 nt, Human herpesvirus 4 [Epstein-Barr virus]
cugcacagaacaucac

SEQ ID NO: 3972233 - RNA, 16 nt, Human herpesvirus 4 [Epstein-Barr virus]
cugcaccaguggcugc

SEQ ID NO: 3972234 - RNA, 16 nt, Human herpesvirus 4 [Epstein-Barr virus]
cugcaccccaguggac

SEQ ID NO: 3972235 - RNA, 15 nt, Human herpesvirus 4 [Epstein-Barr virus]
cugcacggcccucca

SEQ ID NO: 3972236 - RNA, 11 nt, Human herpesvirus 4 [Epstein-Barr virus]
cugcaggacac

SEQ ID NO: 3972237 - RNA, 14 nt, Human herpesvirus 4 [Epstein-Barr virus]
cugcagguaaaccu

SEQ ID NO: 3972238 - RNA, 23 nt, Human herpesvirus 4 [Epstein-Barr virus]
cugcagugggccucucuggcugu

SEQ ID NO: 3972239 - RNA, 20 nt, Human herpesvirus 4 [Epstein-Barr virus]
cugccacgugggucucaugg

SEQ ID NO: 3972240 - RNA, 21 nt, Human herpesvirus 4 [Epstein-Barr virus]
cugccacuuccacagcaaugg

SEQ ID NO: 3972241 - RNA, 21 nt, Human herpesvirus 4 [Epstein-Barr virus]
cugccaggccgccaugcucag

SEQ ID NO: 3972242 - RNA, 16 nt, Human herpesvirus 4 [Epstein-Barr virus]
cugccaucgggacaga

SEQ ID NO: 3972243 - RNA, 17 nt, Human herpesvirus 4 [Epstein-Barr virus]
cugcccccggagcccug

SEQ ID NO: 3972244 - RNA, 18 nt, Human herpesvirus 4 [Epstein-Barr virus]
aaaacucugcauggagaa

SEQ ID NO: 3972245 - RNA, 22 nt, Human herpesvirus 4 [Epstein-Barr virus]
aaaacucugcauggagaagcug

SEQ ID NO: 3972246 - RNA, 11 nt, Human herpesvirus 4 [Epstein-Barr virus]
aaaauaugcaa

SEQ ID NO: 3972247 - RNA, 20 nt, Human herpesvirus 4 [Epstein-Barr virus]
aaaaugucauaaccuggagu

SEQ ID NO: 3972248 - RNA, 17 nt, Human herpesvirus 4 [Epstein-Barr virus]
aaacaaggggaaaggag

SEQ ID NO: 3972249 - RNA, 16 nt, Human herpesvirus 4 [Epstein-Barr virus]
aaaccacgccugcuuc

SEQ ID NO: 3972250 - RNA, 21 nt, Human herpesvirus 4 [Epstein-Barr virus]
aaaccaguagugcgcgugagu

SEQ ID NO: 3972251 - RNA, 12 nt, Human herpesvirus 4 [Epstein-Barr virus]
aaacggccuggc

SEQ ID NO: 3972252 - RNA, 23 nt, Human herpesvirus 4 [Epstein-Barr virus]
aaagcggcccagcagauccaggg

SEQ ID NO: 3972253 - RNA, 14 nt, Human herpesvirus 4 [Epstein-Barr virus]
aaauaaauguuacu

SEQ ID NO: 3972254 - RNA, 23 nt, Human herpesvirus 4 [Epstein-Barr virus]
aaauccucacgaccugugucugu

SEQ ID NO: 3972255 - RNA, 20 nt, Human herpesvirus 4 [Epstein-Barr virus]
aaauguuacuucuuuugcuc

SEQ ID NO: 3972256 - RNA, 14 nt, Human herpesvirus 4 [Epstein-Barr virus]
aacacagcucuggc

SEQ ID NO: 3972257 - RNA, 22 nt, Human herpesvirus 4 [Epstein-Barr virus]
aacacgacgggaaugacgggcu

SEQ ID NO: 3972258 - RNA, 16 nt, Human herpesvirus 4 [Epstein-Barr virus]
aacacuccacagaugg

SEQ ID NO: 3972259 - RNA, 14 nt, Human herpesvirus 4 [Epstein-Barr virus]
aacagucuucaggu

SEQ ID NO: 3972260 - RNA, 13 nt, Human herpesvirus 4 [Epstein-Barr virus]
aacauaaaugccc

SEQ ID NO: 3972261 - RNA, 14 nt, Human herpesvirus 4 [Epstein-Barr virus]
aaccacugaccugg

SEQ ID NO: 3972262 - RNA, 14 nt, Human herpesvirus 4 [Epstein-Barr virus]
aacccccugcagga

SEQ ID NO: 3972263 - RNA, 23 nt, Human herpesvirus 4 [Epstein-Barr virus]
aaccugagccugagccacaccca

SEQ ID NO: 3972264 - RNA, 18 nt, Human herpesvirus 4 [Epstein-Barr virus]
aacggugauuaggcacug

SEQ ID NO: 3972265 - RNA, 19 nt, Human herpesvirus 4 [Epstein-Barr virus]
aacucccccaaacaugucc

SEQ ID NO: 3972266 - RNA, 15 nt, Human herpesvirus 4 [Epstein-Barr virus]
aacuccuccagcagu

SEQ ID NO: 3972267 - RNA, 22 nt, Human herpesvirus 4 [Epstein-Barr virus]
aacucucucaucuccaaaaagu

SEQ ID NO: 3972268 - RNA, 14 nt, Human herpesvirus 4 [Epstein-Barr virus]
aacugacagagccg

SEQ ID NO: 3972269 - RNA, 16 nt, Human herpesvirus 4 [Epstein-Barr virus]
aacuggucaccagcuu

SEQ ID NO: 3972270 - RNA, 17 nt, Human herpesvirus 4 [Epstein-Barr virus]
aacuugucuacauccca

SEQ ID NO: 3972271 - RNA, 21 nt, Human herpesvirus 4 [Epstein-Barr virus]
aagaggaggagggcggguggc

SEQ ID NO: 3972272 - RNA, 15 nt, Human herpesvirus 4 [Epstein-Barr virus]
aagauacccagagca

SEQ ID NO: 3972273 - RNA, 19 nt, Human herpesvirus 4 [Epstein-Barr virus]
aagauacccagagcaaaag

SEQ ID NO: 3972274 - RNA, 16 nt, Human herpesvirus 4 [Epstein-Barr virus]
aagauguaaagaucua

SEQ ID NO: 3972275 - RNA, 20 nt, Human herpesvirus 4 [Epstein-Barr virus]
aagcaacccccggcucucag

SEQ ID NO: 3972276 - RNA, 11 nt, Human herpesvirus 4 [Epstein-Barr virus]
aagcccaccua

SEQ ID NO: 3972277 - RNA, 14 nt, Human herpesvirus 4 [Epstein-Barr virus]
aagcuacaaacacg

SEQ ID NO: 3972278 - RNA, 14 nt, Human herpesvirus 4 [Epstein-Barr virus]
aagcuccggcugcc

SEQ ID NO: 3972279 - RNA, 13 nt, Human herpesvirus 4 [Epstein-Barr virus]
aaggagggcuggu

SEQ ID NO: 3972280 - RNA, 15 nt, Human herpesvirus 4 [Epstein-Barr virus]
aaggagggcugguug

SEQ ID NO: 3972281 - RNA, 12 nt, Human herpesvirus 4 [Epstein-Barr virus]
cguuaacaugga

SEQ ID NO: 3972282 - RNA, 20 nt, Human herpesvirus 4 [Epstein-Barr virus]
cguuauugaaaccacgccug

SEQ ID NO: 3972283 - RNA, 15 nt, Human herpesvirus 4 [Epstein-Barr virus]
cuaacacgcaauaaa

SEQ ID NO: 3972284 - RNA, 22 nt, Human herpesvirus 4 [Epstein-Barr virus]
cuaagcuaauagcggccgaaga

SEQ ID NO: 3972285 - RNA, 18 nt, Human herpesvirus 4 [Epstein-Barr virus]
cuaauguucucuaacugu

SEQ ID NO: 3972286 - RNA, 14 nt, Human herpesvirus 4 [Epstein-Barr virus]
cuaauucagccacc

SEQ ID NO: 3972287 - RNA, 10 nt, Human herpesvirus 4 [Epstein-Barr virus]
cuacaggaca

SEQ ID NO: 3972288 - RNA, 15 nt, Human herpesvirus 4 [Epstein-Barr virus]
cuacccggucgcaug

SEQ ID NO: 3972289 - RNA, 19 nt, Human herpesvirus 4 [Epstein-Barr virus]
cuaccuccuaucacaggga

SEQ ID NO: 3972290 - RNA, 23 nt, Human herpesvirus 4 [Epstein-Barr virus]
cuacgggcgcaccuguguccugg

SEQ ID NO: 3972291 - RNA, 14 nt, Human herpesvirus 4 [Epstein-Barr virus]
cuacucuccacggg

SEQ ID NO: 3972292 - RNA, 18 nt, Human herpesvirus 4 [Epstein-Barr virus]
cuacugccuuacacugga

SEQ ID NO: 3972293 - RNA, 18 nt, Human herpesvirus 4 [Epstein-Barr virus]
cuacugccuuguccacug

SEQ ID NO: 3972294 - RNA, 11 nt, Human herpesvirus 4 [Epstein-Barr virus]
cuacugcugcu

SEQ ID NO: 3972295 - RNA, 23 nt, Human herpesvirus 4 [Epstein-Barr virus]
cuagauuuccuacaacucagccc

SEQ ID NO: 3972296 - RNA, 16 nt, Human herpesvirus 4 [Epstein-Barr virus]
cuagccguccugucca

SEQ ID NO: 3972297 - RNA, 16 nt, Human herpesvirus 4 [Epstein-Barr virus]
cuagcgaggauaaucu

SEQ ID NO: 3972298 - RNA, 22 nt, Human herpesvirus 4 [Epstein-Barr virus]
cuagcggcgagacccgaggcag

SEQ ID NO: 3972299 - RNA, 14 nt, Human herpesvirus 4 [Epstein-Barr virus]
cuagcuucagggaa

SEQ ID NO: 3972300 - RNA, 19 nt, Human herpesvirus 4 [Epstein-Barr virus]
cuaggcaaaccuccaauca

SEQ ID NO: 3972301 - RNA, 14 nt, Human herpesvirus 4 [Epstein-Barr virus]
cuaguuaccacagg

SEQ ID NO: 3972302 - RNA, 12 nt, Human herpesvirus 4 [Epstein-Barr virus]
cuauacggccac

SEQ ID NO: 3972303 - RNA, 17 nt, Human herpesvirus 4 [Epstein-Barr virus]
cuauagauccugggccc

SEQ ID NO: 3972304 - RNA, 23 nt, Human herpesvirus 4 [Epstein-Barr virus]
cuauuggguuaacggguggaagc

SEQ ID NO: 3972305 - RNA, 16 nt, Human herpesvirus 4 [Epstein-Barr virus]
cucaaacagucccgag

SEQ ID NO: 3972306 - RNA, 22 nt, Human herpesvirus 4 [Epstein-Barr virus]
cucaacaaggagugccucuggg

SEQ ID NO: 3972307 - RNA, 19 nt, Human herpesvirus 4 [Epstein-Barr virus]
cucaaggauggcacgggca

SEQ ID NO: 3972308 - RNA, 21 nt, Human herpesvirus 4 [Epstein-Barr virus]
cucaauccauuaucuuggcac

SEQ ID NO: 3972309 - RNA, 11 nt, Human herpesvirus 4 [Epstein-Barr virus]
cucacaggaca

SEQ ID NO: 3972310 - RNA, 19 nt, Human herpesvirus 4 [Epstein-Barr virus]
cucagaauugucacugaga

SEQ ID NO: 3972311 - RNA, 14 nt, Human herpesvirus 4 [Epstein-Barr virus]
cucagccugcuccu

SEQ ID NO: 3972312 - RNA, 20 nt, Human herpesvirus 4 [Epstein-Barr virus]
cucaggaucagggccaagac

SEQ ID NO: 3972313 - RNA, 21 nt, Human herpesvirus 4 [Epstein-Barr virus]
cucaggccaccgucuacccag

SEQ ID NO: 3972314 - RNA, 19 nt, Human herpesvirus 4 [Epstein-Barr virus]
cucaucguucgguggggug

SEQ ID NO: 3972315 - RNA, 14 nt, Human herpesvirus 4 [Epstein-Barr virus]
cucaucucaaggga

SEQ ID NO: 3972316 - RNA, 19 nt, Human herpesvirus 4 [Epstein-Barr virus]
cucaucugugagacaagcc

SEQ ID NO: 3972317 - RNA, 14 nt, Human herpesvirus 4 [Epstein-Barr virus]
cucaugcgccagag

SEQ ID NO: 3972318 - RNA, 21 nt, Human herpesvirus 4 [Epstein-Barr virus]
cucauggaggggcggcagcgg

SEQ ID NO: 3972319 - RNA, 11 nt, Human herpesvirus 4 [Epstein-Barr virus]
cucauuucagu

SEQ ID NO: 3972320 - RNA, 17 nt, Human herpesvirus 4 [Epstein-Barr virus]
cuccaagugcaacaauc

SEQ ID NO: 3972321 - RNA, 13 nt, Human herpesvirus 4 [Epstein-Barr virus]
cuccaucagggcc

SEQ ID NO: 3972322 - RNA, 11 nt, Human herpesvirus 4 [Epstein-Barr virus]
cuccauuccac

SEQ ID NO: 3972323 - RNA, 14 nt, Human herpesvirus 4 [Epstein-Barr virus]
cuccauuccaccca

SEQ ID NO: 3972324 - RNA, 20 nt, Human herpesvirus 4 [Epstein-Barr virus]
cucccaccaccguuaugccu

SEQ ID NO: 3972325 - RNA, 17 nt, Human herpesvirus 4 [Epstein-Barr virus]
cucccauguaagccugc

SEQ ID NO: 3972326 - RNA, 19 nt, Human herpesvirus 4 [Epstein-Barr virus]
cuccccaauggggcuggca

SEQ ID NO: 3972327 - RNA, 17 nt, Human herpesvirus 4 [Epstein-Barr virus]
cuccccugacgcugugg

SEQ ID NO: 3972328 - RNA, 15 nt, Human herpesvirus 4 [Epstein-Barr virus]
cucccgccccugucc

SEQ ID NO: 3972329 - RNA, 16 nt, Human herpesvirus 4 [Epstein-Barr virus]
cucccgggguccagag

SEQ ID NO: 3972330 - RNA, 15 nt, Human herpesvirus 4 [Epstein-Barr virus]
cucccuuagccacac

SEQ ID NO: 3972331 - RNA, 20 nt, Human herpesvirus 4 [Epstein-Barr virus]
cucccuuagccacacugucu

SEQ ID NO: 3972332 - RNA, 16 nt, Human herpesvirus 4 [Epstein-Barr virus]
cuccgcauccuaggca

SEQ ID NO: 3972333 - RNA, 21 nt, Human herpesvirus 4 [Epstein-Barr virus]
cuccgcuuuaagaccaaggcc

SEQ ID NO: 3972334 - RNA, 22 nt, Human herpesvirus 4 [Epstein-Barr virus]
cuccggauucaccggcaccgcc

SEQ ID NO: 3972335 - RNA, 14 nt, Human herpesvirus 4 [Epstein-Barr virus]
cuccgggggcacug

SEQ ID NO: 3972336 - RNA, 17 nt, Human herpesvirus 4 [Epstein-Barr virus]
cuccucaaauguuccag

SEQ ID NO: 3972337 - RNA, 14 nt, Human herpesvirus 4 [Epstein-Barr virus]
cuccucgcaggccc

SEQ ID NO: 3972338 - RNA, 14 nt, Human herpesvirus 4 [Epstein-Barr virus]
cuccucgugcaccu

SEQ ID NO: 3972339 - RNA, 22 nt, Human herpesvirus 4 [Epstein-Barr virus]
cuccuggaucuggggcuggccu

SEQ ID NO: 3972340 - RNA, 14 nt, Human herpesvirus 4 [Epstein-Barr virus]
cuccuggccagcac

SEQ ID NO: 3972341 - RNA, 19 nt, Human herpesvirus 4 [Epstein-Barr virus]
cucgaagcggucucagaca

SEQ ID NO: 3972342 - RNA, 20 nt, Human herpesvirus 4 [Epstein-Barr virus]
cucgccgcuaguugguccag

SEQ ID NO: 3972343 - RNA, 20 nt, Human herpesvirus 4 [Epstein-Barr virus]
cucgcgccccaucuuggccc

SEQ ID NO: 3972344 - RNA, 17 nt, Human herpesvirus 4 [Epstein-Barr virus]
cucggaggugcccgggu

SEQ ID NO: 3972345 - RNA, 16 nt, Human herpesvirus 4 [Epstein-Barr virus]
cucggccuccuggcca

SEQ ID NO: 3972346 - RNA, 20 nt, Human herpesvirus 4 [Epstein-Barr virus]
cucggcucaccgggaacgcc

SEQ ID NO: 3972347 - RNA, 17 nt, Human herpesvirus 4 [Epstein-Barr virus]
cucggggcaugcugccc

SEQ ID NO: 3972348 - RNA, 18 nt, Human herpesvirus 4 [Epstein-Barr virus]
cucggggcuggggagaug

SEQ ID NO: 3972349 - RNA, 15 nt, Human herpesvirus 4 [Epstein-Barr virus]
cucgugcaagcagca

SEQ ID NO: 3972350 - RNA, 18 nt, Human herpesvirus 4 [Epstein-Barr virus]
cucuaacuuggcaucucu

SEQ ID NO: 3972351 - RNA, 17 nt, Human herpesvirus 4 [Epstein-Barr virus]
cucuacaaccccuucca

SEQ ID NO: 3972352 - RNA, 16 nt, Human herpesvirus 4 [Epstein-Barr virus]
cucuacgccaggcucg

SEQ ID NO: 3972353 - RNA, 13 nt, Human herpesvirus 4 [Epstein-Barr virus]
cucucaggccuca

SEQ ID NO: 3972354 - RNA, 17 nt, Human herpesvirus 4 [Epstein-Barr virus]
cucuccagcaaccaaug

SEQ ID NO: 3972355 - RNA, 19 nt, Human herpesvirus 4 [Epstein-Barr virus]
cucuccagcaaccaaugua

SEQ ID NO: 3972356 - RNA, 13 nt, Human herpesvirus 4 [Epstein-Barr virus]
cucucccacggac

SEQ ID NO: 3972357 - RNA, 12 nt, Human herpesvirus 4 [Epstein-Barr virus]
cucucgcacucu

SEQ ID NO: 3972358 - RNA, 18 nt, Human herpesvirus 4 [Epstein-Barr virus]
cucucuauguugucacau

SEQ ID NO: 3972359 - RNA, 14 nt, Human herpesvirus 4 [Epstein-Barr virus]
cucugaccaggaca

SEQ ID NO: 3972360 - RNA, 19 nt, Human herpesvirus 4 [Epstein-Barr virus]
cucugcauggagaagcugg

SEQ ID NO: 3972361 - RNA, 20 nt, Human herpesvirus 4 [Epstein-Barr virus]
cucugcauggagaagcugga

SEQ ID NO: 3972362 - RNA, 20 nt, Human herpesvirus 4 [Epstein-Barr virus]
cucugccaacuuugagcugg

SEQ ID NO: 3972363 - RNA, 20 nt, Human herpesvirus 4 [Epstein-Barr virus]
cucugcccuucagugucugg

SEQ ID NO: 3972364 - RNA, 20 nt, Human herpesvirus 4 [Epstein-Barr virus]
cucuucagugaccggacggg

SEQ ID NO: 3972365 - RNA, 22 nt, Human herpesvirus 4 [Epstein-Barr virus]
cucuugucggacgaggaggaag

SEQ ID NO: 3972366 - RNA, 20 nt, Human herpesvirus 4 [Epstein-Barr virus]
cugaacaucucauccccaga

SEQ ID NO: 3972367 - RNA, 16 nt, Human herpesvirus 4 [Epstein-Barr virus]
cugacccuucugcugc

SEQ ID NO: 3972368 - RNA, 14 nt, Human herpesvirus 4 [Epstein-Barr virus]
cugacgaggggcca

SEQ ID NO: 3972369 - RNA, 18 nt, Human herpesvirus 4 [Epstein-Barr virus]
gaggcugaugauggccac

SEQ ID NO: 3972370 - RNA, 20 nt, Human herpesvirus 4 [Epstein-Barr virus]
gagggacaguaccacaagcu

SEQ ID NO: 3972371 - RNA, 13 nt, Human herpesvirus 4 [Epstein-Barr virus]
gagggccucuggc

SEQ ID NO: 3972372 - RNA, 21 nt, Human herpesvirus 4 [Epstein-Barr virus]
gaggggcaggaggggcaggag

SEQ ID NO: 3972373 - RNA, 20 nt, Human herpesvirus 4 [Epstein-Barr virus]
gaggggcucgaauaugauga

SEQ ID NO: 3972374 - RNA, 13 nt, Human herpesvirus 4 [Epstein-Barr virus]
gagguagauaggu

SEQ ID NO: 3972375 - RNA, 15 nt, Human herpesvirus 4 [Epstein-Barr virus]
gaguccagggcccug

SEQ ID NO: 3972376 - RNA, 15 nt, Human herpesvirus 4 [Epstein-Barr virus]
gagucgaagcucuug

SEQ ID NO: 3972377 - RNA, 22 nt, Human herpesvirus 4 [Epstein-Barr virus]
gagucugacuacucagaugaag

SEQ ID NO: 3972378 - RNA, 21 nt, Human herpesvirus 4 [Epstein-Barr virus]
gagugccgggcccgggacagc

SEQ ID NO: 3972379 - RNA, 16 nt, Human herpesvirus 4 [Epstein-Barr virus]
gauacucaucugugag

SEQ ID NO: 3972380 - RNA, 16 nt, Human herpesvirus 4 [Epstein-Barr virus]
gauauugaauuccaca

SEQ ID NO: 3972381 - RNA, 14 nt, Human herpesvirus 4 [Epstein-Barr virus]
gauccgcaggggcg

SEQ ID NO: 3972382 - RNA, 23 nt, Human herpesvirus 4 [Epstein-Barr virus]
gaucgauuggaaaagggcccagg

SEQ ID NO: 3972383 - RNA, 16 nt, Human herpesvirus 4 [Epstein-Barr virus]
gaucuucuucucccuc

SEQ ID NO: 3972384 - RNA, 16 nt, Human herpesvirus 4 [Epstein-Barr virus]
gaugagcacgugugga

SEQ ID NO: 3972385 - RNA, 22 nt, Human herpesvirus 4 [Epstein-Barr virus]
gaugcugcagagguucagggac

SEQ ID NO: 3972386 - RNA, 22 nt, Human herpesvirus 4 [Epstein-Barr virus]
gauggcacgguccagaagcaga

SEQ ID NO: 3972387 - RNA, 21 nt, Human herpesvirus 4 [Epstein-Barr virus]
gauggcccugaucugggagau

SEQ ID NO: 3972388 - RNA, 13 nt, Human herpesvirus 4 [Epstein-Barr virus]
gaugguggggcuu

SEQ ID NO: 3972389 - RNA, 12 nt, Human herpesvirus 4 [Epstein-Barr virus]
gauguauuacca

SEQ ID NO: 3972390 - RNA, 21 nt, Human herpesvirus 4 [Epstein-Barr virus]
gaugugaauauggcugcggag

SEQ ID NO: 3972391 - RNA, 21 nt, Human herpesvirus 4 [Epstein-Barr virus]
gauuaggagcagggcccagug

SEQ ID NO: 3972392 - RNA, 20 nt, Human herpesvirus 4 [Epstein-Barr virus]
gauuccugauuuuccucauu

SEQ ID NO: 3972393 - RNA, 15 nt, Human herpesvirus 4 [Epstein-Barr virus]
gauugggugguggca

SEQ ID NO: 3972394 - RNA, 15 nt, Human herpesvirus 4 [Epstein-Barr virus]
gauugucacagcugc

SEQ ID NO: 3972395 - RNA, 20 nt, Human herpesvirus 4 [Epstein-Barr virus]
gauuuccuacaacucagccc

SEQ ID NO: 3972396 - RNA, 17 nt, Human herpesvirus 4 [Epstein-Barr virus]
gcaaacagggcagagag

SEQ ID NO: 3972397 - RNA, 14 nt, Human herpesvirus 4 [Epstein-Barr virus]
gcaaacccuggccg

SEQ ID NO: 3972398 - RNA, 14 nt, Human herpesvirus 4 [Epstein-Barr virus]
gcaaagggacccac

SEQ ID NO: 3972399 - RNA, 19 nt, Human herpesvirus 4 [Epstein-Barr virus]
gcaacgccggccugcuggc

SEQ ID NO: 3972400 - RNA, 13 nt, Human herpesvirus 4 [Epstein-Barr virus]
gcaacugcugcag

SEQ ID NO: 3972401 - RNA, 15 nt, Human herpesvirus 4 [Epstein-Barr virus]
gcaagaauuggggcu

SEQ ID NO: 3972402 - RNA, 18 nt, Human herpesvirus 4 [Epstein-Barr virus]
gcaagaauuggggcuggg

SEQ ID NO: 3972403 - RNA, 19 nt, Human herpesvirus 4 [Epstein-Barr virus]
gcaagauccuucuggcacg

SEQ ID NO: 3972404 - RNA, 14 nt, Human herpesvirus 4 [Epstein-Barr virus]
gcaagcaugggcga

SEQ ID NO: 3972405 - RNA, 14 nt, Human herpesvirus 4 [Epstein-Barr virus]
gcaaguuuugcccg

SEQ ID NO: 3972406 - RNA, 17 nt, Human herpesvirus 4 [Epstein-Barr virus]
gcacacauuacggugcu

SEQ ID NO: 3972407 - RNA, 16 nt, Human herpesvirus 4 [Epstein-Barr virus]
gcacacgcucagcuca

SEQ ID NO: 3972408 - RNA, 17 nt, Human herpesvirus 4 [Epstein-Barr virus]
gcacacgcucagcucaa

SEQ ID NO: 3972409 - RNA, 19 nt, Human herpesvirus 4 [Epstein-Barr virus]
gcacagaacaucacugcca

SEQ ID NO: 3972410 - RNA, 22 nt, Human herpesvirus 4 [Epstein-Barr virus]
gcacaucuggaccuggacuggg

SEQ ID NO: 3972411 - RNA, 15 nt, Human herpesvirus 4 [Epstein-Barr virus]
gcaccaccgcagcca

SEQ ID NO: 3972412 - RNA, 18 nt, Human herpesvirus 4 [Epstein-Barr virus]
gcaccagcuaacaggaca

SEQ ID NO: 3972413 - RNA, 18 nt, Human herpesvirus 4 [Epstein-Barr virus]
gcaccagcuccagggaca

SEQ ID NO: 3972414 - RNA, 15 nt, Human herpesvirus 4 [Epstein-Barr virus]
gcaccagggccaggc

SEQ ID NO: 3972415 - RNA, 18 nt, Human herpesvirus 4 [Epstein-Barr virus]
gcaccggagccaccacag

SEQ ID NO: 3972416 - RNA, 22 nt, Human herpesvirus 4 [Epstein-Barr virus]
gcaccuguccuugucugcugcc

SEQ ID NO: 3972417 - RNA, 18 nt, Human herpesvirus 4 [Epstein-Barr virus]
gcaccuguguccugggca

SEQ ID NO: 3972418 - RNA, 23 nt, Human herpesvirus 4 [Epstein-Barr virus]
gcaccuguguccugggcaaggag

SEQ ID NO: 3972419 - RNA, 15 nt, Human herpesvirus 4 [Epstein-Barr virus]
gcacggaugccuggc

SEQ ID NO: 3972420 - RNA, 19 nt, Human herpesvirus 4 [Epstein-Barr virus]
gcacguggguuucugcccc

SEQ ID NO: 3972421 - RNA, 20 nt, Human herpesvirus 4 [Epstein-Barr virus]
gcacguuuaccagugugcca

SEQ ID NO: 3972422 - RNA, 20 nt, Human herpesvirus 4 [Epstein-Barr virus]
gcacucucgagggugccugu

SEQ ID NO: 3972423 - RNA, 15 nt, Human herpesvirus 4 [Epstein-Barr virus]
gcacugcguccaccu

SEQ ID NO: 3972424 - RNA, 18 nt, Human herpesvirus 4 [Epstein-Barr virus]
gcacuggugguggaggag

SEQ ID NO: 3972425 - RNA, 17 nt, Human herpesvirus 4 [Epstein-Barr virus]
gcacugugggggucggg

SEQ ID NO: 3972426 - RNA, 13 nt, Human herpesvirus 4 [Epstein-Barr virus]
gcagaaggggccc

SEQ ID NO: 3972427 - RNA, 22 nt, Human herpesvirus 4 [Epstein-Barr virus]
gcagaggaugagaccaguggca

SEQ ID NO: 3972428 - RNA, 14 nt, Human herpesvirus 4 [Epstein-Barr virus]
gcagcaccucagcu

SEQ ID NO: 3972429 - RNA, 18 nt, Human herpesvirus 4 [Epstein-Barr virus]
gcagcaguggccagcuca

SEQ ID NO: 3972430 - RNA, 12 nt, Human herpesvirus 4 [Epstein-Barr virus]
gcagccuggcuc

SEQ ID NO: 3972431 - RNA, 19 nt, Human herpesvirus 4 [Epstein-Barr virus]
gcagcggacgguggggcuc

SEQ ID NO: 3972432 - RNA, 19 nt, Human herpesvirus 4 [Epstein-Barr virus]
gcaggagcaggaggagggg

SEQ ID NO: 3972433 - RNA, 16 nt, Human herpesvirus 4 [Epstein-Barr virus]
gcaggagcaggagggg

SEQ ID NO: 3972434 - RNA, 15 nt, Human herpesvirus 4 [Epstein-Barr virus]
gcaggaggggcagga

SEQ ID NO: 3972435 - RNA, 22 nt, Human herpesvirus 4 [Epstein-Barr virus]
gcaggcauuuuuggugcugccu

SEQ ID NO: 3972436 - RNA, 14 nt, Human herpesvirus 4 [Epstein-Barr virus]
gcagggugcacaga

SEQ ID NO: 3972437 - RNA, 14 nt, Human herpesvirus 4 [Epstein-Barr virus]
gcagguggcugcug

SEQ ID NO: 3972438 - RNA, 16 nt, Human herpesvirus 4 [Epstein-Barr virus]
gcagguggcugcugcc

SEQ ID NO: 3972439 - RNA, 18 nt, Human herpesvirus 4 [Epstein-Barr virus]
gcaguagcuugggaacac

SEQ ID NO: 3972440 - RNA, 15 nt, Human herpesvirus 4 [Epstein-Barr virus]
gcagucgcugcugca

SEQ ID NO: 3972441 - RNA, 20 nt, Human herpesvirus 4 [Epstein-Barr virus]
gcagugguguuugcuugccc

SEQ ID NO: 3972442 - RNA, 15 nt, Human herpesvirus 4 [Epstein-Barr virus]
gcauacgcugaguga

SEQ ID NO: 3972443 - RNA, 17 nt, Human herpesvirus 4 [Epstein-Barr virus]
gcaucacaagucacauc

SEQ ID NO: 3972444 - RNA, 21 nt, Human herpesvirus 4 [Epstein-Barr virus]
gcauccaacgcuuccaccccc

SEQ ID NO: 3972445 - RNA, 16 nt, Human herpesvirus 4 [Epstein-Barr virus]
gcauccgcaccacaga

SEQ ID NO: 3972446 - RNA, 16 nt, Human herpesvirus 4 [Epstein-Barr virus]
gcauccuaggcacggc

SEQ ID NO: 3972447 - RNA, 18 nt, Human herpesvirus 4 [Epstein-Barr virus]
gcauccucaaggggcacg

SEQ ID NO: 3972448 - RNA, 22 nt, Human herpesvirus 4 [Epstein-Barr virus]
gcaucggggcggacgccuccuc

SEQ ID NO: 3972449 - RNA, 14 nt, Human herpesvirus 4 [Epstein-Barr virus]
gcaugacacaggac

SEQ ID NO: 3972450 - RNA, 18 nt, Human herpesvirus 4 [Epstein-Barr virus]
gcauucagauuucuaguu

SEQ ID NO: 3972451 - RNA, 20 nt, Human herpesvirus 4 [Epstein-Barr virus]
gccaaccugcucucucugga

SEQ ID NO: 3972452 - RNA, 19 nt, Human herpesvirus 4 [Epstein-Barr virus]
gccaaccuuuccaucacug

SEQ ID NO: 3972453 - RNA, 15 nt, Human herpesvirus 4 [Epstein-Barr virus]
gccaacgcucagugc

SEQ ID NO: 3972454 - RNA, 20 nt, Human herpesvirus 4 [Epstein-Barr virus]
gccaaugacccacuccagug

SEQ ID NO: 3972455 - RNA, 17 nt, Human herpesvirus 4 [Epstein-Barr virus]
gccaccacggugcagcc

SEQ ID NO: 3972456 - RNA, 22 nt, Human herpesvirus 4 [Epstein-Barr virus]
gccaccggggaggccagguagc

SEQ ID NO: 3972457 - RNA, 19 nt, Human herpesvirus 4 [Epstein-Barr virus]
ggccgccacccucccccug

SEQ ID NO: 3972458 - RNA, 21 nt, Human herpesvirus 4 [Epstein-Barr virus]
ggccuccagcucggccagcag

SEQ ID NO: 3972459 - RNA, 22 nt, Human herpesvirus 4 [Epstein-Barr virus]
ggccucgccuucuccucagccu

SEQ ID NO: 3972460 - RNA, 17 nt, Human herpesvirus 4 [Epstein-Barr virus]
ggccucgugcaaccagg

SEQ ID NO: 3972461 - RNA, 21 nt, Human herpesvirus 4 [Epstein-Barr virus]
ggccugccuggaucugagcua

SEQ ID NO: 3972462 - RNA, 13 nt, Human herpesvirus 4 [Epstein-Barr virus]
ggccugcugucau

SEQ ID NO: 3972463 - RNA, 14 nt, Human herpesvirus 4 [Epstein-Barr virus]
ggccugcugucauc

SEQ ID NO: 3972464 - RNA, 11 nt, Human herpesvirus 4 [Epstein-Barr virus]
ggccuggggcc

SEQ ID NO: 3972465 - RNA, 21 nt, Human herpesvirus 4 [Epstein-Barr virus]
ggccuuggggguggugggcuc

SEQ ID NO: 3972466 - RNA, 16 nt, Human herpesvirus 4 [Epstein-Barr virus]
ggcgaaugggcugcag

SEQ ID NO: 3972467 - RNA, 14 nt, Human herpesvirus 4 [Epstein-Barr virus]
ggcgacugccgccg

SEQ ID NO: 3972468 - RNA, 21 nt, Human herpesvirus 4 [Epstein-Barr virus]
ggcgacuuggugccaccaucu

SEQ ID NO: 3972469 - RNA, 19 nt, Human herpesvirus 4 [Epstein-Barr virus]
ggcgagacuuggaccaagg

SEQ ID NO: 3972470 - RNA, 13 nt, Human herpesvirus 4 [Epstein-Barr virus]
ggcgccuggggau

SEQ ID NO: 3972471 - RNA, 12 nt, Human herpesvirus 4 [Epstein-Barr virus]
ggcgcggcugga

SEQ ID NO: 3972472 - RNA, 17 nt, Human herpesvirus 4 [Epstein-Barr virus]
ggcgcucugcgccagcc

SEQ ID NO: 3972473 - RNA, 23 nt, Human herpesvirus 4 [Epstein-Barr virus]
ggcgcucugcgccagccccgccc

SEQ ID NO: 3972474 - RNA, 23 nt, Human herpesvirus 4 [Epstein-Barr virus]
ggcggacugcgccuuuaggcgua

SEQ ID NO: 3972475 - RNA, 15 nt, Human herpesvirus 4 [Epstein-Barr virus]
ggcggaggcacugga

SEQ ID NO: 3972476 - RNA, 22 nt, Human herpesvirus 4 [Epstein-Barr virus]
ggcggcagcggaugguggggcu

SEQ ID NO: 3972477 - RNA, 18 nt, Human herpesvirus 4 [Epstein-Barr virus]
ggcggcgaugucggggcu

SEQ ID NO: 3972478 - RNA, 13 nt, Human herpesvirus 4 [Epstein-Barr virus]
ggcgggcgggcuu

SEQ ID NO: 3972479 - RNA, 12 nt, Human herpesvirus 4 [Epstein-Barr virus]
ggcggugccugu

SEQ ID NO: 3972480 - RNA, 17 nt, Human herpesvirus 4 [Epstein-Barr virus]
ggcguggagcugggccu

SEQ ID NO: 3972481 - RNA, 18 nt, Human herpesvirus 4 [Epstein-Barr virus]
ggcuacaacaggcugcug

SEQ ID NO: 3972482 - RNA, 24 nt, Human herpesvirus 4 [Epstein-Barr virus]
ggcuccauguccuguggugugcuu

SEQ ID NO: 3972483 - RNA, 19 nt, Human herpesvirus 4 [Epstein-Barr virus]
ggcuccggauucaccggca

SEQ ID NO: 3972484 - RNA, 19 nt, Human herpesvirus 4 [Epstein-Barr virus]
ggcuccuuagacugagcca

SEQ ID NO: 3972485 - RNA, 15 nt, Human herpesvirus 4 [Epstein-Barr virus]
ggcucucaggccuca

SEQ ID NO: 3972486 - RNA, 20 nt, Human herpesvirus 4 [Epstein-Barr virus]
ggcugacguccaccccaccc

SEQ ID NO: 3972487 - RNA, 19 nt, Human herpesvirus 4 [Epstein-Barr virus]
ggcugcgccugagcugccu

SEQ ID NO: 3972488 - RNA, 20 nt, Human herpesvirus 4 [Epstein-Barr virus]
ggcuggugacaaacucucuc

SEQ ID NO: 3972489 - RNA, 21 nt, Human herpesvirus 4 [Epstein-Barr virus]
ggcugugguaaccggugggcu

SEQ ID NO: 3972490 - RNA, 14 nt, Human herpesvirus 4 [Epstein-Barr virus]
ggcuucugcugcug

SEQ ID NO: 3972491 - RNA, 19 nt, Human herpesvirus 4 [Epstein-Barr virus]
gggaacgaggggaggcggg

SEQ ID NO: 3972492 - RNA, 19 nt, Human herpesvirus 4 [Epstein-Barr virus]
gggaaugacgggcucccuc

SEQ ID NO: 3972493 - RNA, 22 nt, Human herpesvirus 4 [Epstein-Barr virus]
gggaccggcuacgcgggccaca

SEQ ID NO: 3972494 - RNA, 17 nt, Human herpesvirus 4 [Epstein-Barr virus]
gggacgaggacgagaag

SEQ ID NO: 3972495 - RNA, 21 nt, Human herpesvirus 4 [Epstein-Barr virus]
gggacgcagaaugugcaggga

SEQ ID NO: 3972496 - RNA, 21 nt, Human herpesvirus 4 [Epstein-Barr virus]
gggagacacaucuggaccaga

SEQ ID NO: 3972497 - RNA, 11 nt, Human herpesvirus 4 [Epstein-Barr virus]
gggaggacacu

SEQ ID NO: 3972498 - RNA, 15 nt, Human herpesvirus 4 [Epstein-Barr virus]
gggagguggccacac

SEQ ID NO: 3972499 - RNA, 12 nt, Human herpesvirus 4 [Epstein-Barr virus]
gggaugagcugg

SEQ ID NO: 3972500 - RNA, 20 nt, Human herpesvirus 4 [Epstein-Barr virus]
gggcagacaccaccugcucg

SEQ ID NO: 3972501 - RNA, 22 nt, Human herpesvirus 4 [Epstein-Barr virus]
gggcaucaugcagggugcacag

SEQ ID NO: 3972502 - RNA, 23 nt, Human herpesvirus 4 [Epstein-Barr virus]
gggcauuaacuaagcuuaugagc

SEQ ID NO: 3972503 - RNA, 20 nt, Human herpesvirus 4 [Epstein-Barr virus]
gggccacugcaggcuggacg

SEQ ID NO: 3972504 - RNA, 11 nt, Human herpesvirus 4 [Epstein-Barr virus]
gggccaggacc

SEQ ID NO: 3972505 - RNA, 23 nt, Human herpesvirus 4 [Epstein-Barr virus]
gggccucucuggcugugcugacc

SEQ ID NO: 3972506 - RNA, 12 nt, Human herpesvirus 4 [Epstein-Barr virus]
gggccuggggcc

SEQ ID NO: 3972507 - RNA, 23 nt, Human herpesvirus 4 [Epstein-Barr virus]
gggccuggugccagacucucuuc

SEQ ID NO: 3972508 - RNA, 19 nt, Human herpesvirus 4 [Epstein-Barr virus]
gggccugugacuggugcuu

SEQ ID NO: 3972509 - RNA, 13 nt, Human herpesvirus 4 [Epstein-Barr virus]
gggcggcggugga

SEQ ID NO: 3972510 - RNA, 17 nt, Human herpesvirus 4 [Epstein-Barr virus]
gggcggcguggagcugg

SEQ ID NO: 3972511 - RNA, 15 nt, Human herpesvirus 4 [Epstein-Barr virus]
gggcguacaccuggc

SEQ ID NO: 3972512 - RNA, 11 nt, Human herpesvirus 4 [Epstein-Barr virus]
gggcugccccg

SEQ ID NO: 3972513 - RNA, 17 nt, Human herpesvirus 4 [Epstein-Barr virus]
gggcuggccugccugga

SEQ ID NO: 3972514 - RNA, 23 nt, Human herpesvirus 4 [Epstein-Barr virus]
ggggauuacccgacccagccacu

SEQ ID NO: 3972515 - RNA, 15 nt, Human herpesvirus 4 [Epstein-Barr virus]
ggggcaggagcagga

SEQ ID NO: 3972516 - RNA, 22 nt, Human herpesvirus 4 [Epstein-Barr virus]
ggggcaggagcaggaggggcag

SEQ ID NO: 3972517 - RNA, 19 nt, Human herpesvirus 4 [Epstein-Barr virus]
ggggcuaugguaguggcug

SEQ ID NO: 3972518 - RNA, 14 nt, Human herpesvirus 4 [Epstein-Barr virus]
ggggcuguagaagg

SEQ ID NO: 3972519 - RNA, 13 nt, Human herpesvirus 4 [Epstein-Barr virus]
gggggaggagaga

SEQ ID NO: 3972520 - RNA, 22 nt, Human herpesvirus 4 [Epstein-Barr virus]
ggguaacauuguacagagcugu

SEQ ID NO: 3972521 - RNA, 12 nt, Human herpesvirus 4 [Epstein-Barr virus]
ggguacuggcau

SEQ ID NO: 3972522 - RNA, 18 nt, Human herpesvirus 4 [Epstein-Barr virus]
gggugaccacugagggag

SEQ ID NO: 3972523 - RNA, 13 nt, Human herpesvirus 4 [Epstein-Barr virus]
ggguggacaugag

SEQ ID NO: 3972524 - RNA, 13 nt, Human herpesvirus 4 [Epstein-Barr virus]
gguaaaugcaccu

SEQ ID NO: 3972525 - RNA, 14 nt, Human herpesvirus 4 [Epstein-Barr virus]
gguagccggcgcug

SEQ ID NO: 3972526 - RNA, 22 nt, Human herpesvirus 4 [Epstein-Barr virus]
gguagccggcgcuguguggcug

SEQ ID NO: 3972527 - RNA, 11 nt, Human herpesvirus 4 [Epstein-Barr virus]
gguauuccuca

SEQ ID NO: 3972528 - RNA, 13 nt, Human herpesvirus 4 [Epstein-Barr virus]
gguauugcagcug

SEQ ID NO: 3972529 - RNA, 18 nt, Human herpesvirus 4 [Epstein-Barr virus]
ggucaagcaaacggccug

SEQ ID NO: 3972530 - RNA, 18 nt, Human herpesvirus 4 [Epstein-Barr virus]
ggucauuagaugcugccg

SEQ ID NO: 3972531 - RNA, 21 nt, Human herpesvirus 4 [Epstein-Barr virus]
gguccaagaguaaaagcagaa

SEQ ID NO: 3972532 - RNA, 21 nt, Human herpesvirus 4 [Epstein-Barr virus]
ggucccaggccuuagcccaga

SEQ ID NO: 3972533 - RNA, 13 nt, Human herpesvirus 4 [Epstein-Barr virus]
gguccccucugcc

SEQ ID NO: 3972534 - RNA, 20 nt, Human herpesvirus 4 [Epstein-Barr virus]
gguccuccacggggacacgc

SEQ ID NO: 3972535 - RNA, 20 nt, Human herpesvirus 4 [Epstein-Barr virus]
ggucgugguuuucugccccu

SEQ ID NO: 3972536 - RNA, 22 nt, Human herpesvirus 4 [Epstein-Barr virus]
ggugaccacugagggaguguuc

SEQ ID NO: 3972537 - RNA, 17 nt, Human herpesvirus 4 [Epstein-Barr virus]
ggugaggacggugucug

SEQ ID NO: 3972538 - RNA, 15 nt, Human herpesvirus 4 [Epstein-Barr virus]
ggugaucgacuccag

SEQ ID NO: 3972539 - RNA, 23 nt, Human herpesvirus 4 [Epstein-Barr virus]
ggugccugguaugcagaaggggc

SEQ ID NO: 3972540 - RNA, 15 nt, Human herpesvirus 4 [Epstein-Barr virus]
gguggagauagggac

SEQ ID NO: 3972541 - RNA, 16 nt, Human herpesvirus 4 [Epstein-Barr virus]
ggugggggugggugca

SEQ ID NO: 3972542 - RNA, 14 nt, Human herpesvirus 4 [Epstein-Barr virus]
gguggugggugugg

SEQ ID NO: 3972543 - RNA, 20 nt, Human herpesvirus 4 [Epstein-Barr virus]
gguuauaacugccagagcug

SEQ ID NO: 3972544 - RNA, 23 nt, Human herpesvirus 4 [Epstein-Barr virus]
agaggagaauagaggggagcaga

SEQ ID NO: 3972545 - RNA, 20 nt, Human herpesvirus 4 [Epstein-Barr virus]
agaggaggaggaugaagauc

SEQ ID NO: 3972546 - RNA, 18 nt, Human herpesvirus 4 [Epstein-Barr virus]
agaggagggggauccgga

SEQ ID NO: 3972547 - RNA, 19 nt, Human herpesvirus 4 [Epstein-Barr virus]
agaggccucugggguccag

SEQ ID NO: 3972548 - RNA, 12 nt, Human herpesvirus 4 [Epstein-Barr virus]
agagggaugggc

SEQ ID NO: 3972549 - RNA, 18 nt, Human herpesvirus 4 [Epstein-Barr virus]
agagggugagcccaccug

SEQ ID NO: 3972550 - RNA, 22 nt, Human herpesvirus 4 [Epstein-Barr virus]
agagggugagcccaccugucug

SEQ ID NO: 3972551 - RNA, 21 nt, Human herpesvirus 4 [Epstein-Barr virus]
agagguagacgaggcacaggc

SEQ ID NO: 3972552 - RNA, 19 nt, Human herpesvirus 4 [Epstein-Barr virus]
agagguugcgcugcuugcc

SEQ ID NO: 3972553 - RNA, 21 nt, Human herpesvirus 4 [Epstein-Barr virus]
agagugccgggcccgggacag

SEQ ID NO: 3972554 - RNA, 13 nt, Human herpesvirus 4 [Epstein-Barr virus]
agauccaacuccg

SEQ ID NO: 3972555 - RNA, 20 nt, Human herpesvirus 4 [Epstein-Barr virus]
agaugccgugaaugcacgcc

SEQ ID NO: 3972556 - RNA, 14 nt, Human herpesvirus 4 [Epstein-Barr virus]
agaugcucuggcga

SEQ ID NO: 3972557 - RNA, 16 nt, Human herpesvirus 4 [Epstein-Barr virus]
agaugucaaacauggu

SEQ ID NO: 3972558 - RNA, 17 nt, Human herpesvirus 4 [Epstein-Barr virus]
agauuagaagaugaugc

SEQ ID NO: 3972559 - RNA, 12 nt, Human herpesvirus 4 [Epstein-Barr virus]
agcaauggcacg

SEQ ID NO: 3972560 - RNA, 18 nt, Human herpesvirus 4 [Epstein-Barr virus]
agcaccggagccaccaca

SEQ ID NO: 3972561 - RNA, 21 nt, Human herpesvirus 4 [Epstein-Barr virus]
agcagagguugggccacgcug

SEQ ID NO: 3972562 - RNA, 15 nt, Human herpesvirus 4 [Epstein-Barr virus]
agcagauccagggcc

SEQ ID NO: 3972563 - RNA, 13 nt, Human herpesvirus 4 [Epstein-Barr virus]
agcagggcccagu

SEQ ID NO: 3972564 - RNA, 17 nt, Human herpesvirus 4 [Epstein-Barr virus]
agcaggugcaccagcuc

SEQ ID NO: 3972565 - RNA, 15 nt, Human herpesvirus 4 [Epstein-Barr virus]
agcaucagaugagac

SEQ ID NO: 3972566 - RNA, 19 nt, Human herpesvirus 4 [Epstein-Barr virus]
agcaugucacacauucccc

SEQ ID NO: 3972567 - RNA, 12 nt, Human herpesvirus 4 [Epstein-Barr virus]
agcauuugcaag

SEQ ID NO: 3972568 - RNA, 22 nt, Human herpesvirus 4 [Epstein-Barr virus]
agccacggcgucaaacagguga

SEQ ID NO: 3972569 - RNA, 17 nt, Human herpesvirus 4 [Epstein-Barr virus]
agccaggcucgcggaag

SEQ ID NO: 3972570 - RNA, 14 nt, Human herpesvirus 4 [Epstein-Barr virus]
agccauuggcaugg

SEQ ID NO: 3972571 - RNA, 22 nt, Human herpesvirus 4 [Epstein-Barr virus]
agcccaagaagaagcccaccua

SEQ ID NO: 3972572 - RNA, 19 nt, Human herpesvirus 4 [Epstein-Barr virus]
agcccccucccgccccugu

SEQ ID NO: 3972573 - RNA, 22 nt, Human herpesvirus 4 [Epstein-Barr virus]
agcccccucccgccccugucca

SEQ ID NO: 3972574 - RNA, 18 nt, Human herpesvirus 4 [Epstein-Barr virus]
agcccccuccuccagguc

SEQ ID NO: 3972575 - RNA, 18 nt, Human herpesvirus 4 [Epstein-Barr virus]
agccccgcccuccccauc

SEQ ID NO: 3972576 - RNA, 21 nt, Human herpesvirus 4 [Epstein-Barr virus]
agccccgggcccagcccuccu

SEQ ID NO: 3972577 - RNA, 18 nt, Human herpesvirus 4 [Epstein-Barr virus]
agccccuaggccugccac

SEQ ID NO: 3972578 - RNA, 20 nt, Human herpesvirus 4 [Epstein-Barr virus]
agcccggggaaaagagagcu

SEQ ID NO: 3972579 - RNA, 12 nt, Human herpesvirus 4 [Epstein-Barr virus]
agcccuccucag

SEQ ID NO: 3972580 - RNA, 21 nt, Human herpesvirus 4 [Epstein-Barr virus]
agccugagccacacccaccua

SEQ ID NO: 3972581 - RNA, 20 nt, Human herpesvirus 4 [Epstein-Barr virus]
agccugauauugucccccua

SEQ ID NO: 3972582 - RNA, 19 nt, Human herpesvirus 4 [Epstein-Barr virus]
agccugcaccaguggcugc

SEQ ID NO: 3972583 - RNA, 20 nt, Human herpesvirus 4 [Epstein-Barr virus]
agccugucgauaucccugcu

SEQ ID NO: 3972584 - RNA, 22 nt, Human herpesvirus 4 [Epstein-Barr virus]
agccuugcguggugcuguccug

SEQ ID NO: 3972585 - RNA, 20 nt, Human herpesvirus 4 [Epstein-Barr virus]
agcgcccugucccuggagcu

SEQ ID NO: 3972586 - RNA, 22 nt, Human herpesvirus 4 [Epstein-Barr virus]
agcggcgugucuuggccagcgg

SEQ ID NO: 3972587 - RNA, 16 nt, Human herpesvirus 4 [Epstein-Barr virus]
agcgucaggagagggc

SEQ ID NO: 3972588 - RNA, 13 nt, Human herpesvirus 4 [Epstein-Barr virus]
agcuaacaggaca

SEQ ID NO: 3972589 - RNA, 21 nt, Human herpesvirus 4 [Epstein-Barr virus]
agcuacgaaacugaccagaug

SEQ ID NO: 3972590 - RNA, 16 nt, Human herpesvirus 4 [Epstein-Barr virus]
agcucaccuaugguca

SEQ ID NO: 3972591 - RNA, 23 nt, Human herpesvirus 4 [Epstein-Barr virus]
agcuccagggacagggcgcugca

SEQ ID NO: 3972592 - RNA, 16 nt, Human herpesvirus 4 [Epstein-Barr virus]
agcuccgugggcccag

SEQ ID NO: 3972593 - RNA, 23 nt, Human herpesvirus 4 [Epstein-Barr virus]
agcucuaacuuggcaucucuuuu

SEQ ID NO: 3972594 - RNA, 20 nt, Human herpesvirus 4 [Epstein-Barr virus]
agcucugcacaggcuuggaa

SEQ ID NO: 3972595 - RNA, 15 nt, Human herpesvirus 4 [Epstein-Barr virus]
agcugagugcccagg

SEQ ID NO: 3972596 - RNA, 13 nt, Human herpesvirus 4 [Epstein-Barr virus]
agcuuggggccac

SEQ ID NO: 3972597 - RNA, 23 nt, Human herpesvirus 4 [Epstein-Barr virus]
agcuuugccccaaucgcgugcca

SEQ ID NO: 3972598 - RNA, 12 nt, Human herpesvirus 4 [Epstein-Barr virus]
aggaacagccuc

SEQ ID NO: 3972599 - RNA, 17 nt, Human herpesvirus 4 [Epstein-Barr virus]
aggacauguuuggggag

SEQ ID NO: 3972600 - RNA, 19 nt, Human herpesvirus 4 [Epstein-Barr virus]
aggaccugggagggccauc

SEQ ID NO: 3972601 - RNA, 14 nt, Human herpesvirus 4 [Epstein-Barr virus]
aggacggagaagcg

SEQ ID NO: 3972602 - RNA, 15 nt, Human herpesvirus 4 [Epstein-Barr virus]
aggagcaggaggggc

SEQ ID NO: 3972603 - RNA, 17 nt, Human herpesvirus 4 [Epstein-Barr virus]
aggagggcugguugggg

SEQ ID NO: 3972604 - RNA, 23 nt, Human herpesvirus 4 [Epstein-Barr virus]
aggagucugcugcggcuaugcag

SEQ ID NO: 3972605 - RNA, 13 nt, Human herpesvirus 4 [Epstein-Barr virus]
aggaucagggcca

SEQ ID NO: 3972606 - RNA, 16 nt, Human herpesvirus 4 [Epstein-Barr virus]
aggauggaaagggcau

SEQ ID NO: 3972607 - RNA, 15 nt, Human herpesvirus 4 [Epstein-Barr virus]
aggauggcacggucc

SEQ ID NO: 3972608 - RNA, 18 nt, Human herpesvirus 4 [Epstein-Barr virus]
aggcaauggucgccaggg

SEQ ID NO: 3972609 - RNA, 22 nt, Human herpesvirus 4 [Epstein-Barr virus]
aggcacaucuggaccuggacug

SEQ ID NO: 3972610 - RNA, 22 nt, Human herpesvirus 4 [Epstein-Barr virus]
aggcacaucuggcaccuguccu

SEQ ID NO: 3972611 - RNA, 12 nt, Human herpesvirus 4 [Epstein-Barr virus]
aggcaccccauc

SEQ ID NO: 3972612 - RNA, 18 nt, Human herpesvirus 4 [Epstein-Barr virus]
aggcagacaaggccccgc

SEQ ID NO: 3972613 - RNA, 20 nt, Human herpesvirus 4 [Epstein-Barr virus]
aggcauuuuuggugcugccu

SEQ ID NO: 3972614 - RNA, 15 nt, Human herpesvirus 4 [Epstein-Barr virus]
aggccaauuggcacu

SEQ ID NO: 3972615 - RNA, 16 nt, Human herpesvirus 4 [Epstein-Barr virus]
aggccagguagcccag

SEQ ID NO: 3972616 - RNA, 17 nt, Human herpesvirus 4 [Epstein-Barr virus]
aggccaugcgcgcccug

SEQ ID NO: 3972617 - RNA, 15 nt, Human herpesvirus 4 [Epstein-Barr virus]
aggcccagcccccuc

SEQ ID NO: 3972618 - RNA, 17 nt, Human herpesvirus 4 [Epstein-Barr virus]
aggcccagcccccuccc

SEQ ID NO: 3972619 - RNA, 19 nt, Human herpesvirus 4 [Epstein-Barr virus]
aggccccccgcaccagggc

SEQ ID NO: 3972620 - RNA, 18 nt, Human herpesvirus 4 [Epstein-Barr virus]
aggccccuuacuuccaca

SEQ ID NO: 3972621 - RNA, 17 nt, Human herpesvirus 4 [Epstein-Barr virus]
aggccgcugccaggccg

SEQ ID NO: 3972622 - RNA, 13 nt, Human herpesvirus 4 [Epstein-Barr virus]
aggccucuggggu

SEQ ID NO: 3972623 - RNA, 20 nt, Human herpesvirus 4 [Epstein-Barr virus]
aggccugccaaagagccaga

SEQ ID NO: 3972624 - RNA, 15 nt, Human herpesvirus 4 [Epstein-Barr virus]
aggcgcgggucuggg

SEQ ID NO: 3972625 - RNA, 19 nt, Human herpesvirus 4 [Epstein-Barr virus]
aggcgcuguggagagaggc

SEQ ID NO: 3972626 - RNA, 18 nt, Human herpesvirus 4 [Epstein-Barr virus]
aggcggaagaccaggagc

SEQ ID NO: 3972627 - RNA, 19 nt, Human herpesvirus 4 [Epstein-Barr virus]
aggcgggaauggccgccac

SEQ ID NO: 3972628 - RNA, 19 nt, Human herpesvirus 4 [Epstein-Barr virus]
aggcgguuagggaggacac

SEQ ID NO: 3972629 - RNA, 14 nt, Human herpesvirus 4 [Epstein-Barr virus]
aggcguccgccccg

SEQ ID NO: 3972630 - RNA, 17 nt, Human herpesvirus 4 [Epstein-Barr virus]
aggcuacaacaggcugc

SEQ ID NO: 3972631 - RNA, 21 nt, Human herpesvirus 4 [Epstein-Barr virus]
aaaaagcgggccugaguccaa

SEQ ID NO: 3972632 - RNA, 13 nt, Human herpesvirus 4 [Epstein-Barr virus]
aaaaauucagacc

SEQ ID NO: 3972633 - RNA, 17 nt, Human herpesvirus 4 [Epstein-Barr virus]
aaaauauauugcaaaau

SEQ ID NO: 3972634 - RNA, 15 nt, Human herpesvirus 4 [Epstein-Barr virus]
aaaaucaaaacuuua

SEQ ID NO: 3972635 - RNA, 11 nt, Human herpesvirus 4 [Epstein-Barr virus]
aaaaugagcca

SEQ ID NO: 3972636 - RNA, 15 nt, Human herpesvirus 4 [Epstein-Barr virus]
aaacaggagauuggu

SEQ ID NO: 3972637 - RNA, 15 nt, Human herpesvirus 4 [Epstein-Barr virus]
aaacaugggcugcua

SEQ ID NO: 3972638 - RNA, 13 nt, Human herpesvirus 4 [Epstein-Barr virus]
aaacaugguguau

SEQ ID NO: 3972639 - RNA, 17 nt, Human herpesvirus 4 [Epstein-Barr virus]
aaacauggugucuguaa

SEQ ID NO: 3972640 - RNA, 18 nt, Human herpesvirus 4 [Epstein-Barr virus]
aaacauggugucuguaau

SEQ ID NO: 3972641 - RNA, 12 nt, Human herpesvirus 4 [Epstein-Barr virus]
aaacgugauggu

SEQ ID NO: 3972642 - RNA, 15 nt, Human herpesvirus 4 [Epstein-Barr virus]
aaacugaaucuccac

SEQ ID NO: 3972643 - RNA, 18 nt, Human herpesvirus 4 [Epstein-Barr virus]
aaagagacucaggcccuc

SEQ ID NO: 3972644 - RNA, 19 nt, Human herpesvirus 4 [Epstein-Barr virus]
cgccagagacaaggcaggc

SEQ ID NO: 3972645 - RNA, 17 nt, Human herpesvirus 4 [Epstein-Barr virus]
cgccaggcucgcuuuuc

SEQ ID NO: 3972646 - RNA, 16 nt, Human herpesvirus 4 [Epstein-Barr virus]
cgccaugcucagggcc

SEQ ID NO: 3972647 - RNA, 17 nt, Human herpesvirus 4 [Epstein-Barr virus]
cgccaugcucagggcca

SEQ ID NO: 3972648 - RNA, 22 nt, Human herpesvirus 4 [Epstein-Barr virus]
cgcccuaccucuuuuggcuggc

SEQ ID NO: 3972649 - RNA, 19 nt, Human herpesvirus 4 [Epstein-Barr virus]
cgcccuggcgguugagcug

SEQ ID NO: 3972650 - RNA, 14 nt, Human herpesvirus 4 [Epstein-Barr virus]
cgccgcaagcaugg

SEQ ID NO: 3972651 - RNA, 15 nt, Human herpesvirus 4 [Epstein-Barr virus]
cgccgccagcagccc

SEQ ID NO: 3972652 - RNA, 18 nt, Human herpesvirus 4 [Epstein-Barr virus]
cgccuacgcagaggccau

SEQ ID NO: 3972653 - RNA, 21 nt, Human herpesvirus 4 [Epstein-Barr virus]
cgccucagggaucguggacuc

SEQ ID NO: 3972654 - RNA, 17 nt, Human herpesvirus 4 [Epstein-Barr virus]
cgccugacccucuugca

SEQ ID NO: 3972655 - RNA, 20 nt, Human herpesvirus 4 [Epstein-Barr virus]
cgccugagcugccuggugag

SEQ ID NO: 3972656 - RNA, 17 nt, Human herpesvirus 4 [Epstein-Barr virus]
cgccuggggauaagaaa

SEQ ID NO: 3972657 - RNA, 17 nt, Human herpesvirus 4 [Epstein-Barr virus]
cgccuuguuucucagag

SEQ ID NO: 3972658 - RNA, 15 nt, Human herpesvirus 4 [Epstein-Barr virus]
cgcgacauguuucug

SEQ ID NO: 3972659 - RNA, 20 nt, Human herpesvirus 4 [Epstein-Barr virus]
cgcgagcuccgugggcccag

SEQ ID NO: 3972660 - RNA, 13 nt, Human herpesvirus 4 [Epstein-Barr virus]
cgcgcccuccucu

SEQ ID NO: 3972661 - RNA, 23 nt, Human herpesvirus 4 [Epstein-Barr virus]
cgcgcuaccuccuaucacaggga

SEQ ID NO: 3972662 - RNA, 23 nt, Human herpesvirus 4 [Epstein-Barr virus]
cgcgcugcucgccccugguagaa

SEQ ID NO: 3972663 - RNA, 14 nt, Human herpesvirus 4 [Epstein-Barr virus]
cgcggcagaggccu

SEQ ID NO: 3972664 - RNA, 15 nt, Human herpesvirus 4 [Epstein-Barr virus]
cgcggcgacgagcgg

SEQ ID NO: 3972665 - RNA, 16 nt, Human herpesvirus 4 [Epstein-Barr virus]
cgcguagcucugguag

SEQ ID NO: 3972666 - RNA, 14 nt, Human herpesvirus 4 [Epstein-Barr virus]
cgcucuggucgccc

SEQ ID NO: 3972667 - RNA, 15 nt, Human herpesvirus 4 [Epstein-Barr virus]
cgcugggacugccug

SEQ ID NO: 3972668 - RNA, 13 nt, Human herpesvirus 4 [Epstein-Barr virus]
cgcugggccaggu

SEQ ID NO: 3972669 - RNA, 15 nt, Human herpesvirus 4 [Epstein-Barr virus]
cgcuguccgccagga

SEQ ID NO: 3972670 - RNA, 16 nt, Human herpesvirus 4 [Epstein-Barr virus]
cgcuuacagccagaga

SEQ ID NO: 3972671 - RNA, 17 nt, Human herpesvirus 4 [Epstein-Barr virus]
uaccagaagagucauac

SEQ ID NO: 3972672 - RNA, 19 nt, Human herpesvirus 4 [Epstein-Barr virus]
uacccgaaacaagagacga

SEQ ID NO: 3972673 - RNA, 19 nt, Human herpesvirus 4 [Epstein-Barr virus]
uacccuuucuaccaggggc

SEQ ID NO: 3972674 - RNA, 21 nt, Human herpesvirus 4 [Epstein-Barr virus]
uaccucuguuccuucugcucc

SEQ ID NO: 3972675 - RNA, 19 nt, Human herpesvirus 4 [Epstein-Barr virus]
uaccugguauuucugacau

SEQ ID NO: 3972676 - RNA, 19 nt, Human herpesvirus 4 [Epstein-Barr virus]
uaccuucuuucuccuucaa

SEQ ID NO: 3972677 - RNA, 22 nt, Human herpesvirus 4 [Epstein-Barr virus]
uacggugauaacugacagagcc

SEQ ID NO: 3972678 - RNA, 17 nt, Human herpesvirus 4 [Epstein-Barr virus]
uacuaaagaaauaacug

SEQ ID NO: 3972679 - RNA, 16 nt, Human herpesvirus 4 [Epstein-Barr virus]
uacuaacacgcaauaa

SEQ ID NO: 3972680 - RNA, 19 nt, Human herpesvirus 4 [Epstein-Barr virus]
uacuuauuggagaugcucu

SEQ ID NO: 3972681 - RNA, 22 nt, Human herpesvirus 4 [Epstein-Barr virus]
uacuugcucagguuucugggca

SEQ ID NO: 3972682 - RNA, 15 nt, Human herpesvirus 4 [Epstein-Barr virus]
uacuuugggguauuc

SEQ ID NO: 3972683 - RNA, 18 nt, Human herpesvirus 4 [Epstein-Barr virus]
uagaagugugucccccuc

SEQ ID NO: 3972684 - RNA, 13 nt, Human herpesvirus 4 [Epstein-Barr virus]
uagacgaggcaca

SEQ ID NO: 3972685 - RNA, 16 nt, Human herpesvirus 4 [Epstein-Barr virus]
uagagguuuugcuagg

SEQ ID NO: 3972686 - RNA, 15 nt, Human herpesvirus 4 [Epstein-Barr virus]
uagauauagaggcuc

SEQ ID NO: 3972687 - RNA, 20 nt, Human herpesvirus 4 [Epstein-Barr virus]
uagcagaagacuccugccug

SEQ ID NO: 3972688 - RNA, 18 nt, Human herpesvirus 4 [Epstein-Barr virus]
uagccaccguggccaggc

SEQ ID NO: 3972689 - RNA, 22 nt, Human herpesvirus 4 [Epstein-Barr virus]
uagcccaggcacaucuggcacc

SEQ ID NO: 3972690 - RNA, 17 nt, Human herpesvirus 4 [Epstein-Barr virus]
uagccccgggcccagcc

SEQ ID NO: 3972691 - RNA, 17 nt, Human herpesvirus 4 [Epstein-Barr virus]
uagccggccaggcagag

SEQ ID NO: 3972692 - RNA, 20 nt, Human herpesvirus 4 [Epstein-Barr virus]
uagccggcgcuguguggcug

SEQ ID NO: 3972693 - RNA, 18 nt, Human herpesvirus 4 [Epstein-Barr virus]
uagcuauuugaucuuuga

SEQ ID NO: 3972694 - RNA, 19 nt, Human herpesvirus 4 [Epstein-Barr virus]
uaggcacuggacacacaug

SEQ ID NO: 3972695 - RNA, 16 nt, Human herpesvirus 4 [Epstein-Barr virus]
uaguaugaaggcuggc

SEQ ID NO: 3972696 - RNA, 23 nt, Human herpesvirus 4 [Epstein-Barr virus]
uauaauuuaaccaaacagugguc

SEQ ID NO: 3972697 - RNA, 16 nt, Human herpesvirus 4 [Epstein-Barr virus]
uauagcucugcacagg

SEQ ID NO: 3972698 - RNA, 17 nt, Human herpesvirus 4 [Epstein-Barr virus]
uaucagagaggccucug

SEQ ID NO: 3972699 - RNA, 15 nt, Human herpesvirus 4 [Epstein-Barr virus]
uaugccauggccauu

SEQ ID NO: 3972700 - RNA, 13 nt, Human herpesvirus 4 [Epstein-Barr virus]
uauuuugggccag

SEQ ID NO: 3972701 - RNA, 18 nt, Human herpesvirus 4 [Epstein-Barr virus]
ucaacuucagcuccaggg

SEQ ID NO: 3972702 - RNA, 12 nt, Human herpesvirus 4 [Epstein-Barr virus]
ucaagagcuucc

SEQ ID NO: 3972703 - RNA, 22 nt, Human herpesvirus 4 [Epstein-Barr virus]
ucaagauugggugguggcagca

SEQ ID NO: 3972704 - RNA, 15 nt, Human herpesvirus 4 [Epstein-Barr virus]
ucacagaccagcccc

SEQ ID NO: 3972705 - RNA, 17 nt, Human herpesvirus 4 [Epstein-Barr virus]
ucacagaccagccccuc

SEQ ID NO: 3972706 - RNA, 11 nt, Human herpesvirus 4 [Epstein-Barr virus]
ucacagcugcu

SEQ ID NO: 3972707 - RNA, 15 nt, Human herpesvirus 4 [Epstein-Barr virus]
ucaccaggccugcca

SEQ ID NO: 3972708 - RNA, 16 nt, Human herpesvirus 4 [Epstein-Barr virus]
ucacgucacucagcuc

SEQ ID NO: 3972709 - RNA, 18 nt, Human herpesvirus 4 [Epstein-Barr virus]
ucacgucacucagcuccg

SEQ ID NO: 3972710 - RNA, 13 nt, Human herpesvirus 4 [Epstein-Barr virus]
ucagauugccuuc

SEQ ID NO: 3972711 - RNA, 16 nt, Human herpesvirus 4 [Epstein-Barr virus]
ucagauugccuucugu

SEQ ID NO: 3972712 - RNA, 14 nt, Human herpesvirus 4 [Epstein-Barr virus]
ucagcacagccaga

SEQ ID NO: 3972713 - RNA, 17 nt, Human herpesvirus 4 [Epstein-Barr virus]
ucagcuccagggccagc

SEQ ID NO: 3972714 - RNA, 13 nt, Human herpesvirus 4 [Epstein-Barr virus]
ucagcuguguacg

SEQ ID NO: 3972715 - RNA, 22 nt, Human herpesvirus 4 [Epstein-Barr virus]
ucagcuguguacgugccucaga

SEQ ID NO: 3972716 - RNA, 22 nt, Human herpesvirus 4 [Epstein-Barr virus]
ucagcuucgaggucuccccuga

SEQ ID NO: 3972717 - RNA, 18 nt, Human herpesvirus 4 [Epstein-Barr virus]
ucaggaagcuggccaggc

SEQ ID NO: 3972718 - RNA, 15 nt, Human herpesvirus 4 [Epstein-Barr virus]
ucaggaucagggcca

SEQ ID NO: 3972719 - RNA, 15 nt, Human herpesvirus 4 [Epstein-Barr virus]
ucaggccucccaguc

SEQ ID NO: 3972720 - RNA, 22 nt, Human herpesvirus 4 [Epstein-Barr virus]
ucaggcgacaguaacacagggu

SEQ ID NO: 3972721 - RNA, 16 nt, Human herpesvirus 4 [Epstein-Barr virus]
ucaggcuaugaagaag

SEQ ID NO: 3972722 - RNA, 16 nt, Human herpesvirus 4 [Epstein-Barr virus]
ucaguggcccucagaa

SEQ ID NO: 3972723 - RNA, 15 nt, Human herpesvirus 4 [Epstein-Barr virus]
ucauauguaugccuu

SEQ ID NO: 3972724 - RNA, 19 nt, Human herpesvirus 4 [Epstein-Barr virus]
ucaucaguaaaucugucuc

SEQ ID NO: 3972725 - RNA, 14 nt, Human herpesvirus 4 [Epstein-Barr virus]
ucauccgccacccc

SEQ ID NO: 3972726 - RNA, 19 nt, Human herpesvirus 4 [Epstein-Barr virus]
ucaucugaaaaugacaggc

SEQ ID NO: 3972727 - RNA, 14 nt, Human herpesvirus 4 [Epstein-Barr virus]
ucaugcgugaccac

SEQ ID NO: 3972728 - RNA, 20 nt, Human herpesvirus 4 [Epstein-Barr virus]
uccaacauuaaagccuccuc

SEQ ID NO: 3972729 - RNA, 15 nt, Human herpesvirus 4 [Epstein-Barr virus]
uccaagcggcacaga

SEQ ID NO: 3972730 - RNA, 22 nt, Human herpesvirus 4 [Epstein-Barr virus]
uccaauagaggagcuccgagag

SEQ ID NO: 3972731 - RNA, 12 nt, Human herpesvirus 4 [Epstein-Barr virus]
uccacagcccca

SEQ ID NO: 3972732 - RNA, 22 nt, Human herpesvirus 4 [Epstein-Barr virus]
uccacggggagacuuaugcuaa

SEQ ID NO: 3972733 - RNA, 22 nt, Human herpesvirus 4 [Epstein-Barr virus]
uccacugccccgguccccccag

SEQ ID NO: 3972734 - RNA, 17 nt, Human herpesvirus 4 [Epstein-Barr virus]
uccagaaaaugccgggc

SEQ ID NO: 3972735 - RNA, 23 nt, Human herpesvirus 4 [Epstein-Barr virus]
uccagacuccggggguccagccg

SEQ ID NO: 3972736 - RNA, 23 nt, Human herpesvirus 4 [Epstein-Barr virus]
uccagcgcucuggucgcccccuc

SEQ ID NO: 3972737 - RNA, 16 nt, Human herpesvirus 4 [Epstein-Barr virus]
uccaggagucugcugc

SEQ ID NO: 3972738 - RNA, 14 nt, Human herpesvirus 4 [Epstein-Barr virus]
uccaggguccagga

SEQ ID NO: 3972739 - RNA, 16 nt, Human herpesvirus 4 [Epstein-Barr virus]
uccaggguccaggaga

SEQ ID NO: 3972740 - RNA, 18 nt, Human herpesvirus 4 [Epstein-Barr virus]
uccaguuuuuaugugccu

SEQ ID NO: 3972741 - RNA, 13 nt, Human herpesvirus 4 [Epstein-Barr virus]
uccaucauguguu

SEQ ID NO: 3972742 - RNA, 18 nt, Human herpesvirus 4 [Epstein-Barr virus]
uccaugacgcugcugcua

SEQ ID NO: 3972743 - RNA, 23 nt, Human herpesvirus 4 [Epstein-Barr virus]
ucccagggccggaaccugagccu

SEQ ID NO: 3972744 - RNA, 22 nt, Human herpesvirus 4 [Epstein-Barr virus]
ucccaguuguuauucccaccuc

SEQ ID NO: 3972745 - RNA, 18 nt, Human herpesvirus 4 [Epstein-Barr virus]
ucccauaccuacaccacc

SEQ ID NO: 3972746 - RNA, 23 nt, Human herpesvirus 4 [Epstein-Barr virus]
uccccccgccuuugggcacccca

SEQ ID NO: 3972747 - RNA, 12 nt, Human herpesvirus 4 [Epstein-Barr virus]
ucccccuagccc

SEQ ID NO: 3972748 - RNA, 19 nt, Human herpesvirus 4 [Epstein-Barr virus]
uccccgagggugaggccca

SEQ ID NO: 3972749 - RNA, 14 nt, Human herpesvirus 4 [Epstein-Barr virus]
uccccggccucccg

SEQ ID NO: 3972750 - RNA, 18 nt, Human herpesvirus 4 [Epstein-Barr virus]
uccccggggacaccugca

SEQ ID NO: 3972751 - RNA, 23 nt, Human herpesvirus 4 [Epstein-Barr virus]
ucccgagcggccuccgccgucca

SEQ ID NO: 3972752 - RNA, 15 nt, Human herpesvirus 4 [Epstein-Barr virus]
ucccgggcaaacagg

SEQ ID NO: 3972753 - RNA, 21 nt, Human herpesvirus 4 [Epstein-Barr virus]
ucccgggcaaacagggcagag

SEQ ID NO: 3972754 - RNA, 24 nt, Human herpesvirus 4 [Epstein-Barr virus]
uccgacgccugcggacucaggcca

SEQ ID NO: 3972755 - RNA, 14 nt, Human herpesvirus 4 [Epstein-Barr virus]
uccgagaggauggc

SEQ ID NO: 3972756 - RNA, 12 nt, Human herpesvirus 4 [Epstein-Barr virus]
uccgccaccucc

SEQ ID NO: 3972757 - RNA, 16 nt, Human herpesvirus 4 [Epstein-Barr virus]
uccggcugcccgucuc

SEQ ID NO: 3972758 - RNA, 14 nt, Human herpesvirus 4 [Epstein-Barr virus]
uccgucagccaggg

SEQ ID NO: 3972759 - RNA, 20 nt, Human herpesvirus 4 [Epstein-Barr virus]
gaugguggggcuuguuucaa

SEQ ID NO: 3972760 - RNA, 18 nt, Human herpesvirus 4 [Epstein-Barr virus]
gaugguguuggagacggu

SEQ ID NO: 3972761 - RNA, 17 nt, Human herpesvirus 4 [Epstein-Barr virus]
gaugucggggcugcugg

SEQ ID NO: 3972762 - RNA, 16 nt, Human herpesvirus 4 [Epstein-Barr virus]
gaugugcccaagccug

SEQ ID NO: 3972763 - RNA, 16 nt, Human herpesvirus 4 [Epstein-Barr virus]
gauuuccgucagccag

SEQ ID NO: 3972764 - RNA, 21 nt, Human herpesvirus 4 [Epstein-Barr virus]
gcaacugcguccucuaccugg

SEQ ID NO: 3972765 - RNA, 12 nt, Human herpesvirus 4 [Epstein-Barr virus]
gcaagauggaga

SEQ ID NO: 3972766 - RNA, 20 nt, Human herpesvirus 4 [Epstein-Barr virus]
gcaagcagcaccugucccug

SEQ ID NO: 3972767 - RNA, 15 nt, Human herpesvirus 4 [Epstein-Barr virus]
gcaagucaggauucu

SEQ ID NO: 3972768 - RNA, 21 nt, Human herpesvirus 4 [Epstein-Barr virus]
gcaauggcacggaugccuggc

SEQ ID NO: 3972769 - RNA, 19 nt, Human herpesvirus 4 [Epstein-Barr virus]
gcacacacucccuuagcca

SEQ ID NO: 3972770 - RNA, 14 nt, Human herpesvirus 4 [Epstein-Barr virus]
gcaccagggccagg

SEQ ID NO: 3972771 - RNA, 14 nt, Human herpesvirus 4 [Epstein-Barr virus]
gcacccggggaacc

SEQ ID NO: 3972772 - RNA, 22 nt, Human herpesvirus 4 [Epstein-Barr virus]
gcaccgauagcauggccgccag

SEQ ID NO: 3972773 - RNA, 19 nt, Human herpesvirus 4 [Epstein-Barr virus]
gcaccggagccaccacagc

SEQ ID NO: 3972774 - RNA, 22 nt, Human herpesvirus 4 [Epstein-Barr virus]
gcaccuccucgaaggugcagcu

SEQ ID NO: 3972775 - RNA, 23 nt, Human herpesvirus 4 [Epstein-Barr virus]
gcaccuguccuugucugcugcca

SEQ ID NO: 3972776 - RNA, 17 nt, Human herpesvirus 4 [Epstein-Barr virus]
gcaccuugccggccacc

SEQ ID NO: 3972777 - RNA, 17 nt, Human herpesvirus 4 [Epstein-Barr virus]
gcacgguccagaagcag

SEQ ID NO: 3972778 - RNA, 23 nt, Human herpesvirus 4 [Epstein-Barr virus]
gcacuccaagugcaacaaucugg

SEQ ID NO: 3972779 - RNA, 22 nt, Human herpesvirus 4 [Epstein-Barr virus]
gcacucuuaccuuccucugccc

SEQ ID NO: 3972780 - RNA, 22 nt, Human herpesvirus 4 [Epstein-Barr virus]
gcacugcguccaccuggccacc

SEQ ID NO: 3972781 - RNA, 24 nt, Human herpesvirus 4 [Epstein-Barr virus]
gcagaagagccgcuccguggcccc

SEQ ID NO: 3972782 - RNA, 22 nt, Human herpesvirus 4 [Epstein-Barr virus]
gcagacuccgaauauccccaaa

SEQ ID NO: 3972783 - RNA, 17 nt, Human herpesvirus 4 [Epstein-Barr virus]
gcagagguugggccacg

SEQ ID NO: 3972784 - RNA, 18 nt, Human herpesvirus 4 [Epstein-Barr virus]
gcagaguaauugcagugg

SEQ ID NO: 3972785 - RNA, 23 nt, Human herpesvirus 4 [Epstein-Barr virus]
gcagauagccggccaggcagagg

SEQ ID NO: 3972786 - RNA, 20 nt, Human herpesvirus 4 [Epstein-Barr virus]
gcagauuuccgucagccagg

SEQ ID NO: 3972787 - RNA, 18 nt, Human herpesvirus 4 [Epstein-Barr virus]
gcagcagacaaggacagg

SEQ ID NO: 3972788 - RNA, 22 nt, Human herpesvirus 4 [Epstein-Barr virus]
gcagccacguccagacuccggg

SEQ ID NO: 3972789 - RNA, 20 nt, Human herpesvirus 4 [Epstein-Barr virus]
gcagcccggccgaggccugc

SEQ ID NO: 3972790 - RNA, 22 nt, Human herpesvirus 4 [Epstein-Barr virus]
gcagcuagagcggguggaggag

SEQ ID NO: 3972791 - RNA, 10 nt, Human herpesvirus 4 [Epstein-Barr virus]
gcagcuccgc

SEQ ID NO: 3972792 - RNA, 11 nt, Human herpesvirus 4 [Epstein-Barr virus]
gcagcuccgcc

SEQ ID NO: 3972793 - RNA, 23 nt, Human herpesvirus 4 [Epstein-Barr virus]
gcagcuuuuggccuucuuccuag

SEQ ID NO: 3972794 - RNA, 21 nt, Human herpesvirus 4 [Epstein-Barr virus]
gcaggagcgggaggggcagga

SEQ ID NO: 3972795 - RNA, 15 nt, Human herpesvirus 4 [Epstein-Barr virus]
gcaggccccccgcac

SEQ ID NO: 3972796 - RNA, 22 nt, Human herpesvirus 4 [Epstein-Barr virus]
gcaggccccccgcaccagggcc

SEQ ID NO: 3972797 - RNA, 14 nt, Human herpesvirus 4 [Epstein-Barr virus]
gcaggccuggacag

SEQ ID NO: 3972798 - RNA, 16 nt, Human herpesvirus 4 [Epstein-Barr virus]
gcaggcuacaacaggc

SEQ ID NO: 3972799 - RNA, 16 nt, Human herpesvirus 4 [Epstein-Barr virus]
gcagggcaaagccaca

SEQ ID NO: 3972800 - RNA, 12 nt, Human herpesvirus 4 [Epstein-Barr virus]
gcaggggcgccg

SEQ ID NO: 3972801 - RNA, 15 nt, Human herpesvirus 4 [Epstein-Barr virus]
gcagguaauaaagcu

SEQ ID NO: 3972802 - RNA, 18 nt, Human herpesvirus 4 [Epstein-Barr virus]
gcagguggcugcugccaa

SEQ ID NO: 3972803 - RNA, 15 nt, Human herpesvirus 4 [Epstein-Barr virus]
gcaguccuugugucu

SEQ ID NO: 3972804 - RNA, 23 nt, Human herpesvirus 4 [Epstein-Barr virus]
gcagucucaaucucucccacgga

SEQ ID NO: 3972805 - RNA, 18 nt, Human herpesvirus 4 [Epstein-Barr virus]
gcagugggccucucuggc

SEQ ID NO: 3972806 - RNA, 17 nt, Human herpesvirus 4 [Epstein-Barr virus]
gcagugucccugcugcc

SEQ ID NO: 3972807 - RNA, 13 nt, Human herpesvirus 4 [Epstein-Barr virus]
gcauaaugggagg

SEQ ID NO: 3972808 - RNA, 16 nt, Human herpesvirus 4 [Epstein-Barr virus]
gcaucaugcgugacca

SEQ ID NO: 3972809 - RNA, 21 nt, Human herpesvirus 4 [Epstein-Barr virus]
gcaugagccacaggcauugcu

SEQ ID NO: 3972810 - RNA, 20 nt, Human herpesvirus 4 [Epstein-Barr virus]
gcaugagcuccucuccaaau

SEQ ID NO: 3972811 - RNA, 14 nt, Human herpesvirus 4 [Epstein-Barr virus]
gcaugcaggucagg

SEQ ID NO: 3972812 - RNA, 17 nt, Human herpesvirus 4 [Epstein-Barr virus]
gcaugguggcuucuuag

SEQ ID NO: 3972813 - RNA, 19 nt, Human herpesvirus 4 [Epstein-Barr virus]
gcauuaauguccagugggg

SEQ ID NO: 3972814 - RNA, 17 nt, Human herpesvirus 4 [Epstein-Barr virus]
gcauucuacuaggaaac

SEQ ID NO: 3972815 - RNA, 17 nt, Human herpesvirus 4 [Epstein-Barr virus]
gcauuggcugcaaaggg

SEQ ID NO: 3972816 - RNA, 20 nt, Human herpesvirus 4 [Epstein-Barr virus]
gcauuuuuggugcugccugg

SEQ ID NO: 3972817 - RNA, 23 nt, Human herpesvirus 4 [Epstein-Barr virus]
gccaaaauuggugccuugcucuc

SEQ ID NO: 3972818 - RNA, 19 nt, Human herpesvirus 4 [Epstein-Barr virus]
gccaaccugccucucuuau

SEQ ID NO: 3972819 - RNA, 17 nt, Human herpesvirus 4 [Epstein-Barr virus]
gccaaccugcucucucu

SEQ ID NO: 3972820 - RNA, 15 nt, Human herpesvirus 4 [Epstein-Barr virus]
gccaagacauagaga

SEQ ID NO: 3972821 - RNA, 16 nt, Human herpesvirus 4 [Epstein-Barr virus]
gccacaaagagggggc

SEQ ID NO: 3972822 - RNA, 16 nt, Human herpesvirus 4 [Epstein-Barr virus]
gccacacugucugucu

SEQ ID NO: 3972823 - RNA, 18 nt, Human herpesvirus 4 [Epstein-Barr virus]
gccaccggggaggccagg

SEQ ID NO: 3972824 - RNA, 17 nt, Human herpesvirus 4 [Epstein-Barr virus]
gccaccguggccaggcc

SEQ ID NO: 3972825 - RNA, 19 nt, Human herpesvirus 4 [Epstein-Barr virus]
gccacggcgucaaacaggu

SEQ ID NO: 3972826 - RNA, 19 nt, Human herpesvirus 4 [Epstein-Barr virus]
gccagagaggcccacugca

SEQ ID NO: 3972827 - RNA, 17 nt, Human herpesvirus 4 [Epstein-Barr virus]
gccagcgccuccucgca

SEQ ID NO: 3972828 - RNA, 14 nt, Human herpesvirus 4 [Epstein-Barr virus]
gccagcgccuugau

SEQ ID NO: 3972829 - RNA, 22 nt, Human herpesvirus 4 [Epstein-Barr virus]
gccaggcucgcggaagagccca

SEQ ID NO: 3972830 - RNA, 15 nt, Human herpesvirus 4 [Epstein-Barr virus]
gccaguaggauauua

SEQ ID NO: 3972831 - RNA, 15 nt, Human herpesvirus 4 [Epstein-Barr virus]
gccaucgggacagau

SEQ ID NO: 3972832 - RNA, 16 nt, Human herpesvirus 4 [Epstein-Barr virus]
gccaucucugauuaua

SEQ ID NO: 3972833 - RNA, 16 nt, Human herpesvirus 4 [Epstein-Barr virus]
gccaugaccagcagca

SEQ ID NO: 3972834 - RNA, 19 nt, Human herpesvirus 4 [Epstein-Barr virus]
gcccacgucuuuaccaccu

SEQ ID NO: 3972835 - RNA, 18 nt, Human herpesvirus 4 [Epstein-Barr virus]
gcccagcagauccagggc

SEQ ID NO: 3972836 - RNA, 22 nt, Human herpesvirus 4 [Epstein-Barr virus]
gcccaggcacaucuggcaccug

SEQ ID NO: 3972837 - RNA, 18 nt, Human herpesvirus 4 [Epstein-Barr virus]
gcccagggacauccccag

SEQ ID NO: 3972838 - RNA, 15 nt, Human herpesvirus 4 [Epstein-Barr virus]
gcccagugcacccag

SEQ ID NO: 3972839 - RNA, 20 nt, Human herpesvirus 4 [Epstein-Barr virus]
gcccccaaaaguagaggcuc

SEQ ID NO: 3972840 - RNA, 19 nt, Human herpesvirus 4 [Epstein-Barr virus]
gcccccgccagcgccuccu

SEQ ID NO: 3972841 - RNA, 22 nt, Human herpesvirus 4 [Epstein-Barr virus]
gcccccucuuuguggccuuccu

SEQ ID NO: 3972842 - RNA, 14 nt, Human herpesvirus 4 [Epstein-Barr virus]
gccccggcuggcca

SEQ ID NO: 3972843 - RNA, 20 nt, Human herpesvirus 4 [Epstein-Barr virus]
gccccuguccacugccccgg

SEQ ID NO: 3972844 - RNA, 19 nt, Human herpesvirus 4 [Epstein-Barr virus]
gcccgacgaacuccuccag

SEQ ID NO: 3972845 - RNA, 17 nt, Human herpesvirus 4 [Epstein-Barr virus]
gcccggccucgccuucu

SEQ ID NO: 3972846 - RNA, 19 nt, Human herpesvirus 4 [Epstein-Barr virus]
uccuacacacaucagaccu

SEQ ID NO: 3972847 - RNA, 16 nt, Human herpesvirus 4 [Epstein-Barr virus]
uccuacgcgcuaccuc

SEQ ID NO: 3972848 - RNA, 13 nt, Human herpesvirus 4 [Epstein-Barr virus]
uccucagccucca

SEQ ID NO: 3972849 - RNA, 19 nt, Human herpesvirus 4 [Epstein-Barr virus]
uccucauuggcuuugcccu

SEQ ID NO: 3972850 - RNA, 18 nt, Human herpesvirus 4 [Epstein-Barr virus]
uccucugggccgcccggc

SEQ ID NO: 3972851 - RNA, 22 nt, Human herpesvirus 4 [Epstein-Barr virus]
uccugauacuagcguacagaag

SEQ ID NO: 3972852 - RNA, 15 nt, Human herpesvirus 4 [Epstein-Barr virus]
uccugccugccucug

SEQ ID NO: 3972853 - RNA, 19 nt, Human herpesvirus 4 [Epstein-Barr virus]
uccugcucauuauugcucu

SEQ ID NO: 3972854 - RNA, 23 nt, Human herpesvirus 4 [Epstein-Barr virus]
uccuguacaaacccaacaaugug

SEQ ID NO: 3972855 - RNA, 16 nt, Human herpesvirus 4 [Epstein-Barr virus]
uccuugucugcugcca

SEQ ID NO: 3972856 - RNA, 15 nt, Human herpesvirus 4 [Epstein-Barr virus]
uccuugugcagcuua

SEQ ID NO: 3972857 - RNA, 17 nt, Human herpesvirus 4 [Epstein-Barr virus]
uccuuugcggcaucacc

SEQ ID NO: 3972858 - RNA, 23 nt, Human herpesvirus 4 [Epstein-Barr virus]
ucgaugauugagaaugccaagag

SEQ ID NO: 3972859 - RNA, 22 nt, Human herpesvirus 4 [Epstein-Barr virus]
ucgcccacacagcgccagcagg

SEQ ID NO: 3972860 - RNA, 18 nt, Human herpesvirus 4 [Epstein-Barr virus]
ucgcccccucugccuccg

SEQ ID NO: 3972861 - RNA, 16 nt, Human herpesvirus 4 [Epstein-Barr virus]
ucgccuucuccucagc

SEQ ID NO: 3972862 - RNA, 15 nt, Human herpesvirus 4 [Epstein-Barr virus]
ucgcugcugcagcua

SEQ ID NO: 3972863 - RNA, 16 nt, Human herpesvirus 4 [Epstein-Barr virus]
ucggacgaggaggaag

SEQ ID NO: 3972864 - RNA, 14 nt, Human herpesvirus 4 [Epstein-Barr virus]
ucggcccuccgcau

SEQ ID NO: 3972865 - RNA, 22 nt, Human herpesvirus 4 [Epstein-Barr virus]
ucgggauccgcaggggcgccga

SEQ ID NO: 3972866 - RNA, 18 nt, Human herpesvirus 4 [Epstein-Barr virus]
ucgggcaagauggagagg

SEQ ID NO: 3972867 - RNA, 16 nt, Human herpesvirus 4 [Epstein-Barr virus]
ucggggcaugcugccc

SEQ ID NO: 3972868 - RNA, 14 nt, Human herpesvirus 4 [Epstein-Barr virus]
ucgggggccugugu

SEQ ID NO: 3972869 - RNA, 17 nt, Human herpesvirus 4 [Epstein-Barr virus]
ucggucaaguaccagcu

SEQ ID NO: 3972870 - RNA, 15 nt, Human herpesvirus 4 [Epstein-Barr virus]
ucggugcgcagaccc

SEQ ID NO: 3972871 - RNA, 15 nt, Human herpesvirus 4 [Epstein-Barr virus]
ucguagagaucaggc

SEQ ID NO: 3972872 - RNA, 20 nt, Human herpesvirus 4 [Epstein-Barr virus]
ucguagucauccgaggcuga

SEQ ID NO: 3972873 - RNA, 20 nt, Human herpesvirus 4 [Epstein-Barr virus]
ucgucaggagggcagagagg

SEQ ID NO: 3972874 - RNA, 13 nt, Human herpesvirus 4 [Epstein-Barr virus]
ucgugcucuucau

SEQ ID NO: 3972875 - RNA, 20 nt, Human herpesvirus 4 [Epstein-Barr virus]
ucguguuggauuggcuguca

SEQ ID NO: 3972876 - RNA, 18 nt, Human herpesvirus 4 [Epstein-Barr virus]
ucuaacugugucccacuc

SEQ ID NO: 3972877 - RNA, 16 nt, Human herpesvirus 4 [Epstein-Barr virus]
ucuagcaggugcacca

SEQ ID NO: 3972878 - RNA, 19 nt, Human herpesvirus 4 [Epstein-Barr virus]
ucuagcaggugcaccagcu

SEQ ID NO: 3972879 - RNA, 14 nt, Human herpesvirus 4 [Epstein-Barr virus]
ucuagcaucugcua

SEQ ID NO: 3972880 - RNA, 14 nt, Human herpesvirus 4 [Epstein-Barr virus]
ucucagaugcagug

SEQ ID NO: 3972881 - RNA, 19 nt, Human herpesvirus 4 [Epstein-Barr virus]
ucucagggacaacagguca

SEQ ID NO: 3972882 - RNA, 21 nt, Human herpesvirus 4 [Epstein-Barr virus]
ucucaugggggaaugagggaa

SEQ ID NO: 3972883 - RNA, 22 nt, Human herpesvirus 4 [Epstein-Barr virus]
ucucaugggggaaugagggaaa

SEQ ID NO: 3972884 - RNA, 14 nt, Human herpesvirus 4 [Epstein-Barr virus]
ucuccaggcuccug

SEQ ID NO: 3972885 - RNA, 15 nt, Human herpesvirus 4 [Epstein-Barr virus]
ucuccaucagggcca

SEQ ID NO: 3972886 - RNA, 15 nt, Human herpesvirus 4 [Epstein-Barr virus]
ucuccauucccagcc

SEQ ID NO: 3972887 - RNA, 15 nt, Human herpesvirus 4 [Epstein-Barr virus]
ucucccucagagucu

SEQ ID NO: 3972888 - RNA, 15 nt, Human herpesvirus 4 [Epstein-Barr virus]
ucuccugccugccuc

SEQ ID NO: 3972889 - RNA, 22 nt, Human herpesvirus 4 [Epstein-Barr virus]
ucuccugccugccucugcucug

SEQ ID NO: 3972890 - RNA, 17 nt, Human herpesvirus 4 [Epstein-Barr virus]
ucucggcuguuuguacu

SEQ ID NO: 3972891 - RNA, 15 nt, Human herpesvirus 4 [Epstein-Barr virus]
ucugacgaggggcca

SEQ ID NO: 3972892 - RNA, 20 nt, Human herpesvirus 4 [Epstein-Barr virus]
ucugcccccugucucuuucu

SEQ ID NO: 3972893 - RNA, 22 nt, Human herpesvirus 4 [Epstein-Barr virus]
ucugccccucagccugcuccug

SEQ ID NO: 3972894 - RNA, 19 nt, Human herpesvirus 4 [Epstein-Barr virus]
ucugcggaucagucgcugg

SEQ ID NO: 3972895 - RNA, 13 nt, Human herpesvirus 4 [Epstein-Barr virus]
ucugcuggacucc

SEQ ID NO: 3972896 - RNA, 14 nt, Human herpesvirus 4 [Epstein-Barr virus]
ucugcuucuggacc

SEQ ID NO: 3972897 - RNA, 23 nt, Human herpesvirus 4 [Epstein-Barr virus]
ucuggaacauuugaggaggcaca

SEQ ID NO: 3972898 - RNA, 20 nt, Human herpesvirus 4 [Epstein-Barr virus]
ucuggccgguggauccucca

SEQ ID NO: 3972899 - RNA, 13 nt, Human herpesvirus 4 [Epstein-Barr virus]
ucuggcugugcug

SEQ ID NO: 3972900 - RNA, 14 nt, Human herpesvirus 4 [Epstein-Barr virus]
ucuggcugugcuga

SEQ ID NO: 3972901 - RNA, 15 nt, Human herpesvirus 4 [Epstein-Barr virus]
ucuggucgcccccuc

SEQ ID NO: 3972902 - RNA, 12 nt, Human herpesvirus 4 [Epstein-Barr virus]
ucuguuuucccc

SEQ ID NO: 3972903 - RNA, 22 nt, Human herpesvirus 4 [Epstein-Barr virus]
ucuucauucuugcuauccugac

SEQ ID NO: 3972904 - RNA, 21 nt, Human herpesvirus 4 [Epstein-Barr virus]
ucuuccugucggcucucuuug

SEQ ID NO: 3972905 - RNA, 13 nt, Human herpesvirus 4 [Epstein-Barr virus]
ucuucuucucccu

SEQ ID NO: 3972906 - RNA, 20 nt, Human herpesvirus 4 [Epstein-Barr virus]
ucuugucggacgaggaggaa

SEQ ID NO: 3972907 - RNA, 19 nt, Human herpesvirus 4 [Epstein-Barr virus]
ucuuuugcucuuaaccauu

SEQ ID NO: 3972908 - RNA, 16 nt, Human herpesvirus 4 [Epstein-Barr virus]
ugaaaacugccuccuc

SEQ ID NO: 3972909 - RNA, 20 nt, Human herpesvirus 4 [Epstein-Barr virus]
ugaaaccacgccugcuucac

SEQ ID NO: 3972910 - RNA, 12 nt, Human herpesvirus 4 [Epstein-Barr virus]
ugaacaccacca

SEQ ID NO: 3972911 - RNA, 21 nt, Human herpesvirus 4 [Epstein-Barr virus]
ugaagcagaugugcccaagcc

SEQ ID NO: 3972912 - RNA, 13 nt, Human herpesvirus 4 [Epstein-Barr virus]
ugaaucuccaccu

SEQ ID NO: 3972913 - RNA, 16 nt, Human herpesvirus 4 [Epstein-Barr virus]
ugaaugcacgccaaca

SEQ ID NO: 3972914 - RNA, 21 nt, Human herpesvirus 4 [Epstein-Barr virus]
ugacagcuacgaaacugacca

SEQ ID NO: 3972915 - RNA, 21 nt, Human herpesvirus 4 [Epstein-Barr virus]
ugaccacucaggaagcuggcc

SEQ ID NO: 3972916 - RNA, 13 nt, Human herpesvirus 4 [Epstein-Barr virus]
ugaccaugcccag

SEQ ID NO: 3972917 - RNA, 22 nt, Human herpesvirus 4 [Epstein-Barr virus]
ugacgcuccaggaucucccgcg

SEQ ID NO: 3972918 - RNA, 16 nt, Human herpesvirus 4 [Epstein-Barr virus]
ugacuaggcaccacuu

SEQ ID NO: 3972919 - RNA, 13 nt, Human herpesvirus 4 [Epstein-Barr virus]
ugacuaugaggag

SEQ ID NO: 3972920 - RNA, 23 nt, Human herpesvirus 4 [Epstein-Barr virus]
ugacuguuuguggcggcaucaug

SEQ ID NO: 3972921 - RNA, 16 nt, Human herpesvirus 4 [Epstein-Barr virus]
ugacuuggccccugug

SEQ ID NO: 3972922 - RNA, 14 nt, Human herpesvirus 4 [Epstein-Barr virus]
ugagagccuaccca

SEQ ID NO: 3972923 - RNA, 20 nt, Human herpesvirus 4 [Epstein-Barr virus]
ugagcagggcuucguccagg

SEQ ID NO: 3972924 - RNA, 14 nt, Human herpesvirus 4 [Epstein-Barr virus]
ugagccacacccac

SEQ ID NO: 3972925 - RNA, 20 nt, Human herpesvirus 4 [Epstein-Barr virus]
ugagggcuuugccugccuaa

SEQ ID NO: 3972926 - RNA, 14 nt, Human herpesvirus 4 [Epstein-Barr virus]
ugaggugccacaga

SEQ ID NO: 3972927 - RNA, 12 nt, Human herpesvirus 4 [Epstein-Barr virus]
ugagucagccuu

SEQ ID NO: 3972928 - RNA, 16 nt, Human herpesvirus 4 [Epstein-Barr virus]
ugagucugcuggacuc

SEQ ID NO: 3972929 - RNA, 23 nt, Human herpesvirus 4 [Epstein-Barr virus]
ugagucugcuggacuccgaggac

SEQ ID NO: 3972930 - RNA, 15 nt, Human herpesvirus 4 [Epstein-Barr virus]
ugagugcccagggca

SEQ ID NO: 3972931 - RNA, 14 nt, Human herpesvirus 4 [Epstein-Barr virus]
ugauaaaccuuaaa

SEQ ID NO: 3972932 - RNA, 13 nt, Human herpesvirus 4 [Epstein-Barr virus]
ugauaaugaugag

SEQ ID NO: 3972933 - RNA, 15 nt, Human herpesvirus 4 [Epstein-Barr virus]
ugaugacgccgagac

SEQ ID NO: 3972934 - RNA, 23 nt, Human herpesvirus 4 [Epstein-Barr virus]
gcccggggaaaagagagcugaug

SEQ ID NO: 3972935 - RNA, 16 nt, Human herpesvirus 4 [Epstein-Barr virus]
gcccguccccugaccg

SEQ ID NO: 3972936 - RNA, 14 nt, Human herpesvirus 4 [Epstein-Barr virus]
gcccuccucugggc

SEQ ID NO: 3972937 - RNA, 21 nt, Human herpesvirus 4 [Epstein-Barr virus]
gcccugucaccaggccugcca

SEQ ID NO: 3972938 - RNA, 23 nt, Human herpesvirus 4 [Epstein-Barr virus]
gcccuuggaacugacgggcacug

SEQ ID NO: 3972939 - RNA, 22 nt, Human herpesvirus 4 [Epstein-Barr virus]
gcccuuuuaacauuggcagcag

SEQ ID NO: 3972940 - RNA, 15 nt, Human herpesvirus 4 [Epstein-Barr virus]
gccgaagaagggagg

SEQ ID NO: 3972941 - RNA, 15 nt, Human herpesvirus 4 [Epstein-Barr virus]
gccgagaccuaugua

SEQ ID NO: 3972942 - RNA, 23 nt, Human herpesvirus 4 [Epstein-Barr virus]
gccgagaucucuugcgcccaggc

SEQ ID NO: 3972943 - RNA, 13 nt, Human herpesvirus 4 [Epstein-Barr virus]
gccgaguggcaga

SEQ ID NO: 3972944 - RNA, 16 nt, Human herpesvirus 4 [Epstein-Barr virus]
gccgccaugcucaggg

SEQ ID NO: 3972945 - RNA, 21 nt, Human herpesvirus 4 [Epstein-Barr virus]
gccgccggauggccuaugggu

SEQ ID NO: 3972946 - RNA, 18 nt, Human herpesvirus 4 [Epstein-Barr virus]
gccgcuccguggccccgg

SEQ ID NO: 3972947 - RNA, 14 nt, Human herpesvirus 4 [Epstein-Barr virus]
gccgcuucagacag

SEQ ID NO: 3972948 - RNA, 13 nt, Human herpesvirus 4 [Epstein-Barr virus]
gccggagggacag

SEQ ID NO: 3972949 - RNA, 14 nt, Human herpesvirus 4 [Epstein-Barr virus]
gccggccaggcaga

SEQ ID NO: 3972950 - RNA, 15 nt, Human herpesvirus 4 [Epstein-Barr virus]
gccggccugcuggcc

SEQ ID NO: 3972951 - RNA, 18 nt, Human herpesvirus 4 [Epstein-Barr virus]
gccggcgcuguguggcug

SEQ ID NO: 3972952 - RNA, 13 nt, Human herpesvirus 4 [Epstein-Barr virus]
gccggugcugcca

SEQ ID NO: 3972953 - RNA, 12 nt, Human herpesvirus 4 [Epstein-Barr virus]
gccgucauucca

SEQ ID NO: 3972954 - RNA, 13 nt, Human herpesvirus 4 [Epstein-Barr virus]
gccguccucugga

SEQ ID NO: 3972955 - RNA, 14 nt, Human herpesvirus 4 [Epstein-Barr virus]
gccgucuggcaggg

SEQ ID NO: 3972956 - RNA, 17 nt, Human herpesvirus 4 [Epstein-Barr virus]
gccguggcgccugggga

SEQ ID NO: 3972957 - RNA, 17 nt, Human herpesvirus 4 [Epstein-Barr virus]
gccuacgaggcccuggc

SEQ ID NO: 3972958 - RNA, 18 nt, Human herpesvirus 4 [Epstein-Barr virus]
gccuccagcucggccagc

SEQ ID NO: 3972959 - RNA, 20 nt, Human herpesvirus 4 [Epstein-Barr virus]
gccuccagcucggccagcag

SEQ ID NO: 3972960 - RNA, 15 nt, Human herpesvirus 4 [Epstein-Barr virus]
gccuccucccaacgc

SEQ ID NO: 3972961 - RNA, 21 nt, Human herpesvirus 4 [Epstein-Barr virus]
gccucgaguaggugccuccag

SEQ ID NO: 3972962 - RNA, 22 nt, Human herpesvirus 4 [Epstein-Barr virus]
gccucgccuucuccucagccuc

SEQ ID NO: 3972963 - RNA, 23 nt, Human herpesvirus 4 [Epstein-Barr virus]
gccucuacgccaggcucgcuuuu

SEQ ID NO: 3972964 - RNA, 20 nt, Human herpesvirus 4 [Epstein-Barr virus]
gccucucuuaugccuguggc

SEQ ID NO: 3972965 - RNA, 21 nt, Human herpesvirus 4 [Epstein-Barr virus]
gccucugccgggaggugcugg

SEQ ID NO: 3972966 - RNA, 19 nt, Human herpesvirus 4 [Epstein-Barr virus]
gccucuuguguucuugccg

SEQ ID NO: 3972967 - RNA, 18 nt, Human herpesvirus 4 [Epstein-Barr virus]
gccugaauuccccugccu

SEQ ID NO: 3972968 - RNA, 15 nt, Human herpesvirus 4 [Epstein-Barr virus]
gccugagcugccugg

SEQ ID NO: 3972969 - RNA, 16 nt, Human herpesvirus 4 [Epstein-Barr virus]
gccuggcggguggaga

SEQ ID NO: 3972970 - RNA, 14 nt, Human herpesvirus 4 [Epstein-Barr virus]
gccugggaggugcu

SEQ ID NO: 3972971 - RNA, 13 nt, Human herpesvirus 4 [Epstein-Barr virus]
gccuucuuccuag

SEQ ID NO: 3972972 - RNA, 17 nt, Human herpesvirus 4 [Epstein-Barr virus]
gccuugagggcaaagac

SEQ ID NO: 3972973 - RNA, 13 nt, Human herpesvirus 4 [Epstein-Barr virus]
gccuugcccccgc

SEQ ID NO: 3972974 - RNA, 16 nt, Human herpesvirus 4 [Epstein-Barr virus]
gccuugggggccugga

SEQ ID NO: 3972975 - RNA, 19 nt, Human herpesvirus 4 [Epstein-Barr virus]
gcgaacauuuauucauuau

SEQ ID NO: 3972976 - RNA, 14 nt, Human herpesvirus 4 [Epstein-Barr virus]
gcgaccccucgugg

SEQ ID NO: 3972977 - RNA, 14 nt, Human herpesvirus 4 [Epstein-Barr virus]
gcgagaauuggcag

SEQ ID NO: 3972978 - RNA, 18 nt, Human herpesvirus 4 [Epstein-Barr virus]
gcgagaauuggcagacac

SEQ ID NO: 3972979 - RNA, 20 nt, Human herpesvirus 4 [Epstein-Barr virus]
gcgagcagcgcggcagaggc

SEQ ID NO: 3972980 - RNA, 20 nt, Human herpesvirus 4 [Epstein-Barr virus]
gcgcaacgccggccugcugg

SEQ ID NO: 3972981 - RNA, 19 nt, Human herpesvirus 4 [Epstein-Barr virus]
gcgcagugccaagagcugc

SEQ ID NO: 3972982 - RNA, 13 nt, Human herpesvirus 4 [Epstein-Barr virus]
gcgccaccugcag

SEQ ID NO: 3972983 - RNA, 14 nt, Human herpesvirus 4 [Epstein-Barr virus]
gcgccagcagggca

SEQ ID NO: 3972984 - RNA, 16 nt, Human herpesvirus 4 [Epstein-Barr virus]
gcgccagcagggcaca

SEQ ID NO: 3972985 - RNA, 16 nt, Human herpesvirus 4 [Epstein-Barr virus]
gcgcccuccucugggc

SEQ ID NO: 3972986 - RNA, 20 nt, Human herpesvirus 4 [Epstein-Barr virus]
gcgcccuccucugggccgcc

SEQ ID NO: 3972987 - RNA, 14 nt, Human herpesvirus 4 [Epstein-Barr virus]
gcgcgccgccagca

SEQ ID NO: 3972988 - RNA, 12 nt, Human herpesvirus 4 [Epstein-Barr virus]
gcgcugggacug

SEQ ID NO: 3972989 - RNA, 18 nt, Human herpesvirus 4 [Epstein-Barr virus]
gcgcugggacugccuggg

SEQ ID NO: 3972990 - RNA, 22 nt, Human herpesvirus 4 [Epstein-Barr virus]
gcggaggccgagcagggacugg

SEQ ID NO: 3972991 - RNA, 18 nt, Human herpesvirus 4 [Epstein-Barr virus]
gcggcccagcagauccag

SEQ ID NO: 3972992 - RNA, 20 nt, Human herpesvirus 4 [Epstein-Barr virus]
gcggggcuccccagccacag

SEQ ID NO: 3972993 - RNA, 14 nt, Human herpesvirus 4 [Epstein-Barr virus]
gcgggugaggccac

SEQ ID NO: 3972994 - RNA, 18 nt, Human herpesvirus 4 [Epstein-Barr virus]
gcgguuauaacugccaga

SEQ ID NO: 3972995 - RNA, 18 nt, Human herpesvirus 4 [Epstein-Barr virus]
gcgucaggagacacggcu

SEQ ID NO: 3972996 - RNA, 17 nt, Human herpesvirus 4 [Epstein-Barr virus]
gcguccucuaccugguc

SEQ ID NO: 3972997 - RNA, 16 nt, Human herpesvirus 4 [Epstein-Barr virus]
gcguccuuugggaaca

SEQ ID NO: 3972998 - RNA, 17 nt, Human herpesvirus 4 [Epstein-Barr virus]
gcgugaccaccuggcca

SEQ ID NO: 3972999 - RNA, 21 nt, Human herpesvirus 4 [Epstein-Barr virus]
gcuaauagcuuucuguugcug

SEQ ID NO: 3973000 - RNA, 19 nt, Human herpesvirus 4 [Epstein-Barr virus]
gcuacaaacacgggccugg

SEQ ID NO: 3973001 - RNA, 17 nt, Human herpesvirus 4 [Epstein-Barr virus]
gcuacgcgggccacagg

SEQ ID NO: 3973002 - RNA, 18 nt, Human herpesvirus 4 [Epstein-Barr virus]
gcuacuacugccuuacac

SEQ ID NO: 3973003 - RNA, 23 nt, Human herpesvirus 4 [Epstein-Barr virus]
gcuacucuccgccguuccuucag

SEQ ID NO: 3973004 - RNA, 13 nt, Human herpesvirus 4 [Epstein-Barr virus]
gcuagcgucacug

SEQ ID NO: 3973005 - RNA, 15 nt, Human herpesvirus 4 [Epstein-Barr virus]
gcucaaccgccaggg

SEQ ID NO: 3973006 - RNA, 21 nt, Human herpesvirus 4 [Epstein-Barr virus]
gcucaccagggaggccuggga

SEQ ID NO: 3973007 - RNA, 15 nt, Human herpesvirus 4 [Epstein-Barr virus]
gcucauaccuccacu

SEQ ID NO: 3973008 - RNA, 16 nt, Human herpesvirus 4 [Epstein-Barr virus]
gcucccgggcaaacag

SEQ ID NO: 3973009 - RNA, 20 nt, Human herpesvirus 4 [Epstein-Barr virus]
gcucccgggcaaacagggca

SEQ ID NO: 3973010 - RNA, 12 nt, Human herpesvirus 4 [Epstein-Barr virus]
gcucccucuggg

SEQ ID NO: 3973011 - RNA, 18 nt, Human herpesvirus 4 [Epstein-Barr virus]
gcuccggauucaccggca

SEQ ID NO: 3973012 - RNA, 15 nt, Human herpesvirus 4 [Epstein-Barr virus]
gcuccggcugcccgu

SEQ ID NO: 3973013 - RNA, 16 nt, Human herpesvirus 4 [Epstein-Barr virus]
gcucuccagccacggc

SEQ ID NO: 3973014 - RNA, 14 nt, Human herpesvirus 4 [Epstein-Barr virus]
gcucucgcacucuu

SEQ ID NO: 3973015 - RNA, 12 nt, Human herpesvirus 4 [Epstein-Barr virus]
gcucuggcacug

SEQ ID NO: 3973016 - RNA, 14 nt, Human herpesvirus 4 [Epstein-Barr virus]
gcucuggcaguuau

SEQ ID NO: 3973017 - RNA, 19 nt, Human herpesvirus 4 [Epstein-Barr virus]
gcucugguacguuggcuuc

SEQ ID NO: 3973018 - RNA, 23 nt, Human herpesvirus 4 [Epstein-Barr virus]
gcucuucguuaaaauaacacaag

SEQ ID NO: 3973019 - RNA, 14 nt, Human herpesvirus 4 [Epstein-Barr virus]
gcugaacuggggcu

SEQ ID NO: 3973020 - RNA, 16 nt, Human herpesvirus 4 [Epstein-Barr virus]
gcugacauauguacaa

SEQ ID NO: 3973021 - RNA, 14 nt, Human herpesvirus 4 [Epstein-Barr virus]
gcugagcgugugca

SEQ ID NO: 3973022 - RNA, 14 nt, Human herpesvirus 4 [Epstein-Barr virus]
gcugcaccuggaca

SEQ ID NO: 3973023 - RNA, 18 nt, Human herpesvirus 4 [Epstein-Barr virus]
gcugcagguaaaccuucu

SEQ ID NO: 3973024 - RNA, 21 nt, Human herpesvirus 4 [Epstein-Barr virus]
gcugcccggacggccuagcca

SEQ ID NO: 3973025 - RNA, 19 nt, Human herpesvirus 4 [Epstein-Barr virus]
gcugcgacaggcccucgag

SEQ ID NO: 3973026 - RNA, 14 nt, Human herpesvirus 4 [Epstein-Barr virus]
gcugcgguggugcg

SEQ ID NO: 3973027 - RNA, 22 nt, Human herpesvirus 4 [Epstein-Barr virus]
gcugcucggggcaugcugcccg

SEQ ID NO: 3973028 - RNA, 17 nt, Human herpesvirus 4 [Epstein-Barr virus]
gcugcugcuacuggcuu

SEQ ID NO: 3973029 - RNA, 15 nt, Human herpesvirus 4 [Epstein-Barr virus]
gcugcugcuggucau

SEQ ID NO: 3973030 - RNA, 13 nt, Human herpesvirus 4 [Epstein-Barr virus]
gcugcuggucaug

SEQ ID NO: 3973031 - RNA, 23 nt, Human herpesvirus 4 [Epstein-Barr virus]
gcuggaggcaauggucgccaggg

SEQ ID NO: 3973032 - RNA, 13 nt, Human herpesvirus 4 [Epstein-Barr virus]
gcuggccaggcug

SEQ ID NO: 3973033 - RNA, 17 nt, Human herpesvirus 4 [Epstein-Barr virus]
gcugggaauggagaggg

SEQ ID NO: 3973034 - RNA, 16 nt, Human herpesvirus 4 [Epstein-Barr virus]
gcugguggccugggag

SEQ ID NO: 3973035 - RNA, 12 nt, Human herpesvirus 4 [Epstein-Barr virus]
gcuuaaaaaugu

SEQ ID NO: 3973036 - RNA, 20 nt, Human herpesvirus 4 [Epstein-Barr virus]
gcuuaacgggaagagaagug

SEQ ID NO: 3973037 - RNA, 18 nt, Human herpesvirus 4 [Epstein-Barr virus]
gcuucccgccuagagcau

SEQ ID NO: 3973038 - RNA, 20 nt, Human herpesvirus 4 [Epstein-Barr virus]
gcuucgaggucuccccugac

SEQ ID NO: 3973039 - RNA, 21 nt, Human herpesvirus 4 [Epstein-Barr virus]
gcuugaggccagagacgagcu

SEQ ID NO: 3973040 - RNA, 15 nt, Human herpesvirus 4 [Epstein-Barr virus]
gcuugccaaaauugg

SEQ ID NO: 3973041 - RNA, 13 nt, Human herpesvirus 4 [Epstein-Barr virus]
ggaaaaggcccua

SEQ ID NO: 3973042 - RNA, 21 nt, Human herpesvirus 4 [Epstein-Barr virus]
ggaaaaucucgcucagagcug

SEQ ID NO: 3973043 - RNA, 21 nt, Human herpesvirus 4 [Epstein-Barr virus]
ggaaccugagccugagccaca

SEQ ID NO: 3973044 - RNA, 19 nt, Human herpesvirus 4 [Epstein-Barr virus]
ggaauauuaauaaauaucu

SEQ ID NO: 3973045 - RNA, 23 nt, Human herpesvirus 4 [Epstein-Barr virus]
ggaaucuuguuggaauggggcgu

SEQ ID NO: 3973046 - RNA, 23 nt, Human herpesvirus 4 [Epstein-Barr virus]
cgcuucagcuccuugugcagcuu

SEQ ID NO: 3973047 - RNA, 15 nt, Human herpesvirus 4 [Epstein-Barr virus]
cgcuugcgucugccc

SEQ ID NO: 3973048 - RNA, 17 nt, Human herpesvirus 4 [Epstein-Barr virus]
cggaagaccaggagccc

SEQ ID NO: 3973049 - RNA, 13 nt, Human herpesvirus 4 [Epstein-Barr virus]
cggaccaggguca

SEQ ID NO: 3973050 - RNA, 20 nt, Human herpesvirus 4 [Epstein-Barr virus]
cggaggacgauagcccaggc

SEQ ID NO: 3973051 - RNA, 20 nt, Human herpesvirus 4 [Epstein-Barr virus]
cggaggcacuggagcagaag

SEQ ID NO: 3973052 - RNA, 22 nt, Human herpesvirus 4 [Epstein-Barr virus]
cggcaagggcucaccagggagg

SEQ ID NO: 3973053 - RNA, 12 nt, Human herpesvirus 4 [Epstein-Barr virus]
cggcacccaggc

SEQ ID NO: 3973054 - RNA, 23 nt, Human herpesvirus 4 [Epstein-Barr virus]
cggcauccucaaggggcacgaga

SEQ ID NO: 3973055 - RNA, 19 nt, Human herpesvirus 4 [Epstein-Barr virus]
cggcaucggguccuagcac

SEQ ID NO: 3973056 - RNA, 21 nt, Human herpesvirus 4 [Epstein-Barr virus]
cggccaggcagaggaaggcca

SEQ ID NO: 3973057 - RNA, 17 nt, Human herpesvirus 4 [Epstein-Barr virus]
cggccaugcgcuuuguc

SEQ ID NO: 3973058 - RNA, 14 nt, Human herpesvirus 4 [Epstein-Barr virus]
cggcccguggccug

SEQ ID NO: 3973059 - RNA, 18 nt, Human herpesvirus 4 [Epstein-Barr virus]
cggccgccccgggcccgg

SEQ ID NO: 3973060 - RNA, 19 nt, Human herpesvirus 4 [Epstein-Barr virus]
cggccguagcccaguccgc

SEQ ID NO: 3973061 - RNA, 18 nt, Human herpesvirus 4 [Epstein-Barr virus]
cggccugaauuccccugc

SEQ ID NO: 3973062 - RNA, 15 nt, Human herpesvirus 4 [Epstein-Barr virus]
cggcgccucuugucg

SEQ ID NO: 3973063 - RNA, 16 nt, Human herpesvirus 4 [Epstein-Barr virus]
cggcguggagcugggc

SEQ ID NO: 3973064 - RNA, 12 nt, Human herpesvirus 4 [Epstein-Barr virus]
cggcuguggccu

SEQ ID NO: 3973065 - RNA, 20 nt, Human herpesvirus 4 [Epstein-Barr virus]
cgggaaugacgggcucccuc

SEQ ID NO: 3973066 - RNA, 11 nt, Human herpesvirus 4 [Epstein-Barr virus]
cgggagccacg

SEQ ID NO: 3973067 - RNA, 18 nt, Human herpesvirus 4 [Epstein-Barr virus]
cgggaggggcaggagcag

SEQ ID NO: 3973068 - RNA, 23 nt, Human herpesvirus 4 [Epstein-Barr virus]
cgggcacgccuucgcccccucuu

SEQ ID NO: 3973069 - RNA, 18 nt, Human herpesvirus 4 [Epstein-Barr virus]
cgggcacugcguccaccu

SEQ ID NO: 3973070 - RNA, 22 nt, Human herpesvirus 4 [Epstein-Barr virus]
cgggccaaguuuaagcaacugc

SEQ ID NO: 3973071 - RNA, 18 nt, Human herpesvirus 4 [Epstein-Barr virus]
cgggcccagcccuccuca

SEQ ID NO: 3973072 - RNA, 19 nt, Human herpesvirus 4 [Epstein-Barr virus]
cgggcccagcccuccucag

SEQ ID NO: 3973073 - RNA, 19 nt, Human herpesvirus 4 [Epstein-Barr virus]
cgggcggcucaggaucagg

SEQ ID NO: 3973074 - RNA, 13 nt, Human herpesvirus 4 [Epstein-Barr virus]
cgggcucccuccc

SEQ ID NO: 3973075 - RNA, 18 nt, Human herpesvirus 4 [Epstein-Barr virus]
cggggaaggaggauggcc

SEQ ID NO: 3973076 - RNA, 17 nt, Human herpesvirus 4 [Epstein-Barr virus]
cggggcagcgccggugg

SEQ ID NO: 3973077 - RNA, 23 nt, Human herpesvirus 4 [Epstein-Barr virus]
cggggcuaaccaaggacaacagc

SEQ ID NO: 3973078 - RNA, 19 nt, Human herpesvirus 4 [Epstein-Barr virus]
cgggucaggucgcggacca

SEQ ID NO: 3973079 - RNA, 20 nt, Human herpesvirus 4 [Epstein-Barr virus]
cgggucaggucgcggaccag

SEQ ID NO: 3973080 - RNA, 21 nt, Human herpesvirus 4 [Epstein-Barr virus]
cggguggagauagggaccaga

SEQ ID NO: 3973081 - RNA, 14 nt, Human herpesvirus 4 [Epstein-Barr virus]
cgguggaacaggag

SEQ ID NO: 3973082 - RNA, 14 nt, Human herpesvirus 4 [Epstein-Barr virus]
cgguguccaggugu

SEQ ID NO: 3973083 - RNA, 19 nt, Human herpesvirus 4 [Epstein-Barr virus]
cguaggucuauggggaccc

SEQ ID NO: 3973084 - RNA, 14 nt, Human herpesvirus 4 [Epstein-Barr virus]
cgucacucagcucc

SEQ ID NO: 3973085 - RNA, 15 nt, Human herpesvirus 4 [Epstein-Barr virus]
cguccaccuggccac

SEQ ID NO: 3973086 - RNA, 19 nt, Human herpesvirus 4 [Epstein-Barr virus]
cguccacucuaucccgcug

SEQ ID NO: 3973087 - RNA, 20 nt, Human herpesvirus 4 [Epstein-Barr virus]
cgucccugaguucuacaaug

SEQ ID NO: 3973088 - RNA, 16 nt, Human herpesvirus 4 [Epstein-Barr virus]
cguccuuguccaggag

SEQ ID NO: 3973089 - RNA, 15 nt, Human herpesvirus 4 [Epstein-Barr virus]
cguccuuugggaaca

SEQ ID NO: 3973090 - RNA, 16 nt, Human herpesvirus 4 [Epstein-Barr virus]
cgugaccaccuggcca

SEQ ID NO: 3973091 - RNA, 16 nt, Human herpesvirus 4 [Epstein-Barr virus]
cgugagucugcuggac

SEQ ID NO: 3973092 - RNA, 16 nt, Human herpesvirus 4 [Epstein-Barr virus]
cgugcaaccaggccca

SEQ ID NO: 3973093 - RNA, 17 nt, Human herpesvirus 4 [Epstein-Barr virus]
cgugcaaccaggcccac

SEQ ID NO: 3973094 - RNA, 16 nt, Human herpesvirus 4 [Epstein-Barr virus]
cgugcaagcagcaccu

SEQ ID NO: 3973095 - RNA, 17 nt, Human herpesvirus 4 [Epstein-Barr virus]
cgugcaaggauggaaga

SEQ ID NO: 3973096 - RNA, 17 nt, Human herpesvirus 4 [Epstein-Barr virus]
cguguuucucccacugu

SEQ ID NO: 3973097 - RNA, 15 nt, Human herpesvirus 4 [Epstein-Barr virus]
cguuggaugcagucc

SEQ ID NO: 3973098 - RNA, 16 nt, Human herpesvirus 4 [Epstein-Barr virus]
cguuggcauucuacua

SEQ ID NO: 3973099 - RNA, 16 nt, Human herpesvirus 4 [Epstein-Barr virus]
cguuggcuucugcugc

SEQ ID NO: 3973100 - RNA, 17 nt, Human herpesvirus 4 [Epstein-Barr virus]
cuaacacgaaugcccag

SEQ ID NO: 3973101 - RNA, 18 nt, Human herpesvirus 4 [Epstein-Barr virus]
cuaacaggacauguuugg

SEQ ID NO: 3973102 - RNA, 14 nt, Human herpesvirus 4 [Epstein-Barr virus]
cuaaccaaggacaa

SEQ ID NO: 3973103 - RNA, 16 nt, Human herpesvirus 4 [Epstein-Barr virus]
cuaagcagcugagggg

SEQ ID NO: 3973104 - RNA, 13 nt, Human herpesvirus 4 [Epstein-Barr virus]
cuacaacaggcug

SEQ ID NO: 3973105 - RNA, 18 nt, Human herpesvirus 4 [Epstein-Barr virus]
cuacaccggccaguggcc

SEQ ID NO: 3973106 - RNA, 14 nt, Human herpesvirus 4 [Epstein-Barr virus]
cuacaggcccgggc

SEQ ID NO: 3973107 - RNA, 12 nt, Human herpesvirus 4 [Epstein-Barr virus]
cuaccgccacgc

SEQ ID NO: 3973108 - RNA, 14 nt, Human herpesvirus 4 [Epstein-Barr virus]
cuaccucuuuuggc

SEQ ID NO: 3973109 - RNA, 22 nt, Human herpesvirus 4 [Epstein-Barr virus]
cuaccugucggcccugcgcuac

SEQ ID NO: 3973110 - RNA, 16 nt, Human herpesvirus 4 [Epstein-Barr virus]
cuacgcgggccacagg

SEQ ID NO: 3973111 - RNA, 15 nt, Human herpesvirus 4 [Epstein-Barr virus]
cuacucgaccagcac

SEQ ID NO: 3973112 - RNA, 16 nt, Human herpesvirus 4 [Epstein-Barr virus]
cuacucuuggcagcag

SEQ ID NO: 3973113 - RNA, 18 nt, Human herpesvirus 4 [Epstein-Barr virus]
cuagagcauuugcaaguc

SEQ ID NO: 3973114 - RNA, 12 nt, Human herpesvirus 4 [Epstein-Barr virus]
cuagagggacag

SEQ ID NO: 3973115 - RNA, 19 nt, Human herpesvirus 4 [Epstein-Barr virus]
cuaggcuuuccugcaaggc

SEQ ID NO: 3973116 - RNA, 15 nt, Human herpesvirus 4 [Epstein-Barr virus]
cucaagcccuucuuc

SEQ ID NO: 3973117 - RNA, 23 nt, Human herpesvirus 4 [Epstein-Barr virus]
cucaagcuacucaaugagaggga

SEQ ID NO: 3973118 - RNA, 11 nt, Human herpesvirus 4 [Epstein-Barr virus]
cucaaggaggg

SEQ ID NO: 3973119 - RNA, 21 nt, Human herpesvirus 4 [Epstein-Barr virus]
cucaccagggaggccugggag

SEQ ID NO: 3973120 - RNA, 20 nt, Human herpesvirus 4 [Epstein-Barr virus]
cucaccgggaacgcccagua

SEQ ID NO: 3973121 - RNA, 20 nt, Human herpesvirus 4 [Epstein-Barr virus]
cucagaauugucacugagaa

SEQ ID NO: 3973122 - RNA, 19 nt, Human herpesvirus 4 [Epstein-Barr virus]
cucagagagcauuucaggc

SEQ ID NO: 3973123 - RNA, 23 nt, Human herpesvirus 4 [Epstein-Barr virus]
cucagagggggugccugugccuc

SEQ ID NO: 3973124 - RNA, 14 nt, Human herpesvirus 4 [Epstein-Barr virus]
cucagaugcagugg

SEQ ID NO: 3973125 - RNA, 19 nt, Human herpesvirus 4 [Epstein-Barr virus]
cucagccugcuccugagaa

SEQ ID NO: 3973126 - RNA, 16 nt, Human herpesvirus 4 [Epstein-Barr virus]
cucaggaucagggcca

SEQ ID NO: 3973127 - RNA, 23 nt, Human herpesvirus 4 [Epstein-Barr virus]
cucaggccaugcgcgcccuguca

SEQ ID NO: 3973128 - RNA, 13 nt, Human herpesvirus 4 [Epstein-Barr virus]
cucagguuucugg

SEQ ID NO: 3973129 - RNA, 22 nt, Human herpesvirus 4 [Epstein-Barr virus]
cucagucuuugcaauuugccua

SEQ ID NO: 3973130 - RNA, 16 nt, Human herpesvirus 4 [Epstein-Barr virus]
cuccaacaggugcccg

SEQ ID NO: 3973131 - RNA, 17 nt, Human herpesvirus 4 [Epstein-Barr virus]
cuccacaccaaauaaac

SEQ ID NO: 3973132 - RNA, 17 nt, Human herpesvirus 4 [Epstein-Barr virus]
cuccauaggccucugcc

SEQ ID NO: 3973133 - RNA, 16 nt, Human herpesvirus 4 [Epstein-Barr virus]
cuccaucagggccagg

SEQ ID NO: 3973134 - RNA, 22 nt, Human herpesvirus 4 [Epstein-Barr virus]
gagacggugaccugacuggcag

SEQ ID NO: 3973135 - RNA, 14 nt, Human herpesvirus 4 [Epstein-Barr virus]
gagacguggguccc

SEQ ID NO: 3973136 - RNA, 18 nt, Human herpesvirus 4 [Epstein-Barr virus]
gagaggcccgggggccuu

SEQ ID NO: 3973137 - RNA, 23 nt, Human herpesvirus 4 [Epstein-Barr virus]
gagaggcuucccgccuagagcau

SEQ ID NO: 3973138 - RNA, 18 nt, Human herpesvirus 4 [Epstein-Barr virus]
gagcagaaggaacagagg

SEQ ID NO: 3973139 - RNA, 14 nt, Human herpesvirus 4 [Epstein-Barr virus]
gagcaggaggggca

SEQ ID NO: 3973140 - RNA, 19 nt, Human herpesvirus 4 [Epstein-Barr virus]
gagcagggcaaagccacaa

SEQ ID NO: 3973141 - RNA, 21 nt, Human herpesvirus 4 [Epstein-Barr virus]
gagcaugaucaggacccuggg

SEQ ID NO: 3973142 - RNA, 17 nt, Human herpesvirus 4 [Epstein-Barr virus]
gagccagaucuaaggcc

SEQ ID NO: 3973143 - RNA, 21 nt, Human herpesvirus 4 [Epstein-Barr virus]
gagccauuggcaugggcggga

SEQ ID NO: 3973144 - RNA, 22 nt, Human herpesvirus 4 [Epstein-Barr virus]
gagcccauucucguccaucucg

SEQ ID NO: 3973145 - RNA, 13 nt, Human herpesvirus 4 [Epstein-Barr virus]
gagccguggccuu

SEQ ID NO: 3973146 - RNA, 15 nt, Human herpesvirus 4 [Epstein-Barr virus]
gagcgcacgugacag

SEQ ID NO: 3973147 - RNA, 13 nt, Human herpesvirus 4 [Epstein-Barr virus]
gagcgcccaccga

SEQ ID NO: 3973148 - RNA, 24 nt, Human herpesvirus 4 [Epstein-Barr virus]
gagcggcauccucaaggggcacga

SEQ ID NO: 3973149 - RNA, 14 nt, Human herpesvirus 4 [Epstein-Barr virus]
gagcuauguggaaa

SEQ ID NO: 3973150 - RNA, 18 nt, Human herpesvirus 4 [Epstein-Barr virus]
gaggacggugucuguggu

SEQ ID NO: 3973151 - RNA, 15 nt, Human herpesvirus 4 [Epstein-Barr virus]
gaggacuaauguucu

SEQ ID NO: 3973152 - RNA, 13 nt, Human herpesvirus 4 [Epstein-Barr virus]
gaggagacgugug

SEQ ID NO: 3973153 - RNA, 19 nt, Human herpesvirus 4 [Epstein-Barr virus]
gaggagcuccgugagcagg

SEQ ID NO: 3973154 - RNA, 21 nt, Human herpesvirus 4 [Epstein-Barr virus]
gaggagcuccgugagcaggag

SEQ ID NO: 3973155 - RNA, 18 nt, Human herpesvirus 4 [Epstein-Barr virus]
gaggaggacaugugcaug

SEQ ID NO: 3973156 - RNA, 20 nt, Human herpesvirus 4 [Epstein-Barr virus]
gaggauccaaacccccuccc

SEQ ID NO: 3973157 - RNA, 15 nt, Human herpesvirus 4 [Epstein-Barr virus]
gaggcauaacggugg

SEQ ID NO: 3973158 - RNA, 17 nt, Human herpesvirus 4 [Epstein-Barr virus]
gaggccagguagcccag

SEQ ID NO: 3973159 - RNA, 18 nt, Human herpesvirus 4 [Epstein-Barr virus]
gaggccucugggguccag

SEQ ID NO: 3973160 - RNA, 13 nt, Human herpesvirus 4 [Epstein-Barr virus]
gaggccugcacca

SEQ ID NO: 3973161 - RNA, 13 nt, Human herpesvirus 4 [Epstein-Barr virus]
gaggcggugccug

SEQ ID NO: 3973162 - RNA, 17 nt, Human herpesvirus 4 [Epstein-Barr virus]
gagggcagacaccaccu

SEQ ID NO: 3973163 - RNA, 14 nt, Human herpesvirus 4 [Epstein-Barr virus]
gagggccucuggca

SEQ ID NO: 3973164 - RNA, 17 nt, Human herpesvirus 4 [Epstein-Barr virus]
gagggcgcucugcgcca

SEQ ID NO: 3973165 - RNA, 12 nt, Human herpesvirus 4 [Epstein-Barr virus]
gaggggcaggag

SEQ ID NO: 3973166 - RNA, 12 nt, Human herpesvirus 4 [Epstein-Barr virus]
gaggggccaggu

SEQ ID NO: 3973167 - RNA, 16 nt, Human herpesvirus 4 [Epstein-Barr virus]
gaggugcugaggcccg

SEQ ID NO: 3973168 - RNA, 16 nt, Human herpesvirus 4 [Epstein-Barr virus]
gagucccuccucacca

SEQ ID NO: 3973169 - RNA, 12 nt, Human herpesvirus 4 [Epstein-Barr virus]
gagucugcugcg

SEQ ID NO: 3973170 - RNA, 17 nt, Human herpesvirus 4 [Epstein-Barr virus]
gagugggcagcagagag

SEQ ID NO: 3973171 - RNA, 20 nt, Human herpesvirus 4 [Epstein-Barr virus]
gauacaaaaacuugagucuc

SEQ ID NO: 3973172 - RNA, 14 nt, Human herpesvirus 4 [Epstein-Barr virus]
gauagaauagcugc

SEQ ID NO: 3973173 - RNA, 14 nt, Human herpesvirus 4 [Epstein-Barr virus]
gauagccggccagg

SEQ ID NO: 3973174 - RNA, 14 nt, Human herpesvirus 4 [Epstein-Barr virus]
gaucccaggccuca

SEQ ID NO: 3973175 - RNA, 16 nt, Human herpesvirus 4 [Epstein-Barr virus]
gaucccaggccucagc

SEQ ID NO: 3973176 - RNA, 22 nt, Human herpesvirus 4 [Epstein-Barr virus]
gaucccauuuuucacuacggga

SEQ ID NO: 3973177 - RNA, 17 nt, Human herpesvirus 4 [Epstein-Barr virus]
gaugaacccuggggcaa

SEQ ID NO: 3973178 - RNA, 15 nt, Human herpesvirus 4 [Epstein-Barr virus]
gaugacaccauggcc

SEQ ID NO: 3973179 - RNA, 21 nt, Human herpesvirus 4 [Epstein-Barr virus]
gaugaccaugauggugcagag

SEQ ID NO: 3973180 - RNA, 13 nt, Human herpesvirus 4 [Epstein-Barr virus]
gaugaggcugaug

SEQ ID NO: 3973181 - RNA, 22 nt, Human herpesvirus 4 [Epstein-Barr virus]
gaugaggcugaugauggccacg

SEQ ID NO: 3973182 - RNA, 18 nt, Human herpesvirus 4 [Epstein-Barr virus]
gaugauauugaauuccac

SEQ ID NO: 3973183 - RNA, 13 nt, Human herpesvirus 4 [Epstein-Barr virus]
gaugcaacagagg

SEQ ID NO: 3973184 - RNA, 15 nt, Human herpesvirus 4 [Epstein-Barr virus]
gaugcaacagaggau

SEQ ID NO: 3973185 - RNA, 14 nt, Human herpesvirus 4 [Epstein-Barr virus]
gaugcugcagaggu

SEQ ID NO: 3973186 - RNA, 13 nt, Human herpesvirus 4 [Epstein-Barr virus]
gauggccuggaga

SEQ ID NO: 3973187 - RNA, 12 nt, Human herpesvirus 4 [Epstein-Barr virus]
gauggugcuggu

SEQ ID NO: 3973188 - RNA, 14 nt, Human herpesvirus 4 [Epstein-Barr virus]
ggacaugugcaugg

SEQ ID NO: 3973189 - RNA, 14 nt, Human herpesvirus 4 [Epstein-Barr virus]
ggacauucuucuga

SEQ ID NO: 3973190 - RNA, 15 nt, Human herpesvirus 4 [Epstein-Barr virus]
ggacgaggaggcgga

SEQ ID NO: 3973191 - RNA, 17 nt, Human herpesvirus 4 [Epstein-Barr virus]
ggacucucuguuucugu

SEQ ID NO: 3973192 - RNA, 17 nt, Human herpesvirus 4 [Epstein-Barr virus]
ggagacguguguggcug

SEQ ID NO: 3973193 - RNA, 16 nt, Human herpesvirus 4 [Epstein-Barr virus]
ggagaugggugcauuu

SEQ ID NO: 3973194 - RNA, 21 nt, Human herpesvirus 4 [Epstein-Barr virus]
ggagauuuucccacugugccu

SEQ ID NO: 3973195 - RNA, 12 nt, Human herpesvirus 4 [Epstein-Barr virus]
ggagcaggagca

SEQ ID NO: 3973196 - RNA, 15 nt, Human herpesvirus 4 [Epstein-Barr virus]
ggagcaggagcggga

SEQ ID NO: 3973197 - RNA, 14 nt, Human herpesvirus 4 [Epstein-Barr virus]
ggagccgggcuuca

SEQ ID NO: 3973198 - RNA, 19 nt, Human herpesvirus 4 [Epstein-Barr virus]
ggagcuccgugagcaggag

SEQ ID NO: 3973199 - RNA, 18 nt, Human herpesvirus 4 [Epstein-Barr virus]
ggagcuguaacugugguu

SEQ ID NO: 3973200 - RNA, 12 nt, Human herpesvirus 4 [Epstein-Barr virus]
ggaggaagaugg

SEQ ID NO: 3973201 - RNA, 15 nt, Human herpesvirus 4 [Epstein-Barr virus]
ggaggacgugaguga

SEQ ID NO: 3973202 - RNA, 15 nt, Human herpesvirus 4 [Epstein-Barr virus]
ggaggaggggcagga

SEQ ID NO: 3973203 - RNA, 18 nt, Human herpesvirus 4 [Epstein-Barr virus]
ggaggcaauggucgccag

SEQ ID NO: 3973204 - RNA, 23 nt, Human herpesvirus 4 [Epstein-Barr virus]
ggaggccaccgacgagcagagga

SEQ ID NO: 3973205 - RNA, 18 nt, Human herpesvirus 4 [Epstein-Barr virus]
ggagggcacucgcccacu

SEQ ID NO: 3973206 - RNA, 23 nt, Human herpesvirus 4 [Epstein-Barr virus]
ggauagccucgcgacucguggga

SEQ ID NO: 3973207 - RNA, 14 nt, Human herpesvirus 4 [Epstein-Barr virus]
ggaugcuguagugg

SEQ ID NO: 3973208 - RNA, 15 nt, Human herpesvirus 4 [Epstein-Barr virus]
ggauggccuccagcu

SEQ ID NO: 3973209 - RNA, 17 nt, Human herpesvirus 4 [Epstein-Barr virus]
ggcaaacagggcagaga

SEQ ID NO: 3973210 - RNA, 21 nt, Human herpesvirus 4 [Epstein-Barr virus]
ggcaccuguccuugucugcug

SEQ ID NO: 3973211 - RNA, 17 nt, Human herpesvirus 4 [Epstein-Barr virus]
ggcacgccguggcccug

SEQ ID NO: 3973212 - RNA, 14 nt, Human herpesvirus 4 [Epstein-Barr virus]
ggcagaaaggcugg

SEQ ID NO: 3973213 - RNA, 17 nt, Human herpesvirus 4 [Epstein-Barr virus]
ggcagcgaagaacacuc

SEQ ID NO: 3973214 - RNA, 19 nt, Human herpesvirus 4 [Epstein-Barr virus]
ggcagcggaugguggggcu

SEQ ID NO: 3973215 - RNA, 15 nt, Human herpesvirus 4 [Epstein-Barr virus]
ggcaggaggggcagg

SEQ ID NO: 3973216 - RNA, 16 nt, Human herpesvirus 4 [Epstein-Barr virus]
ggcaggaggggcagga

SEQ ID NO: 3973217 - RNA, 21 nt, Human herpesvirus 4 [Epstein-Barr virus]
ggcaggcauuuuuggugcugc

SEQ ID NO: 3973218 - RNA, 18 nt, Human herpesvirus 4 [Epstein-Barr virus]
ggcaggcuacaacaggcu

SEQ ID NO: 3973219 - RNA, 16 nt, Human herpesvirus 4 [Epstein-Barr virus]
ggcaguagaggacacc

SEQ ID NO: 3973220 - RNA, 13 nt, Human herpesvirus 4 [Epstein-Barr virus]
ggcauccuucaga

SEQ ID NO: 3973221 - RNA, 13 nt, Human herpesvirus 4 [Epstein-Barr virus]
ggccaccaacguc

SEQ ID NO: 3973222 - RNA, 17 nt, Human herpesvirus 4 [Epstein-Barr virus]
ggccaccgacgagcaga

SEQ ID NO: 3973223 - RNA, 16 nt, Human herpesvirus 4 [Epstein-Barr virus]
ggccaccggggaggcc

SEQ ID NO: 3973224 - RNA, 17 nt, Human herpesvirus 4 [Epstein-Barr virus]
ggccacugcaggcugga

SEQ ID NO: 3973225 - RNA, 24 nt, Human herpesvirus 4 [Epstein-Barr virus]
ggccagacggcgcuugcgucugcc

SEQ ID NO: 3973226 - RNA, 21 nt, Human herpesvirus 4 [Epstein-Barr virus]
ggccagcucauaugccgcugc

SEQ ID NO: 3973227 - RNA, 14 nt, Human herpesvirus 4 [Epstein-Barr virus]
ggccaggcagagga

SEQ ID NO: 3973228 - RNA, 18 nt, Human herpesvirus 4 [Epstein-Barr virus]
ggccaggcagaggaaggc

SEQ ID NO: 3973229 - RNA, 18 nt, Human herpesvirus 4 [Epstein-Barr virus]
ggccaggcgacgcucccg

SEQ ID NO: 3973230 - RNA, 17 nt, Human herpesvirus 4 [Epstein-Barr virus]
ggccaugcgcgcccugu

SEQ ID NO: 3973231 - RNA, 15 nt, Human herpesvirus 4 [Epstein-Barr virus]
ggccaugcgcuuugu

SEQ ID NO: 3973232 - RNA, 18 nt, Human herpesvirus 4 [Epstein-Barr virus]
ggcccacuggaugcagga

SEQ ID NO: 3973233 - RNA, 19 nt, Human herpesvirus 4 [Epstein-Barr virus]
ggcccagcccuccucagaa

SEQ ID NO: 3973234 - RNA, 19 nt, Human herpesvirus 4 [Epstein-Barr virus]
ggcccagggucacuggcuu

SEQ ID NO: 3973235 - RNA, 16 nt, Human herpesvirus 4 [Epstein-Barr virus]
ggcccccagcuucuga

SEQ ID NO: 3973236 - RNA, 18 nt, Human herpesvirus 4 [Epstein-Barr virus]
ggcccggggguggcagcc

SEQ ID NO: 3973237 - RNA, 14 nt, Human herpesvirus 4 [Epstein-Barr virus]
ggcccgucccucuu

SEQ ID NO: 3973238 - RNA, 21 nt, Human herpesvirus 4 [Epstein-Barr virus]
ggcccucgguggugggcugcu

SEQ ID NO: 3973239 - RNA, 18 nt, Human herpesvirus 4 [Epstein-Barr virus]
ggccgagcagggacuggc

SEQ ID NO: 3973240 - RNA, 20 nt, Human herpesvirus 4 [Epstein-Barr virus]
ggccgcccgccuggcucgcc

SEQ ID NO: 3973241 - RNA, 13 nt, Human herpesvirus 4 [Epstein-Barr virus]
ggccgcugccagg

SEQ ID NO: 3973242 - RNA, 20 nt, Human herpesvirus 4 [Epstein-Barr virus]
ggccgggagaggcagcccca

SEQ ID NO: 3973243 - RNA, 14 nt, Human herpesvirus 4 [Epstein-Barr virus]
ggccggugcugcca

SEQ ID NO: 3973244 - RNA, 15 nt, Human herpesvirus 4 [Epstein-Barr virus]
ggccggugcugccag

SEQ ID NO: 3973245 - RNA, 16 nt, Human herpesvirus 4 [Epstein-Barr virus]
ggccucaaaggccucg

SEQ ID NO: 3973246 - RNA, 16 nt, Human herpesvirus 4 [Epstein-Barr virus]
ggccucaaaguccugc

SEQ ID NO: 3973247 - RNA, 11 nt, Human herpesvirus 4 [Epstein-Barr virus]
ggccuccuggc

SEQ ID NO: 3973248 - RNA, 16 nt, Human herpesvirus 4 [Epstein-Barr virus]
ggccucggccuggggu

SEQ ID NO: 3973249 - RNA, 19 nt, Human herpesvirus 4 [Epstein-Barr virus]
ggccucucuggcugugcug

SEQ ID NO: 3973250 - RNA, 13 nt, Human herpesvirus 4 [Epstein-Barr virus]
ggccucugggguc

SEQ ID NO: 3973251 - RNA, 13 nt, Human herpesvirus 4 [Epstein-Barr virus]
ggcgaagcuggcu

SEQ ID NO: 3973252 - RNA, 13 nt, Human herpesvirus 4 [Epstein-Barr virus]
ggcgaaggcgugc

SEQ ID NO: 3973253 - RNA, 17 nt, Human herpesvirus 4 [Epstein-Barr virus]
ggcgacaguaacacagg

SEQ ID NO: 3973254 - RNA, 19 nt, Human herpesvirus 4 [Epstein-Barr virus]
ggcgaccuguuccgcuucu

SEQ ID NO: 3973255 - RNA, 21 nt, Human herpesvirus 4 [Epstein-Barr virus]
ggcgacuuuguuuagggacag

SEQ ID NO: 3973256 - RNA, 13 nt, Human herpesvirus 4 [Epstein-Barr virus]
ggcgcaggggagg

SEQ ID NO: 3973257 - RNA, 19 nt, Human herpesvirus 4 [Epstein-Barr virus]
ggcgccgaaagcaggaaug

SEQ ID NO: 3973258 - RNA, 21 nt, Human herpesvirus 4 [Epstein-Barr virus]
ggcgccgcccgggggccaguc

SEQ ID NO: 3973259 - RNA, 14 nt, Human herpesvirus 4 [Epstein-Barr virus]
ggcgcucugcgcca

SEQ ID NO: 3973260 - RNA, 22 nt, Human herpesvirus 4 [Epstein-Barr virus]
ggcgcucugcgccagccccgcc

SEQ ID NO: 3973261 - RNA, 18 nt, Human herpesvirus 4 [Epstein-Barr virus]
ggcggcgguggauagaga

SEQ ID NO: 3973262 - RNA, 20 nt, Human herpesvirus 4 [Epstein-Barr virus]
ggcgggaguauggggccaga

SEQ ID NO: 3973263 - RNA, 15 nt, Human herpesvirus 4 [Epstein-Barr virus]
ggcgguuagggagga

SEQ ID NO: 3973264 - RNA, 21 nt, Human herpesvirus 4 [Epstein-Barr virus]
ggcguaguugaaucaccgccg

SEQ ID NO: 3973265 - RNA, 20 nt, Human herpesvirus 4 [Epstein-Barr virus]
ggcgugcccgaacccggguu

SEQ ID NO: 3973266 - RNA, 16 nt, Human herpesvirus 4 [Epstein-Barr virus]
ggcucaggccaugcgc

SEQ ID NO: 3973267 - RNA, 22 nt, Human herpesvirus 4 [Epstein-Barr virus]
ggcucaggcggaggcacuggag

SEQ ID NO: 3973268 - RNA, 15 nt, Human herpesvirus 4 [Epstein-Barr virus]
ggcugagaacugacg

SEQ ID NO: 3973269 - RNA, 13 nt, Human herpesvirus 4 [Epstein-Barr virus]
ggcugaugauggc

SEQ ID NO: 3973270 - RNA, 15 nt, Human herpesvirus 4 [Epstein-Barr virus]
ggcugccagccucag

SEQ ID NO: 3973271 - RNA, 16 nt, Human herpesvirus 4 [Epstein-Barr virus]
ggcugcuaagccagga

SEQ ID NO: 3973272 - RNA, 18 nt, Human herpesvirus 4 [Epstein-Barr virus]
ggcugcuauagugagcca

SEQ ID NO: 3973273 - RNA, 18 nt, Human herpesvirus 4 [Epstein-Barr virus]
ggcugcugccgucccagg

SEQ ID NO: 3973274 - RNA, 11 nt, Human herpesvirus 4 [Epstein-Barr virus]
uagucagucug

SEQ ID NO: 3973275 - RNA, 16 nt, Human herpesvirus 4 [Epstein-Barr virus]
uagugagccaggcuuu

SEQ ID NO: 3973276 - RNA, 13 nt, Human herpesvirus 4 [Epstein-Barr virus]
uauagaggcucuc

SEQ ID NO: 3973277 - RNA, 13 nt, Human herpesvirus 4 [Epstein-Barr virus]
uauagcucuggca

SEQ ID NO: 3973278 - RNA, 20 nt, Human herpesvirus 4 [Epstein-Barr virus]
uauccagagcugagugccca

SEQ ID NO: 3973279 - RNA, 23 nt, Human herpesvirus 4 [Epstein-Barr virus]
uauccagagcugagugcccaggg

SEQ ID NO: 3973280 - RNA, 18 nt, Human herpesvirus 4 [Epstein-Barr virus]
uauccaggucuugccgug

SEQ ID NO: 3973281 - RNA, 14 nt, Human herpesvirus 4 [Epstein-Barr virus]
uaugaaaaugugua

SEQ ID NO: 3973282 - RNA, 18 nt, Human herpesvirus 4 [Epstein-Barr virus]
uaugcauacacugaauuu

SEQ ID NO: 3973283 - RNA, 21 nt, Human herpesvirus 4 [Epstein-Barr virus]
uauuaauaaauaucuuccugu

SEQ ID NO: 3973284 - RNA, 17 nt, Human herpesvirus 4 [Epstein-Barr virus]
uauugaaaccacgccug

SEQ ID NO: 3973285 - RNA, 13 nt, Human herpesvirus 4 [Epstein-Barr virus]
uauugaauuccac

SEQ ID NO: 3973286 - RNA, 15 nt, Human herpesvirus 4 [Epstein-Barr virus]
ucaagagcuuccugg

SEQ ID NO: 3973287 - RNA, 23 nt, Human herpesvirus 4 [Epstein-Barr virus]
ucaagcagcucaccuauggucac

SEQ ID NO: 3973288 - RNA, 13 nt, Human herpesvirus 4 [Epstein-Barr virus]
ucaaggauggcac

SEQ ID NO: 3973289 - RNA, 14 nt, Human herpesvirus 4 [Epstein-Barr virus]
ucaaggccucggag

SEQ ID NO: 3973290 - RNA, 18 nt, Human herpesvirus 4 [Epstein-Barr virus]
ucaaguaccagcuggugg

SEQ ID NO: 3973291 - RNA, 16 nt, Human herpesvirus 4 [Epstein-Barr virus]
ucaauuuugggagcuc

SEQ ID NO: 3973292 - RNA, 13 nt, Human herpesvirus 4 [Epstein-Barr virus]
ucacagcugcugg

SEQ ID NO: 3973293 - RNA, 17 nt, Human herpesvirus 4 [Epstein-Barr virus]
ucacaggacauguuugg

SEQ ID NO: 3973294 - RNA, 19 nt, Human herpesvirus 4 [Epstein-Barr virus]
ucacauauccagagcugag

SEQ ID NO: 3973295 - RNA, 13 nt, Human herpesvirus 4 [Epstein-Barr virus]
ucaccagccaccu

SEQ ID NO: 3973296 - RNA, 13 nt, Human herpesvirus 4 [Epstein-Barr virus]
ucaccaggccugc

SEQ ID NO: 3973297 - RNA, 14 nt, Human herpesvirus 4 [Epstein-Barr virus]
ucacccauggccag

SEQ ID NO: 3973298 - RNA, 19 nt, Human herpesvirus 4 [Epstein-Barr virus]
ucaccccgaguccaaggcc

SEQ ID NO: 3973299 - RNA, 15 nt, Human herpesvirus 4 [Epstein-Barr virus]
ucacuggcaaagggc

SEQ ID NO: 3973300 - RNA, 13 nt, Human herpesvirus 4 [Epstein-Barr virus]
ucacuguccagac

SEQ ID NO: 3973301 - RNA, 23 nt, Human herpesvirus 4 [Epstein-Barr virus]
ucagaccucugcacaacacaacu

SEQ ID NO: 3973302 - RNA, 17 nt, Human herpesvirus 4 [Epstein-Barr virus]
ucagagaggccucuggg

SEQ ID NO: 3973303 - RNA, 23 nt, Human herpesvirus 4 [Epstein-Barr virus]
ucagccagggugaccuggcucag

SEQ ID NO: 3973304 - RNA, 15 nt, Human herpesvirus 4 [Epstein-Barr virus]
ucagccgggaggaag

SEQ ID NO: 3973305 - RNA, 23 nt, Human herpesvirus 4 [Epstein-Barr virus]
ucagccuccaacaggugcccgag

SEQ ID NO: 3973306 - RNA, 16 nt, Human herpesvirus 4 [Epstein-Barr virus]
ucaggacccugggccg

SEQ ID NO: 3973307 - RNA, 23 nt, Human herpesvirus 4 [Epstein-Barr virus]
ucagggccacggcgugccagagg

SEQ ID NO: 3973308 - RNA, 23 nt, Human herpesvirus 4 [Epstein-Barr virus]
ucagggguguagugggugggcau

SEQ ID NO: 3973309 - RNA, 16 nt, Human herpesvirus 4 [Epstein-Barr virus]
ucaucccacugggacg

SEQ ID NO: 3973310 - RNA, 18 nt, Human herpesvirus 4 [Epstein-Barr virus]
ucaugcagggugcacaga

SEQ ID NO: 3973311 - RNA, 18 nt, Human herpesvirus 4 [Epstein-Barr virus]
ucaugcuccuauggacac

SEQ ID NO: 3973312 - RNA, 19 nt, Human herpesvirus 4 [Epstein-Barr virus]
uccaacauuaaagccuccu

SEQ ID NO: 3973313 - RNA, 19 nt, Human herpesvirus 4 [Epstein-Barr virus]
uccaaucaccagccaccuu

SEQ ID NO: 3973314 - RNA, 17 nt, Human herpesvirus 4 [Epstein-Barr virus]
uccacagauggagagau

SEQ ID NO: 3973315 - RNA, 19 nt, Human herpesvirus 4 [Epstein-Barr virus]
uccaccagcuucucaaagg

SEQ ID NO: 3973316 - RNA, 20 nt, Human herpesvirus 4 [Epstein-Barr virus]
uccacccccuggagccagcg

SEQ ID NO: 3973317 - RNA, 20 nt, Human herpesvirus 4 [Epstein-Barr virus]
uccacgggaugacucaucuc

SEQ ID NO: 3973318 - RNA, 17 nt, Human herpesvirus 4 [Epstein-Barr virus]
uccagccaguggucuac

SEQ ID NO: 3973319 - RNA, 18 nt, Human herpesvirus 4 [Epstein-Barr virus]
uccagcucggccagcagg

SEQ ID NO: 3973320 - RNA, 23 nt, Human herpesvirus 4 [Epstein-Barr virus]
uccagcucggccagcaggccggc

SEQ ID NO: 3973321 - RNA, 15 nt, Human herpesvirus 4 [Epstein-Barr virus]
uccaggggccacaca

SEQ ID NO: 3973322 - RNA, 17 nt, Human herpesvirus 4 [Epstein-Barr virus]
uccaguuccccccagcc

SEQ ID NO: 3973323 - RNA, 14 nt, Human herpesvirus 4 [Epstein-Barr virus]
uccaucugcuucug

SEQ ID NO: 3973324 - RNA, 13 nt, Human herpesvirus 4 [Epstein-Barr virus]
uccauuccaccca

SEQ ID NO: 3973325 - RNA, 16 nt, Human herpesvirus 4 [Epstein-Barr virus]
uccauucccagcccca

SEQ ID NO: 3973326 - RNA, 12 nt, Human herpesvirus 4 [Epstein-Barr virus]
ucccaacauggg

SEQ ID NO: 3973327 - RNA, 14 nt, Human herpesvirus 4 [Epstein-Barr virus]
ucccacugugccua

SEQ ID NO: 3973328 - RNA, 20 nt, Human herpesvirus 4 [Epstein-Barr virus]
ucccaggccuuagcccagag

SEQ ID NO: 3973329 - RNA, 23 nt, Human herpesvirus 4 [Epstein-Barr virus]
uccccaaagucaagggaaaggaa

SEQ ID NO: 3973330 - RNA, 17 nt, Human herpesvirus 4 [Epstein-Barr virus]
uccccucguucccccga

SEQ ID NO: 3973331 - RNA, 20 nt, Human herpesvirus 4 [Epstein-Barr virus]
ucccggcgcucgucguucag

SEQ ID NO: 3973332 - RNA, 22 nt, Human herpesvirus 4 [Epstein-Barr virus]
ucccgggcaaacagggcagaga

SEQ ID NO: 3973333 - RNA, 15 nt, Human herpesvirus 4 [Epstein-Barr virus]
ucccggguggugagg

SEQ ID NO: 3973334 - RNA, 22 nt, Human herpesvirus 4 [Epstein-Barr virus]
ucccgugcuuuuugccaggccu

SEQ ID NO: 3973335 - RNA, 20 nt, Human herpesvirus 4 [Epstein-Barr virus]
ucccguggagaguagggagg

SEQ ID NO: 3973336 - RNA, 20 nt, Human herpesvirus 4 [Epstein-Barr virus]
uccgagagcuccgccaccuc

SEQ ID NO: 3973337 - RNA, 20 nt, Human herpesvirus 4 [Epstein-Barr virus]
uccgcagguggcugcugcca

SEQ ID NO: 3973338 - RNA, 16 nt, Human herpesvirus 4 [Epstein-Barr virus]
uccgccaugaccagca

SEQ ID NO: 3973339 - RNA, 18 nt, Human herpesvirus 4 [Epstein-Barr virus]
uccgcgcuaaucgcuggu

SEQ ID NO: 3973340 - RNA, 15 nt, Human herpesvirus 4 [Epstein-Barr virus]
uccgcuccuacacca

SEQ ID NO: 3973341 - RNA, 13 nt, Human herpesvirus 4 [Epstein-Barr virus]
uccgcugggccag

SEQ ID NO: 3973342 - RNA, 16 nt, Human herpesvirus 4 [Epstein-Barr virus]
uccggcccuuugccug

SEQ ID NO: 3973343 - RNA, 15 nt, Human herpesvirus 4 [Epstein-Barr virus]
uccuaggagaaggag

SEQ ID NO: 3973344 - RNA, 23 nt, Human herpesvirus 4 [Epstein-Barr virus]
uccuauggacacuugugguucuc

SEQ ID NO: 3973345 - RNA, 16 nt, Human herpesvirus 4 [Epstein-Barr virus]
uccucaccacucgaaa

SEQ ID NO: 3973346 - RNA, 20 nt, Human herpesvirus 4 [Epstein-Barr virus]
uccugaagcgaagcagcucc

SEQ ID NO: 3973347 - RNA, 21 nt, Human herpesvirus 4 [Epstein-Barr virus]
uccugaagcgaagcagcuccg

SEQ ID NO: 3973348 - RNA, 14 nt, Human herpesvirus 4 [Epstein-Barr virus]
uccugcccucccac

SEQ ID NO: 3973349 - RNA, 23 nt, Human herpesvirus 4 [Epstein-Barr virus]
uccuggccgggcgccugcuccac

SEQ ID NO: 3973350 - RNA, 13 nt, Human herpesvirus 4 [Epstein-Barr virus]
uccuuagacugag

SEQ ID NO: 3973351 - RNA, 17 nt, Human herpesvirus 4 [Epstein-Barr virus]
uccuuggagcuguaacu

SEQ ID NO: 3973352 - RNA, 15 nt, Human herpesvirus 4 [Epstein-Barr virus]
ucgacuucugaagau

SEQ ID NO: 3973353 - RNA, 22 nt, Human herpesvirus 4 [Epstein-Barr virus]
ucgagauuguuuacaucugccc

SEQ ID NO: 3973354 - RNA, 13 nt, Human herpesvirus 4 [Epstein-Barr virus]
ucgaguucucuag

SEQ ID NO: 3973355 - RNA, 19 nt, Human herpesvirus 4 [Epstein-Barr virus]
ucgauuggaaaagggccca

SEQ ID NO: 3973356 - RNA, 17 nt, Human herpesvirus 4 [Epstein-Barr virus]
ucgcccccucugccucc

SEQ ID NO: 3973357 - RNA, 18 nt, Human herpesvirus 4 [Epstein-Barr virus]
ucgccgcuaguuggucca

SEQ ID NO: 3973358 - RNA, 15 nt, Human herpesvirus 4 [Epstein-Barr virus]
ucgccugccacuucc

SEQ ID NO: 3973359 - RNA, 21 nt, Human herpesvirus 4 [Epstein-Barr virus]
ucggguccuagcacaaaccag

SEQ ID NO: 3973360 - RNA, 12 nt, Human herpesvirus 4 [Epstein-Barr virus]
ucggugggccag

SEQ ID NO: 3973361 - RNA, 21 nt, Human herpesvirus 4 [Epstein-Barr virus]
ucguagcuuugaugaggcuga

SEQ ID NO: 3973362 - RNA, 20 nt, Human herpesvirus 4 [Epstein-Barr virus]
cuccguccuuguccaggaga

SEQ ID NO: 3973363 - RNA, 15 nt, Human herpesvirus 4 [Epstein-Barr virus]
cuccgugguccugag

SEQ ID NO: 3973364 - RNA, 15 nt, Human herpesvirus 4 [Epstein-Barr virus]
cuccuaucacaggga

SEQ ID NO: 3973365 - RNA, 21 nt, Human herpesvirus 4 [Epstein-Barr virus]
cuccucgcaggccccccgcac

SEQ ID NO: 3973366 - RNA, 17 nt, Human herpesvirus 4 [Epstein-Barr virus]
cuccugauuugcucuuc

SEQ ID NO: 3973367 - RNA, 15 nt, Human herpesvirus 4 [Epstein-Barr virus]
cuccugccugccucu

SEQ ID NO: 3973368 - RNA, 22 nt, Human herpesvirus 4 [Epstein-Barr virus]
cuccugccugccucugcucugg

SEQ ID NO: 3973369 - RNA, 14 nt, Human herpesvirus 4 [Epstein-Barr virus]
cuccuucuuggccu

SEQ ID NO: 3973370 - RNA, 22 nt, Human herpesvirus 4 [Epstein-Barr virus]
cuccuuggagcuguaacugugg

SEQ ID NO: 3973371 - RNA, 21 nt, Human herpesvirus 4 [Epstein-Barr virus]
cucgccgcuaguugguccagg

SEQ ID NO: 3973372 - RNA, 19 nt, Human herpesvirus 4 [Epstein-Barr virus]
cucggccuccuggccagca

SEQ ID NO: 3973373 - RNA, 23 nt, Human herpesvirus 4 [Epstein-Barr virus]
cucggcggggaacgugacaggca

SEQ ID NO: 3973374 - RNA, 17 nt, Human herpesvirus 4 [Epstein-Barr virus]
cucuccacucccagucc

SEQ ID NO: 3973375 - RNA, 16 nt, Human herpesvirus 4 [Epstein-Barr virus]
cucucuggcugugcug

SEQ ID NO: 3973376 - RNA, 13 nt, Human herpesvirus 4 [Epstein-Barr virus]
cucugcauggaga

SEQ ID NO: 3973377 - RNA, 14 nt, Human herpesvirus 4 [Epstein-Barr virus]
cucugcauggagaa

SEQ ID NO: 3973378 - RNA, 15 nt, Human herpesvirus 4 [Epstein-Barr virus]
cucugccgcgcugcu

SEQ ID NO: 3973379 - RNA, 18 nt, Human herpesvirus 4 [Epstein-Barr virus]
cucuggucgcccccucug

SEQ ID NO: 3973380 - RNA, 12 nt, Human herpesvirus 4 [Epstein-Barr virus]
cucuguuccuuc

SEQ ID NO: 3973381 - RNA, 15 nt, Human herpesvirus 4 [Epstein-Barr virus]
cucuucaaccuuggc

SEQ ID NO: 3973382 - RNA, 18 nt, Human herpesvirus 4 [Epstein-Barr virus]
cucuucauguccacugag

SEQ ID NO: 3973383 - RNA, 22 nt, Human herpesvirus 4 [Epstein-Barr virus]
cucuucgggcaagauggagagg

SEQ ID NO: 3973384 - RNA, 18 nt, Human herpesvirus 4 [Epstein-Barr virus]
cucuuggugcagcccuuu

SEQ ID NO: 3973385 - RNA, 18 nt, Human herpesvirus 4 [Epstein-Barr virus]
cucuuucuggccaaccug

SEQ ID NO: 3973386 - RNA, 18 nt, Human herpesvirus 4 [Epstein-Barr virus]
cucuuuguggccuuccuc

SEQ ID NO: 3973387 - RNA, 16 nt, Human herpesvirus 4 [Epstein-Barr virus]
cugacacacaggccug

SEQ ID NO: 3973388 - RNA, 18 nt, Human herpesvirus 4 [Epstein-Barr virus]
cugacacacaggccuggc

SEQ ID NO: 3973389 - RNA, 14 nt, Human herpesvirus 4 [Epstein-Barr virus]
cugacacuuuagag

SEQ ID NO: 3973390 - RNA, 18 nt, Human herpesvirus 4 [Epstein-Barr virus]
cugacccuucugcugcug

SEQ ID NO: 3973391 - RNA, 19 nt, Human herpesvirus 4 [Epstein-Barr virus]
cugacccuucugcugcugc

SEQ ID NO: 3973392 - RNA, 14 nt, Human herpesvirus 4 [Epstein-Barr virus]
cugaccgacgggca

SEQ ID NO: 3973393 - RNA, 14 nt, Human herpesvirus 4 [Epstein-Barr virus]
cugacgcuccagga

SEQ ID NO: 3973394 - RNA, 14 nt, Human herpesvirus 4 [Epstein-Barr virus]
cugagaaucuccug

SEQ ID NO: 3973395 - RNA, 17 nt, Human herpesvirus 4 [Epstein-Barr virus]
cugagcaccaacacaac

SEQ ID NO: 3973396 - RNA, 16 nt, Human herpesvirus 4 [Epstein-Barr virus]
cugagcugccugguga

SEQ ID NO: 3973397 - RNA, 20 nt, Human herpesvirus 4 [Epstein-Barr virus]
cugaggcggcuguggccucu

SEQ ID NO: 3973398 - RNA, 13 nt, Human herpesvirus 4 [Epstein-Barr virus]
cugagugcccagg

SEQ ID NO: 3973399 - RNA, 17 nt, Human herpesvirus 4 [Epstein-Barr virus]
cugauaaugucuucaau

SEQ ID NO: 3973400 - RNA, 23 nt, Human herpesvirus 4 [Epstein-Barr virus]
cugauucccccugcucauaccuc

SEQ ID NO: 3973401 - RNA, 19 nt, Human herpesvirus 4 [Epstein-Barr virus]
cugcacaaaggaaacugcu

SEQ ID NO: 3973402 - RNA, 21 nt, Human herpesvirus 4 [Epstein-Barr virus]
cugcacaaaggaaacugcuga

SEQ ID NO: 3973403 - RNA, 18 nt, Human herpesvirus 4 [Epstein-Barr virus]
cugcacuauauucuccag

SEQ ID NO: 3973404 - RNA, 12 nt, Human herpesvirus 4 [Epstein-Barr virus]
cugcaggcugga

SEQ ID NO: 3973405 - RNA, 20 nt, Human herpesvirus 4 [Epstein-Barr virus]
cugccaacuuugagcugggc

SEQ ID NO: 3973406 - RNA, 14 nt, Human herpesvirus 4 [Epstein-Barr virus]
cugccacaaggcca

SEQ ID NO: 3973407 - RNA, 19 nt, Human herpesvirus 4 [Epstein-Barr virus]
cugccccaauaugccaacc

SEQ ID NO: 3973408 - RNA, 21 nt, Human herpesvirus 4 [Epstein-Barr virus]
cugcccccggagcccugcccu

SEQ ID NO: 3973409 - RNA, 12 nt, Human herpesvirus 4 [Epstein-Barr virus]
cugccgccgccu

SEQ ID NO: 3973410 - RNA, 23 nt, Human herpesvirus 4 [Epstein-Barr virus]
cugccggaguuuucucccccaga

SEQ ID NO: 3973411 - RNA, 22 nt, Human herpesvirus 4 [Epstein-Barr virus]
cugccuauggauagauagccac

SEQ ID NO: 3973412 - RNA, 23 nt, Human herpesvirus 4 [Epstein-Barr virus]
cugccucgaguaggugccuccag

SEQ ID NO: 3973413 - RNA, 21 nt, Human herpesvirus 4 [Epstein-Barr virus]
cugcgaaacuugggggcaggc

SEQ ID NO: 3973414 - RNA, 17 nt, Human herpesvirus 4 [Epstein-Barr virus]
cugcgaugaggcggugg

SEQ ID NO: 3973415 - RNA, 19 nt, Human herpesvirus 4 [Epstein-Barr virus]
cugcgaugagggccuucca

SEQ ID NO: 3973416 - RNA, 17 nt, Human herpesvirus 4 [Epstein-Barr virus]
cugcggcccacugaaaa

SEQ ID NO: 3973417 - RNA, 13 nt, Human herpesvirus 4 [Epstein-Barr virus]
cugcggggaggag

SEQ ID NO: 3973418 - RNA, 16 nt, Human herpesvirus 4 [Epstein-Barr virus]
cugcuauucugagcac

SEQ ID NO: 3973419 - RNA, 20 nt, Human herpesvirus 4 [Epstein-Barr virus]
cugcucggggcaugcugccc

SEQ ID NO: 3973420 - RNA, 13 nt, Human herpesvirus 4 [Epstein-Barr virus]
cugcugcugcugg

SEQ ID NO: 3973421 - RNA, 14 nt, Human herpesvirus 4 [Epstein-Barr virus]
cugcugcugcuggu

SEQ ID NO: 3973422 - RNA, 14 nt, Human herpesvirus 4 [Epstein-Barr virus]
cugcuggucauggc

SEQ ID NO: 3973423 - RNA, 14 nt, Human herpesvirus 4 [Epstein-Barr virus]
cugcuucuggcucu

SEQ ID NO: 3973424 - RNA, 22 nt, Human herpesvirus 4 [Epstein-Barr virus]
cuggacccuauggagggcagcg

SEQ ID NO: 3973425 - RNA, 18 nt, Human herpesvirus 4 [Epstein-Barr virus]
cuggacgagguccuggac

SEQ ID NO: 3973426 - RNA, 15 nt, Human herpesvirus 4 [Epstein-Barr virus]
cuggagagcaugcag

SEQ ID NO: 3973427 - RNA, 22 nt, Human herpesvirus 4 [Epstein-Barr virus]
cuggaggucuucucugacaaau

SEQ ID NO: 3973428 - RNA, 18 nt, Human herpesvirus 4 [Epstein-Barr virus]
cuggcaaagauccccagu

SEQ ID NO: 3973429 - RNA, 23 nt, Human herpesvirus 4 [Epstein-Barr virus]
cuggcaaagauccccaguggagc

SEQ ID NO: 3973430 - RNA, 13 nt, Human herpesvirus 4 [Epstein-Barr virus]
cuggcacacacuc

SEQ ID NO: 3973431 - RNA, 15 nt, Human herpesvirus 4 [Epstein-Barr virus]
cuggcacacacuccc

SEQ ID NO: 3973432 - RNA, 16 nt, Human herpesvirus 4 [Epstein-Barr virus]
cuggcagaaaggcugg

SEQ ID NO: 3973433 - RNA, 12 nt, Human herpesvirus 4 [Epstein-Barr virus]
cuggccaaccug

SEQ ID NO: 3973434 - RNA, 19 nt, Human herpesvirus 4 [Epstein-Barr virus]
cuggccgagcuggaggcca

SEQ ID NO: 3973435 - RNA, 13 nt, Human herpesvirus 4 [Epstein-Barr virus]
cuggcucagcuug

SEQ ID NO: 3973436 - RNA, 16 nt, Human herpesvirus 4 [Epstein-Barr virus]
cugggaggaaguuuua

SEQ ID NO: 3973437 - RNA, 24 nt, Human herpesvirus 4 [Epstein-Barr virus]
cugggagguagauagguggucgca

SEQ ID NO: 3973438 - RNA, 17 nt, Human herpesvirus 4 [Epstein-Barr virus]
cugggaguccggcccuu

SEQ ID NO: 3973439 - RNA, 20 nt, Human herpesvirus 4 [Epstein-Barr virus]
cugggaugaacccuggggca

SEQ ID NO: 3973440 - RNA, 14 nt, Human herpesvirus 4 [Epstein-Barr virus]
cugggcagccagag

SEQ ID NO: 3973441 - RNA, 15 nt, Human herpesvirus 4 [Epstein-Barr virus]
cugggcagccagagc

SEQ ID NO: 3973442 - RNA, 15 nt, Human herpesvirus 4 [Epstein-Barr virus]
cugggccgcccggcc

SEQ ID NO: 3973443 - RNA, 18 nt, Human herpesvirus 4 [Epstein-Barr virus]
cuggggucucaggccucc

SEQ ID NO: 3973444 - RNA, 17 nt, Human herpesvirus 4 [Epstein-Barr virus]
cuggggugugaagggca

SEQ ID NO: 3973445 - RNA, 14 nt, Human herpesvirus 4 [Epstein-Barr virus]
cugggugcugagcg

SEQ ID NO: 3973446 - RNA, 12 nt, Human herpesvirus 4 [Epstein-Barr virus]
cuggucagggga

SEQ ID NO: 3973447 - RNA, 13 nt, Human herpesvirus 4 [Epstein-Barr virus]
cuggucaucagcc

SEQ ID NO: 3973448 - RNA, 22 nt, Human herpesvirus 4 [Epstein-Barr virus]
cuggugcgguuauaacugccag

SEQ ID NO: 3973449 - RNA, 12 nt, Human herpesvirus 4 [Epstein-Barr virus]
cugguggcccag

SEQ ID NO: 3973450 - RNA, 16 nt, Human herpesvirus 4 [Epstein-Barr virus]
gccugaguccaacauu

SEQ ID NO: 3973451 - RNA, 23 nt, Human herpesvirus 4 [Epstein-Barr virus]
gccugcaccaguggcugccccgg

SEQ ID NO: 3973452 - RNA, 18 nt, Human herpesvirus 4 [Epstein-Barr virus]
gccugcggacucaggcca

SEQ ID NO: 3973453 - RNA, 16 nt, Human herpesvirus 4 [Epstein-Barr virus]
cuggugggcucccucu

SEQ ID NO: 3973454 - RNA, 21 nt, Human herpesvirus 4 [Epstein-Barr virus]
cugguuguaaccuaugccugg

SEQ ID NO: 3973455 - RNA, 12 nt, Human herpesvirus 4 [Epstein-Barr virus]
cuguaacugugg

SEQ ID NO: 3973456 - RNA, 14 nt, Human herpesvirus 4 [Epstein-Barr virus]
cuguaaucacuggc

SEQ ID NO: 3973457 - RNA, 13 nt, Human herpesvirus 4 [Epstein-Barr virus]
cuguacgccgccg

SEQ ID NO: 3973458 - RNA, 13 nt, Human herpesvirus 4 [Epstein-Barr virus]
cuguagccacccg

SEQ ID NO: 3973459 - RNA, 13 nt, Human herpesvirus 4 [Epstein-Barr virus]
cugucucccaccc

SEQ ID NO: 3973460 - RNA, 22 nt, Human herpesvirus 4 [Epstein-Barr virus]
cugugcugacccuucugcugcu

SEQ ID NO: 3973461 - RNA, 22 nt, Human herpesvirus 4 [Epstein-Barr virus]
cuguugcgcccggcccuguaca

SEQ ID NO: 3973462 - RNA, 23 nt, Human herpesvirus 4 [Epstein-Barr virus]
cuguuucuguacaauggggccag

SEQ ID NO: 3973463 - RNA, 20 nt, Human herpesvirus 4 [Epstein-Barr virus]
cuguuuguccagcagggccu

SEQ ID NO: 3973464 - RNA, 13 nt, Human herpesvirus 4 [Epstein-Barr virus]
cuuacugcccagc

SEQ ID NO: 3973465 - RNA, 17 nt, Human herpesvirus 4 [Epstein-Barr virus]
cuuccagagaggcgcag

SEQ ID NO: 3973466 - RNA, 18 nt, Human herpesvirus 4 [Epstein-Barr virus]
cuucccagacucugcuuu

SEQ ID NO: 3973467 - RNA, 16 nt, Human herpesvirus 4 [Epstein-Barr virus]
cuuccgugccucgggc

SEQ ID NO: 3973468 - RNA, 23 nt, Human herpesvirus 4 [Epstein-Barr virus]
cuuccuggccggccgcccccuga

SEQ ID NO: 3973469 - RNA, 21 nt, Human herpesvirus 4 [Epstein-Barr virus]
cuucggucaaguaccagcugg

SEQ ID NO: 3973470 - RNA, 17 nt, Human herpesvirus 4 [Epstein-Barr virus]
cuucucauuagucagga

SEQ ID NO: 3973471 - RNA, 16 nt, Human herpesvirus 4 [Epstein-Barr virus]
cuucugcugcugcugg

SEQ ID NO: 3973472 - RNA, 21 nt, Human herpesvirus 4 [Epstein-Barr virus]
cuucuggcacgacuguuccua

SEQ ID NO: 3973473 - RNA, 14 nt, Human herpesvirus 4 [Epstein-Barr virus]
cuucuggcucuucu

SEQ ID NO: 3973474 - RNA, 19 nt, Human herpesvirus 4 [Epstein-Barr virus]
cuucuggcucuucugggaa

SEQ ID NO: 3973475 - RNA, 13 nt, Human herpesvirus 4 [Epstein-Barr virus]
gcagggcaaagcc

SEQ ID NO: 3973476 - RNA, 12 nt, Human herpesvirus 4 [Epstein-Barr virus]
gcagggcccagu

SEQ ID NO: 3973477 - RNA, 14 nt, Human herpesvirus 4 [Epstein-Barr virus]
gcagggguggugga

SEQ ID NO: 3973478 - RNA, 22 nt, Human herpesvirus 4 [Epstein-Barr virus]
gcaucaugcgugaccaccuggc

SEQ ID NO: 3973479 - RNA, 13 nt, Human herpesvirus 4 [Epstein-Barr virus]
gcauccucaaggg

SEQ ID NO: 3973480 - RNA, 15 nt, Human herpesvirus 4 [Epstein-Barr virus]
gcauggcggccuggc

SEQ ID NO: 3973481 - RNA, 14 nt, Human herpesvirus 4 [Epstein-Barr virus]
gcauuuuuggugcu

SEQ ID NO: 3973482 - RNA, 15 nt, Human herpesvirus 4 [Epstein-Barr virus]
gccaaagcugaagaa

SEQ ID NO: 3973483 - RNA, 21 nt, Human herpesvirus 4 [Epstein-Barr virus]
gccaaccugcucucucuggag

SEQ ID NO: 3973484 - RNA, 18 nt, Human herpesvirus 4 [Epstein-Barr virus]
gccaagguccugggccuc

SEQ ID NO: 3973485 - RNA, 12 nt, Human herpesvirus 4 [Epstein-Barr virus]
gccacacccacc

SEQ ID NO: 3973486 - RNA, 14 nt, Human herpesvirus 4 [Epstein-Barr virus]
gccacacuggggac

SEQ ID NO: 3973487 - RNA, 16 nt, Human herpesvirus 4 [Epstein-Barr virus]
gccacagagcaucaga

SEQ ID NO: 3973488 - RNA, 23 nt, Human herpesvirus 4 [Epstein-Barr virus]
gccacauguuuucuggacacagg

SEQ ID NO: 3973489 - RNA, 17 nt, Human herpesvirus 4 [Epstein-Barr virus]
gccacccucccccugcc

SEQ ID NO: 3973490 - RNA, 17 nt, Human herpesvirus 4 [Epstein-Barr virus]
gccacugcaggcuggac

SEQ ID NO: 3973491 - RNA, 21 nt, Human herpesvirus 4 [Epstein-Barr virus]
gccagacucucuucagugacc

SEQ ID NO: 3973492 - RNA, 18 nt, Human herpesvirus 4 [Epstein-Barr virus]
gccagagcggcauccuca

SEQ ID NO: 3973493 - RNA, 13 nt, Human herpesvirus 4 [Epstein-Barr virus]
gccagaggcgacg

SEQ ID NO: 3973494 - RNA, 17 nt, Human herpesvirus 4 [Epstein-Barr virus]
gccagccggcucgaccg

SEQ ID NO: 3973495 - RNA, 20 nt, Human herpesvirus 4 [Epstein-Barr virus]
gccaggcagaggaaggccac

SEQ ID NO: 3973496 - RNA, 12 nt, Human herpesvirus 4 [Epstein-Barr virus]
gccagguacagg

SEQ ID NO: 3973497 - RNA, 15 nt, Human herpesvirus 4 [Epstein-Barr virus]
gccagguacaggacc

SEQ ID NO: 3973498 - RNA, 18 nt, Human herpesvirus 4 [Epstein-Barr virus]
gccagucuccgggucagg

SEQ ID NO: 3973499 - RNA, 19 nt, Human herpesvirus 4 [Epstein-Barr virus]
gccagucuccgggucaggu

SEQ ID NO: 3973500 - RNA, 16 nt, Human herpesvirus 4 [Epstein-Barr virus]
gccaucaccucuugau

SEQ ID NO: 3973501 - RNA, 17 nt, Human herpesvirus 4 [Epstein-Barr virus]
gccaugaccagcagcag

SEQ ID NO: 3973502 - RNA, 16 nt, Human herpesvirus 4 [Epstein-Barr virus]
gccaugcuaucuugua

SEQ ID NO: 3973503 - RNA, 18 nt, Human herpesvirus 4 [Epstein-Barr virus]
gccauggccgagaagcuu

SEQ ID NO: 3973504 - RNA, 17 nt, Human herpesvirus 4 [Epstein-Barr virus]
gccauguguguccagug

SEQ ID NO: 3973505 - RNA, 18 nt, Human herpesvirus 4 [Epstein-Barr virus]
gcccaagaagaagcccac

SEQ ID NO: 3973506 - RNA, 19 nt, Human herpesvirus 4 [Epstein-Barr virus]
gcccacacagcgccagcag

SEQ ID NO: 3973507 - RNA, 15 nt, Human herpesvirus 4 [Epstein-Barr virus]
gcccaccagccagcg

SEQ ID NO: 3973508 - RNA, 17 nt, Human herpesvirus 4 [Epstein-Barr virus]
gcccaccagccagcgac

SEQ ID NO: 3973509 - RNA, 17 nt, Human herpesvirus 4 [Epstein-Barr virus]
gcccagaggcgcugugg

SEQ ID NO: 3973510 - RNA, 17 nt, Human herpesvirus 4 [Epstein-Barr virus]
gcccagggacaucccca

SEQ ID NO: 3973511 - RNA, 16 nt, Human herpesvirus 4 [Epstein-Barr virus]
gcccagugcacccagg

SEQ ID NO: 3973512 - RNA, 20 nt, Human herpesvirus 4 [Epstein-Barr virus]
gccccaauucuugcacccac

SEQ ID NO: 3973513 - RNA, 21 nt, Human herpesvirus 4 [Epstein-Barr virus]
gccccaauucuugcacccacc

SEQ ID NO: 3973514 - RNA, 16 nt, Human herpesvirus 4 [Epstein-Barr virus]
gcccccaccacuccca

SEQ ID NO: 3973515 - RNA, 19 nt, Human herpesvirus 4 [Epstein-Barr virus]
gccccccgcaccagggcca

SEQ ID NO: 3973516 - RNA, 17 nt, Human herpesvirus 4 [Epstein-Barr virus]
gcccccggagcccugcc

SEQ ID NO: 3973517 - RNA, 19 nt, Human herpesvirus 4 [Epstein-Barr virus]
gcccccucuuuguggccuu

SEQ ID NO: 3973518 - RNA, 12 nt, Human herpesvirus 4 [Epstein-Barr virus]
gcccccugaccu

SEQ ID NO: 3973519 - RNA, 18 nt, Human herpesvirus 4 [Epstein-Barr virus]
gccccgaaagcggcccag

SEQ ID NO: 3973520 - RNA, 15 nt, Human herpesvirus 4 [Epstein-Barr virus]
gccccgggcccagcc

SEQ ID NO: 3973521 - RNA, 14 nt, Human herpesvirus 4 [Epstein-Barr virus]
gccccgggcggcuc

SEQ ID NO: 3973522 - RNA, 16 nt, Human herpesvirus 4 [Epstein-Barr virus]
gccccgguccccccag

SEQ ID NO: 3973523 - RNA, 12 nt, Human herpesvirus 4 [Epstein-Barr virus]
gccccucagccu

SEQ ID NO: 3973524 - RNA, 21 nt, Human herpesvirus 4 [Epstein-Barr virus]
gcccgccuggcucgccuggag

SEQ ID NO: 3973525 - RNA, 20 nt, Human herpesvirus 4 [Epstein-Barr virus]
gcccguuccaggcucuccag

SEQ ID NO: 3973526 - RNA, 19 nt, Human herpesvirus 4 [Epstein-Barr virus]
gcccucauuccacggcccg

SEQ ID NO: 3973527 - RNA, 20 nt, Human herpesvirus 4 [Epstein-Barr virus]
gcccuccuccacccagcagc

SEQ ID NO: 3973528 - RNA, 21 nt, Human herpesvirus 4 [Epstein-Barr virus]
gcccuccucugggccgcccgg

SEQ ID NO: 3973529 - RNA, 22 nt, Human herpesvirus 4 [Epstein-Barr virus]
gcccuccucugggccgcccggc

SEQ ID NO: 3973530 - RNA, 13 nt, Human herpesvirus 4 [Epstein-Barr virus]
gcccucuccagca

SEQ ID NO: 3973531 - RNA, 22 nt, Human herpesvirus 4 [Epstein-Barr virus]
gcccugcaaacugacacacagg

SEQ ID NO: 3973532 - RNA, 17 nt, Human herpesvirus 4 [Epstein-Barr virus]
gcccuggaggccucagg

SEQ ID NO: 3973533 - RNA, 18 nt, Human herpesvirus 4 [Epstein-Barr virus]
gccgccagcauggcagcc

SEQ ID NO: 3973534 - RNA, 14 nt, Human herpesvirus 4 [Epstein-Barr virus]
gccgccccgggccc

SEQ ID NO: 3973535 - RNA, 14 nt, Human herpesvirus 4 [Epstein-Barr virus]
gccgccgccagcag

SEQ ID NO: 3973536 - RNA, 15 nt, Human herpesvirus 4 [Epstein-Barr virus]
gccgccgccagcagc

SEQ ID NO: 3973537 - RNA, 13 nt, Human herpesvirus 4 [Epstein-Barr virus]
gccgcgcugcucg

SEQ ID NO: 3973538 - RNA, 19 nt, Human herpesvirus 4 [Epstein-Barr virus]
gccgcguguuugcugcucg

SEQ ID NO: 3973539 - RNA, 22 nt, Human herpesvirus 4 [Epstein-Barr virus]
gccgcuccguggccccgggagc

SEQ ID NO: 3973540 - RNA, 20 nt, Human herpesvirus 4 [Epstein-Barr virus]
gccggaugccugccuaugga

SEQ ID NO: 3973541 - RNA, 14 nt, Human herpesvirus 4 [Epstein-Barr virus]
gccggcgcugugug

SEQ ID NO: 3973542 - RNA, 14 nt, Human herpesvirus 4 [Epstein-Barr virus]
gccgggagaggcag

SEQ ID NO: 3973543 - RNA, 18 nt, Human herpesvirus 4 [Epstein-Barr virus]
gccgguggauccuccacc

SEQ ID NO: 3973544 - RNA, 23 nt, Human herpesvirus 4 [Epstein-Barr virus]
gccguccacggccguagcccagu

SEQ ID NO: 3973545 - RNA, 14 nt, Human herpesvirus 4 [Epstein-Barr virus]
gccgucccagggcc

SEQ ID NO: 3973546 - RNA, 19 nt, Human herpesvirus 4 [Epstein-Barr virus]
gccgucucaaacggggaag

SEQ ID NO: 3973547 - RNA, 19 nt, Human herpesvirus 4 [Epstein-Barr virus]
gccuagccaucggggcacg

SEQ ID NO: 3973548 - RNA, 17 nt, Human herpesvirus 4 [Epstein-Barr virus]
gccuccuggccagcacc

SEQ ID NO: 3973549 - RNA, 14 nt, Human herpesvirus 4 [Epstein-Barr virus]
gccucuaccuucca

SEQ ID NO: 3973550 - RNA, 16 nt, Human herpesvirus 4 [Epstein-Barr virus]
gccucuacgccccaga

SEQ ID NO: 3973551 - RNA, 20 nt, Human herpesvirus 4 [Epstein-Barr virus]
gccucucaaaggccuuggac

SEQ ID NO: 3973552 - RNA, 18 nt, Human herpesvirus 4 [Epstein-Barr virus]
gccucuccguacccccuc

SEQ ID NO: 3973553 - RNA, 15 nt, Human herpesvirus 4 [Epstein-Barr virus]
gccugacggugccgc

SEQ ID NO: 3973554 - RNA, 20 nt, Human herpesvirus 4 [Epstein-Barr virus]
cccagguaccuuccuguguu

SEQ ID NO: 3973555 - RNA, 16 nt, Human herpesvirus 4 [Epstein-Barr virus]
cccaucuuggcccguc

SEQ ID NO: 3973556 - RNA, 17 nt, Human herpesvirus 4 [Epstein-Barr virus]
ccccaaaaguagaggcu

SEQ ID NO: 3973557 - RNA, 13 nt, Human herpesvirus 4 [Epstein-Barr virus]
ccccaccaccacc

SEQ ID NO: 3973558 - RNA, 17 nt, Human herpesvirus 4 [Epstein-Barr virus]
ccccagcugcaucuucc

SEQ ID NO: 3973559 - RNA, 22 nt, Human herpesvirus 4 [Epstein-Barr virus]
ccccccgccuuugggcacccca

SEQ ID NO: 3973560 - RNA, 11 nt, Human herpesvirus 4 [Epstein-Barr virus]
cccccuccauu

SEQ ID NO: 3973561 - RNA, 21 nt, Human herpesvirus 4 [Epstein-Barr virus]
ccccuauauccuagagggaca

SEQ ID NO: 3973562 - RNA, 13 nt, Human herpesvirus 4 [Epstein-Barr virus]
ccccucugcagag

SEQ ID NO: 3973563 - RNA, 16 nt, Human herpesvirus 4 [Epstein-Barr virus]
ccccuggagccagcgc

SEQ ID NO: 3973564 - RNA, 17 nt, Human herpesvirus 4 [Epstein-Barr virus]
ccccuggcggcccagcc

SEQ ID NO: 3973565 - RNA, 15 nt, Human herpesvirus 4 [Epstein-Barr virus]
ccccuguccacugcc

SEQ ID NO: 3973566 - RNA, 23 nt, Human herpesvirus 4 [Epstein-Barr virus]
ccccuguccacugccccgguccc

SEQ ID NO: 3973567 - RNA, 16 nt, Human herpesvirus 4 [Epstein-Barr virus]
cccgaguccaaggccc

SEQ ID NO: 3973568 - RNA, 15 nt, Human herpesvirus 4 [Epstein-Barr virus]
cccgcaccagggcca

SEQ ID NO: 3973569 - RNA, 17 nt, Human herpesvirus 4 [Epstein-Barr virus]
cccggcccucuuccgug

SEQ ID NO: 3973570 - RNA, 12 nt, Human herpesvirus 4 [Epstein-Barr virus]
cccggcucucag

SEQ ID NO: 3973571 - RNA, 20 nt, Human herpesvirus 4 [Epstein-Barr virus]
cccggcuggccgccguggcc

SEQ ID NO: 3973572 - RNA, 21 nt, Human herpesvirus 4 [Epstein-Barr virus]
cccgggaccgcgcccuccucu

SEQ ID NO: 3973573 - RNA, 12 nt, Human herpesvirus 4 [Epstein-Barr virus]
cccgggagccac

SEQ ID NO: 3973574 - RNA, 18 nt, Human herpesvirus 4 [Epstein-Barr virus]
cccggguucgggcacgcc

SEQ ID NO: 3973575 - RNA, 17 nt, Human herpesvirus 4 [Epstein-Barr virus]
cccgguccccccagaag

SEQ ID NO: 3973576 - RNA, 16 nt, Human herpesvirus 4 [Epstein-Barr virus]
cccucauugugcugaa

SEQ ID NO: 3973577 - RNA, 16 nt, Human herpesvirus 4 [Epstein-Barr virus]
cccuccucugggccgc

SEQ ID NO: 3973578 - RNA, 17 nt, Human herpesvirus 4 [Epstein-Barr virus]
cccucugggagaagggu

SEQ ID NO: 3973579 - RNA, 16 nt, Human herpesvirus 4 [Epstein-Barr virus]
cccucuguuucuucau

SEQ ID NO: 3973580 - RNA, 13 nt, Human herpesvirus 4 [Epstein-Barr virus]
cccucuugucccu

SEQ ID NO: 3973581 - RNA, 15 nt, Human herpesvirus 4 [Epstein-Barr virus]
cccuggaggccucag

SEQ ID NO: 3973582 - RNA, 13 nt, Human herpesvirus 4 [Epstein-Barr virus]
cccuucugcugcu

SEQ ID NO: 3973583 - RNA, 15 nt, Human herpesvirus 4 [Epstein-Barr virus]
cccuucugcugcugc

SEQ ID NO: 3973584 - RNA, 14 nt, Human herpesvirus 4 [Epstein-Barr virus]
ccgaaagcacuuug

SEQ ID NO: 3973585 - RNA, 13 nt, Human herpesvirus 4 [Epstein-Barr virus]
ccgagaccaaggc

SEQ ID NO: 3973586 - RNA, 13 nt, Human herpesvirus 4 [Epstein-Barr virus]
ccgagagcuccgc

SEQ ID NO: 3973587 - RNA, 16 nt, Human herpesvirus 4 [Epstein-Barr virus]
ccgagugaccagucac

SEQ ID NO: 3973588 - RNA, 17 nt, Human herpesvirus 4 [Epstein-Barr virus]
ccgcagaagagccgcuc

SEQ ID NO: 3973589 - RNA, 14 nt, Human herpesvirus 4 [Epstein-Barr virus]
ccgcagguggcugc

SEQ ID NO: 3973590 - RNA, 14 nt, Human herpesvirus 4 [Epstein-Barr virus]
ccgccaccuccggg

SEQ ID NO: 3973591 - RNA, 17 nt, Human herpesvirus 4 [Epstein-Barr virus]
ccgccccgggcccggga

SEQ ID NO: 3973592 - RNA, 15 nt, Human herpesvirus 4 [Epstein-Barr virus]
ccgccgccagcagcc

SEQ ID NO: 3973593 - RNA, 23 nt, Human herpesvirus 4 [Epstein-Barr virus]
ccgccguaaucuguggugggcuc

SEQ ID NO: 3973594 - RNA, 15 nt, Human herpesvirus 4 [Epstein-Barr virus]
ccgccucccccagcc

SEQ ID NO: 3973595 - RNA, 14 nt, Human herpesvirus 4 [Epstein-Barr virus]
ccgcgcccuccucu

SEQ ID NO: 3973596 - RNA, 15 nt, Human herpesvirus 4 [Epstein-Barr virus]
ccgcguguuugcugc

SEQ ID NO: 3973597 - RNA, 17 nt, Human herpesvirus 4 [Epstein-Barr virus]
ccgcguguuugcugcuc

SEQ ID NO: 3973598 - RNA, 19 nt, Human herpesvirus 4 [Epstein-Barr virus]
ccgcuccguggccccggga

SEQ ID NO: 3973599 - RNA, 23 nt, Human herpesvirus 4 [Epstein-Barr virus]
ccgcugcacaaaggaaacugcug

SEQ ID NO: 3973600 - RNA, 22 nt, Human herpesvirus 4 [Epstein-Barr virus]
ccgcugggccaggucacagacc

SEQ ID NO: 3973601 - RNA, 13 nt, Human herpesvirus 4 [Epstein-Barr virus]
ccggccgaggccu

SEQ ID NO: 3973602 - RNA, 20 nt, Human herpesvirus 4 [Epstein-Barr virus]
ccggcggcaguggaccucaa

SEQ ID NO: 3973603 - RNA, 15 nt, Human herpesvirus 4 [Epstein-Barr virus]
ccggggcggcggugg

SEQ ID NO: 3973604 - RNA, 14 nt, Human herpesvirus 4 [Epstein-Barr virus]
ccgggggccuuguc

SEQ ID NO: 3973605 - RNA, 17 nt, Human herpesvirus 4 [Epstein-Barr virus]
ccggggguccagccggg

SEQ ID NO: 3973606 - RNA, 22 nt, Human herpesvirus 4 [Epstein-Barr virus]
ccggguuugauguuucuguggc

SEQ ID NO: 3973607 - RNA, 12 nt, Human herpesvirus 4 [Epstein-Barr virus]
ccggugcugcca

SEQ ID NO: 3973608 - RNA, 14 nt, Human herpesvirus 4 [Epstein-Barr virus]
ccgugcaccugcca

SEQ ID NO: 3973609 - RNA, 13 nt, Human herpesvirus 4 [Epstein-Barr virus]
ccuacgcagaggc

SEQ ID NO: 3973610 - RNA, 21 nt, Human herpesvirus 4 [Epstein-Barr virus]
ccuagccaccguggccaggcc

SEQ ID NO: 3973611 - RNA, 16 nt, Human herpesvirus 4 [Epstein-Barr virus]
ccuagguacucuuggu

SEQ ID NO: 3973612 - RNA, 14 nt, Human herpesvirus 4 [Epstein-Barr virus]
ccuauggagggcag

SEQ ID NO: 3973613 - RNA, 15 nt, Human herpesvirus 4 [Epstein-Barr virus]
ccuauuugcacguug

SEQ ID NO: 3973614 - RNA, 15 nt, Human herpesvirus 4 [Epstein-Barr virus]
ccucacgcgaaggga

SEQ ID NO: 3973615 - RNA, 17 nt, Human herpesvirus 4 [Epstein-Barr virus]
ccucagcuguucccagu

SEQ ID NO: 3973616 - RNA, 19 nt, Human herpesvirus 4 [Epstein-Barr virus]
ccuccaaucaccagccacc

SEQ ID NO: 3973617 - RNA, 20 nt, Human herpesvirus 4 [Epstein-Barr virus]
ccuccacccagcagcagccc

SEQ ID NO: 3973618 - RNA, 23 nt, Human herpesvirus 4 [Epstein-Barr virus]
ccuccgagugaccagucaccuuc

SEQ ID NO: 3973619 - RNA, 14 nt, Human herpesvirus 4 [Epstein-Barr virus]
ccuccucugggccg

SEQ ID NO: 3973620 - RNA, 13 nt, Human herpesvirus 4 [Epstein-Barr virus]
ccuccuggccagc

SEQ ID NO: 3973621 - RNA, 19 nt, Human herpesvirus 4 [Epstein-Barr virus]
ccucggacauccagugucc

SEQ ID NO: 3973622 - RNA, 16 nt, Human herpesvirus 4 [Epstein-Barr virus]
ccucgguggugggcug

SEQ ID NO: 3973623 - RNA, 17 nt, Human herpesvirus 4 [Epstein-Barr virus]
ccucuacgccaggcucg

SEQ ID NO: 3973624 - RNA, 16 nt, Human herpesvirus 4 [Epstein-Barr virus]
ccucuccagcaaccaa

SEQ ID NO: 3973625 - RNA, 17 nt, Human herpesvirus 4 [Epstein-Barr virus]
ccucuccauucccagcc

SEQ ID NO: 3973626 - RNA, 22 nt, Human herpesvirus 4 [Epstein-Barr virus]
ccucugaugguggccggcagcc

SEQ ID NO: 3973627 - RNA, 12 nt, Human herpesvirus 4 [Epstein-Barr virus]
ccucugccggga

SEQ ID NO: 3973628 - RNA, 18 nt, Human herpesvirus 4 [Epstein-Barr virus]
ccucugccuccggccgcc

SEQ ID NO: 3973629 - RNA, 13 nt, Human herpesvirus 4 [Epstein-Barr virus]
ccucugggccgcc

SEQ ID NO: 3973630 - RNA, 17 nt, Human herpesvirus 4 [Epstein-Barr virus]
ccugaccgaauggggca

SEQ ID NO: 3973631 - RNA, 20 nt, Human herpesvirus 4 [Epstein-Barr virus]
ccugaccgaauggggcagug

SEQ ID NO: 3973632 - RNA, 13 nt, Human herpesvirus 4 [Epstein-Barr virus]
ccugacugacucu

SEQ ID NO: 3973633 - RNA, 20 nt, Human herpesvirus 4 [Epstein-Barr virus]
ccugacugacucucccucca

SEQ ID NO: 3973634 - RNA, 17 nt, Human herpesvirus 4 [Epstein-Barr virus]
ccugauauugucccccu

SEQ ID NO: 3973635 - RNA, 24 nt, Human herpesvirus 4 [Epstein-Barr virus]
ccugcagaguaauugcaguggacc

SEQ ID NO: 3973636 - RNA, 23 nt, Human herpesvirus 4 [Epstein-Barr virus]
ccugcgcuacuaugacaccuauc

SEQ ID NO: 3973637 - RNA, 18 nt, Human herpesvirus 4 [Epstein-Barr virus]
ccuggaagcaggagaugg

SEQ ID NO: 3973638 - RNA, 23 nt, Human herpesvirus 4 [Epstein-Barr virus]
ccuggacgagggggcgcggcugg

SEQ ID NO: 3973639 - RNA, 23 nt, Human herpesvirus 4 [Epstein-Barr virus]
ccuggagagcaugcaggucaggu

SEQ ID NO: 3973640 - RNA, 14 nt, Human herpesvirus 4 [Epstein-Barr virus]
ccuggagccagcgc

SEQ ID NO: 3973641 - RNA, 15 nt, Human herpesvirus 4 [Epstein-Barr virus]
ccuggccaggcaccc

SEQ ID NO: 3973642 - RNA, 18 nt, Human herpesvirus 4 [Epstein-Barr virus]
aggcuccggcggcagugg

SEQ ID NO: 3973643 - RNA, 16 nt, Human herpesvirus 4 [Epstein-Barr virus]
aggcucuccagcccca

SEQ ID NO: 3973644 - RNA, 17 nt, Human herpesvirus 4 [Epstein-Barr virus]
agggagacacaucugga

SEQ ID NO: 3973645 - RNA, 15 nt, Human herpesvirus 4 [Epstein-Barr virus]
agggaggacacugcc

SEQ ID NO: 3973646 - RNA, 20 nt, Human herpesvirus 4 [Epstein-Barr virus]
agggcccagggucacuggcu

SEQ ID NO: 3973647 - RNA, 21 nt, Human herpesvirus 4 [Epstein-Barr virus]
agggcgcucugcgccagcccc

SEQ ID NO: 3973648 - RNA, 15 nt, Human herpesvirus 4 [Epstein-Barr virus]
aggggcaggaggggc

SEQ ID NO: 3973649 - RNA, 23 nt, Human herpesvirus 4 [Epstein-Barr virus]
aggggccagguacaggaccugga

SEQ ID NO: 3973650 - RNA, 23 nt, Human herpesvirus 4 [Epstein-Barr virus]
aggggcucgaauaugaugaggac

SEQ ID NO: 3973651 - RNA, 15 nt, Human herpesvirus 4 [Epstein-Barr virus]
agggggccuggugcc

SEQ ID NO: 3973652 - RNA, 16 nt, Human herpesvirus 4 [Epstein-Barr virus]
aggggggaaucuuguu

SEQ ID NO: 3973653 - RNA, 16 nt, Human herpesvirus 4 [Epstein-Barr virus]
aggggguacggagagg

SEQ ID NO: 3973654 - RNA, 16 nt, Human herpesvirus 4 [Epstein-Barr virus]
agggguaacccuguag

SEQ ID NO: 3973655 - RNA, 22 nt, Human herpesvirus 4 [Epstein-Barr virus]
aggggucaccuuggauccccuu

SEQ ID NO: 3973656 - RNA, 16 nt, Human herpesvirus 4 [Epstein-Barr virus]
agggucagcacagcca

SEQ ID NO: 3973657 - RNA, 22 nt, Human herpesvirus 4 [Epstein-Barr virus]
agggucagcacagccagagagg

SEQ ID NO: 3973658 - RNA, 19 nt, Human herpesvirus 4 [Epstein-Barr virus]
agguccuggacgagggggc

SEQ ID NO: 3973659 - RNA, 13 nt, Human herpesvirus 4 [Epstein-Barr virus]
aggucgcggacca

SEQ ID NO: 3973660 - RNA, 20 nt, Human herpesvirus 4 [Epstein-Barr virus]
aggucgugguacuugaccag

SEQ ID NO: 3973661 - RNA, 19 nt, Human herpesvirus 4 [Epstein-Barr virus]
aggucugacacccacgccu

SEQ ID NO: 3973662 - RNA, 22 nt, Human herpesvirus 4 [Epstein-Barr virus]
agguguacgcccuggcgguuga

SEQ ID NO: 3973663 - RNA, 13 nt, Human herpesvirus 4 [Epstein-Barr virus]
agguuauuuugcc

SEQ ID NO: 3973664 - RNA, 14 nt, Human herpesvirus 4 [Epstein-Barr virus]
agguucucggucag

SEQ ID NO: 3973665 - RNA, 11 nt, Human herpesvirus 4 [Epstein-Barr virus]
aguaccagcug

SEQ ID NO: 3973666 - RNA, 15 nt, Human herpesvirus 4 [Epstein-Barr virus]
aguaccagcuggugg

SEQ ID NO: 3973667 - RNA, 13 nt, Human herpesvirus 4 [Epstein-Barr virus]
aguaggcgguggg

SEQ ID NO: 3973668 - RNA, 23 nt, Human herpesvirus 4 [Epstein-Barr virus]
aguaggcgguggggcugagacca

SEQ ID NO: 3973669 - RNA, 19 nt, Human herpesvirus 4 [Epstein-Barr virus]
aguaggugccuccagagcc

SEQ ID NO: 3973670 - RNA, 20 nt, Human herpesvirus 4 [Epstein-Barr virus]
agucagccuugcccccgcca

SEQ ID NO: 3973671 - RNA, 21 nt, Human herpesvirus 4 [Epstein-Barr virus]
agucaggagguacaugggcca

SEQ ID NO: 3973672 - RNA, 16 nt, Human herpesvirus 4 [Epstein-Barr virus]
agucaucccguggaga

SEQ ID NO: 3973673 - RNA, 15 nt, Human herpesvirus 4 [Epstein-Barr virus]
aguccaggggccaca

SEQ ID NO: 3973674 - RNA, 22 nt, Human herpesvirus 4 [Epstein-Barr virus]
agucccaacccaaaaccacaca

SEQ ID NO: 3973675 - RNA, 18 nt, Human herpesvirus 4 [Epstein-Barr virus]
agucccgggggaggagaa

SEQ ID NO: 3973676 - RNA, 13 nt, Human herpesvirus 4 [Epstein-Barr virus]
aguccggggagaa

SEQ ID NO: 3973677 - RNA, 16 nt, Human herpesvirus 4 [Epstein-Barr virus]
agucggccacagggga

SEQ ID NO: 3973678 - RNA, 21 nt, Human herpesvirus 4 [Epstein-Barr virus]
agucugacuacucagaugaag

SEQ ID NO: 3973679 - RNA, 15 nt, Human herpesvirus 4 [Epstein-Barr virus]
agucuguacuuggga

SEQ ID NO: 3973680 - RNA, 22 nt, Human herpesvirus 4 [Epstein-Barr virus]
agugccauguguguccagugcc

SEQ ID NO: 3973681 - RNA, 20 nt, Human herpesvirus 4 [Epstein-Barr virus]
aguggccggggccguggagc

SEQ ID NO: 3973682 - RNA, 12 nt, Human herpesvirus 4 [Epstein-Barr virus]
aguggcugggau

SEQ ID NO: 3973683 - RNA, 18 nt, Human herpesvirus 4 [Epstein-Barr virus]
agugguuucggacacacc

SEQ ID NO: 3973684 - RNA, 19 nt, Human herpesvirus 4 [Epstein-Barr virus]
aguuacaccgucaacagau

SEQ ID NO: 3973685 - RNA, 13 nt, Human herpesvirus 4 [Epstein-Barr virus]
aguugggguccuc

SEQ ID NO: 3973686 - RNA, 13 nt, Human herpesvirus 4 [Epstein-Barr virus]
auaacgcaggucc

SEQ ID NO: 3973687 - RNA, 17 nt, Human herpesvirus 4 [Epstein-Barr virus]
auaaggcucugaagcaa

SEQ ID NO: 3973688 - RNA, 16 nt, Human herpesvirus 4 [Epstein-Barr virus]
auaccgagauguacau

SEQ ID NO: 3973689 - RNA, 18 nt, Human herpesvirus 4 [Epstein-Barr virus]
auagacaagaggcagaga

SEQ ID NO: 3973690 - RNA, 17 nt, Human herpesvirus 4 [Epstein-Barr virus]
auagaggggagcagagg

SEQ ID NO: 3973691 - RNA, 21 nt, Human herpesvirus 4 [Epstein-Barr virus]
auagcaggacggggggcuggc

SEQ ID NO: 3973692 - RNA, 18 nt, Human herpesvirus 4 [Epstein-Barr virus]
auagccggccaggcagag

SEQ ID NO: 3973693 - RNA, 13 nt, Human herpesvirus 4 [Epstein-Barr virus]
auaggccucugcc

SEQ ID NO: 3973694 - RNA, 14 nt, Human herpesvirus 4 [Epstein-Barr virus]
auauugucccccua

SEQ ID NO: 3973695 - RNA, 14 nt, Human herpesvirus 4 [Epstein-Barr virus]
aucaccagccaccu

SEQ ID NO: 3973696 - RNA, 23 nt, Human herpesvirus 4 [Epstein-Barr virus]
aucaccccgaguccaaggcccaa

SEQ ID NO: 3973697 - RNA, 18 nt, Human herpesvirus 4 [Epstein-Barr virus]
aucaccuggguacccaaa

SEQ ID NO: 3973698 - RNA, 18 nt, Human herpesvirus 4 [Epstein-Barr virus]
aucagaugagacuuuguu

SEQ ID NO: 3973699 - RNA, 14 nt, Human herpesvirus 4 [Epstein-Barr virus]
aucagggccaggcu

SEQ ID NO: 3973700 - RNA, 22 nt, Human herpesvirus 4 [Epstein-Barr virus]
aucaucagcgccguccacggcc

SEQ ID NO: 3973701 - RNA, 18 nt, Human herpesvirus 4 [Epstein-Barr virus]
auccaaacccccuccccu

SEQ ID NO: 3973702 - RNA, 22 nt, Human herpesvirus 4 [Epstein-Barr virus]
auccaggaggaggacgugagug

SEQ ID NO: 3973703 - RNA, 13 nt, Human herpesvirus 4 [Epstein-Barr virus]
auccaguggggcu

SEQ ID NO: 3973704 - RNA, 16 nt, Human herpesvirus 4 [Epstein-Barr virus]
aucccaaauaaauguu

SEQ ID NO: 3973705 - RNA, 23 nt, Human herpesvirus 4 [Epstein-Barr virus]
auccuagagggacagcugacggu

SEQ ID NO: 3973706 - RNA, 12 nt, Human herpesvirus 4 [Epstein-Barr virus]
aucgcagcucua

SEQ ID NO: 3973707 - RNA, 19 nt, Human herpesvirus 4 [Epstein-Barr virus]
aucgcugguggcaguauuu

SEQ ID NO: 3973708 - RNA, 15 nt, Human herpesvirus 4 [Epstein-Barr virus]
aucuauuagcagccu

SEQ ID NO: 3973709 - RNA, 19 nt, Human herpesvirus 4 [Epstein-Barr virus]
aucucauccccagagggcg

SEQ ID NO: 3973710 - RNA, 19 nt, Human herpesvirus 4 [Epstein-Barr virus]
aucucggcuguuuguacuu

SEQ ID NO: 3973711 - RNA, 21 nt, Human herpesvirus 4 [Epstein-Barr virus]
aucucugauuauagcucuggc

SEQ ID NO: 3973712 - RNA, 16 nt, Human herpesvirus 4 [Epstein-Barr virus]
aucuggaccagaaggc

SEQ ID NO: 3973713 - RNA, 22 nt, Human herpesvirus 4 [Epstein-Barr virus]
aucuggcuggggcauuaacuaa

SEQ ID NO: 3973714 - RNA, 14 nt, Human herpesvirus 4 [Epstein-Barr virus]
aucuuccugucggc

SEQ ID NO: 3973715 - RNA, 16 nt, Human herpesvirus 4 [Epstein-Barr virus]
aucuuugacugacaca

SEQ ID NO: 3973716 - RNA, 16 nt, Human herpesvirus 4 [Epstein-Barr virus]
augaaaauguguauuc

SEQ ID NO: 3973717 - RNA, 14 nt, Human herpesvirus 4 [Epstein-Barr virus]
augaacccuggggc

SEQ ID NO: 3973718 - RNA, 22 nt, Human herpesvirus 4 [Epstein-Barr virus]
augaauccaguaugccugccug

SEQ ID NO: 3973719 - RNA, 20 nt, Human herpesvirus 4 [Epstein-Barr virus]
augagcacguguggaagagg

SEQ ID NO: 3973720 - RNA, 14 nt, Human herpesvirus 4 [Epstein-Barr virus]
augagcggggagau

SEQ ID NO: 3973721 - RNA, 22 nt, Human herpesvirus 4 [Epstein-Barr virus]
augauaaugaugaggagcaccg

SEQ ID NO: 3973722 - RNA, 18 nt, Human herpesvirus 4 [Epstein-Barr virus]
augauucaucagaagcua

SEQ ID NO: 3973723 - RNA, 21 nt, Human herpesvirus 4 [Epstein-Barr virus]
augcaauaaauaaaaguacag

SEQ ID NO: 3973724 - RNA, 22 nt, Human herpesvirus 4 [Epstein-Barr virus]
augcaauaaauaaaaguacaga

SEQ ID NO: 3973725 - RNA, 15 nt, Human herpesvirus 4 [Epstein-Barr virus]
augccaauccaugcc

SEQ ID NO: 3973726 - RNA, 19 nt, Human herpesvirus 4 [Epstein-Barr virus]
augccucacgcgaagggaa

SEQ ID NO: 3973727 - RNA, 16 nt, Human herpesvirus 4 [Epstein-Barr virus]
augccuuggcaugacg

SEQ ID NO: 3973728 - RNA, 12 nt, Human herpesvirus 4 [Epstein-Barr virus]
auggagaugugc

SEQ ID NO: 3973729 - RNA, 16 nt, Human herpesvirus 4 [Epstein-Barr virus]
auggccgccacccucc

SEQ ID NO: 3973730 - RNA, 14 nt, Human herpesvirus 4 [Epstein-Barr virus]
caucacaagucaca

SEQ ID NO: 3973731 - RNA, 15 nt, Human herpesvirus 4 [Epstein-Barr virus]
caucagcgccgucca

SEQ ID NO: 3973732 - RNA, 13 nt, Human herpesvirus 4 [Epstein-Barr virus]
caucagcucgccc

SEQ ID NO: 3973733 - RNA, 16 nt, Human herpesvirus 4 [Epstein-Barr virus]
caucaucagcgccguc

SEQ ID NO: 3973734 - RNA, 22 nt, Human herpesvirus 4 [Epstein-Barr virus]
caucaugcugaauauugccagc

SEQ ID NO: 3973735 - RNA, 17 nt, Human herpesvirus 4 [Epstein-Barr virus]
cauccacagccccacuc

SEQ ID NO: 3973736 - RNA, 14 nt, Human herpesvirus 4 [Epstein-Barr virus]
cauccgagaggaug

SEQ ID NO: 3973737 - RNA, 16 nt, Human herpesvirus 4 [Epstein-Barr virus]
cauccggugccugaga

SEQ ID NO: 3973738 - RNA, 15 nt, Human herpesvirus 4 [Epstein-Barr virus]
cauccucagaggagg

SEQ ID NO: 3973739 - RNA, 13 nt, Human herpesvirus 4 [Epstein-Barr virus]
caucuaaggucca

SEQ ID NO: 3973740 - RNA, 16 nt, Human herpesvirus 4 [Epstein-Barr virus]
caucuagcgggagaug

SEQ ID NO: 3973741 - RNA, 15 nt, Human herpesvirus 4 [Epstein-Barr virus]
caucuauuagcagcc

SEQ ID NO: 3973742 - RNA, 14 nt, Human herpesvirus 4 [Epstein-Barr virus]
caugagcuccucuc

SEQ ID NO: 3973743 - RNA, 15 nt, Human herpesvirus 4 [Epstein-Barr virus]
caugcacggcccuga

SEQ ID NO: 3973744 - RNA, 18 nt, Human herpesvirus 4 [Epstein-Barr virus]
caugcagggugcacagac

SEQ ID NO: 3973745 - RNA, 18 nt, Human herpesvirus 4 [Epstein-Barr virus]
cauggagagguuugagaa

SEQ ID NO: 3973746 - RNA, 23 nt, Human herpesvirus 4 [Epstein-Barr virus]
cauggaggauugaggacccaccu

SEQ ID NO: 3973747 - RNA, 13 nt, Human herpesvirus 4 [Epstein-Barr virus]
caugguggcuucu

SEQ ID NO: 3973748 - RNA, 12 nt, Human herpesvirus 4 [Epstein-Barr virus]
cauggugugaga

SEQ ID NO: 3973749 - RNA, 14 nt, Human herpesvirus 4 [Epstein-Barr virus]
cauguuuuuggcau

SEQ ID NO: 3973750 - RNA, 23 nt, Human herpesvirus 4 [Epstein-Barr virus]
cauucacggggccgugcaccugc

SEQ ID NO: 3973751 - RNA, 15 nt, Human herpesvirus 4 [Epstein-Barr virus]
cauucccccaugaga

SEQ ID NO: 3973752 - RNA, 21 nt, Human herpesvirus 4 [Epstein-Barr virus]
cauucguacaucuccaggcga

SEQ ID NO: 3973753 - RNA, 16 nt, Human herpesvirus 4 [Epstein-Barr virus]
cauugacccgaggauc

SEQ ID NO: 3973754 - RNA, 17 nt, Human herpesvirus 4 [Epstein-Barr virus]
cauugaugaacugguca

SEQ ID NO: 3973755 - RNA, 20 nt, Human herpesvirus 4 [Epstein-Barr virus]
cauugcuggccgcagcuggc

SEQ ID NO: 3973756 - RNA, 16 nt, Human herpesvirus 4 [Epstein-Barr virus]
cauuuucguccuccca

SEQ ID NO: 3973757 - RNA, 18 nt, Human herpesvirus 4 [Epstein-Barr virus]
cauuuuuagccccagccc

SEQ ID NO: 3973758 - RNA, 22 nt, Human herpesvirus 4 [Epstein-Barr virus]
ccaacgagggcagacaccaccu

SEQ ID NO: 3973759 - RNA, 17 nt, Human herpesvirus 4 [Epstein-Barr virus]
ccaaggacaacagcuag

SEQ ID NO: 3973760 - RNA, 17 nt, Human herpesvirus 4 [Epstein-Barr virus]
ccacagccugcaccagu

SEQ ID NO: 3973761 - RNA, 15 nt, Human herpesvirus 4 [Epstein-Barr virus]
ccacccccaccaccc

SEQ ID NO: 3973762 - RNA, 16 nt, Human herpesvirus 4 [Epstein-Barr virus]
ccacgauguagccgcu

SEQ ID NO: 3973763 - RNA, 20 nt, Human herpesvirus 4 [Epstein-Barr virus]
ccacgcuccgcgcucggccu

SEQ ID NO: 3973764 - RNA, 17 nt, Human herpesvirus 4 [Epstein-Barr virus]
ccacggccguagcccag

SEQ ID NO: 3973765 - RNA, 15 nt, Human herpesvirus 4 [Epstein-Barr virus]
ccacuacaccccuga

SEQ ID NO: 3973766 - RNA, 22 nt, Human herpesvirus 4 [Epstein-Barr virus]
ccacucaggaagcuggccaggc

SEQ ID NO: 3973767 - RNA, 20 nt, Human herpesvirus 4 [Epstein-Barr virus]
ccacugagcaagauccuucu

SEQ ID NO: 3973768 - RNA, 19 nt, Human herpesvirus 4 [Epstein-Barr virus]
ccacuuccacagcaauggc

SEQ ID NO: 3973769 - RNA, 17 nt, Human herpesvirus 4 [Epstein-Barr virus]
ccagacgcgauggcaca

SEQ ID NO: 3973770 - RNA, 19 nt, Human herpesvirus 4 [Epstein-Barr virus]
ccagagaggcccacugcag

SEQ ID NO: 3973771 - RNA, 14 nt, Human herpesvirus 4 [Epstein-Barr virus]
ccagagcccagagg

SEQ ID NO: 3973772 - RNA, 18 nt, Human herpesvirus 4 [Epstein-Barr virus]
ccagaguucccggcugcu

SEQ ID NO: 3973773 - RNA, 17 nt, Human herpesvirus 4 [Epstein-Barr virus]
ccagaucgccugccacu

SEQ ID NO: 3973774 - RNA, 19 nt, Human herpesvirus 4 [Epstein-Barr virus]
ccagcaaaaccagcccggg

SEQ ID NO: 3973775 - RNA, 23 nt, Human herpesvirus 4 [Epstein-Barr virus]
ccagcaacagaucuugcugaggu

SEQ ID NO: 3973776 - RNA, 13 nt, Human herpesvirus 4 [Epstein-Barr virus]
ccagcaggcucag

SEQ ID NO: 3973777 - RNA, 22 nt, Human herpesvirus 4 [Epstein-Barr virus]
ccagcccucgagaaccccagca

SEQ ID NO: 3973778 - RNA, 22 nt, Human herpesvirus 4 [Epstein-Barr virus]
ccagcgccuccucgcaggcccc

SEQ ID NO: 3973779 - RNA, 20 nt, Human herpesvirus 4 [Epstein-Barr virus]
ccagcuaacaggacauguuu

SEQ ID NO: 3973780 - RNA, 17 nt, Human herpesvirus 4 [Epstein-Barr virus]
ccagcucggccagcagg

SEQ ID NO: 3973781 - RNA, 19 nt, Human herpesvirus 4 [Epstein-Barr virus]
ccagcuggucaucagccgc

SEQ ID NO: 3973782 - RNA, 22 nt, Human herpesvirus 4 [Epstein-Barr virus]
ccagcuggugguccgcauguuu

SEQ ID NO: 3973783 - RNA, 20 nt, Human herpesvirus 4 [Epstein-Barr virus]
ccaggcacaucuggcaccug

SEQ ID NO: 3973784 - RNA, 22 nt, Human herpesvirus 4 [Epstein-Barr virus]
ccaggcagcacacgaagccugc

SEQ ID NO: 3973785 - RNA, 16 nt, Human herpesvirus 4 [Epstein-Barr virus]
ccaggccgccaugcuc

SEQ ID NO: 3973786 - RNA, 15 nt, Human herpesvirus 4 [Epstein-Barr virus]
ccaggcgacacuugg

SEQ ID NO: 3973787 - RNA, 21 nt, Human herpesvirus 4 [Epstein-Barr virus]
ccaggcgguuagggaggacac

SEQ ID NO: 3973788 - RNA, 17 nt, Human herpesvirus 4 [Epstein-Barr virus]
ccaggcuccuggaucug

SEQ ID NO: 3973789 - RNA, 19 nt, Human herpesvirus 4 [Epstein-Barr virus]
ccaggcuuucuaugccuga

SEQ ID NO: 3973790 - RNA, 13 nt, Human herpesvirus 4 [Epstein-Barr virus]
ccagggccagcaa

SEQ ID NO: 3973791 - RNA, 17 nt, Human herpesvirus 4 [Epstein-Barr virus]
ccaggggcgagcagcgc

SEQ ID NO: 3973792 - RNA, 16 nt, Human herpesvirus 4 [Epstein-Barr virus]
ccagucaccuuccaga

SEQ ID NO: 3973793 - RNA, 15 nt, Human herpesvirus 4 [Epstein-Barr virus]
ccaguguggcugggg

SEQ ID NO: 3973794 - RNA, 18 nt, Human herpesvirus 4 [Epstein-Barr virus]
ccaguuccccccagccug

SEQ ID NO: 3973795 - RNA, 18 nt, Human herpesvirus 4 [Epstein-Barr virus]
ccauauuggggcaauggc

SEQ ID NO: 3973796 - RNA, 23 nt, Human herpesvirus 4 [Epstein-Barr virus]
ccaucaccuggguacccaaacca

SEQ ID NO: 3973797 - RNA, 13 nt, Human herpesvirus 4 [Epstein-Barr virus]
ccaucagcucgcc

SEQ ID NO: 3973798 - RNA, 21 nt, Human herpesvirus 4 [Epstein-Barr virus]
ccaucugcuucuggcucuucu

SEQ ID NO: 3973799 - RNA, 16 nt, Human herpesvirus 4 [Epstein-Barr virus]
ccaugacgcugcugcu

SEQ ID NO: 3973800 - RNA, 20 nt, Human herpesvirus 4 [Epstein-Barr virus]
ccaugcaaguggaugcaucu

SEQ ID NO: 3973801 - RNA, 15 nt, Human herpesvirus 4 [Epstein-Barr virus]
ccaugccaucucuga

SEQ ID NO: 3973802 - RNA, 15 nt, Human herpesvirus 4 [Epstein-Barr virus]
ccaugcgcgcccugu

SEQ ID NO: 3973803 - RNA, 15 nt, Human herpesvirus 4 [Epstein-Barr virus]
cccaacagucuucag

SEQ ID NO: 3973804 - RNA, 12 nt, Human herpesvirus 4 [Epstein-Barr virus]
cccaaguacaga

SEQ ID NO: 3973805 - RNA, 22 nt, Human herpesvirus 4 [Epstein-Barr virus]
cccaauauccaucugcuucugg

SEQ ID NO: 3973806 - RNA, 19 nt, Human herpesvirus 4 [Epstein-Barr virus]
cccacacagcgccagcagg

SEQ ID NO: 3973807 - RNA, 14 nt, Human herpesvirus 4 [Epstein-Barr virus]
cccaccagccagcg

SEQ ID NO: 3973808 - RNA, 23 nt, Human herpesvirus 4 [Epstein-Barr virus]
cccacuaucacccauggccaggc

SEQ ID NO: 3973809 - RNA, 14 nt, Human herpesvirus 4 [Epstein-Barr virus]
cccacucuugccuc

SEQ ID NO: 3973810 - RNA, 18 nt, Human herpesvirus 4 [Epstein-Barr virus]
cccacugaaaaaccagac

SEQ ID NO: 3973811 - RNA, 20 nt, Human herpesvirus 4 [Epstein-Barr virus]
cccagaccugugugcuguau

SEQ ID NO: 3973812 - RNA, 13 nt, Human herpesvirus 4 [Epstein-Barr virus]
cccagcagaucca

SEQ ID NO: 3973813 - RNA, 11 nt, Human herpesvirus 4 [Epstein-Barr virus]
cccagccacag

SEQ ID NO: 3973814 - RNA, 16 nt, Human herpesvirus 4 [Epstein-Barr virus]
cccagcccuccucaga

SEQ ID NO: 3973815 - RNA, 13 nt, Human herpesvirus 4 [Epstein-Barr virus]
cccagcccucgag

SEQ ID NO: 3973816 - RNA, 18 nt, Human herpesvirus 4 [Epstein-Barr virus]
cccagcgcuggcuccagg

SEQ ID NO: 3973817 - RNA, 19 nt, Human herpesvirus 4 [Epstein-Barr virus]
cccaggcagccuugcgugg

SEQ ID NO: 3973818 - RNA, 11 nt, Human herpesvirus 4 [Epstein-Barr virus]
aaagggcccag

SEQ ID NO: 3973819 - RNA, 11 nt, Human herpesvirus 4 [Epstein-Barr virus]
aaaggggagau

SEQ ID NO: 3973820 - RNA, 21 nt, Human herpesvirus 4 [Epstein-Barr virus]
aaaguacaggauuauugccaa

SEQ ID NO: 3973821 - RNA, 17 nt, Human herpesvirus 4 [Epstein-Barr virus]
aaaguugaugauauuga

SEQ ID NO: 3973822 - RNA, 15 nt, Human herpesvirus 4 [Epstein-Barr virus]
aaauaaauguuacuu

SEQ ID NO: 3973823 - RNA, 19 nt, Human herpesvirus 4 [Epstein-Barr virus]
aaauaaauguuacuucuuu

SEQ ID NO: 3973824 - RNA, 18 nt, Human herpesvirus 4 [Epstein-Barr virus]
aaaucaacuacaagcagc

SEQ ID NO: 3973825 - RNA, 20 nt, Human herpesvirus 4 [Epstein-Barr virus]
aacacauauacgaagaagcg

SEQ ID NO: 3973826 - RNA, 12 nt, Human herpesvirus 4 [Epstein-Barr virus]
aacaggcugcug

SEQ ID NO: 3973827 - RNA, 19 nt, Human herpesvirus 4 [Epstein-Barr virus]
aacccccggcucucaggcc

SEQ ID NO: 3973828 - RNA, 23 nt, Human herpesvirus 4 [Epstein-Barr virus]
aacccuguagucaccugcacaga

SEQ ID NO: 3973829 - RNA, 11 nt, Human herpesvirus 4 [Epstein-Barr virus]
aaccugagccu

SEQ ID NO: 3973830 - RNA, 22 nt, Human herpesvirus 4 [Epstein-Barr virus]
aaccuuaaaaguccccccaucu

SEQ ID NO: 3973831 - RNA, 17 nt, Human herpesvirus 4 [Epstein-Barr virus]
aacgaucccaggccuca

SEQ ID NO: 3973832 - RNA, 21 nt, Human herpesvirus 4 [Epstein-Barr virus]
aacuggccaugcaggccugga

SEQ ID NO: 3973833 - RNA, 17 nt, Human herpesvirus 4 [Epstein-Barr virus]
aacuuggaggcugcuaa

SEQ ID NO: 3973834 - RNA, 15 nt, Human herpesvirus 4 [Epstein-Barr virus]
aacuuugagcugggc

SEQ ID NO: 3973835 - RNA, 17 nt, Human herpesvirus 4 [Epstein-Barr virus]
aacuuugagcugggcaa

SEQ ID NO: 3973836 - RNA, 14 nt, Human herpesvirus 4 [Epstein-Barr virus]
aagaagauugaaga

SEQ ID NO: 3973837 - RNA, 16 nt, Human herpesvirus 4 [Epstein-Barr virus]
aagaccaauacccagg

SEQ ID NO: 3973838 - RNA, 15 nt, Human herpesvirus 4 [Epstein-Barr virus]
aagacuauguucucu

SEQ ID NO: 3973839 - RNA, 17 nt, Human herpesvirus 4 [Epstein-Barr virus]
aagagccauggugagac

SEQ ID NO: 3973840 - RNA, 17 nt, Human herpesvirus 4 [Epstein-Barr virus]
aagcaacagguccucag

SEQ ID NO: 3973841 - RNA, 15 nt, Human herpesvirus 4 [Epstein-Barr virus]
aagcaacugcugcag

SEQ ID NO: 3973842 - RNA, 14 nt, Human herpesvirus 4 [Epstein-Barr virus]
aagcuuaugagcga

SEQ ID NO: 3973843 - RNA, 17 nt, Human herpesvirus 4 [Epstein-Barr virus]
aagcuuuugaccaagcu

SEQ ID NO: 3973844 - RNA, 13 nt, Human herpesvirus 4 [Epstein-Barr virus]
aaggcucugaagc

SEQ ID NO: 3973845 - RNA, 20 nt, Human herpesvirus 4 [Epstein-Barr virus]
aaggugguuauuuugggcca

SEQ ID NO: 3973846 - RNA, 18 nt, Human herpesvirus 4 [Epstein-Barr virus]
aagguguagaaguguguc

SEQ ID NO: 3973847 - RNA, 16 nt, Human herpesvirus 4 [Epstein-Barr virus]
aagucaggauucucua

SEQ ID NO: 3973848 - RNA, 23 nt, Human herpesvirus 4 [Epstein-Barr virus]
aauaaauaucuuccugucggcuc

SEQ ID NO: 3973849 - RNA, 23 nt, Human herpesvirus 4 [Epstein-Barr virus]
aaucaccgccguaaucuguggug

SEQ ID NO: 3973850 - RNA, 18 nt, Human herpesvirus 4 [Epstein-Barr virus]
aaucaccuuaacuggcac

SEQ ID NO: 3973851 - RNA, 17 nt, Human herpesvirus 4 [Epstein-Barr virus]
aauccgcgcagccuguu

SEQ ID NO: 3973852 - RNA, 15 nt, Human herpesvirus 4 [Epstein-Barr virus]
aaugaacccaggggu

SEQ ID NO: 3973853 - RNA, 22 nt, Human herpesvirus 4 [Epstein-Barr virus]
aauguaacacuacuuguuucug

SEQ ID NO: 3973854 - RNA, 23 nt, Human herpesvirus 4 [Epstein-Barr virus]
aauguagccccuaggccugccac

SEQ ID NO: 3973855 - RNA, 14 nt, Human herpesvirus 4 [Epstein-Barr virus]
aauguccagugggg

SEQ ID NO: 3973856 - RNA, 16 nt, Human herpesvirus 4 [Epstein-Barr virus]
aauuccccggggacac

SEQ ID NO: 3973857 - RNA, 22 nt, Human herpesvirus 4 [Epstein-Barr virus]
acaaccuuggacccugcugcga

SEQ ID NO: 3973858 - RNA, 24 nt, Human herpesvirus 4 [Epstein-Barr virus]
acaacugcuauucugagcaccaac

SEQ ID NO: 3973859 - RNA, 19 nt, Human herpesvirus 4 [Epstein-Barr virus]
acaagaguucucuggugaa

SEQ ID NO: 3973860 - RNA, 18 nt, Human herpesvirus 4 [Epstein-Barr virus]
acaagggaagagggaaaa

SEQ ID NO: 3973861 - RNA, 21 nt, Human herpesvirus 4 [Epstein-Barr virus]
acaauagaauuuuugcagcua

SEQ ID NO: 3973862 - RNA, 14 nt, Human herpesvirus 4 [Epstein-Barr virus]
acaaucuugugaac

SEQ ID NO: 3973863 - RNA, 14 nt, Human herpesvirus 4 [Epstein-Barr virus]
acaauguuccuucu

SEQ ID NO: 3973864 - RNA, 14 nt, Human herpesvirus 4 [Epstein-Barr virus]
acaccagucccaac

SEQ ID NO: 3973865 - RNA, 14 nt, Human herpesvirus 4 [Epstein-Barr virus]
acacgaaugcccag

SEQ ID NO: 3973866 - RNA, 15 nt, Human herpesvirus 4 [Epstein-Barr virus]
acacugaugagucug

SEQ ID NO: 3973867 - RNA, 22 nt, Human herpesvirus 4 [Epstein-Barr virus]
acacuucugaaaacugccuccu

SEQ ID NO: 3973868 - RNA, 20 nt, Human herpesvirus 4 [Epstein-Barr virus]
acacuugugguucuccugau

SEQ ID NO: 3973869 - RNA, 18 nt, Human herpesvirus 4 [Epstein-Barr virus]
acagaggaggcuggugcc

SEQ ID NO: 3973870 - RNA, 15 nt, Human herpesvirus 4 [Epstein-Barr virus]
acagauacaaaaacu

SEQ ID NO: 3973871 - RNA, 23 nt, Human herpesvirus 4 [Epstein-Barr virus]
acagccccacucuugccucggcg

SEQ ID NO: 3973872 - RNA, 19 nt, Human herpesvirus 4 [Epstein-Barr virus]
acagcugucacccaugccu

SEQ ID NO: 3973873 - RNA, 21 nt, Human herpesvirus 4 [Epstein-Barr virus]
acaggacuaaccaugccaucu

SEQ ID NO: 3973874 - RNA, 21 nt, Human herpesvirus 4 [Epstein-Barr virus]
acaggccgccuauggggccug

SEQ ID NO: 3973875 - RNA, 21 nt, Human herpesvirus 4 [Epstein-Barr virus]
acaggccuggcggguggagau

SEQ ID NO: 3973876 - RNA, 12 nt, Human herpesvirus 4 [Epstein-Barr virus]
acaggcugcgcc

SEQ ID NO: 3973877 - RNA, 14 nt, Human herpesvirus 4 [Epstein-Barr virus]
acaggggagguggc

SEQ ID NO: 3973878 - RNA, 22 nt, Human herpesvirus 4 [Epstein-Barr virus]
acaugagaaaauacuucucuag

SEQ ID NO: 3973879 - RNA, 13 nt, Human herpesvirus 4 [Epstein-Barr virus]
acaugcugaugug

SEQ ID NO: 3973880 - RNA, 18 nt, Human herpesvirus 4 [Epstein-Barr virus]
acaugcugaugugcugcc

SEQ ID NO: 3973881 - RNA, 14 nt, Human herpesvirus 4 [Epstein-Barr virus]
acaugguagauaaa

SEQ ID NO: 3973882 - RNA, 21 nt, Human herpesvirus 4 [Epstein-Barr virus]
acaugguuuaaggaaugaaca

SEQ ID NO: 3973883 - RNA, 16 nt, Human herpesvirus 4 [Epstein-Barr virus]
acauuggcagcagcuc

SEQ ID NO: 3973884 - RNA, 15 nt, Human herpesvirus 4 [Epstein-Barr virus]
accacuaggaaccca

SEQ ID NO: 3973885 - RNA, 15 nt, Human herpesvirus 4 [Epstein-Barr virus]
accagagcccagagg

SEQ ID NO: 3973886 - RNA, 12 nt, Human herpesvirus 4 [Epstein-Barr virus]
accagcuccagg

SEQ ID NO: 3973887 - RNA, 15 nt, Human herpesvirus 4 [Epstein-Barr virus]
accaggcgccgcagg

SEQ ID NO: 3973888 - RNA, 13 nt, Human herpesvirus 4 [Epstein-Barr virus]
accauaugaugac

SEQ ID NO: 3973889 - RNA, 15 nt, Human herpesvirus 4 [Epstein-Barr virus]
accauggacgaggac

SEQ ID NO: 3973890 - RNA, 16 nt, Human herpesvirus 4 [Epstein-Barr virus]
acccaaugugcauggg

SEQ ID NO: 3973891 - RNA, 17 nt, Human herpesvirus 4 [Epstein-Barr virus]
acccagccacuuacagc

SEQ ID NO: 3973892 - RNA, 15 nt, Human herpesvirus 4 [Epstein-Barr virus]
acccagcccucgaga

SEQ ID NO: 3973893 - RNA, 18 nt, Human herpesvirus 4 [Epstein-Barr virus]
acccaucugagggcagug

SEQ ID NO: 3973894 - RNA, 15 nt, Human herpesvirus 4 [Epstein-Barr virus]
acccccaccaccuca

SEQ ID NO: 3973895 - RNA, 15 nt, Human herpesvirus 4 [Epstein-Barr virus]
acccccaccaccucc

SEQ ID NO: 3973896 - RNA, 18 nt, Human herpesvirus 4 [Epstein-Barr virus]
acccccagcgcuggcucc

SEQ ID NO: 3973897 - RNA, 20 nt, Human herpesvirus 4 [Epstein-Barr virus]
acccgaaaucugacacuuua

SEQ ID NO: 3973898 - RNA, 22 nt, Human herpesvirus 4 [Epstein-Barr virus]
acccugggccggggccuccauc

SEQ ID NO: 3973899 - RNA, 21 nt, Human herpesvirus 4 [Epstein-Barr virus]
acccuucugcugcugcugguc

SEQ ID NO: 3973900 - RNA, 22 nt, Human herpesvirus 4 [Epstein-Barr virus]
accgcagccacguccagacucc

SEQ ID NO: 3973901 - RNA, 20 nt, Human herpesvirus 4 [Epstein-Barr virus]
accgcgcccuccucugggcc

SEQ ID NO: 3973902 - RNA, 23 nt, Human herpesvirus 4 [Epstein-Barr virus]
accgcgcccuccucugggccgcc

SEQ ID NO: 3973903 - RNA, 21 nt, Human herpesvirus 4 [Epstein-Barr virus]
accggccaagguccugggccu

SEQ ID NO: 3973904 - RNA, 13 nt, Human herpesvirus 4 [Epstein-Barr virus]
accgucagccaca

SEQ ID NO: 3973905 - RNA, 22 nt, Human herpesvirus 4 [Epstein-Barr virus]
accuacgccauuaagaacaagu

SEQ ID NO: 3973906 - RNA, 14 nt, Human herpesvirus 4 [Epstein-Barr virus]
accuaugccuggaa

SEQ ID NO: 3973907 - RNA, 21 nt, Human herpesvirus 4 [Epstein-Barr virus]
accuccaccaccuucaccacc

SEQ ID NO: 3973908 - RNA, 21 nt, Human herpesvirus 4 [Epstein-Barr virus]
accuccacuuacaaccaagcc

SEQ ID NO: 3973909 - RNA, 16 nt, Human herpesvirus 4 [Epstein-Barr virus]
accucccccccagacc

SEQ ID NO: 3973910 - RNA, 22 nt, Human herpesvirus 4 [Epstein-Barr virus]
accuccgggggcacugucgaga

SEQ ID NO: 3973911 - RNA, 19 nt, Human herpesvirus 4 [Epstein-Barr virus]
accugcacagaucugacca

SEQ ID NO: 3973912 - RNA, 16 nt, Human herpesvirus 4 [Epstein-Barr virus]
accugccggagggaca

SEQ ID NO: 3973913 - RNA, 20 nt, Human herpesvirus 4 [Epstein-Barr virus]
accuggacauagaggggcau

SEQ ID NO: 3973914 - RNA, 21 nt, Human herpesvirus 4 [Epstein-Barr virus]
accuguccuugucugcugcca

SEQ ID NO: 3973915 - RNA, 23 nt, Human herpesvirus 4 [Epstein-Barr virus]
accugucugauugcacccuggcc

SEQ ID NO: 3973916 - RNA, 16 nt, Human herpesvirus 4 [Epstein-Barr virus]
acgacuauccaggucu

SEQ ID NO: 3973917 - RNA, 22 nt, Human herpesvirus 4 [Epstein-Barr virus]
acgaggaggcggaagaccagga

SEQ ID NO: 3973918 - RNA, 18 nt, Human herpesvirus 4 [Epstein-Barr virus]
acgaucuucaagagucuc

SEQ ID NO: 3973919 - RNA, 21 nt, Human herpesvirus 4 [Epstein-Barr virus]
acgcaauuagagugccgggcc

SEQ ID NO: 3973920 - RNA, 22 nt, Human herpesvirus 4 [Epstein-Barr virus]
acgcauccaccaucaaugucac

SEQ ID NO: 3973921 - RNA, 21 nt, Human herpesvirus 4 [Epstein-Barr virus]
acgcccgacaauaaaguugau

SEQ ID NO: 3973922 - RNA, 14 nt, Human herpesvirus 4 [Epstein-Barr virus]
acgccggccugcug

SEQ ID NO: 3973923 - RNA, 20 nt, Human herpesvirus 4 [Epstein-Barr virus]
acgcucucuauguugucaca

SEQ ID NO: 3973924 - RNA, 18 nt, Human herpesvirus 4 [Epstein-Barr virus]
acgcugcccuagagguuu

SEQ ID NO: 3973925 - RNA, 16 nt, Human herpesvirus 4 [Epstein-Barr virus]
acgcugguacccgcca

SEQ ID NO: 3973926 - RNA, 14 nt, Human herpesvirus 4 [Epstein-Barr virus]
acgcuggucuugaa

SEQ ID NO: 3973927 - RNA, 21 nt, Human herpesvirus 4 [Epstein-Barr virus]
acggcaaggccggaggcagac

SEQ ID NO: 3973928 - RNA, 21 nt, Human herpesvirus 4 [Epstein-Barr virus]
acggccacguccccggccucc

SEQ ID NO: 3973929 - RNA, 21 nt, Human herpesvirus 4 [Epstein-Barr virus]
acggcccggggguggcagccc

SEQ ID NO: 3973930 - RNA, 19 nt, Human herpesvirus 4 [Epstein-Barr virus]
acgggaacaucaaccagug

SEQ ID NO: 3973931 - RNA, 13 nt, Human herpesvirus 4 [Epstein-Barr virus]
acgggacuucuuc

SEQ ID NO: 3973932 - RNA, 11 nt, Human herpesvirus 4 [Epstein-Barr virus]
acgggccucua

SEQ ID NO: 3973933 - RNA, 21 nt, Human herpesvirus 4 [Epstein-Barr virus]
acguccgugagagccuaccca

SEQ ID NO: 3973934 - RNA, 18 nt, Human herpesvirus 4 [Epstein-Barr virus]
acgugaacauccugcgug

SEQ ID NO: 3973935 - RNA, 15 nt, Human herpesvirus 4 [Epstein-Barr virus]
acguggcuuccagag

SEQ ID NO: 3973936 - RNA, 19 nt, Human herpesvirus 4 [Epstein-Barr virus]
acguggcuuccagagaggc

SEQ ID NO: 3973937 - RNA, 22 nt, Human herpesvirus 4 [Epstein-Barr virus]
acgugucgcguagcucugguag

SEQ ID NO: 3973938 - RNA, 18 nt, Human herpesvirus 4 [Epstein-Barr virus]
acguuggcuucugcugcu

SEQ ID NO: 3973939 - RNA, 20 nt, Human herpesvirus 4 [Epstein-Barr virus]
acguuguagguguccagcgc

SEQ ID NO: 3973940 - RNA, 19 nt, Human herpesvirus 4 [Epstein-Barr virus]
acuaauggaauauuaauaa

SEQ ID NO: 3973941 - RNA, 17 nt, Human herpesvirus 4 [Epstein-Barr virus]
acuacaagcagcuagag

SEQ ID NO: 3973942 - RNA, 16 nt, Human herpesvirus 4 [Epstein-Barr virus]
acuacaauguuccuuc

SEQ ID NO: 3973943 - RNA, 13 nt, Human herpesvirus 4 [Epstein-Barr virus]
acuacaccagucc

SEQ ID NO: 3973944 - RNA, 21 nt, Human herpesvirus 4 [Epstein-Barr virus]
acuacaccaucaccgucggca

SEQ ID NO: 3973945 - RNA, 19 nt, Human herpesvirus 4 [Epstein-Barr virus]
acuacgagggccucuggca

SEQ ID NO: 3973946 - RNA, 18 nt, Human herpesvirus 4 [Epstein-Barr virus]
acuaugacaccuaucugu

SEQ ID NO: 3973947 - RNA, 22 nt, Human herpesvirus 4 [Epstein-Barr virus]
acucacccccgaggagagggga

SEQ ID NO: 3973948 - RNA, 16 nt, Human herpesvirus 4 [Epstein-Barr virus]
acuccacagauggaga

SEQ ID NO: 3973949 - RNA, 14 nt, Human herpesvirus 4 [Epstein-Barr virus]
acucccaccacccc

SEQ ID NO: 3973950 - RNA, 20 nt, Human herpesvirus 4 [Epstein-Barr virus]
acucccauguaagccugccu

SEQ ID NO: 3973951 - RNA, 21 nt, Human herpesvirus 4 [Epstein-Barr virus]
acuccuaugcauuuccugccc

SEQ ID NO: 3973952 - RNA, 23 nt, Human herpesvirus 4 [Epstein-Barr virus]
acucucucccccgggcgcugccu

SEQ ID NO: 3973953 - RNA, 12 nt, Human herpesvirus 4 [Epstein-Barr virus]
acucugcuuucu

SEQ ID NO: 3973954 - RNA, 17 nt, Human herpesvirus 4 [Epstein-Barr virus]
acucuggggucucaggc

SEQ ID NO: 3973955 - RNA, 14 nt, Human herpesvirus 4 [Epstein-Barr virus]
acucuuggcagcag

SEQ ID NO: 3973956 - RNA, 15 nt, Human herpesvirus 4 [Epstein-Barr virus]
acugaauuuauaccc

SEQ ID NO: 3973957 - RNA, 18 nt, Human herpesvirus 4 [Epstein-Barr virus]
acugauggccaucuuuca

SEQ ID NO: 3973958 - RNA, 21 nt, Human herpesvirus 4 [Epstein-Barr virus]
acugcagugggccucucuggc

SEQ ID NO: 3973959 - RNA, 22 nt, Human herpesvirus 4 [Epstein-Barr virus]
acugcagugggccucucuggcu

SEQ ID NO: 3973960 - RNA, 20 nt, Human herpesvirus 4 [Epstein-Barr virus]
acugccacauuggacaccca

SEQ ID NO: 3973961 - RNA, 23 nt, Human herpesvirus 4 [Epstein-Barr virus]
acuggaacuguacuaaauuugcu

SEQ ID NO: 3973962 - RNA, 17 nt, Human herpesvirus 4 [Epstein-Barr virus]
acuggccaugcaggccu

SEQ ID NO: 3973963 - RNA, 16 nt, Human herpesvirus 4 [Epstein-Barr virus]
acuggggcugguggcc

SEQ ID NO: 3973964 - RNA, 22 nt, Human herpesvirus 4 [Epstein-Barr virus]
acuuacagcacauuuuguucua

SEQ ID NO: 3973965 - RNA, 19 nt, Human herpesvirus 4 [Epstein-Barr virus]
acuuacaucgacuuuaugc

SEQ ID NO: 3973966 - RNA, 17 nt, Human herpesvirus 4 [Epstein-Barr virus]
acuucauucucaaacag

SEQ ID NO: 3973967 - RNA, 23 nt, Human herpesvirus 4 [Epstein-Barr virus]
acuuggaggcugcuaagccagga

SEQ ID NO: 3973968 - RNA, 17 nt, Human herpesvirus 4 [Epstein-Barr virus]
acuugggggcaggcuac

SEQ ID NO: 3973969 - RNA, 16 nt, Human herpesvirus 4 [Epstein-Barr virus]
acuuuagagcucugga

SEQ ID NO: 3973970 - RNA, 13 nt, Human herpesvirus 4 [Epstein-Barr virus]
acuuuauuaauaa

SEQ ID NO: 3973971 - RNA, 16 nt, Human herpesvirus 4 [Epstein-Barr virus]
acuuuauuaauaaaca

SEQ ID NO: 3973972 - RNA, 20 nt, Human herpesvirus 4 [Epstein-Barr virus]
agaaaacucugcauggagaa

SEQ ID NO: 3973973 - RNA, 23 nt, Human herpesvirus 4 [Epstein-Barr virus]
agaacccccugcaggacacguga

SEQ ID NO: 3973974 - RNA, 23 nt, Human herpesvirus 4 [Epstein-Barr virus]
agaagugugucccccuccauucc

SEQ ID NO: 3973975 - RNA, 14 nt, Human herpesvirus 4 [Epstein-Barr virus]
agaaucugggcugg

SEQ ID NO: 3973976 - RNA, 19 nt, Human herpesvirus 4 [Epstein-Barr virus]
agacaugcagacuccaggu

SEQ ID NO: 3973977 - RNA, 17 nt, Human herpesvirus 4 [Epstein-Barr virus]
agaccaauacccaggau

SEQ ID NO: 3973978 - RNA, 22 nt, Human herpesvirus 4 [Epstein-Barr virus]
agacgagucugacuacagcgag

SEQ ID NO: 3973979 - RNA, 17 nt, Human herpesvirus 4 [Epstein-Barr virus]
agacguguguggcugua

SEQ ID NO: 3973980 - RNA, 18 nt, Human herpesvirus 4 [Epstein-Barr virus]
agagauuucauccucaga

SEQ ID NO: 3973981 - RNA, 19 nt, Human herpesvirus 4 [Epstein-Barr virus]
agagauuucauccucagag

SEQ ID NO: 3973982 - RNA, 15 nt, Human herpesvirus 4 [Epstein-Barr virus]
agaggacuguucucu

SEQ ID NO: 3973983 - RNA, 14 nt, Human herpesvirus 4 [Epstein-Barr virus]
caccucgggcucaa

SEQ ID NO: 3973984 - RNA, 15 nt, Human herpesvirus 4 [Epstein-Barr virus]
caccuugaggugcca

SEQ ID NO: 3973985 - RNA, 20 nt, Human herpesvirus 4 [Epstein-Barr virus]
caccuugaggugccacagag

SEQ ID NO: 3973986 - RNA, 12 nt, Human herpesvirus 4 [Epstein-Barr virus]
caccuuugcuau

SEQ ID NO: 3973987 - RNA, 17 nt, Human herpesvirus 4 [Epstein-Barr virus]
cacgguuauggcagagc

SEQ ID NO: 3973988 - RNA, 18 nt, Human herpesvirus 4 [Epstein-Barr virus]
cacguguggaagaggaaa

SEQ ID NO: 3973989 - RNA, 19 nt, Human herpesvirus 4 [Epstein-Barr virus]
cacguuugcccgcuuccuc

SEQ ID NO: 3973990 - RNA, 16 nt, Human herpesvirus 4 [Epstein-Barr virus]
cacucagacucuccgc

SEQ ID NO: 3973991 - RNA, 13 nt, Human herpesvirus 4 [Epstein-Barr virus]
cacuccaccugcc

SEQ ID NO: 3973992 - RNA, 14 nt, Human herpesvirus 4 [Epstein-Barr virus]
cacucccaccaccc

SEQ ID NO: 3973993 - RNA, 23 nt, Human herpesvirus 4 [Epstein-Barr virus]
cacuccggacgcagaggccugca

SEQ ID NO: 3973994 - RNA, 15 nt, Human herpesvirus 4 [Epstein-Barr virus]
cacucugaccaggac

SEQ ID NO: 3973995 - RNA, 14 nt, Human herpesvirus 4 [Epstein-Barr virus]
cacugaaaaaccag

SEQ ID NO: 3973996 - RNA, 23 nt, Human herpesvirus 4 [Epstein-Barr virus]
cacugaugagucugacuacucag

SEQ ID NO: 3973997 - RNA, 20 nt, Human herpesvirus 4 [Epstein-Barr virus]
cacugauuuugggcacacuu

SEQ ID NO: 3973998 - RNA, 19 nt, Human herpesvirus 4 [Epstein-Barr virus]
cacugcguccaccuggcca

SEQ ID NO: 3973999 - RNA, 19 nt, Human herpesvirus 4 [Epstein-Barr virus]
gggaaaaacuggccaugca

SEQ ID NO: 3974000 - RNA, 18 nt, Human herpesvirus 4 [Epstein-Barr virus]
gggacgggguggugccug

SEQ ID NO: 3974001 - RNA, 20 nt, Human herpesvirus 4 [Epstein-Barr virus]
cggguggagauagggaccag

SEQ ID NO: 3974002 - RNA, 15 nt, Human herpesvirus 4 [Epstein-Barr virus]
cggguucgggcacgc

SEQ ID NO: 3974003 - RNA, 18 nt, Human herpesvirus 4 [Epstein-Barr virus]
cggucaaguaccagcugg

SEQ ID NO: 3974004 - RNA, 15 nt, Human herpesvirus 4 [Epstein-Barr virus]
cggugaucagggaga

SEQ ID NO: 3974005 - RNA, 16 nt, Human herpesvirus 4 [Epstein-Barr virus]
cgguggaacaggagca

SEQ ID NO: 3974006 - RNA, 15 nt, Human herpesvirus 4 [Epstein-Barr virus]
cgguggccugcucac

SEQ ID NO: 3974007 - RNA, 13 nt, Human herpesvirus 4 [Epstein-Barr virus]
cguaucugggcac

SEQ ID NO: 3974008 - RNA, 19 nt, Human herpesvirus 4 [Epstein-Barr virus]
cgucacugauuuugggcac

SEQ ID NO: 3974009 - RNA, 20 nt, Human herpesvirus 4 [Epstein-Barr virus]
cgucaggagacacggcucug

SEQ ID NO: 3974010 - RNA, 15 nt, Human herpesvirus 4 [Epstein-Barr virus]
cguccuuguccagga

SEQ ID NO: 3974011 - RNA, 23 nt, Human herpesvirus 4 [Epstein-Barr virus]
cgucgacgcuguuuugcagcuga

SEQ ID NO: 3974012 - RNA, 20 nt, Human herpesvirus 4 [Epstein-Barr virus]
cgucgcggagagggaugggc

SEQ ID NO: 3974013 - RNA, 20 nt, Human herpesvirus 4 [Epstein-Barr virus]
cgucgggaaacacagcucug

SEQ ID NO: 3974014 - RNA, 22 nt, Human herpesvirus 4 [Epstein-Barr virus]
cgugaaccucccccccagaccu

SEQ ID NO: 3974015 - RNA, 20 nt, Human herpesvirus 4 [Epstein-Barr virus]
cgugaauugugcccaccaga

SEQ ID NO: 3974016 - RNA, 18 nt, Human herpesvirus 4 [Epstein-Barr virus]
cgugaguccagggcccug

SEQ ID NO: 3974017 - RNA, 19 nt, Human herpesvirus 4 [Epstein-Barr virus]
cgugagugacacugaugag

SEQ ID NO: 3974018 - RNA, 17 nt, Human herpesvirus 4 [Epstein-Barr virus]
cgugaucaugagggcuu

SEQ ID NO: 3974019 - RNA, 19 nt, Human herpesvirus 4 [Epstein-Barr virus]
cgugcuuuuugccaggccu

SEQ ID NO: 3974020 - RNA, 13 nt, Human herpesvirus 4 [Epstein-Barr virus]
cguggagguuguc

SEQ ID NO: 3974021 - RNA, 22 nt, Human herpesvirus 4 [Epstein-Barr virus]
cguggccaccuucuccaucucc

SEQ ID NO: 3974022 - RNA, 17 nt, Human herpesvirus 4 [Epstein-Barr virus]
cguggccagguacgggc

SEQ ID NO: 3974023 - RNA, 21 nt, Human herpesvirus 4 [Epstein-Barr virus]
cgugggaaaauaguuccaggu

SEQ ID NO: 3974024 - RNA, 14 nt, Human herpesvirus 4 [Epstein-Barr virus]
cguguguggcugua

SEQ ID NO: 3974025 - RNA, 20 nt, Human herpesvirus 4 [Epstein-Barr virus]
cguuaaaacaguagaagaac

SEQ ID NO: 3974026 - RNA, 16 nt, Human herpesvirus 4 [Epstein-Barr virus]
cguucaggaacagccu

SEQ ID NO: 3974027 - RNA, 17 nt, Human herpesvirus 4 [Epstein-Barr virus]
cguuggcuucugcugcu

SEQ ID NO: 3974028 - RNA, 18 nt, Human herpesvirus 4 [Epstein-Barr virus]
cguuggcuucugcugcug

SEQ ID NO: 3974029 - RNA, 18 nt, Human herpesvirus 4 [Epstein-Barr virus]
cuaacacgaaugcccagg

SEQ ID NO: 3974030 - RNA, 23 nt, Human herpesvirus 4 [Epstein-Barr virus]
cuaacacgcuuuugucugccugg

SEQ ID NO: 3974031 - RNA, 15 nt, Human herpesvirus 4 [Epstein-Barr virus]
cuaaggcaguccagg

SEQ ID NO: 3974032 - RNA, 18 nt, Human herpesvirus 4 [Epstein-Barr virus]
cuaaucgcugguggcagu

SEQ ID NO: 3974033 - RNA, 14 nt, Human herpesvirus 4 [Epstein-Barr virus]
cuacaacucagccc

SEQ ID NO: 3974034 - RNA, 11 nt, Human herpesvirus 4 [Epstein-Barr virus]
cuacaccaccc

SEQ ID NO: 3974035 - RNA, 17 nt, Human herpesvirus 4 [Epstein-Barr virus]
cuacacggccucaaagg

SEQ ID NO: 3974036 - RNA, 12 nt, Human herpesvirus 4 [Epstein-Barr virus]
cuacaguauuuu

SEQ ID NO: 3974037 - RNA, 21 nt, Human herpesvirus 4 [Epstein-Barr virus]
cuaccucuguuccuucugcuc

SEQ ID NO: 3974038 - RNA, 23 nt, Human herpesvirus 4 [Epstein-Barr virus]
cuaccucuguuccuucugcucca

SEQ ID NO: 3974039 - RNA, 16 nt, Human herpesvirus 4 [Epstein-Barr virus]
aaaaacuugagucucu

SEQ ID NO: 3974040 - RNA, 13 nt, Human herpesvirus 4 [Epstein-Barr virus]
aaaagcagccacc

SEQ ID NO: 3974041 - RNA, 21 nt, Human herpesvirus 4 [Epstein-Barr virus]
aaaaggggcagcaaucucggc

SEQ ID NO: 3974042 - RNA, 22 nt, Human herpesvirus 4 [Epstein-Barr virus]
aaaccuccaaucaccagccacc

SEQ ID NO: 3974043 - RNA, 16 nt, Human herpesvirus 4 [Epstein-Barr virus]
aaaggaaacugcugac

SEQ ID NO: 3974044 - RNA, 15 nt, Human herpesvirus 4 [Epstein-Barr virus]
aaaggggagauguua

SEQ ID NO: 3974045 - RNA, 22 nt, Human herpesvirus 4 [Epstein-Barr virus]
aaagugguucaguggacaccca

SEQ ID NO: 3974046 - RNA, 19 nt, Human herpesvirus 4 [Epstein-Barr virus]
aaaguuguccugggcugcc

SEQ ID NO: 3974047 - RNA, 19 nt, Human herpesvirus 4 [Epstein-Barr virus]
aaaugaacccagggguggc

SEQ ID NO: 3974048 - RNA, 14 nt, Human herpesvirus 4 [Epstein-Barr virus]
aacacgaaugccca

SEQ ID NO: 3974049 - RNA, 19 nt, Human herpesvirus 4 [Epstein-Barr virus]
aacauuugaggaggcacac

SEQ ID NO: 3974050 - RNA, 16 nt, Human herpesvirus 4 [Epstein-Barr virus]
aaccucacugucauuc

SEQ ID NO: 3974051 - RNA, 16 nt, Human herpesvirus 4 [Epstein-Barr virus]
aaccugauucccccug

SEQ ID NO: 3974052 - RNA, 18 nt, Human herpesvirus 4 [Epstein-Barr virus]
aaccuuggacccugcugc

SEQ ID NO: 3974053 - RNA, 21 nt, Human herpesvirus 4 [Epstein-Barr virus]
aacuagcggcgagacccgagg

SEQ ID NO: 3974054 - RNA, 20 nt, Human herpesvirus 4 [Epstein-Barr virus]
aacugccuaucauguuucaa

SEQ ID NO: 3974055 - RNA, 14 nt, Human herpesvirus 4 [Epstein-Barr virus]
aacuggccaugcag

SEQ ID NO: 3974056 - RNA, 23 nt, Human herpesvirus 4 [Epstein-Barr virus]
aacuggggcugguggccugggag

SEQ ID NO: 3974057 - RNA, 20 nt, Human herpesvirus 4 [Epstein-Barr virus]
aacuugacuacaauguuccu

SEQ ID NO: 3974058 - RNA, 15 nt, Human herpesvirus 4 [Epstein-Barr virus]
aacuuggaggcugcu

SEQ ID NO: 3974059 - RNA, 24 nt, Human herpesvirus 4 [Epstein-Barr virus]
aacuuuacuuuuauuucaguucug

SEQ ID NO: 3974060 - RNA, 14 nt, Human herpesvirus 4 [Epstein-Barr virus]
aagaaucggguggc

SEQ ID NO: 3974061 - RNA, 12 nt, Human herpesvirus 4 [Epstein-Barr virus]
aagaccaaggcc

SEQ ID NO: 3974062 - RNA, 18 nt, Human herpesvirus 4 [Epstein-Barr virus]
aagagacuucacagagca

SEQ ID NO: 3974063 - RNA, 15 nt, Human herpesvirus 4 [Epstein-Barr virus]
aagaguucucuggug

SEQ ID NO: 3974064 - RNA, 15 nt, Human herpesvirus 4 [Epstein-Barr virus]
aagaugucaaacaug

SEQ ID NO: 3974065 - RNA, 22 nt, Human herpesvirus 4 [Epstein-Barr virus]
aagcaugggggaaaccugcgaa

SEQ ID NO: 3974066 - RNA, 20 nt, Human herpesvirus 4 [Epstein-Barr virus]
aagcccaagaagaagcccac

SEQ ID NO: 3974067 - RNA, 14 nt, Human herpesvirus 4 [Epstein-Barr virus]
aagccgggggagaa

SEQ ID NO: 3974068 - RNA, 17 nt, Human herpesvirus 4 [Epstein-Barr virus]
aagcgggugcaguaaca

SEQ ID NO: 3974069 - RNA, 22 nt, Human herpesvirus 4 [Epstein-Barr virus]
aagcuaccgaugauucuggcca

SEQ ID NO: 3974070 - RNA, 12 nt, Human herpesvirus 4 [Epstein-Barr virus]
aagcugaagaac

SEQ ID NO: 3974071 - RNA, 14 nt, Human herpesvirus 4 [Epstein-Barr virus]
aaggccgcugccag

SEQ ID NO: 3974072 - RNA, 17 nt, Human herpesvirus 4 [Epstein-Barr virus]
aagggacccacggugga

SEQ ID NO: 3974073 - RNA, 18 nt, Human herpesvirus 4 [Epstein-Barr virus]
aagggcccagggucacug

SEQ ID NO: 3974074 - RNA, 15 nt, Human herpesvirus 4 [Epstein-Barr virus]
aagguccugggccuc

SEQ ID NO: 3974075 - RNA, 18 nt, Human herpesvirus 4 [Epstein-Barr virus]
aaguaguuggagcucaag

SEQ ID NO: 3974076 - RNA, 23 nt, Human herpesvirus 4 [Epstein-Barr virus]
aagugauuaggagcagggcccag

SEQ ID NO: 3974077 - RNA, 15 nt, Human herpesvirus 4 [Epstein-Barr virus]
aauaaaguugaugau

SEQ ID NO: 3974078 - RNA, 17 nt, Human herpesvirus 4 [Epstein-Barr virus]
aauaaauguuacuucuu

SEQ ID NO: 3974079 - RNA, 21 nt, Human herpesvirus 4 [Epstein-Barr virus]
aaucagaccacccggacccgg

SEQ ID NO: 3974080 - RNA, 16 nt, Human herpesvirus 4 [Epstein-Barr virus]
aaucuaaugaagagcc

SEQ ID NO: 3974081 - RNA, 20 nt, Human herpesvirus 4 [Epstein-Barr virus]
aaugggcgcgggucccccua

SEQ ID NO: 3974082 - RNA, 23 nt, Human herpesvirus 4 [Epstein-Barr virus]
aauuauccaagaaaccccacgga

SEQ ID NO: 3974083 - RNA, 15 nt, Human herpesvirus 4 [Epstein-Barr virus]
aauucagccaccucc

SEQ ID NO: 3974084 - RNA, 18 nt, Human herpesvirus 4 [Epstein-Barr virus]
aauucagccaccuccccu

SEQ ID NO: 3974085 - RNA, 18 nt, Human herpesvirus 4 [Epstein-Barr virus]
aauucccucgaaucccua

SEQ ID NO: 3974086 - RNA, 18 nt, Human herpesvirus 4 [Epstein-Barr virus]
aauucuugcacccacccc

SEQ ID NO: 3974087 - RNA, 15 nt, Human herpesvirus 4 [Epstein-Barr virus]
aauugugcccaccag

SEQ ID NO: 3974088 - RNA, 18 nt, Human herpesvirus 4 [Epstein-Barr virus]
aauuguuaguuuaaacag

SEQ ID NO: 3974089 - RNA, 12 nt, Human herpesvirus 4 [Epstein-Barr virus]
aauuuaaccaaa

SEQ ID NO: 3974090 - RNA, 15 nt, Human herpesvirus 4 [Epstein-Barr virus]
acaacggcugugacu

SEQ ID NO: 3974091 - RNA, 17 nt, Human herpesvirus 4 [Epstein-Barr virus]
acaaggagugccucugg

SEQ ID NO: 3974092 - RNA, 17 nt, Human herpesvirus 4 [Epstein-Barr virus]
acaagggaagagggaaa

SEQ ID NO: 3974093 - RNA, 15 nt, Human herpesvirus 4 [Epstein-Barr virus]
acacagccugacucu

SEQ ID NO: 3974094 - RNA, 15 nt, Human herpesvirus 4 [Epstein-Barr virus]
acacagcucuggcag

SEQ ID NO: 3974095 - RNA, 19 nt, Human herpesvirus 4 [Epstein-Barr virus]
acacauuacggugcuggag

SEQ ID NO: 3974096 - RNA, 19 nt, Human herpesvirus 4 [Epstein-Barr virus]
acacgaggaucucuuaaau

SEQ ID NO: 3974097 - RNA, 19 nt, Human herpesvirus 4 [Epstein-Barr virus]
acacggaaaccacaacagc

SEQ ID NO: 3974098 - RNA, 20 nt, Human herpesvirus 4 [Epstein-Barr virus]
acacuccauuaauuccacua

SEQ ID NO: 3974099 - RNA, 21 nt, Human herpesvirus 4 [Epstein-Barr virus]
acacucuggggucucaggccu

SEQ ID NO: 3974100 - RNA, 23 nt, Human herpesvirus 4 [Epstein-Barr virus]
acacugccaagguugaagagcag

SEQ ID NO: 3974101 - RNA, 20 nt, Human herpesvirus 4 [Epstein-Barr virus]
acagcagcagugugugaaga

SEQ ID NO: 3974102 - RNA, 12 nt, Human herpesvirus 4 [Epstein-Barr virus]
acagcucuggca

SEQ ID NO: 3974103 - RNA, 21 nt, Human herpesvirus 4 [Epstein-Barr virus]
acaggaggcccgaccccaacu

SEQ ID NO: 3974104 - RNA, 21 nt, Human herpesvirus 4 [Epstein-Barr virus]
acagggguauguggugccaug

SEQ ID NO: 3974105 - RNA, 17 nt, Human herpesvirus 4 [Epstein-Barr virus]
acaggugggacaaaaug

SEQ ID NO: 3974106 - RNA, 17 nt, Human herpesvirus 4 [Epstein-Barr virus]
acagucccgagaccggc

SEQ ID NO: 3974107 - RNA, 16 nt, Human herpesvirus 4 [Epstein-Barr virus]
acagucuucaggucug

SEQ ID NO: 3974108 - RNA, 15 nt, Human herpesvirus 4 [Epstein-Barr virus]
acaucugcccggcua

SEQ ID NO: 3974109 - RNA, 22 nt, Human herpesvirus 4 [Epstein-Barr virus]
acaugggccacugcaggcugga

SEQ ID NO: 3974110 - RNA, 13 nt, Human herpesvirus 4 [Epstein-Barr virus]
acauggggcauua

SEQ ID NO: 3974111 - RNA, 15 nt, Human herpesvirus 4 [Epstein-Barr virus]
acauggugucuguaa

SEQ ID NO: 3974112 - RNA, 23 nt, Human herpesvirus 4 [Epstein-Barr virus]
accaacaagcagguauugcagcu

SEQ ID NO: 3974113 - RNA, 22 nt, Human herpesvirus 4 [Epstein-Barr virus]
accccacggggugcucccccug

SEQ ID NO: 3974114 - RNA, 14 nt, Human herpesvirus 4 [Epstein-Barr virus]
acccccaccacccc

SEQ ID NO: 3974115 - RNA, 16 nt, Human herpesvirus 4 [Epstein-Barr virus]
acccccaccaccucca

SEQ ID NO: 3974116 - RNA, 16 nt, Human herpesvirus 4 [Epstein-Barr virus]
accccccccaccacca

SEQ ID NO: 3974117 - RNA, 19 nt, Human herpesvirus 4 [Epstein-Barr virus]
acccccggcucucaggccu

SEQ ID NO: 3974118 - RNA, 18 nt, Human herpesvirus 4 [Epstein-Barr virus]
acccccguccagcaggcu

SEQ ID NO: 3974119 - RNA, 19 nt, Human herpesvirus 4 [Epstein-Barr virus]
acccccuggagccagcgcu

SEQ ID NO: 3974120 - RNA, 15 nt, Human herpesvirus 4 [Epstein-Barr virus]
acccggacccggacc

SEQ ID NO: 3974121 - RNA, 22 nt, Human herpesvirus 4 [Epstein-Barr virus]
acccggucgcaugguggcuucu

SEQ ID NO: 3974122 - RNA, 17 nt, Human herpesvirus 4 [Epstein-Barr virus]
acccucauugugcugaa

SEQ ID NO: 3974123 - RNA, 17 nt, Human herpesvirus 4 [Epstein-Barr virus]
acccucuugcacuccaa

SEQ ID NO: 3974124 - RNA, 17 nt, Human herpesvirus 4 [Epstein-Barr virus]
acccugcauggccaggc

SEQ ID NO: 3974125 - RNA, 19 nt, Human herpesvirus 4 [Epstein-Barr virus]
accgccuuaugaggaccca

SEQ ID NO: 3974126 - RNA, 21 nt, Human herpesvirus 4 [Epstein-Barr virus]
accgcgaccaagacucaauuu

SEQ ID NO: 3974127 - RNA, 12 nt, Human herpesvirus 4 [Epstein-Barr virus]
accggugggcuc

SEQ ID NO: 3974128 - RNA, 23 nt, Human herpesvirus 4 [Epstein-Barr virus]
accuacgcugcccuagagguuuu

SEQ ID NO: 3974129 - RNA, 15 nt, Human herpesvirus 4 [Epstein-Barr virus]
accucauccugcuca

SEQ ID NO: 3974130 - RNA, 16 nt, Human herpesvirus 4 [Epstein-Barr virus]
accucauccugcucau

SEQ ID NO: 3974131 - RNA, 22 nt, Human herpesvirus 4 [Epstein-Barr virus]
accucuguuccuucugcuccag

SEQ ID NO: 3974132 - RNA, 23 nt, Human herpesvirus 4 [Epstein-Barr virus]
accugacuggcagaaaggcuggc

SEQ ID NO: 3974133 - RNA, 16 nt, Human herpesvirus 4 [Epstein-Barr virus]
accugagccugagcca

SEQ ID NO: 3974134 - RNA, 17 nt, Human herpesvirus 4 [Epstein-Barr virus]
accugauucccccugcu

SEQ ID NO: 3974135 - RNA, 17 nt, Human herpesvirus 4 [Epstein-Barr virus]
accuucaccaccacccc

SEQ ID NO: 3974136 - RNA, 17 nt, Human herpesvirus 4 [Epstein-Barr virus]
accuuccuguguucucc

SEQ ID NO: 3974137 - RNA, 22 nt, Human herpesvirus 4 [Epstein-Barr virus]
accuuggccgguggcuguggac

SEQ ID NO: 3974138 - RNA, 23 nt, Human herpesvirus 4 [Epstein-Barr virus]
accuuuuaauucucuucuguuug

SEQ ID NO: 3974139 - RNA, 16 nt, Human herpesvirus 4 [Epstein-Barr virus]
acgacaucugggagug

SEQ ID NO: 3974140 - RNA, 21 nt, Human herpesvirus 4 [Epstein-Barr virus]
acgaggcccugcaagccaaga

SEQ ID NO: 3974141 - RNA, 14 nt, Human herpesvirus 4 [Epstein-Barr virus]
acgcagaggccugc

SEQ ID NO: 3974142 - RNA, 14 nt, Human herpesvirus 4 [Epstein-Barr virus]
acgccagagacaag

SEQ ID NO: 3974143 - RNA, 17 nt, Human herpesvirus 4 [Epstein-Barr virus]
acgccggaugccugccu

SEQ ID NO: 3974144 - RNA, 13 nt, Human herpesvirus 4 [Epstein-Barr virus]
acgccggccugcu

SEQ ID NO: 3974145 - RNA, 22 nt, Human herpesvirus 4 [Epstein-Barr virus]
acgccggccugcuggccgagcu

SEQ ID NO: 3974146 - RNA, 18 nt, Human herpesvirus 4 [Epstein-Barr virus]
acgccguggcccugagca

SEQ ID NO: 3974147 - RNA, 12 nt, Human herpesvirus 4 [Epstein-Barr virus]
acgcgauggcac

SEQ ID NO: 3974148 - RNA, 21 nt, Human herpesvirus 4 [Epstein-Barr virus]
acgcucccgggcaaacagggc

SEQ ID NO: 3974149 - RNA, 16 nt, Human herpesvirus 4 [Epstein-Barr virus]
acgcuuccacccccug

SEQ ID NO: 3974150 - RNA, 13 nt, Human herpesvirus 4 [Epstein-Barr virus]
acggggaaggagg

SEQ ID NO: 3974151 - RNA, 20 nt, Human herpesvirus 4 [Epstein-Barr virus]
acgugcaaggauggaagaga

SEQ ID NO: 3974152 - RNA, 16 nt, Human herpesvirus 4 [Epstein-Barr virus]
acguggcugcgguggu

SEQ ID NO: 3974153 - RNA, 14 nt, Human herpesvirus 4 [Epstein-Barr virus]
acuacuuguuucug

SEQ ID NO: 3974154 - RNA, 12 nt, Human herpesvirus 4 [Epstein-Barr virus]
acuauaccaaag

SEQ ID NO: 3974155 - RNA, 15 nt, Human herpesvirus 4 [Epstein-Barr virus]
acuccacagauggag

SEQ ID NO: 3974156 - RNA, 13 nt, Human herpesvirus 4 [Epstein-Barr virus]
acucccuccagaa

SEQ ID NO: 3974157 - RNA, 17 nt, Human herpesvirus 4 [Epstein-Barr virus]
acuccggcccacgccau

SEQ ID NO: 3974158 - RNA, 17 nt, Human herpesvirus 4 [Epstein-Barr virus]
acucgagagaggccucu

SEQ ID NO: 3974159 - RNA, 15 nt, Human herpesvirus 4 [Epstein-Barr virus]
acucgugggaaaaug

SEQ ID NO: 3974160 - RNA, 21 nt, Human herpesvirus 4 [Epstein-Barr virus]
acucuccgcuuuaagaccaag

SEQ ID NO: 3974161 - RNA, 14 nt, Human herpesvirus 4 [Epstein-Barr virus]
acucugaaaaugau

SEQ ID NO: 3974162 - RNA, 13 nt, Human herpesvirus 4 [Epstein-Barr virus]
acucuucauucuu

SEQ ID NO: 3974163 - RNA, 15 nt, Human herpesvirus 4 [Epstein-Barr virus]
acugaaaaaccagac

SEQ ID NO: 3974164 - RNA, 16 nt, Human herpesvirus 4 [Epstein-Barr virus]
acugaccacucaggaa

SEQ ID NO: 3974165 - RNA, 17 nt, Human herpesvirus 4 [Epstein-Barr virus]
acugacucucccuccau

SEQ ID NO: 3974166 - RNA, 16 nt, Human herpesvirus 4 [Epstein-Barr virus]
acugauugucgcuggc

SEQ ID NO: 3974167 - RNA, 17 nt, Human herpesvirus 4 [Epstein-Barr virus]
acugauuuugggcacac

SEQ ID NO: 3974168 - RNA, 19 nt, Human herpesvirus 4 [Epstein-Barr virus]
acugcagugggccucucug

SEQ ID NO: 3974169 - RNA, 17 nt, Human herpesvirus 4 [Epstein-Barr virus]
acugccuggggaaaaug

SEQ ID NO: 3974170 - RNA, 21 nt, Human herpesvirus 4 [Epstein-Barr virus]
acugggaugaacccuggggca

SEQ ID NO: 3974171 - RNA, 20 nt, Human herpesvirus 4 [Epstein-Barr virus]
acuggggugugaagggcagg

SEQ ID NO: 3974172 - RNA, 22 nt, Human herpesvirus 4 [Epstein-Barr virus]
acuggugcuuguggugugggag

SEQ ID NO: 3974173 - RNA, 21 nt, Human herpesvirus 4 [Epstein-Barr virus]
acugguuguaaccuaugccug

SEQ ID NO: 3974174 - RNA, 14 nt, Human herpesvirus 4 [Epstein-Barr virus]
acugucacugugca

SEQ ID NO: 3974175 - RNA, 19 nt, Human herpesvirus 4 [Epstein-Barr virus]
acugugguuuccaugacgc

SEQ ID NO: 3974176 - RNA, 13 nt, Human herpesvirus 4 [Epstein-Barr virus]
acuuccucugcuu

SEQ ID NO: 3974177 - RNA, 11 nt, Human herpesvirus 4 [Epstein-Barr virus]
acuuccuggga

SEQ ID NO: 3974178 - RNA, 16 nt, Human herpesvirus 4 [Epstein-Barr virus]
acuucuucucugcucg

SEQ ID NO: 3974179 - RNA, 15 nt, Human herpesvirus 4 [Epstein-Barr virus]
acuugaggugggcug

SEQ ID NO: 3974180 - RNA, 17 nt, Human herpesvirus 4 [Epstein-Barr virus]
agaaaagagagcggcug

SEQ ID NO: 3974181 - RNA, 22 nt, Human herpesvirus 4 [Epstein-Barr virus]
agaaaggcuggccguguucacu

SEQ ID NO: 3974182 - RNA, 21 nt, Human herpesvirus 4 [Epstein-Barr virus]
agaaggcuccggcggcagugg

SEQ ID NO: 3974183 - RNA, 18 nt, Human herpesvirus 4 [Epstein-Barr virus]
agaaggggcccuguacau

SEQ ID NO: 3974184 - RNA, 14 nt, Human herpesvirus 4 [Epstein-Barr virus]
agaagugcugggag

SEQ ID NO: 3974185 - RNA, 15 nt, Human herpesvirus 4 [Epstein-Barr virus]
agaaguguguccccc

SEQ ID NO: 3974186 - RNA, 14 nt, Human herpesvirus 4 [Epstein-Barr virus]
agaaguuaccuggu

SEQ ID NO: 3974187 - RNA, 14 nt, Human herpesvirus 4 [Epstein-Barr virus]
agacaccaggcgcc

SEQ ID NO: 3974188 - RNA, 12 nt, Human herpesvirus 4 [Epstein-Barr virus]
agaccccaaaaa

SEQ ID NO: 3974189 - RNA, 15 nt, Human herpesvirus 4 [Epstein-Barr virus]
agaccucugugucca

SEQ ID NO: 3974190 - RNA, 17 nt, Human herpesvirus 4 [Epstein-Barr virus]
agacuaugcauacacug

SEQ ID NO: 3974191 - RNA, 18 nt, Human herpesvirus 4 [Epstein-Barr virus]
agacucaucucaagggag

SEQ ID NO: 3974192 - RNA, 17 nt, Human herpesvirus 4 [Epstein-Barr virus]
cggagcccugcccuccu

SEQ ID NO: 3974193 - RNA, 11 nt, Human herpesvirus 4 [Epstein-Barr virus]
cggagggacag

SEQ ID NO: 3974194 - RNA, 17 nt, Human herpesvirus 4 [Epstein-Barr virus]
cggaggucgacccuccu

SEQ ID NO: 3974195 - RNA, 13 nt, Human herpesvirus 4 [Epstein-Barr virus]
cggagucuucaag

SEQ ID NO: 3974196 - RNA, 24 nt, Human herpesvirus 4 [Epstein-Barr virus]
cggaguugaugaaaggggccgagg

SEQ ID NO: 3974197 - RNA, 16 nt, Human herpesvirus 4 [Epstein-Barr virus]
cggcaccgccaggugg

SEQ ID NO: 3974198 - RNA, 14 nt, Human herpesvirus 4 [Epstein-Barr virus]
cggcaguggaccuc

SEQ ID NO: 3974199 - RNA, 21 nt, Human herpesvirus 4 [Epstein-Barr virus]
cggcccacgccauaccugcac

SEQ ID NO: 3974200 - RNA, 13 nt, Human herpesvirus 4 [Epstein-Barr virus]
cggcccagcccga

SEQ ID NO: 3974201 - RNA, 14 nt, Human herpesvirus 4 [Epstein-Barr virus]
cggccgaggccugc

SEQ ID NO: 3974202 - RNA, 17 nt, Human herpesvirus 4 [Epstein-Barr virus]
cggccuacgaggcccug

SEQ ID NO: 3974203 - RNA, 20 nt, Human herpesvirus 4 [Epstein-Barr virus]
cggccuccuggccagcaccc

SEQ ID NO: 3974204 - RNA, 19 nt, Human herpesvirus 4 [Epstein-Barr virus]
cggcgaugucggggcugcu

SEQ ID NO: 3974205 - RNA, 22 nt, Human herpesvirus 4 [Epstein-Barr virus]
cggcgaugucggggcugcuggc

SEQ ID NO: 3974206 - RNA, 13 nt, Human herpesvirus 4 [Epstein-Barr virus]
cggcgccucuugu

SEQ ID NO: 3974207 - RNA, 22 nt, Human herpesvirus 4 [Epstein-Barr virus]
cggcgcucgucguucaggaaca

SEQ ID NO: 3974208 - RNA, 13 nt, Human herpesvirus 4 [Epstein-Barr virus]
cggcguggagcug

SEQ ID NO: 3974209 - RNA, 21 nt, Human herpesvirus 4 [Epstein-Barr virus]
cggcuagccugacuaagggug

SEQ ID NO: 3974210 - RNA, 13 nt, Human herpesvirus 4 [Epstein-Barr virus]
cggcucaggauca

SEQ ID NO: 3974211 - RNA, 14 nt, Human herpesvirus 4 [Epstein-Barr virus]
cggcucgaccggga

SEQ ID NO: 3974212 - RNA, 14 nt, Human herpesvirus 4 [Epstein-Barr virus]
cggcucucaggccu

SEQ ID NO: 3974213 - RNA, 16 nt, Human herpesvirus 4 [Epstein-Barr virus]
cggcugcugagaccuc

SEQ ID NO: 3974214 - RNA, 16 nt, Human herpesvirus 4 [Epstein-Barr virus]
cgggaugacucaucuc

SEQ ID NO: 3974215 - RNA, 18 nt, Human herpesvirus 4 [Epstein-Barr virus]
cggggaaaagagagcuga

SEQ ID NO: 3974216 - RNA, 22 nt, Human herpesvirus 4 [Epstein-Barr virus]
cggggcgauaccuugggcauca

SEQ ID NO: 3974217 - RNA, 14 nt, Human herpesvirus 4 [Epstein-Barr virus]
cggggcggcggugg

SEQ ID NO: 3974218 - RNA, 15 nt, Human herpesvirus 4 [Epstein-Barr virus]
cgggggagagaaaga

SEQ ID NO: 3974219 - RNA, 16 nt, Human herpesvirus 4 [Epstein-Barr virus]
cgggggagagaaagag

SEQ ID NO: 3974220 - RNA, 16 nt, Human herpesvirus 4 [Epstein-Barr virus]
cggguagaccacuggc

SEQ ID NO: 3974221 - RNA, 19 nt, Human herpesvirus 4 [Epstein-Barr virus]
cggguaguagcacuggugg

SEQ ID NO: 3974222 - RNA, 16 nt, Human herpesvirus 4 [Epstein-Barr virus]
cgggucccccuagccc

SEQ ID NO: 3974223 - RNA, 14 nt, Human herpesvirus 4 [Epstein-Barr virus]
cggguccuagcaca

SEQ ID NO: 3974224 - RNA, 19 nt, Human herpesvirus 4 [Epstein-Barr virus]
cggguggaggagcuccgug

SEQ ID NO: 3974225 - RNA, 12 nt, Human herpesvirus 4 [Epstein-Barr virus]
cggugcugccag

SEQ ID NO: 3974226 - RNA, 15 nt, Human herpesvirus 4 [Epstein-Barr virus]
cgguggaacaggagc

SEQ ID NO: 3974227 - RNA, 17 nt, Human herpesvirus 4 [Epstein-Barr virus]
cgguggaacaggagcag

SEQ ID NO: 3974228 - RNA, 19 nt, Human herpesvirus 4 [Epstein-Barr virus]
cgguggaacaggagcagga

SEQ ID NO: 3974229 - RNA, 20 nt, Human herpesvirus 4 [Epstein-Barr virus]
cgguggaacaggagcaggag

SEQ ID NO: 3974230 - RNA, 15 nt, Human herpesvirus 4 [Epstein-Barr virus]
cggugucggcaccua

SEQ ID NO: 3974231 - RNA, 13 nt, Human herpesvirus 4 [Epstein-Barr virus]
cgguugagcugag

SEQ ID NO: 3974232 - RNA, 17 nt, Human herpesvirus 4 [Epstein-Barr virus]
cguaaucuguggugggc

SEQ ID NO: 3974233 - RNA, 15 nt, Human herpesvirus 4 [Epstein-Barr virus]
cgucacucagcuccg

SEQ ID NO: 3974234 - RNA, 23 nt, Human herpesvirus 4 [Epstein-Barr virus]
cguccaucuugagcgccguggcc

SEQ ID NO: 3974235 - RNA, 23 nt, Human herpesvirus 4 [Epstein-Barr virus]
cgucccagggccggaaccugagc

SEQ ID NO: 3974236 - RNA, 18 nt, Human herpesvirus 4 [Epstein-Barr virus]
cguccccgggagcgggag

SEQ ID NO: 3974237 - RNA, 22 nt, Human herpesvirus 4 [Epstein-Barr virus]
cgucgacgcuguuuugcagcug

SEQ ID NO: 3974238 - RNA, 21 nt, Human herpesvirus 4 [Epstein-Barr virus]
cgucguucaggaacagccucc

SEQ ID NO: 3974239 - RNA, 14 nt, Human herpesvirus 4 [Epstein-Barr virus]
cgugcaugcagcgc

SEQ ID NO: 3974240 - RNA, 16 nt, Human herpesvirus 4 [Epstein-Barr virus]
cgugccucgggccuca

SEQ ID NO: 3974241 - RNA, 16 nt, Human herpesvirus 4 [Epstein-Barr virus]
cgugggauggcggggc

SEQ ID NO: 3974242 - RNA, 18 nt, Human herpesvirus 4 [Epstein-Barr virus]
cgugugcacccggcugga

SEQ ID NO: 3974243 - RNA, 21 nt, Human herpesvirus 4 [Epstein-Barr virus]
cguguucccuaagcagcugag

SEQ ID NO: 3974244 - RNA, 18 nt, Human herpesvirus 4 [Epstein-Barr virus]
cguuuaaacgagagaaga

SEQ ID NO: 3974245 - RNA, 18 nt, Human herpesvirus 4 [Epstein-Barr virus]
cguuuacuaauggaauau

SEQ ID NO: 3974246 - RNA, 20 nt, Human herpesvirus 4 [Epstein-Barr virus]
cguuugaguccaaacagcua

SEQ ID NO: 3974247 - RNA, 22 nt, Human herpesvirus 4 [Epstein-Barr virus]
cguuugugauucccagaaagaa

SEQ ID NO: 3974248 - RNA, 11 nt, Human herpesvirus 4 [Epstein-Barr virus]
cuaagcagcug

SEQ ID NO: 3974249 - RNA, 23 nt, Human herpesvirus 4 [Epstein-Barr virus]
cuaaggcaguccaggggccacac

SEQ ID NO: 3974250 - RNA, 18 nt, Human herpesvirus 4 [Epstein-Barr virus]
cuaaggccgggagaggca

SEQ ID NO: 3974251 - RNA, 20 nt, Human herpesvirus 4 [Epstein-Barr virus]
cuaauggccguccucuggac

SEQ ID NO: 3974252 - RNA, 17 nt, Human herpesvirus 4 [Epstein-Barr virus]
cuacaccaccccaccau

SEQ ID NO: 3974253 - RNA, 18 nt, Human herpesvirus 4 [Epstein-Barr virus]
cuacaccccugagaaccc

SEQ ID NO: 3974254 - RNA, 15 nt, Human herpesvirus 4 [Epstein-Barr virus]
cuacccucuuaggga

SEQ ID NO: 3974255 - RNA, 14 nt, Human herpesvirus 4 [Epstein-Barr virus]
cuacgcagaggcca

SEQ ID NO: 3974256 - RNA, 15 nt, Human herpesvirus 4 [Epstein-Barr virus]
cuacgcugcccuaga

SEQ ID NO: 3974257 - RNA, 15 nt, Human herpesvirus 4 [Epstein-Barr virus]
cuacuucgccaugcu

SEQ ID NO: 3974258 - RNA, 22 nt, Human herpesvirus 4 [Epstein-Barr virus]
cuagauuuccuacaacucagcc

SEQ ID NO: 3974259 - RNA, 23 nt, Human herpesvirus 4 [Epstein-Barr virus]
cuaggcgggcgggcuugugcuug

SEQ ID NO: 3974260 - RNA, 19 nt, Human herpesvirus 4 [Epstein-Barr virus]
cuaggcugaaaagccacau

SEQ ID NO: 3974261 - RNA, 20 nt, Human herpesvirus 4 [Epstein-Barr virus]
cuauaaagacaagccugcgu

SEQ ID NO: 3974262 - RNA, 19 nt, Human herpesvirus 4 [Epstein-Barr virus]
gccacugcaggcuggacgu

SEQ ID NO: 3974263 - RNA, 14 nt, Human herpesvirus 4 [Epstein-Barr virus]
gccagacuccgcca

SEQ ID NO: 3974264 - RNA, 22 nt, Human herpesvirus 4 [Epstein-Barr virus]
gccagagcggcauccucaaggg

SEQ ID NO: 3974265 - RNA, 17 nt, Human herpesvirus 4 [Epstein-Barr virus]
gccaggcccgaccugcc

SEQ ID NO: 3974266 - RNA, 14 nt, Human herpesvirus 4 [Epstein-Barr virus]
gccaggcuggugac

SEQ ID NO: 3974267 - RNA, 18 nt, Human herpesvirus 4 [Epstein-Barr virus]
gccaggcugucgccagcc

SEQ ID NO: 3974268 - RNA, 17 nt, Human herpesvirus 4 [Epstein-Barr virus]
gccaugcacggcccuga

SEQ ID NO: 3974269 - RNA, 16 nt, Human herpesvirus 4 [Epstein-Barr virus]
gccaugcucagggcca

SEQ ID NO: 3974270 - RNA, 16 nt, Human herpesvirus 4 [Epstein-Barr virus]
gccaugcuucuuacac

SEQ ID NO: 3974271 - RNA, 22 nt, Human herpesvirus 4 [Epstein-Barr virus]
gcccaccagagggugagcccac

SEQ ID NO: 3974272 - RNA, 20 nt, Human herpesvirus 4 [Epstein-Barr virus]
gcccaccagccagcgacuga

SEQ ID NO: 3974273 - RNA, 11 nt, Human herpesvirus 4 [Epstein-Barr virus]
gcccacccacu

SEQ ID NO: 3974274 - RNA, 18 nt, Human herpesvirus 4 [Epstein-Barr virus]
gcccagaggcgcugugga

SEQ ID NO: 3974275 - RNA, 17 nt, Human herpesvirus 4 [Epstein-Barr virus]
gcccauggaaugcucag

SEQ ID NO: 3974276 - RNA, 12 nt, Human herpesvirus 4 [Epstein-Barr virus]
gccccagccccu

SEQ ID NO: 3974277 - RNA, 16 nt, Human herpesvirus 4 [Epstein-Barr virus]
gcccccaccaccccca

SEQ ID NO: 3974278 - RNA, 15 nt, Human herpesvirus 4 [Epstein-Barr virus]
gcccccgccagcgcc

SEQ ID NO: 3974279 - RNA, 15 nt, Human herpesvirus 4 [Epstein-Barr virus]
gcccccggagcccug

SEQ ID NO: 3974280 - RNA, 20 nt, Human herpesvirus 4 [Epstein-Barr virus]
gccccgaaagcggcccagca

SEQ ID NO: 3974281 - RNA, 14 nt, Human herpesvirus 4 [Epstein-Barr virus]
gccccggucccccc

SEQ ID NO: 3974282 - RNA, 17 nt, Human herpesvirus 4 [Epstein-Barr virus]
gccccgguccccccaga

SEQ ID NO: 3974283 - RNA, 19 nt, Human herpesvirus 4 [Epstein-Barr virus]
gccccuaggccugccacgu

SEQ ID NO: 3974284 - RNA, 11 nt, Human herpesvirus 4 [Epstein-Barr virus]
gccccucagcc

SEQ ID NO: 3974285 - RNA, 19 nt, Human herpesvirus 4 [Epstein-Barr virus]
gcccucgguggugggcugc

SEQ ID NO: 3974286 - RNA, 21 nt, Human herpesvirus 4 [Epstein-Barr virus]
gcccucgguggugggcugcug

SEQ ID NO: 3974287 - RNA, 23 nt, Human herpesvirus 4 [Epstein-Barr virus]
gcccugcccuccuccacccagca

SEQ ID NO: 3974288 - RNA, 15 nt, Human herpesvirus 4 [Epstein-Barr virus]
gcccuggaggccuca

SEQ ID NO: 3974289 - RNA, 18 nt, Human herpesvirus 4 [Epstein-Barr virus]
gcccuggaggccucaggc

SEQ ID NO: 3974290 - RNA, 14 nt, Human herpesvirus 4 [Epstein-Barr virus]
gccgagccugucga

SEQ ID NO: 3974291 - RNA, 20 nt, Human herpesvirus 4 [Epstein-Barr virus]
gccgcagaagagccgcuccg

SEQ ID NO: 3974292 - RNA, 14 nt, Human herpesvirus 4 [Epstein-Barr virus]
gccgccagcagccc

SEQ ID NO: 3974293 - RNA, 16 nt, Human herpesvirus 4 [Epstein-Barr virus]
gccgcgcugcucgccc

SEQ ID NO: 3974294 - RNA, 18 nt, Human herpesvirus 4 [Epstein-Barr virus]
gccgcuaguugguccagg

SEQ ID NO: 3974295 - RNA, 13 nt, Human herpesvirus 4 [Epstein-Barr virus]
gccgcugccaggc

SEQ ID NO: 3974296 - RNA, 21 nt, Human herpesvirus 4 [Epstein-Barr virus]
cccauaaaaauaagugcaugg

SEQ ID NO: 3974297 - RNA, 17 nt, Human herpesvirus 4 [Epstein-Barr virus]
cccauguaagccugccu

SEQ ID NO: 3974298 - RNA, 22 nt, Human herpesvirus 4 [Epstein-Barr virus]
ccccaaaaguagaggcucaggc

SEQ ID NO: 3974299 - RNA, 12 nt, Human herpesvirus 4 [Epstein-Barr virus]
ccccagccacag

SEQ ID NO: 3974300 - RNA, 16 nt, Human herpesvirus 4 [Epstein-Barr virus]
ccccagcccgccagcc

SEQ ID NO: 3974301 - RNA, 20 nt, Human herpesvirus 4 [Epstein-Barr virus]
cccccagaccugugugcugu

SEQ ID NO: 3974302 - RNA, 17 nt, Human herpesvirus 4 [Epstein-Barr virus]
ccccccagaagccccca

SEQ ID NO: 3974303 - RNA, 12 nt, Human herpesvirus 4 [Epstein-Barr virus]
ccccccagccug

SEQ ID NO: 3974304 - RNA, 18 nt, Human herpesvirus 4 [Epstein-Barr virus]
ccccgaaagcggcccagc

SEQ ID NO: 3974305 - RNA, 22 nt, Human herpesvirus 4 [Epstein-Barr virus]
ccccuggacacuuauguuucaa

SEQ ID NO: 3974306 - RNA, 13 nt, Human herpesvirus 4 [Epstein-Barr virus]
cccgacaauaaag

SEQ ID NO: 3974307 - RNA, 17 nt, Human herpesvirus 4 [Epstein-Barr virus]
cccgccagcgccuccuc

SEQ ID NO: 3974308 - RNA, 17 nt, Human herpesvirus 4 [Epstein-Barr virus]
cccgccuagagcauuug

SEQ ID NO: 3974309 - RNA, 20 nt, Human herpesvirus 4 [Epstein-Barr virus]
cccgcgccgcaagcaugggc

SEQ ID NO: 3974310 - RNA, 22 nt, Human herpesvirus 4 [Epstein-Barr virus]
cccgcuuuugcgaccccucuga

SEQ ID NO: 3974311 - RNA, 13 nt, Human herpesvirus 4 [Epstein-Barr virus]
cccggcggcugcu

SEQ ID NO: 3974312 - RNA, 23 nt, Human herpesvirus 4 [Epstein-Barr virus]
cccgggggaggagaagagaggcu

SEQ ID NO: 3974313 - RNA, 16 nt, Human herpesvirus 4 [Epstein-Barr virus]
cccggggguggcagcc

SEQ ID NO: 3974314 - RNA, 20 nt, Human herpesvirus 4 [Epstein-Barr virus]
cccgggugggcugguugggg

SEQ ID NO: 3974315 - RNA, 19 nt, Human herpesvirus 4 [Epstein-Barr virus]
cccgucccggguacaaguc

SEQ ID NO: 3974316 - RNA, 12 nt, Human herpesvirus 4 [Epstein-Barr virus]
cccgucgggcca

SEQ ID NO: 3974317 - RNA, 21 nt, Human herpesvirus 4 [Epstein-Barr virus]
cccuagagguuuugcuaggga

SEQ ID NO: 3974318 - RNA, 18 nt, Human herpesvirus 4 [Epstein-Barr virus]
cccuccauaggccucugc

SEQ ID NO: 3974319 - RNA, 20 nt, Human herpesvirus 4 [Epstein-Barr virus]
cccuccauuccacccacuga

SEQ ID NO: 3974320 - RNA, 15 nt, Human herpesvirus 4 [Epstein-Barr virus]
cccucgguggugggc

SEQ ID NO: 3974321 - RNA, 19 nt, Human herpesvirus 4 [Epstein-Barr virus]
cccucgguggugggcugcu

SEQ ID NO: 3974322 - RNA, 12 nt, Human herpesvirus 4 [Epstein-Barr virus]
cccucuccagca

SEQ ID NO: 3974323 - RNA, 21 nt, Human herpesvirus 4 [Epstein-Barr virus]
cccugcagaguaauugcagug

SEQ ID NO: 3974324 - RNA, 13 nt, Human herpesvirus 4 [Epstein-Barr virus]
cccuggccaccua

SEQ ID NO: 3974325 - RNA, 21 nt, Human herpesvirus 4 [Epstein-Barr virus]
ccgaaagcggcccagcagauc

SEQ ID NO: 3974326 - RNA, 11 nt, Human herpesvirus 4 [Epstein-Barr virus]
ccgaacauggg

SEQ ID NO: 3974327 - RNA, 20 nt, Human herpesvirus 4 [Epstein-Barr virus]
ccgacaucgccgccccaggg

SEQ ID NO: 3974328 - RNA, 19 nt, Human herpesvirus 4 [Epstein-Barr virus]
ccgacgccguccucgaagg

SEQ ID NO: 3974329 - RNA, 23 nt, Human herpesvirus 4 [Epstein-Barr virus]
ccgacuuauggcuagauuuccua

SEQ ID NO: 3974330 - RNA, 22 nt, Human herpesvirus 4 [Epstein-Barr virus]
ccgcaccagcuaacaggacaug

SEQ ID NO: 3974331 - RNA, 15 nt, Human herpesvirus 4 [Epstein-Barr virus]
ccgcaccagggccag

SEQ ID NO: 3974332 - RNA, 21 nt, Human herpesvirus 4 [Epstein-Barr virus]
ccgcagaagagccgcuccgug

SEQ ID NO: 3974333 - RNA, 19 nt, Human herpesvirus 4 [Epstein-Barr virus]
ccgcagccgcugaagccag

SEQ ID NO: 3974334 - RNA, 20 nt, Human herpesvirus 4 [Epstein-Barr virus]
ccgcagccgcugaagccagg

SEQ ID NO: 3974335 - RNA, 10 nt, Human herpesvirus 4 [Epstein-Barr virus]
ccgcagcugg

SEQ ID NO: 3974336 - RNA, 18 nt, Human herpesvirus 4 [Epstein-Barr virus]
ccgcccccaccaccccca

SEQ ID NO: 3974337 - RNA, 14 nt, Human herpesvirus 4 [Epstein-Barr virus]
ccgccgccagcagc

SEQ ID NO: 3974338 - RNA, 14 nt, Human herpesvirus 4 [Epstein-Barr virus]
ccgcgccgcaagca

SEQ ID NO: 3974339 - RNA, 16 nt, Human herpesvirus 4 [Epstein-Barr virus]
ccgcgcucggccuaga

SEQ ID NO: 3974340 - RNA, 12 nt, Human herpesvirus 4 [Epstein-Barr virus]
ccgcugggccag

SEQ ID NO: 3974341 - RNA, 14 nt, Human herpesvirus 4 [Epstein-Barr virus]
ccggacgcagaggc

SEQ ID NO: 3974342 - RNA, 16 nt, Human herpesvirus 4 [Epstein-Barr virus]
ccggagacugaggccu

SEQ ID NO: 3974343 - RNA, 21 nt, Human herpesvirus 4 [Epstein-Barr virus]
ccggagacugaggccuuuguc

SEQ ID NO: 3974344 - RNA, 21 nt, Human herpesvirus 4 [Epstein-Barr virus]
ccggaucgaaggagagcugga

SEQ ID NO: 3974345 - RNA, 14 nt, Human herpesvirus 4 [Epstein-Barr virus]
ccggccaggcagag

SEQ ID NO: 3974346 - RNA, 15 nt, Human herpesvirus 4 [Epstein-Barr virus]
ccggccgaggccugc

SEQ ID NO: 3974347 - RNA, 13 nt, Human herpesvirus 4 [Epstein-Barr virus]
ccgggagccacgg

SEQ ID NO: 3974348 - RNA, 12 nt, Human herpesvirus 4 [Epstein-Barr virus]
ccgggggcggga

SEQ ID NO: 3974349 - RNA, 15 nt, Human herpesvirus 4 [Epstein-Barr virus]
ccggguacaaguccc

SEQ ID NO: 3974350 - RNA, 19 nt, Human herpesvirus 4 [Epstein-Barr virus]
ccgguccccccagaagccc

SEQ ID NO: 3974351 - RNA, 19 nt, Human herpesvirus 4 [Epstein-Barr virus]
ccggugucggcaccuagcc

SEQ ID NO: 3974352 - RNA, 17 nt, Human herpesvirus 4 [Epstein-Barr virus]
ccgucaaggccucggag

SEQ ID NO: 3974353 - RNA, 17 nt, Human herpesvirus 4 [Epstein-Barr virus]
ccgugcauggcagcaga

SEQ ID NO: 3974354 - RNA, 16 nt, Human herpesvirus 4 [Epstein-Barr virus]
ccguggccaggcccga

SEQ ID NO: 3974355 - RNA, 13 nt, Human herpesvirus 4 [Epstein-Barr virus]
ccgugucuccuga

SEQ ID NO: 3974356 - RNA, 20 nt, Human herpesvirus 4 [Epstein-Barr virus]
ccguugguggucagcagcag

SEQ ID NO: 3974357 - RNA, 14 nt, Human herpesvirus 4 [Epstein-Barr virus]
ccuaagcagcugag

SEQ ID NO: 3974358 - RNA, 16 nt, Human herpesvirus 4 [Epstein-Barr virus]
ccuacgaggcccuggc

SEQ ID NO: 3974359 - RNA, 23 nt, Human herpesvirus 4 [Epstein-Barr virus]
ccuagaaacugugccauggugcc

SEQ ID NO: 3974360 - RNA, 20 nt, Human herpesvirus 4 [Epstein-Barr virus]
ccuagagguuuugcuaggga

SEQ ID NO: 3974361 - RNA, 18 nt, Human herpesvirus 4 [Epstein-Barr virus]
ccuagauauaccccuccu

SEQ ID NO: 3974362 - RNA, 18 nt, Human herpesvirus 4 [Epstein-Barr virus]
ccuauagauccugggccc

SEQ ID NO: 3974363 - RNA, 21 nt, Human herpesvirus 4 [Epstein-Barr virus]
ccuaucacgggggucaagcaa

SEQ ID NO: 3974364 - RNA, 18 nt, Human herpesvirus 4 [Epstein-Barr virus]
ccucauucccccaugaga

SEQ ID NO: 3974365 - RNA, 14 nt, Human herpesvirus 4 [Epstein-Barr virus]
ccucauuggcuuug

SEQ ID NO: 3974366 - RNA, 20 nt, Human herpesvirus 4 [Epstein-Barr virus]
ccuccaacaggugcccgagc

SEQ ID NO: 3974367 - RNA, 22 nt, Human herpesvirus 4 [Epstein-Barr virus]
ccuccaagcggcacagauuaga

SEQ ID NO: 3974368 - RNA, 23 nt, Human herpesvirus 4 [Epstein-Barr virus]
ccuccaaucaccagccaccuucc

SEQ ID NO: 3974369 - RNA, 17 nt, Human herpesvirus 4 [Epstein-Barr virus]
ccuccauuccacccacu

SEQ ID NO: 3974370 - RNA, 21 nt, Human herpesvirus 4 [Epstein-Barr virus]
ccuccgcauccuaggcacggc

SEQ ID NO: 3974371 - RNA, 21 nt, Human herpesvirus 4 [Epstein-Barr virus]
ccuccggccgccccgggcccg

SEQ ID NO: 3974372 - RNA, 15 nt, Human herpesvirus 4 [Epstein-Barr virus]
ccuccuacacacauc

SEQ ID NO: 3974373 - RNA, 13 nt, Human herpesvirus 4 [Epstein-Barr virus]
ccuccucaccacu

SEQ ID NO: 3974374 - RNA, 16 nt, Human herpesvirus 4 [Epstein-Barr virus]
ccuccuggccagcacc

SEQ ID NO: 3974375 - RNA, 17 nt, Human herpesvirus 4 [Epstein-Barr virus]
ccuccuggccagcaccc

SEQ ID NO: 3974376 - RNA, 18 nt, Human herpesvirus 4 [Epstein-Barr virus]
ccucgaguccggggagaa

SEQ ID NO: 3974377 - RNA, 20 nt, Human herpesvirus 4 [Epstein-Barr virus]
ccucguguuucacggccuca

SEQ ID NO: 3974378 - RNA, 19 nt, Human herpesvirus 4 [Epstein-Barr virus]
ccucugccacaaggccagc

SEQ ID NO: 3974379 - RNA, 19 nt, Human herpesvirus 4 [Epstein-Barr virus]
ccugaagcgaagcagcucc

SEQ ID NO: 3974380 - RNA, 21 nt, Human herpesvirus 4 [Epstein-Barr virus]
ccugaccgaauggggcagugg

SEQ ID NO: 3974381 - RNA, 15 nt, Human herpesvirus 4 [Epstein-Barr virus]
ccugaggggcggugg

SEQ ID NO: 3974382 - RNA, 22 nt, Human herpesvirus 4 [Epstein-Barr virus]
ccugaguccaacauuaaagccu

SEQ ID NO: 3974383 - RNA, 16 nt, Human herpesvirus 4 [Epstein-Barr virus]
ccuggcggcccagccc

SEQ ID NO: 3974384 - RNA, 12 nt, Human herpesvirus 4 [Epstein-Barr virus]
ccuggcucgccu

SEQ ID NO: 3974385 - RNA, 16 nt, Human herpesvirus 4 [Epstein-Barr virus]
ccuggcuuccacucac

SEQ ID NO: 3974386 - RNA, 16 nt, Human herpesvirus 4 [Epstein-Barr virus]
ccugggaggugcugag

SEQ ID NO: 3974387 - RNA, 23 nt, Human herpesvirus 4 [Epstein-Barr virus]
ccugguaugcagaaggggcccug

SEQ ID NO: 3974388 - RNA, 14 nt, Human herpesvirus 4 [Epstein-Barr virus]
ccuggugccagacu

SEQ ID NO: 3974389 - RNA, 17 nt, Human herpesvirus 4 [Epstein-Barr virus]
ccugucggcucucuuug

SEQ ID NO: 3974390 - RNA, 21 nt, Human herpesvirus 4 [Epstein-Barr virus]
ccugugcagggacgaggacga

SEQ ID NO: 3974391 - RNA, 24 nt, Human herpesvirus 4 [Epstein-Barr virus]
ccuguuccggccucgguggcagug

SEQ ID NO: 3974392 - RNA, 23 nt, Human herpesvirus 4 [Epstein-Barr virus]
ccuuaaauucaccuaagaauggg

SEQ ID NO: 3974393 - RNA, 14 nt, Human herpesvirus 4 [Epstein-Barr virus]
ccuucuccucagcc

SEQ ID NO: 3974394 - RNA, 16 nt, Human herpesvirus 4 [Epstein-Barr virus]
ccuucuccucagccuc

SEQ ID NO: 3974395 - RNA, 21 nt, Human herpesvirus 4 [Epstein-Barr virus]
ccuucucugauggccuggaga

SEQ ID NO: 3974396 - RNA, 13 nt, Human herpesvirus 4 [Epstein-Barr virus]
ccuucugcugcug

SEQ ID NO: 3974397 - RNA, 20 nt, Human herpesvirus 4 [Epstein-Barr virus]
ccuucugcugcugcugguca

SEQ ID NO: 3974398 - RNA, 14 nt, Human herpesvirus 4 [Epstein-Barr virus]
ccuucuuccuagcc

SEQ ID NO: 3974399 - RNA, 18 nt, Human herpesvirus 4 [Epstein-Barr virus]
ccuugcccucuccagcaa

SEQ ID NO: 3974400 - RNA, 20 nt, Human herpesvirus 4 [Epstein-Barr virus]
ccuugcccucuccagcaacc

SEQ ID NO: 3974401 - RNA, 18 nt, Human herpesvirus 4 [Epstein-Barr virus]
ccuugcguggugcugucc

SEQ ID NO: 3974402 - RNA, 17 nt, Human herpesvirus 4 [Epstein-Barr virus]
ccuugcucgcagcugga

SEQ ID NO: 3974403 - RNA, 14 nt, Human herpesvirus 4 [Epstein-Barr virus]
ccuuggcaugacgu

SEQ ID NO: 3974404 - RNA, 16 nt, Human herpesvirus 4 [Epstein-Barr virus]
ccuugggggccuggac

SEQ ID NO: 3974405 - RNA, 15 nt, Human herpesvirus 4 [Epstein-Barr virus]
ccuuuacccagcccu

SEQ ID NO: 3974406 - RNA, 22 nt, Human herpesvirus 4 [Epstein-Barr virus]
ccuuucccccacccuggaacaa

SEQ ID NO: 3974407 - RNA, 16 nt, Human herpesvirus 4 [Epstein-Barr virus]
ccuuuccuaagaccua

SEQ ID NO: 3974408 - RNA, 11 nt, Human herpesvirus 4 [Epstein-Barr virus]
ccuuuugcaac

SEQ ID NO: 3974409 - RNA, 16 nt, Human herpesvirus 4 [Epstein-Barr virus]
cgaaaguaggcggugg

SEQ ID NO: 3974410 - RNA, 15 nt, Human herpesvirus 4 [Epstein-Barr virus]
cgaagcggucucaga

SEQ ID NO: 3974411 - RNA, 16 nt, Human herpesvirus 4 [Epstein-Barr virus]
cgaaucugacauuucu

SEQ ID NO: 3974412 - RNA, 20 nt, Human herpesvirus 4 [Epstein-Barr virus]
cgaaucugacauuucucaua

SEQ ID NO: 3974413 - RNA, 14 nt, Human herpesvirus 4 [Epstein-Barr virus]
cgacggccucggcg

SEQ ID NO: 3974414 - RNA, 13 nt, Human herpesvirus 4 [Epstein-Barr virus]
cgacuccaggccc

SEQ ID NO: 3974415 - RNA, 19 nt, Human herpesvirus 4 [Epstein-Barr virus]
cgacuuuguuuagggacag

SEQ ID NO: 3974416 - RNA, 12 nt, Human herpesvirus 4 [Epstein-Barr virus]
cgagaaggagga

SEQ ID NO: 3974417 - RNA, 21 nt, Human herpesvirus 4 [Epstein-Barr virus]
cgagaggaugaggcugaugau

SEQ ID NO: 3974418 - RNA, 22 nt, Human herpesvirus 4 [Epstein-Barr virus]
cgagaggaugauccuguacaaa

SEQ ID NO: 3974419 - RNA, 13 nt, Human herpesvirus 4 [Epstein-Barr virus]
cgagauggcccag

SEQ ID NO: 3974420 - RNA, 16 nt, Human herpesvirus 4 [Epstein-Barr virus]
cgagcagaaggccaug

SEQ ID NO: 3974421 - RNA, 17 nt, Human herpesvirus 4 [Epstein-Barr virus]
cgagcagaaggccaugg

SEQ ID NO: 3974422 - RNA, 20 nt, Human herpesvirus 4 [Epstein-Barr virus]
cgagcagaaggccauggaga

SEQ ID NO: 3974423 - RNA, 17 nt, Human herpesvirus 4 [Epstein-Barr virus]
cgagcuccgugggccca

SEQ ID NO: 3974424 - RNA, 17 nt, Human herpesvirus 4 [Epstein-Barr virus]
cgaggcccugcaagcca

SEQ ID NO: 3974425 - RNA, 21 nt, Human herpesvirus 4 [Epstein-Barr virus]
cgaggcugagaacugacgcuc

SEQ ID NO: 3974426 - RNA, 19 nt, Human herpesvirus 4 [Epstein-Barr virus]
cgaggcugagggggcgguc

SEQ ID NO: 3974427 - RNA, 16 nt, Human herpesvirus 4 [Epstein-Barr virus]
cgaggucuccccugac

SEQ ID NO: 3974428 - RNA, 13 nt, Human herpesvirus 4 [Epstein-Barr virus]
cgaguccaagcug

SEQ ID NO: 3974429 - RNA, 14 nt, Human herpesvirus 4 [Epstein-Barr virus]
cgauaccgggucag

SEQ ID NO: 3974430 - RNA, 13 nt, Human herpesvirus 4 [Epstein-Barr virus]
cgauagcccaggc

SEQ ID NO: 3974431 - RNA, 19 nt, Human herpesvirus 4 [Epstein-Barr virus]
cgaucuggacccuauggag

SEQ ID NO: 3974432 - RNA, 21 nt, Human herpesvirus 4 [Epstein-Barr virus]
cgauggucgucaucuggcucu

SEQ ID NO: 3974433 - RNA, 17 nt, Human herpesvirus 4 [Epstein-Barr virus]
cgauguacccccgggga

SEQ ID NO: 3974434 - RNA, 17 nt, Human herpesvirus 4 [Epstein-Barr virus]
cgcaacgccggccugcu

SEQ ID NO: 3974435 - RNA, 19 nt, Human herpesvirus 4 [Epstein-Barr virus]
cgcagaccccagagcagcc

SEQ ID NO: 3974436 - RNA, 13 nt, Human herpesvirus 4 [Epstein-Barr virus]
cgcagaggccauc

SEQ ID NO: 3974437 - RNA, 18 nt, Human herpesvirus 4 [Epstein-Barr virus]
cgcagcccagcccuccgc

SEQ ID NO: 3974438 - RNA, 23 nt, Human herpesvirus 4 [Epstein-Barr virus]
cgcaggccccccgcaccagggcc

SEQ ID NO: 3974439 - RNA, 18 nt, Human herpesvirus 4 [Epstein-Barr virus]
cgcagguggcugcugcca

SEQ ID NO: 3974440 - RNA, 13 nt, Human herpesvirus 4 [Epstein-Barr virus]
cgcauccuaggca

SEQ ID NO: 3974441 - RNA, 18 nt, Human herpesvirus 4 [Epstein-Barr virus]
cgccaccacggugcagcc

SEQ ID NO: 3974442 - RNA, 21 nt, Human herpesvirus 4 [Epstein-Barr virus]
cgccacccucccccugccccg

SEQ ID NO: 3974443 - RNA, 16 nt, Human herpesvirus 4 [Epstein-Barr virus]
cgccagcagccccgac

SEQ ID NO: 3974444 - RNA, 13 nt, Human herpesvirus 4 [Epstein-Barr virus]
cgccagcgccucc

SEQ ID NO: 3974445 - RNA, 23 nt, Human herpesvirus 4 [Epstein-Barr virus]
cgccagggcguacaccuggcugu

SEQ ID NO: 3974446 - RNA, 20 nt, Human herpesvirus 4 [Epstein-Barr virus]
cgcccagggacauccccaga

SEQ ID NO: 3974447 - RNA, 12 nt, Human herpesvirus 4 [Epstein-Barr virus]
cgcccccucugc

SEQ ID NO: 3974448 - RNA, 22 nt, Human herpesvirus 4 [Epstein-Barr virus]
cgccccugcguugaacccaccc

SEQ ID NO: 3974449 - RNA, 19 nt, Human herpesvirus 4 [Epstein-Barr virus]
cgcccucacgggccaucuc

SEQ ID NO: 3974450 - RNA, 14 nt, Human herpesvirus 4 [Epstein-Barr virus]
cgcccuccucuggg

SEQ ID NO: 3974451 - RNA, 14 nt, Human herpesvirus 4 [Epstein-Barr virus]
cgcccugagcugga

SEQ ID NO: 3974452 - RNA, 12 nt, Human herpesvirus 4 [Epstein-Barr virus]
cgcccugucacc

SEQ ID NO: 3974453 - RNA, 21 nt, Human herpesvirus 4 [Epstein-Barr virus]
cgcccugucccuggagcuggu

SEQ ID NO: 3974454 - RNA, 13 nt, Human herpesvirus 4 [Epstein-Barr virus]
cgccgccagcagc

SEQ ID NO: 3974455 - RNA, 14 nt, Human herpesvirus 4 [Epstein-Barr virus]
cgccgccagcaugg

SEQ ID NO: 3974456 - RNA, 18 nt, Human herpesvirus 4 [Epstein-Barr virus]
cgccgccagcauggcagc

SEQ ID NO: 3974457 - RNA, 14 nt, Human herpesvirus 4 [Epstein-Barr virus]
cgccgccgccagca

SEQ ID NO: 3974458 - RNA, 15 nt, Human herpesvirus 4 [Epstein-Barr virus]
cgccucauccuggcc

SEQ ID NO: 3974459 - RNA, 13 nt, Human herpesvirus 4 [Epstein-Barr virus]
cgccugagcugcc

SEQ ID NO: 3974460 - RNA, 17 nt, Human herpesvirus 4 [Epstein-Barr virus]
cgccuuaugaggaccca

SEQ ID NO: 3974461 - RNA, 22 nt, Human herpesvirus 4 [Epstein-Barr virus]
cgcgccgcaagcaugggcgagg

SEQ ID NO: 3974462 - RNA, 21 nt, Human herpesvirus 4 [Epstein-Barr virus]
cgcggugguggcccucggugg

SEQ ID NO: 3974463 - RNA, 13 nt, Human herpesvirus 4 [Epstein-Barr virus]
cgcucagagcugg

SEQ ID NO: 3974464 - RNA, 14 nt, Human herpesvirus 4 [Epstein-Barr virus]
cgcucccgggcaaa

SEQ ID NO: 3974465 - RNA, 20 nt, Human herpesvirus 4 [Epstein-Barr virus]
cgcuccgcgcucggccuaga

SEQ ID NO: 3974466 - RNA, 15 nt, Human herpesvirus 4 [Epstein-Barr virus]
cgcuccguccuuguc

SEQ ID NO: 3974467 - RNA, 14 nt, Human herpesvirus 4 [Epstein-Barr virus]
cgcugaagccaggc

SEQ ID NO: 3974468 - RNA, 18 nt, Human herpesvirus 4 [Epstein-Barr virus]
cggacaugucacgugucc

SEQ ID NO: 3974469 - RNA, 11 nt, Human herpesvirus 4 [Epstein-Barr virus]
cggagaggcgg

SEQ ID NO: 3974470 - RNA, 20 nt, Human herpesvirus 4 [Epstein-Barr virus]
cggagaucaucccacuggga

SEQ ID NO: 3974471 - RNA, 17 nt, Human herpesvirus 4 [Epstein-Barr virus]
caucagccgcugcgcaa

SEQ ID NO: 3974472 - RNA, 21 nt, Human herpesvirus 4 [Epstein-Barr virus]
caucaggcgaaggcggagaag

SEQ ID NO: 3974473 - RNA, 16 nt, Human herpesvirus 4 [Epstein-Barr virus]
caucauuagcccagcc

SEQ ID NO: 3974474 - RNA, 14 nt, Human herpesvirus 4 [Epstein-Barr virus]
cagggacuggcggc

SEQ ID NO: 3974475 - RNA, 15 nt, Human herpesvirus 4 [Epstein-Barr virus]
cagggcaaagccaca

SEQ ID NO: 3974476 - RNA, 15 nt, Human herpesvirus 4 [Epstein-Barr virus]
cagggguguaguggg

SEQ ID NO: 3974477 - RNA, 20 nt, Human herpesvirus 4 [Epstein-Barr virus]
cagggugaccuggcucaggu

SEQ ID NO: 3974478 - RNA, 23 nt, Human herpesvirus 4 [Epstein-Barr virus]
cagggugcacagacuagcgagga

SEQ ID NO: 3974479 - RNA, 22 nt, Human herpesvirus 4 [Epstein-Barr virus]
caggguggcuacuugcucaggu

SEQ ID NO: 3974480 - RNA, 14 nt, Human herpesvirus 4 [Epstein-Barr virus]
caggucuugccgug

SEQ ID NO: 3974481 - RNA, 23 nt, Human herpesvirus 4 [Epstein-Barr virus]
caggugcccgagccccgccuggc

SEQ ID NO: 3974482 - RNA, 16 nt, Human herpesvirus 4 [Epstein-Barr virus]
cagguggcugcugcca

SEQ ID NO: 3974483 - RNA, 14 nt, Human herpesvirus 4 [Epstein-Barr virus]
cagguuugacuuca

SEQ ID NO: 3974484 - RNA, 11 nt, Human herpesvirus 4 [Epstein-Barr virus]
caguauuuugc

SEQ ID NO: 3974485 - RNA, 15 nt, Human herpesvirus 4 [Epstein-Barr virus]
caguccgccaugacc

SEQ ID NO: 3974486 - RNA, 19 nt, Human herpesvirus 4 [Epstein-Barr virus]
caguggaccucaaagaaga

SEQ ID NO: 3974487 - RNA, 20 nt, Human herpesvirus 4 [Epstein-Barr virus]
cagugggcuucgggggccug

SEQ ID NO: 3974488 - RNA, 15 nt, Human herpesvirus 4 [Epstein-Barr virus]
caguguggcccgauc

SEQ ID NO: 3974489 - RNA, 23 nt, Human herpesvirus 4 [Epstein-Barr virus]
caguugacggacgugcccagcuc

SEQ ID NO: 3974490 - RNA, 14 nt, Human herpesvirus 4 [Epstein-Barr virus]
cauaacccagaauc

SEQ ID NO: 3974491 - RNA, 15 nt, Human herpesvirus 4 [Epstein-Barr virus]
cauaauggugccuga

SEQ ID NO: 3974492 - RNA, 22 nt, Human herpesvirus 4 [Epstein-Barr virus]
cauagagaugguguccggagac

SEQ ID NO: 3974493 - RNA, 14 nt, Human herpesvirus 4 [Epstein-Barr virus]
cauccccagagggc

SEQ ID NO: 3974494 - RNA, 23 nt, Human herpesvirus 4 [Epstein-Barr virus]
cauccugaagcgaagcagcuccg

SEQ ID NO: 3974495 - RNA, 13 nt, Human herpesvirus 4 [Epstein-Barr virus]
caucgcaagcucc

SEQ ID NO: 3974496 - RNA, 19 nt, Human herpesvirus 4 [Epstein-Barr virus]
caucucaagggaggagugc

SEQ ID NO: 3974497 - RNA, 12 nt, Human herpesvirus 4 [Epstein-Barr virus]
caucucagggac

SEQ ID NO: 3974498 - RNA, 15 nt, Human herpesvirus 4 [Epstein-Barr virus]
caucucauccccaga

SEQ ID NO: 3974499 - RNA, 23 nt, Human herpesvirus 4 [Epstein-Barr virus]
caucugcuucuggcucuucuggg

SEQ ID NO: 3974500 - RNA, 13 nt, Human herpesvirus 4 [Epstein-Barr virus]
caucuuccaggug

SEQ ID NO: 3974501 - RNA, 12 nt, Human herpesvirus 4 [Epstein-Barr virus]
caucuuccuccu

SEQ ID NO: 3974502 - RNA, 15 nt, Human herpesvirus 4 [Epstein-Barr virus]
caugacgcugcugcu

SEQ ID NO: 3974503 - RNA, 15 nt, Human herpesvirus 4 [Epstein-Barr virus]
caugagcauggaaga

SEQ ID NO: 3974504 - RNA, 20 nt, Human herpesvirus 4 [Epstein-Barr virus]
caugaggagguaauuagcac

SEQ ID NO: 3974505 - RNA, 14 nt, Human herpesvirus 4 [Epstein-Barr virus]
caugagggcaccga

SEQ ID NO: 3974506 - RNA, 22 nt, Human herpesvirus 4 [Epstein-Barr virus]
caugcacaccuuggcgggucau

SEQ ID NO: 3974507 - RNA, 17 nt, Human herpesvirus 4 [Epstein-Barr virus]
caugcuguaccugauga

SEQ ID NO: 3974508 - RNA, 21 nt, Human herpesvirus 4 [Epstein-Barr virus]
cauggguaaugauucaucaga

SEQ ID NO: 3974509 - RNA, 19 nt, Human herpesvirus 4 [Epstein-Barr virus]
cauggugucuguaaucucu

SEQ ID NO: 3974510 - RNA, 18 nt, Human herpesvirus 4 [Epstein-Barr virus]
cauguguacuuguccuca

SEQ ID NO: 3974511 - RNA, 21 nt, Human herpesvirus 4 [Epstein-Barr virus]
cauguugucacgucacucagc

SEQ ID NO: 3974512 - RNA, 19 nt, Human herpesvirus 4 [Epstein-Barr virus]
cauucgacaggccauuaga

SEQ ID NO: 3974513 - RNA, 17 nt, Human herpesvirus 4 [Epstein-Barr virus]
cauugcuaauguaccuc

SEQ ID NO: 3974514 - RNA, 12 nt, Human herpesvirus 4 [Epstein-Barr virus]
cauuggcagcag

SEQ ID NO: 3974515 - RNA, 15 nt, Human herpesvirus 4 [Epstein-Barr virus]
cauuggcagcagcuc

SEQ ID NO: 3974516 - RNA, 18 nt, Human herpesvirus 4 [Epstein-Barr virus]
cauugguguuccacagcc

SEQ ID NO: 3974517 - RNA, 15 nt, Human herpesvirus 4 [Epstein-Barr virus]
cauuugaggaggcac

SEQ ID NO: 3974518 - RNA, 17 nt, Human herpesvirus 4 [Epstein-Barr virus]
ccaaacuuuguccagau

SEQ ID NO: 3974519 - RNA, 12 nt, Human herpesvirus 4 [Epstein-Barr virus]
ccaagagcugcc

SEQ ID NO: 3974520 - RNA, 16 nt, Human herpesvirus 4 [Epstein-Barr virus]
ccaagccgggggagaa

SEQ ID NO: 3974521 - RNA, 17 nt, Human herpesvirus 4 [Epstein-Barr virus]
ccaaucaccagccaccu

SEQ ID NO: 3974522 - RNA, 18 nt, Human herpesvirus 4 [Epstein-Barr virus]
ccaauucacaucucaggg

SEQ ID NO: 3974523 - RNA, 21 nt, Human herpesvirus 4 [Epstein-Barr virus]
ccacgggaugacucaucucaa

SEQ ID NO: 3974524 - RNA, 13 nt, Human herpesvirus 4 [Epstein-Barr virus]
ccacuacaccccu

SEQ ID NO: 3974525 - RNA, 21 nt, Human herpesvirus 4 [Epstein-Barr virus]
ccacuccaccugccggaggga

SEQ ID NO: 3974526 - RNA, 23 nt, Human herpesvirus 4 [Epstein-Barr virus]
ccacugagcaagauccuucuggc

SEQ ID NO: 3974527 - RNA, 22 nt, Human herpesvirus 4 [Epstein-Barr virus]
ccagaaagauacccagagcaaa

SEQ ID NO: 3974528 - RNA, 21 nt, Human herpesvirus 4 [Epstein-Barr virus]
ccagacacgucguucaugaga

SEQ ID NO: 3974529 - RNA, 23 nt, Human herpesvirus 4 [Epstein-Barr virus]
ccagacuccggggguccagccgg

SEQ ID NO: 3974530 - RNA, 15 nt, Human herpesvirus 4 [Epstein-Barr virus]
ccagagcaaaagcaa

SEQ ID NO: 3974531 - RNA, 13 nt, Human herpesvirus 4 [Epstein-Barr virus]
ccagagcccagag

SEQ ID NO: 3974532 - RNA, 15 nt, Human herpesvirus 4 [Epstein-Barr virus]
ccagagcccagagga

SEQ ID NO: 3974533 - RNA, 12 nt, Human herpesvirus 4 [Epstein-Barr virus]
ccagagcugagu

SEQ ID NO: 3974534 - RNA, 18 nt, Human herpesvirus 4 [Epstein-Barr virus]
ccagcagauccagggccc

SEQ ID NO: 3974535 - RNA, 19 nt, Human herpesvirus 4 [Epstein-Barr virus]
ccagcagauccagggcccg

SEQ ID NO: 3974536 - RNA, 20 nt, Human herpesvirus 4 [Epstein-Barr virus]
ccagcagauccagggcccgu

SEQ ID NO: 3974537 - RNA, 18 nt, Human herpesvirus 4 [Epstein-Barr virus]
ccagccagcgacugaucc

SEQ ID NO: 3974538 - RNA, 21 nt, Human herpesvirus 4 [Epstein-Barr virus]
ccagcccccucccgccccugu

SEQ ID NO: 3974539 - RNA, 15 nt, Human herpesvirus 4 [Epstein-Barr virus]
ccagcccuccucaga

SEQ ID NO: 3974540 - RNA, 17 nt, Human herpesvirus 4 [Epstein-Barr virus]
ccagcccuuaacacacc

SEQ ID NO: 3974541 - RNA, 22 nt, Human herpesvirus 4 [Epstein-Barr virus]
ccagccgggugcacacgcucag

SEQ ID NO: 3974542 - RNA, 17 nt, Human herpesvirus 4 [Epstein-Barr virus]
ccagccuacucuccacu

SEQ ID NO: 3974543 - RNA, 15 nt, Human herpesvirus 4 [Epstein-Barr virus]
ccagcggggagaggg

SEQ ID NO: 3974544 - RNA, 16 nt, Human herpesvirus 4 [Epstein-Barr virus]
ccagcggggagagggu

SEQ ID NO: 3974545 - RNA, 23 nt, Human herpesvirus 4 [Epstein-Barr virus]
ccaggaccuggaugcuguagugg

SEQ ID NO: 3974546 - RNA, 15 nt, Human herpesvirus 4 [Epstein-Barr virus]
ccaggagucugcugc

SEQ ID NO: 3974547 - RNA, 17 nt, Human herpesvirus 4 [Epstein-Barr virus]
ccaggccucagcgucag

SEQ ID NO: 3974548 - RNA, 22 nt, Human herpesvirus 4 [Epstein-Barr virus]
ccagggacagggcgcugcaugc

SEQ ID NO: 3974549 - RNA, 15 nt, Human herpesvirus 4 [Epstein-Barr virus]
ccagggguggcagug

SEQ ID NO: 3974550 - RNA, 22 nt, Human herpesvirus 4 [Epstein-Barr virus]
ccagggguggcaguggaugggg

SEQ ID NO: 3974551 - RNA, 16 nt, Human herpesvirus 4 [Epstein-Barr virus]
ccaggucuugccgugg

SEQ ID NO: 3974552 - RNA, 19 nt, Human herpesvirus 4 [Epstein-Barr virus]
ccagucaccuuccagacua

SEQ ID NO: 3974553 - RNA, 18 nt, Human herpesvirus 4 [Epstein-Barr virus]
ccagucuccgggucaggu

SEQ ID NO: 3974554 - RNA, 14 nt, Human herpesvirus 4 [Epstein-Barr virus]
ccauaccaggugcc

SEQ ID NO: 3974555 - RNA, 20 nt, Human herpesvirus 4 [Epstein-Barr virus]
ccaucaacuucagcuccagg

SEQ ID NO: 3974556 - RNA, 15 nt, Human herpesvirus 4 [Epstein-Barr virus]
ccaucagcucgccca

SEQ ID NO: 3974557 - RNA, 23 nt, Human herpesvirus 4 [Epstein-Barr virus]
ccaucaugcugaauauugccagc

SEQ ID NO: 3974558 - RNA, 13 nt, Human herpesvirus 4 [Epstein-Barr virus]
ccaucauguguuu

SEQ ID NO: 3974559 - RNA, 12 nt, Human herpesvirus 4 [Epstein-Barr virus]
ccaucugcuucu

SEQ ID NO: 3974560 - RNA, 13 nt, Human herpesvirus 4 [Epstein-Barr virus]
ccaugaccagcag

SEQ ID NO: 3974561 - RNA, 14 nt, Human herpesvirus 4 [Epstein-Barr virus]
ccauuccacccacu

SEQ ID NO: 3974562 - RNA, 21 nt, Human herpesvirus 4 [Epstein-Barr virus]
cccaccagaucgccugccacu

SEQ ID NO: 3974563 - RNA, 13 nt, Human herpesvirus 4 [Epstein-Barr virus]
cccacccuggaac

SEQ ID NO: 3974564 - RNA, 21 nt, Human herpesvirus 4 [Epstein-Barr virus]
cccaccuaugccaauccaugc

SEQ ID NO: 3974565 - RNA, 22 nt, Human herpesvirus 4 [Epstein-Barr virus]
cccacgguggaacaggagcagg

SEQ ID NO: 3974566 - RNA, 18 nt, Human herpesvirus 4 [Epstein-Barr virus]
cccagcagauccagggcc

SEQ ID NO: 3974567 - RNA, 15 nt, Human herpesvirus 4 [Epstein-Barr virus]
cccagccccuccucu

SEQ ID NO: 3974568 - RNA, 16 nt, Human herpesvirus 4 [Epstein-Barr virus]
cccagcccgccagcca

SEQ ID NO: 3974569 - RNA, 13 nt, Human herpesvirus 4 [Epstein-Barr virus]
cccaggcagccuu

SEQ ID NO: 3974570 - RNA, 18 nt, Human herpesvirus 4 [Epstein-Barr virus]
cccagguaccuuccugug

SEQ ID NO: 3974571 - RNA, 12 nt, Human herpesvirus 4 [Epstein-Barr virus]
ccugauuuuccu

SEQ ID NO: 3974572 - RNA, 12 nt, Human herpesvirus 4 [Epstein-Barr virus]
ccugcaaacuga

SEQ ID NO: 3974573 - RNA, 14 nt, Human herpesvirus 4 [Epstein-Barr virus]
ccugcccucccacu

SEQ ID NO: 3974574 - RNA, 23 nt, Human herpesvirus 4 [Epstein-Barr virus]
ccugcccuccuccacccagcagc

SEQ ID NO: 3974575 - RNA, 14 nt, Human herpesvirus 4 [Epstein-Barr virus]
ccugccucugcucu

SEQ ID NO: 3974576 - RNA, 12 nt, Human herpesvirus 4 [Epstein-Barr virus]
ccugccuggauc

SEQ ID NO: 3974577 - RNA, 14 nt, Human herpesvirus 4 [Epstein-Barr virus]
ccugccuggaucug

SEQ ID NO: 3974578 - RNA, 23 nt, Human herpesvirus 4 [Epstein-Barr virus]
ccugcggcccacugaaaaaccag

SEQ ID NO: 3974579 - RNA, 16 nt, Human herpesvirus 4 [Epstein-Barr virus]
ccugcguugaacccac

SEQ ID NO: 3974580 - RNA, 20 nt, Human herpesvirus 4 [Epstein-Barr virus]
ccuggccagggcggaggaga

SEQ ID NO: 3974581 - RNA, 14 nt, Human herpesvirus 4 [Epstein-Barr virus]
ccuggccggccgcc

SEQ ID NO: 3974582 - RNA, 17 nt, Human herpesvirus 4 [Epstein-Barr virus]
accaagggcagggcaau

SEQ ID NO: 3974583 - RNA, 15 nt, Human herpesvirus 4 [Epstein-Barr virus]
accaaugccaaagcu

SEQ ID NO: 3974584 - RNA, 14 nt, Human herpesvirus 4 [Epstein-Barr virus]
accacgcucuguuu

SEQ ID NO: 3974585 - RNA, 20 nt, Human herpesvirus 4 [Epstein-Barr virus]
accacucaggaagcuggcca

SEQ ID NO: 3974586 - RNA, 21 nt, Human herpesvirus 4 [Epstein-Barr virus]
accagagggugagcccaccug

SEQ ID NO: 3974587 - RNA, 19 nt, Human herpesvirus 4 [Epstein-Barr virus]
accagcccuuuuuccagug

SEQ ID NO: 3974588 - RNA, 11 nt, Human herpesvirus 4 [Epstein-Barr virus]
accagcuccag

SEQ ID NO: 3974589 - RNA, 17 nt, Human herpesvirus 4 [Epstein-Barr virus]
acccagggguggcagug

SEQ ID NO: 3974590 - RNA, 20 nt, Human herpesvirus 4 [Epstein-Barr virus]
acccaucccggcccucuucc

SEQ ID NO: 3974591 - RNA, 22 nt, Human herpesvirus 4 [Epstein-Barr virus]
guacgugcgugaucaugagggc

SEQ ID NO: 3974592 - RNA, 11 nt, Human herpesvirus 4 [Epstein-Barr virus]
guagacagauc

SEQ ID NO: 3974593 - RNA, 14 nt, Human herpesvirus 4 [Epstein-Barr virus]
guagacgaggcaca

SEQ ID NO: 3974594 - RNA, 17 nt, Human herpesvirus 4 [Epstein-Barr virus]
guagccccuaggccugc

SEQ ID NO: 3974595 - RNA, 13 nt, Human herpesvirus 4 [Epstein-Barr virus]
guagccuuggggg

SEQ ID NO: 3974596 - RNA, 22 nt, Human herpesvirus 4 [Epstein-Barr virus]
guauccaccuagaaagagccau

SEQ ID NO: 3974597 - RNA, 21 nt, Human herpesvirus 4 [Epstein-Barr virus]
guaucccaaauaaauguuacu

SEQ ID NO: 3974598 - RNA, 22 nt, Human herpesvirus 4 [Epstein-Barr virus]
gucaaacaggugagucagccuu

SEQ ID NO: 3974599 - RNA, 20 nt, Human herpesvirus 4 [Epstein-Barr virus]
gucaaacauggugucuguaa

SEQ ID NO: 3974600 - RNA, 19 nt, Human herpesvirus 4 [Epstein-Barr virus]
gucaagagcuuccuggccg

SEQ ID NO: 3974601 - RNA, 17 nt, Human herpesvirus 4 [Epstein-Barr virus]
gucaaguaccagcuggu

SEQ ID NO: 3974602 - RNA, 19 nt, Human herpesvirus 4 [Epstein-Barr virus]
gucaauaauuucagugaaa

SEQ ID NO: 3974603 - RNA, 12 nt, Human herpesvirus 4 [Epstein-Barr virus]
gucacagcugcu

SEQ ID NO: 3974604 - RNA, 14 nt, Human herpesvirus 4 [Epstein-Barr virus]
gucacagcugcugg

SEQ ID NO: 3974605 - RNA, 15 nt, Human herpesvirus 4 [Epstein-Barr virus]
gucaccaggccugcc

SEQ ID NO: 3974606 - RNA, 22 nt, Human herpesvirus 4 [Epstein-Barr virus]
gucacccaugccuccccagcaa

SEQ ID NO: 3974607 - RNA, 16 nt, Human herpesvirus 4 [Epstein-Barr virus]
gucacucagcuccgcg

SEQ ID NO: 3974608 - RNA, 14 nt, Human herpesvirus 4 [Epstein-Barr virus]
gucagaccugaaga

SEQ ID NO: 3974609 - RNA, 15 nt, Human herpesvirus 4 [Epstein-Barr virus]
gucagcaaaccagcu

SEQ ID NO: 3974610 - RNA, 19 nt, Human herpesvirus 4 [Epstein-Barr virus]
guccaagagaaugacagca

SEQ ID NO: 3974611 - RNA, 15 nt, Human herpesvirus 4 [Epstein-Barr virus]
guccaggggccacac

SEQ ID NO: 3974612 - RNA, 20 nt, Human herpesvirus 4 [Epstein-Barr virus]
guccaguuuuuaugugccuc

SEQ ID NO: 3974613 - RNA, 19 nt, Human herpesvirus 4 [Epstein-Barr virus]
gucccagggccggaaccug

SEQ ID NO: 3974614 - RNA, 17 nt, Human herpesvirus 4 [Epstein-Barr virus]
gucccauguacagcaca

SEQ ID NO: 3974615 - RNA, 19 nt, Human herpesvirus 4 [Epstein-Barr virus]
guccccgagggugaggccc

SEQ ID NO: 3974616 - RNA, 20 nt, Human herpesvirus 4 [Epstein-Barr virus]
gucccgccucuccguacccc

SEQ ID NO: 3974617 - RNA, 15 nt, Human herpesvirus 4 [Epstein-Barr virus]
gucccuuuggaggac

SEQ ID NO: 3974618 - RNA, 14 nt, Human herpesvirus 4 [Epstein-Barr virus]
guccgugagagccu

SEQ ID NO: 3974619 - RNA, 15 nt, Human herpesvirus 4 [Epstein-Barr virus]
guccuuugggaacac

SEQ ID NO: 3974620 - RNA, 17 nt, Human herpesvirus 4 [Epstein-Barr virus]
gucgugguuuucugccc

SEQ ID NO: 3974621 - RNA, 13 nt, Human herpesvirus 4 [Epstein-Barr virus]
gucguuugauucu

SEQ ID NO: 3974622 - RNA, 18 nt, Human herpesvirus 4 [Epstein-Barr virus]
gucuacaucccauaccua

SEQ ID NO: 3974623 - RNA, 17 nt, Human herpesvirus 4 [Epstein-Barr virus]
gucuaccucuguuccuu

SEQ ID NO: 3974624 - RNA, 16 nt, Human herpesvirus 4 [Epstein-Barr virus]
gucuauccaggaggag

SEQ ID NO: 3974625 - RNA, 17 nt, Human herpesvirus 4 [Epstein-Barr virus]
gucuccuuguugaccuc

SEQ ID NO: 3974626 - RNA, 21 nt, Human herpesvirus 4 [Epstein-Barr virus]
gucucggccuacgaggcccug

SEQ ID NO: 3974627 - RNA, 17 nt, Human herpesvirus 4 [Epstein-Barr virus]
gucuggcagggggccgg

SEQ ID NO: 3974628 - RNA, 15 nt, Human herpesvirus 4 [Epstein-Barr virus]
gucuuugccaaccug

SEQ ID NO: 3974629 - RNA, 16 nt, Human herpesvirus 4 [Epstein-Barr virus]
gucuuugccaaccugc

SEQ ID NO: 3974630 - RNA, 17 nt, Human herpesvirus 4 [Epstein-Barr virus]
gugaauugugcccacca

SEQ ID NO: 3974631 - RNA, 21 nt, Human herpesvirus 4 [Epstein-Barr virus]
gugacaugcuauggugccggg

SEQ ID NO: 3974632 - RNA, 17 nt, Human herpesvirus 4 [Epstein-Barr virus]
gugaggagcgcccaccg

SEQ ID NO: 3974633 - RNA, 23 nt, Human herpesvirus 4 [Epstein-Barr virus]
ggccggaaccugagccugagcca

SEQ ID NO: 3974634 - RNA, 14 nt, Human herpesvirus 4 [Epstein-Barr virus]
ggccguccucugga

SEQ ID NO: 3974635 - RNA, 15 nt, Human herpesvirus 4 [Epstein-Barr virus]
ggccguccucuggac

SEQ ID NO: 3974636 - RNA, 15 nt, Human herpesvirus 4 [Epstein-Barr virus]
ggccuccagcucggc

SEQ ID NO: 3974637 - RNA, 13 nt, Human herpesvirus 4 [Epstein-Barr virus]
ggccuccuggcca

SEQ ID NO: 3974638 - RNA, 19 nt, Human herpesvirus 4 [Epstein-Barr virus]
ggccugcuggccgagcugg

SEQ ID NO: 3974639 - RNA, 20 nt, Human herpesvirus 4 [Epstein-Barr virus]
ggccugggaggugcugaggc

SEQ ID NO: 3974640 - RNA, 18 nt, Human herpesvirus 4 [Epstein-Barr virus]
ggccugugacuggugcuu

SEQ ID NO: 3974641 - RNA, 19 nt, Human herpesvirus 4 [Epstein-Barr virus]
ggccuugguuucagccuca

SEQ ID NO: 3974642 - RNA, 19 nt, Human herpesvirus 4 [Epstein-Barr virus]
ggccuuguccgcugggcca

SEQ ID NO: 3974643 - RNA, 14 nt, Human herpesvirus 4 [Epstein-Barr virus]
ggcgacgcggagag

SEQ ID NO: 3974644 - RNA, 12 nt, Human herpesvirus 4 [Epstein-Barr virus]
ggcgaggggcgc

SEQ ID NO: 3974645 - RNA, 18 nt, Human herpesvirus 4 [Epstein-Barr virus]
ggcgauaccuugggcauc

SEQ ID NO: 3974646 - RNA, 21 nt, Human herpesvirus 4 [Epstein-Barr virus]
ggcgcaggggagggggcagga

SEQ ID NO: 3974647 - RNA, 19 nt, Human herpesvirus 4 [Epstein-Barr virus]
ggcgccgcagggguggugg

SEQ ID NO: 3974648 - RNA, 16 nt, Human herpesvirus 4 [Epstein-Barr virus]
ggcgcgggucugggau

SEQ ID NO: 3974649 - RNA, 17 nt, Human herpesvirus 4 [Epstein-Barr virus]
ggcggacaucauuagcc

SEQ ID NO: 3974650 - RNA, 16 nt, Human herpesvirus 4 [Epstein-Barr virus]
ggcgggaauggccgcc

SEQ ID NO: 3974651 - RNA, 21 nt, Human herpesvirus 4 [Epstein-Barr virus]
ggcgggacuggcacgguggcu

SEQ ID NO: 3974652 - RNA, 17 nt, Human herpesvirus 4 [Epstein-Barr virus]
ggcuagacgcagcugug

SEQ ID NO: 3974653 - RNA, 14 nt, Human herpesvirus 4 [Epstein-Barr virus]
ggcucaggccgccg

SEQ ID NO: 3974654 - RNA, 21 nt, Human herpesvirus 4 [Epstein-Barr virus]
ggcucucccaacacaauagaa

SEQ ID NO: 3974655 - RNA, 14 nt, Human herpesvirus 4 [Epstein-Barr virus]
ggcugccgaagcag

SEQ ID NO: 3974656 - RNA, 12 nt, Human herpesvirus 4 [Epstein-Barr virus]
ggcugcugccaa

SEQ ID NO: 3974657 - RNA, 22 nt, Human herpesvirus 4 [Epstein-Barr virus]
ggcugcugccgucccagggccg

SEQ ID NO: 3974658 - RNA, 17 nt, Human herpesvirus 4 [Epstein-Barr virus]
ggcuggugggcucccuc

SEQ ID NO: 3974659 - RNA, 18 nt, Human herpesvirus 4 [Epstein-Barr virus]
ggcugugguaaccggugg

SEQ ID NO: 3974660 - RNA, 18 nt, Human herpesvirus 4 [Epstein-Barr virus]
ggcuuacaagaauaacau

SEQ ID NO: 3974661 - RNA, 23 nt, Human herpesvirus 4 [Epstein-Barr virus]
ggcuucuuagaugaggagcaggc

SEQ ID NO: 3974662 - RNA, 12 nt, Human herpesvirus 4 [Epstein-Barr virus]
ggcuugccaaaa

SEQ ID NO: 3974663 - RNA, 21 nt, Human herpesvirus 4 [Epstein-Barr virus]
gggaacaugagaaaauacuuc

SEQ ID NO: 3974664 - RNA, 14 nt, Human herpesvirus 4 [Epstein-Barr virus]
gggaagcucagcag

SEQ ID NO: 3974665 - RNA, 22 nt, Human herpesvirus 4 [Epstein-Barr virus]
gggacgcagaaugugcagggau

SEQ ID NO: 3974666 - RNA, 17 nt, Human herpesvirus 4 [Epstein-Barr virus]
gggagaacgguggccag

SEQ ID NO: 3974667 - RNA, 15 nt, Human herpesvirus 4 [Epstein-Barr virus]
gggagggacgggccu

SEQ ID NO: 3974668 - RNA, 23 nt, Human herpesvirus 4 [Epstein-Barr virus]
gggaugaacccuggggcaacaga

SEQ ID NO: 3974669 - RNA, 20 nt, Human herpesvirus 4 [Epstein-Barr virus]
gggauugcaacacgacggga

SEQ ID NO: 3974670 - RNA, 16 nt, Human herpesvirus 4 [Epstein-Barr virus]
gggcaaacagggcaga

SEQ ID NO: 3974671 - RNA, 13 nt, Human herpesvirus 4 [Epstein-Barr virus]
gggcaccguggga

SEQ ID NO: 3974672 - RNA, 21 nt, Human herpesvirus 4 [Epstein-Barr virus]
gggccacggcgugccagaggc

SEQ ID NO: 3974673 - RNA, 21 nt, Human herpesvirus 4 [Epstein-Barr virus]
gggccaggucacagaccagcc

SEQ ID NO: 3974674 - RNA, 19 nt, Human herpesvirus 4 [Epstein-Barr virus]
gggccauucgugaguccag

SEQ ID NO: 3974675 - RNA, 17 nt, Human herpesvirus 4 [Epstein-Barr virus]
gggcccgcuucauucac

SEQ ID NO: 3974676 - RNA, 14 nt, Human herpesvirus 4 [Epstein-Barr virus]
gggccucggccugg

SEQ ID NO: 3974677 - RNA, 18 nt, Human herpesvirus 4 [Epstein-Barr virus]
gggcggcguggagcuggg

SEQ ID NO: 3974678 - RNA, 17 nt, Human herpesvirus 4 [Epstein-Barr virus]
gggcgggcuugugcuug

SEQ ID NO: 3974679 - RNA, 16 nt, Human herpesvirus 4 [Epstein-Barr virus]
gggcuggccugccugg

SEQ ID NO: 3974680 - RNA, 21 nt, Human herpesvirus 4 [Epstein-Barr virus]
ggggcacucucgagggugccu

SEQ ID NO: 3974681 - RNA, 18 nt, Human herpesvirus 4 [Epstein-Barr virus]
ggggcaggaggggcagga

SEQ ID NO: 3974682 - RNA, 20 nt, Human herpesvirus 4 [Epstein-Barr virus]
ggggcgauaccuugggcauc

SEQ ID NO: 3974683 - RNA, 20 nt, Human herpesvirus 4 [Epstein-Barr virus]
ggggcugagaccaugcucag

SEQ ID NO: 3974684 - RNA, 15 nt, Human herpesvirus 4 [Epstein-Barr virus]
gggggccuggugcca

SEQ ID NO: 3974685 - RNA, 13 nt, Human herpesvirus 4 [Epstein-Barr virus]
gggggugggcacc

SEQ ID NO: 3974686 - RNA, 18 nt, Human herpesvirus 4 [Epstein-Barr virus]
gggguguagugggugggc

SEQ ID NO: 3974687 - RNA, 22 nt, Human herpesvirus 4 [Epstein-Barr virus]
ggguaggccauacgucuagcca

SEQ ID NO: 3974688 - RNA, 12 nt, Human herpesvirus 4 [Epstein-Barr virus]
ggguaggggagu

SEQ ID NO: 3974689 - RNA, 19 nt, Human herpesvirus 4 [Epstein-Barr virus]
ggguauagagcauaugccg

SEQ ID NO: 3974690 - RNA, 14 nt, Human herpesvirus 4 [Epstein-Barr virus]
gggucagugaugga

SEQ ID NO: 3974691 - RNA, 14 nt, Human herpesvirus 4 [Epstein-Barr virus]
ggguccgugcggcu

SEQ ID NO: 3974692 - RNA, 19 nt, Human herpesvirus 4 [Epstein-Barr virus]
gggucucggcacccaggca

SEQ ID NO: 3974693 - RNA, 17 nt, Human herpesvirus 4 [Epstein-Barr virus]
gggugaggccacgcuuu

SEQ ID NO: 3974694 - RNA, 19 nt, Human herpesvirus 4 [Epstein-Barr virus]
ggguggaacgcuccagcuu

SEQ ID NO: 3974695 - RNA, 21 nt, Human herpesvirus 4 [Epstein-Barr virus]
ggguggacagcagcguccugg

SEQ ID NO: 3974696 - RNA, 20 nt, Human herpesvirus 4 [Epstein-Barr virus]
gguaacauuguacagagcug

SEQ ID NO: 3974697 - RNA, 14 nt, Human herpesvirus 4 [Epstein-Barr virus]
gguacgauggcgga

SEQ ID NO: 3974698 - RNA, 22 nt, Human herpesvirus 4 [Epstein-Barr virus]
ggucacuaaaguuggucaggcu

SEQ ID NO: 3974699 - RNA, 22 nt, Human herpesvirus 4 [Epstein-Barr virus]
ggucacuggcuuaugcguggga

SEQ ID NO: 3974700 - RNA, 12 nt, Human herpesvirus 4 [Epstein-Barr virus]
ggucauggcgga

SEQ ID NO: 3974701 - RNA, 18 nt, Human herpesvirus 4 [Epstein-Barr virus]
ggucauggcggacugcgc

SEQ ID NO: 3974702 - RNA, 17 nt, Human herpesvirus 4 [Epstein-Barr virus]
gguccaggagucugcug

SEQ ID NO: 3974703 - RNA, 22 nt, Human herpesvirus 4 [Epstein-Barr virus]
gguccucauaaggcgguggggg

SEQ ID NO: 3974704 - RNA, 22 nt, Human herpesvirus 4 [Epstein-Barr virus]
ggucgcuagauggcgcggguga

SEQ ID NO: 3974705 - RNA, 14 nt, Human herpesvirus 4 [Epstein-Barr virus]
ggugacacagugcc

SEQ ID NO: 3974706 - RNA, 12 nt, Human herpesvirus 4 [Epstein-Barr virus]
ggugaggcccag

SEQ ID NO: 3974707 - RNA, 14 nt, Human herpesvirus 4 [Epstein-Barr virus]
ggugaggcccagcc

SEQ ID NO: 3974708 - RNA, 19 nt, Human herpesvirus 4 [Epstein-Barr virus]
ggugccaagcucagccccu

SEQ ID NO: 3974709 - RNA, 13 nt, Human herpesvirus 4 [Epstein-Barr virus]
ggugcccccacca

SEQ ID NO: 3974710 - RNA, 18 nt, Human herpesvirus 4 [Epstein-Barr virus]
ggugcccgagccccgccu

SEQ ID NO: 3974711 - RNA, 15 nt, Human herpesvirus 4 [Epstein-Barr virus]
ggugccggggcccac

SEQ ID NO: 3974712 - RNA, 16 nt, Human herpesvirus 4 [Epstein-Barr virus]
ggugccggggcccacg

SEQ ID NO: 3974713 - RNA, 18 nt, Human herpesvirus 4 [Epstein-Barr virus]
ggugcuugugguguggga

SEQ ID NO: 3974714 - RNA, 21 nt, Human herpesvirus 4 [Epstein-Barr virus]
gguggcagcccccuccuccag

SEQ ID NO: 3974715 - RNA, 14 nt, Human herpesvirus 4 [Epstein-Barr virus]
gguggccggcagcc

SEQ ID NO: 3974716 - RNA, 16 nt, Human herpesvirus 4 [Epstein-Barr virus]
gguugcgcugcuugcc

SEQ ID NO: 3974717 - RNA, 19 nt, Human herpesvirus 4 [Epstein-Barr virus]
gguuguauguucagagcuc

SEQ ID NO: 3974718 - RNA, 22 nt, Human herpesvirus 4 [Epstein-Barr virus]
guaaaaagcgggccugagucca

SEQ ID NO: 3974719 - RNA, 23 nt, Human herpesvirus 4 [Epstein-Barr virus]
guaacuugucuacaucccauacc

SEQ ID NO: 3974720 - RNA, 14 nt, Human herpesvirus 4 [Epstein-Barr virus]
guacgugccucaga

SEQ ID NO: 3974721 - RNA, 22 nt, Human herpesvirus 4 [Epstein-Barr virus]
gcugcacaaaggaaacugcuga

SEQ ID NO: 3974722 - RNA, 21 nt, Human herpesvirus 4 [Epstein-Barr virus]
gcugcaccggagccugccgga

SEQ ID NO: 3974723 - RNA, 23 nt, Human herpesvirus 4 [Epstein-Barr virus]
gcugcaccuggacauagaggggc

SEQ ID NO: 3974724 - RNA, 12 nt, Human herpesvirus 4 [Epstein-Barr virus]
gcugccagccuc

SEQ ID NO: 3974725 - RNA, 20 nt, Human herpesvirus 4 [Epstein-Barr virus]
gcugcccauggaaugcucag

SEQ ID NO: 3974726 - RNA, 17 nt, Human herpesvirus 4 [Epstein-Barr virus]
gcugccccgggcccacc

SEQ ID NO: 3974727 - RNA, 19 nt, Human herpesvirus 4 [Epstein-Barr virus]
gcugccgcuacugcugcua

SEQ ID NO: 3974728 - RNA, 16 nt, Human herpesvirus 4 [Epstein-Barr virus]
gcugcgccugagcugc

SEQ ID NO: 3974729 - RNA, 12 nt, Human herpesvirus 4 [Epstein-Barr virus]
gcugcuggucau

SEQ ID NO: 3974730 - RNA, 17 nt, Human herpesvirus 4 [Epstein-Barr virus]
gcugcuguccacccugg

SEQ ID NO: 3974731 - RNA, 21 nt, Human herpesvirus 4 [Epstein-Barr virus]
gcugcuuuuagccuaauugug

SEQ ID NO: 3974732 - RNA, 20 nt, Human herpesvirus 4 [Epstein-Barr virus]
gcuggacgugaaccuccccc

SEQ ID NO: 3974733 - RNA, 14 nt, Human herpesvirus 4 [Epstein-Barr virus]
gcuggcaguccuug

SEQ ID NO: 3974734 - RNA, 14 nt, Human herpesvirus 4 [Epstein-Barr virus]
gcuggccgcagcug

SEQ ID NO: 3974735 - RNA, 17 nt, Human herpesvirus 4 [Epstein-Barr virus]
gcuggccgcagcuggcg

SEQ ID NO: 3974736 - RNA, 15 nt, Human herpesvirus 4 [Epstein-Barr virus]
gcuggccugccugga

SEQ ID NO: 3974737 - RNA, 15 nt, Human herpesvirus 4 [Epstein-Barr virus]
gcugguggccuggga

SEQ ID NO: 3974738 - RNA, 15 nt, Human herpesvirus 4 [Epstein-Barr virus]
gcuguugacaugagc

SEQ ID NO: 3974739 - RNA, 18 nt, Human herpesvirus 4 [Epstein-Barr virus]
gcuguugacaugagcaug

SEQ ID NO: 3974740 - RNA, 14 nt, Human herpesvirus 4 [Epstein-Barr virus]
gcuuaaaaaugugc

SEQ ID NO: 3974741 - RNA, 23 nt, Human herpesvirus 4 [Epstein-Barr virus]
gcuuaaaaaugugcagcuucucc

SEQ ID NO: 3974742 - RNA, 14 nt, Human herpesvirus 4 [Epstein-Barr virus]
gcuuacagccagag

SEQ ID NO: 3974743 - RNA, 15 nt, Human herpesvirus 4 [Epstein-Barr virus]
gcuuaugcagcaccu

SEQ ID NO: 3974744 - RNA, 22 nt, Human herpesvirus 4 [Epstein-Barr virus]
gcuuccacccccuggagccagc

SEQ ID NO: 3974745 - RNA, 14 nt, Human herpesvirus 4 [Epstein-Barr virus]
gcuugugaacuuua

SEQ ID NO: 3974746 - RNA, 21 nt, Human herpesvirus 4 [Epstein-Barr virus]
gcuuugccggcauccagugcg

SEQ ID NO: 3974747 - RNA, 22 nt, Human herpesvirus 4 [Epstein-Barr virus]
ggaaagaggucccauguacagc

SEQ ID NO: 3974748 - RNA, 19 nt, Human herpesvirus 4 [Epstein-Barr virus]
ggaaauggccuaggagaga

SEQ ID NO: 3974749 - RNA, 19 nt, Human herpesvirus 4 [Epstein-Barr virus]
ggaacggugggaagcucag

SEQ ID NO: 3974750 - RNA, 18 nt, Human herpesvirus 4 [Epstein-Barr virus]
ggaagagaggggcaggga

SEQ ID NO: 3974751 - RNA, 21 nt, Human herpesvirus 4 [Epstein-Barr virus]
ggaagcaggagaugggugcau

SEQ ID NO: 3974752 - RNA, 21 nt, Human herpesvirus 4 [Epstein-Barr virus]
ggaagcguucuucacugucca

SEQ ID NO: 3974753 - RNA, 14 nt, Human herpesvirus 4 [Epstein-Barr virus]
ggaaggaggauggc

SEQ ID NO: 3974754 - RNA, 14 nt, Human herpesvirus 4 [Epstein-Barr virus]
ggaaucucugccaa

SEQ ID NO: 3974755 - RNA, 15 nt, Human herpesvirus 4 [Epstein-Barr virus]
ggacaaggcaguaga

SEQ ID NO: 3974756 - RNA, 17 nt, Human herpesvirus 4 [Epstein-Barr virus]
ggacaucauuagcccag

SEQ ID NO: 3974757 - RNA, 15 nt, Human herpesvirus 4 [Epstein-Barr virus]
ggacgaggaggaaga

SEQ ID NO: 3974758 - RNA, 21 nt, Human herpesvirus 4 [Epstein-Barr virus]
ggacguuggcgggacuggcac

SEQ ID NO: 3974759 - RNA, 22 nt, Human herpesvirus 4 [Epstein-Barr virus]
ggagacguggguccccucugcc

SEQ ID NO: 3974760 - RNA, 15 nt, Human herpesvirus 4 [Epstein-Barr virus]
ggagagggccagaga

SEQ ID NO: 3974761 - RNA, 18 nt, Human herpesvirus 4 [Epstein-Barr virus]
ggagauagggaccagagg

SEQ ID NO: 3974762 - RNA, 21 nt, Human herpesvirus 4 [Epstein-Barr virus]
ggagauccgccaggaccugga

SEQ ID NO: 3974763 - RNA, 19 nt, Human herpesvirus 4 [Epstein-Barr virus]
ggagcacucggggcccuuu

SEQ ID NO: 3974764 - RNA, 17 nt, Human herpesvirus 4 [Epstein-Barr virus]
ggagccagcgcuggggg

SEQ ID NO: 3974765 - RNA, 21 nt, Human herpesvirus 4 [Epstein-Barr virus]
ggaggagaagagaggcuuccc

SEQ ID NO: 3974766 - RNA, 18 nt, Human herpesvirus 4 [Epstein-Barr virus]
ggaggaggacgugaguga

SEQ ID NO: 3974767 - RNA, 14 nt, Human herpesvirus 4 [Epstein-Barr virus]
ggaggaugccagcc

SEQ ID NO: 3974768 - RNA, 17 nt, Human herpesvirus 4 [Epstein-Barr virus]
ggaggcacuggagcaga

SEQ ID NO: 3974769 - RNA, 16 nt, Human herpesvirus 4 [Epstein-Barr virus]
ggaggccccggccgcc

SEQ ID NO: 3974770 - RNA, 18 nt, Human herpesvirus 4 [Epstein-Barr virus]
ggaggccgagcagggacu

SEQ ID NO: 3974771 - RNA, 20 nt, Human herpesvirus 4 [Epstein-Barr virus]
ggaggccugggagggggcga

SEQ ID NO: 3974772 - RNA, 11 nt, Human herpesvirus 4 [Epstein-Barr virus]
ggaggcugcua

SEQ ID NO: 3974773 - RNA, 19 nt, Human herpesvirus 4 [Epstein-Barr virus]
ggagggagccugcccaucc

SEQ ID NO: 3974774 - RNA, 21 nt, Human herpesvirus 4 [Epstein-Barr virus]
ggagggcgcucugcgccagcc

SEQ ID NO: 3974775 - RNA, 14 nt, Human herpesvirus 4 [Epstein-Barr virus]
ggaggugaagaugg

SEQ ID NO: 3974776 - RNA, 13 nt, Human herpesvirus 4 [Epstein-Barr virus]
ggaugaagaucca

SEQ ID NO: 3974777 - RNA, 21 nt, Human herpesvirus 4 [Epstein-Barr virus]
ggcaaagauccccaguggagc

SEQ ID NO: 3974778 - RNA, 17 nt, Human herpesvirus 4 [Epstein-Barr virus]
ggcacaucuggcaccug

SEQ ID NO: 3974779 - RNA, 20 nt, Human herpesvirus 4 [Epstein-Barr virus]
ggcacguuuaccagugugcc

SEQ ID NO: 3974780 - RNA, 22 nt, Human herpesvirus 4 [Epstein-Barr virus]
ggcacguuuaccagugugccag

SEQ ID NO: 3974781 - RNA, 21 nt, Human herpesvirus 4 [Epstein-Barr virus]
ggcacucucgagggugccugu

SEQ ID NO: 3974782 - RNA, 18 nt, Human herpesvirus 4 [Epstein-Barr virus]
ggcagcacacgaagccug

SEQ ID NO: 3974783 - RNA, 24 nt, Human herpesvirus 4 [Epstein-Barr virus]
ggcagcagcucuggcacugcuagc

SEQ ID NO: 3974784 - RNA, 16 nt, Human herpesvirus 4 [Epstein-Barr virus]
ggcagccagagccagc

SEQ ID NO: 3974785 - RNA, 21 nt, Human herpesvirus 4 [Epstein-Barr virus]
ggcagccgcggccaucaccug

SEQ ID NO: 3974786 - RNA, 15 nt, Human herpesvirus 4 [Epstein-Barr virus]
ggcagcuuuuggccu

SEQ ID NO: 3974787 - RNA, 13 nt, Human herpesvirus 4 [Epstein-Barr virus]
ggcagggggccgg

SEQ ID NO: 3974788 - RNA, 18 nt, Human herpesvirus 4 [Epstein-Barr virus]
ggcagugauaagucauga

SEQ ID NO: 3974789 - RNA, 12 nt, Human herpesvirus 4 [Epstein-Barr virus]
ggcaugcugccc

SEQ ID NO: 3974790 - RNA, 15 nt, Human herpesvirus 4 [Epstein-Barr virus]
ggcaugggaccggga

SEQ ID NO: 3974791 - RNA, 13 nt, Human herpesvirus 4 [Epstein-Barr virus]
ggcauucagauuu

SEQ ID NO: 3974792 - RNA, 16 nt, Human herpesvirus 4 [Epstein-Barr virus]
ggccaaaagggcucug

SEQ ID NO: 3974793 - RNA, 18 nt, Human herpesvirus 4 [Epstein-Barr virus]
ggccaaaagggcucugac

SEQ ID NO: 3974794 - RNA, 16 nt, Human herpesvirus 4 [Epstein-Barr virus]
ggccacacuggggacc

SEQ ID NO: 3974795 - RNA, 18 nt, Human herpesvirus 4 [Epstein-Barr virus]
ggccaccggggaggccag

SEQ ID NO: 3974796 - RNA, 23 nt, Human herpesvirus 4 [Epstein-Barr virus]
ggccacgcugauaaaguuguccu

SEQ ID NO: 3974797 - RNA, 14 nt, Human herpesvirus 4 [Epstein-Barr virus]
ggccagcuuugagc

SEQ ID NO: 3974798 - RNA, 22 nt, Human herpesvirus 4 [Epstein-Barr virus]
ggccaggcgacgcucccgggca

SEQ ID NO: 3974799 - RNA, 22 nt, Human herpesvirus 4 [Epstein-Barr virus]
ggccaugcaggccuggacagca

SEQ ID NO: 3974800 - RNA, 20 nt, Human herpesvirus 4 [Epstein-Barr virus]
ggcccagcagauccagggcc

SEQ ID NO: 3974801 - RNA, 12 nt, Human herpesvirus 4 [Epstein-Barr virus]
ggcccagccccc

SEQ ID NO: 3974802 - RNA, 24 nt, Human herpesvirus 4 [Epstein-Barr virus]
ggcccagugcacccagguggucuu

SEQ ID NO: 3974803 - RNA, 23 nt, Human herpesvirus 4 [Epstein-Barr virus]
ggccccccgcaccagggccaggc

SEQ ID NO: 3974804 - RNA, 18 nt, Human herpesvirus 4 [Epstein-Barr virus]
ggccccgggagccacggc

SEQ ID NO: 3974805 - RNA, 16 nt, Human herpesvirus 4 [Epstein-Barr virus]
ggccccggucacccca

SEQ ID NO: 3974806 - RNA, 16 nt, Human herpesvirus 4 [Epstein-Barr virus]
ggcccgggaccgcgcc

SEQ ID NO: 3974807 - RNA, 23 nt, Human herpesvirus 4 [Epstein-Barr virus]
ggccgaggcugagggggcgguca

SEQ ID NO: 3974808 - RNA, 14 nt, Human herpesvirus 4 [Epstein-Barr virus]
gccggcagccuggc

SEQ ID NO: 3974809 - RNA, 22 nt, Human herpesvirus 4 [Epstein-Barr virus]
gccggcauccagugcgucagca

SEQ ID NO: 3974810 - RNA, 14 nt, Human herpesvirus 4 [Epstein-Barr virus]
gccgggcgcgcucc

SEQ ID NO: 3974811 - RNA, 13 nt, Human herpesvirus 4 [Epstein-Barr virus]
gccggggccgaga

SEQ ID NO: 3974812 - RNA, 23 nt, Human herpesvirus 4 [Epstein-Barr virus]
gccguccucuggacgcugguacc

SEQ ID NO: 3974813 - RNA, 17 nt, Human herpesvirus 4 [Epstein-Barr virus]
gccgugguugggcagaa

SEQ ID NO: 3974814 - RNA, 19 nt, Human herpesvirus 4 [Epstein-Barr virus]
gccuaaacgugauggugcu

SEQ ID NO: 3974815 - RNA, 17 nt, Human herpesvirus 4 [Epstein-Barr virus]
gccuacgcagaggccau

SEQ ID NO: 3974816 - RNA, 14 nt, Human herpesvirus 4 [Epstein-Barr virus]
gccuaggagagaag

SEQ ID NO: 3974817 - RNA, 16 nt, Human herpesvirus 4 [Epstein-Barr virus]
gccuaucauguuucaa

SEQ ID NO: 3974818 - RNA, 20 nt, Human herpesvirus 4 [Epstein-Barr virus]
gccuauggguuaccaggcau

SEQ ID NO: 3974819 - RNA, 19 nt, Human herpesvirus 4 [Epstein-Barr virus]
gccucagcgucaggagagg

SEQ ID NO: 3974820 - RNA, 14 nt, Human herpesvirus 4 [Epstein-Barr virus]
gccuccagagcccc

SEQ ID NO: 3974821 - RNA, 16 nt, Human herpesvirus 4 [Epstein-Barr virus]
gccuccagcucggcca

SEQ ID NO: 3974822 - RNA, 14 nt, Human herpesvirus 4 [Epstein-Barr virus]
gccuccgccugagc

SEQ ID NO: 3974823 - RNA, 17 nt, Human herpesvirus 4 [Epstein-Barr virus]
gccuccggccgccccgg

SEQ ID NO: 3974824 - RNA, 17 nt, Human herpesvirus 4 [Epstein-Barr virus]
gccucggccugggguaa

SEQ ID NO: 3974825 - RNA, 16 nt, Human herpesvirus 4 [Epstein-Barr virus]
gccucgugcaaccagg

SEQ ID NO: 3974826 - RNA, 20 nt, Human herpesvirus 4 [Epstein-Barr virus]
gccucuacgccccagaugaa

SEQ ID NO: 3974827 - RNA, 19 nt, Human herpesvirus 4 [Epstein-Barr virus]
gccugaauuccccugccug

SEQ ID NO: 3974828 - RNA, 16 nt, Human herpesvirus 4 [Epstein-Barr virus]
gccugagccacaccca

SEQ ID NO: 3974829 - RNA, 19 nt, Human herpesvirus 4 [Epstein-Barr virus]
gccugccaaagagccagau

SEQ ID NO: 3974830 - RNA, 17 nt, Human herpesvirus 4 [Epstein-Barr virus]
gccugccucugcucugg

SEQ ID NO: 3974831 - RNA, 16 nt, Human herpesvirus 4 [Epstein-Barr virus]
gccugcuucacgccuc

SEQ ID NO: 3974832 - RNA, 16 nt, Human herpesvirus 4 [Epstein-Barr virus]
gccuggauucuuacag

SEQ ID NO: 3974833 - RNA, 18 nt, Human herpesvirus 4 [Epstein-Barr virus]
gccuucuccucagccucc

SEQ ID NO: 3974834 - RNA, 16 nt, Human herpesvirus 4 [Epstein-Barr virus]
gccuugcccccgccag

SEQ ID NO: 3974835 - RNA, 22 nt, Human herpesvirus 4 [Epstein-Barr virus]
gcgacauguuucuggugagcca

SEQ ID NO: 3974836 - RNA, 21 nt, Human herpesvirus 4 [Epstein-Barr virus]
gcgacuucgggggcgacugcc

SEQ ID NO: 3974837 - RNA, 18 nt, Human herpesvirus 4 [Epstein-Barr virus]
gcgagacuuggaccaagg

SEQ ID NO: 3974838 - RNA, 16 nt, Human herpesvirus 4 [Epstein-Barr virus]
gcgagcaugaucagga

SEQ ID NO: 3974839 - RNA, 16 nt, Human herpesvirus 4 [Epstein-Barr virus]
gcgagcucuccagcca

SEQ ID NO: 3974840 - RNA, 14 nt, Human herpesvirus 4 [Epstein-Barr virus]
gcgagggggccugg

SEQ ID NO: 3974841 - RNA, 21 nt, Human herpesvirus 4 [Epstein-Barr virus]
gcgaugccucuacgccccaga

SEQ ID NO: 3974842 - RNA, 23 nt, Human herpesvirus 4 [Epstein-Barr virus]
gcgcaaccagcacgucgucagag

SEQ ID NO: 3974843 - RNA, 18 nt, Human herpesvirus 4 [Epstein-Barr virus]
gcgcacccggggaaccgg

SEQ ID NO: 3974844 - RNA, 17 nt, Human herpesvirus 4 [Epstein-Barr virus]
gcgccagcagggcacag

SEQ ID NO: 3974845 - RNA, 21 nt, Human herpesvirus 4 [Epstein-Barr virus]
gcgcccugucccuggagcugg

SEQ ID NO: 3974846 - RNA, 14 nt, Human herpesvirus 4 [Epstein-Barr virus]
gcgccgccagcaug

SEQ ID NO: 3974847 - RNA, 19 nt, Human herpesvirus 4 [Epstein-Barr virus]
gcgccgcccgggggccagu

SEQ ID NO: 3974848 - RNA, 15 nt, Human herpesvirus 4 [Epstein-Barr virus]
gcgccguccacggcc

SEQ ID NO: 3974849 - RNA, 23 nt, Human herpesvirus 4 [Epstein-Barr virus]
gcgcgcccugucaccaggccugc

SEQ ID NO: 3974850 - RNA, 19 nt, Human herpesvirus 4 [Epstein-Barr virus]
gcgcggcuggaugcccuca

SEQ ID NO: 3974851 - RNA, 15 nt, Human herpesvirus 4 [Epstein-Barr virus]
gcgcgggucccccua

SEQ ID NO: 3974852 - RNA, 22 nt, Human herpesvirus 4 [Epstein-Barr virus]
gcggcaagggcucaccagggag

SEQ ID NO: 3974853 - RNA, 11 nt, Human herpesvirus 4 [Epstein-Barr virus]
gcggcccagca

SEQ ID NO: 3974854 - RNA, 22 nt, Human herpesvirus 4 [Epstein-Barr virus]
gcggcgaugucggggcugcugg

SEQ ID NO: 3974855 - RNA, 12 nt, Human herpesvirus 4 [Epstein-Barr virus]
gcggcugcugcc

SEQ ID NO: 3974856 - RNA, 12 nt, Human herpesvirus 4 [Epstein-Barr virus]
gcggcugugagc

SEQ ID NO: 3974857 - RNA, 14 nt, Human herpesvirus 4 [Epstein-Barr virus]
gcggcuguggccuc

SEQ ID NO: 3974858 - RNA, 16 nt, Human herpesvirus 4 [Epstein-Barr virus]
gcgggauagcaggacg

SEQ ID NO: 3974859 - RNA, 14 nt, Human herpesvirus 4 [Epstein-Barr virus]
gcgggggccucagc

SEQ ID NO: 3974860 - RNA, 23 nt, Human herpesvirus 4 [Epstein-Barr virus]
gcggguggaggagcuccgugagc

SEQ ID NO: 3974861 - RNA, 14 nt, Human herpesvirus 4 [Epstein-Barr virus]
gcggugccugugga

SEQ ID NO: 3974862 - RNA, 13 nt, Human herpesvirus 4 [Epstein-Barr virus]
gcgucucauuccc

SEQ ID NO: 3974863 - RNA, 23 nt, Human herpesvirus 4 [Epstein-Barr virus]
gcgugacggcauucgugagcagg

SEQ ID NO: 3974864 - RNA, 12 nt, Human herpesvirus 4 [Epstein-Barr virus]
gcguggguguca

SEQ ID NO: 3974865 - RNA, 14 nt, Human herpesvirus 4 [Epstein-Barr virus]
gcguugccagacuc

SEQ ID NO: 3974866 - RNA, 17 nt, Human herpesvirus 4 [Epstein-Barr virus]
gcguuucugcggaucag

SEQ ID NO: 3974867 - RNA, 14 nt, Human herpesvirus 4 [Epstein-Barr virus]
gcuaauagcuuucu

SEQ ID NO: 3974868 - RNA, 16 nt, Human herpesvirus 4 [Epstein-Barr virus]
gcuaaucgcugguggc

SEQ ID NO: 3974869 - RNA, 18 nt, Human herpesvirus 4 [Epstein-Barr virus]
gcuaaucgcugguggcag

SEQ ID NO: 3974870 - RNA, 16 nt, Human herpesvirus 4 [Epstein-Barr virus]
gcuacaaacacgggcc

SEQ ID NO: 3974871 - RNA, 18 nt, Human herpesvirus 4 [Epstein-Barr virus]
gcuaguugguccaggguc

SEQ ID NO: 3974872 - RNA, 18 nt, Human herpesvirus 4 [Epstein-Barr virus]
gcuauugccgccucgugu

SEQ ID NO: 3974873 - RNA, 20 nt, Human herpesvirus 4 [Epstein-Barr virus]
gcucaaggcagucuccaccu

SEQ ID NO: 3974874 - RNA, 16 nt, Human herpesvirus 4 [Epstein-Barr virus]
gcucaccccugugcag

SEQ ID NO: 3974875 - RNA, 17 nt, Human herpesvirus 4 [Epstein-Barr virus]
gcucaggaucagggcca

SEQ ID NO: 3974876 - RNA, 17 nt, Human herpesvirus 4 [Epstein-Barr virus]
gcuccaccagcuucuca

SEQ ID NO: 3974877 - RNA, 16 nt, Human herpesvirus 4 [Epstein-Barr virus]
gcuccagggccagcaa

SEQ ID NO: 3974878 - RNA, 17 nt, Human herpesvirus 4 [Epstein-Barr virus]
gcuccagugccuccgcc

SEQ ID NO: 3974879 - RNA, 14 nt, Human herpesvirus 4 [Epstein-Barr virus]
gcucccgccucagg

SEQ ID NO: 3974880 - RNA, 16 nt, Human herpesvirus 4 [Epstein-Barr virus]
gcuccgagagcuccgc

SEQ ID NO: 3974881 - RNA, 19 nt, Human herpesvirus 4 [Epstein-Barr virus]
gcuccguccuuguccagga

SEQ ID NO: 3974882 - RNA, 16 nt, Human herpesvirus 4 [Epstein-Barr virus]
gcuccgugagcaggag

SEQ ID NO: 3974883 - RNA, 22 nt, Human herpesvirus 4 [Epstein-Barr virus]
gcuccgugagcaggagcuugag

SEQ ID NO: 3974884 - RNA, 19 nt, Human herpesvirus 4 [Epstein-Barr virus]
gcucgaccgggaugugaug

SEQ ID NO: 3974885 - RNA, 17 nt, Human herpesvirus 4 [Epstein-Barr virus]
gcucgcagcuggaggaa

SEQ ID NO: 3974886 - RNA, 16 nt, Human herpesvirus 4 [Epstein-Barr virus]
gcucggggcuggggag

SEQ ID NO: 3974887 - RNA, 18 nt, Human herpesvirus 4 [Epstein-Barr virus]
gcucgucguucaggaaca

SEQ ID NO: 3974888 - RNA, 16 nt, Human herpesvirus 4 [Epstein-Barr virus]
gcucucguugccaaaa

SEQ ID NO: 3974889 - RNA, 13 nt, Human herpesvirus 4 [Epstein-Barr virus]
gcucucucuggag

SEQ ID NO: 3974890 - RNA, 22 nt, Human herpesvirus 4 [Epstein-Barr virus]
gcucuggucgcccccucugccu

SEQ ID NO: 3974891 - RNA, 14 nt, Human herpesvirus 4 [Epstein-Barr virus]
gcucugucaguuau

SEQ ID NO: 3974892 - RNA, 18 nt, Human herpesvirus 4 [Epstein-Barr virus]
gcugacccuucugcugcu

SEQ ID NO: 3974893 - RNA, 17 nt, Human herpesvirus 4 [Epstein-Barr virus]
gcugaccggcucggcca

SEQ ID NO: 3974894 - RNA, 23 nt, Human herpesvirus 4 [Epstein-Barr virus]
gcugaggggcaaccugaacuuua

SEQ ID NO: 3974895 - RNA, 15 nt, Human herpesvirus 4 [Epstein-Barr virus]
gcugaugugcugccc

SEQ ID NO: 3974896 - RNA, 13 nt, Human herpesvirus 4 [Epstein-Barr virus]
agacuccugccug

SEQ ID NO: 3974897 - RNA, 14 nt, Human herpesvirus 4 [Epstein-Barr virus]
agagacaaggcagg

SEQ ID NO: 3974898 - RNA, 11 nt, Human herpesvirus 4 [Epstein-Barr virus]
agagagccaca

SEQ ID NO: 3974899 - RNA, 17 nt, Human herpesvirus 4 [Epstein-Barr virus]
agagagcggcugugagc

SEQ ID NO: 3974900 - RNA, 13 nt, Human herpesvirus 4 [Epstein-Barr virus]
agagaggccucug

SEQ ID NO: 3974901 - RNA, 23 nt, Human herpesvirus 4 [Epstein-Barr virus]
agagaggccucugccgcgcugcu

SEQ ID NO: 3974902 - RNA, 14 nt, Human herpesvirus 4 [Epstein-Barr virus]
aggcuaugaagaag

SEQ ID NO: 3974903 - RNA, 14 nt, Human herpesvirus 4 [Epstein-Barr virus]
aggcugcgccugag

SEQ ID NO: 3974904 - RNA, 16 nt, Human herpesvirus 4 [Epstein-Barr virus]
aggcugcgccugagcu

SEQ ID NO: 3974905 - RNA, 14 nt, Human herpesvirus 4 [Epstein-Barr virus]
aggcuucccgccua

SEQ ID NO: 3974906 - RNA, 21 nt, Human herpesvirus 4 [Epstein-Barr virus]
agggacccacgguggaacagg

SEQ ID NO: 3974907 - RNA, 13 nt, Human herpesvirus 4 [Epstein-Barr virus]
agggaggccuggg

SEQ ID NO: 3974908 - RNA, 22 nt, Human herpesvirus 4 [Epstein-Barr virus]
agggauaugaaggugucauuga

SEQ ID NO: 3974909 - RNA, 19 nt, Human herpesvirus 4 [Epstein-Barr virus]
agggaugggcuugauggcc

SEQ ID NO: 3974910 - RNA, 12 nt, Human herpesvirus 4 [Epstein-Barr virus]
agggcagacugc

SEQ ID NO: 3974911 - RNA, 13 nt, Human herpesvirus 4 [Epstein-Barr virus]
agggcagagaggc

SEQ ID NO: 3974912 - RNA, 14 nt, Human herpesvirus 4 [Epstein-Barr virus]
agggcaugcuuggg

SEQ ID NO: 3974913 - RNA, 23 nt, Human herpesvirus 4 [Epstein-Barr virus]
agggccacggcgugccagaggcc

SEQ ID NO: 3974914 - RNA, 19 nt, Human herpesvirus 4 [Epstein-Barr virus]
agggccgucacuccagcca

SEQ ID NO: 3974915 - RNA, 16 nt, Human herpesvirus 4 [Epstein-Barr virus]
agggcucaccagggag

SEQ ID NO: 3974916 - RNA, 10 nt, Human herpesvirus 4 [Epstein-Barr virus]
aggggcggca

SEQ ID NO: 3974917 - RNA, 17 nt, Human herpesvirus 4 [Epstein-Barr virus]
aggggcucgaauaugau

SEQ ID NO: 3974918 - RNA, 19 nt, Human herpesvirus 4 [Epstein-Barr virus]
agggggacaagagcacaaa

SEQ ID NO: 3974919 - RNA, 15 nt, Human herpesvirus 4 [Epstein-Barr virus]
aggggguacggagag

SEQ ID NO: 3974920 - RNA, 16 nt, Human herpesvirus 4 [Epstein-Barr virus]
aggucaggucccccuc

SEQ ID NO: 3974921 - RNA, 12 nt, Human herpesvirus 4 [Epstein-Barr virus]
agguccgcuccu

SEQ ID NO: 3974922 - RNA, 20 nt, Human herpesvirus 4 [Epstein-Barr virus]
aggugguuauuuugggccag

SEQ ID NO: 3974923 - RNA, 19 nt, Human herpesvirus 4 [Epstein-Barr virus]
agguguccagcgcucuggu

SEQ ID NO: 3974924 - RNA, 20 nt, Human herpesvirus 4 [Epstein-Barr virus]
aguaacagguaaucucuggu

SEQ ID NO: 3974925 - RNA, 22 nt, Human herpesvirus 4 [Epstein-Barr virus]
aguaaccacauauacuggagau

SEQ ID NO: 3974926 - RNA, 15 nt, Human herpesvirus 4 [Epstein-Barr virus]
aguaaggccgcugcc

SEQ ID NO: 3974927 - RNA, 19 nt, Human herpesvirus 4 [Epstein-Barr virus]
aguaggcacaucuggaccu

SEQ ID NO: 3974928 - RNA, 17 nt, Human herpesvirus 4 [Epstein-Barr virus]
aguaggugccuccagag

SEQ ID NO: 3974929 - RNA, 22 nt, Human herpesvirus 4 [Epstein-Barr virus]
agucagccuugcccccgccagc

SEQ ID NO: 3974930 - RNA, 17 nt, Human herpesvirus 4 [Epstein-Barr virus]
aguccaggggccacaca

SEQ ID NO: 3974931 - RNA, 15 nt, Human herpesvirus 4 [Epstein-Barr virus]
agucccgagcggccu

SEQ ID NO: 3974932 - RNA, 14 nt, Human herpesvirus 4 [Epstein-Barr virus]
aguccucauggcag

SEQ ID NO: 3974933 - RNA, 12 nt, Human herpesvirus 4 [Epstein-Barr virus]
agucgcugcugc

SEQ ID NO: 3974934 - RNA, 13 nt, Human herpesvirus 4 [Epstein-Barr virus]
agucugcuggacu

SEQ ID NO: 3974935 - RNA, 21 nt, Human herpesvirus 4 [Epstein-Barr virus]
agugcauggauauagcucugc

SEQ ID NO: 3974936 - RNA, 18 nt, Human herpesvirus 4 [Epstein-Barr virus]
agugcccuggaggccuca

SEQ ID NO: 3974937 - RNA, 14 nt, Human herpesvirus 4 [Epstein-Barr virus]
agugcgaggaacug

SEQ ID NO: 3974938 - RNA, 18 nt, Human herpesvirus 4 [Epstein-Barr virus]
agugcuaugaccaugccc

SEQ ID NO: 3974939 - RNA, 21 nt, Human herpesvirus 4 [Epstein-Barr virus]
aguggccgucuggcagggggc

SEQ ID NO: 3974940 - RNA, 19 nt, Human herpesvirus 4 [Epstein-Barr virus]
agugggcuucgggggccug

SEQ ID NO: 3974941 - RNA, 16 nt, Human herpesvirus 4 [Epstein-Barr virus]
aguucuacaaugccag

SEQ ID NO: 3974942 - RNA, 22 nt, Human herpesvirus 4 [Epstein-Barr virus]
aguugacggacgugcccagcuc

SEQ ID NO: 3974943 - RNA, 15 nt, Human herpesvirus 4 [Epstein-Barr virus]
aguuggucaggcuga

SEQ ID NO: 3974944 - RNA, 16 nt, Human herpesvirus 4 [Epstein-Barr virus]
aguuuaccugguacau

SEQ ID NO: 3974945 - RNA, 13 nt, Human herpesvirus 4 [Epstein-Barr virus]
auaaaaguacaga

SEQ ID NO: 3974946 - RNA, 15 nt, Human herpesvirus 4 [Epstein-Barr virus]
auacccagagcaaaa

SEQ ID NO: 3974947 - RNA, 20 nt, Human herpesvirus 4 [Epstein-Barr virus]
auaccuauagauccugggcc

SEQ ID NO: 3974948 - RNA, 20 nt, Human herpesvirus 4 [Epstein-Barr virus]
auacgcccgacaauaaaguu

SEQ ID NO: 3974949 - RNA, 19 nt, Human herpesvirus 4 [Epstein-Barr virus]
auacuucucuagagccagg

SEQ ID NO: 3974950 - RNA, 20 nt, Human herpesvirus 4 [Epstein-Barr virus]
auagagaugguguccggaga

SEQ ID NO: 3974951 - RNA, 22 nt, Human herpesvirus 4 [Epstein-Barr virus]
auagcaggacggggggcuggcg

SEQ ID NO: 3974952 - RNA, 23 nt, Human herpesvirus 4 [Epstein-Barr virus]
auagcaggucuccagagggcaga

SEQ ID NO: 3974953 - RNA, 15 nt, Human herpesvirus 4 [Epstein-Barr virus]
auagccggccaggca

SEQ ID NO: 3974954 - RNA, 15 nt, Human herpesvirus 4 [Epstein-Barr virus]
auauccuagagggac

SEQ ID NO: 3974955 - RNA, 13 nt, Human herpesvirus 4 [Epstein-Barr virus]
auaugcucucgca

SEQ ID NO: 3974956 - RNA, 18 nt, Human herpesvirus 4 [Epstein-Barr virus]
aucacccauggccaggcu

SEQ ID NO: 3974957 - RNA, 19 nt, Human herpesvirus 4 [Epstein-Barr virus]
aucagggccaagacauaga

SEQ ID NO: 3974958 - RNA, 15 nt, Human herpesvirus 4 [Epstein-Barr virus]
aucaucgggaaaggc

SEQ ID NO: 3974959 - RNA, 16 nt, Human herpesvirus 4 [Epstein-Barr virus]
aucaucgggaaaggcg

SEQ ID NO: 3974960 - RNA, 22 nt, Human herpesvirus 4 [Epstein-Barr virus]
aucaucucgcuggcucgccuca

SEQ ID NO: 3974961 - RNA, 21 nt, Human herpesvirus 4 [Epstein-Barr virus]
auccacagccccacucuugcc

SEQ ID NO: 3974962 - RNA, 19 nt, Human herpesvirus 4 [Epstein-Barr virus]
auccaguaugccugccugu

SEQ ID NO: 3974963 - RNA, 21 nt, Human herpesvirus 4 [Epstein-Barr virus]
auccagugcgucagcaacugc

SEQ ID NO: 3974964 - RNA, 22 nt, Human herpesvirus 4 [Epstein-Barr virus]
aucccaauucacaucucaggga

SEQ ID NO: 3974965 - RNA, 15 nt, Human herpesvirus 4 [Epstein-Barr virus]
aucccaggccucagc

SEQ ID NO: 3974966 - RNA, 17 nt, Human herpesvirus 4 [Epstein-Barr virus]
aucccccggacaccaga

SEQ ID NO: 3974967 - RNA, 13 nt, Human herpesvirus 4 [Epstein-Barr virus]
auccgccaggacc

SEQ ID NO: 3974968 - RNA, 15 nt, Human herpesvirus 4 [Epstein-Barr virus]
auccuaggcacggcc

SEQ ID NO: 3974969 - RNA, 11 nt, Human herpesvirus 4 [Epstein-Barr virus]
aucuggcucuc

SEQ ID NO: 3974970 - RNA, 15 nt, Human herpesvirus 4 [Epstein-Barr virus]
aucugggcagccaga

SEQ ID NO: 3974971 - RNA, 14 nt, Human herpesvirus 4 [Epstein-Barr virus]
aucugggcugggac

SEQ ID NO: 3974972 - RNA, 11 nt, Human herpesvirus 4 [Epstein-Barr virus]
aucuguugacg

SEQ ID NO: 3974973 - RNA, 17 nt, Human herpesvirus 4 [Epstein-Barr virus]
aucuuugcugaagauga

SEQ ID NO: 3974974 - RNA, 13 nt, Human herpesvirus 4 [Epstein-Barr virus]
augaacccugggg

SEQ ID NO: 3974975 - RNA, 14 nt, Human herpesvirus 4 [Epstein-Barr virus]
augacccacuccag

SEQ ID NO: 3974976 - RNA, 14 nt, Human herpesvirus 4 [Epstein-Barr virus]
augaggagcaggca

SEQ ID NO: 3974977 - RNA, 21 nt, Human herpesvirus 4 [Epstein-Barr virus]
augauagcagaagacuccugc

SEQ ID NO: 3974978 - RNA, 13 nt, Human herpesvirus 4 [Epstein-Barr virus]
augauccuguaca

SEQ ID NO: 3974979 - RNA, 16 nt, Human herpesvirus 4 [Epstein-Barr virus]
augcagggugcacaga

SEQ ID NO: 3974980 - RNA, 23 nt, Human herpesvirus 4 [Epstein-Barr virus]
augcccccuuuguggugggacug

SEQ ID NO: 3974981 - RNA, 15 nt, Human herpesvirus 4 [Epstein-Barr virus]
augcgauucugaacu

SEQ ID NO: 3974982 - RNA, 16 nt, Human herpesvirus 4 [Epstein-Barr virus]
augcgcgcccugucac

SEQ ID NO: 3974983 - RNA, 17 nt, Human herpesvirus 4 [Epstein-Barr virus]
augcgugaccaccuggc

SEQ ID NO: 3974984 - RNA, 18 nt, Human herpesvirus 4 [Epstein-Barr virus]
augcucagaccccggguu

SEQ ID NO: 3974985 - RNA, 18 nt, Human herpesvirus 4 [Epstein-Barr virus]
augcugccgcuacugcug

SEQ ID NO: 3974986 - RNA, 21 nt, Human herpesvirus 4 [Epstein-Barr virus]
auggacgaggacggggaagag

SEQ ID NO: 3974987 - RNA, 20 nt, Human herpesvirus 4 [Epstein-Barr virus]
uacagcaggauuccugauuu

SEQ ID NO: 3974988 - RNA, 17 nt, Human herpesvirus 4 [Epstein-Barr virus]
uacagugguucuccuga

SEQ ID NO: 3974989 - RNA, 14 nt, Human herpesvirus 4 [Epstein-Barr virus]
uaccaggcauacag

SEQ ID NO: 3974990 - RNA, 14 nt, Human herpesvirus 4 [Epstein-Barr virus]
uacccaacagucuu

SEQ ID NO: 3974991 - RNA, 21 nt, Human herpesvirus 4 [Epstein-Barr virus]
uacccaauuuguucugcaugu

SEQ ID NO: 3974992 - RNA, 18 nt, Human herpesvirus 4 [Epstein-Barr virus]
uacccugcauggccaggc

SEQ ID NO: 3974993 - RNA, 15 nt, Human herpesvirus 4 [Epstein-Barr virus]
uaccgagauguacau

SEQ ID NO: 3974994 - RNA, 18 nt, Human herpesvirus 4 [Epstein-Barr virus]
uaccgaugauucuggcca

SEQ ID NO: 3974995 - RNA, 19 nt, Human herpesvirus 4 [Epstein-Barr virus]
uaccucuguuccuucugcu

SEQ ID NO: 3974996 - RNA, 18 nt, Human herpesvirus 4 [Epstein-Barr virus]
uacgccgccgccagcagc

SEQ ID NO: 3974997 - RNA, 15 nt, Human herpesvirus 4 [Epstein-Barr virus]
uacgcgacugagggg

SEQ ID NO: 3974998 - RNA, 17 nt, Human herpesvirus 4 [Epstein-Barr virus]
uacguguccauguacaa

SEQ ID NO: 3974999 - RNA, 16 nt, Human herpesvirus 4 [Epstein-Barr virus]
uacuaauggaauauua

SEQ ID NO: 3975000 - RNA, 17 nt, Human herpesvirus 4 [Epstein-Barr virus]
uacuccuggcauacuuu

SEQ ID NO: 3975001 - RNA, 19 nt, Human herpesvirus 4 [Epstein-Barr virus]
uacugcgaugagggccuuc

SEQ ID NO: 3975002 - RNA, 11 nt, Human herpesvirus 4 [Epstein-Barr virus]
uacugcugcua

SEQ ID NO: 3975003 - RNA, 19 nt, Human herpesvirus 4 [Epstein-Barr virus]
uacuggcuuucguccucug

SEQ ID NO: 3975004 - RNA, 15 nt, Human herpesvirus 4 [Epstein-Barr virus]
uacuucuuuugcucu

SEQ ID NO: 3975005 - RNA, 20 nt, Human herpesvirus 4 [Epstein-Barr virus]
uagagugccgggcccgggac

SEQ ID NO: 3975006 - RNA, 23 nt, Human herpesvirus 4 [Epstein-Barr virus]
uagauaaauuaagagucccuccu

SEQ ID NO: 3975007 - RNA, 17 nt, Human herpesvirus 4 [Epstein-Barr virus]
uagaugaggagcaggca

SEQ ID NO: 3975008 - RNA, 14 nt, Human herpesvirus 4 [Epstein-Barr virus]
uagaugcugccgcu

SEQ ID NO: 3975009 - RNA, 19 nt, Human herpesvirus 4 [Epstein-Barr virus]
uagccaccguggccaggcc

SEQ ID NO: 3975010 - RNA, 15 nt, Human herpesvirus 4 [Epstein-Barr virus]
uagcccacuccccuc

SEQ ID NO: 3975011 - RNA, 20 nt, Human herpesvirus 4 [Epstein-Barr virus]
uagcgacauuuaccugguga

SEQ ID NO: 3975012 - RNA, 18 nt, Human herpesvirus 4 [Epstein-Barr virus]
uagggacagacccugggc

SEQ ID NO: 3975013 - RNA, 22 nt, Human herpesvirus 4 [Epstein-Barr virus]
uaggggcgaagggugggggugg

SEQ ID NO: 3975014 - RNA, 16 nt, Human herpesvirus 4 [Epstein-Barr virus]
uaguuccaggugacag

SEQ ID NO: 3975015 - RNA, 18 nt, Human herpesvirus 4 [Epstein-Barr virus]
uaucacccauggccaggc

SEQ ID NO: 3975016 - RNA, 17 nt, Human herpesvirus 4 [Epstein-Barr virus]
uaucccugcugucucug

SEQ ID NO: 3975017 - RNA, 14 nt, Human herpesvirus 4 [Epstein-Barr virus]
uaugaaggcuggca

SEQ ID NO: 3975018 - RNA, 18 nt, Human herpesvirus 4 [Epstein-Barr virus]
uaugcaugagccacaggc

SEQ ID NO: 3975019 - RNA, 22 nt, Human herpesvirus 4 [Epstein-Barr virus]
uauuaauaaacaauuacagaua

SEQ ID NO: 3975020 - RNA, 20 nt, Human herpesvirus 4 [Epstein-Barr virus]
uauuaauaaauaucuuccug

SEQ ID NO: 3975021 - RNA, 16 nt, Human herpesvirus 4 [Epstein-Barr virus]
uauugaaaccacgccu

SEQ ID NO: 3975022 - RNA, 23 nt, Human herpesvirus 4 [Epstein-Barr virus]
ucaacaagcuaccgaugauucug

SEQ ID NO: 3975023 - RNA, 20 nt, Human herpesvirus 4 [Epstein-Barr virus]
ucaaccugauucccccugcu

SEQ ID NO: 3975024 - RNA, 21 nt, Human herpesvirus 4 [Epstein-Barr virus]
ucaaccugauucccccugcuc

SEQ ID NO: 3975025 - RNA, 16 nt, Human herpesvirus 4 [Epstein-Barr virus]
ucugcagagagccaca

SEQ ID NO: 3975026 - RNA, 22 nt, Human herpesvirus 4 [Epstein-Barr virus]
ucugcgccagccccgcccuccc

SEQ ID NO: 3975027 - RNA, 17 nt, Human herpesvirus 4 [Epstein-Barr virus]
ucugcugccaugcacgg

SEQ ID NO: 3975028 - RNA, 20 nt, Human herpesvirus 4 [Epstein-Barr virus]
ucugcuucgcguccuuuggg

SEQ ID NO: 3975029 - RNA, 13 nt, Human herpesvirus 4 [Epstein-Barr virus]
ucuggcacugcua

SEQ ID NO: 3975030 - RNA, 23 nt, Human herpesvirus 4 [Epstein-Barr virus]
ucugggcauaaauucuccugccu

SEQ ID NO: 3975031 - RNA, 16 nt, Human herpesvirus 4 [Epstein-Barr virus]
ucuuccccugcagagu

SEQ ID NO: 3975032 - RNA, 14 nt, Human herpesvirus 4 [Epstein-Barr virus]
ucuucucugacaaa

SEQ ID NO: 3975033 - RNA, 12 nt, Human herpesvirus 4 [Epstein-Barr virus]
ucuucugaagga

SEQ ID NO: 3975034 - RNA, 18 nt, Human herpesvirus 4 [Epstein-Barr virus]
ucuugagcgccguggcca

SEQ ID NO: 3975035 - RNA, 19 nt, Human herpesvirus 4 [Epstein-Barr virus]
ucuugauagggauccgcua

SEQ ID NO: 3975036 - RNA, 12 nt, Human herpesvirus 4 [Epstein-Barr virus]
ucuuugcuucac

SEQ ID NO: 3975037 - RNA, 17 nt, Human herpesvirus 4 [Epstein-Barr virus]
ugaacaucucaucccca

SEQ ID NO: 3975038 - RNA, 15 nt, Human herpesvirus 4 [Epstein-Barr virus]
ugaacuuuaacauug

SEQ ID NO: 3975039 - RNA, 16 nt, Human herpesvirus 4 [Epstein-Barr virus]
ugaagauccaacuccg

SEQ ID NO: 3975040 - RNA, 18 nt, Human herpesvirus 4 [Epstein-Barr virus]
ugaagauggccucaaagu

SEQ ID NO: 3975041 - RNA, 18 nt, Human herpesvirus 4 [Epstein-Barr virus]
ugaagcaacccccggcuc

SEQ ID NO: 3975042 - RNA, 11 nt, Human herpesvirus 4 [Epstein-Barr virus]
ugaccaacaug

SEQ ID NO: 3975043 - RNA, 18 nt, Human herpesvirus 4 [Epstein-Barr virus]
ugacuggcagaaaggcug

SEQ ID NO: 3975044 - RNA, 23 nt, Human herpesvirus 4 [Epstein-Barr virus]
ugagaauaaggcucugaagcaac

SEQ ID NO: 3975045 - RNA, 12 nt, Human herpesvirus 4 [Epstein-Barr virus]
ugagaaugccaa

SEQ ID NO: 3975046 - RNA, 20 nt, Human herpesvirus 4 [Epstein-Barr virus]
ugagagccaaaaauuugaua

SEQ ID NO: 3975047 - RNA, 17 nt, Human herpesvirus 4 [Epstein-Barr virus]
ugagcccaccugucuga

SEQ ID NO: 3975048 - RNA, 14 nt, Human herpesvirus 4 [Epstein-Barr virus]
ugagcuauguggaa

SEQ ID NO: 3975049 - RNA, 15 nt, Human herpesvirus 4 [Epstein-Barr virus]
ugaggaaaggccuuu

SEQ ID NO: 3975050 - RNA, 13 nt, Human herpesvirus 4 [Epstein-Barr virus]
ugaggacucugaa

SEQ ID NO: 3975051 - RNA, 15 nt, Human herpesvirus 4 [Epstein-Barr virus]
ugaggcugaugaugg

SEQ ID NO: 3975052 - RNA, 21 nt, Human herpesvirus 4 [Epstein-Barr virus]
ugaggcugaugauggccacga

SEQ ID NO: 3975053 - RNA, 22 nt, Human herpesvirus 4 [Epstein-Barr virus]
ugagggacguaucugggcacuu

SEQ ID NO: 3975054 - RNA, 23 nt, Human herpesvirus 4 [Epstein-Barr virus]
ugagguaaaaagcgggccugagu

SEQ ID NO: 3975055 - RNA, 13 nt, Human herpesvirus 4 [Epstein-Barr virus]
ugaggugggcuga

SEQ ID NO: 3975056 - RNA, 15 nt, Human herpesvirus 4 [Epstein-Barr virus]
ugauaaugucuucaa

SEQ ID NO: 3975057 - RNA, 13 nt, Human herpesvirus 4 [Epstein-Barr virus]
ugcaagcagcacc

SEQ ID NO: 3975058 - RNA, 21 nt, Human herpesvirus 4 [Epstein-Barr virus]
ugcaauaaauaaaaguacaga

SEQ ID NO: 3975059 - RNA, 14 nt, Human herpesvirus 4 [Epstein-Barr virus]
ugcaaugcccaccc

SEQ ID NO: 3975060 - RNA, 16 nt, Human herpesvirus 4 [Epstein-Barr virus]
ugcaccagcuccaggg

SEQ ID NO: 3975061 - RNA, 21 nt, Human herpesvirus 4 [Epstein-Barr virus]
ugcagaggaugagaccagugg

SEQ ID NO: 3975062 - RNA, 18 nt, Human herpesvirus 4 [Epstein-Barr virus]
ugcagcaacgcccaggga

SEQ ID NO: 3975063 - RNA, 15 nt, Human herpesvirus 4 [Epstein-Barr virus]
ugcagcgcaucaggc

SEQ ID NO: 3975064 - RNA, 21 nt, Human herpesvirus 4 [Epstein-Barr virus]
ugcaucuuaccccuggcuucc

SEQ ID NO: 3975065 - RNA, 17 nt, Human herpesvirus 4 [Epstein-Barr virus]
ugccaaagagccagauc

SEQ ID NO: 3975066 - RNA, 21 nt, Human herpesvirus 4 [Epstein-Barr virus]
ugccacauguuuucuggacac

SEQ ID NO: 3975067 - RNA, 12 nt, Human herpesvirus 4 [Epstein-Barr virus]
ugccagaggccc

SEQ ID NO: 3975068 - RNA, 16 nt, Human herpesvirus 4 [Epstein-Barr virus]
ugccaggccugucauu

SEQ ID NO: 3975069 - RNA, 22 nt, Human herpesvirus 4 [Epstein-Barr virus]
ugccauuguuuaccgccaucgc

SEQ ID NO: 3975070 - RNA, 17 nt, Human herpesvirus 4 [Epstein-Barr virus]
ugcccauggaaugcuca

SEQ ID NO: 3975071 - RNA, 21 nt, Human herpesvirus 4 [Epstein-Barr virus]
ugcccccgccagcgccuccuc

SEQ ID NO: 3975072 - RNA, 22 nt, Human herpesvirus 4 [Epstein-Barr virus]
ugcccccuuuguggugggacug

SEQ ID NO: 3975073 - RNA, 22 nt, Human herpesvirus 4 [Epstein-Barr virus]
ugccccggggcuaaccaaggac

SEQ ID NO: 3975074 - RNA, 21 nt, Human herpesvirus 4 [Epstein-Barr virus]
ugccccgguccccccagaagc

SEQ ID NO: 3975075 - RNA, 21 nt, Human herpesvirus 4 [Epstein-Barr virus]
ugcccuccuccacccagcagc

SEQ ID NO: 3975076 - RNA, 18 nt, Human herpesvirus 4 [Epstein-Barr virus]
ugccgugguugggcagaa

SEQ ID NO: 3975077 - RNA, 19 nt, Human herpesvirus 4 [Epstein-Barr virus]
ugccucagauagccggacc

SEQ ID NO: 3975078 - RNA, 23 nt, Human herpesvirus 4 [Epstein-Barr virus]
cuggcacugcuagcgucacugau

SEQ ID NO: 3975079 - RNA, 13 nt, Human herpesvirus 4 [Epstein-Barr virus]
cuggccagcaccc

SEQ ID NO: 3975080 - RNA, 15 nt, Human herpesvirus 4 [Epstein-Barr virus]
cuggccgccguggcc

SEQ ID NO: 3975081 - RNA, 20 nt, Human herpesvirus 4 [Epstein-Barr virus]
cuggccggccgcccccugac

SEQ ID NO: 3975082 - RNA, 16 nt, Human herpesvirus 4 [Epstein-Barr virus]
cuggccguggccaggu

SEQ ID NO: 3975083 - RNA, 13 nt, Human herpesvirus 4 [Epstein-Barr virus]
cuggccugccugg

SEQ ID NO: 3975084 - RNA, 9 nt, Human herpesvirus 4 [Epstein-Barr virus]
cuggcucuc

SEQ ID NO: 3975085 - RNA, 14 nt, Human herpesvirus 4 [Epstein-Barr virus]
cuggcugugcugac

SEQ ID NO: 3975086 - RNA, 17 nt, Human herpesvirus 4 [Epstein-Barr virus]
cuggcuucugugacuuu

SEQ ID NO: 3975087 - RNA, 12 nt, Human herpesvirus 4 [Epstein-Barr virus]
cugggaggugcu

SEQ ID NO: 3975088 - RNA, 20 nt, Human herpesvirus 4 [Epstein-Barr virus]
cugggcauaaauucuccugc

SEQ ID NO: 3975089 - RNA, 21 nt, Human herpesvirus 4 [Epstein-Barr virus]
cugggcauaaauucuccugcc

SEQ ID NO: 3975090 - RNA, 22 nt, Human herpesvirus 4 [Epstein-Barr virus]
cugggcugccccgggcccaccc

SEQ ID NO: 3975091 - RNA, 16 nt, Human herpesvirus 4 [Epstein-Barr virus]
cuggggcuggccugcc

SEQ ID NO: 3975092 - RNA, 14 nt, Human herpesvirus 4 [Epstein-Barr virus]
cuggggcugguggc

SEQ ID NO: 3975093 - RNA, 20 nt, Human herpesvirus 4 [Epstein-Barr virus]
cuggucuccuuguugaccuc

SEQ ID NO: 3975094 - RNA, 16 nt, Human herpesvirus 4 [Epstein-Barr virus]
cuggucuuuuaugagc

SEQ ID NO: 3975095 - RNA, 22 nt, Human herpesvirus 4 [Epstein-Barr virus]
cuguacgccgccgccagcagcc

SEQ ID NO: 3975096 - RNA, 21 nt, Human herpesvirus 4 [Epstein-Barr virus]
cuguacuugggauugcaacac

SEQ ID NO: 3975097 - RNA, 19 nt, Human herpesvirus 4 [Epstein-Barr virus]
cuguaguggccuucucuga

SEQ ID NO: 3975098 - RNA, 15 nt, Human herpesvirus 4 [Epstein-Barr virus]
cuguauuuacaaaca

SEQ ID NO: 3975099 - RNA, 15 nt, Human herpesvirus 4 [Epstein-Barr virus]
cugucagacacucca

SEQ ID NO: 3975100 - RNA, 23 nt, Human herpesvirus 4 [Epstein-Barr virus]
cugucauucuaucaauuaaacaa

SEQ ID NO: 3975101 - RNA, 15 nt, Human herpesvirus 4 [Epstein-Barr virus]
cuguccuugucugcu

SEQ ID NO: 3975102 - RNA, 19 nt, Human herpesvirus 4 [Epstein-Barr virus]
cuguccuugucugcugcca

SEQ ID NO: 3975103 - RNA, 18 nt, Human herpesvirus 4 [Epstein-Barr virus]
cugugcagggacgaggac

SEQ ID NO: 3975104 - RNA, 16 nt, Human herpesvirus 4 [Epstein-Barr virus]
cugugcugacccuucu

SEQ ID NO: 3975105 - RNA, 14 nt, Human herpesvirus 4 [Epstein-Barr virus]
cugugguugucuuc

SEQ ID NO: 3975106 - RNA, 21 nt, Human herpesvirus 4 [Epstein-Barr virus]
cugugucccacuccaccugcc

SEQ ID NO: 3975107 - RNA, 15 nt, Human herpesvirus 4 [Epstein-Barr virus]
cugugugaccccuca

SEQ ID NO: 3975108 - RNA, 20 nt, Human herpesvirus 4 [Epstein-Barr virus]
cuguucaaacagcagcagca

SEQ ID NO: 3975109 - RNA, 16 nt, Human herpesvirus 4 [Epstein-Barr virus]
cuuagccacacugucu

SEQ ID NO: 3975110 - RNA, 21 nt, Human herpesvirus 4 [Epstein-Barr virus]
cuuauguuucaagcagcucac

SEQ ID NO: 3975111 - RNA, 21 nt, Human herpesvirus 4 [Epstein-Barr virus]
cuucaagauugggugguggca

SEQ ID NO: 3975112 - RNA, 22 nt, Human herpesvirus 4 [Epstein-Barr virus]
cuucagcaguagcuugggaaca

SEQ ID NO: 3975113 - RNA, 18 nt, Human herpesvirus 4 [Epstein-Barr virus]
cuucaggggaaucucugc

SEQ ID NO: 3975114 - RNA, 16 nt, Human herpesvirus 4 [Epstein-Barr virus]
cuuccagagaggcgca

SEQ ID NO: 3975115 - RNA, 9 nt, Human herpesvirus 4 [Epstein-Barr virus]
cuuccuguc

SEQ ID NO: 3975116 - RNA, 18 nt, Human herpesvirus 4 [Epstein-Barr virus]
cuucucuagagccaggcu

SEQ ID NO: 3975117 - RNA, 18 nt, Human herpesvirus 4 [Epstein-Barr virus]
cuucugaaaacugccucc

SEQ ID NO: 3975118 - RNA, 13 nt, Human herpesvirus 4 [Epstein-Barr virus]
cuucugcugcugc

SEQ ID NO: 3975119 - RNA, 16 nt, Human herpesvirus 4 [Epstein-Barr virus]
cuugccaauuggggug

SEQ ID NO: 3975120 - RNA, 22 nt, Human herpesvirus 4 [Epstein-Barr virus]
cuugcguggugcuguccugcug

SEQ ID NO: 3975121 - RNA, 15 nt, Human herpesvirus 4 [Epstein-Barr virus]
cuugcucgcagcugg

SEQ ID NO: 3975122 - RNA, 14 nt, Human herpesvirus 4 [Epstein-Barr virus]
cuugcucucagcac

SEQ ID NO: 3975123 - RNA, 16 nt, Human herpesvirus 4 [Epstein-Barr virus]
cuuggacccugcugcg

SEQ ID NO: 3975124 - RNA, 16 nt, Human herpesvirus 4 [Epstein-Barr virus]
cuuggcagcaguggcc

SEQ ID NO: 3975125 - RNA, 18 nt, Human herpesvirus 4 [Epstein-Barr virus]
cuuggccccuguguacau

SEQ ID NO: 3975126 - RNA, 16 nt, Human herpesvirus 4 [Epstein-Barr virus]
cuuggucaagguguca

SEQ ID NO: 3975127 - RNA, 14 nt, Human herpesvirus 4 [Epstein-Barr virus]
cuugugcuuguacu

SEQ ID NO: 3975128 - RNA, 17 nt, Human herpesvirus 4 [Epstein-Barr virus]
cuugugguucuccugau

SEQ ID NO: 3975129 - RNA, 15 nt, Human herpesvirus 4 [Epstein-Barr virus]
cuuguuucucagaga

SEQ ID NO: 3975130 - RNA, 17 nt, Human herpesvirus 4 [Epstein-Barr virus]
cuuuaaaggggagaugu

SEQ ID NO: 3975131 - RNA, 12 nt, Human herpesvirus 4 [Epstein-Barr virus]
cuuuauaugaaa

SEQ ID NO: 3975132 - RNA, 13 nt, Human herpesvirus 4 [Epstein-Barr virus]
cuuuccaguuccc

SEQ ID NO: 3975133 - RNA, 18 nt, Human herpesvirus 4 [Epstein-Barr virus]
cuuuuacccccuggccac

SEQ ID NO: 3975134 - RNA, 23 nt, Human herpesvirus 4 [Epstein-Barr virus]
cuuuucuccucagucuuugcaau

SEQ ID NO: 3975135 - RNA, 16 nt, Human herpesvirus 4 [Epstein-Barr virus]
gaaaagagagcugaug

SEQ ID NO: 3975136 - RNA, 17 nt, Human herpesvirus 4 [Epstein-Barr virus]
gaaaaucugcuucuccc

SEQ ID NO: 3975137 - RNA, 19 nt, Human herpesvirus 4 [Epstein-Barr virus]
gaaaccacgccugcuucac

SEQ ID NO: 3975138 - RNA, 23 nt, Human herpesvirus 4 [Epstein-Barr virus]
gaaacccaaguuuccuugccauc

SEQ ID NO: 3975139 - RNA, 14 nt, Human herpesvirus 4 [Epstein-Barr virus]
gaaagaggcucugc

SEQ ID NO: 3975140 - RNA, 16 nt, Human herpesvirus 4 [Epstein-Barr virus]
gaacaacugucagaca

SEQ ID NO: 3975141 - RNA, 22 nt, Human herpesvirus 4 [Epstein-Barr virus]
gaacaauuccccggggacaccu

SEQ ID NO: 3975142 - RNA, 20 nt, Human herpesvirus 4 [Epstein-Barr virus]
gaacacggcaccgucagcca

SEQ ID NO: 3975143 - RNA, 17 nt, Human herpesvirus 4 [Epstein-Barr virus]
gaacaggagcaggagca

SEQ ID NO: 3975144 - RNA, 20 nt, Human herpesvirus 4 [Epstein-Barr virus]
gaacaguaaacacugccaua

SEQ ID NO: 3975145 - RNA, 19 nt, Human herpesvirus 4 [Epstein-Barr virus]
gaacaucuggcuggggcau

SEQ ID NO: 3975146 - RNA, 18 nt, Human herpesvirus 4 [Epstein-Barr virus]
gaaccugagccugagcca

SEQ ID NO: 3975147 - RNA, 19 nt, Human herpesvirus 4 [Epstein-Barr virus]
gaacguggagguugucaaa

SEQ ID NO: 3975148 - RNA, 23 nt, Human herpesvirus 4 [Epstein-Barr virus]
gaacucugcccuucagugucugg

SEQ ID NO: 3975149 - RNA, 22 nt, Human herpesvirus 4 [Epstein-Barr virus]
gaacugggaugaacccuggggc

SEQ ID NO: 3975150 - RNA, 13 nt, Human herpesvirus 4 [Epstein-Barr virus]
gaagacgaggaga

SEQ ID NO: 3975151 - RNA, 21 nt, Human herpesvirus 4 [Epstein-Barr virus]
gaagacuguuggguagauggc

SEQ ID NO: 3975152 - RNA, 21 nt, Human herpesvirus 4 [Epstein-Barr virus]
gaagagccgcuccguggcccc

SEQ ID NO: 3975153 - RNA, 16 nt, Human herpesvirus 4 [Epstein-Barr virus]
gaagaguacgugcaga

SEQ ID NO: 3975154 - RNA, 17 nt, Human herpesvirus 4 [Epstein-Barr virus]
gaagauugucacagcug

SEQ ID NO: 3975155 - RNA, 22 nt, Human herpesvirus 4 [Epstein-Barr virus]
gaagcagauagccggccaggca

SEQ ID NO: 3975156 - RNA, 23 nt, Human herpesvirus 4 [Epstein-Barr virus]
gaagcccaagaagaagcccaccu

SEQ ID NO: 3975157 - RNA, 23 nt, Human herpesvirus 4 [Epstein-Barr virus]
gaagcgccgguacuuguuaagga

SEQ ID NO: 3975158 - RNA, 21 nt, Human herpesvirus 4 [Epstein-Barr virus]
gaagcggggcugggugggaga

SEQ ID NO: 3975159 - RNA, 17 nt, Human herpesvirus 4 [Epstein-Barr virus]
gaagcguucuucacugu

SEQ ID NO: 3975160 - RNA, 23 nt, Human herpesvirus 4 [Epstein-Barr virus]
gaagcuacaaacacgggccuggg

SEQ ID NO: 3975161 - RNA, 23 nt, Human herpesvirus 4 [Epstein-Barr virus]
gaagcuagugcagggggcucggc

SEQ ID NO: 3975162 - RNA, 18 nt, Human herpesvirus 4 [Epstein-Barr virus]
gaaggcgcaggggagggg

SEQ ID NO: 3975163 - RNA, 24 nt, Human herpesvirus 4 [Epstein-Barr virus]
gaaggcuccggcggcaguggaccu

SEQ ID NO: 3975164 - RNA, 14 nt, Human herpesvirus 4 [Epstein-Barr virus]
gaaggcuugccaaa

SEQ ID NO: 3975165 - RNA, 19 nt, Human herpesvirus 4 [Epstein-Barr virus]
uggcagccgcggccaucac

SEQ ID NO: 3975166 - RNA, 15 nt, Human herpesvirus 4 [Epstein-Barr virus]
uggcauaauuuccuc

SEQ ID NO: 3975167 - RNA, 22 nt, Human herpesvirus 4 [Epstein-Barr virus]
uggccaccacaucggacgggca

SEQ ID NO: 3975168 - RNA, 15 nt, Human herpesvirus 4 [Epstein-Barr virus]
uggccccuguguaca

SEQ ID NO: 3975169 - RNA, 16 nt, Human herpesvirus 4 [Epstein-Barr virus]
uggccgcggcccaggu

SEQ ID NO: 3975170 - RNA, 17 nt, Human herpesvirus 4 [Epstein-Barr virus]
uggcgaagauucccaac

SEQ ID NO: 3975171 - RNA, 19 nt, Human herpesvirus 4 [Epstein-Barr virus]
uggcgccguuugacuguuu

SEQ ID NO: 3975172 - RNA, 15 nt, Human herpesvirus 4 [Epstein-Barr virus]
uggcggcccagcccg

SEQ ID NO: 3975173 - RNA, 14 nt, Human herpesvirus 4 [Epstein-Barr virus]
uggcuacuugcuca

SEQ ID NO: 3975174 - RNA, 21 nt, Human herpesvirus 4 [Epstein-Barr virus]
uggcuccccauagacucccau

SEQ ID NO: 3975175 - RNA, 18 nt, Human herpesvirus 4 [Epstein-Barr virus]
uggcugccgaagcagaug

SEQ ID NO: 3975176 - RNA, 13 nt, Human herpesvirus 4 [Epstein-Barr virus]
uggcuugcuccac

SEQ ID NO: 3975177 - RNA, 20 nt, Human herpesvirus 4 [Epstein-Barr virus]
uggcuugcuccaccagcuuc

SEQ ID NO: 3975178 - RNA, 17 nt, Human herpesvirus 4 [Epstein-Barr virus]
ugggaacaccgggcagg

SEQ ID NO: 3975179 - RNA, 15 nt, Human herpesvirus 4 [Epstein-Barr virus]
ugggaccuacaggac

SEQ ID NO: 3975180 - RNA, 17 nt, Human herpesvirus 4 [Epstein-Barr virus]
ugggagcaaccagcugg

SEQ ID NO: 3975181 - RNA, 14 nt, Human herpesvirus 4 [Epstein-Barr virus]
ugggagcacauucc

SEQ ID NO: 3975182 - RNA, 17 nt, Human herpesvirus 4 [Epstein-Barr virus]
ugggccacugcaggcug

SEQ ID NO: 3975183 - RNA, 17 nt, Human herpesvirus 4 [Epstein-Barr virus]
ugggccucucuggcugu

SEQ ID NO: 3975184 - RNA, 15 nt, Human herpesvirus 4 [Epstein-Barr virus]
ugggcuugauggccc

SEQ ID NO: 3975185 - RNA, 13 nt, Human herpesvirus 4 [Epstein-Barr virus]
ugggcuuggguca

SEQ ID NO: 3975186 - RNA, 12 nt, Human herpesvirus 4 [Epstein-Barr virus]
uggggcaauggc

SEQ ID NO: 3975187 - RNA, 23 nt, Human herpesvirus 4 [Epstein-Barr virus]
uggggccaccggggaggccaggu

SEQ ID NO: 3975188 - RNA, 12 nt, Human herpesvirus 4 [Epstein-Barr virus]
ugggggcuacag

SEQ ID NO: 3975189 - RNA, 17 nt, Human herpesvirus 4 [Epstein-Barr virus]
ugggguccggucuugca

SEQ ID NO: 3975190 - RNA, 16 nt, Human herpesvirus 4 [Epstein-Barr virus]
ugggugcacagguggc

SEQ ID NO: 3975191 - RNA, 14 nt, Human herpesvirus 4 [Epstein-Barr virus]
uggugcuguccugc

SEQ ID NO: 3975192 - RNA, 20 nt, Human herpesvirus 4 [Epstein-Barr virus]
ugguggccggcagccuggcu

SEQ ID NO: 3975193 - RNA, 21 nt, Human herpesvirus 4 [Epstein-Barr virus]
uggugggcuccuuagacugag

SEQ ID NO: 3975194 - RNA, 22 nt, Human herpesvirus 4 [Epstein-Barr virus]
ugguguauuucuggccaucugu

SEQ ID NO: 3975195 - RNA, 15 nt, Human herpesvirus 4 [Epstein-Barr virus]
ugguucuccugauuu

SEQ ID NO: 3975196 - RNA, 14 nt, Human herpesvirus 4 [Epstein-Barr virus]
ugguugucuuccca

SEQ ID NO: 3975197 - RNA, 15 nt, Human herpesvirus 4 [Epstein-Barr virus]
uguaaccuaugccug

SEQ ID NO: 3975198 - RNA, 23 nt, Human herpesvirus 4 [Epstein-Barr virus]
uguagguguccagcgcucugguc

SEQ ID NO: 3975199 - RNA, 17 nt, Human herpesvirus 4 [Epstein-Barr virus]
uguauaaugacuaugag

SEQ ID NO: 3975200 - RNA, 14 nt, Human herpesvirus 4 [Epstein-Barr virus]
uguccagcagggcc

SEQ ID NO: 3975201 - RNA, 13 nt, Human herpesvirus 4 [Epstein-Barr virus]
ugucccccuagcc

SEQ ID NO: 3975202 - RNA, 21 nt, Human herpesvirus 4 [Epstein-Barr virus]
uguccgcagguggcugcugcc

SEQ ID NO: 3975203 - RNA, 15 nt, Human herpesvirus 4 [Epstein-Barr virus]
uguccugcugaaggg

SEQ ID NO: 3975204 - RNA, 16 nt, Human herpesvirus 4 [Epstein-Barr virus]
ugucgagcaugagcuc

SEQ ID NO: 3975205 - RNA, 18 nt, Human herpesvirus 4 [Epstein-Barr virus]
ugucugugguugucuucc

SEQ ID NO: 3975206 - RNA, 20 nt, Human herpesvirus 4 [Epstein-Barr virus]
ugugcugacccuucugcugc

SEQ ID NO: 3975207 - RNA, 17 nt, Human herpesvirus 4 [Epstein-Barr virus]
uguggugggacugagau

SEQ ID NO: 3975208 - RNA, 16 nt, Human herpesvirus 4 [Epstein-Barr virus]
uguguggcuguagcca

SEQ ID NO: 3975209 - RNA, 20 nt, Human herpesvirus 4 [Epstein-Barr virus]
uguuacccucauugugcuga

SEQ ID NO: 3975210 - RNA, 14 nt, Human herpesvirus 4 [Epstein-Barr virus]
uguuccuucucaug

SEQ ID NO: 3975211 - RNA, 21 nt, Human herpesvirus 4 [Epstein-Barr virus]
uguuucucagagagcauuuca

SEQ ID NO: 3975212 - RNA, 23 nt, Human herpesvirus 4 [Epstein-Barr virus]
uuaacgggaggaaacaggaggag

SEQ ID NO: 3975213 - RNA, 18 nt, Human herpesvirus 4 [Epstein-Barr virus]
uuaagagucccuccucac

SEQ ID NO: 3975214 - RNA, 20 nt, Human herpesvirus 4 [Epstein-Barr virus]
uuagccccagccccuccucu

SEQ ID NO: 3975215 - RNA, 23 nt, Human herpesvirus 4 [Epstein-Barr virus]
uuagccuaauuguguauugcucu

SEQ ID NO: 3975216 - RNA, 15 nt, Human herpesvirus 4 [Epstein-Barr virus]
uuauacccaauuugu

SEQ ID NO: 3975217 - RNA, 22 nt, Human herpesvirus 4 [Epstein-Barr virus]
uuaugagcgauuuuaucacagg

SEQ ID NO: 3975218 - RNA, 17 nt, Human herpesvirus 4 [Epstein-Barr virus]
uucccggacaauacacc

SEQ ID NO: 3975219 - RNA, 14 nt, Human herpesvirus 4 [Epstein-Barr virus]
uucgacugucauuu

SEQ ID NO: 3975220 - RNA, 15 nt, Human herpesvirus 4 [Epstein-Barr virus]
uucuacgaugaggaa

SEQ ID NO: 3975221 - RNA, 12 nt, Human herpesvirus 4 [Epstein-Barr virus]
uucuccugauuu

SEQ ID NO: 3975222 - RNA, 19 nt, Human herpesvirus 4 [Epstein-Barr virus]
uucucuaaucccucuggga

SEQ ID NO: 3975223 - RNA, 21 nt, Human herpesvirus 4 [Epstein-Barr virus]
uucugcauguuauuacugauu

SEQ ID NO: 3975224 - RNA, 15 nt, Human herpesvirus 4 [Epstein-Barr virus]
uucugcugcugcugg

SEQ ID NO: 3975225 - RNA, 16 nt, Human herpesvirus 4 [Epstein-Barr virus]
uucuggaaugcuucua

SEQ ID NO: 3975226 - RNA, 14 nt, Human herpesvirus 4 [Epstein-Barr virus]
uucugucucggccu

SEQ ID NO: 3975227 - RNA, 20 nt, Human herpesvirus 4 [Epstein-Barr virus]
uucuguuaaggcuguugaca

SEQ ID NO: 3975228 - RNA, 19 nt, Human herpesvirus 4 [Epstein-Barr virus]
uugacacccccagcgcugg

SEQ ID NO: 3975229 - RNA, 15 nt, Human herpesvirus 4 [Epstein-Barr virus]
uugaucuucuucucc

SEQ ID NO: 3975230 - RNA, 22 nt, Human herpesvirus 4 [Epstein-Barr virus]
uugcccucuccagcaaccaaug

SEQ ID NO: 3975231 - RNA, 12 nt, Human herpesvirus 4 [Epstein-Barr virus]
uugggggggugg

SEQ ID NO: 3975232 - RNA, 15 nt, Human herpesvirus 4 [Epstein-Barr virus]
uuguaagacaaucac

SEQ ID NO: 3975233 - RNA, 17 nt, Human herpesvirus 4 [Epstein-Barr virus]
uugucccugagauguga

SEQ ID NO: 3975234 - RNA, 20 nt, Human herpesvirus 4 [Epstein-Barr virus]
uugucuacaucccauaccua

SEQ ID NO: 3975235 - RNA, 15 nt, Human herpesvirus 4 [Epstein-Barr virus]
uugugugccuccuca

SEQ ID NO: 3975236 - RNA, 17 nt, Human herpesvirus 4 [Epstein-Barr virus]
uuguuaaggaacacggu

SEQ ID NO: 3975237 - RNA, 16 nt, Human herpesvirus 4 [Epstein-Barr virus]
uuguuaguuuaaacag

SEQ ID NO: 3975238 - RNA, 22 nt, Human herpesvirus 4 [Epstein-Barr virus]
uuuacuaauggaauauuaauaa

SEQ ID NO: 3975239 - RNA, 13 nt, Human herpesvirus 4 [Epstein-Barr virus]
uuucugaccuuua

SEQ ID NO: 3975240 - RNA, 12 nt, Human herpesvirus 4 [Epstein-Barr virus]
uuucuguacaau

SEQ ID NO: 3975241 - RNA, 13 nt, Human herpesvirus 4 [Epstein-Barr virus]
uuucuuugcuuca

SEQ ID NO: 3975242 - RNA, 17 nt, Human herpesvirus 4 [Epstein-Barr virus]
uuugccuugugugcugu

SEQ ID NO: 3975243 - RNA, 17 nt, Human herpesvirus 4 [Epstein-Barr virus]
uuugcuaucuuugcuga

SEQ ID NO: 3975244 - RNA, 12 nt, Human herpesvirus 4 [Epstein-Barr virus]
uuuggcaacgag

SEQ ID NO: 3975245 - RNA, 22 nt, Human herpesvirus 4 [Epstein-Barr virus]
uuugggcacacuuaacuugacu

SEQ ID NO: 3975246 - RNA, 18 nt, Human herpesvirus 4 [Epstein-Barr virus]
cugacucucauguacuuu

SEQ ID NO: 3975247 - RNA, 18 nt, Human herpesvirus 4 [Epstein-Barr virus]
cugagacagaggugcuca

SEQ ID NO: 3975248 - RNA, 16 nt, Human herpesvirus 4 [Epstein-Barr virus]
cugagaccaugcucag

SEQ ID NO: 3975249 - RNA, 15 nt, Human herpesvirus 4 [Epstein-Barr virus]
cugagcaccaacaca

SEQ ID NO: 3975250 - RNA, 20 nt, Human herpesvirus 4 [Epstein-Barr virus]
cugagcagggcaaagccaca

SEQ ID NO: 3975251 - RNA, 19 nt, Human herpesvirus 4 [Epstein-Barr virus]
cugagccugagccacaccc

SEQ ID NO: 3975252 - RNA, 22 nt, Human herpesvirus 4 [Epstein-Barr virus]
cugaggguugguguccucccgg

SEQ ID NO: 3975253 - RNA, 18 nt, Human herpesvirus 4 [Epstein-Barr virus]
cugauggcaaagguccca

SEQ ID NO: 3975254 - RNA, 18 nt, Human herpesvirus 4 [Epstein-Barr virus]
cugauucccccugcucau

SEQ ID NO: 3975255 - RNA, 15 nt, Human herpesvirus 4 [Epstein-Barr virus]
cugcaaagggaccca

SEQ ID NO: 3975256 - RNA, 17 nt, Human herpesvirus 4 [Epstein-Barr virus]
cugcaccaguggcugcc

SEQ ID NO: 3975257 - RNA, 20 nt, Human herpesvirus 4 [Epstein-Barr virus]
cugcacgagaccccugggcu

SEQ ID NO: 3975258 - RNA, 14 nt, Human herpesvirus 4 [Epstein-Barr virus]
cugcauggccaggc

SEQ ID NO: 3975259 - RNA, 22 nt, Human herpesvirus 4 [Epstein-Barr virus]
cugccaacuuugagcugggcaa

SEQ ID NO: 3975260 - RNA, 17 nt, Human herpesvirus 4 [Epstein-Barr virus]
cugccacaaggccagcu

SEQ ID NO: 3975261 - RNA, 23 nt, Human herpesvirus 4 [Epstein-Barr virus]
cugcccuagagguuuugcuaggg

SEQ ID NO: 3975262 - RNA, 19 nt, Human herpesvirus 4 [Epstein-Barr virus]
cugccgcuacugcugcuac

SEQ ID NO: 3975263 - RNA, 14 nt, Human herpesvirus 4 [Epstein-Barr virus]
cugccuaacggucg

SEQ ID NO: 3975264 - RNA, 19 nt, Human herpesvirus 4 [Epstein-Barr virus]
cugcgagggggccuggugc

SEQ ID NO: 3975265 - RNA, 18 nt, Human herpesvirus 4 [Epstein-Barr virus]
cugcgguugucacuuucu

SEQ ID NO: 3975266 - RNA, 14 nt, Human herpesvirus 4 [Epstein-Barr virus]
cugcguagaugagc

SEQ ID NO: 3975267 - RNA, 18 nt, Human herpesvirus 4 [Epstein-Barr virus]
cugcguccaccuggccac

SEQ ID NO: 3975268 - RNA, 13 nt, Human herpesvirus 4 [Epstein-Barr virus]
cugcguccucuac

SEQ ID NO: 3975269 - RNA, 19 nt, Human herpesvirus 4 [Epstein-Barr virus]
cugcguccucuaccugguc

SEQ ID NO: 3975270 - RNA, 16 nt, Human herpesvirus 4 [Epstein-Barr virus]
cugcucucucuggaga

SEQ ID NO: 3975271 - RNA, 13 nt, Human herpesvirus 4 [Epstein-Barr virus]
cugcugcagcacu

SEQ ID NO: 3975272 - RNA, 15 nt, Human herpesvirus 4 [Epstein-Barr virus]
cugcugcugcugguc

SEQ ID NO: 3975273 - RNA, 13 nt, Human herpesvirus 4 [Epstein-Barr virus]
cugcuggucaugg

SEQ ID NO: 3975274 - RNA, 22 nt, Human herpesvirus 4 [Epstein-Barr virus]
cuggacacaagagccaucaccu

SEQ ID NO: 3975275 - RNA, 15 nt, Human herpesvirus 4 [Epstein-Barr virus]
cuggacguggcugcg

SEQ ID NO: 3975276 - RNA, 20 nt, Human herpesvirus 4 [Epstein-Barr virus]
cuggaggccucaggcaacaa

SEQ ID NO: 3975277 - RNA, 18 nt, Human herpesvirus 4 [Epstein-Barr virus]
cuggaucuggggcuggcc

SEQ ID NO: 3975278 - RNA, 23 nt, Human herpesvirus 4 [Epstein-Barr virus]
cuggcauacuuuuugccacccag

SEQ ID NO: 3975279 - RNA, 12 nt, Human herpesvirus 4 [Epstein-Barr virus]
cuggccagcacc

SEQ ID NO: 3975280 - RNA, 16 nt, Human herpesvirus 4 [Epstein-Barr virus]
cuggccaggcugguga

SEQ ID NO: 3975281 - RNA, 20 nt, Human herpesvirus 4 [Epstein-Barr virus]
cuggccaugaaucugacucu

SEQ ID NO: 3975282 - RNA, 15 nt, Human herpesvirus 4 [Epstein-Barr virus]
cuggccguggccagg

SEQ ID NO: 3975283 - RNA, 18 nt, Human herpesvirus 4 [Epstein-Barr virus]
cuggccguggccagguac

SEQ ID NO: 3975284 - RNA, 13 nt, Human herpesvirus 4 [Epstein-Barr virus]
cuggcucuccugu

SEQ ID NO: 3975285 - RNA, 22 nt, Human herpesvirus 4 [Epstein-Barr virus]
cuggcuguacgccgccgccagc

SEQ ID NO: 3975286 - RNA, 17 nt, Human herpesvirus 4 [Epstein-Barr virus]
cuggcugugcugacccu

SEQ ID NO: 3975287 - RNA, 20 nt, Human herpesvirus 4 [Epstein-Barr virus]
cuggcugugcugacccuucu

SEQ ID NO: 3975288 - RNA, 15 nt, Human herpesvirus 4 [Epstein-Barr virus]
cuggggcugguggcc

SEQ ID NO: 3975289 - RNA, 13 nt, Human herpesvirus 4 [Epstein-Barr virus]
cugguaguaggca

SEQ ID NO: 3975290 - RNA, 19 nt, Human herpesvirus 4 [Epstein-Barr virus]
cugguggccugggaggugc

SEQ ID NO: 3975291 - RNA, 15 nt, Human herpesvirus 4 [Epstein-Barr virus]
cugguuggggcugcu

SEQ ID NO: 3975292 - RNA, 20 nt, Human herpesvirus 4 [Epstein-Barr virus]
cuguaaacuauggaggcccc

SEQ ID NO: 3975293 - RNA, 22 nt, Human herpesvirus 4 [Epstein-Barr virus]
cuguaacugugguuuccaugac

SEQ ID NO: 3975294 - RNA, 15 nt, Human herpesvirus 4 [Epstein-Barr virus]
cugucaccaccuccc

SEQ ID NO: 3975295 - RNA, 14 nt, Human herpesvirus 4 [Epstein-Barr virus]
cugucaccaggccu

SEQ ID NO: 3975296 - RNA, 14 nt, Human herpesvirus 4 [Epstein-Barr virus]
cugucacugugcac

SEQ ID NO: 3975297 - RNA, 16 nt, Human herpesvirus 4 [Epstein-Barr virus]
cugucccuggagcugg

SEQ ID NO: 3975298 - RNA, 21 nt, Human herpesvirus 4 [Epstein-Barr virus]
cugucccugggggccuguguc

SEQ ID NO: 3975299 - RNA, 20 nt, Human herpesvirus 4 [Epstein-Barr virus]
cugucucggccuccuggcca

SEQ ID NO: 3975300 - RNA, 14 nt, Human herpesvirus 4 [Epstein-Barr virus]
cugucuugucacca

SEQ ID NO: 3975301 - RNA, 17 nt, Human herpesvirus 4 [Epstein-Barr virus]
cugugcacucucucccc

SEQ ID NO: 3975302 - RNA, 21 nt, Human herpesvirus 4 [Epstein-Barr virus]
cugugugcgcgccgccagcau

SEQ ID NO: 3975303 - RNA, 16 nt, Human herpesvirus 4 [Epstein-Barr virus]
cuguucaaacagcagc

SEQ ID NO: 3975304 - RNA, 16 nt, Human herpesvirus 4 [Epstein-Barr virus]
cuguuccuucugcucc

SEQ ID NO: 3975305 - RNA, 13 nt, Human herpesvirus 4 [Epstein-Barr virus]
cuuacagccagag

SEQ ID NO: 3975306 - RNA, 15 nt, Human herpesvirus 4 [Epstein-Barr virus]
cuuacuccccuaccc

SEQ ID NO: 3975307 - RNA, 13 nt, Human herpesvirus 4 [Epstein-Barr virus]
cuuaugcagcacc

SEQ ID NO: 3975308 - RNA, 19 nt, Human herpesvirus 4 [Epstein-Barr virus]
cuuauguuucaagcagcuc

SEQ ID NO: 3975309 - RNA, 18 nt, Human herpesvirus 4 [Epstein-Barr virus]
cuucagcuccagggccag

SEQ ID NO: 3975310 - RNA, 20 nt, Human herpesvirus 4 [Epstein-Barr virus]
cuucagcuccagggccagca

SEQ ID NO: 3975311 - RNA, 23 nt, Human herpesvirus 4 [Epstein-Barr virus]
cuucaggggaaucucugccaacu

SEQ ID NO: 3975312 - RNA, 16 nt, Human herpesvirus 4 [Epstein-Barr virus]
cuuccagaaaaugccg

SEQ ID NO: 3975313 - RNA, 22 nt, Human herpesvirus 4 [Epstein-Barr virus]
cuucggucaaguaccagcuggu

SEQ ID NO: 3975314 - RNA, 21 nt, Human herpesvirus 4 [Epstein-Barr virus]
cuucuaggcauuaccauguca

SEQ ID NO: 3975315 - RNA, 19 nt, Human herpesvirus 4 [Epstein-Barr virus]
cuucucccacccuguacac

SEQ ID NO: 3975316 - RNA, 21 nt, Human herpesvirus 4 [Epstein-Barr virus]
cuucugaggcggcuguggccu

SEQ ID NO: 3975317 - RNA, 12 nt, Human herpesvirus 4 [Epstein-Barr virus]
cuucugcugcug

SEQ ID NO: 3975318 - RNA, 23 nt, Human herpesvirus 4 [Epstein-Barr virus]
cuucugcugcugcuggucauggc

SEQ ID NO: 3975319 - RNA, 14 nt, Human herpesvirus 4 [Epstein-Barr virus]
cuugaacgugugcu

SEQ ID NO: 3975320 - RNA, 21 nt, Human herpesvirus 4 [Epstein-Barr virus]
cuugaccaguguguacauucc

SEQ ID NO: 3975321 - RNA, 22 nt, Human herpesvirus 4 [Epstein-Barr virus]
cuugaccaguguguacauucca

SEQ ID NO: 3975322 - RNA, 21 nt, Human herpesvirus 4 [Epstein-Barr virus]
cuugacgugcaaggauggaag

SEQ ID NO: 3975323 - RNA, 15 nt, Human herpesvirus 4 [Epstein-Barr virus]
cuugaggugggcuga

SEQ ID NO: 3975324 - RNA, 19 nt, Human herpesvirus 4 [Epstein-Barr virus]
cuugaucuucuucucccuc

SEQ ID NO: 3975325 - RNA, 13 nt, Human herpesvirus 4 [Epstein-Barr virus]
cuugcacccaccc

SEQ ID NO: 3975326 - RNA, 16 nt, Human herpesvirus 4 [Epstein-Barr virus]
cuugcacccaccccca

SEQ ID NO: 3975327 - RNA, 23 nt, Human herpesvirus 4 [Epstein-Barr virus]
cuuggacuucucauuagucagga

SEQ ID NO: 3975328 - RNA, 13 nt, Human herpesvirus 4 [Epstein-Barr virus]
cuuggaggcugcu

SEQ ID NO: 3975329 - RNA, 23 nt, Human herpesvirus 4 [Epstein-Barr virus]
cuuggcccucucacuucuacucu

SEQ ID NO: 3975330 - RNA, 14 nt, Human herpesvirus 4 [Epstein-Barr virus]
cuuguccaggagac

SEQ ID NO: 3975331 - RNA, 16 nt, Human herpesvirus 4 [Epstein-Barr virus]
cuuguccgcugggcca

SEQ ID NO: 3975332 - RNA, 15 nt, Human herpesvirus 4 [Epstein-Barr virus]
cuugucuacauccca

SEQ ID NO: 3975333 - RNA, 18 nt, Human herpesvirus 4 [Epstein-Barr virus]
gcucagacuuagggccgg

SEQ ID NO: 3975334 - RNA, 21 nt, Human herpesvirus 4 [Epstein-Barr virus]
gcucagcucaaccgccagggc

SEQ ID NO: 3975335 - RNA, 19 nt, Human herpesvirus 4 [Epstein-Barr virus]
gcucaggaucagggccaag

SEQ ID NO: 3975336 - RNA, 14 nt, Human herpesvirus 4 [Epstein-Barr virus]
gcuccagggccagc

SEQ ID NO: 3975337 - RNA, 15 nt, Human herpesvirus 4 [Epstein-Barr virus]
gcuccagggccagca

SEQ ID NO: 3975338 - RNA, 20 nt, Human herpesvirus 4 [Epstein-Barr virus]
gcuccccagccacagcaccc

SEQ ID NO: 3975339 - RNA, 16 nt, Human herpesvirus 4 [Epstein-Barr virus]
gcucccucccccuccc

SEQ ID NO: 3975340 - RNA, 23 nt, Human herpesvirus 4 [Epstein-Barr virus]
gcuccggcggcaguggaccucaa

SEQ ID NO: 3975341 - RNA, 21 nt, Human herpesvirus 4 [Epstein-Barr virus]
gcuccguccuuguccaggaga

SEQ ID NO: 3975342 - RNA, 16 nt, Human herpesvirus 4 [Epstein-Barr virus]
gcuccguggccccggg

SEQ ID NO: 3975343 - RNA, 12 nt, Human herpesvirus 4 [Epstein-Barr virus]
gcuccuuugccu

SEQ ID NO: 3975344 - RNA, 13 nt, Human herpesvirus 4 [Epstein-Barr virus]
gcucgcagcugga

SEQ ID NO: 3975345 - RNA, 17 nt, Human herpesvirus 4 [Epstein-Barr virus]
gcucgcccacacagcgc

SEQ ID NO: 3975346 - RNA, 15 nt, Human herpesvirus 4 [Epstein-Barr virus]
gcucggcccuccgca

SEQ ID NO: 3975347 - RNA, 15 nt, Human herpesvirus 4 [Epstein-Barr virus]
gcucggggcaugcug

SEQ ID NO: 3975348 - RNA, 14 nt, Human herpesvirus 4 [Epstein-Barr virus]
gcucucaggccuca

SEQ ID NO: 3975349 - RNA, 12 nt, Human herpesvirus 4 [Epstein-Barr virus]
gcucugcacagg

SEQ ID NO: 3975350 - RNA, 14 nt, Human herpesvirus 4 [Epstein-Barr virus]
gcucuuggucaagg

SEQ ID NO: 3975351 - RNA, 14 nt, Human herpesvirus 4 [Epstein-Barr virus]
gcugaagcccaaga

SEQ ID NO: 3975352 - RNA, 20 nt, Human herpesvirus 4 [Epstein-Barr virus]
gcugcaucuuaccccuggcu

SEQ ID NO: 3975353 - RNA, 15 nt, Human herpesvirus 4 [Epstein-Barr virus]
gcugccagccucagc

SEQ ID NO: 3975354 - RNA, 19 nt, Human herpesvirus 4 [Epstein-Barr virus]
gcugccccaauaugccaac

SEQ ID NO: 3975355 - RNA, 15 nt, Human herpesvirus 4 [Epstein-Barr virus]
gcugccccgggccca

SEQ ID NO: 3975356 - RNA, 17 nt, Human herpesvirus 4 [Epstein-Barr virus]
gcugccguuauugccug

SEQ ID NO: 3975357 - RNA, 19 nt, Human herpesvirus 4 [Epstein-Barr virus]
gcugcgaggcauacagcau

SEQ ID NO: 3975358 - RNA, 21 nt, Human herpesvirus 4 [Epstein-Barr virus]
gcugcucggggcaugcugccc

SEQ ID NO: 3975359 - RNA, 16 nt, Human herpesvirus 4 [Epstein-Barr virus]
gcuggacgagguccug

SEQ ID NO: 3975360 - RNA, 16 nt, Human herpesvirus 4 [Epstein-Barr virus]
gcuggccaggcuggug

SEQ ID NO: 3975361 - RNA, 17 nt, Human herpesvirus 4 [Epstein-Barr virus]
gcuggggcuggugcuca

SEQ ID NO: 3975362 - RNA, 23 nt, Human herpesvirus 4 [Epstein-Barr virus]
gcugguggccugggaggugcuga

SEQ ID NO: 3975363 - RNA, 21 nt, Human herpesvirus 4 [Epstein-Barr virus]
gcuguccgccaggacggagaa

SEQ ID NO: 3975364 - RNA, 12 nt, Human herpesvirus 4 [Epstein-Barr virus]
gcugugcugacc

SEQ ID NO: 3975365 - RNA, 20 nt, Human herpesvirus 4 [Epstein-Barr virus]
gcuuagugccccccuugaga

SEQ ID NO: 3975366 - RNA, 20 nt, Human herpesvirus 4 [Epstein-Barr virus]
gcuucaaguuaccuucuuuc

SEQ ID NO: 3975367 - RNA, 23 nt, Human herpesvirus 4 [Epstein-Barr virus]
gcuucagcaguagcuugggaaca

SEQ ID NO: 3975368 - RNA, 16 nt, Human herpesvirus 4 [Epstein-Barr virus]
gcuucuggaccgugcc

SEQ ID NO: 3975369 - RNA, 20 nt, Human herpesvirus 4 [Epstein-Barr virus]
gcuugccuuuuugccacaug

SEQ ID NO: 3975370 - RNA, 17 nt, Human herpesvirus 4 [Epstein-Barr virus]
gcuuuugucugccugga

SEQ ID NO: 3975371 - RNA, 14 nt, Human herpesvirus 4 [Epstein-Barr virus]
ggaaaaacuggcca

SEQ ID NO: 3975372 - RNA, 14 nt, Human herpesvirus 4 [Epstein-Barr virus]
ggaacgaggggagg

SEQ ID NO: 3975373 - RNA, 18 nt, Human herpesvirus 4 [Epstein-Barr virus]
ggaacuggcucagcuugg

SEQ ID NO: 3975374 - RNA, 16 nt, Human herpesvirus 4 [Epstein-Barr virus]
ggaagcuggccaggcu

SEQ ID NO: 3975375 - RNA, 17 nt, Human herpesvirus 4 [Epstein-Barr virus]
ggacccccggagucugg

SEQ ID NO: 3975376 - RNA, 18 nt, Human herpesvirus 4 [Epstein-Barr virus]
ggacccggaccaaugcca

SEQ ID NO: 3975377 - RNA, 22 nt, Human herpesvirus 4 [Epstein-Barr virus]
ggacggaggacgauagcccagg

SEQ ID NO: 3975378 - RNA, 16 nt, Human herpesvirus 4 [Epstein-Barr virus]
ggacgggguggugccu

SEQ ID NO: 3975379 - RNA, 18 nt, Human herpesvirus 4 [Epstein-Barr virus]
ggacgggguggugccugg

SEQ ID NO: 3975380 - RNA, 18 nt, Human herpesvirus 4 [Epstein-Barr virus]
ggacguaucugggcacuu

SEQ ID NO: 3975381 - RNA, 13 nt, Human herpesvirus 4 [Epstein-Barr virus]
ggacgugaaccuc

SEQ ID NO: 3975382 - RNA, 14 nt, Human herpesvirus 4 [Epstein-Barr virus]
ggagagaagggaga

SEQ ID NO: 3975383 - RNA, 14 nt, Human herpesvirus 4 [Epstein-Barr virus]
ggagcagggcccag

SEQ ID NO: 3975384 - RNA, 14 nt, Human herpesvirus 4 [Epstein-Barr virus]
ggagccguggccuu

SEQ ID NO: 3975385 - RNA, 19 nt, Human herpesvirus 4 [Epstein-Barr virus]
ggaggacacugccaagguu

SEQ ID NO: 3975386 - RNA, 18 nt, Human herpesvirus 4 [Epstein-Barr virus]
ggaggaggggggcaguga

SEQ ID NO: 3975387 - RNA, 13 nt, Human herpesvirus 4 [Epstein-Barr virus]
ggaggagugcugc

SEQ ID NO: 3975388 - RNA, 21 nt, Human herpesvirus 4 [Epstein-Barr virus]
ggaggcccccggcuggccgcc

SEQ ID NO: 3975389 - RNA, 16 nt, Human herpesvirus 4 [Epstein-Barr virus]
ggaguccaugaccagg

SEQ ID NO: 3975390 - RNA, 22 nt, Human herpesvirus 4 [Epstein-Barr virus]
ggauccccgccggggcuagggg

SEQ ID NO: 3975391 - RNA, 21 nt, Human herpesvirus 4 [Epstein-Barr virus]
ggaucgaaggagagcuggaug

SEQ ID NO: 3975392 - RNA, 14 nt, Human herpesvirus 4 [Epstein-Barr virus]
ggaucucccgcgcc

SEQ ID NO: 3975393 - RNA, 15 nt, Human herpesvirus 4 [Epstein-Barr virus]
ggaugcaggaccuag

SEQ ID NO: 3975394 - RNA, 16 nt, Human herpesvirus 4 [Epstein-Barr virus]
ggcaaacagggcagag

SEQ ID NO: 3975395 - RNA, 15 nt, Human herpesvirus 4 [Epstein-Barr virus]
ggcaaggagcuguuu

SEQ ID NO: 3975396 - RNA, 21 nt, Human herpesvirus 4 [Epstein-Barr virus]
ggcacacauuacggugcugga

SEQ ID NO: 3975397 - RNA, 16 nt, Human herpesvirus 4 [Epstein-Barr virus]
ggcacaccagacaugg

SEQ ID NO: 3975398 - RNA, 17 nt, Human herpesvirus 4 [Epstein-Barr virus]
ggcacaccagacauggu

SEQ ID NO: 3975399 - RNA, 13 nt, Human herpesvirus 4 [Epstein-Barr virus]
ggcaccccacggg

SEQ ID NO: 3975400 - RNA, 15 nt, Human herpesvirus 4 [Epstein-Barr virus]
ggcacccccucugag

SEQ ID NO: 3975401 - RNA, 20 nt, Human herpesvirus 4 [Epstein-Barr virus]
ggcacgggcagaggacacgc

SEQ ID NO: 3975402 - RNA, 21 nt, Human herpesvirus 4 [Epstein-Barr virus]
ggcagcgaagaacacuccaca

SEQ ID NO: 3975403 - RNA, 19 nt, Human herpesvirus 4 [Epstein-Barr virus]
ggcagcggacgguggggcu

SEQ ID NO: 3975404 - RNA, 13 nt, Human herpesvirus 4 [Epstein-Barr virus]
ggcaggagcagga

SEQ ID NO: 3975405 - RNA, 19 nt, Human herpesvirus 4 [Epstein-Barr virus]
ggccaaggugguagcguug

SEQ ID NO: 3975406 - RNA, 15 nt, Human herpesvirus 4 [Epstein-Barr virus]
ggccacacagccuga

SEQ ID NO: 3975407 - RNA, 19 nt, Human herpesvirus 4 [Epstein-Barr virus]
ggccacggcgugccagagg

SEQ ID NO: 3975408 - RNA, 15 nt, Human herpesvirus 4 [Epstein-Barr virus]
ggccagcaggccggc

SEQ ID NO: 3975409 - RNA, 11 nt, Human herpesvirus 4 [Epstein-Barr virus]
ggccaggaccc

SEQ ID NO: 3975410 - RNA, 18 nt, Human herpesvirus 4 [Epstein-Barr virus]
ggccauucgacaggccau

SEQ ID NO: 3975411 - RNA, 22 nt, Human herpesvirus 4 [Epstein-Barr virus]
ggcccacgucuuuaccaccuca

SEQ ID NO: 3975412 - RNA, 19 nt, Human herpesvirus 4 [Epstein-Barr virus]
ggcccacgugaacauccug

SEQ ID NO: 3975413 - RNA, 12 nt, Human herpesvirus 4 [Epstein-Barr virus]
ggcccagcccuc

SEQ ID NO: 3975414 - RNA, 19 nt, Human herpesvirus 4 [Epstein-Barr virus]
ggccccccgcaccagggcc

SEQ ID NO: 3975415 - RNA, 15 nt, Human herpesvirus 4 [Epstein-Barr virus]
ggccccggcuggcca

SEQ ID NO: 3975416 - RNA, 13 nt, Human herpesvirus 4 [Epstein-Barr virus]
ggcccgggaccgc

SEQ ID NO: 3975417 - RNA, 20 nt, Human herpesvirus 4 [Epstein-Barr virus]
ggcccuccagcguggucaua

SEQ ID NO: 3975418 - RNA, 21 nt, Human herpesvirus 4 [Epstein-Barr virus]
ggcccugagcauggcggccug

SEQ ID NO: 3975419 - RNA, 16 nt, Human herpesvirus 4 [Epstein-Barr virus]
ggcccuuagcauggga

SEQ ID NO: 3975420 - RNA, 16 nt, Human herpesvirus 4 [Epstein-Barr virus]
ggccgcagcuggcgga

SEQ ID NO: 3975421 - RNA, 12 nt, Human herpesvirus 4 [Epstein-Barr virus]
gguugggcagaa

SEQ ID NO: 3975422 - RNA, 14 nt, Human herpesvirus 4 [Epstein-Barr virus]
gguugucuucccag

SEQ ID NO: 3975423 - RNA, 21 nt, Human herpesvirus 4 [Epstein-Barr virus]
gguugucuucccagacucugc

SEQ ID NO: 3975424 - RNA, 22 nt, Human herpesvirus 4 [Epstein-Barr virus]
gguuucauuuaagcaggugagg

SEQ ID NO: 3975425 - RNA, 19 nt, Human herpesvirus 4 [Epstein-Barr virus]
gguuuccaugacgcugcug

SEQ ID NO: 3975426 - RNA, 14 nt, Human herpesvirus 4 [Epstein-Barr virus]
guaaaacugccaca

SEQ ID NO: 3975427 - RNA, 15 nt, Human herpesvirus 4 [Epstein-Barr virus]
guaaccuaugccugg

SEQ ID NO: 3975428 - RNA, 23 nt, Human herpesvirus 4 [Epstein-Barr virus]
guacagacuaccggcgagcauga

SEQ ID NO: 3975429 - RNA, 19 nt, Human herpesvirus 4 [Epstein-Barr virus]
guacagacuuuuggcaaug

SEQ ID NO: 3975430 - RNA, 15 nt, Human herpesvirus 4 [Epstein-Barr virus]
guaccagcugguggu

SEQ ID NO: 3975431 - RNA, 17 nt, Human herpesvirus 4 [Epstein-Barr virus]
guacccauaacugggca

SEQ ID NO: 3975432 - RNA, 23 nt, Human herpesvirus 4 [Epstein-Barr virus]
guagcccuuggaacugacgggca

SEQ ID NO: 3975433 - RNA, 21 nt, Human herpesvirus 4 [Epstein-Barr virus]
guaguaacgcauucccuugcu

SEQ ID NO: 3975434 - RNA, 19 nt, Human herpesvirus 4 [Epstein-Barr virus]
guauaaagaaugcccacca

SEQ ID NO: 3975435 - RNA, 19 nt, Human herpesvirus 4 [Epstein-Barr virus]
guaugcagaaggggcccug

SEQ ID NO: 3975436 - RNA, 13 nt, Human herpesvirus 4 [Epstein-Barr virus]
guauguauuggga

SEQ ID NO: 3975437 - RNA, 15 nt, Human herpesvirus 4 [Epstein-Barr virus]
gucaaguaccagcug

SEQ ID NO: 3975438 - RNA, 14 nt, Human herpesvirus 4 [Epstein-Barr virus]
gucacugugcacuc

SEQ ID NO: 3975439 - RNA, 15 nt, Human herpesvirus 4 [Epstein-Barr virus]
gucacugugcacucu

SEQ ID NO: 3975440 - RNA, 16 nt, Human herpesvirus 4 [Epstein-Barr virus]
gucaggagggcagaga

SEQ ID NO: 3975441 - RNA, 18 nt, Human herpesvirus 4 [Epstein-Barr virus]
gucauggcggacugcgcc

SEQ ID NO: 3975442 - RNA, 18 nt, Human herpesvirus 4 [Epstein-Barr virus]
guccaccuggccaccaca

SEQ ID NO: 3975443 - RNA, 16 nt, Human herpesvirus 4 [Epstein-Barr virus]
guccacggggagacuu

SEQ ID NO: 3975444 - RNA, 10 nt, Human herpesvirus 4 [Epstein-Barr virus]
guccacugcc

SEQ ID NO: 3975445 - RNA, 21 nt, Human herpesvirus 4 [Epstein-Barr virus]
guccagaguucccggcugcuc

SEQ ID NO: 3975446 - RNA, 19 nt, Human herpesvirus 4 [Epstein-Barr virus]
guccagccacgcaggaugu

SEQ ID NO: 3975447 - RNA, 19 nt, Human herpesvirus 4 [Epstein-Barr virus]
guccaggggcuuguucuug

SEQ ID NO: 3975448 - RNA, 16 nt, Human herpesvirus 4 [Epstein-Barr virus]
guccagggguccccga

SEQ ID NO: 3975449 - RNA, 17 nt, Human herpesvirus 4 [Epstein-Barr virus]
guccaggguccaggaga

SEQ ID NO: 3975450 - RNA, 16 nt, Human herpesvirus 4 [Epstein-Barr virus]
gucccugcugcccaug

SEQ ID NO: 3975451 - RNA, 19 nt, Human herpesvirus 4 [Epstein-Barr virus]
guccgccaggacggagaag

SEQ ID NO: 3975452 - RNA, 16 nt, Human herpesvirus 4 [Epstein-Barr virus]
guccuccacggggaca

SEQ ID NO: 3975453 - RNA, 16 nt, Human herpesvirus 4 [Epstein-Barr virus]
guccuugucugcugcc

SEQ ID NO: 3975454 - RNA, 17 nt, Human herpesvirus 4 [Epstein-Barr virus]
guccuugucugcugcca

SEQ ID NO: 3975455 - RNA, 22 nt, Human herpesvirus 4 [Epstein-Barr virus]
gucggcuaaugccaugcagcgg

SEQ ID NO: 3975456 - RNA, 20 nt, Human herpesvirus 4 [Epstein-Barr virus]
gucgggagaacgaaggcgug

SEQ ID NO: 3975457 - RNA, 15 nt, Human herpesvirus 4 [Epstein-Barr virus]
gucggggcugcuggc

SEQ ID NO: 3975458 - RNA, 18 nt, Human herpesvirus 4 [Epstein-Barr virus]
gucgugguuuucugcccc

SEQ ID NO: 3975459 - RNA, 13 nt, Human herpesvirus 4 [Epstein-Barr virus]
gucuacccagagg

SEQ ID NO: 3975460 - RNA, 23 nt, Human herpesvirus 4 [Epstein-Barr virus]
gucuaccucuguuccuucugcuc

SEQ ID NO: 3975461 - RNA, 14 nt, Human herpesvirus 4 [Epstein-Barr virus]
gucuauccaggagg

SEQ ID NO: 3975462 - RNA, 23 nt, Human herpesvirus 4 [Epstein-Barr virus]
gucucaugggggaaugagggaaa

SEQ ID NO: 3975463 - RNA, 17 nt, Human herpesvirus 4 [Epstein-Barr virus]
gucuccagagggcagac

SEQ ID NO: 3975464 - RNA, 22 nt, Human herpesvirus 4 [Epstein-Barr virus]
gucugccgcguguuugcugcuc

SEQ ID NO: 3975465 - RNA, 19 nt, Human herpesvirus 4 [Epstein-Barr virus]
gucuguaaucucuaaagau

SEQ ID NO: 3975466 - RNA, 14 nt, Human herpesvirus 4 [Epstein-Barr virus]
gucuucaauagaca

SEQ ID NO: 3975467 - RNA, 18 nt, Human herpesvirus 4 [Epstein-Barr virus]
gucuucaaucuucuucau

SEQ ID NO: 3975468 - RNA, 20 nt, Human herpesvirus 4 [Epstein-Barr virus]
gucuugccguggcgccuggg

SEQ ID NO: 3975469 - RNA, 15 nt, Human herpesvirus 4 [Epstein-Barr virus]
gucuuuuaugagcca

SEQ ID NO: 3975470 - RNA, 20 nt, Human herpesvirus 4 [Epstein-Barr virus]
gugaaacuggcuucugugac

SEQ ID NO: 3975471 - RNA, 17 nt, Human herpesvirus 4 [Epstein-Barr virus]
gugaagggcagggcucg

SEQ ID NO: 3975472 - RNA, 23 nt, Human herpesvirus 4 [Epstein-Barr virus]
gugaaugcacgccaacagcgacc

SEQ ID NO: 3975473 - RNA, 17 nt, Human herpesvirus 4 [Epstein-Barr virus]
gugacauucacugggac

SEQ ID NO: 3975474 - RNA, 17 nt, Human herpesvirus 4 [Epstein-Barr virus]
gugaccugacuggcaga

SEQ ID NO: 3975475 - RNA, 20 nt, Human herpesvirus 4 [Epstein-Barr virus]
gugacgaagacccaucugag

SEQ ID NO: 3975476 - RNA, 22 nt, Human herpesvirus 4 [Epstein-Barr virus]
gugauaaccauggacgaggacg

SEQ ID NO: 3975477 - RNA, 20 nt, Human herpesvirus 4 [Epstein-Barr virus]
gugauuaggagcagggccca

SEQ ID NO: 3975478 - RNA, 17 nt, Human herpesvirus 4 [Epstein-Barr virus]
gugccauaccacacccc

SEQ ID NO: 3975479 - RNA, 18 nt, Human herpesvirus 4 [Epstein-Barr virus]
gugccauaccacaccccc

SEQ ID NO: 3975480 - RNA, 19 nt, Human herpesvirus 4 [Epstein-Barr virus]
gugccuaaacgugauggug

SEQ ID NO: 3975481 - RNA, 21 nt, Human herpesvirus 4 [Epstein-Barr virus]
gugcgcaacgccggccugcug

SEQ ID NO: 3975482 - RNA, 22 nt, Human herpesvirus 4 [Epstein-Barr virus]
gugcgguuauaacugccagagc

SEQ ID NO: 3975483 - RNA, 13 nt, Human herpesvirus 4 [Epstein-Barr virus]
gugcugaggcccg

SEQ ID NO: 3975484 - RNA, 18 nt, Human herpesvirus 4 [Epstein-Barr virus]
gugcugcguugggaacug

SEQ ID NO: 3975485 - RNA, 16 nt, Human herpesvirus 4 [Epstein-Barr virus]
guggaacagaugcugu

SEQ ID NO: 3975486 - RNA, 23 nt, Human herpesvirus 4 [Epstein-Barr virus]
guggcacacauuacggugcugga

SEQ ID NO: 3975487 - RNA, 22 nt, Human herpesvirus 4 [Epstein-Barr virus]
guggcagaaucaccagagccca

SEQ ID NO: 3975488 - RNA, 17 nt, Human herpesvirus 4 [Epstein-Barr virus]
guggcagugauguucug

SEQ ID NO: 3975489 - RNA, 21 nt, Human herpesvirus 4 [Epstein-Barr virus]
guggccaacgcaggcacggcc

SEQ ID NO: 3975490 - RNA, 15 nt, Human herpesvirus 4 [Epstein-Barr virus]
guggccacacugggg

SEQ ID NO: 3975491 - RNA, 23 nt, Human herpesvirus 4 [Epstein-Barr virus]
guggccagcucauaugccgcugc

SEQ ID NO: 3975492 - RNA, 18 nt, Human herpesvirus 4 [Epstein-Barr virus]
guggccccggcuggccau

SEQ ID NO: 3975493 - RNA, 16 nt, Human herpesvirus 4 [Epstein-Barr virus]
guggccgaguggcaga

SEQ ID NO: 3975494 - RNA, 23 nt, Human herpesvirus 4 [Epstein-Barr virus]
guggccuucucugauggccugga

SEQ ID NO: 3975495 - RNA, 20 nt, Human herpesvirus 4 [Epstein-Barr virus]
guggcgguggaacacggcac

SEQ ID NO: 3975496 - RNA, 14 nt, Human herpesvirus 4 [Epstein-Barr virus]
guggcuugggcugu

SEQ ID NO: 3975497 - RNA, 17 nt, Human herpesvirus 4 [Epstein-Barr virus]
gugggacguuuagaaac

SEQ ID NO: 3975498 - RNA, 12 nt, Human herpesvirus 4 [Epstein-Barr virus]
gugggaggccca

SEQ ID NO: 3975499 - RNA, 23 nt, Human herpesvirus 4 [Epstein-Barr virus]
gugggccucucuggcugugcuga

SEQ ID NO: 3975500 - RNA, 14 nt, Human herpesvirus 4 [Epstein-Barr virus]
guggugcuguccug

SEQ ID NO: 3975501 - RNA, 19 nt, Human herpesvirus 4 [Epstein-Barr virus]
gugguggcagcaggcgcug

SEQ ID NO: 3975502 - RNA, 21 nt, Human herpesvirus 4 [Epstein-Barr virus]
gugguguucuaacgggaagug

SEQ ID NO: 3975503 - RNA, 19 nt, Human herpesvirus 4 [Epstein-Barr virus]
gugguuauuuugggccagg

SEQ ID NO: 3975504 - RNA, 16 nt, Human herpesvirus 4 [Epstein-Barr virus]
gugguugucuucccag

SEQ ID NO: 3975505 - RNA, 20 nt, Human herpesvirus 4 [Epstein-Barr virus]
gugucauuuagaaaccuugc

SEQ ID NO: 3975506 - RNA, 19 nt, Human herpesvirus 4 [Epstein-Barr virus]
gugucccccuccauuccac

SEQ ID NO: 3975507 - RNA, 21 nt, Human herpesvirus 4 [Epstein-Barr virus]
gugucuggcggccgcugcgcc

SEQ ID NO: 3975508 - RNA, 20 nt, Human herpesvirus 4 [Epstein-Barr virus]
aucuggcagcuuuuggccuu

SEQ ID NO: 3975509 - RNA, 17 nt, Human herpesvirus 4 [Epstein-Barr virus]
aucuggcucuccugugu

SEQ ID NO: 3975510 - RNA, 14 nt, Human herpesvirus 4 [Epstein-Barr virus]
aucuggggccaagg

SEQ ID NO: 3975511 - RNA, 16 nt, Human herpesvirus 4 [Epstein-Barr virus]
augaaggugucauuga

SEQ ID NO: 3975512 - RNA, 13 nt, Human herpesvirus 4 [Epstein-Barr virus]
augacacaggaca

SEQ ID NO: 3975513 - RNA, 16 nt, Human herpesvirus 4 [Epstein-Barr virus]
augaggaaggggccuc

SEQ ID NO: 3975514 - RNA, 20 nt, Human herpesvirus 4 [Epstein-Barr virus]
augaugacgccgagaccuau

SEQ ID NO: 3975515 - RNA, 17 nt, Human herpesvirus 4 [Epstein-Barr virus]
augauugagaaugccaa

SEQ ID NO: 3975516 - RNA, 22 nt, Human herpesvirus 4 [Epstein-Barr virus]
augcaacagaggauuggcugca

SEQ ID NO: 3975517 - RNA, 20 nt, Human herpesvirus 4 [Epstein-Barr virus]
augcaauaaauaaaaguaca

SEQ ID NO: 3975518 - RNA, 15 nt, Human herpesvirus 4 [Epstein-Barr virus]
augcaaugcccaccc

SEQ ID NO: 3975519 - RNA, 13 nt, Human herpesvirus 4 [Epstein-Barr virus]
augcagaaggggc

SEQ ID NO: 3975520 - RNA, 15 nt, Human herpesvirus 4 [Epstein-Barr virus]
augcaggccuggaca

SEQ ID NO: 3975521 - RNA, 17 nt, Human herpesvirus 4 [Epstein-Barr virus]
augcauccgcaccacag

SEQ ID NO: 3975522 - RNA, 11 nt, Human herpesvirus 4 [Epstein-Barr virus]
augccaaagcu

SEQ ID NO: 3975523 - RNA, 15 nt, Human herpesvirus 4 [Epstein-Barr virus]
augcgaaacuacagg

SEQ ID NO: 3975524 - RNA, 12 nt, Human herpesvirus 4 [Epstein-Barr virus]
augcuaucuugu

SEQ ID NO: 3975525 - RNA, 22 nt, Human herpesvirus 4 [Epstein-Barr virus]
augcucaguggccgucuggcag

SEQ ID NO: 3975526 - RNA, 14 nt, Human herpesvirus 4 [Epstein-Barr virus]
augcuccuauggac

SEQ ID NO: 3975527 - RNA, 19 nt, Human herpesvirus 4 [Epstein-Barr virus]
augcucuggcgacuuggug

SEQ ID NO: 3975528 - RNA, 17 nt, Human herpesvirus 4 [Epstein-Barr virus]
augcuuacucaauccau

SEQ ID NO: 3975529 - RNA, 22 nt, Human herpesvirus 4 [Epstein-Barr virus]
auggagagauuucauccucaga

SEQ ID NO: 3975530 - RNA, 15 nt, Human herpesvirus 4 [Epstein-Barr virus]
auggaugugaaugcc

SEQ ID NO: 3975531 - RNA, 16 nt, Human herpesvirus 4 [Epstein-Barr virus]
auggauuacuggucuu

SEQ ID NO: 3975532 - RNA, 21 nt, Human herpesvirus 4 [Epstein-Barr virus]
auggcacggaugccuggcgcu

SEQ ID NO: 3975533 - RNA, 17 nt, Human herpesvirus 4 [Epstein-Barr virus]
auggccguccucuggac

SEQ ID NO: 3975534 - RNA, 19 nt, Human herpesvirus 4 [Epstein-Barr virus]
auggcuauacacaggagcc

SEQ ID NO: 3975535 - RNA, 18 nt, Human herpesvirus 4 [Epstein-Barr virus]
auggggccaggacgcugc

SEQ ID NO: 3975536 - RNA, 21 nt, Human herpesvirus 4 [Epstein-Barr virus]
augggggaggagagaccaaga

SEQ ID NO: 3975537 - RNA, 20 nt, Human herpesvirus 4 [Epstein-Barr virus]
augguggccggcagccuggc

SEQ ID NO: 3975538 - RNA, 23 nt, Human herpesvirus 4 [Epstein-Barr virus]
augugccucgguggccugcucac

SEQ ID NO: 3975539 - RNA, 12 nt, Human herpesvirus 4 [Epstein-Barr virus]
auguucagagcu

SEQ ID NO: 3975540 - RNA, 15 nt, Human herpesvirus 4 [Epstein-Barr virus]
auucagauuucuagu

SEQ ID NO: 3975541 - RNA, 22 nt, Human herpesvirus 4 [Epstein-Barr virus]
auucccuaggaauuauuuacca

SEQ ID NO: 3975542 - RNA, 11 nt, Human herpesvirus 4 [Epstein-Barr virus]
auucucagaug

SEQ ID NO: 3975543 - RNA, 15 nt, Human herpesvirus 4 [Epstein-Barr virus]
auucuggcacgucau

SEQ ID NO: 3975544 - RNA, 17 nt, Human herpesvirus 4 [Epstein-Barr virus]
auugaaaccacgccugc

SEQ ID NO: 3975545 - RNA, 14 nt, Human herpesvirus 4 [Epstein-Barr virus]
auugagaucagaaa

SEQ ID NO: 3975546 - RNA, 17 nt, Human herpesvirus 4 [Epstein-Barr virus]
auugaugugacuuguga

SEQ ID NO: 3975547 - RNA, 14 nt, Human herpesvirus 4 [Epstein-Barr virus]
auugccuucuguua

SEQ ID NO: 3975548 - RNA, 17 nt, Human herpesvirus 4 [Epstein-Barr virus]
auugcugaacuggggcu

SEQ ID NO: 3975549 - RNA, 17 nt, Human herpesvirus 4 [Epstein-Barr virus]
auuggacacccacccug

SEQ ID NO: 3975550 - RNA, 16 nt, Human herpesvirus 4 [Epstein-Barr virus]
auuggcagcagcucug

SEQ ID NO: 3975551 - RNA, 23 nt, Human herpesvirus 4 [Epstein-Barr virus]
auugggugguggcagcaggcgcu

SEQ ID NO: 3975552 - RNA, 16 nt, Human herpesvirus 4 [Epstein-Barr virus]
auuguucuacuccugg

SEQ ID NO: 3975553 - RNA, 19 nt, Human herpesvirus 4 [Epstein-Barr virus]
auuugcugacauauguaca

SEQ ID NO: 3975554 - RNA, 20 nt, Human herpesvirus 4 [Epstein-Barr virus]
auuugcugacauauguacaa

SEQ ID NO: 3975555 - RNA, 20 nt, Human herpesvirus 4 [Epstein-Barr virus]
auuuggacaucuaguggcag

SEQ ID NO: 3975556 - RNA, 20 nt, Human herpesvirus 4 [Epstein-Barr virus]
auuuggacgagagcaugcca

SEQ ID NO: 3975557 - RNA, 15 nt, Human herpesvirus 4 [Epstein-Barr virus]
auuuggaggaagagu

SEQ ID NO: 3975558 - RNA, 16 nt, Human herpesvirus 4 [Epstein-Barr virus]
auuugggagggaccac

SEQ ID NO: 3975559 - RNA, 17 nt, Human herpesvirus 4 [Epstein-Barr virus]
caaaacuuuagaggcga

SEQ ID NO: 3975560 - RNA, 20 nt, Human herpesvirus 4 [Epstein-Barr virus]
caaacaggugagucagccuu

SEQ ID NO: 3975561 - RNA, 18 nt, Human herpesvirus 4 [Epstein-Barr virus]
caaacaugggcugcuaua

SEQ ID NO: 3975562 - RNA, 18 nt, Human herpesvirus 4 [Epstein-Barr virus]
caaacucgacuucugaag

SEQ ID NO: 3975563 - RNA, 21 nt, Human herpesvirus 4 [Epstein-Barr virus]
caaauaaacauuuuauuggua

SEQ ID NO: 3975564 - RNA, 18 nt, Human herpesvirus 4 [Epstein-Barr virus]
caacagacuaaccaagcc

SEQ ID NO: 3975565 - RNA, 18 nt, Human herpesvirus 4 [Epstein-Barr virus]
caacagcuagcagacauu

SEQ ID NO: 3975566 - RNA, 21 nt, Human herpesvirus 4 [Epstein-Barr virus]
caacaggugcccgagccccgc

SEQ ID NO: 3975567 - RNA, 14 nt, Human herpesvirus 4 [Epstein-Barr virus]
caacauuaaagccu

SEQ ID NO: 3975568 - RNA, 23 nt, Human herpesvirus 4 [Epstein-Barr virus]
caacgcauccaccaucaauguca

SEQ ID NO: 3975569 - RNA, 23 nt, Human herpesvirus 4 [Epstein-Barr virus]
caacucggcccgucuuacugccc

SEQ ID NO: 3975570 - RNA, 23 nt, Human herpesvirus 4 [Epstein-Barr virus]
caacuucagcuccagggccagca

SEQ ID NO: 3975571 - RNA, 20 nt, Human herpesvirus 4 [Epstein-Barr virus]
caagaacccccugcaggaca

SEQ ID NO: 3975572 - RNA, 17 nt, Human herpesvirus 4 [Epstein-Barr virus]
caagacucccugacggu

SEQ ID NO: 3975573 - RNA, 18 nt, Human herpesvirus 4 [Epstein-Barr virus]
caagagucucgccaucua

SEQ ID NO: 3975574 - RNA, 20 nt, Human herpesvirus 4 [Epstein-Barr virus]
caagaguuuaagcagcacug

SEQ ID NO: 3975575 - RNA, 24 nt, Human herpesvirus 4 [Epstein-Barr virus]
caagauugggugguggcagcaggc

SEQ ID NO: 3975576 - RNA, 23 nt, Human herpesvirus 4 [Epstein-Barr virus]
caagccgggggagaagcaccuca

SEQ ID NO: 3975577 - RNA, 19 nt, Human herpesvirus 4 [Epstein-Barr virus]
caagcuuuugaccaagcua

SEQ ID NO: 3975578 - RNA, 15 nt, Human herpesvirus 4 [Epstein-Barr virus]
caaggacaggugcca

SEQ ID NO: 3975579 - RNA, 14 nt, Human herpesvirus 4 [Epstein-Barr virus]
caaguaccagcugg

SEQ ID NO: 3975580 - RNA, 17 nt, Human herpesvirus 4 [Epstein-Barr virus]
caauaaaguugaugaua

SEQ ID NO: 3975581 - RNA, 23 nt, Human herpesvirus 4 [Epstein-Barr virus]
caauccauuaucuuggcaccccg

SEQ ID NO: 3975582 - RNA, 21 nt, Human herpesvirus 4 [Epstein-Barr virus]
caaugagagccaaaaauuuga

SEQ ID NO: 3975583 - RNA, 14 nt, Human herpesvirus 4 [Epstein-Barr virus]
caauggggccagga

SEQ ID NO: 3975584 - RNA, 17 nt, Human herpesvirus 4 [Epstein-Barr virus]
caaugggggaggagaga

SEQ ID NO: 3975585 - RNA, 23 nt, Human herpesvirus 4 [Epstein-Barr virus]
caauguaucccaaauaaauguua

SEQ ID NO: 3975586 - RNA, 22 nt, Human herpesvirus 4 [Epstein-Barr virus]
caauucuacuguucaaacagca

SEQ ID NO: 3975587 - RNA, 15 nt, Human herpesvirus 4 [Epstein-Barr virus]
cacacagcgccagca

SEQ ID NO: 3975588 - RNA, 23 nt, Human herpesvirus 4 [Epstein-Barr virus]
cacaccuaaauuuagcacguccc

SEQ ID NO: 3975589 - RNA, 16 nt, Human herpesvirus 4 [Epstein-Barr virus]
cacacgaagccugccu

SEQ ID NO: 3975590 - RNA, 23 nt, Human herpesvirus 4 [Epstein-Barr virus]
cacagaucugaccacggcccacg

SEQ ID NO: 3975591 - RNA, 12 nt, Human herpesvirus 4 [Epstein-Barr virus]
cacagcgccagc

SEQ ID NO: 3975592 - RNA, 22 nt, Human herpesvirus 4 [Epstein-Barr virus]
cacaggguggggguggacauga

SEQ ID NO: 3975593 - RNA, 14 nt, Human herpesvirus 4 [Epstein-Barr virus]
cacaucuggaccug

SEQ ID NO: 3975594 - RNA, 17 nt, Human herpesvirus 4 [Epstein-Barr virus]
caccaagauagugacca

SEQ ID NO: 3975595 - RNA, 20 nt, Human herpesvirus 4 [Epstein-Barr virus]
ccacauacaucccugucucc

SEQ ID NO: 3975596 - RNA, 13 nt, Human herpesvirus 4 [Epstein-Barr virus]
ccaccccacacuc

SEQ ID NO: 3975597 - RNA, 19 nt, Human herpesvirus 4 [Epstein-Barr virus]
ccacccgucccggguacaa

SEQ ID NO: 3975598 - RNA, 15 nt, Human herpesvirus 4 [Epstein-Barr virus]
ccaccguggccaggc

SEQ ID NO: 3975599 - RNA, 21 nt, Human herpesvirus 4 [Epstein-Barr virus]
ccacggcccggggguggcagc

SEQ ID NO: 3975600 - RNA, 22 nt, Human herpesvirus 4 [Epstein-Barr virus]
ccacgggaaaaagaauagcuuc

SEQ ID NO: 3975601 - RNA, 19 nt, Human herpesvirus 4 [Epstein-Barr virus]
ccacucaggaagcuggcca

SEQ ID NO: 3975602 - RNA, 19 nt, Human herpesvirus 4 [Epstein-Barr virus]
ccacugagcaagauccuuc

SEQ ID NO: 3975603 - RNA, 19 nt, Human herpesvirus 4 [Epstein-Barr virus]
ccacuuuuaccccaguccc

SEQ ID NO: 3975604 - RNA, 15 nt, Human herpesvirus 4 [Epstein-Barr virus]
ccagaaagucccgag

SEQ ID NO: 3975605 - RNA, 11 nt, Human herpesvirus 4 [Epstein-Barr virus]
ccagaagcccc

SEQ ID NO: 3975606 - RNA, 18 nt, Human herpesvirus 4 [Epstein-Barr virus]
ccagaagucggccacagg

SEQ ID NO: 3975607 - RNA, 19 nt, Human herpesvirus 4 [Epstein-Barr virus]
ccagaaucgguaaggaggg

SEQ ID NO: 3975608 - RNA, 17 nt, Human herpesvirus 4 [Epstein-Barr virus]
ccagacucugcuuucug

SEQ ID NO: 3975609 - RNA, 18 nt, Human herpesvirus 4 [Epstein-Barr virus]
ccagagccucugccacaa

SEQ ID NO: 3975610 - RNA, 19 nt, Human herpesvirus 4 [Epstein-Barr virus]
ccagagggcgaaugggcug

SEQ ID NO: 3975611 - RNA, 18 nt, Human herpesvirus 4 [Epstein-Barr virus]
ccagcaaaaccagcccgg

SEQ ID NO: 3975612 - RNA, 15 nt, Human herpesvirus 4 [Epstein-Barr virus]
ccagcagauccaggg

SEQ ID NO: 3975613 - RNA, 15 nt, Human herpesvirus 4 [Epstein-Barr virus]
ccagcagcagcccgg

SEQ ID NO: 3975614 - RNA, 17 nt, Human herpesvirus 4 [Epstein-Barr virus]
ccagcauggcagccggg

SEQ ID NO: 3975615 - RNA, 17 nt, Human herpesvirus 4 [Epstein-Barr virus]
ccagcccuccucagaaa

SEQ ID NO: 3975616 - RNA, 20 nt, Human herpesvirus 4 [Epstein-Barr virus]
ccagccgggugcacacgcuc

SEQ ID NO: 3975617 - RNA, 20 nt, Human herpesvirus 4 [Epstein-Barr virus]
ccagccuacucuccacuccc

SEQ ID NO: 3975618 - RNA, 20 nt, Human herpesvirus 4 [Epstein-Barr virus]
ccagccuguuuguccagcag

SEQ ID NO: 3975619 - RNA, 17 nt, Human herpesvirus 4 [Epstein-Barr virus]
ccagcgcuggcuccagg

SEQ ID NO: 3975620 - RNA, 19 nt, Human herpesvirus 4 [Epstein-Barr virus]
ccagcuccgugguccugag

SEQ ID NO: 3975621 - RNA, 21 nt, Human herpesvirus 4 [Epstein-Barr virus]
ccagcucggccagcaggccgg

SEQ ID NO: 3975622 - RNA, 21 nt, Human herpesvirus 4 [Epstein-Barr virus]
ccaggcaccggucucguccau

SEQ ID NO: 3975623 - RNA, 14 nt, Human herpesvirus 4 [Epstein-Barr virus]
ccaggccucagcgu

SEQ ID NO: 3975624 - RNA, 12 nt, Human herpesvirus 4 [Epstein-Barr virus]
ccaggcucucca

SEQ ID NO: 3975625 - RNA, 22 nt, Human herpesvirus 4 [Epstein-Barr virus]
ccaggcuggugacaaacucucu

SEQ ID NO: 3975626 - RNA, 15 nt, Human herpesvirus 4 [Epstein-Barr virus]
ccaggguccaggaga

SEQ ID NO: 3975627 - RNA, 21 nt, Human herpesvirus 4 [Epstein-Barr virus]
ccagguagcccagcgucagga

SEQ ID NO: 3975628 - RNA, 17 nt, Human herpesvirus 4 [Epstein-Barr virus]
ccaggucuugccguggc

SEQ ID NO: 3975629 - RNA, 20 nt, Human herpesvirus 4 [Epstein-Barr virus]
ccagugcgaggaacuggcuc

SEQ ID NO: 3975630 - RNA, 22 nt, Human herpesvirus 4 [Epstein-Barr virus]
ccaguucccuucucccacccug

SEQ ID NO: 3975631 - RNA, 19 nt, Human herpesvirus 4 [Epstein-Barr virus]
ccauaccuacaccacccca

SEQ ID NO: 3975632 - RNA, 19 nt, Human herpesvirus 4 [Epstein-Barr virus]
ccauagucacggaugcugc

SEQ ID NO: 3975633 - RNA, 21 nt, Human herpesvirus 4 [Epstein-Barr virus]
ccaucccaauucacaucucag

SEQ ID NO: 3975634 - RNA, 17 nt, Human herpesvirus 4 [Epstein-Barr virus]
ccaucuaaacgccugau

SEQ ID NO: 3975635 - RNA, 17 nt, Human herpesvirus 4 [Epstein-Barr virus]
ccaucuggcagcuuuug

SEQ ID NO: 3975636 - RNA, 19 nt, Human herpesvirus 4 [Epstein-Barr virus]
ccaucuuaggagcccgggc

SEQ ID NO: 3975637 - RNA, 16 nt, Human herpesvirus 4 [Epstein-Barr virus]
ccaugaaucugacucu

SEQ ID NO: 3975638 - RNA, 18 nt, Human herpesvirus 4 [Epstein-Barr virus]
ccaugcccagacucaucu

SEQ ID NO: 3975639 - RNA, 16 nt, Human herpesvirus 4 [Epstein-Barr virus]
ccaugccuccccagca

SEQ ID NO: 3975640 - RNA, 23 nt, Human herpesvirus 4 [Epstein-Barr virus]
cccaaacucgacuucugaagaug

SEQ ID NO: 3975641 - RNA, 24 nt, Human herpesvirus 4 [Epstein-Barr virus]
cccaaacucgacuucugaagaugu

SEQ ID NO: 3975642 - RNA, 18 nt, Human herpesvirus 4 [Epstein-Barr virus]
cccaaagggacucaaugg

SEQ ID NO: 3975643 - RNA, 18 nt, Human herpesvirus 4 [Epstein-Barr virus]
cccaagaucaaagucugu

SEQ ID NO: 3975644 - RNA, 13 nt, Human herpesvirus 4 [Epstein-Barr virus]
cccaagccuggau

SEQ ID NO: 3975645 - RNA, 23 nt, Human herpesvirus 4 [Epstein-Barr virus]
cccaccauaugaugacgccgaga

SEQ ID NO: 3975646 - RNA, 20 nt, Human herpesvirus 4 [Epstein-Barr virus]
cccaccuuuuaauucucuuc

SEQ ID NO: 3975647 - RNA, 19 nt, Human herpesvirus 4 [Epstein-Barr virus]
cccacuaucacccauggcc

SEQ ID NO: 3975648 - RNA, 18 nt, Human herpesvirus 4 [Epstein-Barr virus]
cccagacucaucucaagg

SEQ ID NO: 3975649 - RNA, 13 nt, Human herpesvirus 4 [Epstein-Barr virus]
cccagacucugcu

SEQ ID NO: 3975650 - RNA, 18 nt, Human herpesvirus 4 [Epstein-Barr virus]
cccagacucugcuuucug

SEQ ID NO: 3975651 - RNA, 21 nt, Human herpesvirus 4 [Epstein-Barr virus]
cccagacucugcuuucugccg

SEQ ID NO: 3975652 - RNA, 15 nt, Human herpesvirus 4 [Epstein-Barr virus]
cccagaggaggcccc

SEQ ID NO: 3975653 - RNA, 15 nt, Human herpesvirus 4 [Epstein-Barr virus]
cccagcccccucccg

SEQ ID NO: 3975654 - RNA, 17 nt, Human herpesvirus 4 [Epstein-Barr virus]
cccagggacauccccag

SEQ ID NO: 3975655 - RNA, 23 nt, Human herpesvirus 4 [Epstein-Barr virus]
cccagguggucuuagggcgccag

SEQ ID NO: 3975656 - RNA, 19 nt, Human herpesvirus 4 [Epstein-Barr virus]
cccauacaugucucagagg

SEQ ID NO: 3975657 - RNA, 17 nt, Human herpesvirus 4 [Epstein-Barr virus]
cccauauuggggcaaug

SEQ ID NO: 3975658 - RNA, 18 nt, Human herpesvirus 4 [Epstein-Barr virus]
cccauauuggggcaaugg

SEQ ID NO: 3975659 - RNA, 23 nt, Human herpesvirus 4 [Epstein-Barr virus]
cccaugaccaacaugagggcacc

SEQ ID NO: 3975660 - RNA, 16 nt, Human herpesvirus 4 [Epstein-Barr virus]
cccauguacagcacaa

SEQ ID NO: 3975661 - RNA, 16 nt, Human herpesvirus 4 [Epstein-Barr virus]
ccccaaaaacguccaa

SEQ ID NO: 3975662 - RNA, 23 nt, Human herpesvirus 4 [Epstein-Barr virus]
ccccacggggugcucccccugga

SEQ ID NO: 3975663 - RNA, 15 nt, Human herpesvirus 4 [Epstein-Barr virus]
ccccagaagccccca

SEQ ID NO: 3975664 - RNA, 23 nt, Human herpesvirus 4 [Epstein-Barr virus]
ccccaucuuccagcgcaagcuug

SEQ ID NO: 3975665 - RNA, 14 nt, Human herpesvirus 4 [Epstein-Barr virus]
cccccgccuuuggg

SEQ ID NO: 3975666 - RNA, 16 nt, Human herpesvirus 4 [Epstein-Barr virus]
cccccgggcgccccca

SEQ ID NO: 3975667 - RNA, 20 nt, Human herpesvirus 4 [Epstein-Barr virus]
cccccuggcggcccagcccg

SEQ ID NO: 3975668 - RNA, 16 nt, Human herpesvirus 4 [Epstein-Barr virus]
ccccgcaccagggcca

SEQ ID NO: 3975669 - RNA, 15 nt, Human herpesvirus 4 [Epstein-Barr virus]
ccccgggcgccccca

SEQ ID NO: 3975670 - RNA, 21 nt, Human herpesvirus 4 [Epstein-Barr virus]
ccccggggacaccugcacgag

SEQ ID NO: 3975671 - RNA, 13 nt, Human herpesvirus 4 [Epstein-Barr virus]
ccccuaggccugc

SEQ ID NO: 3975672 - RNA, 21 nt, Human herpesvirus 4 [Epstein-Barr virus]
ccccuccgagugaccagucac

SEQ ID NO: 3975673 - RNA, 18 nt, Human herpesvirus 4 [Epstein-Barr virus]
ccccuggcggcccagccc

SEQ ID NO: 3975674 - RNA, 16 nt, Human herpesvirus 4 [Epstein-Barr virus]
ccccuuccacguggcc

SEQ ID NO: 3975675 - RNA, 19 nt, Human herpesvirus 4 [Epstein-Barr virus]
cccgaaagcggcccagcag

SEQ ID NO: 3975676 - RNA, 20 nt, Human herpesvirus 4 [Epstein-Barr virus]
cccgacaaugagcggggaga

SEQ ID NO: 3975677 - RNA, 16 nt, Human herpesvirus 4 [Epstein-Barr virus]
cccgagaccggcuccg

SEQ ID NO: 3975678 - RNA, 13 nt, Human herpesvirus 4 [Epstein-Barr virus]
cccgcaccagggc

SEQ ID NO: 3975679 - RNA, 18 nt, Human herpesvirus 4 [Epstein-Barr virus]
cccgcaccagggccaggc

SEQ ID NO: 3975680 - RNA, 19 nt, Human herpesvirus 4 [Epstein-Barr virus]
cccgcaccccccgccacca

SEQ ID NO: 3975681 - RNA, 11 nt, Human herpesvirus 4 [Epstein-Barr virus]
cccggacggcc

SEQ ID NO: 3975682 - RNA, 20 nt, Human herpesvirus 4 [Epstein-Barr virus]
cccgggcccagcccuccuca

SEQ ID NO: 3975683 - RNA, 21 nt, Human herpesvirus 4 [Epstein-Barr virus]
cccgggcccagcccuccucag

SEQ ID NO: 3975684 - RNA, 19 nt, Human herpesvirus 4 [Epstein-Barr virus]
cccggggguggaggcugcg

SEQ ID NO: 3975685 - RNA, 19 nt, Human herpesvirus 4 [Epstein-Barr virus]
cccgggucccgccucuccg

SEQ ID NO: 3975686 - RNA, 20 nt, Human herpesvirus 4 [Epstein-Barr virus]
cccggguggugaggacggug

SEQ ID NO: 3975687 - RNA, 23 nt, Human herpesvirus 4 [Epstein-Barr virus]
cccguccagcaggcucaggccgc

SEQ ID NO: 3975688 - RNA, 20 nt, Human herpesvirus 4 [Epstein-Barr virus]
cccgugcuuuuugccaggcc

SEQ ID NO: 3975689 - RNA, 13 nt, Human herpesvirus 4 [Epstein-Barr virus]
cccucccccugcc

SEQ ID NO: 3975690 - RNA, 16 nt, Human herpesvirus 4 [Epstein-Barr virus]
cccucggugggccaga

SEQ ID NO: 3975691 - RNA, 19 nt, Human herpesvirus 4 [Epstein-Barr virus]
cccucugaugguggccggc

SEQ ID NO: 3975692 - RNA, 18 nt, Human herpesvirus 4 [Epstein-Barr virus]
cccucugccuccggccgc

SEQ ID NO: 3975693 - RNA, 16 nt, Human herpesvirus 4 [Epstein-Barr virus]
cccucuuccgugccuc

SEQ ID NO: 3975694 - RNA, 18 nt, Human herpesvirus 4 [Epstein-Barr virus]
cccugcucauaccuccac

SEQ ID NO: 3975695 - RNA, 12 nt, Human herpesvirus 4 [Epstein-Barr virus]
cccuucugcugc

SEQ ID NO: 3975696 - RNA, 13 nt, Human herpesvirus 4 [Epstein-Barr virus]
ccgaggcacuugc

SEQ ID NO: 3975697 - RNA, 21 nt, Human herpesvirus 4 [Epstein-Barr virus]
ccgagugaccagucaccuucc

SEQ ID NO: 3975698 - RNA, 21 nt, Human herpesvirus 4 [Epstein-Barr virus]
ccgcagccacguccagacucc

SEQ ID NO: 3975699 - RNA, 15 nt, Human herpesvirus 4 [Epstein-Barr virus]
ccgcagguggcugcu

SEQ ID NO: 3975700 - RNA, 13 nt, Human herpesvirus 4 [Epstein-Barr virus]
ccgccagcagccc

SEQ ID NO: 3975701 - RNA, 13 nt, Human herpesvirus 4 [Epstein-Barr virus]
ccgccaggaccug

SEQ ID NO: 3975702 - RNA, 18 nt, Human herpesvirus 4 [Epstein-Barr virus]
ccgccaggaccuggaugc

SEQ ID NO: 3975703 - RNA, 12 nt, Human herpesvirus 4 [Epstein-Barr virus]
ccgcccugagcu

SEQ ID NO: 3975704 - RNA, 17 nt, Human herpesvirus 4 [Epstein-Barr virus]
ccgccgccugcggccca

SEQ ID NO: 3975705 - RNA, 20 nt, Human herpesvirus 4 [Epstein-Barr virus]
ccgccuagagcauuugcaag

SEQ ID NO: 3975706 - RNA, 20 nt, Human herpesvirus 4 [Epstein-Barr virus]
ccgcgguuucagcaucacag

SEQ ID NO: 3975707 - RNA, 13 nt, Human herpesvirus 4 [Epstein-Barr virus]
ccgcugggccagg

SEQ ID NO: 3975708 - RNA, 19 nt, Human herpesvirus 4 [Epstein-Barr virus]
ccggacgcagaggccugca

SEQ ID NO: 3975709 - RNA, 17 nt, Human herpesvirus 4 [Epstein-Barr virus]
ccggcaccgccaggugg

SEQ ID NO: 3975710 - RNA, 17 nt, Human herpesvirus 4 [Epstein-Barr virus]
ccggcccuuugccuggg

SEQ ID NO: 3975711 - RNA, 16 nt, Human herpesvirus 4 [Epstein-Barr virus]
ccggcgagacuuggac

SEQ ID NO: 3975712 - RNA, 14 nt, Human herpesvirus 4 [Epstein-Barr virus]
ccggcuaucugcuu

SEQ ID NO: 3975713 - RNA, 14 nt, Human herpesvirus 4 [Epstein-Barr virus]
ccgggcaaacaggg

SEQ ID NO: 3975714 - RNA, 19 nt, Human herpesvirus 4 [Epstein-Barr virus]
ccgggcagguccgugagaa

SEQ ID NO: 3975715 - RNA, 22 nt, Human herpesvirus 4 [Epstein-Barr virus]
ccgggcgcccccaaacuuuguc

SEQ ID NO: 3975716 - RNA, 22 nt, Human herpesvirus 4 [Epstein-Barr virus]
ccggguacccuuucuaccaggg

SEQ ID NO: 3975717 - RNA, 17 nt, Human herpesvirus 4 [Epstein-Barr virus]
ccggucgcaugguggcu

SEQ ID NO: 3975718 - RNA, 21 nt, Human herpesvirus 4 [Epstein-Barr virus]
ccggugguggguguggagccg

SEQ ID NO: 3975719 - RNA, 19 nt, Human herpesvirus 4 [Epstein-Barr virus]
ccgugcauggcagcagaca

SEQ ID NO: 3975720 - RNA, 18 nt, Human herpesvirus 4 [Epstein-Barr virus]
ccguggagccgggggcau

SEQ ID NO: 3975721 - RNA, 22 nt, Human herpesvirus 4 [Epstein-Barr virus]
ccguuccaggcucuccagcccc

SEQ ID NO: 3975722 - RNA, 20 nt, Human herpesvirus 4 [Epstein-Barr virus]
ccuacaccaagauagugacc

SEQ ID NO: 3975723 - RNA, 18 nt, Human herpesvirus 4 [Epstein-Barr virus]
ccuacgcugcccuagagg

SEQ ID NO: 3975724 - RNA, 23 nt, Human herpesvirus 4 [Epstein-Barr virus]
ccuagagguuuugcuagggagga

SEQ ID NO: 3975725 - RNA, 21 nt, Human herpesvirus 4 [Epstein-Barr virus]
ccuagccccgggcccagcccu

SEQ ID NO: 3975726 - RNA, 19 nt, Human herpesvirus 4 [Epstein-Barr virus]
ccuagugguuucggacaca

SEQ ID NO: 3975727 - RNA, 13 nt, Human herpesvirus 4 [Epstein-Barr virus]
ccuaucacaggga

SEQ ID NO: 3975728 - RNA, 15 nt, Human herpesvirus 4 [Epstein-Barr virus]
ccucagaggaggagg

SEQ ID NO: 3975729 - RNA, 16 nt, Human herpesvirus 4 [Epstein-Barr virus]
ccucagauagccggac

SEQ ID NO: 3975730 - RNA, 23 nt, Human herpesvirus 4 [Epstein-Barr virus]
ccucagcgcagggaugccuggac

SEQ ID NO: 3975731 - RNA, 14 nt, Human herpesvirus 4 [Epstein-Barr virus]
ccucaucccugacc

SEQ ID NO: 3975732 - RNA, 14 nt, Human herpesvirus 4 [Epstein-Barr virus]
ccucauccuggccc

SEQ ID NO: 3975733 - RNA, 23 nt, Human herpesvirus 4 [Epstein-Barr virus]
ccuccacuuacaaccaagccacu

SEQ ID NO: 3975734 - RNA, 14 nt, Human herpesvirus 4 [Epstein-Barr virus]
ccuccagagccccu

SEQ ID NO: 3975735 - RNA, 13 nt, Human herpesvirus 4 [Epstein-Barr virus]
ccucccgccccug

SEQ ID NO: 3975736 - RNA, 22 nt, Human herpesvirus 4 [Epstein-Barr virus]
ccuccgguuugaacaucagacc

SEQ ID NO: 3975737 - RNA, 18 nt, Human herpesvirus 4 [Epstein-Barr virus]
ccucgaaggugcagcugg

SEQ ID NO: 3975738 - RNA, 16 nt, Human herpesvirus 4 [Epstein-Barr virus]
ccucgccuucuccuca

SEQ ID NO: 3975739 - RNA, 13 nt, Human herpesvirus 4 [Epstein-Barr virus]
ccucggagucuuc

SEQ ID NO: 3975740 - RNA, 19 nt, Human herpesvirus 4 [Epstein-Barr virus]
ccucggcgccaacgcgcca

SEQ ID NO: 3975741 - RNA, 20 nt, Human herpesvirus 4 [Epstein-Barr virus]
ccucgugcaaccaggcccac

SEQ ID NO: 3975742 - RNA, 14 nt, Human herpesvirus 4 [Epstein-Barr virus]
ccucgugcaccuau

SEQ ID NO: 3975743 - RNA, 14 nt, Human herpesvirus 4 [Epstein-Barr virus]
ccucuaaguacagg

SEQ ID NO: 3975744 - RNA, 21 nt, Human herpesvirus 4 [Epstein-Barr virus]
ccucucgccuuguuucucaga

SEQ ID NO: 3975745 - RNA, 13 nt, Human herpesvirus 4 [Epstein-Barr virus]
ccucuggcacgcc

SEQ ID NO: 3975746 - RNA, 12 nt, Human herpesvirus 4 [Epstein-Barr virus]
ccucugggagaa

SEQ ID NO: 3975747 - RNA, 11 nt, Human herpesvirus 4 [Epstein-Barr virus]
ccucugggugc

SEQ ID NO: 3975748 - RNA, 23 nt, Human herpesvirus 4 [Epstein-Barr virus]
ccugagaaugcuuaucaagcuua

SEQ ID NO: 3975749 - RNA, 20 nt, Human herpesvirus 4 [Epstein-Barr virus]
ccugagcauggcggccuggc

SEQ ID NO: 3975750 - RNA, 20 nt, Human herpesvirus 4 [Epstein-Barr virus]
ccugaguucuacaaugccag

SEQ ID NO: 3975751 - RNA, 23 nt, Human herpesvirus 4 [Epstein-Barr virus]
ccugaucugggagaugagauaga

SEQ ID NO: 3975752 - RNA, 19 nt, Human herpesvirus 4 [Epstein-Barr virus]
ccugaugagucacacccca

SEQ ID NO: 3975753 - RNA, 16 nt, Human herpesvirus 4 [Epstein-Barr virus]
ccugauuugcucuucg

SEQ ID NO: 3975754 - RNA, 19 nt, Human herpesvirus 4 [Epstein-Barr virus]
ccugccaaagagccagauc

SEQ ID NO: 3975755 - RNA, 23 nt, Human herpesvirus 4 [Epstein-Barr virus]
ccugccggaguuuucucccccag

SEQ ID NO: 3975756 - RNA, 13 nt, Human herpesvirus 4 [Epstein-Barr virus]
ccugcuucacgcc

SEQ ID NO: 3975757 - RNA, 14 nt, Human herpesvirus 4 [Epstein-Barr virus]
ccuggcggcccagc

SEQ ID NO: 3975758 - RNA, 20 nt, Human herpesvirus 4 [Epstein-Barr virus]
ccuggcggcccagcccgacc

SEQ ID NO: 3975759 - RNA, 15 nt, Human herpesvirus 4 [Epstein-Barr virus]
ccugggccccccgga

SEQ ID NO: 3975760 - RNA, 21 nt, Human herpesvirus 4 [Epstein-Barr virus]
ccugucucuuucuggccaacc

SEQ ID NO: 3975761 - RNA, 20 nt, Human herpesvirus 4 [Epstein-Barr virus]
ccuguggccccggcuggcca

SEQ ID NO: 3975762 - RNA, 15 nt, Human herpesvirus 4 [Epstein-Barr virus]
ccuguguccugggca

SEQ ID NO: 3975763 - RNA, 12 nt, Human herpesvirus 4 [Epstein-Barr virus]
ccuguugauggu

SEQ ID NO: 3975764 - RNA, 18 nt, Human herpesvirus 4 [Epstein-Barr virus]
ccuguuucggcgccgccc

SEQ ID NO: 3975765 - RNA, 17 nt, Human herpesvirus 4 [Epstein-Barr virus]
ccuuacacuggaaagug

SEQ ID NO: 3975766 - RNA, 14 nt, Human herpesvirus 4 [Epstein-Barr virus]
ccuugcguggugcu

SEQ ID NO: 3975767 - RNA, 18 nt, Human herpesvirus 4 [Epstein-Barr virus]
ccuugggugaccuggcca

SEQ ID NO: 3975768 - RNA, 17 nt, Human herpesvirus 4 [Epstein-Barr virus]
ccuugucuuugguggau

SEQ ID NO: 3975769 - RNA, 12 nt, Human herpesvirus 4 [Epstein-Barr virus]
ucccaggccuca

SEQ ID NO: 3975770 - RNA, 14 nt, Human herpesvirus 4 [Epstein-Barr virus]
ucccauaccuacac

SEQ ID NO: 3975771 - RNA, 19 nt, Human herpesvirus 4 [Epstein-Barr virus]
ucccccaaacauguccugu

SEQ ID NO: 3975772 - RNA, 22 nt, Human herpesvirus 4 [Epstein-Barr virus]
ucccccaaacauguccuguuag

SEQ ID NO: 3975773 - RNA, 16 nt, Human herpesvirus 4 [Epstein-Barr virus]
ucccccuagccccggc

SEQ ID NO: 3975774 - RNA, 21 nt, Human herpesvirus 4 [Epstein-Barr virus]
uccccgagggugaggcccagc

SEQ ID NO: 3975775 - RNA, 15 nt, Human herpesvirus 4 [Epstein-Barr virus]
uccccggccucccgc

SEQ ID NO: 3975776 - RNA, 22 nt, Human herpesvirus 4 [Epstein-Barr virus]
uccccuuguauuugcuauucaa

SEQ ID NO: 3975777 - RNA, 16 nt, Human herpesvirus 4 [Epstein-Barr virus]
ucccgccccuguccac

SEQ ID NO: 3975778 - RNA, 15 nt, Human herpesvirus 4 [Epstein-Barr virus]
ucccgugcuuuuugc

SEQ ID NO: 3975779 - RNA, 18 nt, Human herpesvirus 4 [Epstein-Barr virus]
uccgcggugguggcccuc

SEQ ID NO: 3975780 - RNA, 20 nt, Human herpesvirus 4 [Epstein-Barr virus]
uccgcuuuaagaccaaggcc

SEQ ID NO: 3975781 - RNA, 14 nt, Human herpesvirus 4 [Epstein-Barr virus]
uccggaggggacca

SEQ ID NO: 3975782 - RNA, 21 nt, Human herpesvirus 4 [Epstein-Barr virus]
uccggcugcccgucucggccu

SEQ ID NO: 3975783 - RNA, 16 nt, Human herpesvirus 4 [Epstein-Barr virus]
uccgggcuccaugucc

SEQ ID NO: 3975784 - RNA, 21 nt, Human herpesvirus 4 [Epstein-Barr virus]
uccgggucaggucgcggacca

SEQ ID NO: 3975785 - RNA, 18 nt, Human herpesvirus 4 [Epstein-Barr virus]
uccuacaacucagcccca

SEQ ID NO: 3975786 - RNA, 22 nt, Human herpesvirus 4 [Epstein-Barr virus]
uccucaaauguuccagaagucg

SEQ ID NO: 3975787 - RNA, 15 nt, Human herpesvirus 4 [Epstein-Barr virus]
uccucaagcccuucu

SEQ ID NO: 3975788 - RNA, 21 nt, Human herpesvirus 4 [Epstein-Barr virus]
uccucauuggcuuugcccucu

SEQ ID NO: 3975789 - RNA, 20 nt, Human herpesvirus 4 [Epstein-Barr virus]
uccucauuucaguggcccuc

SEQ ID NO: 3975790 - RNA, 23 nt, Human herpesvirus 4 [Epstein-Barr virus]
ucgaugccgcuuacagccagaga

SEQ ID NO: 3975791 - RNA, 21 nt, Human herpesvirus 4 [Epstein-Barr virus]
ucgauuggaaaagggcccagg

SEQ ID NO: 3975792 - RNA, 19 nt, Human herpesvirus 4 [Epstein-Barr virus]
ucgccuucuccucagccuc

SEQ ID NO: 3975793 - RNA, 17 nt, Human herpesvirus 4 [Epstein-Barr virus]
ucgccuuguuucucaga

SEQ ID NO: 3975794 - RNA, 18 nt, Human herpesvirus 4 [Epstein-Barr virus]
ucgcgugacggcauucgu

SEQ ID NO: 3975795 - RNA, 14 nt, Human herpesvirus 4 [Epstein-Barr virus]
ucggcaccuccucg

SEQ ID NO: 3975796 - RNA, 10 nt, Human herpesvirus 4 [Epstein-Barr virus]
ucggcgccgc

SEQ ID NO: 3975797 - RNA, 19 nt, Human herpesvirus 4 [Epstein-Barr virus]
ucggucaaguaccagcugg

SEQ ID NO: 3975798 - RNA, 13 nt, Human herpesvirus 4 [Epstein-Barr virus]
ucggugggccaga

SEQ ID NO: 3975799 - RNA, 15 nt, Human herpesvirus 4 [Epstein-Barr virus]
ucgugagucugcugg

SEQ ID NO: 3975800 - RNA, 22 nt, Human herpesvirus 4 [Epstein-Barr virus]
ucgugcucuucauguccacuga

SEQ ID NO: 3975801 - RNA, 13 nt, Human herpesvirus 4 [Epstein-Barr virus]
ucguuaugcacuc

SEQ ID NO: 3975802 - RNA, 13 nt, Human herpesvirus 4 [Epstein-Barr virus]
ucuaacaguucac

SEQ ID NO: 3975803 - RNA, 14 nt, Human herpesvirus 4 [Epstein-Barr virus]
ucuacaaugccagg

SEQ ID NO: 3975804 - RNA, 15 nt, Human herpesvirus 4 [Epstein-Barr virus]
ucuacccuccccaug

SEQ ID NO: 3975805 - RNA, 23 nt, Human herpesvirus 4 [Epstein-Barr virus]
ucuaccuggucaagagcuuccug

SEQ ID NO: 3975806 - RNA, 12 nt, Human herpesvirus 4 [Epstein-Barr virus]
ucucauccccag

SEQ ID NO: 3975807 - RNA, 15 nt, Human herpesvirus 4 [Epstein-Barr virus]
ucucccacugucacu

SEQ ID NO: 3975808 - RNA, 13 nt, Human herpesvirus 4 [Epstein-Barr virus]
ucuccccugacgc

SEQ ID NO: 3975809 - RNA, 23 nt, Human herpesvirus 4 [Epstein-Barr virus]
ucuccucagccuccaacaggugc

SEQ ID NO: 3975810 - RNA, 14 nt, Human herpesvirus 4 [Epstein-Barr virus]
ucucuggcugugcu

SEQ ID NO: 3975811 - RNA, 21 nt, Human herpesvirus 4 [Epstein-Barr virus]
ucucuguuucuguacaauggg

SEQ ID NO: 3975812 - RNA, 15 nt, Human herpesvirus 4 [Epstein-Barr virus]
ucucuuaugccugug

SEQ ID NO: 3975813 - RNA, 15 nt, Human herpesvirus 4 [Epstein-Barr virus]
ucugacauuucucau

SEQ ID NO: 3975814 - RNA, 19 nt, Human herpesvirus 4 [Epstein-Barr virus]
ucugaccgacgggcaucuu

SEQ ID NO: 3975815 - RNA, 13 nt, Human herpesvirus 4 [Epstein-Barr virus]
ucugccacaaggc

SEQ ID NO: 3975816 - RNA, 14 nt, Human herpesvirus 4 [Epstein-Barr virus]
ucugccacaaggcc

SEQ ID NO: 3975817 - RNA, 15 nt, Human herpesvirus 4 [Epstein-Barr virus]
ucugccuccggccgc

SEQ ID NO: 3975818 - RNA, 15 nt, Human herpesvirus 4 [Epstein-Barr virus]
ucugcugcugcuggu

SEQ ID NO: 3975819 - RNA, 23 nt, Human herpesvirus 4 [Epstein-Barr virus]
ucugcuggacuccgaggaccagg

SEQ ID NO: 3975820 - RNA, 21 nt, Human herpesvirus 4 [Epstein-Barr virus]
ucugguugauaaucucaaaga

SEQ ID NO: 3975821 - RNA, 15 nt, Human herpesvirus 4 [Epstein-Barr virus]
ucuuacugcccagcc

SEQ ID NO: 3975822 - RNA, 15 nt, Human herpesvirus 4 [Epstein-Barr virus]
ucuucauucuugcua

SEQ ID NO: 3975823 - RNA, 12 nt, Human herpesvirus 4 [Epstein-Barr virus]
ucuuggcagcag

SEQ ID NO: 3975824 - RNA, 23 nt, Human herpesvirus 4 [Epstein-Barr virus]
ucuuguaacggcauagggggagg

SEQ ID NO: 3975825 - RNA, 20 nt, Human herpesvirus 4 [Epstein-Barr virus]
ugaagaucgugaggccugag

SEQ ID NO: 3975826 - RNA, 12 nt, Human herpesvirus 4 [Epstein-Barr virus]
ugaaucaggguc

SEQ ID NO: 3975827 - RNA, 15 nt, Human herpesvirus 4 [Epstein-Barr virus]
ugacagcugucaccc

SEQ ID NO: 3975828 - RNA, 18 nt, Human herpesvirus 4 [Epstein-Barr virus]
ugaccacucaggaagcug

SEQ ID NO: 3975829 - RNA, 18 nt, Human herpesvirus 4 [Epstein-Barr virus]
ugacccauaccaggugcc

SEQ ID NO: 3975830 - RNA, 17 nt, Human herpesvirus 4 [Epstein-Barr virus]
ugacccuucugcugcug

SEQ ID NO: 3975831 - RNA, 22 nt, Human herpesvirus 4 [Epstein-Barr virus]
ugaccucuacacgcuuggaguc

SEQ ID NO: 3975832 - RNA, 16 nt, Human herpesvirus 4 [Epstein-Barr virus]
ugagaacuuucuucua

SEQ ID NO: 3975833 - RNA, 23 nt, Human herpesvirus 4 [Epstein-Barr virus]
ugagccacuccggacgcagaggc

SEQ ID NO: 3975834 - RNA, 21 nt, Human herpesvirus 4 [Epstein-Barr virus]
ugagcgugugcacccggcugg

SEQ ID NO: 3975835 - RNA, 18 nt, Human herpesvirus 4 [Epstein-Barr virus]
ugaggaggcacacaaaau

SEQ ID NO: 3975836 - RNA, 12 nt, Human herpesvirus 4 [Epstein-Barr virus]
ugaggcccagcc

SEQ ID NO: 3975837 - RNA, 14 nt, Human herpesvirus 4 [Epstein-Barr virus]
ugaggcccagcccc

SEQ ID NO: 3975838 - RNA, 19 nt, Human herpesvirus 4 [Epstein-Barr virus]
ugaggcugaugauggccac

SEQ ID NO: 3975839 - RNA, 16 nt, Human herpesvirus 4 [Epstein-Barr virus]
ugagucagccuugccc

SEQ ID NO: 3975840 - RNA, 16 nt, Human herpesvirus 4 [Epstein-Barr virus]
ugaguccaacauuaaa

SEQ ID NO: 3975841 - RNA, 17 nt, Human herpesvirus 4 [Epstein-Barr virus]
ugauauugaauuccaca

SEQ ID NO: 3975842 - RNA, 20 nt, Human herpesvirus 4 [Epstein-Barr virus]
ugauguucaaaccggaggau

SEQ ID NO: 3975843 - RNA, 13 nt, Human herpesvirus 4 [Epstein-Barr virus]
ugauugagaucag

SEQ ID NO: 3975844 - RNA, 17 nt, Human herpesvirus 4 [Epstein-Barr virus]
ugcaacaaucuggacuc

SEQ ID NO: 3975845 - RNA, 21 nt, Human herpesvirus 4 [Epstein-Barr virus]
ugcaauuugccuaacauggag

SEQ ID NO: 3975846 - RNA, 17 nt, Human herpesvirus 4 [Epstein-Barr virus]
ugcacacgcucagcuca

SEQ ID NO: 3975847 - RNA, 21 nt, Human herpesvirus 4 [Epstein-Barr virus]
ugcacagaucugaccacggcc

SEQ ID NO: 3975848 - RNA, 17 nt, Human herpesvirus 4 [Epstein-Barr virus]
ugcacaggcuuggaaac

SEQ ID NO: 3975849 - RNA, 17 nt, Human herpesvirus 4 [Epstein-Barr virus]
ugcacccacccccaccc

SEQ ID NO: 3975850 - RNA, 18 nt, Human herpesvirus 4 [Epstein-Barr virus]
ugcacccacccccacccu

SEQ ID NO: 3975851 - RNA, 16 nt, Human herpesvirus 4 [Epstein-Barr virus]
ugcaccgauagcaugg

SEQ ID NO: 3975852 - RNA, 23 nt, Human herpesvirus 4 [Epstein-Barr virus]
ugcagcaccucagcuguucccag

SEQ ID NO: 3975853 - RNA, 12 nt, Human herpesvirus 4 [Epstein-Barr virus]
ugcaggcuggac

SEQ ID NO: 3975854 - RNA, 14 nt, Human herpesvirus 4 [Epstein-Barr virus]
ugcaguauguacag

SEQ ID NO: 3975855 - RNA, 13 nt, Human herpesvirus 4 [Epstein-Barr virus]
ugcagugggugag

SEQ ID NO: 3975856 - RNA, 19 nt, Human herpesvirus 4 [Epstein-Barr virus]
ugcaucuaagguccauccc

SEQ ID NO: 3975857 - RNA, 17 nt, Human herpesvirus 5
aaaucaucguucgcaug

SEQ ID NO: 3975858 - RNA, 12 nt, Human herpesvirus 5
aacaacagcagc

SEQ ID NO: 3975859 - RNA, 13 nt, Human herpesvirus 5
aacacgcaacacg

SEQ ID NO: 3975860 - RNA, 16 nt, Human herpesvirus 5
aacacuccucuccccg

SEQ ID NO: 3975861 - RNA, 14 nt, Human herpesvirus 5
aacacuggcugcgc

SEQ ID NO: 3975862 - RNA, 20 nt, Human herpesvirus 5
aacagccccgaagguuagcg

SEQ ID NO: 3975863 - RNA, 20 nt, Human herpesvirus 5
aacagccuguggcaccgccu

SEQ ID NO: 3975864 - RNA, 13 nt, Human herpesvirus 5
aacaucuuaagaa

SEQ ID NO: 3975865 - RNA, 21 nt, Human herpesvirus 5
aaccaagucuugccgugacgu

SEQ ID NO: 3975866 - RNA, 20 nt, Human herpesvirus 5
aaccagauacaacgucaugc

SEQ ID NO: 3975867 - RNA, 21 nt, Human herpesvirus 5
aaccagcugguaccugaaacc

SEQ ID NO: 3975868 - RNA, 21 nt, Human herpesvirus 5
aacccaaguagcggcgcgccc

SEQ ID NO: 3975869 - RNA, 11 nt, Human herpesvirus 5
aacccaucccc

SEQ ID NO: 3975870 - RNA, 23 nt, Human herpesvirus 5
aacccugggcuauaugcaucgga

SEQ ID NO: 3975871 - RNA, 19 nt, Human herpesvirus 5
aaccgcgcaaaaccacgcg

SEQ ID NO: 3975872 - RNA, 18 nt, Human herpesvirus 5
aaccgucgaaaacaacca

SEQ ID NO: 3975873 - RNA, 22 nt, Human herpesvirus 5
aaccgugcccguuuucacagca

SEQ ID NO: 3975874 - RNA, 15 nt, Human herpesvirus 5
aaccuaccugggcug

SEQ ID NO: 3975875 - RNA, 13 nt, Human herpesvirus 5
aaccuacgugcaa

SEQ ID NO: 3975876 - RNA, 16 nt, Human herpesvirus 5
aaccuacgugcaacgc

SEQ ID NO: 3975877 - RNA, 14 nt, Human herpesvirus 5
aaccugcugcacuu

SEQ ID NO: 3975878 - RNA, 13 nt, Human herpesvirus 5
aaccuggagcagc

SEQ ID NO: 3975879 - RNA, 20 nt, Human herpesvirus 5
aacgacaguaguagcggcag

SEQ ID NO: 3975880 - RNA, 17 nt, Human herpesvirus 5
aacgaggucguggaucu

SEQ ID NO: 3975881 - RNA, 16 nt, Human herpesvirus 5
aacgccgagcucuguc

SEQ ID NO: 3975882 - RNA, 13 nt, Human herpesvirus 5
aacgcuggcucac

SEQ ID NO: 3975883 - RNA, 13 nt, Human herpesvirus 5
aacguaacagcaa

SEQ ID NO: 3975884 - RNA, 19 nt, Human herpesvirus 5
aacgucaucucgccgacgu

SEQ ID NO: 3975885 - RNA, 18 nt, Human herpesvirus 5
aacgucguuguguucuua

SEQ ID NO: 3975886 - RNA, 18 nt, Human herpesvirus 5
aacgugccacgugacuca

SEQ ID NO: 3975887 - RNA, 12 nt, Human herpesvirus 5
aacgugugguga

SEQ ID NO: 3975888 - RNA, 14 nt, Human herpesvirus 5
aacguguggugaga

SEQ ID NO: 3975889 - RNA, 16 nt, Human herpesvirus 5
aacucuuuccccgccc

SEQ ID NO: 3975890 - RNA, 16 nt, Human herpesvirus 5
aacuguuccacggcca

SEQ ID NO: 3975891 - RNA, 21 nt, Human herpesvirus 5
aacuugagcacaaaaauacug

SEQ ID NO: 3975892 - RNA, 18 nt, Human herpesvirus 5
aacuuugccgucaugccu

SEQ ID NO: 3975893 - RNA, 16 nt, Human herpesvirus 5
aagaaaaaaugguguu

SEQ ID NO: 3975894 - RNA, 13 nt, Human herpesvirus 5
aagaaacgcugga

SEQ ID NO: 3975895 - RNA, 18 nt, Human herpesvirus 5
aagaaucuaggaacacug

SEQ ID NO: 3975896 - RNA, 23 nt, Human herpesvirus 5
aagacgggacggcugccucucau

SEQ ID NO: 3975897 - RNA, 13 nt, Human herpesvirus 5
aagacgggccugg

SEQ ID NO: 3975898 - RNA, 16 nt, Human herpesvirus 5
aagcccguggcccagg

SEQ ID NO: 3975899 - RNA, 20 nt, Human herpesvirus 5
aagccgacaaccugcugcac

SEQ ID NO: 3975900 - RNA, 13 nt, Human herpesvirus 5
aagccggcagcug

SEQ ID NO: 3975901 - RNA, 21 nt, Human herpesvirus 5
aagccuccggaacccucuggc

SEQ ID NO: 3975902 - RNA, 17 nt, Human herpesvirus 5
aagcgccgugcucuugg

SEQ ID NO: 3975903 - RNA, 21 nt, Human herpesvirus 5
aagcgcggagguuugucuggc

SEQ ID NO: 3975904 - RNA, 17 nt, Human herpesvirus 5
aagcuauaccaucaccu

SEQ ID NO: 3975905 - RNA, 22 nt, Human herpesvirus 5
aagcugcugguggugacccagg

SEQ ID NO: 3975906 - RNA, 14 nt, Human herpesvirus 5
aagcugucagccuc

SEQ ID NO: 3975907 - RNA, 22 nt, Human herpesvirus 5
aaggccgccucuucuggcccuc

SEQ ID NO: 3975908 - RNA, 15 nt, Human herpesvirus 5
aaggcggcggccgca

SEQ ID NO: 3975909 - RNA, 15 nt, Human herpesvirus 5
aagggagccccauca

SEQ ID NO: 3975910 - RNA, 18 nt, Human herpesvirus 5
aagggcgaaaacguuucg

SEQ ID NO: 3975911 - RNA, 13 nt, Human herpesvirus 5
aagggcugcucgg

SEQ ID NO: 3975912 - RNA, 22 nt, Human herpesvirus 5
aaggggaaaaggaauagcaaga

SEQ ID NO: 3975913 - RNA, 13 nt, Human herpesvirus 5
aagggugugacug

SEQ ID NO: 3975914 - RNA, 13 nt, Human herpesvirus 5
aaggucguucucc

SEQ ID NO: 3975915 - RNA, 12 nt, Human herpesvirus 5
aaguaugugcuc

SEQ ID NO: 3975916 - RNA, 12 nt, Human herpesvirus 5
aauaaaaaccac

SEQ ID NO: 3975917 - RNA, 15 nt, Human herpesvirus 5
aauaauauacacacg

SEQ ID NO: 3975918 - RNA, 15 nt, Human herpesvirus 5
aauaauggucaauaa

SEQ ID NO: 3975919 - RNA, 14 nt, Human herpesvirus 5
aauacagaguccgu

SEQ ID NO: 3975920 - RNA, 20 nt, Human herpesvirus 5
aauaugggaauuccccugcc

SEQ ID NO: 3975921 - RNA, 16 nt, Human herpesvirus 5
aauauugcuucguaua

SEQ ID NO: 3975922 - RNA, 13 nt, Human herpesvirus 5
aaucgucggcaga

SEQ ID NO: 3975923 - RNA, 15 nt, Human herpesvirus 5
aaucuccugagacac

SEQ ID NO: 3975924 - RNA, 17 nt, Human herpesvirus 5
aaucuuccccucugcug

SEQ ID NO: 3975925 - RNA, 19 nt, Human herpesvirus 5
aaucuuccccucugcugcu

SEQ ID NO: 3975926 - RNA, 19 nt, Human herpesvirus 5
aaugcgucugcaacggcau

SEQ ID NO: 3975927 - RNA, 20 nt, Human herpesvirus 5
aaugcuaguuuguagaggcu

SEQ ID NO: 3975928 - RNA, 14 nt, Human herpesvirus 5
aauggaagccauac

SEQ ID NO: 3975929 - RNA, 18 nt, Human herpesvirus 5
aauugcgggcccugcuga

SEQ ID NO: 3975930 - RNA, 17 nt, Human herpesvirus 5
acaaauaccaacacuau

SEQ ID NO: 3975931 - RNA, 21 nt, Human herpesvirus 5
acaacaccacggcacgacaua

SEQ ID NO: 3975932 - RNA, 21 nt, Human herpesvirus 5
acaacaccguguaaggaaaac

SEQ ID NO: 3975933 - RNA, 13 nt, Human herpesvirus 5
acaacacuacccu

SEQ ID NO: 3975934 - RNA, 15 nt, Human herpesvirus 5
acaacagucgcagcc

SEQ ID NO: 3975935 - RNA, 13 nt, Human herpesvirus 5
acaaccugcugca

SEQ ID NO: 3975936 - RNA, 18 nt, Human herpesvirus 5
acaaccuguggaauaccc

SEQ ID NO: 3975937 - RNA, 16 nt, Human herpesvirus 5
acaacggccgccgcag

SEQ ID NO: 3975938 - RNA, 23 nt, Human herpesvirus 5
acaagacggcuauccagcagcug

SEQ ID NO: 3975939 - RNA, 17 nt, Human herpesvirus 5
acaagcgccgucacuuc

SEQ ID NO: 3975940 - RNA, 12 nt, Human herpesvirus 5
acaagggcuggc

SEQ ID NO: 3975941 - RNA, 18 nt, Human herpesvirus 5
acaaggucguucuccucg

SEQ ID NO: 3975942 - RNA, 14 nt, Human herpesvirus 5
acaaguauuuauga

SEQ ID NO: 3975943 - RNA, 15 nt, Human herpesvirus 5
acacaccgcuuuggu

SEQ ID NO: 3975944 - RNA, 23 nt, Human herpesvirus 5
acacagaagaaaaaaacacaucg

SEQ ID NO: 3975945 - RNA, 12 nt, Human herpesvirus 5
acacauugcuga

SEQ ID NO: 3975946 - RNA, 23 nt, Human herpesvirus 5
acaccaguauugguucugggcgc

SEQ ID NO: 3975947 - RNA, 13 nt, Human herpesvirus 5
acacccugcggag

SEQ ID NO: 3975948 - RNA, 22 nt, Human herpesvirus 5
acacgcgcuacgaaacuuuucu

SEQ ID NO: 3975949 - RNA, 23 nt, Human herpesvirus 5
acacgcgcuacgaaacuuuucug

SEQ ID NO: 3975950 - RNA, 13 nt, Human herpesvirus 5
acacggggauuuu

SEQ ID NO: 3975951 - RNA, 18 nt, Human herpesvirus 5
acacguaaaguagcuggu

SEQ ID NO: 3975952 - RNA, 14 nt, Human herpesvirus 5
acacguugcuuucg

SEQ ID NO: 3975953 - RNA, 21 nt, Human herpesvirus 5
acacguuguuugucugcgacg

SEQ ID NO: 3975954 - RNA, 15 nt, Human herpesvirus 5
acacuacagcuugca

SEQ ID NO: 3975955 - RNA, 23 nt, Human herpesvirus 5
acacucgugacgucaaucaaauc

SEQ ID NO: 3975956 - RNA, 18 nt, Human herpesvirus 5
acacucuggcccugcugu

SEQ ID NO: 3975957 - RNA, 21 nt, Human herpesvirus 5
acacuugaauaaauaaaccgg

SEQ ID NO: 3975958 - RNA, 21 nt, Human herpesvirus 5
acagagacaccaauugcuuua

SEQ ID NO: 3975959 - RNA, 13 nt, Human herpesvirus 5
acagcagcaacag

SEQ ID NO: 3975960 - RNA, 21 nt, Human herpesvirus 5
acagcagcaacagcagccacc

SEQ ID NO: 3975961 - RNA, 11 nt, Human herpesvirus 5
acagcagcucg

SEQ ID NO: 3975962 - RNA, 17 nt, Human herpesvirus 5
acagcggcgacagacgg

SEQ ID NO: 3975963 - RNA, 14 nt, Human herpesvirus 5
acagcguccacagu

SEQ ID NO: 3975964 - RNA, 16 nt, Human herpesvirus 5
acagcguccacaguuu

SEQ ID NO: 3975965 - RNA, 15 nt, Human herpesvirus 5
acagcuaccucauga

SEQ ID NO: 3975966 - RNA, 17 nt, Human herpesvirus 5
acaggacgaggcagggu

SEQ ID NO: 3975967 - RNA, 17 nt, Human herpesvirus 5
acaggccagcugccacc

SEQ ID NO: 3975968 - RNA, 15 nt, Human herpesvirus 5
acaggcgccgcaaac

SEQ ID NO: 3975969 - RNA, 18 nt, Human herpesvirus 5
acaggcucgucgugggcu

SEQ ID NO: 3975970 - RNA, 19 nt, Human herpesvirus 5
acaggggaucuauaaaugu

SEQ ID NO: 3975971 - RNA, 22 nt, Human herpesvirus 5
acagguagguggccaugaugac

SEQ ID NO: 3975972 - RNA, 21 nt, Human herpesvirus 5
aggccaccgggacggccuggg

SEQ ID NO: 3975973 - RNA, 22 nt, Human herpesvirus 5
aggccucguugcacgagugggc

SEQ ID NO: 3975974 - RNA, 14 nt, Human herpesvirus 5
aggcgauccggacc

SEQ ID NO: 3975975 - RNA, 11 nt, Human herpesvirus 5
aggcgcucgug

SEQ ID NO: 3975976 - RNA, 21 nt, Human herpesvirus 5
aggcgcuggacgccaucaugg

SEQ ID NO: 3975977 - RNA, 13 nt, Human herpesvirus 5
aggcggaggagag

SEQ ID NO: 3975978 - RNA, 18 nt, Human herpesvirus 5
aggcggcguggacuggga

SEQ ID NO: 3975979 - RNA, 13 nt, Human herpesvirus 5
agggacgagcagc

SEQ ID NO: 3975980 - RNA, 19 nt, Human herpesvirus 5
agggcgcgcgucuggacgc

SEQ ID NO: 3975981 - RNA, 15 nt, Human herpesvirus 5
agguagguggccaug

SEQ ID NO: 3975982 - RNA, 20 nt, Human herpesvirus 5
agguauuccgaaaccuguau

SEQ ID NO: 3975983 - RNA, 14 nt, Human herpesvirus 5
aggucgaaagccac

SEQ ID NO: 3975984 - RNA, 16 nt, Human herpesvirus 5
aggucguggaggcagc

SEQ ID NO: 3975985 - RNA, 17 nt, Human herpesvirus 5
aggugcugcaccucaac

SEQ ID NO: 3975986 - RNA, 14 nt, Human herpesvirus 5
aggugcuggcggcc

SEQ ID NO: 3975987 - RNA, 15 nt, Human herpesvirus 5
agguuagcgccgcgg

SEQ ID NO: 3975988 - RNA, 13 nt, Human herpesvirus 5
agguugcgccgca

SEQ ID NO: 3975989 - RNA, 16 nt, Human herpesvirus 5
aguauacuaaacucug

SEQ ID NO: 3975990 - RNA, 16 nt, Human herpesvirus 5
aguaucaccuggaagg

SEQ ID NO: 3975991 - RNA, 19 nt, Human herpesvirus 5
agucagacccacuaccugg

SEQ ID NO: 3975992 - RNA, 19 nt, Human herpesvirus 5
agucauuaugauuuccucc

SEQ ID NO: 3975993 - RNA, 13 nt, Human herpesvirus 5
aguccaccucugc

SEQ ID NO: 3975994 - RNA, 20 nt, Human herpesvirus 5
agucgcuuagccaccaccug

SEQ ID NO: 3975995 - RNA, 19 nt, Human herpesvirus 5
agugguggggcugcgucgc

SEQ ID NO: 3975996 - RNA, 18 nt, Human herpesvirus 5
agugucucuaaacgccac

SEQ ID NO: 3975997 - RNA, 20 nt, Human herpesvirus 5
aguuaucagcaauaaaagca

SEQ ID NO: 3975998 - RNA, 23 nt, Human herpesvirus 5
aguugggucccagcgagcugcgc

SEQ ID NO: 3975999 - RNA, 22 nt, Human herpesvirus 5
aguuuaucgagcgcgcucuuga

SEQ ID NO: 3976000 - RNA, 15 nt, Human herpesvirus 5
auaagaaaagacaau

SEQ ID NO: 3976001 - RNA, 11 nt, Human herpesvirus 5
auaagcaccgu

SEQ ID NO: 3976002 - RNA, 13 nt, Human herpesvirus 5
auaauaccacaac

SEQ ID NO: 3976003 - RNA, 23 nt, Human herpesvirus 5
auaauagauuagcagaaggaaua

SEQ ID NO: 3976004 - RNA, 18 nt, Human herpesvirus 5
auaaucgccguuucguaa

SEQ ID NO: 3976005 - RNA, 11 nt, Human herpesvirus 5
auacacacgga

SEQ ID NO: 3976006 - RNA, 17 nt, Human herpesvirus 5
auacaucgcauaugacg

SEQ ID NO: 3976007 - RNA, 22 nt, Human herpesvirus 5
auacauugcccuucuggagcac

SEQ ID NO: 3976008 - RNA, 24 nt, Human herpesvirus 5
auacgacgauguuuuuugaaucau

SEQ ID NO: 3976009 - RNA, 14 nt, Human herpesvirus 5
auacgauaauugcu

SEQ ID NO: 3976010 - RNA, 24 nt, Human herpesvirus 5
auacuaauauccgcguuaucagaa

SEQ ID NO: 3976011 - RNA, 14 nt, Human herpesvirus 5
auacuggaagcugc

SEQ ID NO: 3976012 - RNA, 17 nt, Human herpesvirus 5
auacuggaagcugcugg

SEQ ID NO: 3976013 - RNA, 23 nt, Human herpesvirus 5
auacuuguuucauuuucuuucua

SEQ ID NO: 3976014 - RNA, 15 nt, Human herpesvirus 5
auagaaagucacagg

SEQ ID NO: 3976015 - RNA, 20 nt, Human herpesvirus 5
auaguguguuccuguccggu

SEQ ID NO: 3976016 - RNA, 11 nt, Human herpesvirus 5
auauacacaug

SEQ ID NO: 3976017 - RNA, 18 nt, Human herpesvirus 5
auaugcuaauauauccaa

SEQ ID NO: 3976018 - RNA, 23 nt, Human herpesvirus 5
auaugucaacaugaaucuucccc

SEQ ID NO: 3976019 - RNA, 13 nt, Human herpesvirus 5
aucaacagcagca

SEQ ID NO: 3976020 - RNA, 17 nt, Human herpesvirus 5
aucaacgacgccacaca

SEQ ID NO: 3976021 - RNA, 12 nt, Human herpesvirus 5
aucagccgccgc

SEQ ID NO: 3976022 - RNA, 17 nt, Human herpesvirus 5
aucauggaagagggcgc

SEQ ID NO: 3976023 - RNA, 14 nt, Human herpesvirus 5
auccagcagcugcg

SEQ ID NO: 3976024 - RNA, 19 nt, Human herpesvirus 5
auccgcuacucccgagcuc

SEQ ID NO: 3976025 - RNA, 13 nt, Human herpesvirus 5
auccggcggcgcc

SEQ ID NO: 3976026 - RNA, 14 nt, Human herpesvirus 5
auccuuggaagagg

SEQ ID NO: 3976027 - RNA, 15 nt, Human herpesvirus 5
aucgaccguuguccc

SEQ ID NO: 3976028 - RNA, 16 nt, Human herpesvirus 5
aucgcaacaacagcaa

SEQ ID NO: 3976029 - RNA, 15 nt, Human herpesvirus 5
aucgcagccuccucg

SEQ ID NO: 3976030 - RNA, 15 nt, Human herpesvirus 5
aucgcgagcugggcg

SEQ ID NO: 3976031 - RNA, 19 nt, Human herpesvirus 5
aucgcucgcuuuggagcgc

SEQ ID NO: 3976032 - RNA, 21 nt, Human herpesvirus 5
aucggcucucaggcgcgcaga

SEQ ID NO: 3976033 - RNA, 19 nt, Human herpesvirus 5
aucgggcgcgcaucgccgu

SEQ ID NO: 3976034 - RNA, 14 nt, Human herpesvirus 5
aucgugggccagga

SEQ ID NO: 3976035 - RNA, 16 nt, Human herpesvirus 5
aucgugggccaggacc

SEQ ID NO: 3976036 - RNA, 15 nt, Human herpesvirus 5
aucucaacgucaacg

SEQ ID NO: 3976037 - RNA, 21 nt, Human herpesvirus 5
aucucgccguacggcaacgag

SEQ ID NO: 3976038 - RNA, 21 nt, Human herpesvirus 5
aucugcaccucgaugaagccu

SEQ ID NO: 3976039 - RNA, 20 nt, Human herpesvirus 5
aucugggagguggcugggcu

SEQ ID NO: 3976040 - RNA, 15 nt, Human herpesvirus 5
aucugucaccucaca

SEQ ID NO: 3976041 - RNA, 23 nt, Human herpesvirus 5
aucugucaccucacaagcgucaa

SEQ ID NO: 3976042 - RNA, 23 nt, Human herpesvirus 5
aucuguucuuccaccagcuacuu

SEQ ID NO: 3976043 - RNA, 24 nt, Human herpesvirus 5
aucuguucuuccaccagcuacuuu

SEQ ID NO: 3976044 - RNA, 22 nt, Human herpesvirus 5
aucuuuuggaggauguucugca

SEQ ID NO: 3976045 - RNA, 16 nt, Human herpesvirus 5
augaaaaauaaaaaac

SEQ ID NO: 3976046 - RNA, 21 nt, Human herpesvirus 5
augaagccaagcguauccugg

SEQ ID NO: 3976047 - RNA, 15 nt, Human herpesvirus 5
augaagccuaucaau

SEQ ID NO: 3976048 - RNA, 22 nt, Human herpesvirus 5
augaaguuguugaucugcugaa

SEQ ID NO: 3976049 - RNA, 13 nt, Human herpesvirus 5
augagcgugcugc

SEQ ID NO: 3976050 - RNA, 14 nt, Human herpesvirus 5
augaggaagcgggg

SEQ ID NO: 3976051 - RNA, 13 nt, Human herpesvirus 5
augauauaaagcg

SEQ ID NO: 3976052 - RNA, 16 nt, Human herpesvirus 5
augcagcacauuguau

SEQ ID NO: 3976053 - RNA, 20 nt, Human herpesvirus 5
augccggccucaucuguaaa

SEQ ID NO: 3976054 - RNA, 16 nt, Human herpesvirus 5
augccucuacaucacu

SEQ ID NO: 3976055 - RNA, 19 nt, Human herpesvirus 5
augccuuggcgcucuggau

SEQ ID NO: 3976056 - RNA, 12 nt, Human herpesvirus 5
augcguguccug

SEQ ID NO: 3976057 - RNA, 21 nt, Human herpesvirus 5
auggauugggcggacgugcgu

SEQ ID NO: 3976058 - RNA, 14 nt, Human herpesvirus 5
auguaguugcagag

SEQ ID NO: 3976059 - RNA, 20 nt, Human herpesvirus 5
auguaucgcauaaagggugg

SEQ ID NO: 3976060 - RNA, 18 nt, Human herpesvirus 5
auguccgcucguguucca

SEQ ID NO: 3976061 - RNA, 14 nt, Human herpesvirus 5
auguggaaaucacc

SEQ ID NO: 3976062 - RNA, 17 nt, Human herpesvirus 5
auguggcuccgccggca

SEQ ID NO: 3976063 - RNA, 15 nt, Human herpesvirus 5
auguuacacauuacu

SEQ ID NO: 3976064 - RNA, 23 nt, Human herpesvirus 5
auuaacaauuccacgccgcugcu

SEQ ID NO: 3976065 - RNA, 20 nt, Human herpesvirus 5
auucuaaagccacgcggcgu

SEQ ID NO: 3976066 - RNA, 22 nt, Human herpesvirus 5
auucugagggccgauggcugcc

SEQ ID NO: 3976067 - RNA, 14 nt, Human herpesvirus 5
auuuuauugggaau

SEQ ID NO: 3976068 - RNA, 14 nt, Human herpesvirus 5
auuuucuuucuagu

SEQ ID NO: 3976069 - RNA, 17 nt, Human herpesvirus 5
caaaaaaaaaucggugg

SEQ ID NO: 3976070 - RNA, 14 nt, Human herpesvirus 5
caaaaccggguaca

SEQ ID NO: 3976071 - RNA, 15 nt, Human herpesvirus 5
caaaacgucaggaau

SEQ ID NO: 3976072 - RNA, 17 nt, Human herpesvirus 5
caaacacagacaggcgg

SEQ ID NO: 3976073 - RNA, 15 nt, Human herpesvirus 5
caaacgucacugaca

SEQ ID NO: 3976074 - RNA, 20 nt, Human herpesvirus 5
caaagacgaugauaccgaag

SEQ ID NO: 3976075 - RNA, 18 nt, Human herpesvirus 5
caacaguuaucagcaaua

SEQ ID NO: 3976076 - RNA, 20 nt, Human herpesvirus 5
caacucuaucgcgacagaca

SEQ ID NO: 3976077 - RNA, 18 nt, Human herpesvirus 5
caacugcaccagcaacca

SEQ ID NO: 3976078 - RNA, 12 nt, Human herpesvirus 5
caacugcugccu

SEQ ID NO: 3976079 - RNA, 16 nt, Human herpesvirus 5
caacuguuguuaguuu

SEQ ID NO: 3976080 - RNA, 21 nt, Human herpesvirus 5
caacuuuggcgugcccagccc

SEQ ID NO: 3976081 - RNA, 18 nt, Human herpesvirus 5
caagaguugcaacgcgcc

SEQ ID NO: 3976082 - RNA, 19 nt, Human herpesvirus 5
caagccuguuagaaccgcg

SEQ ID NO: 3976083 - RNA, 21 nt, Human herpesvirus 5
caagcucguuucgccggcgcg

SEQ ID NO: 3976084 - RNA, 16 nt, Human herpesvirus 5
caagcuuuagccaggu

SEQ ID NO: 3976085 - RNA, 17 nt, Human herpesvirus 5
caaggccgccucuucug

SEQ ID NO: 3976086 - RNA, 15 nt, Human herpesvirus 5
caaggcgagccacuc

SEQ ID NO: 3976087 - RNA, 17 nt, Human herpesvirus 5
gaguucaaagccgcgug

SEQ ID NO: 3976088 - RNA, 13 nt, Human herpesvirus 5
gaguugcugugca

SEQ ID NO: 3976089 - RNA, 22 nt, Human herpesvirus 5
gaguuggccucgauccauccug

SEQ ID NO: 3976090 - RNA, 23 nt, Human herpesvirus 5
gaguuggccucgauccauccugg

SEQ ID NO: 3976091 - RNA, 16 nt, Human herpesvirus 5
gauaacuacaacagcg

SEQ ID NO: 3976092 - RNA, 12 nt, Human herpesvirus 5
gauaagcgcuuu

SEQ ID NO: 3976093 - RNA, 16 nt, Human herpesvirus 5
gauacuaucgggggag

SEQ ID NO: 3976094 - RNA, 13 nt, Human herpesvirus 5
gauaggcaccugg

SEQ ID NO: 3976095 - RNA, 15 nt, Human herpesvirus 5
gaucacguuguccuu

SEQ ID NO: 3976096 - RNA, 17 nt, Human herpesvirus 5
gaucagccgccgccucc

SEQ ID NO: 3976097 - RNA, 12 nt, Human herpesvirus 5
gaucaugugcuu

SEQ ID NO: 3976098 - RNA, 22 nt, Human herpesvirus 5
gauccaaggccuccagcgccuc

SEQ ID NO: 3976099 - RNA, 17 nt, Human herpesvirus 5
gauccacgggccgcgcu

SEQ ID NO: 3976100 - RNA, 13 nt, Human herpesvirus 5
gaucccacuggca

SEQ ID NO: 3976101 - RNA, 20 nt, Human herpesvirus 5
gauccgcucaccacguacga

SEQ ID NO: 3976102 - RNA, 17 nt, Human herpesvirus 5
gauccugggacaccacg

SEQ ID NO: 3976103 - RNA, 17 nt, Human herpesvirus 5
gaucgaggcggcggcga

SEQ ID NO: 3976104 - RNA, 16 nt, Human herpesvirus 5
gaucgcagccuccucg

SEQ ID NO: 3976105 - RNA, 22 nt, Human herpesvirus 5
gaucgccgucacuaaggaccga

SEQ ID NO: 3976106 - RNA, 19 nt, Human herpesvirus 5
gaucgcggccuucagcguc

SEQ ID NO: 3976107 - RNA, 17 nt, Human herpesvirus 5
gaucggccgcggugcgc

SEQ ID NO: 3976108 - RNA, 18 nt, Human herpesvirus 5
gaugaaccuuccccaccc

SEQ ID NO: 3976109 - RNA, 16 nt, Human herpesvirus 5
gaugaacgcucucguc

SEQ ID NO: 3976110 - RNA, 13 nt, Human herpesvirus 5
gaugaacuguucc

SEQ ID NO: 3976111 - RNA, 14 nt, Human herpesvirus 5
gaugagauaaaagu

SEQ ID NO: 3976112 - RNA, 17 nt, Human herpesvirus 5
gaugcgcaccuucggcg

SEQ ID NO: 3976113 - RNA, 17 nt, Human herpesvirus 5
gauggaggucugcgaga

SEQ ID NO: 3976114 - RNA, 15 nt, Human herpesvirus 5
gaugucaacacugac

SEQ ID NO: 3976115 - RNA, 19 nt, Human herpesvirus 5
gauuaccuacgucaaagcg

SEQ ID NO: 3976116 - RNA, 17 nt, Human herpesvirus 5
gauucaguaaccuggag

SEQ ID NO: 3976117 - RNA, 22 nt, Human herpesvirus 5
gauucugagggccgauggcugc

SEQ ID NO: 3976118 - RNA, 14 nt, Human herpesvirus 5
gcaacaacagucgc

SEQ ID NO: 3976119 - RNA, 20 nt, Human herpesvirus 5
gcaacaacgacgacuaugau

SEQ ID NO: 3976120 - RNA, 13 nt, Human herpesvirus 5
gcaacacuaaauu

SEQ ID NO: 3976121 - RNA, 17 nt, Human herpesvirus 5
gcaacuucuucuacuca

SEQ ID NO: 3976122 - RNA, 13 nt, Human herpesvirus 5
gcaagggcugcuc

SEQ ID NO: 3976123 - RNA, 17 nt, Human herpesvirus 5
gcaaggucaacuacagc

SEQ ID NO: 3976124 - RNA, 16 nt, Human herpesvirus 5
gcaagugccugcacga

SEQ ID NO: 3976125 - RNA, 19 nt, Human herpesvirus 5
gcaaucgcuucaccgucgc

SEQ ID NO: 3976126 - RNA, 19 nt, Human herpesvirus 5
gcacaccuuuaagguacgg

SEQ ID NO: 3976127 - RNA, 21 nt, Human herpesvirus 5
gcaccacgucgauucccaucu

SEQ ID NO: 3976128 - RNA, 15 nt, Human herpesvirus 5
gcaccaguuggccac

SEQ ID NO: 3976129 - RNA, 15 nt, Human herpesvirus 5
gcaccaugccggagc

SEQ ID NO: 3976130 - RNA, 12 nt, Human herpesvirus 5
gcaccggcagcc

SEQ ID NO: 3976131 - RNA, 19 nt, Human herpesvirus 5
gcaccggcgccugcugcuc

SEQ ID NO: 3976132 - RNA, 16 nt, Human herpesvirus 5
gcaccgguuggagcag

SEQ ID NO: 3976133 - RNA, 19 nt, Human herpesvirus 5
gcaccgguuggagcagcuc

SEQ ID NO: 3976134 - RNA, 18 nt, Human herpesvirus 5
gcacgcgauuggccagca

SEQ ID NO: 3976135 - RNA, 19 nt, Human herpesvirus 5
gcacgcgauuggccagcac

SEQ ID NO: 3976136 - RNA, 13 nt, Human herpesvirus 5
gcacgcggcucac

SEQ ID NO: 3976137 - RNA, 18 nt, Human herpesvirus 5
gcacgggcucgggugacg

SEQ ID NO: 3976138 - RNA, 15 nt, Human herpesvirus 5
gcacgggcugcuggu

SEQ ID NO: 3976139 - RNA, 16 nt, Human herpesvirus 5
gcacguuuuggaaaac

SEQ ID NO: 3976140 - RNA, 18 nt, Human herpesvirus 5
gcacuuccuguacacauc

SEQ ID NO: 3976141 - RNA, 14 nt, Human herpesvirus 5
gcagaacccgguug

SEQ ID NO: 3976142 - RNA, 17 nt, Human herpesvirus 5
gcagaagaauguugcga

SEQ ID NO: 3976143 - RNA, 13 nt, Human herpesvirus 5
gcagaccauccuc

SEQ ID NO: 3976144 - RNA, 18 nt, Human herpesvirus 5
gcagaucgugccgcgagg

SEQ ID NO: 3976145 - RNA, 14 nt, Human herpesvirus 5
gcagcaacagcccc

SEQ ID NO: 3976146 - RNA, 23 nt, Human herpesvirus 5
gcagcacgcgauuggccagcacg

SEQ ID NO: 3976147 - RNA, 22 nt, Human herpesvirus 5
gcagcacgcggcucacguagca

SEQ ID NO: 3976148 - RNA, 13 nt, Human herpesvirus 5
gcagcagcuggug

SEQ ID NO: 3976149 - RNA, 21 nt, Human herpesvirus 5
gcagccaccgacacagcagca

SEQ ID NO: 3976150 - RNA, 18 nt, Human herpesvirus 5
gcagcccauccucgugga

SEQ ID NO: 3976151 - RNA, 23 nt, Human herpesvirus 5
gcagcccauccucguggaaggca

SEQ ID NO: 3976152 - RNA, 17 nt, Human herpesvirus 5
gcagcccgaggugugcg

SEQ ID NO: 3976153 - RNA, 18 nt, Human herpesvirus 5
gcagcgaguugcugugca

SEQ ID NO: 3976154 - RNA, 15 nt, Human herpesvirus 5
gcagcggaacucgac

SEQ ID NO: 3976155 - RNA, 14 nt, Human herpesvirus 5
gcagcggagguggg

SEQ ID NO: 3976156 - RNA, 23 nt, Human herpesvirus 5
gcagcggaggugggccggggccc

SEQ ID NO: 3976157 - RNA, 22 nt, Human herpesvirus 5
gcagcgggaaaccgcgucgucg

SEQ ID NO: 3976158 - RNA, 17 nt, Human herpesvirus 5
gcagcggggagaaaagu

SEQ ID NO: 3976159 - RNA, 23 nt, Human herpesvirus 5
gcagcggggagaaaaguggcaga

SEQ ID NO: 3976160 - RNA, 14 nt, Human herpesvirus 5
gcagcgugcugugc

SEQ ID NO: 3976161 - RNA, 14 nt, Human herpesvirus 5
gcagcucgcgcugg

SEQ ID NO: 3976162 - RNA, 13 nt, Human herpesvirus 5
gcaggccaugggu

SEQ ID NO: 3976163 - RNA, 16 nt, Human herpesvirus 5
gcaggccgcgcaggcc

SEQ ID NO: 3976164 - RNA, 13 nt, Human herpesvirus 5
gcaggcuaaagaa

SEQ ID NO: 3976165 - RNA, 20 nt, Human herpesvirus 5
gcaggggcuggacgugguua

SEQ ID NO: 3976166 - RNA, 17 nt, Human herpesvirus 5
gcaggucacacugggag

SEQ ID NO: 3976167 - RNA, 17 nt, Human herpesvirus 5
gcagugggcccacggcu

SEQ ID NO: 3976168 - RNA, 14 nt, Human herpesvirus 5
gcauacaaugugcu

SEQ ID NO: 3976169 - RNA, 22 nt, Human herpesvirus 5
gcauacggggaggagacacaga

SEQ ID NO: 3976170 - RNA, 17 nt, Human herpesvirus 5
gcauccugcccaccgcc

SEQ ID NO: 3976171 - RNA, 22 nt, Human herpesvirus 5
gcauccugcccaccgccuccga

SEQ ID NO: 3976172 - RNA, 18 nt, Human herpesvirus 5
gcaucgcaacaacagcaa

SEQ ID NO: 3976173 - RNA, 17 nt, Human herpesvirus 5
gcaucuucgacuuucug

SEQ ID NO: 3976174 - RNA, 21 nt, Human herpesvirus 5
gcauggagucgcgcggucgcc

SEQ ID NO: 3976175 - RNA, 12 nt, Human herpesvirus 5
gcaugucgccca

SEQ ID NO: 3976176 - RNA, 22 nt, Human herpesvirus 5
gcauguuggugccccaggauga

SEQ ID NO: 3976177 - RNA, 16 nt, Human herpesvirus 5
gccaacaugcccagca

SEQ ID NO: 3976178 - RNA, 23 nt, Human herpesvirus 5
gccaaggugcgggagacuagguc

SEQ ID NO: 3976179 - RNA, 16 nt, Human herpesvirus 5
gccaccaggugccggc

SEQ ID NO: 3976180 - RNA, 18 nt, Human herpesvirus 5
gccaccauagccacuacc

SEQ ID NO: 3976181 - RNA, 17 nt, Human herpesvirus 5
gccaccaugcaucccac

SEQ ID NO: 3976182 - RNA, 18 nt, Human herpesvirus 5
gccaccaugcaucccacc

SEQ ID NO: 3976183 - RNA, 22 nt, Human herpesvirus 5
gccaccaugcaucccaccacgg

SEQ ID NO: 3976184 - RNA, 20 nt, Human herpesvirus 5
gccaccgacauggagcccac

SEQ ID NO: 3976185 - RNA, 16 nt, Human herpesvirus 5
gccaccgccgccacca

SEQ ID NO: 3976186 - RNA, 20 nt, Human herpesvirus 5
gccaccgucccucagcgacg

SEQ ID NO: 3976187 - RNA, 18 nt, Human herpesvirus 5
gccaccgucgcccucagc

SEQ ID NO: 3976188 - RNA, 18 nt, Human herpesvirus 5
gccacguucuugcguccu

SEQ ID NO: 3976189 - RNA, 23 nt, Human herpesvirus 5
gccacguucuugcguccuucauc

SEQ ID NO: 3976190 - RNA, 15 nt, Human herpesvirus 5
gccacugggccucgg

SEQ ID NO: 3976191 - RNA, 18 nt, Human herpesvirus 5
gccagcguccgcgccugc

SEQ ID NO: 3976192 - RNA, 15 nt, Human herpesvirus 5
gccaggugaccagca

SEQ ID NO: 3976193 - RNA, 15 nt, Human herpesvirus 5
gccaucuagacucac

SEQ ID NO: 3976194 - RNA, 20 nt, Human herpesvirus 5
gccaugcggauccagcugcu

SEQ ID NO: 3976195 - RNA, 16 nt, Human herpesvirus 5
gccauuuucagcgacg

SEQ ID NO: 3976196 - RNA, 13 nt, Human herpesvirus 5
gcccaaagaccgc

SEQ ID NO: 3976197 - RNA, 14 nt, Human herpesvirus 5
gcccacgaaggcgc

SEQ ID NO: 3976198 - RNA, 20 nt, Human herpesvirus 5
gcccaucgucugcauguuca

SEQ ID NO: 3976199 - RNA, 15 nt, Human herpesvirus 5
gccccacaugcugcu

SEQ ID NO: 3976200 - RNA, 16 nt, Human herpesvirus 5
gccccacaugcugcuu

SEQ ID NO: 3976201 - RNA, 15 nt, Human herpesvirus 5
gccccaucauggccc

SEQ ID NO: 3976202 - RNA, 14 nt, Human herpesvirus 5
ggccgucuccacca

SEQ ID NO: 3976203 - RNA, 15 nt, Human herpesvirus 5
ggccuacggcugcau

SEQ ID NO: 3976204 - RNA, 14 nt, Human herpesvirus 5
ggcgaagcgggaag

SEQ ID NO: 3976205 - RNA, 17 nt, Human herpesvirus 5
ggcgacaagcuguggcu

SEQ ID NO: 3976206 - RNA, 13 nt, Human herpesvirus 5
ggcgacagacggc

SEQ ID NO: 3976207 - RNA, 24 nt, Human herpesvirus 5
ggcgaccgucuggagguggccugc

SEQ ID NO: 3976208 - RNA, 20 nt, Human herpesvirus 5
ggcgcaggucacacugggag

SEQ ID NO: 3976209 - RNA, 19 nt, Human herpesvirus 5
ggcgcccaaaccgcaggag

SEQ ID NO: 3976210 - RNA, 15 nt, Human herpesvirus 5
ggcgccgggacucug

SEQ ID NO: 3976211 - RNA, 18 nt, Human herpesvirus 5
ggcgccgggacucuggug

SEQ ID NO: 3976212 - RNA, 18 nt, Human herpesvirus 5
ggcgccugguugcugccg

SEQ ID NO: 3976213 - RNA, 20 nt, Human herpesvirus 5
ggcgcguuauaagcaccgug

SEQ ID NO: 3976214 - RNA, 12 nt, Human herpesvirus 5
ggcgcucuggau

SEQ ID NO: 3976215 - RNA, 15 nt, Human herpesvirus 5
ggcgcuucgagggcu

SEQ ID NO: 3976216 - RNA, 12 nt, Human herpesvirus 5
ggcggcagccac

SEQ ID NO: 3976217 - RNA, 19 nt, Human herpesvirus 5
ggcggccgagucuccgcgc

SEQ ID NO: 3976218 - RNA, 14 nt, Human herpesvirus 5
ggcggcgaucgcgc

SEQ ID NO: 3976219 - RNA, 16 nt, Human herpesvirus 5
ggcggcgauggucaug

SEQ ID NO: 3976220 - RNA, 17 nt, Human herpesvirus 5
ggcggcgccgggcgcca

SEQ ID NO: 3976221 - RNA, 14 nt, Human herpesvirus 5
ggcggcggugguga

SEQ ID NO: 3976222 - RNA, 14 nt, Human herpesvirus 5
ggcggcugaucugc

SEQ ID NO: 3976223 - RNA, 17 nt, Human herpesvirus 5
ggcgggcgcgggguggc

SEQ ID NO: 3976224 - RNA, 19 nt, Human herpesvirus 5
ggcgguacugaagccgccg

SEQ ID NO: 3976225 - RNA, 13 nt, Human herpesvirus 5
ggcgguggccguc

SEQ ID NO: 3976226 - RNA, 17 nt, Human herpesvirus 5
ggcgguuucagcuggca

SEQ ID NO: 3976227 - RNA, 21 nt, Human herpesvirus 5
ggcguagucggcuaacaaagc

SEQ ID NO: 3976228 - RNA, 19 nt, Human herpesvirus 5
ggcgucuuccuccucgucg

SEQ ID NO: 3976229 - RNA, 21 nt, Human herpesvirus 5
ggcgugaccacgucaccgugc

SEQ ID NO: 3976230 - RNA, 14 nt, Human herpesvirus 5
ggcgugccgagcug

SEQ ID NO: 3976231 - RNA, 19 nt, Human herpesvirus 5
ggcguggaugagguacugc

SEQ ID NO: 3976232 - RNA, 22 nt, Human herpesvirus 5
ggcguggcggccgacggcagcg

SEQ ID NO: 3976233 - RNA, 12 nt, Human herpesvirus 5
ggcguucugcuc

SEQ ID NO: 3976234 - RNA, 16 nt, Human herpesvirus 5
ggcuacguacgacugc

SEQ ID NO: 3976235 - RNA, 14 nt, Human herpesvirus 5
ggcuacugcugcuu

SEQ ID NO: 3976236 - RNA, 20 nt, Human herpesvirus 5
ggcucaccacgcagcaggcu

SEQ ID NO: 3976237 - RNA, 15 nt, Human herpesvirus 5
ggcuccacacgcauc

SEQ ID NO: 3976238 - RNA, 21 nt, Human herpesvirus 5
ggcucgcaaagacgugccacg

SEQ ID NO: 3976239 - RNA, 13 nt, Human herpesvirus 5
ggcucgcucggcc

SEQ ID NO: 3976240 - RNA, 17 nt, Human herpesvirus 5
ggcucguguggcagcug

SEQ ID NO: 3976241 - RNA, 19 nt, Human herpesvirus 5
ggcucucaggcgcgcagac

SEQ ID NO: 3976242 - RNA, 20 nt, Human herpesvirus 5
ggcucucggaucugcggcuc

SEQ ID NO: 3976243 - RNA, 13 nt, Human herpesvirus 5
ggcugacagucga

SEQ ID NO: 3976244 - RNA, 15 nt, Human herpesvirus 5
ggcugaccgucgucc

SEQ ID NO: 3976245 - RNA, 19 nt, Human herpesvirus 5
ggcugagacaggacgaggc

SEQ ID NO: 3976246 - RNA, 22 nt, Human herpesvirus 5
ggcugagacaggacgaggcagg

SEQ ID NO: 3976247 - RNA, 21 nt, Human herpesvirus 5
ggcugagauucgcgggaucgu

SEQ ID NO: 3976248 - RNA, 12 nt, Human herpesvirus 5
ggcugccggucu

SEQ ID NO: 3976249 - RNA, 15 nt, Human herpesvirus 5
ggcugccuguuccug

SEQ ID NO: 3976250 - RNA, 22 nt, Human herpesvirus 5
ggcugcgcgcucgucuccacgc

SEQ ID NO: 3976251 - RNA, 19 nt, Human herpesvirus 5
ggcuggcgacccgcagucu

SEQ ID NO: 3976252 - RNA, 15 nt, Human herpesvirus 5
ggcuggcgugcuguu

SEQ ID NO: 3976253 - RNA, 19 nt, Human herpesvirus 5
ggcuucccuccugcagcug

SEQ ID NO: 3976254 - RNA, 14 nt, Human herpesvirus 5
ggcuugaccgcguu

SEQ ID NO: 3976255 - RNA, 13 nt, Human herpesvirus 5
gggaacacaucgc

SEQ ID NO: 3976256 - RNA, 13 nt, Human herpesvirus 5
gggacggugauga

SEQ ID NO: 3976257 - RNA, 17 nt, Human herpesvirus 5
gggagacaaggugguga

SEQ ID NO: 3976258 - RNA, 12 nt, Human herpesvirus 5
gggagccccauc

SEQ ID NO: 3976259 - RNA, 19 nt, Human herpesvirus 5
gggaggccacaggcggcgc

SEQ ID NO: 3976260 - RNA, 14 nt, Human herpesvirus 5
gggagucaacacua

SEQ ID NO: 3976261 - RNA, 13 nt, Human herpesvirus 5
gggaugacgggga

SEQ ID NO: 3976262 - RNA, 19 nt, Human herpesvirus 5
gggcauacgcgauaucugg

SEQ ID NO: 3976263 - RNA, 13 nt, Human herpesvirus 5
gggccaacgguac

SEQ ID NO: 3976264 - RNA, 20 nt, Human herpesvirus 5
gggccgccaauuggcggcga

SEQ ID NO: 3976265 - RNA, 19 nt, Human herpesvirus 5
gggccgcgcuccaggcgga

SEQ ID NO: 3976266 - RNA, 22 nt, Human herpesvirus 5
gggcgacacucaguacuuuggg

SEQ ID NO: 3976267 - RNA, 19 nt, Human herpesvirus 5
gggcgauggguccgagcug

SEQ ID NO: 3976268 - RNA, 13 nt, Human herpesvirus 5
gggcgauucugug

SEQ ID NO: 3976269 - RNA, 22 nt, Human herpesvirus 5
gggcgcaucacccgccucaugg

SEQ ID NO: 3976270 - RNA, 12 nt, Human herpesvirus 5
gggcguuguuga

SEQ ID NO: 3976271 - RNA, 20 nt, Human herpesvirus 5
gggcucguguggcagcuggc

SEQ ID NO: 3976272 - RNA, 21 nt, Human herpesvirus 5
gggcuucccuccugcagcugc

SEQ ID NO: 3976273 - RNA, 22 nt, Human herpesvirus 5
ggggaaaaucacgaaaggcacc

SEQ ID NO: 3976274 - RNA, 19 nt, Human herpesvirus 5
ggggcgcagaaacuuuucc

SEQ ID NO: 3976275 - RNA, 12 nt, Human herpesvirus 5
ggggcugcucaa

SEQ ID NO: 3976276 - RNA, 16 nt, Human herpesvirus 5
gggguacgcuaugugu

SEQ ID NO: 3976277 - RNA, 17 nt, Human herpesvirus 5
ggguggcgaagcgggaa

SEQ ID NO: 3976278 - RNA, 16 nt, Human herpesvirus 5
gguaacuggcagagcc

SEQ ID NO: 3976279 - RNA, 15 nt, Human herpesvirus 5
gguacgccaguagcc

SEQ ID NO: 3976280 - RNA, 15 nt, Human herpesvirus 5
ggucaaaagccuggg

SEQ ID NO: 3976281 - RNA, 18 nt, Human herpesvirus 5
ggucacugacgugcagga

SEQ ID NO: 3976282 - RNA, 15 nt, Human herpesvirus 5
ggucagcuugaggcu

SEQ ID NO: 3976283 - RNA, 16 nt, Human herpesvirus 5
ggucaugaaguuguug

SEQ ID NO: 3976284 - RNA, 12 nt, Human herpesvirus 5
gguccagccagc

SEQ ID NO: 3976285 - RNA, 14 nt, Human herpesvirus 5
gguccgcccgccga

SEQ ID NO: 3976286 - RNA, 20 nt, Human herpesvirus 5
gguccgucgagaccggcgga

SEQ ID NO: 3976287 - RNA, 19 nt, Human herpesvirus 5
gguccuccagcagcagcug

SEQ ID NO: 3976288 - RNA, 21 nt, Human herpesvirus 5
gguccuccagcagcagcuggu

SEQ ID NO: 3976289 - RNA, 23 nt, Human herpesvirus 5
ggucgacugcguggggugcugga

SEQ ID NO: 3976290 - RNA, 17 nt, Human herpesvirus 5
ggucggucagccgaccc

SEQ ID NO: 3976291 - RNA, 12 nt, Human herpesvirus 5
ggucggugucuc

SEQ ID NO: 3976292 - RNA, 17 nt, Human herpesvirus 5
ggugacgucgguggugg

SEQ ID NO: 3976293 - RNA, 16 nt, Human herpesvirus 5
ggugaugaugcugcug

SEQ ID NO: 3976294 - RNA, 15 nt, Human herpesvirus 5
ggugcaucaucuggu

SEQ ID NO: 3976295 - RNA, 20 nt, Human herpesvirus 5
ggugcggugaaacucuaugg

SEQ ID NO: 3976296 - RNA, 18 nt, Human herpesvirus 5
ggugcuauggcugcucaa

SEQ ID NO: 3976297 - RNA, 15 nt, Human herpesvirus 5
ggugcucgaccagga

SEQ ID NO: 3976298 - RNA, 20 nt, Human herpesvirus 5
gguggacuuccaggugcgca

SEQ ID NO: 3976299 - RNA, 20 nt, Human herpesvirus 5
gguggagaugaggcggcgug

SEQ ID NO: 3976300 - RNA, 13 nt, Human herpesvirus 5
gguggcggcagcc

SEQ ID NO: 3976301 - RNA, 14 nt, Human herpesvirus 5
gguggcucuugcgc

SEQ ID NO: 3976302 - RNA, 22 nt, Human herpesvirus 5
gguggugugugauggggugugg

SEQ ID NO: 3976303 - RNA, 19 nt, Human herpesvirus 5
ggugguuuaugaugaaacc

SEQ ID NO: 3976304 - RNA, 17 nt, Human herpesvirus 5
gguguuucuccgugugu

SEQ ID NO: 3976305 - RNA, 16 nt, Human herpesvirus 5
gguuaccccucgcugg

SEQ ID NO: 3976306 - RNA, 11 nt, Human herpesvirus 5
gguugcagcuu

SEQ ID NO: 3976307 - RNA, 15 nt, Human herpesvirus 5
gguuguuucuccguc

SEQ ID NO: 3976308 - RNA, 16 nt, Human herpesvirus 5
gguuucgggccgacgu

SEQ ID NO: 3976309 - RNA, 17 nt, Human herpesvirus 5
gguuugugccucugaaa

SEQ ID NO: 3976310 - RNA, 24 nt, Human herpesvirus 5
guaacacacggccagcuccacgcu

SEQ ID NO: 3976311 - RNA, 14 nt, Human herpesvirus 5
guaaccuggagcag

SEQ ID NO: 3976312 - RNA, 14 nt, Human herpesvirus 5
guaagcggcagcau

SEQ ID NO: 3976313 - RNA, 16 nt, Human herpesvirus 5
guacagcggcucgccg

SEQ ID NO: 3976314 - RNA, 19 nt, Human herpesvirus 5
guacagcggcucgccgcag

SEQ ID NO: 3976315 - RNA, 11 nt, Human herpesvirus 5
guaccacauuu

SEQ ID NO: 3976316 - RNA, 15 nt, Human herpesvirus 5
guacccaccaccucc

SEQ ID NO: 3976317 - RNA, 12 nt, Human herpesvirus 5
guaccuacggac

SEQ ID NO: 3976318 - RNA, 20 nt, Human herpesvirus 5
ucacgacgacgcgcccccca

SEQ ID NO: 3976319 - RNA, 21 nt, Human herpesvirus 5
ucacggcggcguguguuuuau

SEQ ID NO: 3976320 - RNA, 20 nt, Human herpesvirus 5
ucacgggaaggcuaguuaga

SEQ ID NO: 3976321 - RNA, 19 nt, Human herpesvirus 5
ucacgggacccgccgccgc

SEQ ID NO: 3976322 - RNA, 13 nt, Human herpesvirus 5
ucacuagacagau

SEQ ID NO: 3976323 - RNA, 19 nt, Human herpesvirus 5
ucacuugcgcgguuauggc

SEQ ID NO: 3976324 - RNA, 23 nt, Human herpesvirus 5
ucacuuuuaacagcucaugccuc

SEQ ID NO: 3976325 - RNA, 17 nt, Human herpesvirus 5
ucagacccacuaccugg

SEQ ID NO: 3976326 - RNA, 12 nt, Human herpesvirus 5
ucagagcaucaa

SEQ ID NO: 3976327 - RNA, 19 nt, Human herpesvirus 5
ucagaguaggugauccagu

SEQ ID NO: 3976328 - RNA, 22 nt, Human herpesvirus 5
ucagccucuguguucccaacac

SEQ ID NO: 3976329 - RNA, 17 nt, Human herpesvirus 5
ucagcggcacgccgccg

SEQ ID NO: 3976330 - RNA, 23 nt, Human herpesvirus 5
ucagcggcguguacagcuaccuc

SEQ ID NO: 3976331 - RNA, 13 nt, Human herpesvirus 5
ucaucagccaacu

SEQ ID NO: 3976332 - RNA, 19 nt, Human herpesvirus 5
ucaucuuuauuugcaucau

SEQ ID NO: 3976333 - RNA, 18 nt, Human herpesvirus 5
ucaugaguuggugcagcu

SEQ ID NO: 3976334 - RNA, 13 nt, Human herpesvirus 5
ucaugucuuacaa

SEQ ID NO: 3976335 - RNA, 16 nt, Human herpesvirus 5
ucauguucucccagga

SEQ ID NO: 3976336 - RNA, 19 nt, Human herpesvirus 5
ucauuagcgcgcugguuug

SEQ ID NO: 3976337 - RNA, 19 nt, Human herpesvirus 5
uccaaggccuccagcgccu

SEQ ID NO: 3976338 - RNA, 21 nt, Human herpesvirus 5
uccacagagccgcguggcugu

SEQ ID NO: 3976339 - RNA, 22 nt, Human herpesvirus 5
uccaccauccgaagcuacagcc

SEQ ID NO: 3976340 - RNA, 15 nt, Human herpesvirus 5
uccacgccaccgccg

SEQ ID NO: 3976341 - RNA, 21 nt, Human herpesvirus 5
uccacggccuccgacgagcgu

SEQ ID NO: 3976342 - RNA, 15 nt, Human herpesvirus 5
uccacguagguuucu

SEQ ID NO: 3976343 - RNA, 19 nt, Human herpesvirus 5
uccacugccaacccagcag

SEQ ID NO: 3976344 - RNA, 22 nt, Human herpesvirus 5
uccacugccaacccagcagccg

SEQ ID NO: 3976345 - RNA, 21 nt, Human herpesvirus 5
uccagauacgcgcugguucug

SEQ ID NO: 3976346 - RNA, 15 nt, Human herpesvirus 5
uccagcacaaaaaac

SEQ ID NO: 3976347 - RNA, 18 nt, Human herpesvirus 5
uccaggagguggucgagc

SEQ ID NO: 3976348 - RNA, 20 nt, Human herpesvirus 5
uccaucggcagauccggcaa

SEQ ID NO: 3976349 - RNA, 16 nt, Human herpesvirus 5
uccaugucuccaaguc

SEQ ID NO: 3976350 - RNA, 15 nt, Human herpesvirus 5
uccaugugcagcugg

SEQ ID NO: 3976351 - RNA, 21 nt, Human herpesvirus 5
ucccaccgcgacccagcgaca

SEQ ID NO: 3976352 - RNA, 17 nt, Human herpesvirus 5
ucccaugcaacuucuuc

SEQ ID NO: 3976353 - RNA, 17 nt, Human herpesvirus 5
uccccgacuccgcgguc

SEQ ID NO: 3976354 - RNA, 18 nt, Human herpesvirus 5
uccccggucgcuuaugcg

SEQ ID NO: 3976355 - RNA, 15 nt, Human herpesvirus 5
uccccuaacgucacu

SEQ ID NO: 3976356 - RNA, 13 nt, Human herpesvirus 5
uccccucugcugc

SEQ ID NO: 3976357 - RNA, 16 nt, Human herpesvirus 5
uccccucugcugcugg

SEQ ID NO: 3976358 - RNA, 21 nt, Human herpesvirus 5
ucccggauccaagggacgagc

SEQ ID NO: 3976359 - RNA, 15 nt, Human herpesvirus 5
ucccggccuugcugu

SEQ ID NO: 3976360 - RNA, 16 nt, Human herpesvirus 5
ucccgugugugggggg

SEQ ID NO: 3976361 - RNA, 17 nt, Human herpesvirus 5
ucccuacuaccgucgug

SEQ ID NO: 3976362 - RNA, 20 nt, Human herpesvirus 5
ucccucaccgaccagcacuc

SEQ ID NO: 3976363 - RNA, 11 nt, Human herpesvirus 5
ucccucagccu

SEQ ID NO: 3976364 - RNA, 16 nt, Human herpesvirus 5
ucccucagccucugug

SEQ ID NO: 3976365 - RNA, 17 nt, Human herpesvirus 5
ucccuccugcagcugca

SEQ ID NO: 3976366 - RNA, 18 nt, Human herpesvirus 5
ucccuccugcagcugcac

SEQ ID NO: 3976367 - RNA, 20 nt, Human herpesvirus 5
uccgacgucggucccaucgc

SEQ ID NO: 3976368 - RNA, 22 nt, Human herpesvirus 5
uccgacucgcugucgagacggc

SEQ ID NO: 3976369 - RNA, 18 nt, Human herpesvirus 5
uccgcuacucccgagcuc

SEQ ID NO: 3976370 - RNA, 15 nt, Human herpesvirus 5
uccgcuuccucagcu

SEQ ID NO: 3976371 - RNA, 18 nt, Human herpesvirus 5
uccggcggcgccgucaga

SEQ ID NO: 3976372 - RNA, 23 nt, Human herpesvirus 5
uccguccucgucgccuuccagcu

SEQ ID NO: 3976373 - RNA, 14 nt, Human herpesvirus 5
uccuccucccucgc

SEQ ID NO: 3976374 - RNA, 17 nt, Human herpesvirus 5
uccuccucugccugggc

SEQ ID NO: 3976375 - RNA, 20 nt, Human herpesvirus 5
uccucggguuccucggccuc

SEQ ID NO: 3976376 - RNA, 14 nt, Human herpesvirus 5
uccugguuuuucau

SEQ ID NO: 3976377 - RNA, 14 nt, Human herpesvirus 5
uccuuaucugggug

SEQ ID NO: 3976378 - RNA, 15 nt, Human herpesvirus 5
ucgaccgacaaggcg

SEQ ID NO: 3976379 - RNA, 14 nt, Human herpesvirus 5
ucgacgauaugucg

SEQ ID NO: 3976380 - RNA, 18 nt, Human herpesvirus 5
ucgagaacuacagcuucu

SEQ ID NO: 3976381 - RNA, 19 nt, Human herpesvirus 5
ucgagacuugcacgcuguc

SEQ ID NO: 3976382 - RNA, 17 nt, Human herpesvirus 5
ucgaggaggggccgcug

SEQ ID NO: 3976383 - RNA, 20 nt, Human herpesvirus 5
ucgauccucucucacgcguc

SEQ ID NO: 3976384 - RNA, 16 nt, Human herpesvirus 5
ucgcacaaagaagucu

SEQ ID NO: 3976385 - RNA, 20 nt, Human herpesvirus 5
ucgcagccuccucgcuggga

SEQ ID NO: 3976386 - RNA, 15 nt, Human herpesvirus 5
ucgcccagaaagaac

SEQ ID NO: 3976387 - RNA, 15 nt, Human herpesvirus 5
ucgcccucgacggcg

SEQ ID NO: 3976388 - RNA, 18 nt, Human herpesvirus 5
ucgccgaggcuacugcug

SEQ ID NO: 3976389 - RNA, 13 nt, Human herpesvirus 5
ucgccgccaccuu

SEQ ID NO: 3976390 - RNA, 22 nt, Human herpesvirus 5
ucgcgagccccaucgggcccgc

SEQ ID NO: 3976391 - RNA, 19 nt, Human herpesvirus 5
ucgcgcaucgccugcaccu

SEQ ID NO: 3976392 - RNA, 15 nt, Human herpesvirus 5
ucgcgccuccuccug

SEQ ID NO: 3976393 - RNA, 18 nt, Human herpesvirus 5
ucgcgugccgaauacaaa

SEQ ID NO: 3976394 - RNA, 15 nt, Human herpesvirus 5
ucgcucgcuuuggag

SEQ ID NO: 3976395 - RNA, 15 nt, Human herpesvirus 5
ucggaggaacccugc

SEQ ID NO: 3976396 - RNA, 14 nt, Human herpesvirus 5
ucggaugaggcagg

SEQ ID NO: 3976397 - RNA, 15 nt, Human herpesvirus 5
ucggccgaccccguc

SEQ ID NO: 3976398 - RNA, 18 nt, Human herpesvirus 5
ucggccggaccgugcacg

SEQ ID NO: 3976399 - RNA, 23 nt, Human herpesvirus 5
ucggcgugaaugggcacgccgug

SEQ ID NO: 3976400 - RNA, 23 nt, Human herpesvirus 5
ucggcguggucaacgcuuuggaa

SEQ ID NO: 3976401 - RNA, 22 nt, Human herpesvirus 5
ucggcugccuguuccugcugcu

SEQ ID NO: 3976402 - RNA, 20 nt, Human herpesvirus 5
ucgggcgcaucacccgccuc

SEQ ID NO: 3976403 - RNA, 16 nt, Human herpesvirus 5
ucggggugcaucaucu

SEQ ID NO: 3976404 - RNA, 17 nt, Human herpesvirus 5
ucgguguuaaggauucu

SEQ ID NO: 3976405 - RNA, 18 nt, Human herpesvirus 5
ucguacgacgucugcuca

SEQ ID NO: 3976406 - RNA, 16 nt, Human herpesvirus 5
ucguaguuguugcaga

SEQ ID NO: 3976407 - RNA, 11 nt, Human herpesvirus 5
ucguccagcag

SEQ ID NO: 3976408 - RNA, 13 nt, Human herpesvirus 5
ucgucgugcccgu

SEQ ID NO: 3976409 - RNA, 12 nt, Human herpesvirus 5
ucgucugcaugu

SEQ ID NO: 3976410 - RNA, 13 nt, Human herpesvirus 5
ucgugcgaggaca

SEQ ID NO: 3976411 - RNA, 15 nt, Human herpesvirus 5
ucguuguccuccucg

SEQ ID NO: 3976412 - RNA, 21 nt, Human herpesvirus 5
ucuaaugugcuguuugaaaca

SEQ ID NO: 3976413 - RNA, 16 nt, Human herpesvirus 5
ucuaccuccugcagga

SEQ ID NO: 3976414 - RNA, 21 nt, Human herpesvirus 5
ucuacgugucugggccacagg

SEQ ID NO: 3976415 - RNA, 18 nt, Human herpesvirus 5
ucuacuccaucaugaagg

SEQ ID NO: 3976416 - RNA, 17 nt, Human herpesvirus 5
ucuacuccgaauaacaa

SEQ ID NO: 3976417 - RNA, 13 nt, Human herpesvirus 5
ucuacugcaacug

SEQ ID NO: 3976418 - RNA, 14 nt, Human herpesvirus 5
ucuaggaacacuga

SEQ ID NO: 3976419 - RNA, 19 nt, Human herpesvirus 5
ucuaggcuacucugacugu

SEQ ID NO: 3976420 - RNA, 23 nt, Human herpesvirus 5
ucuauaggcgguacuuacgucac

SEQ ID NO: 3976421 - RNA, 13 nt, Human herpesvirus 5
ucuauauucugca

SEQ ID NO: 3976422 - RNA, 14 nt, Human herpesvirus 5
ucucaacgacuuuc

SEQ ID NO: 3976423 - RNA, 14 nt, Human herpesvirus 5
ucucagccucgucg

SEQ ID NO: 3976424 - RNA, 19 nt, Human herpesvirus 5
ucucaugucgcucuuggag

SEQ ID NO: 3976425 - RNA, 15 nt, Human herpesvirus 5
ucucccgacgucacu

SEQ ID NO: 3976426 - RNA, 14 nt, Human herpesvirus 5
ucuccgguuucaaa

SEQ ID NO: 3976427 - RNA, 19 nt, Human herpesvirus 5
ucugacgcugucuugcuua

SEQ ID NO: 3976428 - RNA, 13 nt, Human herpesvirus 5
ucugccucuuccu

SEQ ID NO: 3976429 - RNA, 15 nt, Human herpesvirus 5
ucuggcccuccgcca

SEQ ID NO: 3976430 - RNA, 22 nt, Human herpesvirus 5
ucugggugcaaugccucauccu

SEQ ID NO: 3976431 - RNA, 16 nt, Human herpesvirus 5
ucuggucuucccuaca

SEQ ID NO: 3976432 - RNA, 20 nt, Human herpesvirus 5
ucuguaaaagcugcaugaaa

SEQ ID NO: 3976433 - RNA, 16 nt, Human herpesvirus 5
ucugucguacuguccu

SEQ ID NO: 3976434 - RNA, 12 nt, Human herpesvirus 5
ucuucuggcccu

SEQ ID NO: 3976435 - RNA, 15 nt, Human herpesvirus 5
ucuugacuggccgga

SEQ ID NO: 3976436 - RNA, 14 nt, Human herpesvirus 5
ucuugcccacgccg

SEQ ID NO: 3976437 - RNA, 20 nt, Human herpesvirus 5
ucuuuaaaaacacuggcugc

SEQ ID NO: 3976438 - RNA, 15 nt, Human herpesvirus 5
ucuuucuacaagaca

SEQ ID NO: 3976439 - RNA, 17 nt, Human herpesvirus 5
ucuuugccggcucuccu

SEQ ID NO: 3976440 - RNA, 14 nt, Human herpesvirus 5
ugaaaagguacuuu

SEQ ID NO: 3976441 - RNA, 19 nt, Human herpesvirus 5
ugaacaccuuuuugcugca

SEQ ID NO: 3976442 - RNA, 20 nt, Human herpesvirus 5
ugaacaccuuuuugcugcac

SEQ ID NO: 3976443 - RNA, 20 nt, Human herpesvirus 5
ugaagccgccgucgagccac

SEQ ID NO: 3976444 - RNA, 22 nt, Human herpesvirus 5
ugaauaacaccaaaaauccaga

SEQ ID NO: 3976445 - RNA, 17 nt, Human herpesvirus 5
ugaaucgaugucaagga

SEQ ID NO: 3976446 - RNA, 19 nt, Human herpesvirus 5
ugaaucgcgagcugggcga

SEQ ID NO: 3976447 - RNA, 20 nt, Human herpesvirus 5
ugacacagcuccugaaugag

SEQ ID NO: 3976448 - RNA, 13 nt, Human herpesvirus 5
ugaccaugggcua

SEQ ID NO: 3976449 - RNA, 16 nt, Human herpesvirus 5
ugacccagggcugcuc

SEQ ID NO: 3976450 - RNA, 20 nt, Human herpesvirus 5
ugacgacggcgugguaucca

SEQ ID NO: 3976451 - RNA, 14 nt, Human herpesvirus 5
ugacgcggacgagg

SEQ ID NO: 3976452 - RNA, 16 nt, Human herpesvirus 5
ugacggggcugggugg

SEQ ID NO: 3976453 - RNA, 20 nt, Human herpesvirus 5
ugacgucccuuuuacuagua

SEQ ID NO: 3976454 - RNA, 17 nt, Human herpesvirus 5
ugacguggauacuagua

SEQ ID NO: 3976455 - RNA, 22 nt, Human herpesvirus 5
ugagaaccgcacggaguaauca

SEQ ID NO: 3976456 - RNA, 15 nt, Human herpesvirus 5
ugagaagcacggaga

SEQ ID NO: 3976457 - RNA, 19 nt, Human herpesvirus 5
ugagcaggguaaaaaccac

SEQ ID NO: 3976458 - RNA, 19 nt, Human herpesvirus 5
ugagccggaaaaaccgcag

SEQ ID NO: 3976459 - RNA, 16 nt, Human herpesvirus 5
ugagccggggugccgc

SEQ ID NO: 3976460 - RNA, 14 nt, Human herpesvirus 5
ugagcgacagcagc

SEQ ID NO: 3976461 - RNA, 14 nt, Human herpesvirus 5
ugagcgugcugcuc

SEQ ID NO: 3976462 - RNA, 16 nt, Human herpesvirus 5
ugagcgugcugcucug

SEQ ID NO: 3976463 - RNA, 16 nt, Human herpesvirus 5
ugagcuguuucgacgu

SEQ ID NO: 3976464 - RNA, 23 nt, Human herpesvirus 5
ugaggagcucacccggcugcugg

SEQ ID NO: 3976465 - RNA, 23 nt, Human herpesvirus 5
ugauaauaaccgcggugugcuuu

SEQ ID NO: 3976466 - RNA, 21 nt, Human herpesvirus 5
ugauaggcggcgaggcgaaac

SEQ ID NO: 3976467 - RNA, 13 nt, Human herpesvirus 5
ugaucugggcagc

SEQ ID NO: 3976468 - RNA, 12 nt, Human herpesvirus 5
ugaugcugcuga

SEQ ID NO: 3976469 - RNA, 16 nt, Human herpesvirus 5
ugaugucggauccggc

SEQ ID NO: 3976470 - RNA, 15 nt, Human herpesvirus 5
ugauuucuugcuugc

SEQ ID NO: 3976471 - RNA, 17 nt, Human herpesvirus 5
ugauuuuuuuuacaaua

SEQ ID NO: 3976472 - RNA, 15 nt, Human herpesvirus 5
ugcaacgccuggcgu

SEQ ID NO: 3976473 - RNA, 15 nt, Human herpesvirus 5
ugcaacgcgugaaac

SEQ ID NO: 3976474 - RNA, 22 nt, Human herpesvirus 5
ugcaccuggguggaacgagcgc

SEQ ID NO: 3976475 - RNA, 16 nt, Human herpesvirus 5
ugcacgcgcugcuuuc

SEQ ID NO: 3976476 - RNA, 21 nt, Human herpesvirus 5
ugcagcacgcgauuggccagc

SEQ ID NO: 3976477 - RNA, 18 nt, Human herpesvirus 5
ugcagcgcuacgugcgcg

SEQ ID NO: 3976478 - RNA, 15 nt, Human herpesvirus 5
ugccaccgacaugga

SEQ ID NO: 3976479 - RNA, 16 nt, Human herpesvirus 5
ugccaguugcuguugc

SEQ ID NO: 3976480 - RNA, 21 nt, Human herpesvirus 5
ugcccuuuacggugcugcguc

SEQ ID NO: 3976481 - RNA, 19 nt, Human herpesvirus 5
ugccgcguggcgcugcaca

SEQ ID NO: 3976482 - RNA, 15 nt, Human herpesvirus 5
ugccggaacccuucc

SEQ ID NO: 3976483 - RNA, 15 nt, Human herpesvirus 5
ugccggagcuacgcg

SEQ ID NO: 3976484 - RNA, 20 nt, Human herpesvirus 5
ugccugcacgaccugcucca

SEQ ID NO: 3976485 - RNA, 23 nt, Human herpesvirus 5
ugccuuuuuaauaaagucugggu

SEQ ID NO: 3976486 - RNA, 20 nt, Human herpesvirus 5
ugcgccuccucgucggccug

SEQ ID NO: 3976487 - RNA, 17 nt, Human herpesvirus 5
ugcgcgauacauugccc

SEQ ID NO: 3976488 - RNA, 19 nt, Human herpesvirus 5
ugcggcggcuugggcagca

SEQ ID NO: 3976489 - RNA, 17 nt, Human herpesvirus 5
ugcgggaugcugcggcg

SEQ ID NO: 3976490 - RNA, 15 nt, Human herpesvirus 5
ugcgucuggauuugu

SEQ ID NO: 3976491 - RNA, 12 nt, Human herpesvirus 5
ugcuacagggag

SEQ ID NO: 3976492 - RNA, 21 nt, Human herpesvirus 5
ugcuccucggagcacgggcga

SEQ ID NO: 3976493 - RNA, 14 nt, Human herpesvirus 5
ugcucgaccaggag

SEQ ID NO: 3976494 - RNA, 16 nt, Human herpesvirus 5
ugcucgaccaggaggu

SEQ ID NO: 3976495 - RNA, 17 nt, Human herpesvirus 5
ugcucggcggccacggc

SEQ ID NO: 3976496 - RNA, 19 nt, Human herpesvirus 5
ugcucuacugcaacugcac

SEQ ID NO: 3976497 - RNA, 13 nt, Human herpesvirus 5
ugcucucuuagug

SEQ ID NO: 3976498 - RNA, 14 nt, Human herpesvirus 5
ugcugcaaggccuc

SEQ ID NO: 3976499 - RNA, 16 nt, Human herpesvirus 5
ugcugcugagacugag

SEQ ID NO: 3976500 - RNA, 15 nt, Human herpesvirus 5
ugcugggcugggugc

SEQ ID NO: 3976501 - RNA, 18 nt, Human herpesvirus 5
ugcuucuaccaccuuugu

SEQ ID NO: 3976502 - RNA, 17 nt, Human herpesvirus 5
uggaaacuacgugcaac

SEQ ID NO: 3976503 - RNA, 16 nt, Human herpesvirus 5
uggaacaagaaacaca

SEQ ID NO: 3976504 - RNA, 16 nt, Human herpesvirus 5
uggaacgagcgccguc

SEQ ID NO: 3976505 - RNA, 22 nt, Human herpesvirus 5
uggaacggucuuuauauauaca

SEQ ID NO: 3976506 - RNA, 21 nt, Human herpesvirus 5
uggaagcgaauaagcgcgacc

SEQ ID NO: 3976507 - RNA, 14 nt, Human herpesvirus 5
uggaccugaccugu

SEQ ID NO: 3976508 - RNA, 15 nt, Human herpesvirus 5
uggacggguuucagc

SEQ ID NO: 3976509 - RNA, 15 nt, Human herpesvirus 5
uggagcgggucgccg

SEQ ID NO: 3976510 - RNA, 21 nt, Human herpesvirus 5
uggaggucuaucacgggcucg

SEQ ID NO: 3976511 - RNA, 23 nt, Human herpesvirus 5
uggagucgcgguucggccggacc

SEQ ID NO: 3976512 - RNA, 18 nt, Human herpesvirus 5
uggauuaguaauggaaag

SEQ ID NO: 3976513 - RNA, 18 nt, Human herpesvirus 5
uggcaaggugcugcaccu

SEQ ID NO: 3976514 - RNA, 20 nt, Human herpesvirus 5
uggcacguuuuggaaaacgu

SEQ ID NO: 3976515 - RNA, 14 nt, Human herpesvirus 5
uggcagcuggcuug

SEQ ID NO: 3976516 - RNA, 23 nt, Human herpesvirus 5
uggcgcggucugcgugaugccug

SEQ ID NO: 3976517 - RNA, 17 nt, Human herpesvirus 5
uggcuuuccucgggcga

SEQ ID NO: 3976518 - RNA, 13 nt, Human herpesvirus 5
ugggauugacgcg

SEQ ID NO: 3976519 - RNA, 19 nt, Human herpesvirus 5
ugggcauacgcgauaucug

SEQ ID NO: 3976520 - RNA, 23 nt, Human herpesvirus 5
ugggccaggacccguacugcgac

SEQ ID NO: 3976521 - RNA, 14 nt, Human herpesvirus 5
ugggcgacaugcac

SEQ ID NO: 3976522 - RNA, 15 nt, Human herpesvirus 5
ugggcgcccccaccc

SEQ ID NO: 3976523 - RNA, 15 nt, Human herpesvirus 5
uggggacggugauga

SEQ ID NO: 3976524 - RNA, 17 nt, Human herpesvirus 5
uggggcaacugcugccu

SEQ ID NO: 3976525 - RNA, 13 nt, Human herpesvirus 5
uggggcuucgccu

SEQ ID NO: 3976526 - RNA, 13 nt, Human herpesvirus 5
uggggugggcgcg

SEQ ID NO: 3976527 - RNA, 16 nt, Human herpesvirus 5
uggggugucuagcugg

SEQ ID NO: 3976528 - RNA, 17 nt, Human herpesvirus 5
ugggucagcggcacgcc

SEQ ID NO: 3976529 - RNA, 18 nt, Human herpesvirus 5
ugggucugcgcugccccg

SEQ ID NO: 3976530 - RNA, 13 nt, Human herpesvirus 5
ugggugaaaccga

SEQ ID NO: 3976531 - RNA, 17 nt, Human herpesvirus 5
uggucauguucucccag

SEQ ID NO: 3976532 - RNA, 18 nt, Human herpesvirus 5
uggucgagcgcgaccgcc

SEQ ID NO: 3976533 - RNA, 16 nt, Human herpesvirus 5
ugguggcucaugccgc

SEQ ID NO: 3976534 - RNA, 20 nt, Human herpesvirus 5
ugguggucuacaagcgcaac

SEQ ID NO: 3976535 - RNA, 14 nt, Human herpesvirus 5
uggugugucggcaa

SEQ ID NO: 3976536 - RNA, 19 nt, Human herpesvirus 5
uguacaaucucacgguuaa

SEQ ID NO: 3976537 - RNA, 18 nt, Human herpesvirus 5
uguauggaggucacuguc

SEQ ID NO: 3976538 - RNA, 19 nt, Human herpesvirus 5
uguauuuuuaucgggaaug

SEQ ID NO: 3976539 - RNA, 21 nt, Human herpesvirus 5
ugucaaggaacgcguguuuug

SEQ ID NO: 3976540 - RNA, 20 nt, Human herpesvirus 5
ugucacggaacauguccugg

SEQ ID NO: 3976541 - RNA, 14 nt, Human herpesvirus 5
ugucaugggucugc

SEQ ID NO: 3976542 - RNA, 15 nt, Human herpesvirus 5
ugucgagcugguuaa

SEQ ID NO: 3976543 - RNA, 14 nt, Human herpesvirus 5
ugucucuacgcucc

SEQ ID NO: 3976544 - RNA, 19 nt, Human herpesvirus 5
ugugcaccgucaucggcac

SEQ ID NO: 3976545 - RNA, 13 nt, Human herpesvirus 5
ugugcgucaaugc

SEQ ID NO: 3976546 - RNA, 21 nt, Human herpesvirus 5
uguguuauucagaaccaugua

SEQ ID NO: 3976547 - RNA, 13 nt, Human herpesvirus 5
uguguuugacauu

SEQ ID NO: 3976548 - RNA, 23 nt, Human herpesvirus 5
caaguauuuaugacggacacgga

SEQ ID NO: 3976549 - RNA, 20 nt, Human herpesvirus 5
caagucgccgacgaagaaga

SEQ ID NO: 3976550 - RNA, 17 nt, Human herpesvirus 5
caagugcaagcgccgcg

SEQ ID NO: 3976551 - RNA, 14 nt, Human herpesvirus 5
caaguugguggugg

SEQ ID NO: 3976552 - RNA, 14 nt, Human herpesvirus 5
caauaaaaaccacc

SEQ ID NO: 3976553 - RNA, 14 nt, Human herpesvirus 5
caaugggcuucccu

SEQ ID NO: 3976554 - RNA, 14 nt, Human herpesvirus 5
caauuccacgccgc

SEQ ID NO: 3976555 - RNA, 13 nt, Human herpesvirus 5
cacaauacacaug

SEQ ID NO: 3976556 - RNA, 13 nt, Human herpesvirus 5
cacacaccgcuuu

SEQ ID NO: 3976557 - RNA, 14 nt, Human herpesvirus 5
cacacgcaucugca

SEQ ID NO: 3976558 - RNA, 11 nt, Human herpesvirus 5
cacacggcuaa

SEQ ID NO: 3976559 - RNA, 20 nt, Human herpesvirus 5
cacacggugugaugguacua

SEQ ID NO: 3976560 - RNA, 13 nt, Human herpesvirus 5
cacagcagcacca

SEQ ID NO: 3976561 - RNA, 12 nt, Human herpesvirus 5
cacagcuccuga

SEQ ID NO: 3976562 - RNA, 20 nt, Human herpesvirus 5
cacagcuccugaaugagcuc

SEQ ID NO: 3976563 - RNA, 23 nt, Human herpesvirus 5
cacagcuccugaaugagcucuuu

SEQ ID NO: 3976564 - RNA, 13 nt, Human herpesvirus 5
cacaguuaccacc

SEQ ID NO: 3976565 - RNA, 17 nt, Human herpesvirus 5
cacauuagacacacggg

SEQ ID NO: 3976566 - RNA, 14 nt, Human herpesvirus 5
caccaaagaugaag

SEQ ID NO: 3976567 - RNA, 18 nt, Human herpesvirus 5
caccacacgucgugagca

SEQ ID NO: 3976568 - RNA, 19 nt, Human herpesvirus 5
caccagacuuuuugcuuua

SEQ ID NO: 3976569 - RNA, 21 nt, Human herpesvirus 5
caccaucgugguagcgccgcg

SEQ ID NO: 3976570 - RNA, 17 nt, Human herpesvirus 5
cacccaggccgcggggu

SEQ ID NO: 3976571 - RNA, 19 nt, Human herpesvirus 5
cacccccgauaugggccgc

SEQ ID NO: 3976572 - RNA, 16 nt, Human herpesvirus 5
cacccgcaccagacuu

SEQ ID NO: 3976573 - RNA, 15 nt, Human herpesvirus 5
caccgacacagcagc

SEQ ID NO: 3976574 - RNA, 16 nt, Human herpesvirus 5
caccgacccugcgucc

SEQ ID NO: 3976575 - RNA, 19 nt, Human herpesvirus 5
caccgggacggccugggcg

SEQ ID NO: 3976576 - RNA, 14 nt, Human herpesvirus 5
caccguaccugcau

SEQ ID NO: 3976577 - RNA, 14 nt, Human herpesvirus 5
caccgugacaccgg

SEQ ID NO: 3976578 - RNA, 18 nt, Human herpesvirus 5
caccgugccccacucgcu

SEQ ID NO: 3976579 - RNA, 17 nt, Human herpesvirus 5
caccugagacuggucug

SEQ ID NO: 3976580 - RNA, 23 nt, Human herpesvirus 5
caccugccucgacaucucgccgu

SEQ ID NO: 3976581 - RNA, 14 nt, Human herpesvirus 5
cacgaccgcgacga

SEQ ID NO: 3976582 - RNA, 14 nt, Human herpesvirus 5
cacgacgaccccgc

SEQ ID NO: 3976583 - RNA, 12 nt, Human herpesvirus 5
cacgacggcucc

SEQ ID NO: 3976584 - RNA, 13 nt, Human herpesvirus 5
cacgccgccguga

SEQ ID NO: 3976585 - RNA, 15 nt, Human herpesvirus 5
cacgccggccugagc

SEQ ID NO: 3976586 - RNA, 15 nt, Human herpesvirus 5
cacgccgugcucgcg

SEQ ID NO: 3976587 - RNA, 18 nt, Human herpesvirus 5
cacgccguugccacgagc

SEQ ID NO: 3976588 - RNA, 13 nt, Human herpesvirus 5
cacgcgcuagccu

SEQ ID NO: 3976589 - RNA, 15 nt, Human herpesvirus 5
cacgcugcacgaccu

SEQ ID NO: 3976590 - RNA, 22 nt, Human herpesvirus 5
cacgcugcuauaagaaggccau

SEQ ID NO: 3976591 - RNA, 19 nt, Human herpesvirus 5
cacggaacauguccuggcg

SEQ ID NO: 3976592 - RNA, 19 nt, Human herpesvirus 5
cacggccuccgacgagcgu

SEQ ID NO: 3976593 - RNA, 23 nt, Human herpesvirus 5
cacggccuuauguggcugcgccg

SEQ ID NO: 3976594 - RNA, 16 nt, Human herpesvirus 5
cacggcgaaccgccgu

SEQ ID NO: 3976595 - RNA, 19 nt, Human herpesvirus 5
cacggcgccggugacccgc

SEQ ID NO: 3976596 - RNA, 17 nt, Human herpesvirus 5
cacgguacaaaccucua

SEQ ID NO: 3976597 - RNA, 19 nt, Human herpesvirus 5
cacggucugcuugcuggcu

SEQ ID NO: 3976598 - RNA, 23 nt, Human herpesvirus 5
cacgucaccgugccccacucgcu

SEQ ID NO: 3976599 - RNA, 23 nt, Human herpesvirus 5
cacguccaugucgcgacacgacc

SEQ ID NO: 3976600 - RNA, 20 nt, Human herpesvirus 5
cacgucggagccccugcgcg

SEQ ID NO: 3976601 - RNA, 21 nt, Human herpesvirus 5
cacgugugugcguuuucuagu

SEQ ID NO: 3976602 - RNA, 12 nt, Human herpesvirus 5
cacuacucuggg

SEQ ID NO: 3976603 - RNA, 17 nt, Human herpesvirus 5
cacuauauuaucuuuua

SEQ ID NO: 3976604 - RNA, 16 nt, Human herpesvirus 5
cacucgcaccggcagc

SEQ ID NO: 3976605 - RNA, 18 nt, Human herpesvirus 5
cacugccaacccagcagc

SEQ ID NO: 3976606 - RNA, 21 nt, Human herpesvirus 5
cacugccaacccagcagccgg

SEQ ID NO: 3976607 - RNA, 17 nt, Human herpesvirus 5
cacugcuacccugcgcu

SEQ ID NO: 3976608 - RNA, 20 nt, Human herpesvirus 5
cacugggagacggccuggau

SEQ ID NO: 3976609 - RNA, 19 nt, Human herpesvirus 5
cacuuuacauaaaaccacc

SEQ ID NO: 3976610 - RNA, 22 nt, Human herpesvirus 5
cacuuuaggcggcgcagcgcca

SEQ ID NO: 3976611 - RNA, 12 nt, Human herpesvirus 5
cacuuucucugg

SEQ ID NO: 3976612 - RNA, 17 nt, Human herpesvirus 5
cacuuuuaacagcucau

SEQ ID NO: 3976613 - RNA, 17 nt, Human herpesvirus 5
cagaagaaaaaaacaca

SEQ ID NO: 3976614 - RNA, 17 nt, Human herpesvirus 5
cagaagcugcggcucug

SEQ ID NO: 3976615 - RNA, 19 nt, Human herpesvirus 5
cagacccgauacagucagc

SEQ ID NO: 3976616 - RNA, 14 nt, Human herpesvirus 5
cagacugcccuuga

SEQ ID NO: 3976617 - RNA, 18 nt, Human herpesvirus 5
cagagaccgccgccgcgc

SEQ ID NO: 3976618 - RNA, 20 nt, Human herpesvirus 5
cagauauccacaacgacaaa

SEQ ID NO: 3976619 - RNA, 18 nt, Human herpesvirus 5
cagaucuaccaugucuuu

SEQ ID NO: 3976620 - RNA, 20 nt, Human herpesvirus 5
cagauucaguaaccuggagc

SEQ ID NO: 3976621 - RNA, 20 nt, Human herpesvirus 5
cagauuuacagcccggcggu

SEQ ID NO: 3976622 - RNA, 16 nt, Human herpesvirus 5
cagcaagaguugcaac

SEQ ID NO: 3976623 - RNA, 14 nt, Human herpesvirus 5
cagcacauuagaca

SEQ ID NO: 3976624 - RNA, 17 nt, Human herpesvirus 5
cagcaccaguuggccac

SEQ ID NO: 3976625 - RNA, 18 nt, Human herpesvirus 5
cagcaccccgcgucacuu

SEQ ID NO: 3976626 - RNA, 21 nt, Human herpesvirus 5
cagcagauacaugcgucguau

SEQ ID NO: 3976627 - RNA, 16 nt, Human herpesvirus 5
cagcagcagcuggugc

SEQ ID NO: 3976628 - RNA, 17 nt, Human herpesvirus 5
cagcagcuggugcauca

SEQ ID NO: 3976629 - RNA, 15 nt, Human herpesvirus 5
cagcauggacugucu

SEQ ID NO: 3976630 - RNA, 18 nt, Human herpesvirus 5
cagccaccgacacagcag

SEQ ID NO: 3976631 - RNA, 22 nt, Human herpesvirus 5
cagccaccgcgaggccacccac

SEQ ID NO: 3976632 - RNA, 18 nt, Human herpesvirus 5
cagcgaguugcugugcac

SEQ ID NO: 3976633 - RNA, 18 nt, Human herpesvirus 5
cagcgccagcggccuggc

SEQ ID NO: 3976634 - RNA, 20 nt, Human herpesvirus 5
cagcgccagcggccuggccu

SEQ ID NO: 3976635 - RNA, 16 nt, Human herpesvirus 5
cagcgcuacgugcgcg

SEQ ID NO: 3976636 - RNA, 18 nt, Human herpesvirus 5
cagcggaacucgaccucu

SEQ ID NO: 3976637 - RNA, 14 nt, Human herpesvirus 5
cagcggauugggua

SEQ ID NO: 3976638 - RNA, 21 nt, Human herpesvirus 5
cagcggucguaagcggcagca

SEQ ID NO: 3976639 - RNA, 14 nt, Human herpesvirus 5
cagcgguggcugga

SEQ ID NO: 3976640 - RNA, 21 nt, Human herpesvirus 5
cagcguauuuucuacuccgaa

SEQ ID NO: 3976641 - RNA, 13 nt, Human herpesvirus 5
cagcgucacagag

SEQ ID NO: 3976642 - RNA, 15 nt, Human herpesvirus 5
cagcgucuggccagc

SEQ ID NO: 3976643 - RNA, 17 nt, Human herpesvirus 5
cagcuaucgugacuggg

SEQ ID NO: 3976644 - RNA, 19 nt, Human herpesvirus 5
cagcugcuggagcgcggcc

SEQ ID NO: 3976645 - RNA, 19 nt, Human herpesvirus 5
cagcuggugaucggccgcg

SEQ ID NO: 3976646 - RNA, 14 nt, Human herpesvirus 5
caggaccacgucca

SEQ ID NO: 3976647 - RNA, 23 nt, Human herpesvirus 5
caggacccguacugcgacggcag

SEQ ID NO: 3976648 - RNA, 14 nt, Human herpesvirus 5
caggagcugcugcu

SEQ ID NO: 3976649 - RNA, 22 nt, Human herpesvirus 5
caggaggaaaaaaaaacuagac

SEQ ID NO: 3976650 - RNA, 19 nt, Human herpesvirus 5
caggaucuggugcaggcca

SEQ ID NO: 3976651 - RNA, 13 nt, Human herpesvirus 5
caggccgcaaagc

SEQ ID NO: 3976652 - RNA, 14 nt, Human herpesvirus 5
caggccgcgcaggc

SEQ ID NO: 3976653 - RNA, 12 nt, Human herpesvirus 5
caggcgcgcaga

SEQ ID NO: 3976654 - RNA, 19 nt, Human herpesvirus 5
caggcucgucgugggcuac

SEQ ID NO: 3976655 - RNA, 16 nt, Human herpesvirus 5
caggcuguucacgcgg

SEQ ID NO: 3976656 - RNA, 22 nt, Human herpesvirus 5
cagggacagugcgccaacggca

SEQ ID NO: 3976657 - RNA, 15 nt, Human herpesvirus 5
caggguaacagccuu

SEQ ID NO: 3976658 - RNA, 22 nt, Human herpesvirus 5
cagguaggauuccaagccgcag

SEQ ID NO: 3976659 - RNA, 18 nt, Human herpesvirus 5
cagguccaaucgcacuag

SEQ ID NO: 3976660 - RNA, 20 nt, Human herpesvirus 5
caguacaacaguuaucagca

SEQ ID NO: 3976661 - RNA, 12 nt, Human herpesvirus 5
caguacuuuggg

SEQ ID NO: 3976662 - RNA, 20 nt, Human herpesvirus 5
caguagcaccggccccacgc

SEQ ID NO: 3976663 - RNA, 21 nt, Human herpesvirus 5
caguagcgguaccagacgcgg

SEQ ID NO: 3976664 - RNA, 15 nt, Human herpesvirus 5
caguauuccccgcug

SEQ ID NO: 3976665 - RNA, 16 nt, Human herpesvirus 5
caguauuccccgcugu

SEQ ID NO: 3976666 - RNA, 16 nt, Human herpesvirus 5
caguauuuacuucacc

SEQ ID NO: 3976667 - RNA, 21 nt, Human herpesvirus 5
caguauuucuagagcacugag

SEQ ID NO: 3976668 - RNA, 15 nt, Human herpesvirus 5
cagugaguacacgca

SEQ ID NO: 3976669 - RNA, 17 nt, Human herpesvirus 5
caguggcaggcccgggu

SEQ ID NO: 3976670 - RNA, 23 nt, Human herpesvirus 5
caguguauuggcauauagccaau

SEQ ID NO: 3976671 - RNA, 18 nt, Human herpesvirus 5
caguguuggaucagacuc

SEQ ID NO: 3976672 - RNA, 17 nt, Human herpesvirus 5
caguugggaccgcagcg

SEQ ID NO: 3976673 - RNA, 21 nt, Human herpesvirus 5
cauaaaaccaccguaccugca

SEQ ID NO: 3976674 - RNA, 20 nt, Human herpesvirus 5
cauaaguuuacgggaggaau

SEQ ID NO: 3976675 - RNA, 14 nt, Human herpesvirus 5
cauagugccagccc

SEQ ID NO: 3976676 - RNA, 13 nt, Human herpesvirus 5
cauaucgggcccu

SEQ ID NO: 3976677 - RNA, 12 nt, Human herpesvirus 5
caucaggugaca

SEQ ID NO: 3976678 - RNA, 17 nt, Human herpesvirus 5
caucaucaacagcagca

SEQ ID NO: 3976679 - RNA, 16 nt, Human herpesvirus 5
caucaucagcgccgug

SEQ ID NO: 3976680 - RNA, 13 nt, Human herpesvirus 5
cauccaauuacac

SEQ ID NO: 3976681 - RNA, 18 nt, Human herpesvirus 5
cauccagcuccguucgcg

SEQ ID NO: 3976682 - RNA, 16 nt, Human herpesvirus 5
cauccugcccaccgcc

SEQ ID NO: 3976683 - RNA, 20 nt, Human herpesvirus 5
cauccuuuucaugcucauac

SEQ ID NO: 3976684 - RNA, 22 nt, Human herpesvirus 5
caucgcccacaguagcgguacc

SEQ ID NO: 3976685 - RNA, 20 nt, Human herpesvirus 5
caucggugccggccagguag

SEQ ID NO: 3976686 - RNA, 13 nt, Human herpesvirus 5
caucucacggaua

SEQ ID NO: 3976687 - RNA, 15 nt, Human herpesvirus 5
caucugcggcagcgg

SEQ ID NO: 3976688 - RNA, 12 nt, Human herpesvirus 5
caugaacaaaaa

SEQ ID NO: 3976689 - RNA, 20 nt, Human herpesvirus 5
caugaaguuguugaucugcu

SEQ ID NO: 3976690 - RNA, 21 nt, Human herpesvirus 5
caugaaguuguugaucugcug

SEQ ID NO: 3976691 - RNA, 15 nt, Human herpesvirus 5
caugacgcacgccgg

SEQ ID NO: 3976692 - RNA, 19 nt, Human herpesvirus 5
caugaguuggugcagcugc

SEQ ID NO: 3976693 - RNA, 22 nt, Human herpesvirus 5
caugcauucugguaccugcuaa

SEQ ID NO: 3976694 - RNA, 17 nt, Human herpesvirus 5
caugcggcaaucggugc

SEQ ID NO: 3976695 - RNA, 21 nt, Human herpesvirus 5
caugcugagcaaguacacgcg

SEQ ID NO: 3976696 - RNA, 21 nt, Human herpesvirus 5
cauggacauaaaaaagagaca

SEQ ID NO: 3976697 - RNA, 15 nt, Human herpesvirus 5
cauggagacaguuuc

SEQ ID NO: 3976698 - RNA, 15 nt, Human herpesvirus 5
cauggccaaugcaua

SEQ ID NO: 3976699 - RNA, 17 nt, Human herpesvirus 5
cauggccaaugcauauc

SEQ ID NO: 3976700 - RNA, 17 nt, Human herpesvirus 5
cauguccggccgucgca

SEQ ID NO: 3976701 - RNA, 14 nt, Human herpesvirus 5
caugucgcgacaga

SEQ ID NO: 3976702 - RNA, 18 nt, Human herpesvirus 5
caugucuuacaaaucaca

SEQ ID NO: 3976703 - RNA, 15 nt, Human herpesvirus 5
cauguggcguacacg

SEQ ID NO: 3976704 - RNA, 15 nt, Human herpesvirus 5
cauguucggcuccgu

SEQ ID NO: 3976705 - RNA, 16 nt, Human herpesvirus 5
cauguuuuaggaauga

SEQ ID NO: 3976706 - RNA, 17 nt, Human herpesvirus 5
cauuccccaccuucccu

SEQ ID NO: 3976707 - RNA, 21 nt, Human herpesvirus 5
cauugcccuucuggagcacac

SEQ ID NO: 3976708 - RNA, 21 nt, Human herpesvirus 5
ccaaagaugaagacacccugc

SEQ ID NO: 3976709 - RNA, 12 nt, Human herpesvirus 5
ccaacacguccc

SEQ ID NO: 3976710 - RNA, 13 nt, Human herpesvirus 5
ccaaccucgccgu

SEQ ID NO: 3976711 - RNA, 19 nt, Human herpesvirus 5
ccaacuccgugccagcugg

SEQ ID NO: 3976712 - RNA, 12 nt, Human herpesvirus 5
ccaagcacgcca

SEQ ID NO: 3976713 - RNA, 22 nt, Human herpesvirus 5
ccaaggaaccaccguagcacug

SEQ ID NO: 3976714 - RNA, 14 nt, Human herpesvirus 5
ccaaggccuccagc

SEQ ID NO: 3976715 - RNA, 15 nt, Human herpesvirus 5
ccaaggccuccagcg

SEQ ID NO: 3976716 - RNA, 13 nt, Human herpesvirus 5
ccaagucuugccg

SEQ ID NO: 3976717 - RNA, 15 nt, Human herpesvirus 5
ccaaguucagcagca

SEQ ID NO: 3976718 - RNA, 15 nt, Human herpesvirus 5
ccacaaccuguggaa

SEQ ID NO: 3976719 - RNA, 19 nt, Human herpesvirus 5
ccacaagaaacgcuggaaa

SEQ ID NO: 3976720 - RNA, 15 nt, Human herpesvirus 5
ccacagagccgcgug

SEQ ID NO: 3976721 - RNA, 14 nt, Human herpesvirus 5
ccacaggcgccgca

SEQ ID NO: 3976722 - RNA, 21 nt, Human herpesvirus 5
ccaccaaggcgacauggcccu

SEQ ID NO: 3976723 - RNA, 14 nt, Human herpesvirus 5
ccaccauagccacu

SEQ ID NO: 3976724 - RNA, 22 nt, Human herpesvirus 5
ccaccgaagccguauuccguuu

SEQ ID NO: 3976725 - RNA, 13 nt, Human herpesvirus 5
ccaccgacacagc

SEQ ID NO: 3976726 - RNA, 21 nt, Human herpesvirus 5
ccaccgccgcuuucucaucuc

SEQ ID NO: 3976727 - RNA, 20 nt, Human herpesvirus 5
ccaccguaccugcaucacgg

SEQ ID NO: 3976728 - RNA, 20 nt, Human herpesvirus 5
ccaccgugucuccgugacgg

SEQ ID NO: 3976729 - RNA, 13 nt, Human herpesvirus 5
ccacgacaaacac

SEQ ID NO: 3976730 - RNA, 17 nt, Human herpesvirus 5
ccacgccaccgccgcca

SEQ ID NO: 3976731 - RNA, 21 nt, Human herpesvirus 5
ccacgcuauacauagcccgcu

SEQ ID NO: 3976732 - RNA, 20 nt, Human herpesvirus 5
ccacgcucgagggcuccguc

SEQ ID NO: 3976733 - RNA, 23 nt, Human herpesvirus 5
ccacgcucgcucugacgccgcgc

SEQ ID NO: 3976734 - RNA, 19 nt, Human herpesvirus 5
ccacgcugacaacccacuc

SEQ ID NO: 3976735 - RNA, 14 nt, Human herpesvirus 5
ccacgcugcuucac

SEQ ID NO: 3976736 - RNA, 12 nt, Human herpesvirus 5
ccacggccagcg

SEQ ID NO: 3976737 - RNA, 13 nt, Human herpesvirus 5
ccacggcugcuga

SEQ ID NO: 3976738 - RNA, 18 nt, Human herpesvirus 5
ccacgguacgccaguagc

SEQ ID NO: 3976739 - RNA, 18 nt, Human herpesvirus 5
ccacgguuuaccacaggc

SEQ ID NO: 3976740 - RNA, 16 nt, Human herpesvirus 5
ccacguagguuucugu

SEQ ID NO: 3976741 - RNA, 18 nt, Human herpesvirus 5
ccacguagucgcgcgcga

SEQ ID NO: 3976742 - RNA, 15 nt, Human herpesvirus 5
ccacgucaccgugcc

SEQ ID NO: 3976743 - RNA, 16 nt, Human herpesvirus 5
ccacguccacccaucc

SEQ ID NO: 3976744 - RNA, 18 nt, Human herpesvirus 5
ccacgucuucaaaguagc

SEQ ID NO: 3976745 - RNA, 17 nt, Human herpesvirus 5
ccacuaccaccacgacc

SEQ ID NO: 3976746 - RNA, 14 nt, Human herpesvirus 5
ccacugggccucgg

SEQ ID NO: 3976747 - RNA, 20 nt, Human herpesvirus 5
ccagacugcccuugaaugua

SEQ ID NO: 3976748 - RNA, 13 nt, Human herpesvirus 5
ccagagacagaga

SEQ ID NO: 3976749 - RNA, 15 nt, Human herpesvirus 5
ccagauacgcguugg

SEQ ID NO: 3976750 - RNA, 14 nt, Human herpesvirus 5
ccagcagccggagg

SEQ ID NO: 3976751 - RNA, 18 nt, Human herpesvirus 5
ccagcggccgcagugggc

SEQ ID NO: 3976752 - RNA, 19 nt, Human herpesvirus 5
ccagcuuaccgccaccguc

SEQ ID NO: 3976753 - RNA, 21 nt, Human herpesvirus 5
ccaggcgcguaaaacucccca

SEQ ID NO: 3976754 - RNA, 15 nt, Human herpesvirus 5
ccaggcucugcgccg

SEQ ID NO: 3976755 - RNA, 15 nt, Human herpesvirus 5
ccaggcuuaacacua

SEQ ID NO: 3976756 - RNA, 19 nt, Human herpesvirus 5
ccagugcgucgcuguugag

SEQ ID NO: 3976757 - RNA, 17 nt, Human herpesvirus 5
ccaguuacacucgcucu

SEQ ID NO: 3976758 - RNA, 20 nt, Human herpesvirus 5
ccaguuggccacgaccacga

SEQ ID NO: 3976759 - RNA, 17 nt, Human herpesvirus 5
ccauacuuaccaccgug

SEQ ID NO: 3976760 - RNA, 18 nt, Human herpesvirus 5
ccauacuuuuacaugaac

SEQ ID NO: 3976761 - RNA, 18 nt, Human herpesvirus 5
ccaucuagacucacuuua

SEQ ID NO: 3976762 - RNA, 12 nt, Human herpesvirus 5
ccaugagccuca

SEQ ID NO: 3976763 - RNA, 19 nt, Human herpesvirus 5
ccaugagguagaagggcug

SEQ ID NO: 3976764 - RNA, 13 nt, Human herpesvirus 5
ccaugcagaccua

SEQ ID NO: 3976765 - RNA, 14 nt, Human herpesvirus 5
ccaugcaucccacc

SEQ ID NO: 3976766 - RNA, 15 nt, Human herpesvirus 5
ccaugccuuccgcgu

SEQ ID NO: 3976767 - RNA, 19 nt, Human herpesvirus 5
ccaugucuccaagucuggu

SEQ ID NO: 3976768 - RNA, 18 nt, Human herpesvirus 5
ccauuuucagcgacgacc

SEQ ID NO: 3976769 - RNA, 18 nt, Human herpesvirus 5
cccacaaaggguaucugg

SEQ ID NO: 3976770 - RNA, 16 nt, Human herpesvirus 5
cccaccccccgggcca

SEQ ID NO: 3976771 - RNA, 15 nt, Human herpesvirus 5
cccaguagacagaca

SEQ ID NO: 3976772 - RNA, 21 nt, Human herpesvirus 5
cccaucgucccccuuucucua

SEQ ID NO: 3976773 - RNA, 22 nt, Human herpesvirus 5
ccccaccuucccucuagagaca

SEQ ID NO: 3976774 - RNA, 22 nt, Human herpesvirus 5
ccccacggcggcggccugcucg

SEQ ID NO: 3976775 - RNA, 17 nt, Human herpesvirus 5
cccccacggaucucgcg

SEQ ID NO: 3976776 - RNA, 18 nt, Human herpesvirus 5
cccccuaccugcgcgaua

SEQ ID NO: 3976777 - RNA, 15 nt, Human herpesvirus 5
ccccgaacuggagcu

SEQ ID NO: 3976778 - RNA, 18 nt, Human herpesvirus 5
ccccgugacgugcaagac

SEQ ID NO: 3976779 - RNA, 12 nt, Human herpesvirus 5
ccccuaccuaga

SEQ ID NO: 3976780 - RNA, 12 nt, Human herpesvirus 5
ccccucugcugc

SEQ ID NO: 3976781 - RNA, 19 nt, Human herpesvirus 5
cccgaggcacgucggggcu

SEQ ID NO: 3976782 - RNA, 22 nt, Human herpesvirus 5
cccgaggucuuuugcacgcgcg

SEQ ID NO: 3976783 - RNA, 18 nt, Human herpesvirus 5
cccgauaaucggcucuca

SEQ ID NO: 3976784 - RNA, 19 nt, Human herpesvirus 5
cccgccaccaugcauccca

SEQ ID NO: 3976785 - RNA, 17 nt, Human herpesvirus 5
cccgccgcacgcgcuua

SEQ ID NO: 3976786 - RNA, 14 nt, Human herpesvirus 5
cccgccguugcggc

SEQ ID NO: 3976787 - RNA, 19 nt, Human herpesvirus 5
cccgccguugcggccgccg

SEQ ID NO: 3976788 - RNA, 13 nt, Human herpesvirus 5
cccgcgucccugg

SEQ ID NO: 3976789 - RNA, 15 nt, Human herpesvirus 5
cccgggccgccgcca

SEQ ID NO: 3976790 - RNA, 17 nt, Human herpesvirus 5
cccgguguuggccacca

SEQ ID NO: 3976791 - RNA, 12 nt, Human herpesvirus 5
cccucaugacgc

SEQ ID NO: 3976792 - RNA, 13 nt, Human herpesvirus 5
cccucgcugggcu

SEQ ID NO: 3976793 - RNA, 13 nt, Human herpesvirus 5
cccucugcugcug

SEQ ID NO: 3976794 - RNA, 15 nt, Human herpesvirus 5
cccucugcugcuggu

SEQ ID NO: 3976795 - RNA, 16 nt, Human herpesvirus 5
cccugacacguaauac

SEQ ID NO: 3976796 - RNA, 22 nt, Human herpesvirus 5
ccgaacgcucgugagcaacagu

SEQ ID NO: 3976797 - RNA, 19 nt, Human herpesvirus 5
ccgaagaccucaccaucuc

SEQ ID NO: 3976798 - RNA, 17 nt, Human herpesvirus 5
ccgacaaccugcugcac

SEQ ID NO: 3976799 - RNA, 17 nt, Human herpesvirus 5
ccgacauucgcgucggc

SEQ ID NO: 3976800 - RNA, 14 nt, Human herpesvirus 5
ccgacgaagaagaa

SEQ ID NO: 3976801 - RNA, 18 nt, Human herpesvirus 5
ccgacgacgacagucucc

SEQ ID NO: 3976802 - RNA, 12 nt, Human herpesvirus 5
ccgacgccgggu

SEQ ID NO: 3976803 - RNA, 20 nt, Human herpesvirus 5
ccgacgcuggcgcugcggcu

SEQ ID NO: 3976804 - RNA, 19 nt, Human herpesvirus 5
ccgacugcagcccaccgcc

SEQ ID NO: 3976805 - RNA, 15 nt, Human herpesvirus 5
ccgagacggaggaau

SEQ ID NO: 3976806 - RNA, 18 nt, Human herpesvirus 5
ccgagcgggaggcgguga

SEQ ID NO: 3976807 - RNA, 14 nt, Human herpesvirus 5
ccgaguaacgcgcc

SEQ ID NO: 3976808 - RNA, 17 nt, Human herpesvirus 5
ccgaguaacgcgccguc

SEQ ID NO: 3976809 - RNA, 22 nt, Human herpesvirus 5
ccgcaacagcggcgacagacgg

SEQ ID NO: 3976810 - RNA, 15 nt, Human herpesvirus 5
ccgcaagcgccgcca

SEQ ID NO: 3976811 - RNA, 17 nt, Human herpesvirus 5
ccgcaaugggcuucccu

SEQ ID NO: 3976812 - RNA, 19 nt, Human herpesvirus 5
ccgcacgaccgcgacgagg

SEQ ID NO: 3976813 - RNA, 20 nt, Human herpesvirus 5
ccgcacgaccgcgacgaggu

SEQ ID NO: 3976814 - RNA, 13 nt, Human herpesvirus 5
ccgcagaaggcca

SEQ ID NO: 3976815 - RNA, 11 nt, Human herpesvirus 5
ccgcagccacg

SEQ ID NO: 3976816 - RNA, 18 nt, Human herpesvirus 5
ccgcagcgaguugcugug

SEQ ID NO: 3976817 - RNA, 14 nt, Human herpesvirus 5
ccgcagcugcugga

SEQ ID NO: 3976818 - RNA, 16 nt, Human herpesvirus 5
ccgcagcugcuggagc

SEQ ID NO: 3976819 - RNA, 18 nt, Human herpesvirus 5
ccgcagcugcuggagcgc

SEQ ID NO: 3976820 - RNA, 22 nt, Human herpesvirus 5
ccgcagcugcuggagcgcggcc

SEQ ID NO: 3976821 - RNA, 18 nt, Human herpesvirus 5
ccgcaggagcugcuuuuc

SEQ ID NO: 3976822 - RNA, 15 nt, Human herpesvirus 5
ccgcagguuagcggc

SEQ ID NO: 3976823 - RNA, 15 nt, Human herpesvirus 5
ccgcaguuacaccac

SEQ ID NO: 3976824 - RNA, 13 nt, Human herpesvirus 5
ccgccacaccugu

SEQ ID NO: 3976825 - RNA, 14 nt, Human herpesvirus 5
ccgccagcggaagc

SEQ ID NO: 3976826 - RNA, 19 nt, Human herpesvirus 5
ccgccccucuuuuccccgu

SEQ ID NO: 3976827 - RNA, 13 nt, Human herpesvirus 5
ccgccgaagccug

SEQ ID NO: 3976828 - RNA, 19 nt, Human herpesvirus 5
ccgccgaagccuggggcac

SEQ ID NO: 3976829 - RNA, 15 nt, Human herpesvirus 5
ccgccggccacgagc

SEQ ID NO: 3976830 - RNA, 17 nt, Human herpesvirus 5
ccgccguugcggccgcc

SEQ ID NO: 3976831 - RNA, 23 nt, Human herpesvirus 5
ccgcgagcggcggacuuggcagc

SEQ ID NO: 3976832 - RNA, 16 nt, Human herpesvirus 5
ccgcguagcgcuccug

SEQ ID NO: 3976833 - RNA, 16 nt, Human herpesvirus 5
ccgcgucgcuucgccg

SEQ ID NO: 3976834 - RNA, 21 nt, Human herpesvirus 5
ccgcguuuggucgccugccua

SEQ ID NO: 3976835 - RNA, 22 nt, Human herpesvirus 5
ccgcugccguacagcgccgccg

SEQ ID NO: 3976836 - RNA, 19 nt, Human herpesvirus 5
ccgcuggacugacacagcu

SEQ ID NO: 3976837 - RNA, 17 nt, Human herpesvirus 5
ccgcuguggcugccgcu

SEQ ID NO: 3976838 - RNA, 20 nt, Human herpesvirus 5
ccgcuuaacaacguguccag

SEQ ID NO: 3976839 - RNA, 16 nt, Human herpesvirus 5
ccgcuugcgcccgaga

SEQ ID NO: 3976840 - RNA, 20 nt, Human herpesvirus 5
ccgcuuucucaucucagccu

SEQ ID NO: 3976841 - RNA, 21 nt, Human herpesvirus 5
ccgcuuucucaucucagccuc

SEQ ID NO: 3976842 - RNA, 16 nt, Human herpesvirus 5
ccgcuuuucagaccgc

SEQ ID NO: 3976843 - RNA, 17 nt, Human herpesvirus 5
ccgcuuuucagaccgca

SEQ ID NO: 3976844 - RNA, 15 nt, Human herpesvirus 5
ccggaaacaccgcga

SEQ ID NO: 3976845 - RNA, 17 nt, Human herpesvirus 5
ccggaacgcuguuacga

SEQ ID NO: 3976846 - RNA, 18 nt, Human herpesvirus 5
ccggaggaagcggcggua

SEQ ID NO: 3976847 - RNA, 12 nt, Human herpesvirus 5
ccggaggagcgu

SEQ ID NO: 3976848 - RNA, 11 nt, Human herpesvirus 5
ccggcagcugc

SEQ ID NO: 3976849 - RNA, 22 nt, Human herpesvirus 5
ccggccccacgcugacaaccca

SEQ ID NO: 3976850 - RNA, 22 nt, Human herpesvirus 5
ccggccgucgcaagggcugcuc

SEQ ID NO: 3976851 - RNA, 18 nt, Human herpesvirus 5
ccggcguggcggccgacg

SEQ ID NO: 3976852 - RNA, 14 nt, Human herpesvirus 5
ccggcuugaccgcg

SEQ ID NO: 3976853 - RNA, 12 nt, Human herpesvirus 5
ccgggaucacga

SEQ ID NO: 3976854 - RNA, 18 nt, Human herpesvirus 5
ccgggccaccagccgcga

SEQ ID NO: 3976855 - RNA, 20 nt, Human herpesvirus 5
ccgguaaaggaacaacccgu

SEQ ID NO: 3976856 - RNA, 18 nt, Human herpesvirus 5
ccggucacuggacucggu

SEQ ID NO: 3976857 - RNA, 16 nt, Human herpesvirus 5
ccggugccgaugagau

SEQ ID NO: 3976858 - RNA, 18 nt, Human herpesvirus 5
ccguacacgcacgcuggu

SEQ ID NO: 3976859 - RNA, 18 nt, Human herpesvirus 5
ccgucacgacgcuccguc

SEQ ID NO: 3976860 - RNA, 17 nt, Human herpesvirus 5
ccgucacugccaccgac

SEQ ID NO: 3976861 - RNA, 12 nt, Human herpesvirus 5
ccgucagccucg

SEQ ID NO: 3976862 - RNA, 22 nt, Human herpesvirus 5
ccgucccucuccucccuccgcg

SEQ ID NO: 3976863 - RNA, 16 nt, Human herpesvirus 5
ccgucgccggccgacg

SEQ ID NO: 3976864 - RNA, 20 nt, Human herpesvirus 5
ccgugauaacggucaagaag

SEQ ID NO: 3976865 - RNA, 23 nt, Human herpesvirus 5
ccgugcccguuuucacagcagcc

SEQ ID NO: 3976866 - RNA, 20 nt, Human herpesvirus 5
ccgugcucuuggcgccgcgg

SEQ ID NO: 3976867 - RNA, 14 nt, Human herpesvirus 5
ccguggccuguggc

SEQ ID NO: 3976868 - RNA, 16 nt, Human herpesvirus 5
ccgugggucccggcgc

SEQ ID NO: 3976869 - RNA, 18 nt, Human herpesvirus 5
ccguguaaaaggcguccu

SEQ ID NO: 3976870 - RNA, 21 nt, Human herpesvirus 5
ccguguauaacuaacgugucc

SEQ ID NO: 3976871 - RNA, 14 nt, Human herpesvirus 5
ccguuuugcugucc

SEQ ID NO: 3976872 - RNA, 15 nt, Human herpesvirus 5
ccguuuugcuguccu

SEQ ID NO: 3976873 - RNA, 15 nt, Human herpesvirus 5
ccuaagacgucgcga

SEQ ID NO: 3976874 - RNA, 18 nt, Human herpesvirus 5
ccuacggaccgcagcacc

SEQ ID NO: 3976875 - RNA, 23 nt, Human herpesvirus 5
ccuaucuccgacagcgcgacgag

SEQ ID NO: 3976876 - RNA, 14 nt, Human herpesvirus 5
ccuauggcgccgug

SEQ ID NO: 3976877 - RNA, 17 nt, Human herpesvirus 5
ccucaaaaagcaggugg

SEQ ID NO: 3976878 - RNA, 16 nt, Human herpesvirus 5
ccucagcgugcucagc

SEQ ID NO: 3976879 - RNA, 14 nt, Human herpesvirus 5
ccucagcuugcccg

SEQ ID NO: 3976880 - RNA, 23 nt, Human herpesvirus 5
ccucauggcggcggccacggccu

SEQ ID NO: 3976881 - RNA, 12 nt, Human herpesvirus 5
ccuccacugcca

SEQ ID NO: 3976882 - RNA, 14 nt, Human herpesvirus 5
ccuccagcagcagc

SEQ ID NO: 3976883 - RNA, 16 nt, Human herpesvirus 5
ccuccgacgacgccga

SEQ ID NO: 3976884 - RNA, 11 nt, Human herpesvirus 5
ccuccgcggcc

SEQ ID NO: 3976885 - RNA, 13 nt, Human herpesvirus 5
ccuccggcuguca

SEQ ID NO: 3976886 - RNA, 15 nt, Human herpesvirus 5
ccucgcccaggcugu

SEQ ID NO: 3976887 - RNA, 13 nt, Human herpesvirus 5
ccucgcgccgccc

SEQ ID NO: 3976888 - RNA, 21 nt, Human herpesvirus 5
ccucgcugggcuacaagugca

SEQ ID NO: 3976889 - RNA, 19 nt, Human herpesvirus 5
ccucgggaggacucagagc

SEQ ID NO: 3976890 - RNA, 17 nt, Human herpesvirus 5
ccucggguugccuggac

SEQ ID NO: 3976891 - RNA, 19 nt, Human herpesvirus 5
ccucgucggccugggcugc

SEQ ID NO: 3976892 - RNA, 15 nt, Human herpesvirus 5
ccucgucgugcccgu

SEQ ID NO: 3976893 - RNA, 17 nt, Human herpesvirus 5
ccucguuguccucuccu

SEQ ID NO: 3976894 - RNA, 18 nt, Human herpesvirus 5
ccucuacacuuggugcuc

SEQ ID NO: 3976895 - RNA, 13 nt, Human herpesvirus 5
ccucugccugggc

SEQ ID NO: 3976896 - RNA, 22 nt, Human herpesvirus 5
ccucuuaacaagccgaccccca

SEQ ID NO: 3976897 - RNA, 22 nt, Human herpesvirus 5
ccucuucuuugccggcucuccu

SEQ ID NO: 3976898 - RNA, 15 nt, Human herpesvirus 5
ccugacccgcggcua

SEQ ID NO: 3976899 - RNA, 15 nt, Human herpesvirus 5
ccugcacgaccugcu

SEQ ID NO: 3976900 - RNA, 20 nt, Human herpesvirus 5
ccugcacguccaugucgcga

SEQ ID NO: 3976901 - RNA, 17 nt, Human herpesvirus 5
ccugcagaccgaggcgc

SEQ ID NO: 3976902 - RNA, 20 nt, Human herpesvirus 5
ccugcagcgcuacgugcgcg

SEQ ID NO: 3976903 - RNA, 18 nt, Human herpesvirus 5
ccugccagucuccgcagu

SEQ ID NO: 3976904 - RNA, 23 nt, Human herpesvirus 5
ccugccgaagaccucaccaucuc

SEQ ID NO: 3976905 - RNA, 17 nt, Human herpesvirus 5
ccugcgacggcgggugg

SEQ ID NO: 3976906 - RNA, 23 nt, Human herpesvirus 5
ccuggacacucuggcccugcugu

SEQ ID NO: 3976907 - RNA, 20 nt, Human herpesvirus 5
ccuggacguaaauccagacc

SEQ ID NO: 3976908 - RNA, 14 nt, Human herpesvirus 5
ccuggccccggcca

SEQ ID NO: 3976909 - RNA, 20 nt, Human herpesvirus 5
ccugggaacgcgcgcacggc

SEQ ID NO: 3976910 - RNA, 16 nt, Human herpesvirus 5
ccugugguagaaugcu

SEQ ID NO: 3976911 - RNA, 14 nt, Human herpesvirus 5
ccuguuccugcugc

SEQ ID NO: 3976912 - RNA, 19 nt, Human herpesvirus 5
ccuguugugucgcacgccc

SEQ ID NO: 3976913 - RNA, 20 nt, Human herpesvirus 5
ccuuagcuuucuugacuggc

SEQ ID NO: 3976914 - RNA, 20 nt, Human herpesvirus 5
ccuucccucuagagacagac

SEQ ID NO: 3976915 - RNA, 15 nt, Human herpesvirus 5
ccuuccuccucugcc

SEQ ID NO: 3976916 - RNA, 21 nt, Human herpesvirus 5
ccuucugcuacgcggcgcccg

SEQ ID NO: 3976917 - RNA, 13 nt, Human herpesvirus 5
ccuugcgcgcggu

SEQ ID NO: 3976918 - RNA, 15 nt, Human herpesvirus 5
ccuuuugcuggcugg

SEQ ID NO: 3976919 - RNA, 13 nt, Human herpesvirus 5
cgaagaagaacaa

SEQ ID NO: 3976920 - RNA, 15 nt, Human herpesvirus 5
cgaauuugggcggug

SEQ ID NO: 3976921 - RNA, 18 nt, Human herpesvirus 5
cgacaucuuccgcgagca

SEQ ID NO: 3976922 - RNA, 14 nt, Human herpesvirus 5
cgaccgucuggagg

SEQ ID NO: 3976923 - RNA, 19 nt, Human herpesvirus 5
cgacgccggguuggcacga

SEQ ID NO: 3976924 - RNA, 12 nt, Human herpesvirus 5
cgacgcgcgacc

SEQ ID NO: 3976925 - RNA, 14 nt, Human herpesvirus 5
cgacgcgcggcggc

SEQ ID NO: 3976926 - RNA, 18 nt, Human herpesvirus 5
cgacggcuccaagaaaaa

SEQ ID NO: 3976927 - RNA, 19 nt, Human herpesvirus 5
cgacgggugguaccugcaa

SEQ ID NO: 3976928 - RNA, 15 nt, Human herpesvirus 5
cgacguaccagcugu

SEQ ID NO: 3976929 - RNA, 19 nt, Human herpesvirus 5
cgacguagguuaccgcgug

SEQ ID NO: 3976930 - RNA, 18 nt, Human herpesvirus 5
cgacucgcugccgcagcu

SEQ ID NO: 3976931 - RNA, 15 nt, Human herpesvirus 5
cgacugcgcggccug

SEQ ID NO: 3976932 - RNA, 16 nt, Human herpesvirus 5
cgacuggcucaacuuu

SEQ ID NO: 3976933 - RNA, 18 nt, Human herpesvirus 5
cgacuuuacggugcgcgg

SEQ ID NO: 3976934 - RNA, 16 nt, Human herpesvirus 5
cgagcauggaucacgc

SEQ ID NO: 3976935 - RNA, 17 nt, Human herpesvirus 5
cgagcguugcgcucgcg

SEQ ID NO: 3976936 - RNA, 12 nt, Human herpesvirus 5
cgagcucagccc

SEQ ID NO: 3976937 - RNA, 17 nt, Human herpesvirus 5
cgagcugaaggacacgg

SEQ ID NO: 3976938 - RNA, 21 nt, Human herpesvirus 5
cgagcuggacaaguacagcgg

SEQ ID NO: 3976939 - RNA, 21 nt, Human herpesvirus 5
cgagcuuauugagcgcagcca

SEQ ID NO: 3976940 - RNA, 16 nt, Human herpesvirus 5
cgaggaggaggggccg

SEQ ID NO: 3976941 - RNA, 13 nt, Human herpesvirus 5
cgagugggccagc

SEQ ID NO: 3976942 - RNA, 20 nt, Human herpesvirus 5
cgaguucggggugcaucauc

SEQ ID NO: 3976943 - RNA, 22 nt, Human herpesvirus 5
cgaguugcaaaagaagcugccc

SEQ ID NO: 3976944 - RNA, 11 nt, Human herpesvirus 5
cgaguuguagu

SEQ ID NO: 3976945 - RNA, 14 nt, Human herpesvirus 5
cgauauaggugaca

SEQ ID NO: 3976946 - RNA, 21 nt, Human herpesvirus 5
cgaucgcgcuuuugaccgcga

SEQ ID NO: 3976947 - RNA, 19 nt, Human herpesvirus 5
cgaucuggaaggcguggau

SEQ ID NO: 3976948 - RNA, 15 nt, Human herpesvirus 5
cgaugaaccuucccc

SEQ ID NO: 3976949 - RNA, 18 nt, Human herpesvirus 5
cgaugguauuacgcccga

SEQ ID NO: 3976950 - RNA, 16 nt, Human herpesvirus 5
cgaugugcagggacag

SEQ ID NO: 3976951 - RNA, 12 nt, Human herpesvirus 5
cgcaagggcugc

SEQ ID NO: 3976952 - RNA, 20 nt, Human herpesvirus 5
cgcaaugggcuucccuccug

SEQ ID NO: 3976953 - RNA, 23 nt, Human herpesvirus 5
cgcaaugggcuucccuccugcag

SEQ ID NO: 3976954 - RNA, 20 nt, Human herpesvirus 5
cgcacaacugguuccugcag

SEQ ID NO: 3976955 - RNA, 18 nt, Human herpesvirus 5
cgcaccgguuggagcagc

SEQ ID NO: 3976956 - RNA, 20 nt, Human herpesvirus 5
cgcacgaccgcgacgagguc

SEQ ID NO: 3976957 - RNA, 23 nt, Human herpesvirus 5
cgcacgagacgcgacuccugcag

SEQ ID NO: 3976958 - RNA, 17 nt, Human herpesvirus 5
cgcagcccggcuccgcg

SEQ ID NO: 3976959 - RNA, 17 nt, Human herpesvirus 5
cgcaggcaagccaaacc

SEQ ID NO: 3976960 - RNA, 21 nt, Human herpesvirus 5
cgcauaagaacggagugguga

SEQ ID NO: 3976961 - RNA, 20 nt, Human herpesvirus 5
cgcaucaucaacagcagcaa

SEQ ID NO: 3976962 - RNA, 13 nt, Human herpesvirus 5
cgcauccugccca

SEQ ID NO: 3976963 - RNA, 15 nt, Human herpesvirus 5
cgcaugggaaaguac

SEQ ID NO: 3976964 - RNA, 15 nt, Human herpesvirus 5
cgccacaacgccguc

SEQ ID NO: 3976965 - RNA, 15 nt, Human herpesvirus 5
cgccaccgauccgca

SEQ ID NO: 3976966 - RNA, 16 nt, Human herpesvirus 5
cgccacuauguccucc

SEQ ID NO: 3976967 - RNA, 22 nt, Human herpesvirus 5
cgccacuauguccuccgcacuu

SEQ ID NO: 3976968 - RNA, 13 nt, Human herpesvirus 5
cgccagcggccug

SEQ ID NO: 3976969 - RNA, 22 nt, Human herpesvirus 5
cgccaugaggcgguggcugcgc

SEQ ID NO: 3976970 - RNA, 14 nt, Human herpesvirus 5
cgcccgagacggcg

SEQ ID NO: 3976971 - RNA, 16 nt, Human herpesvirus 5
cgcccgagacggcggc

SEQ ID NO: 3976972 - RNA, 21 nt, Human herpesvirus 5
cgcccgaggcggaggagccgg

SEQ ID NO: 3976973 - RNA, 20 nt, Human herpesvirus 5
cgcccucagcgugcucagcu

SEQ ID NO: 3976974 - RNA, 22 nt, Human herpesvirus 5
cgccgacgugauccaggaggug

SEQ ID NO: 3976975 - RNA, 20 nt, Human herpesvirus 5
cgccgaugcuccgcgaccgg

SEQ ID NO: 3976976 - RNA, 14 nt, Human herpesvirus 5
cgccgcaacagcgg

SEQ ID NO: 3976977 - RNA, 22 nt, Human herpesvirus 5
cgccgccacccgcaccagacuu

SEQ ID NO: 3976978 - RNA, 15 nt, Human herpesvirus 5
cgccgccagcgcggu

SEQ ID NO: 3976979 - RNA, 22 nt, Human herpesvirus 5
cgccgcucauaaugccgucacc

SEQ ID NO: 3976980 - RNA, 14 nt, Human herpesvirus 5
cgccggaggcugug

SEQ ID NO: 3976981 - RNA, 17 nt, Human herpesvirus 5
cgccggcguugccgcca

SEQ ID NO: 3976982 - RNA, 17 nt, Human herpesvirus 5
cgccgggcggcuuccug

SEQ ID NO: 3976983 - RNA, 13 nt, Human herpesvirus 5
cgccguuugcccg

SEQ ID NO: 3976984 - RNA, 23 nt, Human herpesvirus 5
cgccguuugcccgaagcggcugu

SEQ ID NO: 3976985 - RNA, 14 nt, Human herpesvirus 5
cgccuccgguggug

SEQ ID NO: 3976986 - RNA, 15 nt, Human herpesvirus 5
cgccuccguccucgu

SEQ ID NO: 3976987 - RNA, 15 nt, Human herpesvirus 5
cgccucuucuggccc

SEQ ID NO: 3976988 - RNA, 16 nt, Human herpesvirus 5
cgccugcgacggcggg

SEQ ID NO: 3976989 - RNA, 14 nt, Human herpesvirus 5
cgccugguugcugc

SEQ ID NO: 3976990 - RNA, 23 nt, Human herpesvirus 5
cgcgaaagcuucggccggcugcu

SEQ ID NO: 3976991 - RNA, 12 nt, Human herpesvirus 5
cgcgaacggcga

SEQ ID NO: 3976992 - RNA, 13 nt, Human herpesvirus 5
cgcgacacggugg

SEQ ID NO: 3976993 - RNA, 19 nt, Human herpesvirus 5
cgcgagccccaucgggccc

SEQ ID NO: 3976994 - RNA, 13 nt, Human herpesvirus 5
cgcgagcggcgga

SEQ ID NO: 3976995 - RNA, 17 nt, Human herpesvirus 5
cgcgaguaucgggccgu

SEQ ID NO: 3976996 - RNA, 19 nt, Human herpesvirus 5
cgcgcaagugccugcacga

SEQ ID NO: 3976997 - RNA, 12 nt, Human herpesvirus 5
cgcgcaggcagc

SEQ ID NO: 3976998 - RNA, 22 nt, Human herpesvirus 5
cgcgcaggccgccgccgcucag

SEQ ID NO: 3976999 - RNA, 13 nt, Human herpesvirus 5
cgcgcccacugga

SEQ ID NO: 3977000 - RNA, 14 nt, Human herpesvirus 5
cgcgcccgacagcu

SEQ ID NO: 3977001 - RNA, 23 nt, Human herpesvirus 5
cgcgcccucuucuuugccggcuc

SEQ ID NO: 3977002 - RNA, 14 nt, Human herpesvirus 5
cgcgccuuccuccu

SEQ ID NO: 3977003 - RNA, 22 nt, Human herpesvirus 5
cgcgcgaagguguggcggcagc

SEQ ID NO: 3977004 - RNA, 12 nt, Human herpesvirus 5
cgcgcgcccgcg

SEQ ID NO: 3977005 - RNA, 15 nt, Human herpesvirus 5
cgcgcgcgaaggugu

SEQ ID NO: 3977006 - RNA, 21 nt, Human herpesvirus 5
cgcgcggucauauagccuccg

SEQ ID NO: 3977007 - RNA, 14 nt, Human herpesvirus 5
cgcgcuucuggucg

SEQ ID NO: 3977008 - RNA, 18 nt, Human herpesvirus 5
cgcgcuuugcgccgccgc

SEQ ID NO: 3977009 - RNA, 19 nt, Human herpesvirus 5
cgcgcuuuugaccgcgagc

SEQ ID NO: 3977010 - RNA, 17 nt, Human herpesvirus 5
cgcggacacccgcggcc

SEQ ID NO: 3977011 - RNA, 13 nt, Human herpesvirus 5
cgcggcaccagga

SEQ ID NO: 3977012 - RNA, 17 nt, Human herpesvirus 5
cgcggcgagguggucaa

SEQ ID NO: 3977013 - RNA, 11 nt, Human herpesvirus 5
cgcggcggugg

SEQ ID NO: 3977014 - RNA, 22 nt, Human herpesvirus 5
cgcggucgccgcgucagcggcc

SEQ ID NO: 3977015 - RNA, 23 nt, Human herpesvirus 5
cgcggucgccgcgucagcggccg

SEQ ID NO: 3977016 - RNA, 18 nt, Human herpesvirus 5
cgcguacggacgagugga

SEQ ID NO: 3977017 - RNA, 14 nt, Human herpesvirus 5
cgcguagaaggcaa

SEQ ID NO: 3977018 - RNA, 13 nt, Human herpesvirus 5
cgcguagccaccu

SEQ ID NO: 3977019 - RNA, 15 nt, Human herpesvirus 5
cgcguaggacgacgu

SEQ ID NO: 3977020 - RNA, 16 nt, Human herpesvirus 5
cgcguccagcuucugg

SEQ ID NO: 3977021 - RNA, 18 nt, Human herpesvirus 5
cgcgugccugggaacgcg

SEQ ID NO: 3977022 - RNA, 14 nt, Human herpesvirus 5
cgcgugcuccacca

SEQ ID NO: 3977023 - RNA, 12 nt, Human herpesvirus 5
cgcguggcccug

SEQ ID NO: 3977024 - RNA, 24 nt, Human herpesvirus 5
cgcguguuuugucugagcgccgac

SEQ ID NO: 3977025 - RNA, 16 nt, Human herpesvirus 5
cgcuaggcggcgccgg

SEQ ID NO: 3977026 - RNA, 13 nt, Human herpesvirus 5
cgcuccucgagcc

SEQ ID NO: 3977027 - RNA, 22 nt, Human herpesvirus 5
cgcugauggccuacggcugcau

SEQ ID NO: 3977028 - RNA, 13 nt, Human herpesvirus 5
cgcugccgcagcu

SEQ ID NO: 3977029 - RNA, 17 nt, Human herpesvirus 5
cgcugccgcagcugcug

SEQ ID NO: 3977030 - RNA, 20 nt, Human herpesvirus 5
cgcuggaggacgcgcuggcu

SEQ ID NO: 3977031 - RNA, 14 nt, Human herpesvirus 5
cgcuggcgggccga

SEQ ID NO: 3977032 - RNA, 20 nt, Human herpesvirus 5
cgcuugcgcccgagacggcg

SEQ ID NO: 3977033 - RNA, 18 nt, Human herpesvirus 5
cgcuuuaagcugcucaug

SEQ ID NO: 3977034 - RNA, 11 nt, Human herpesvirus 5
cgcuuucacac

SEQ ID NO: 3977035 - RNA, 21 nt, Human herpesvirus 5
cgcuuuucagaccgcaacaac

SEQ ID NO: 3977036 - RNA, 12 nt, Human herpesvirus 5
cggaaacagcgu

SEQ ID NO: 3977037 - RNA, 14 nt, Human herpesvirus 5
cggaagaagaagaa

SEQ ID NO: 3977038 - RNA, 19 nt, Human herpesvirus 5
cggacacuaggcguccgcg

SEQ ID NO: 3977039 - RNA, 21 nt, Human herpesvirus 5
cggacuuggcagcgggccugu

SEQ ID NO: 3977040 - RNA, 18 nt, Human herpesvirus 5
cggagcacgggcugcugg

SEQ ID NO: 3977041 - RNA, 18 nt, Human herpesvirus 5
cggagcagccgccagcga

SEQ ID NO: 3977042 - RNA, 17 nt, Human herpesvirus 5
cggagccccugcgcgcc

SEQ ID NO: 3977043 - RNA, 21 nt, Human herpesvirus 5
cggaggaggugaccuggcugc

SEQ ID NO: 3977044 - RNA, 22 nt, Human herpesvirus 5
cggaggaggugaccuggcugcu

SEQ ID NO: 3977045 - RNA, 12 nt, Human herpesvirus 5
cggaucgcggua

SEQ ID NO: 3977046 - RNA, 17 nt, Human herpesvirus 5
cggcaacuucuugguga

SEQ ID NO: 3977047 - RNA, 14 nt, Human herpesvirus 5
cggcaagagccgga

SEQ ID NO: 3977048 - RNA, 18 nt, Human herpesvirus 5
cggcaaggcggaggagag

SEQ ID NO: 3977049 - RNA, 21 nt, Human herpesvirus 5
cggcaaucggugcgauauccc

SEQ ID NO: 3977050 - RNA, 21 nt, Human herpesvirus 5
cggcacgccguugccacgagc

SEQ ID NO: 3977051 - RNA, 18 nt, Human herpesvirus 5
cggcagccaccgcgaggc

SEQ ID NO: 3977052 - RNA, 19 nt, Human herpesvirus 5
cggcagcccauccucgugg

SEQ ID NO: 3977053 - RNA, 19 nt, Human herpesvirus 5
cggcagcggaacucgaccu

SEQ ID NO: 3977054 - RNA, 18 nt, Human herpesvirus 5
cggcaggaaggccucguu

SEQ ID NO: 3977055 - RNA, 22 nt, Human herpesvirus 5
cggcauccucgggcuuuccggc

SEQ ID NO: 3977056 - RNA, 20 nt, Human herpesvirus 5
cggccaacaaccacggcgaa

SEQ ID NO: 3977057 - RNA, 22 nt, Human herpesvirus 5
cggccgacggcagcgugcugug

SEQ ID NO: 3977058 - RNA, 14 nt, Human herpesvirus 5
cggccgcagaaggc

SEQ ID NO: 3977059 - RNA, 19 nt, Human herpesvirus 5
cggccgcagugggcccacg

SEQ ID NO: 3977060 - RNA, 15 nt, Human herpesvirus 5
cggccggcugcugca

SEQ ID NO: 3977061 - RNA, 13 nt, Human herpesvirus 5
cggccgugcagca

SEQ ID NO: 3977062 - RNA, 21 nt, Human herpesvirus 5
cggccugggcgcccccacccc

SEQ ID NO: 3977063 - RNA, 12 nt, Human herpesvirus 5
cggccuuucuag

SEQ ID NO: 3977064 - RNA, 18 nt, Human herpesvirus 5
cggcgaauggaucaucug

SEQ ID NO: 3977065 - RNA, 17 nt, Human herpesvirus 5
cggcgacugacgccggc

SEQ ID NO: 3977066 - RNA, 19 nt, Human herpesvirus 5
cggcgcccaaaccgcagga

SEQ ID NO: 3977067 - RNA, 23 nt, Human herpesvirus 5
cggcggacuuggcagcgggccug

SEQ ID NO: 3977068 - RNA, 21 nt, Human herpesvirus 5
cggcgguggagggcgcgcggc

SEQ ID NO: 3977069 - RNA, 22 nt, Human herpesvirus 5
cggcgguggagggcgcgcggca

SEQ ID NO: 3977070 - RNA, 18 nt, Human herpesvirus 5
cggcucaccacgcagcag

SEQ ID NO: 3977071 - RNA, 20 nt, Human herpesvirus 5
cggcucaccacgcagcaggc

SEQ ID NO: 3977072 - RNA, 14 nt, Human herpesvirus 5
cggcucgccgcaga

SEQ ID NO: 3977073 - RNA, 18 nt, Human herpesvirus 5
cggcugacgcggacgagg

SEQ ID NO: 3977074 - RNA, 21 nt, Human herpesvirus 5
cggcugccuguuccugcugcu

SEQ ID NO: 3977075 - RNA, 16 nt, Human herpesvirus 5
cggcuugggcagcagc

SEQ ID NO: 3977076 - RNA, 15 nt, Human herpesvirus 5
cgggaaaccacgccg

SEQ ID NO: 3977077 - RNA, 16 nt, Human herpesvirus 5
cgggaaaccacgccgg

SEQ ID NO: 3977078 - RNA, 19 nt, Human herpesvirus 5
cgggacagcgugccggcga

SEQ ID NO: 3977079 - RNA, 22 nt, Human herpesvirus 5
cgggaggacucagagccacuga

SEQ ID NO: 3977080 - RNA, 16 nt, Human herpesvirus 5
cgggagucuaccuccu

SEQ ID NO: 3977081 - RNA, 13 nt, Human herpesvirus 5
cgggcacugggga

SEQ ID NO: 3977082 - RNA, 14 nt, Human herpesvirus 5
cgggcccugcugac

SEQ ID NO: 3977083 - RNA, 15 nt, Human herpesvirus 5
cgggccgccgccagc

SEQ ID NO: 3977084 - RNA, 21 nt, Human herpesvirus 5
cgggccugguauacgaggcuc

SEQ ID NO: 3977085 - RNA, 20 nt, Human herpesvirus 5
cgggcggcuuccugcggccg

SEQ ID NO: 3977086 - RNA, 15 nt, Human herpesvirus 5
cgggcguuggccugu

SEQ ID NO: 3977087 - RNA, 22 nt, Human herpesvirus 5
cgggcucaccgcaguugcugcc

SEQ ID NO: 3977088 - RNA, 23 nt, Human herpesvirus 5
cgggcucaccgcaguugcugccu

SEQ ID NO: 3977089 - RNA, 19 nt, Human herpesvirus 5
cgggcucguguggcagcug

SEQ ID NO: 3977090 - RNA, 18 nt, Human herpesvirus 5
cgggcucugggaagcugc

SEQ ID NO: 3977091 - RNA, 21 nt, Human herpesvirus 5
cggggcgugccgagcugccuu

SEQ ID NO: 3977092 - RNA, 18 nt, Human herpesvirus 5
cggguccauuggagccgc

SEQ ID NO: 3977093 - RNA, 18 nt, Human herpesvirus 5
cgggucucuuugacacga

SEQ ID NO: 3977094 - RNA, 14 nt, Human herpesvirus 5
cgggugacggcgac

SEQ ID NO: 3977095 - RNA, 13 nt, Human herpesvirus 5
cggguugcagcuu

SEQ ID NO: 3977096 - RNA, 16 nt, Human herpesvirus 5
cgguaccauuucuugg

SEQ ID NO: 3977097 - RNA, 22 nt, Human herpesvirus 5
cgguacgcagucacugcguguc

SEQ ID NO: 3977098 - RNA, 19 nt, Human herpesvirus 5
cggucccccccguccaggu

SEQ ID NO: 3977099 - RNA, 15 nt, Human herpesvirus 5
cggucgcgacgguga

SEQ ID NO: 3977100 - RNA, 19 nt, Human herpesvirus 5
cggucguaagcggcagcau

SEQ ID NO: 3977101 - RNA, 18 nt, Human herpesvirus 5
cgguggaauucgcugggc

SEQ ID NO: 3977102 - RNA, 18 nt, Human herpesvirus 5
cgguggucgaugcugauc

SEQ ID NO: 3977103 - RNA, 22 nt, Human herpesvirus 5
cgguggucgaugcugaucacgu

SEQ ID NO: 3977104 - RNA, 14 nt, Human herpesvirus 5
cgguggugacuggg

SEQ ID NO: 3977105 - RNA, 17 nt, Human herpesvirus 5
cggugguuucgcuggga

SEQ ID NO: 3977106 - RNA, 22 nt, Human herpesvirus 5
cggugucuccucgcgaggcuga

SEQ ID NO: 3977107 - RNA, 17 nt, Human herpesvirus 5
cgguguuucggcucccg

SEQ ID NO: 3977108 - RNA, 14 nt, Human herpesvirus 5
cgguuugaccacac

SEQ ID NO: 3977109 - RNA, 23 nt, Human herpesvirus 5
cguacgcgagaccugaaaguuua

SEQ ID NO: 3977110 - RNA, 15 nt, Human herpesvirus 5
cguauacgcgcugga

SEQ ID NO: 3977111 - RNA, 16 nt, Human herpesvirus 5
cgucacaauugacgug

SEQ ID NO: 3977112 - RNA, 17 nt, Human herpesvirus 5
cgucacuacucugggau

SEQ ID NO: 3977113 - RNA, 16 nt, Human herpesvirus 5
cgucacuucaaccacg

SEQ ID NO: 3977114 - RNA, 21 nt, Human herpesvirus 5
cgucagccucgggugcaccgc

SEQ ID NO: 3977115 - RNA, 20 nt, Human herpesvirus 5
cgucaucucgccgacguggu

SEQ ID NO: 3977116 - RNA, 21 nt, Human herpesvirus 5
cgucaugccuuggcgcucugg

SEQ ID NO: 3977117 - RNA, 22 nt, Human herpesvirus 5
cgucgaccuugagcgacagcag

SEQ ID NO: 3977118 - RNA, 13 nt, Human herpesvirus 5
cgucgacggugaa

SEQ ID NO: 3977119 - RNA, 14 nt, Human herpesvirus 5
cgucgagcggcgug

SEQ ID NO: 3977120 - RNA, 14 nt, Human herpesvirus 5
cgucggccaacaac

SEQ ID NO: 3977121 - RNA, 16 nt, Human herpesvirus 5
cgucggcggggcggac

SEQ ID NO: 3977122 - RNA, 18 nt, Human herpesvirus 5
cgucggcgguccuccagc

SEQ ID NO: 3977123 - RNA, 23 nt, Human herpesvirus 5
cgucggcugccuguuccugcugc

SEQ ID NO: 3977124 - RNA, 11 nt, Human herpesvirus 5
cgucgguggaa

SEQ ID NO: 3977125 - RNA, 15 nt, Human herpesvirus 5
cgucugacgcugucu

SEQ ID NO: 3977126 - RNA, 14 nt, Human herpesvirus 5
cgugaaacagcagc

SEQ ID NO: 3977127 - RNA, 13 nt, Human herpesvirus 5
cgugacacuuugg

SEQ ID NO: 3977128 - RNA, 14 nt, Human herpesvirus 5
cgugacgcagucug

SEQ ID NO: 3977129 - RNA, 14 nt, Human herpesvirus 5
cgugauaggcggcg

SEQ ID NO: 3977130 - RNA, 12 nt, Human herpesvirus 5
cgugccaccugc

SEQ ID NO: 3977131 - RNA, 20 nt, Human herpesvirus 5
cgugccaucaaucgcguccg

SEQ ID NO: 3977132 - RNA, 21 nt, Human herpesvirus 5
cgugcgauuuggaccuggagg

SEQ ID NO: 3977133 - RNA, 16 nt, Human herpesvirus 5
cgugcgcacgccgcgc

SEQ ID NO: 3977134 - RNA, 18 nt, Human herpesvirus 5
cgugcugauucgcgccgu

SEQ ID NO: 3977135 - RNA, 22 nt, Human herpesvirus 5
cgugcugauucgcgccgugcgc

SEQ ID NO: 3977136 - RNA, 18 nt, Human herpesvirus 5
cguggaccucacguugaa

SEQ ID NO: 3977137 - RNA, 13 nt, Human herpesvirus 5
cguggagaccacc

SEQ ID NO: 3977138 - RNA, 15 nt, Human herpesvirus 5
cguggccuguggccc

SEQ ID NO: 3977139 - RNA, 12 nt, Human herpesvirus 5
cguggcgcacac

SEQ ID NO: 3977140 - RNA, 15 nt, Human herpesvirus 5
cguggcgcgggcacg

SEQ ID NO: 3977141 - RNA, 16 nt, Human herpesvirus 5
cgugggcuacuuugac

SEQ ID NO: 3977142 - RNA, 13 nt, Human herpesvirus 5
cguggugcgcugc

SEQ ID NO: 3977143 - RNA, 16 nt, Human herpesvirus 5
cgugucgggaaaggag

SEQ ID NO: 3977144 - RNA, 15 nt, Human herpesvirus 5
cgugucugauaccgg

SEQ ID NO: 3977145 - RNA, 19 nt, Human herpesvirus 5
cgugucugggccacaggga

SEQ ID NO: 3977146 - RNA, 18 nt, Human herpesvirus 5
cgugugguagaagagcac

SEQ ID NO: 3977147 - RNA, 14 nt, Human herpesvirus 5
cguguuaucacaga

SEQ ID NO: 3977148 - RNA, 15 nt, Human herpesvirus 5
cguuacgccgacgug

SEQ ID NO: 3977149 - RNA, 21 nt, Human herpesvirus 5
cguuagagaaagagcagcgcg

SEQ ID NO: 3977150 - RNA, 18 nt, Human herpesvirus 5
cguucgcgugcacgcgcc

SEQ ID NO: 3977151 - RNA, 16 nt, Human herpesvirus 5
cguugcuuuggcggca

SEQ ID NO: 3977152 - RNA, 21 nt, Human herpesvirus 5
cguuggacgcuuaucgggcgc

SEQ ID NO: 3977153 - RNA, 18 nt, Human herpesvirus 5
cguuggcucucgcagccc

SEQ ID NO: 3977154 - RNA, 16 nt, Human herpesvirus 5
cguugggucugcgcug

SEQ ID NO: 3977155 - RNA, 20 nt, Human herpesvirus 5
cguuguuucuguacggcguu

SEQ ID NO: 3977156 - RNA, 19 nt, Human herpesvirus 5
cuaaaacgguacgggcccc

SEQ ID NO: 3977157 - RNA, 16 nt, Human herpesvirus 5
cuaacuagccuucccg

SEQ ID NO: 3977158 - RNA, 16 nt, Human herpesvirus 5
cuaacucgcguuuaua

SEQ ID NO: 3977159 - RNA, 21 nt, Human herpesvirus 5
cuaagagauccugggacacca

SEQ ID NO: 3977160 - RNA, 13 nt, Human herpesvirus 5
cuacacuauguuc

SEQ ID NO: 3977161 - RNA, 16 nt, Human herpesvirus 5
cuacgccggggaagcc

SEQ ID NO: 3977162 - RNA, 22 nt, Human herpesvirus 5
cuacgccggggaagccuccgga

SEQ ID NO: 3977163 - RNA, 19 nt, Human herpesvirus 5
cuacgcgugcacgcgcugc

SEQ ID NO: 3977164 - RNA, 15 nt, Human herpesvirus 5
cuacgugcaacgcca

SEQ ID NO: 3977165 - RNA, 19 nt, Human herpesvirus 5
cuacgugcgcgccacggcg

SEQ ID NO: 3977166 - RNA, 22 nt, Human herpesvirus 5
cuacucacguugguguuguagc

SEQ ID NO: 3977167 - RNA, 21 nt, Human herpesvirus 5
cuacuucacgugcggcugugu

SEQ ID NO: 3977168 - RNA, 14 nt, Human herpesvirus 5
cuagacgaaauuca

SEQ ID NO: 3977169 - RNA, 15 nt, Human herpesvirus 5
cuagcauucugguga

SEQ ID NO: 3977170 - RNA, 20 nt, Human herpesvirus 5
cuagccuuucugaccuugcu

SEQ ID NO: 3977171 - RNA, 20 nt, Human herpesvirus 5
cuagcuggcggccucuuuug

SEQ ID NO: 3977172 - RNA, 19 nt, Human herpesvirus 5
cuaguuagauuuccugugu

SEQ ID NO: 3977173 - RNA, 20 nt, Human herpesvirus 5
cuaucaccaaacaacaccac

SEQ ID NO: 3977174 - RNA, 14 nt, Human herpesvirus 5
cuaugagggccugc

SEQ ID NO: 3977175 - RNA, 15 nt, Human herpesvirus 5
cuaugauccuguggu

SEQ ID NO: 3977176 - RNA, 13 nt, Human herpesvirus 5
cuauguggcuccg

SEQ ID NO: 3977177 - RNA, 15 nt, Human herpesvirus 5
cuauguggcuccgcc

SEQ ID NO: 3977178 - RNA, 17 nt, Human herpesvirus 5
cuauguggcuccgccgg

SEQ ID NO: 3977179 - RNA, 17 nt, Human herpesvirus 5
cuauugccacacgcgcu

SEQ ID NO: 3977180 - RNA, 20 nt, Human herpesvirus 5
cucaacgacuuucuggagca

SEQ ID NO: 3977181 - RNA, 21 nt, Human herpesvirus 5
cucaccccgcgcgacguagaa

SEQ ID NO: 3977182 - RNA, 11 nt, Human herpesvirus 5
cucagagccac

SEQ ID NO: 3977183 - RNA, 20 nt, Human herpesvirus 5
cucagcgacgucccgcgcgg

SEQ ID NO: 3977184 - RNA, 17 nt, Human herpesvirus 5
cucagcggcguguacag

SEQ ID NO: 3977185 - RNA, 18 nt, Human herpesvirus 5
cucagcggcguguacagc

SEQ ID NO: 3977186 - RNA, 23 nt, Human herpesvirus 5
cucagcggcguguacagcuaccu

SEQ ID NO: 3977187 - RNA, 16 nt, Human herpesvirus 5
cucagcuugauggugu

SEQ ID NO: 3977188 - RNA, 14 nt, Human herpesvirus 5
cucaggcgcgcaga

SEQ ID NO: 3977189 - RNA, 23 nt, Human herpesvirus 5
cucagggcugggauccgccgcca

SEQ ID NO: 3977190 - RNA, 20 nt, Human herpesvirus 5
cucagucaccgaguccauca

SEQ ID NO: 3977191 - RNA, 17 nt, Human herpesvirus 5
cucagugaauucuggca

SEQ ID NO: 3977192 - RNA, 16 nt, Human herpesvirus 5
cucaucucagccucgu

SEQ ID NO: 3977193 - RNA, 12 nt, Human herpesvirus 5
cuccacaaccug

SEQ ID NO: 3977194 - RNA, 15 nt, Human herpesvirus 5
cuccacgucuucaaa

SEQ ID NO: 3977195 - RNA, 16 nt, Human herpesvirus 5
cuccagcagcagcugg

SEQ ID NO: 3977196 - RNA, 15 nt, Human herpesvirus 5
cuccaucaugaagga

SEQ ID NO: 3977197 - RNA, 22 nt, Human herpesvirus 5
cuccaucgcagccacgcgcugg

SEQ ID NO: 3977198 - RNA, 18 nt, Human herpesvirus 5
cucccgacaggcucgucg

SEQ ID NO: 3977199 - RNA, 22 nt, Human herpesvirus 5
cuccgcaguuacaccacacguc

SEQ ID NO: 3977200 - RNA, 15 nt, Human herpesvirus 5
cuccgcuugcugcga

SEQ ID NO: 3977201 - RNA, 13 nt, Human herpesvirus 5
cuccggcugucau

SEQ ID NO: 3977202 - RNA, 14 nt, Human herpesvirus 5
cuccgucaauaaaa

SEQ ID NO: 3977203 - RNA, 14 nt, Human herpesvirus 5
cuccgucacgccuc

SEQ ID NO: 3977204 - RNA, 15 nt, Human herpesvirus 5
cuccgucacgccucu

SEQ ID NO: 3977205 - RNA, 14 nt, Human herpesvirus 5
cuccguccucgucg

SEQ ID NO: 3977206 - RNA, 22 nt, Human herpesvirus 5
cuccgucguuaucuucccugag

SEQ ID NO: 3977207 - RNA, 12 nt, Human herpesvirus 5
cuccgucucugg

SEQ ID NO: 3977208 - RNA, 16 nt, Human herpesvirus 5
cuccgugcggccccca

SEQ ID NO: 3977209 - RNA, 17 nt, Human herpesvirus 5
cuccuccgagccaaaag

SEQ ID NO: 3977210 - RNA, 20 nt, Human herpesvirus 5
cuccucgacgcgcggcggcg

SEQ ID NO: 3977211 - RNA, 14 nt, Human herpesvirus 5
cuccucguccucgu

SEQ ID NO: 3977212 - RNA, 15 nt, Human herpesvirus 5
cuccucugccugggc

SEQ ID NO: 3977213 - RNA, 16 nt, Human herpesvirus 5
cuccucugccugggca

SEQ ID NO: 3977214 - RNA, 14 nt, Human herpesvirus 5
cuccugcagcugca

SEQ ID NO: 3977215 - RNA, 19 nt, Human herpesvirus 5
cucgaccgcuggaggccuc

SEQ ID NO: 3977216 - RNA, 16 nt, Human herpesvirus 5
cucgaccggcggcugc

SEQ ID NO: 3977217 - RNA, 20 nt, Human herpesvirus 5
cucgaccggcggcugcuguu

SEQ ID NO: 3977218 - RNA, 19 nt, Human herpesvirus 5
cucgagcuuauugagcgca

SEQ ID NO: 3977219 - RNA, 15 nt, Human herpesvirus 5
cucgaggaggggccg

SEQ ID NO: 3977220 - RNA, 22 nt, Human herpesvirus 5
cucgagggcuccgucugcguca

SEQ ID NO: 3977221 - RNA, 14 nt, Human herpesvirus 5
cucgcgcccgcaga

SEQ ID NO: 3977222 - RNA, 21 nt, Human herpesvirus 5
cucgcugccgcagcugcugga

SEQ ID NO: 3977223 - RNA, 12 nt, Human herpesvirus 5
cucgcuggaagc

SEQ ID NO: 3977224 - RNA, 19 nt, Human herpesvirus 5
cucgcuuacgucuacagca

SEQ ID NO: 3977225 - RNA, 22 nt, Human herpesvirus 5
cucgcuuacgucuacagcaugg

SEQ ID NO: 3977226 - RNA, 15 nt, Human herpesvirus 5
cucggaucugcggcu

SEQ ID NO: 3977227 - RNA, 21 nt, Human herpesvirus 5
cucggccuugcgcucccugcu

SEQ ID NO: 3977228 - RNA, 19 nt, Human herpesvirus 5
cucgggaggacucagagcc

SEQ ID NO: 3977229 - RNA, 16 nt, Human herpesvirus 5
cucgggcuggcgugcu

SEQ ID NO: 3977230 - RNA, 16 nt, Human herpesvirus 5
cucgggugcaccgcgg

SEQ ID NO: 3977231 - RNA, 15 nt, Human herpesvirus 5
cucggguugccugga

SEQ ID NO: 3977232 - RNA, 17 nt, Human herpesvirus 5
cucggugugcgacgcca

SEQ ID NO: 3977233 - RNA, 19 nt, Human herpesvirus 5
cucgucaaucuugcguugc

SEQ ID NO: 3977234 - RNA, 21 nt, Human herpesvirus 5
cucgucgccagcgcgagcgcu

SEQ ID NO: 3977235 - RNA, 20 nt, Human herpesvirus 5
cucgucgcucuaucugcgcg

SEQ ID NO: 3977236 - RNA, 20 nt, Human herpesvirus 5
cucgucggugagacgaggcc

SEQ ID NO: 3977237 - RNA, 18 nt, Human herpesvirus 5
cucgucugagccggggug

SEQ ID NO: 3977238 - RNA, 20 nt, Human herpesvirus 5
cucguuucgccggcgcgcca

SEQ ID NO: 3977239 - RNA, 19 nt, Human herpesvirus 5
cucucgagugcggucggug

SEQ ID NO: 3977240 - RNA, 12 nt, Human herpesvirus 5
cucucgggccga

SEQ ID NO: 3977241 - RNA, 22 nt, Human herpesvirus 5
cucucugugagcuuuuuucccc

SEQ ID NO: 3977242 - RNA, 14 nt, Human herpesvirus 5
cucugccugggcac

SEQ ID NO: 3977243 - RNA, 21 nt, Human herpesvirus 5
cucuggaugguacgucucuac

SEQ ID NO: 3977244 - RNA, 17 nt, Human herpesvirus 5
cucuggcccugcuguac

SEQ ID NO: 3977245 - RNA, 17 nt, Human herpesvirus 5
cucugucggcgccgccg

SEQ ID NO: 3977246 - RNA, 16 nt, Human herpesvirus 5
cucuuccaaaucuccg

SEQ ID NO: 3977247 - RNA, 13 nt, Human herpesvirus 5
cucuugcgcccuc

SEQ ID NO: 3977248 - RNA, 13 nt, Human herpesvirus 5
cugaacaauaaac

SEQ ID NO: 3977249 - RNA, 14 nt, Human herpesvirus 5
cugaacaauaaacu

SEQ ID NO: 3977250 - RNA, 14 nt, Human herpesvirus 5
cugaaggacacggu

SEQ ID NO: 3977251 - RNA, 22 nt, Human herpesvirus 5
cugaaugacguuaucauaaacu

SEQ ID NO: 3977252 - RNA, 14 nt, Human herpesvirus 5
cugacacagcuccu

SEQ ID NO: 3977253 - RNA, 20 nt, Human herpesvirus 5
cugacccuccccccaucccg

SEQ ID NO: 3977254 - RNA, 19 nt, Human herpesvirus 5
cugacgcuguacaaucuca

SEQ ID NO: 3977255 - RNA, 15 nt, Human herpesvirus 5
cugacgugaggcgcu

SEQ ID NO: 3977256 - RNA, 19 nt, Human herpesvirus 5
cugagaaccuacgugcaac

SEQ ID NO: 3977257 - RNA, 15 nt, Human herpesvirus 5
cugagacagccacau

SEQ ID NO: 3977258 - RNA, 18 nt, Human herpesvirus 5
cugagacugguggugaga

SEQ ID NO: 3977259 - RNA, 17 nt, Human herpesvirus 5
cugagcgcgcucagcua

SEQ ID NO: 3977260 - RNA, 17 nt, Human herpesvirus 5
cugaggaaggggaggag

SEQ ID NO: 3977261 - RNA, 17 nt, Human herpesvirus 5
cugaguuccgucagcac

SEQ ID NO: 3977262 - RNA, 17 nt, Human herpesvirus 5
cugauccaguugcaccu

SEQ ID NO: 3977263 - RNA, 23 nt, Human herpesvirus 5
cugauggccgacgaggccggcgg

SEQ ID NO: 3977264 - RNA, 23 nt, Human herpesvirus 5
cugauuaaccauaucgugaacca

SEQ ID NO: 3977265 - RNA, 18 nt, Human herpesvirus 5
cugcaacugcaccagcaa

SEQ ID NO: 3977266 - RNA, 18 nt, Human herpesvirus 5
cugcaccucgugcgagga

SEQ ID NO: 3977267 - RNA, 23 nt, Human herpesvirus 5
cugcagcacgcgauuggccagca

SEQ ID NO: 3977268 - RNA, 14 nt, Human herpesvirus 5
cugcagcugcacca

SEQ ID NO: 3977269 - RNA, 20 nt, Human herpesvirus 5
cugccucagucucucggugc

SEQ ID NO: 3977270 - RNA, 23 nt, Human herpesvirus 5
cugccucagucucucggugcgug

SEQ ID NO: 3977271 - RNA, 20 nt, Human herpesvirus 5
cugccugguuaguucgccgu

SEQ ID NO: 3977272 - RNA, 17 nt, Human herpesvirus 5
cugcgcaggccgccgcu

SEQ ID NO: 3977273 - RNA, 13 nt, Human herpesvirus 5
cugcgcgacacgg

SEQ ID NO: 3977274 - RNA, 22 nt, Human herpesvirus 5
cugcgcgccuccguccucgucg

SEQ ID NO: 3977275 - RNA, 13 nt, Human herpesvirus 5
cugcggcgacugg

SEQ ID NO: 3977276 - RNA, 22 nt, Human herpesvirus 5
cugcggcggcgcgaccuucccu

SEQ ID NO: 3977277 - RNA, 15 nt, Human herpesvirus 5
cugcguaagcaccgu

SEQ ID NO: 3977278 - RNA, 18 nt, Human herpesvirus 5
cugcguucacgaggacca

SEQ ID NO: 3977279 - RNA, 18 nt, Human herpesvirus 5
cugcguucuguggugcgu

SEQ ID NO: 3977280 - RNA, 19 nt, Human herpesvirus 5
cugcuauaagaaggccaug

SEQ ID NO: 3977281 - RNA, 15 nt, Human herpesvirus 5
cugcugcccacggaa

SEQ ID NO: 3977282 - RNA, 20 nt, Human herpesvirus 5
cugcugugguguugccuucu

SEQ ID NO: 3977283 - RNA, 17 nt, Human herpesvirus 5
cuggacccacaagcgcc

SEQ ID NO: 3977284 - RNA, 13 nt, Human herpesvirus 5
cuggauacaagcu

SEQ ID NO: 3977285 - RNA, 16 nt, Human herpesvirus 5
cuggcaacgugccacg

SEQ ID NO: 3977286 - RNA, 17 nt, Human herpesvirus 5
cuggcaauuacgugggu

SEQ ID NO: 3977287 - RNA, 12 nt, Human herpesvirus 5
cuggcagagcca

SEQ ID NO: 3977288 - RNA, 16 nt, Human herpesvirus 5
cuggcccaaagaccgc

SEQ ID NO: 3977289 - RNA, 15 nt, Human herpesvirus 5
cuggccgagacggcg

SEQ ID NO: 3977290 - RNA, 19 nt, Human herpesvirus 5
cuggcgacccgcagucugg

SEQ ID NO: 3977291 - RNA, 21 nt, Human herpesvirus 5
cugggagagccgcacagacca

SEQ ID NO: 3977292 - RNA, 21 nt, Human herpesvirus 5
cugggagugguggcggcagcc

SEQ ID NO: 3977293 - RNA, 19 nt, Human herpesvirus 5
cugggauaccgcccgcaug

SEQ ID NO: 3977294 - RNA, 16 nt, Human herpesvirus 5
cugggcgcccccaccc

SEQ ID NO: 3977295 - RNA, 18 nt, Human herpesvirus 5
cugggcgcccccaccccc

SEQ ID NO: 3977296 - RNA, 14 nt, Human herpesvirus 5
cugggcugggugca

SEQ ID NO: 3977297 - RNA, 14 nt, Human herpesvirus 5
cuggggcugcugcu

SEQ ID NO: 3977298 - RNA, 19 nt, Human herpesvirus 5
cuggggcugcugcugcacg

SEQ ID NO: 3977299 - RNA, 14 nt, Human herpesvirus 5
cuggguauccccga

SEQ ID NO: 3977300 - RNA, 12 nt, Human herpesvirus 5
cugggugcaaug

SEQ ID NO: 3977301 - RNA, 22 nt, Human herpesvirus 5
cugguagcgcuugcggcacagc

SEQ ID NO: 3977302 - RNA, 14 nt, Human herpesvirus 5
cugguauaaccagu

SEQ ID NO: 3977303 - RNA, 24 nt, Human herpesvirus 5
cuguaguacuaccguuaacuauuc

SEQ ID NO: 3977304 - RNA, 14 nt, Human herpesvirus 5
cuguauuauauaca

SEQ ID NO: 3977305 - RNA, 24 nt, Human herpesvirus 5
cugucagcgccgggugcgcgacac

SEQ ID NO: 3977306 - RNA, 17 nt, Human herpesvirus 5
cugucaucacgguacac

SEQ ID NO: 3977307 - RNA, 23 nt, Human herpesvirus 5
cugucguguuccagaccagcgcc

SEQ ID NO: 3977308 - RNA, 20 nt, Human herpesvirus 5
cugucuaacuagccuucccg

SEQ ID NO: 3977309 - RNA, 17 nt, Human herpesvirus 5
cugucuugcuuaaugau

SEQ ID NO: 3977310 - RNA, 15 nt, Human herpesvirus 5
cugugaucugcacgu

SEQ ID NO: 3977311 - RNA, 23 nt, Human herpesvirus 5
cuguggcaccgccuccgaacgcu

SEQ ID NO: 3977312 - RNA, 13 nt, Human herpesvirus 5
cugugggcccacu

SEQ ID NO: 3977313 - RNA, 19 nt, Human herpesvirus 5
cugugucgcaugagaucca

SEQ ID NO: 3977314 - RNA, 21 nt, Human herpesvirus 5
cuguuaacccccgacgagcag

SEQ ID NO: 3977315 - RNA, 16 nt, Human herpesvirus 5
cuguuacgagaagaaa

SEQ ID NO: 3977316 - RNA, 20 nt, Human herpesvirus 5
cuguuagaaccgcgggccgc

SEQ ID NO: 3977317 - RNA, 14 nt, Human herpesvirus 5
cuguuccugcugcu

SEQ ID NO: 3977318 - RNA, 15 nt, Human herpesvirus 5
cuguugaccugggua

SEQ ID NO: 3977319 - RNA, 14 nt, Human herpesvirus 5
cuguugcucuaccg

SEQ ID NO: 3977320 - RNA, 17 nt, Human herpesvirus 5
cuguuggcuuacugccu

SEQ ID NO: 3977321 - RNA, 23 nt, Human herpesvirus 5
cuuagacauuccccaccuucccu

SEQ ID NO: 3977322 - RNA, 15 nt, Human herpesvirus 5
cuucaaccacgagua

SEQ ID NO: 3977323 - RNA, 19 nt, Human herpesvirus 5
cuucaucuuucagcuggcu

SEQ ID NO: 3977324 - RNA, 21 nt, Human herpesvirus 5
cuucauggcuuggcgcagcgg

SEQ ID NO: 3977325 - RNA, 20 nt, Human herpesvirus 5
cuuccauaauaaaaguaaaa

SEQ ID NO: 3977326 - RNA, 21 nt, Human herpesvirus 5
cuuccuagcgacggcggccau

SEQ ID NO: 3977327 - RNA, 18 nt, Human herpesvirus 5
cuucggucucgggcucgc

SEQ ID NO: 3977328 - RNA, 17 nt, Human herpesvirus 5
cuucucgaucuuuugga

SEQ ID NO: 3977329 - RNA, 12 nt, Human herpesvirus 5
cuugcccggcgu

SEQ ID NO: 3977330 - RNA, 16 nt, Human herpesvirus 5
cuugcgcucggucagc

SEQ ID NO: 3977331 - RNA, 16 nt, Human herpesvirus 5
cuugggcagcagcggc

SEQ ID NO: 3977332 - RNA, 19 nt, Human herpesvirus 5
cuugguacgcugacguggu

SEQ ID NO: 3977333 - RNA, 22 nt, Human herpesvirus 5
cuugucgucauucgggccagga

SEQ ID NO: 3977334 - RNA, 20 nt, Human herpesvirus 5
cuuuagccaggugaccagca

SEQ ID NO: 3977335 - RNA, 15 nt, Human herpesvirus 5
cuuuauuugcaucau

SEQ ID NO: 3977336 - RNA, 15 nt, Human herpesvirus 5
cuuucuggagcagga

SEQ ID NO: 3977337 - RNA, 19 nt, Human herpesvirus 5
cuuugacgugcucaagagg

SEQ ID NO: 3977338 - RNA, 17 nt, Human herpesvirus 5
cuuugcuuaucugccuc

SEQ ID NO: 3977339 - RNA, 18 nt, Human herpesvirus 5
cuuugcuuaucugccucu

SEQ ID NO: 3977340 - RNA, 17 nt, Human herpesvirus 5
cuuuggcgugcccagcc

SEQ ID NO: 3977341 - RNA, 17 nt, Human herpesvirus 5
cuuuggcuacgguggug

SEQ ID NO: 3977342 - RNA, 19 nt, Human herpesvirus 5
cuuuuacaugaacaaaaaa

SEQ ID NO: 3977343 - RNA, 23 nt, Human herpesvirus 5
cuuuugcgucgcccucgacggcg

SEQ ID NO: 3977344 - RNA, 13 nt, Human herpesvirus 5
gaaaaagaaaccc

SEQ ID NO: 3977345 - RNA, 14 nt, Human herpesvirus 5
gaaaacuuguuuua

SEQ ID NO: 3977346 - RNA, 13 nt, Human herpesvirus 5
gaaaaguggcaga

SEQ ID NO: 3977347 - RNA, 16 nt, Human herpesvirus 5
gaaacacgguuucuuc

SEQ ID NO: 3977348 - RNA, 23 nt, Human herpesvirus 5
gaaaccguacuaagucucccgug

SEQ ID NO: 3977349 - RNA, 22 nt, Human herpesvirus 5
gaaagaggacguucgcucgggc

SEQ ID NO: 3977350 - RNA, 18 nt, Human herpesvirus 5
gaaagcucuacgagcugg

SEQ ID NO: 3977351 - RNA, 23 nt, Human herpesvirus 5
gaaagcuucggccggcugcugca

SEQ ID NO: 3977352 - RNA, 20 nt, Human herpesvirus 5
gaaagugauuauaucuuucu

SEQ ID NO: 3977353 - RNA, 17 nt, Human herpesvirus 5
gaaaguuggcugcgccc

SEQ ID NO: 3977354 - RNA, 15 nt, Human herpesvirus 5
gaaauccggcggcgc

SEQ ID NO: 3977355 - RNA, 19 nt, Human herpesvirus 5
gaacaaauucagcaacacu

SEQ ID NO: 3977356 - RNA, 15 nt, Human herpesvirus 5
gaacccaucgaggag

SEQ ID NO: 3977357 - RNA, 16 nt, Human herpesvirus 5
gaaccccguggaucag

SEQ ID NO: 3977358 - RNA, 22 nt, Human herpesvirus 5
gaacugucgucgccggaaggaa

SEQ ID NO: 3977359 - RNA, 23 nt, Human herpesvirus 5
gaagaccaugacgacggugacga

SEQ ID NO: 3977360 - RNA, 13 nt, Human herpesvirus 5
gaagacggagcuc

SEQ ID NO: 3977361 - RNA, 17 nt, Human herpesvirus 5
gaagccgccagcggaag

SEQ ID NO: 3977362 - RNA, 18 nt, Human herpesvirus 5
gaagcgcugauguaccug

SEQ ID NO: 3977363 - RNA, 14 nt, Human herpesvirus 5
gaagcuguuuuguu

SEQ ID NO: 3977364 - RNA, 14 nt, Human herpesvirus 5
gaaggaacgcacgc

SEQ ID NO: 3977365 - RNA, 14 nt, Human herpesvirus 5
gaaggcaaagaaaa

SEQ ID NO: 3977366 - RNA, 19 nt, Human herpesvirus 5
gaagggcgcgggcggccag

SEQ ID NO: 3977367 - RNA, 21 nt, Human herpesvirus 5
gaagucgaacuauaccgggcg

SEQ ID NO: 3977368 - RNA, 15 nt, Human herpesvirus 5
gaaucaccgucggcg

SEQ ID NO: 3977369 - RNA, 15 nt, Human herpesvirus 5
gaaucgcgagcuggg

SEQ ID NO: 3977370 - RNA, 16 nt, Human herpesvirus 5
gaaucgcgagcugggc

SEQ ID NO: 3977371 - RNA, 17 nt, Human herpesvirus 5
gaaugauuuggcugggu

SEQ ID NO: 3977372 - RNA, 13 nt, Human herpesvirus 5
gacaaccgcaucc

SEQ ID NO: 3977373 - RNA, 18 nt, Human herpesvirus 5
gacaauacgcguaagaua

SEQ ID NO: 3977374 - RNA, 19 nt, Human herpesvirus 5
gacacacguucgacaugga

SEQ ID NO: 3977375 - RNA, 13 nt, Human herpesvirus 5
gacacccgcggcc

SEQ ID NO: 3977376 - RNA, 22 nt, Human herpesvirus 5
gacacggaggaugacgaggagc

SEQ ID NO: 3977377 - RNA, 15 nt, Human herpesvirus 5
gacacggugcugcug

SEQ ID NO: 3977378 - RNA, 18 nt, Human herpesvirus 5
gacacucuggcccugcug

SEQ ID NO: 3977379 - RNA, 15 nt, Human herpesvirus 5
gacagagaccgccgc

SEQ ID NO: 3977380 - RNA, 17 nt, Human herpesvirus 5
gacagagaccgccgccg

SEQ ID NO: 3977381 - RNA, 13 nt, Human herpesvirus 5
gacagaugcggcg

SEQ ID NO: 3977382 - RNA, 19 nt, Human herpesvirus 5
gacagcaaggccgccgccg

SEQ ID NO: 3977383 - RNA, 13 nt, Human herpesvirus 5
gacagcgugccgg

SEQ ID NO: 3977384 - RNA, 17 nt, Human herpesvirus 5
gacaugauggaaaugcc

SEQ ID NO: 3977385 - RNA, 12 nt, Human herpesvirus 5
gacauggagccc

SEQ ID NO: 3977386 - RNA, 14 nt, Human herpesvirus 5
gacauggauaacga

SEQ ID NO: 3977387 - RNA, 21 nt, Human herpesvirus 5
gacaugguuuggccguguccu

SEQ ID NO: 3977388 - RNA, 19 nt, Human herpesvirus 5
gacauuuuuucggccgcgg

SEQ ID NO: 3977389 - RNA, 22 nt, Human herpesvirus 5
gaccaccguuaccaguaccacc

SEQ ID NO: 3977390 - RNA, 23 nt, Human herpesvirus 5
gaccagcaguaugacgugcgaug

SEQ ID NO: 3977391 - RNA, 15 nt, Human herpesvirus 5
gaccaggagguguug

SEQ ID NO: 3977392 - RNA, 17 nt, Human herpesvirus 5
gacccacggucugcgug

SEQ ID NO: 3977393 - RNA, 21 nt, Human herpesvirus 5
gacccgcagucuggcuugggu

SEQ ID NO: 3977394 - RNA, 14 nt, Human herpesvirus 5
gaccgaagacgccg

SEQ ID NO: 3977395 - RNA, 16 nt, Human herpesvirus 5
gaccgauuccagaacu

SEQ ID NO: 3977396 - RNA, 16 nt, Human herpesvirus 5
gaccgcaacaacagca

SEQ ID NO: 3977397 - RNA, 21 nt, Human herpesvirus 5
gaccgcaacaacagcagcaac

SEQ ID NO: 3977398 - RNA, 15 nt, Human herpesvirus 5
gaccgcaacgugcug

SEQ ID NO: 3977399 - RNA, 18 nt, Human herpesvirus 5
gaccgcaacgugcugcug

SEQ ID NO: 3977400 - RNA, 15 nt, Human herpesvirus 5
gaccgcgacgagguc

SEQ ID NO: 3977401 - RNA, 13 nt, Human herpesvirus 5
gaccgcggcgcag

SEQ ID NO: 3977402 - RNA, 16 nt, Human herpesvirus 5
gaccggcggcugcugu

SEQ ID NO: 3977403 - RNA, 20 nt, Human herpesvirus 5
gaccggugguacugcugugg

SEQ ID NO: 3977404 - RNA, 15 nt, Human herpesvirus 5
gaccugcacgacauc

SEQ ID NO: 3977405 - RNA, 18 nt, Human herpesvirus 5
gaccuguuuaccucaugc

SEQ ID NO: 3977406 - RNA, 15 nt, Human herpesvirus 5
gacgacucagggcug

SEQ ID NO: 3977407 - RNA, 17 nt, Human herpesvirus 5
gacgaggccggcggcgg

SEQ ID NO: 3977408 - RNA, 18 nt, Human herpesvirus 5
gacgagggucugcgcgac

SEQ ID NO: 3977409 - RNA, 16 nt, Human herpesvirus 5
gacgaucccucgccgc

SEQ ID NO: 3977410 - RNA, 14 nt, Human herpesvirus 5
gacgaugcuuuccu

SEQ ID NO: 3977411 - RNA, 19 nt, Human herpesvirus 5
gacgauuuuaugcgccgcc

SEQ ID NO: 3977412 - RNA, 22 nt, Human herpesvirus 5
gacgcaugauuagcaauauuau

SEQ ID NO: 3977413 - RNA, 20 nt, Human herpesvirus 5
gacgccaugcucaagacaga

SEQ ID NO: 3977414 - RNA, 17 nt, Human herpesvirus 5
gacgcgccgggcggcuu

SEQ ID NO: 3977415 - RNA, 20 nt, Human herpesvirus 5
gacgcgcguggccgcgcugg

SEQ ID NO: 3977416 - RNA, 16 nt, Human herpesvirus 5
gacgcgcuggacucuu

SEQ ID NO: 3977417 - RNA, 17 nt, Human herpesvirus 5
gacgcggaacgugacgg

SEQ ID NO: 3977418 - RNA, 19 nt, Human herpesvirus 5
gacgcggugcagguucuga

SEQ ID NO: 3977419 - RNA, 18 nt, Human herpesvirus 5
gacgcucggccuugcgcu

SEQ ID NO: 3977420 - RNA, 15 nt, Human herpesvirus 5
gacgcuuaucgggcg

SEQ ID NO: 3977421 - RNA, 12 nt, Human herpesvirus 5
gacggaggagac

SEQ ID NO: 3977422 - RNA, 18 nt, Human herpesvirus 5
gacggccugggcgccccc

SEQ ID NO: 3977423 - RNA, 23 nt, Human herpesvirus 5
gacggcggcgcguugccacagcg

SEQ ID NO: 3977424 - RNA, 15 nt, Human herpesvirus 5
gacggugacgagcgc

SEQ ID NO: 3977425 - RNA, 19 nt, Human herpesvirus 5
gacgugcgaccuggacggc

SEQ ID NO: 3977426 - RNA, 13 nt, Human herpesvirus 5
gacuacaugcuau

SEQ ID NO: 3977427 - RNA, 20 nt, Human herpesvirus 5
gacuaugagggccugcggcg

SEQ ID NO: 3977428 - RNA, 13 nt, Human herpesvirus 5
gacucgaaggcgc

SEQ ID NO: 3977429 - RNA, 13 nt, Human herpesvirus 5
gacucgcucucgu

SEQ ID NO: 3977430 - RNA, 17 nt, Human herpesvirus 5
gacucuaacacccaggc

SEQ ID NO: 3977431 - RNA, 20 nt, Human herpesvirus 5
gacucuaacacccaggccgc

SEQ ID NO: 3977432 - RNA, 22 nt, Human herpesvirus 5
gacucuauaaaaacccacgucc

SEQ ID NO: 3977433 - RNA, 13 nt, Human herpesvirus 5
gacugacacagcu

SEQ ID NO: 3977434 - RNA, 14 nt, Human herpesvirus 5
gacugacacagcuc

SEQ ID NO: 3977435 - RNA, 18 nt, Human herpesvirus 5
gacugcagcccaccgccc

SEQ ID NO: 3977436 - RNA, 18 nt, Human herpesvirus 5
gacugcguggggugcugg

SEQ ID NO: 3977437 - RNA, 14 nt, Human herpesvirus 5
gacugguggugaga

SEQ ID NO: 3977438 - RNA, 18 nt, Human herpesvirus 5
gacuuacaucugcucccc

SEQ ID NO: 3977439 - RNA, 16 nt, Human herpesvirus 5
gacuuagaaucucuug

SEQ ID NO: 3977440 - RNA, 17 nt, Human herpesvirus 5
gacuugcacgcuguccg

SEQ ID NO: 3977441 - RNA, 19 nt, Human herpesvirus 5
gacuugggcgauucugugu

SEQ ID NO: 3977442 - RNA, 15 nt, Human herpesvirus 5
gacuuugauguaguu

SEQ ID NO: 3977443 - RNA, 15 nt, Human herpesvirus 5
gagaaacccccaccc

SEQ ID NO: 3977444 - RNA, 14 nt, Human herpesvirus 5
gagaaagagcagcg

SEQ ID NO: 3977445 - RNA, 17 nt, Human herpesvirus 5
gagacacgcagaccgug

SEQ ID NO: 3977446 - RNA, 19 nt, Human herpesvirus 5
gagacgagagaaccuaccu

SEQ ID NO: 3977447 - RNA, 14 nt, Human herpesvirus 5
gagacgagcucuug

SEQ ID NO: 3977448 - RNA, 17 nt, Human herpesvirus 5
gagagccaccuuggugg

SEQ ID NO: 3977449 - RNA, 14 nt, Human herpesvirus 5
gagagggucuuucu

SEQ ID NO: 3977450 - RNA, 16 nt, Human herpesvirus 5
gagcacaaacugcgac

SEQ ID NO: 3977451 - RNA, 17 nt, Human herpesvirus 5
gagcacaaacugcgaca

SEQ ID NO: 3977452 - RNA, 20 nt, Human herpesvirus 5
gagcacgggcugcuggucuc

SEQ ID NO: 3977453 - RNA, 16 nt, Human herpesvirus 5
gagcaucgcaacaaca

SEQ ID NO: 3977454 - RNA, 16 nt, Human herpesvirus 5
gagccacggcuuggac

SEQ ID NO: 3977455 - RNA, 20 nt, Human herpesvirus 5
gagcgccggggagacgacga

SEQ ID NO: 3977456 - RNA, 15 nt, Human herpesvirus 5
gagcgcgagcgggca

SEQ ID NO: 3977457 - RNA, 18 nt, Human herpesvirus 5
gagcgggcggcgguggug

SEQ ID NO: 3977458 - RNA, 14 nt, Human herpesvirus 5
gagcguccgacgcc

SEQ ID NO: 3977459 - RNA, 15 nt, Human herpesvirus 5
gagcuggccagcaaa

SEQ ID NO: 3977460 - RNA, 15 nt, Human herpesvirus 5
gaggacagcaaggcc

SEQ ID NO: 3977461 - RNA, 13 nt, Human herpesvirus 5
gaggguaacuaug

SEQ ID NO: 3977462 - RNA, 18 nt, Human herpesvirus 5
gaggucguggaggcagcg

SEQ ID NO: 3977463 - RNA, 16 nt, Human herpesvirus 5
gaguaccccacgcaua

SEQ ID NO: 3977464 - RNA, 17 nt, Human herpesvirus 5
gagucacacuuaagaaa

SEQ ID NO: 3977465 - RNA, 13 nt, Human herpesvirus 5
gaguccuggucuu

SEQ ID NO: 3977466 - RNA, 18 nt, Human herpesvirus 5
gagucgcggggacgcgug

SEQ ID NO: 3977467 - RNA, 16 nt, Human herpesvirus 5
gagugguggcggcagc

SEQ ID NO: 3977468 - RNA, 14 nt, Human herpesvirus 5
uguucucccaggac

SEQ ID NO: 3977469 - RNA, 17 nt, Human herpesvirus 5
uguugccgcuggacuga

SEQ ID NO: 3977470 - RNA, 22 nt, Human herpesvirus 5
uguuggaacccaucgaggaggc

SEQ ID NO: 3977471 - RNA, 19 nt, Human herpesvirus 5
uguuguagcaacuggcaaa

SEQ ID NO: 3977472 - RNA, 22 nt, Human herpesvirus 5
uguuugggaacuuugccgucau

SEQ ID NO: 3977473 - RNA, 12 nt, Human herpesvirus 5
uguuuugucuga

SEQ ID NO: 3977474 - RNA, 14 nt, Human herpesvirus 5
uuaacauguuaugu

SEQ ID NO: 3977475 - RNA, 19 nt, Human herpesvirus 5
uuaacccccgacgagcagg

SEQ ID NO: 3977476 - RNA, 15 nt, Human herpesvirus 5
uuaagaggucacagg

SEQ ID NO: 3977477 - RNA, 14 nt, Human herpesvirus 5
uuaagcuggaccug

SEQ ID NO: 3977478 - RNA, 20 nt, Human herpesvirus 5
uuacagcuuuuuaauaaaaa

SEQ ID NO: 3977479 - RNA, 15 nt, Human herpesvirus 5
uuacauaaaaccacc

SEQ ID NO: 3977480 - RNA, 18 nt, Human herpesvirus 5
uuaccaacguaacagcaa

SEQ ID NO: 3977481 - RNA, 16 nt, Human herpesvirus 5
uuacggguaaugcaug

SEQ ID NO: 3977482 - RNA, 22 nt, Human herpesvirus 5
uuacucgagcuuauugagcgca

SEQ ID NO: 3977483 - RNA, 15 nt, Human herpesvirus 5
uuauaaggaggcaaa

SEQ ID NO: 3977484 - RNA, 15 nt, Human herpesvirus 5
uuaugaagcugaaca

SEQ ID NO: 3977485 - RNA, 18 nt, Human herpesvirus 5
uuaugauucugcacagau

SEQ ID NO: 3977486 - RNA, 13 nt, Human herpesvirus 5
uuauuacccgcua

SEQ ID NO: 3977487 - RNA, 17 nt, Human herpesvirus 5
uuauuuacaucuguaca

SEQ ID NO: 3977488 - RNA, 18 nt, Human herpesvirus 5
uucaaccucacguuaaac

SEQ ID NO: 3977489 - RNA, 16 nt, Human herpesvirus 5
uucaauaaaaaccacc

SEQ ID NO: 3977490 - RNA, 18 nt, Human herpesvirus 5
uucaauaaaaaccaccgu

SEQ ID NO: 3977491 - RNA, 21 nt, Human herpesvirus 5
uucagucagagagucugaaac

SEQ ID NO: 3977492 - RNA, 22 nt, Human herpesvirus 5
uuccaugacgcgccucauggcg

SEQ ID NO: 3977493 - RNA, 20 nt, Human herpesvirus 5
uuccccaccuucccucuaga

SEQ ID NO: 3977494 - RNA, 17 nt, Human herpesvirus 5
uuccccgugacgugcaa

SEQ ID NO: 3977495 - RNA, 15 nt, Human herpesvirus 5
uuccuauugggaagg

SEQ ID NO: 3977496 - RNA, 15 nt, Human herpesvirus 5
uucgcgccccucugc

SEQ ID NO: 3977497 - RNA, 16 nt, Human herpesvirus 5
uucgggccgacgucaa

SEQ ID NO: 3977498 - RNA, 15 nt, Human herpesvirus 5
uucucccgacgucac

SEQ ID NO: 3977499 - RNA, 20 nt, Human herpesvirus 5
uucugcuuuuuugucuccug

SEQ ID NO: 3977500 - RNA, 23 nt, Human herpesvirus 5
uugaaacgcgagaugaacuguuc

SEQ ID NO: 3977501 - RNA, 22 nt, Human herpesvirus 5
uugaccacacucgugacgucaa

SEQ ID NO: 3977502 - RNA, 14 nt, Human herpesvirus 5
uugagacacgcgcu

SEQ ID NO: 3977503 - RNA, 17 nt, Human herpesvirus 5
uugagcgccuucugcua

SEQ ID NO: 3977504 - RNA, 16 nt, Human herpesvirus 5
uugaugguguaggaga

SEQ ID NO: 3977505 - RNA, 23 nt, Human herpesvirus 5
uugcaacgcgcccgacagcugca

SEQ ID NO: 3977506 - RNA, 17 nt, Human herpesvirus 5
uugcacauccucacgag

SEQ ID NO: 3977507 - RNA, 21 nt, Human herpesvirus 5
uugcccgcacgccccggggcg

SEQ ID NO: 3977508 - RNA, 17 nt, Human herpesvirus 5
uugcugacgcuggaaac

SEQ ID NO: 3977509 - RNA, 22 nt, Human herpesvirus 5
uugcuuuggcggcagcggaggu

SEQ ID NO: 3977510 - RNA, 23 nt, Human herpesvirus 5
uugggacacugggcguuguugag

SEQ ID NO: 3977511 - RNA, 12 nt, Human herpesvirus 5
uugguggacucg

SEQ ID NO: 3977512 - RNA, 17 nt, Human herpesvirus 5
uugucauuaaacaggcu

SEQ ID NO: 3977513 - RNA, 12 nt, Human herpesvirus 5
uuguccuccucg

SEQ ID NO: 3977514 - RNA, 17 nt, Human herpesvirus 5
uuuacgcgaaacgauga

SEQ ID NO: 3977515 - RNA, 14 nt, Human herpesvirus 5
uuuauuaaagguuu

SEQ ID NO: 3977516 - RNA, 21 nt, Human herpesvirus 5
uuucaugucuuacaaaucaca

SEQ ID NO: 3977517 - RNA, 18 nt, Human herpesvirus 5
uuucggauguuuacccuu

SEQ ID NO: 3977518 - RNA, 16 nt, Human herpesvirus 5
uuucgugcguggaaaa

SEQ ID NO: 3977519 - RNA, 22 nt, Human herpesvirus 5
uuucugucgccgacuaaauuca

SEQ ID NO: 3977520 - RNA, 22 nt, Human herpesvirus 5
uuucuugccaagcuuuagccag

SEQ ID NO: 3977521 - RNA, 13 nt, Human herpesvirus 5
uuucuuuccucgg

SEQ ID NO: 3977522 - RNA, 13 nt, Human herpesvirus 5
uuucuuucucagu

SEQ ID NO: 3977523 - RNA, 13 nt, Human herpesvirus 5
uuuggauguaugu

SEQ ID NO: 3977524 - RNA, 21 nt, Human herpesvirus 5
uuuuaaagucggucaugaagu

SEQ ID NO: 3977525 - RNA, 16 nt, Human herpesvirus 5
uuuuaaucgucgaaaa

SEQ ID NO: 3977526 - RNA, 21 nt, Human herpesvirus 5
uuuuccguguugccgacggcg

SEQ ID NO: 3977527 - RNA, 14 nt, Human herpesvirus 5
uuuugcugcaccag

SEQ ID NO: 3977528 - RNA, 15 nt, Human herpesvirus 5
uuuuuauuacccgcu

SEQ ID NO: 3977529 - RNA, 13 nt, Human herpesvirus 5
aaaaaaaagagag

SEQ ID NO: 3977530 - RNA, 15 nt, Human herpesvirus 5
aaaaacacagagacg

SEQ ID NO: 3977531 - RNA, 15 nt, Human herpesvirus 5
aaaaagugcgucaaa

SEQ ID NO: 3977532 - RNA, 17 nt, Human herpesvirus 5
aaaaaucgauauuugaa

SEQ ID NO: 3977533 - RNA, 14 nt, Human herpesvirus 5
aaaacauaagaaua

SEQ ID NO: 3977534 - RNA, 23 nt, Human herpesvirus 5
aaaacaugcgguguuuccgaugg

SEQ ID NO: 3977535 - RNA, 14 nt, Human herpesvirus 5
aaaagaagcugccc

SEQ ID NO: 3977536 - RNA, 15 nt, Human herpesvirus 5
aaaagggacgucaaa

SEQ ID NO: 3977537 - RNA, 11 nt, Human herpesvirus 5
aaaauauguag

SEQ ID NO: 3977538 - RNA, 17 nt, Human herpesvirus 5
aaaaucggugguggugu

SEQ ID NO: 3977539 - RNA, 12 nt, Human herpesvirus 5
aaacagcacauu

SEQ ID NO: 3977540 - RNA, 14 nt, Human herpesvirus 5
aaaccgagcaagca

SEQ ID NO: 3977541 - RNA, 20 nt, Human herpesvirus 5
aaacgccaccugcaaaguua

SEQ ID NO: 3977542 - RNA, 19 nt, Human herpesvirus 5
aaacucccacuccuguugg

SEQ ID NO: 3977543 - RNA, 23 nt, Human herpesvirus 5
aaacucccacuccuguuggcuua

SEQ ID NO: 3977544 - RNA, 20 nt, Human herpesvirus 5
aaagaaaaaaugguguuaca

SEQ ID NO: 3977545 - RNA, 14 nt, Human herpesvirus 5
aaagaccgcugccu

SEQ ID NO: 3977546 - RNA, 15 nt, Human herpesvirus 5
aaaguagguacuaac

SEQ ID NO: 3977547 - RNA, 17 nt, Human herpesvirus 5
aaaguccgucaugcugg

SEQ ID NO: 3977548 - RNA, 14 nt, Human herpesvirus 5
aaauacagaguccg

SEQ ID NO: 3977549 - RNA, 13 nt, Human herpesvirus 5
aaauauguaguau

SEQ ID NO: 3977550 - RNA, 14 nt, Human herpesvirus 5
aaaucuacacugaa

SEQ ID NO: 3977551 - RNA, 14 nt, Human herpesvirus 5
aaaugagaccccau

SEQ ID NO: 3977552 - RNA, 18 nt, Human herpesvirus 5
aacaaugacuaacccugg

SEQ ID NO: 3977553 - RNA, 18 nt, Human herpesvirus 5
aacagacccgauacaguc

SEQ ID NO: 3977554 - RNA, 18 nt, Human herpesvirus 5
aacagcagcaacagcagc

SEQ ID NO: 3977555 - RNA, 18 nt, Human herpesvirus 5
aacagccuucccuuguaa

SEQ ID NO: 3977556 - RNA, 16 nt, Human herpesvirus 5
aacauuccccugggaa

SEQ ID NO: 3977557 - RNA, 17 nt, Human herpesvirus 5
aaccaccguagcacugc

SEQ ID NO: 3977558 - RNA, 21 nt, Human herpesvirus 5
aaccaccguagcacugcgcaa

SEQ ID NO: 3977559 - RNA, 20 nt, Human herpesvirus 5
aaccacgaguaacaccguca

SEQ ID NO: 3977560 - RNA, 15 nt, Human herpesvirus 5
aaccagauacaacgu

SEQ ID NO: 3977561 - RNA, 16 nt, Human herpesvirus 5
aaccauugagaaagcu

SEQ ID NO: 3977562 - RNA, 12 nt, Human herpesvirus 5
aacccagcagcc

SEQ ID NO: 3977563 - RNA, 16 nt, Human herpesvirus 5
aaccccguguccgccc

SEQ ID NO: 3977564 - RNA, 18 nt, Human herpesvirus 5
aaccgcaugggaaaguac

SEQ ID NO: 3977565 - RNA, 23 nt, Human herpesvirus 5
aaccgcgggccgcccaaacaucu

SEQ ID NO: 3977566 - RNA, 15 nt, Human herpesvirus 5
aacgaggagcggcaa

SEQ ID NO: 3977567 - RNA, 22 nt, Human herpesvirus 5
aacgccuggcgugaucacgccu

SEQ ID NO: 3977568 - RNA, 18 nt, Human herpesvirus 5
aacggauggcguguauau

SEQ ID NO: 3977569 - RNA, 13 nt, Human herpesvirus 5
aacgggugggcug

SEQ ID NO: 3977570 - RNA, 12 nt, Human herpesvirus 5
aacguucuguaa

SEQ ID NO: 3977571 - RNA, 17 nt, Human herpesvirus 5
aacuacuaauacagaua

SEQ ID NO: 3977572 - RNA, 14 nt, Human herpesvirus 5
aacuagccuucccg

SEQ ID NO: 3977573 - RNA, 12 nt, Human herpesvirus 5
aacucuuucccc

SEQ ID NO: 3977574 - RNA, 12 nt, Human herpesvirus 5
aacuuugcugcu

SEQ ID NO: 3977575 - RNA, 15 nt, Human herpesvirus 5
aagaacgugguuguu

SEQ ID NO: 3977576 - RNA, 20 nt, Human herpesvirus 5
aagacaucgucacaccuauc

SEQ ID NO: 3977577 - RNA, 18 nt, Human herpesvirus 5
aagaccaagagcaugcug

SEQ ID NO: 3977578 - RNA, 15 nt, Human herpesvirus 5
aagacgucaaugaca

SEQ ID NO: 3977579 - RNA, 14 nt, Human herpesvirus 5
aagagguuggugug

SEQ ID NO: 3977580 - RNA, 23 nt, Human herpesvirus 5
aagauaaucugccaaucgcaccu

SEQ ID NO: 3977581 - RNA, 21 nt, Human herpesvirus 5
aagauagagaaaccgcaugug

SEQ ID NO: 3977582 - RNA, 12 nt, Human herpesvirus 5
aagaugauacau

SEQ ID NO: 3977583 - RNA, 23 nt, Human herpesvirus 5
aagcaccguggggucaucgaccg

SEQ ID NO: 3977584 - RNA, 18 nt, Human herpesvirus 5
aagcgccgcggcagcacc

SEQ ID NO: 3977585 - RNA, 13 nt, Human herpesvirus 5
aagcuugguacac

SEQ ID NO: 3977586 - RNA, 12 nt, Human herpesvirus 5
aaggcacacggu

SEQ ID NO: 3977587 - RNA, 17 nt, Human herpesvirus 5
aaggccaugagcggcag

SEQ ID NO: 3977588 - RNA, 20 nt, Human herpesvirus 5
aaggccgccucuucuggccc

SEQ ID NO: 3977589 - RNA, 22 nt, Human herpesvirus 5
aaggccguggagaugcaggagg

SEQ ID NO: 3977590 - RNA, 22 nt, Human herpesvirus 5
aaggcggaggagagaacggaag

SEQ ID NO: 3977591 - RNA, 18 nt, Human herpesvirus 5
aagggcaaggaggcggcg

SEQ ID NO: 3977592 - RNA, 17 nt, Human herpesvirus 5
aagguacuuuaccuagc

SEQ ID NO: 3977593 - RNA, 21 nt, Human herpesvirus 5
aagguugggagaugcggggug

SEQ ID NO: 3977594 - RNA, 18 nt, Human herpesvirus 5
aagucuacgaucgcugga

SEQ ID NO: 3977595 - RNA, 20 nt, Human herpesvirus 5
aagugcucgacuuuacggug

SEQ ID NO: 3977596 - RNA, 18 nt, Human herpesvirus 5
aauaaaagcacuucagaa

SEQ ID NO: 3977597 - RNA, 15 nt, Human herpesvirus 5
aauaaagagaguugu

SEQ ID NO: 3977598 - RNA, 16 nt, Human herpesvirus 5
aauaaagucuggguuu

SEQ ID NO: 3977599 - RNA, 16 nt, Human herpesvirus 5
aauacgauaauugcua

SEQ ID NO: 3977600 - RNA, 13 nt, Human herpesvirus 5
aaucaagccuguu

SEQ ID NO: 3977601 - RNA, 17 nt, Human herpesvirus 5
aaucagcagugaguaca

SEQ ID NO: 3977602 - RNA, 22 nt, Human herpesvirus 5
aaucuguguguucugugauaac

SEQ ID NO: 3977603 - RNA, 20 nt, Human herpesvirus 5
aaucuuccauaauaaaagua

SEQ ID NO: 3977604 - RNA, 13 nt, Human herpesvirus 5
aaugcauuaucau

SEQ ID NO: 3977605 - RNA, 19 nt, Human herpesvirus 5
aauugcaacuuaacgcgca

SEQ ID NO: 3977606 - RNA, 13 nt, Human herpesvirus 5
aauugggaaagag

SEQ ID NO: 3977607 - RNA, 16 nt, Human herpesvirus 5
aauuuuuucgcugcca

SEQ ID NO: 3977608 - RNA, 10 nt, Human herpesvirus 5
acaaaacaac

SEQ ID NO: 3977609 - RNA, 13 nt, Human herpesvirus 5
acaaacaaugaca

SEQ ID NO: 3977610 - RNA, 16 nt, Human herpesvirus 5
acaacagcagcaacag

SEQ ID NO: 3977611 - RNA, 16 nt, Human herpesvirus 5
acaagcgggacgaaaa

SEQ ID NO: 3977612 - RNA, 15 nt, Human herpesvirus 5
acaaguaugaaaguu

SEQ ID NO: 3977613 - RNA, 15 nt, Human herpesvirus 5
acaccgucagcugcg

SEQ ID NO: 3977614 - RNA, 23 nt, Human herpesvirus 5
acaccugccucgacaucucgccg

SEQ ID NO: 3977615 - RNA, 13 nt, Human herpesvirus 5
acacgacgaaagc

SEQ ID NO: 3977616 - RNA, 16 nt, Human herpesvirus 5
acacgcagaccguggg

SEQ ID NO: 3977617 - RNA, 18 nt, Human herpesvirus 5
acacgccuugcaccuggg

SEQ ID NO: 3977618 - RNA, 19 nt, Human herpesvirus 5
acacgccuugcaccugggu

SEQ ID NO: 3977619 - RNA, 22 nt, Human herpesvirus 5
acacggugacguagcagcacgc

SEQ ID NO: 3977620 - RNA, 21 nt, Human herpesvirus 5
acacguaauacucgcgucacg

SEQ ID NO: 3977621 - RNA, 19 nt, Human herpesvirus 5
acacuaaauuguuauugcc

SEQ ID NO: 3977622 - RNA, 17 nt, Human herpesvirus 5
acacugcuacccugcgc

SEQ ID NO: 3977623 - RNA, 23 nt, Human herpesvirus 5
acacuuggugcucgaccaggagg

SEQ ID NO: 3977624 - RNA, 14 nt, Human herpesvirus 5
acagaaugaaccuu

SEQ ID NO: 3977625 - RNA, 16 nt, Human herpesvirus 5
acagacaggacaccgc

SEQ ID NO: 3977626 - RNA, 20 nt, Human herpesvirus 5
acagacuuuauaaaccguag

SEQ ID NO: 3977627 - RNA, 19 nt, Human herpesvirus 5
acagcaacaacagucgcag

SEQ ID NO: 3977628 - RNA, 15 nt, Human herpesvirus 5
acagccuugagaacc

SEQ ID NO: 3977629 - RNA, 18 nt, Human herpesvirus 5
acagcggcgacagacggc

SEQ ID NO: 3977630 - RNA, 13 nt, Human herpesvirus 5
acagcggcucgcc

SEQ ID NO: 3977631 - RNA, 14 nt, Human herpesvirus 5
acagcgucuggcca

SEQ ID NO: 3977632 - RNA, 15 nt, Human herpesvirus 5
acagcucaugccucu

SEQ ID NO: 3977633 - RNA, 16 nt, Human herpesvirus 5
acagguagguggccau

SEQ ID NO: 3977634 - RNA, 23 nt, Human herpesvirus 5
acagucgcagcccccguggccgc

SEQ ID NO: 3977635 - RNA, 15 nt, Human herpesvirus 5
acaguuuccacgcag

SEQ ID NO: 3977636 - RNA, 12 nt, Human herpesvirus 5
acauaaaaccac

SEQ ID NO: 3977637 - RNA, 23 nt, Human herpesvirus 5
acaucaacaguuuacgaguacaa

SEQ ID NO: 3977638 - RNA, 14 nt, Human herpesvirus 5
acaucauaaaaacc

SEQ ID NO: 3977639 - RNA, 16 nt, Human herpesvirus 5
acauccgucagccucg

SEQ ID NO: 3977640 - RNA, 16 nt, Human herpesvirus 5
acaucugucaccucac

SEQ ID NO: 3977641 - RNA, 19 nt, Human herpesvirus 5
acaucugucaccucacaag

SEQ ID NO: 3977642 - RNA, 13 nt, Human herpesvirus 5
acaugaggaagcg

SEQ ID NO: 3977643 - RNA, 20 nt, Human herpesvirus 5
acaugcccagcaucuccucg

SEQ ID NO: 3977644 - RNA, 17 nt, Human herpesvirus 5
acauggagcccacgccg

SEQ ID NO: 3977645 - RNA, 15 nt, Human herpesvirus 5
acauguaucucacca

SEQ ID NO: 3977646 - RNA, 22 nt, Human herpesvirus 5
acauuccccaccuucccucuag

SEQ ID NO: 3977647 - RNA, 18 nt, Human herpesvirus 5
acauuuuuugacagauga

SEQ ID NO: 3977648 - RNA, 14 nt, Human herpesvirus 5
accacgcagcaggc

SEQ ID NO: 3977649 - RNA, 16 nt, Human herpesvirus 5
accacgguuaccuucu

SEQ ID NO: 3977650 - RNA, 13 nt, Human herpesvirus 5
accauccucaccc

SEQ ID NO: 3977651 - RNA, 20 nt, Human herpesvirus 5
accaugugcaaaaacuuguc

SEQ ID NO: 3977652 - RNA, 14 nt, Human herpesvirus 5
acccacgaccauuu

SEQ ID NO: 3977653 - RNA, 13 nt, Human herpesvirus 5
acccauuacagua

SEQ ID NO: 3977654 - RNA, 14 nt, Human herpesvirus 5
gaugugcagcaucg

SEQ ID NO: 3977655 - RNA, 20 nt, Human herpesvirus 5
gauucaggacgaggagccaa

SEQ ID NO: 3977656 - RNA, 12 nt, Human herpesvirus 5
gcaaacucccac

SEQ ID NO: 3977657 - RNA, 18 nt, Human herpesvirus 5
gcaaaucacgugugugcg

SEQ ID NO: 3977658 - RNA, 20 nt, Human herpesvirus 5
gcaacaacagucgcagcccc

SEQ ID NO: 3977659 - RNA, 22 nt, Human herpesvirus 5
gcaacaacagucgcagcccccg

SEQ ID NO: 3977660 - RNA, 12 nt, Human herpesvirus 5
gcaacauguguu

SEQ ID NO: 3977661 - RNA, 23 nt, Human herpesvirus 5
gcaacggccguuaucaaggccac

SEQ ID NO: 3977662 - RNA, 21 nt, Human herpesvirus 5
gcaacuaucaccaaacaacac

SEQ ID NO: 3977663 - RNA, 12 nt, Human herpesvirus 5
gcaacugcugcc

SEQ ID NO: 3977664 - RNA, 16 nt, Human herpesvirus 5
gcaagccgagcgggag

SEQ ID NO: 3977665 - RNA, 22 nt, Human herpesvirus 5
gcacaccuauggcgccgugggu

SEQ ID NO: 3977666 - RNA, 21 nt, Human herpesvirus 5
gcacaccugccucgacaucuc

SEQ ID NO: 3977667 - RNA, 20 nt, Human herpesvirus 5
gcacaucggugccggccagg

SEQ ID NO: 3977668 - RNA, 19 nt, Human herpesvirus 5
gcaccccgaacuggagcuc

SEQ ID NO: 3977669 - RNA, 20 nt, Human herpesvirus 5
gcaccggccuccgacgacgc

SEQ ID NO: 3977670 - RNA, 13 nt, Human herpesvirus 5
gcaccugcugccg

SEQ ID NO: 3977671 - RNA, 18 nt, Human herpesvirus 5
gcaccugucgucgacaug

SEQ ID NO: 3977672 - RNA, 12 nt, Human herpesvirus 5
gcacgacaugac

SEQ ID NO: 3977673 - RNA, 16 nt, Human herpesvirus 5
gcacgacgcggcguug

SEQ ID NO: 3977674 - RNA, 13 nt, Human herpesvirus 5
gcacgacuggcca

SEQ ID NO: 3977675 - RNA, 16 nt, Human herpesvirus 5
gcacgagugggccagc

SEQ ID NO: 3977676 - RNA, 17 nt, Human herpesvirus 5
gcacgagugggccagcc

SEQ ID NO: 3977677 - RNA, 18 nt, Human herpesvirus 5
gcacgccaaaccgcgucc

SEQ ID NO: 3977678 - RNA, 20 nt, Human herpesvirus 5
gcacggcaucaugcugggcg

SEQ ID NO: 3977679 - RNA, 15 nt, Human herpesvirus 5
gcacgucagugguga

SEQ ID NO: 3977680 - RNA, 17 nt, Human herpesvirus 5
gcacuucggucucgggc

SEQ ID NO: 3977681 - RNA, 16 nt, Human herpesvirus 5
gcagaacgaucccuuu

SEQ ID NO: 3977682 - RNA, 16 nt, Human herpesvirus 5
gcagaaguuguugcaa

SEQ ID NO: 3977683 - RNA, 14 nt, Human herpesvirus 5
gcagagggcgcgcc

SEQ ID NO: 3977684 - RNA, 16 nt, Human herpesvirus 5
gcagcaacagcagcca

SEQ ID NO: 3977685 - RNA, 16 nt, Human herpesvirus 5
gcagcaccucuuucca

SEQ ID NO: 3977686 - RNA, 21 nt, Human herpesvirus 5
gcagcacgcgauuggccagca

SEQ ID NO: 3977687 - RNA, 14 nt, Human herpesvirus 5
gcagcagcuggugc

SEQ ID NO: 3977688 - RNA, 15 nt, Human herpesvirus 5
gcagcagcuggugca

SEQ ID NO: 3977689 - RNA, 19 nt, Human herpesvirus 5
gcagcaucgcguugcucag

SEQ ID NO: 3977690 - RNA, 13 nt, Human herpesvirus 5
gcagcccccgugg

SEQ ID NO: 3977691 - RNA, 15 nt, Human herpesvirus 5
gcagcgcgugcgcau

SEQ ID NO: 3977692 - RNA, 15 nt, Human herpesvirus 5
gcagcggcugcgcgc

SEQ ID NO: 3977693 - RNA, 13 nt, Human herpesvirus 5
gcagcgggccugu

SEQ ID NO: 3977694 - RNA, 21 nt, Human herpesvirus 5
gcagcucuuuuccagcgugcg

SEQ ID NO: 3977695 - RNA, 24 nt, Human herpesvirus 5
gcaggacgggauaucccagaggaa

SEQ ID NO: 3977696 - RNA, 19 nt, Human herpesvirus 5
gcaggucacacugggagac

SEQ ID NO: 3977697 - RNA, 15 nt, Human herpesvirus 5
gcaggugugcgcguc

SEQ ID NO: 3977698 - RNA, 14 nt, Human herpesvirus 5
gcaguccgcuccgg

SEQ ID NO: 3977699 - RNA, 13 nt, Human herpesvirus 5
gcaguugcugccu

SEQ ID NO: 3977700 - RNA, 13 nt, Human herpesvirus 5
gcaucaugugccu

SEQ ID NO: 3977701 - RNA, 14 nt, Human herpesvirus 5
gcaucaugugccuc

SEQ ID NO: 3977702 - RNA, 23 nt, Human herpesvirus 5
gcaugacggugacuauguguacu

SEQ ID NO: 3977703 - RNA, 13 nt, Human herpesvirus 5
gcaugauuagcaa

SEQ ID NO: 3977704 - RNA, 19 nt, Human herpesvirus 5
gccaacuccgugccagcug

SEQ ID NO: 3977705 - RNA, 21 nt, Human herpesvirus 5
gccaacuccgugccagcuggc

SEQ ID NO: 3977706 - RNA, 18 nt, Human herpesvirus 5
gccaagaugcugcgggcc

SEQ ID NO: 3977707 - RNA, 23 nt, Human herpesvirus 5
gccaccacccgacugcagcccac

SEQ ID NO: 3977708 - RNA, 15 nt, Human herpesvirus 5
gccacccgccggagc

SEQ ID NO: 3977709 - RNA, 17 nt, Human herpesvirus 5
gccaccgucgcccucag

SEQ ID NO: 3977710 - RNA, 16 nt, Human herpesvirus 5
gccacgcguacuggcu

SEQ ID NO: 3977711 - RNA, 18 nt, Human herpesvirus 5
gccacuuuucuccccgcu

SEQ ID NO: 3977712 - RNA, 13 nt, Human herpesvirus 5
gccagcggccugg

SEQ ID NO: 3977713 - RNA, 14 nt, Human herpesvirus 5
gccagcguccgcgc

SEQ ID NO: 3977714 - RNA, 13 nt, Human herpesvirus 5
gccagcugccacc

SEQ ID NO: 3977715 - RNA, 16 nt, Human herpesvirus 5
gccagcugcgucguca

SEQ ID NO: 3977716 - RNA, 22 nt, Human herpesvirus 5
gccaguacagcgccgacgugcu

SEQ ID NO: 3977717 - RNA, 14 nt, Human herpesvirus 5
gcccaccgccuccg

SEQ ID NO: 3977718 - RNA, 17 nt, Human herpesvirus 5
gcccagcaucuccucgc

SEQ ID NO: 3977719 - RNA, 20 nt, Human herpesvirus 5
gcccauugagcgagaacuaa

SEQ ID NO: 3977720 - RNA, 22 nt, Human herpesvirus 5
gccccccaccuacgagcaggcc

SEQ ID NO: 3977721 - RNA, 20 nt, Human herpesvirus 5
gccccgaagguuagcgccgc

SEQ ID NO: 3977722 - RNA, 18 nt, Human herpesvirus 5
gccccucacgucaguguu

SEQ ID NO: 3977723 - RNA, 21 nt, Human herpesvirus 5
gcccgacugcggacgccgacg

SEQ ID NO: 3977724 - RNA, 16 nt, Human herpesvirus 5
gcccgaggcggaggag

SEQ ID NO: 3977725 - RNA, 15 nt, Human herpesvirus 5
gcccgccacugcccg

SEQ ID NO: 3977726 - RNA, 23 nt, Human herpesvirus 5
gcccgccggcgggcggcugccgg

SEQ ID NO: 3977727 - RNA, 16 nt, Human herpesvirus 5
gcccgucgcgcacggc

SEQ ID NO: 3977728 - RNA, 18 nt, Human herpesvirus 5
gcccgucggcugccuguu

SEQ ID NO: 3977729 - RNA, 20 nt, Human herpesvirus 5
gcccucgacggcgguacuga

SEQ ID NO: 3977730 - RNA, 11 nt, Human herpesvirus 5
gcccucgccgg

SEQ ID NO: 3977731 - RNA, 17 nt, Human herpesvirus 5
gcccugucugcagccgg

SEQ ID NO: 3977732 - RNA, 14 nt, Human herpesvirus 5
gccgagacgcugcg

SEQ ID NO: 3977733 - RNA, 14 nt, Human herpesvirus 5
gccgagacggcgug

SEQ ID NO: 3977734 - RNA, 12 nt, Human herpesvirus 5
gccgagcccaac

SEQ ID NO: 3977735 - RNA, 14 nt, Human herpesvirus 5
gccgaggcuacugc

SEQ ID NO: 3977736 - RNA, 12 nt, Human herpesvirus 5
gccgagucuccg

SEQ ID NO: 3977737 - RNA, 19 nt, Human herpesvirus 5
gccgagucuccgcgcaaca

SEQ ID NO: 3977738 - RNA, 17 nt, Human herpesvirus 5
gccgauccacgggccgc

SEQ ID NO: 3977739 - RNA, 15 nt, Human herpesvirus 5
gccgauggcugcccg

SEQ ID NO: 3977740 - RNA, 19 nt, Human herpesvirus 5
gccgaugugaguuucugug

SEQ ID NO: 3977741 - RNA, 23 nt, Human herpesvirus 5
gccgauucguaaucgacaggagg

SEQ ID NO: 3977742 - RNA, 14 nt, Human herpesvirus 5
gccgcaacagcggc

SEQ ID NO: 3977743 - RNA, 15 nt, Human herpesvirus 5
gccgcaacagcggcg

SEQ ID NO: 3977744 - RNA, 13 nt, Human herpesvirus 5
gccgcaagcggcg

SEQ ID NO: 3977745 - RNA, 15 nt, Human herpesvirus 5
gccgcagaaggccau

SEQ ID NO: 3977746 - RNA, 14 nt, Human herpesvirus 5
gccgccaacgccga

SEQ ID NO: 3977747 - RNA, 16 nt, Human herpesvirus 5
gccgccaacgccgagc

SEQ ID NO: 3977748 - RNA, 15 nt, Human herpesvirus 5
gccgccaacgcgagc

SEQ ID NO: 3977749 - RNA, 19 nt, Human herpesvirus 5
gccgccaucaucauguggg

SEQ ID NO: 3977750 - RNA, 15 nt, Human herpesvirus 5
gccgcccgacgccga

SEQ ID NO: 3977751 - RNA, 21 nt, Human herpesvirus 5
gccgccgaagccuggggcacc

SEQ ID NO: 3977752 - RNA, 15 nt, Human herpesvirus 5
gccgccgcgccacac

SEQ ID NO: 3977753 - RNA, 15 nt, Human herpesvirus 5
gccgccgcucagguc

SEQ ID NO: 3977754 - RNA, 13 nt, Human herpesvirus 5
gccgccuccgcgg

SEQ ID NO: 3977755 - RNA, 13 nt, Human herpesvirus 5
gccgccuggaguc

SEQ ID NO: 3977756 - RNA, 20 nt, Human herpesvirus 5
gccgcgaggugucauguucg

SEQ ID NO: 3977757 - RNA, 13 nt, Human herpesvirus 5
gccgcggcagcac

SEQ ID NO: 3977758 - RNA, 16 nt, Human herpesvirus 5
gccgcggccgcugccg

SEQ ID NO: 3977759 - RNA, 14 nt, Human herpesvirus 5
gccgcgggguacgg

SEQ ID NO: 3977760 - RNA, 16 nt, Human herpesvirus 5
gccgcggugcaggccg

SEQ ID NO: 3977761 - RNA, 18 nt, Human herpesvirus 5
gccgcggugcgcugcagc

SEQ ID NO: 3977762 - RNA, 16 nt, Human herpesvirus 5
gccgcgugccugggaa

SEQ ID NO: 3977763 - RNA, 18 nt, Human herpesvirus 5
gccgcucauaaugccguc

SEQ ID NO: 3977764 - RNA, 18 nt, Human herpesvirus 5
gccgcuggacugacacag

SEQ ID NO: 3977765 - RNA, 22 nt, Human herpesvirus 5
gccgcuuuucagaccgcaacaa

SEQ ID NO: 3977766 - RNA, 22 nt, Human herpesvirus 5
gccggagcccggucugagcucc

SEQ ID NO: 3977767 - RNA, 15 nt, Human herpesvirus 5
gccggaggagcaggc

SEQ ID NO: 3977768 - RNA, 18 nt, Human herpesvirus 5
gccggcgagcgacgcggc

SEQ ID NO: 3977769 - RNA, 16 nt, Human herpesvirus 5
gccggcgccugguugc

SEQ ID NO: 3977770 - RNA, 14 nt, Human herpesvirus 5
gccggcggcggcgu

SEQ ID NO: 3977771 - RNA, 16 nt, Human herpesvirus 5
gccggcggcggcguca

SEQ ID NO: 3977772 - RNA, 21 nt, Human herpesvirus 5
gccggcguggcggccgacggc

SEQ ID NO: 3977773 - RNA, 17 nt, Human herpesvirus 5
gccggcuugaccgcguu

SEQ ID NO: 3977774 - RNA, 20 nt, Human herpesvirus 5
gccgggaaagacgggcgaca

SEQ ID NO: 3977775 - RNA, 12 nt, Human herpesvirus 5
gccggggcccgu

SEQ ID NO: 3977776 - RNA, 14 nt, Human herpesvirus 5
gccgucaaggccgc

SEQ ID NO: 3977777 - RNA, 15 nt, Human herpesvirus 5
gccgucacugccacc

SEQ ID NO: 3977778 - RNA, 21 nt, Human herpesvirus 5
gccgucagagcaucaacgacg

SEQ ID NO: 3977779 - RNA, 22 nt, Human herpesvirus 5
gccgucucgucacacggcaaca

SEQ ID NO: 3977780 - RNA, 15 nt, Human herpesvirus 5
gccgugcugggcugg

SEQ ID NO: 3977781 - RNA, 13 nt, Human herpesvirus 5
gccgugguggccg

SEQ ID NO: 3977782 - RNA, 15 nt, Human herpesvirus 5
gccgugguggccgug

SEQ ID NO: 3977783 - RNA, 20 nt, Human herpesvirus 5
gccguguguuaccgccgccg

SEQ ID NO: 3977784 - RNA, 18 nt, Human herpesvirus 5
gccguucgacgaucuuua

SEQ ID NO: 3977785 - RNA, 23 nt, Human herpesvirus 5
gccucaaaaagcagguggaggac

SEQ ID NO: 3977786 - RNA, 21 nt, Human herpesvirus 5
gccucgauccauccuggggaa

SEQ ID NO: 3977787 - RNA, 13 nt, Human herpesvirus 5
gccucugggcuga

SEQ ID NO: 3977788 - RNA, 16 nt, Human herpesvirus 5
gccugcacgaccugcu

SEQ ID NO: 3977789 - RNA, 22 nt, Human herpesvirus 5
gccugcacgccgccgugacugc

SEQ ID NO: 3977790 - RNA, 20 nt, Human herpesvirus 5
gccugccgaagaccucacca

SEQ ID NO: 3977791 - RNA, 14 nt, Human herpesvirus 5
gccuggacccacaa

SEQ ID NO: 3977792 - RNA, 14 nt, Human herpesvirus 5
gccuggacgccugg

SEQ ID NO: 3977793 - RNA, 22 nt, Human herpesvirus 5
gccuggauuaucacaucggugu

SEQ ID NO: 3977794 - RNA, 14 nt, Human herpesvirus 5
gccuggcggcgggu

SEQ ID NO: 3977795 - RNA, 14 nt, Human herpesvirus 5
gccuguggauagau

SEQ ID NO: 3977796 - RNA, 20 nt, Human herpesvirus 5
gccuguggauagauuucugc

SEQ ID NO: 3977797 - RNA, 20 nt, Human herpesvirus 5
gccuuccccgaugugcaggg

SEQ ID NO: 3977798 - RNA, 19 nt, Human herpesvirus 5
gccuuccuccucugccugg

SEQ ID NO: 3977799 - RNA, 14 nt, Human herpesvirus 5
gccuucggccagcg

SEQ ID NO: 3977800 - RNA, 17 nt, Human herpesvirus 5
gccuugagaaccugcuc

SEQ ID NO: 3977801 - RNA, 13 nt, Human herpesvirus 5
gccuugcaccugg

SEQ ID NO: 3977802 - RNA, 20 nt, Human herpesvirus 5
gccuugcgcucccugcuccg

SEQ ID NO: 3977803 - RNA, 16 nt, Human herpesvirus 5
gccuuggcgcucugga

SEQ ID NO: 3977804 - RNA, 21 nt, Human herpesvirus 5
gccuuucugaccuugcugaug

SEQ ID NO: 3977805 - RNA, 15 nt, Human herpesvirus 5
gcgaacggcgacggc

SEQ ID NO: 3977806 - RNA, 16 nt, Human herpesvirus 5
gcgaauaagcgcgacc

SEQ ID NO: 3977807 - RNA, 20 nt, Human herpesvirus 5
gcgacaccguaucagcuacc

SEQ ID NO: 3977808 - RNA, 15 nt, Human herpesvirus 5
gcgaccgucuggagg

SEQ ID NO: 3977809 - RNA, 17 nt, Human herpesvirus 5
gcgaccuggacggcuac

SEQ ID NO: 3977810 - RNA, 15 nt, Human herpesvirus 5
gcgacgagggucugc

SEQ ID NO: 3977811 - RNA, 13 nt, Human herpesvirus 5
gcgacggagagga

SEQ ID NO: 3977812 - RNA, 17 nt, Human herpesvirus 5
gcgacguaccagcuguc

SEQ ID NO: 3977813 - RNA, 14 nt, Human herpesvirus 5
gcgacguggaggag

SEQ ID NO: 3977814 - RNA, 18 nt, Human herpesvirus 5
gcgacuuuuuucugugag

SEQ ID NO: 3977815 - RNA, 20 nt, Human herpesvirus 5
gcgagaccgauuccagaacu

SEQ ID NO: 3977816 - RNA, 14 nt, Human herpesvirus 5
gcgagcgcucggcg

SEQ ID NO: 3977817 - RNA, 18 nt, Human herpesvirus 5
gcgagcggaacccgggcu

SEQ ID NO: 3977818 - RNA, 22 nt, Human herpesvirus 5
gcgagcgggguucaccugcagc

SEQ ID NO: 3977819 - RNA, 13 nt, Human herpesvirus 5
gcgagcugggcga

SEQ ID NO: 3977820 - RNA, 23 nt, Human herpesvirus 5
gcgaggacaaggcuccgaaaccg

SEQ ID NO: 3977821 - RNA, 16 nt, Human herpesvirus 5
gcgcacggcgcggucc

SEQ ID NO: 3977822 - RNA, 20 nt, Human herpesvirus 5
gcgcagacgucggcgguccu

SEQ ID NO: 3977823 - RNA, 19 nt, Human herpesvirus 5
gcgcagcgccagccuuagc

SEQ ID NO: 3977824 - RNA, 13 nt, Human herpesvirus 5
gcgcaggccgccg

SEQ ID NO: 3977825 - RNA, 21 nt, Human herpesvirus 5
gcgcagugcgccgagcggccg

SEQ ID NO: 3977826 - RNA, 18 nt, Human herpesvirus 5
gcgcccgcgccucacgcu

SEQ ID NO: 3977827 - RNA, 21 nt, Human herpesvirus 5
gcgcccgcgccucacgcugca

SEQ ID NO: 3977828 - RNA, 19 nt, Human herpesvirus 5
gcgccggccgucuccacca

SEQ ID NO: 3977829 - RNA, 15 nt, Human herpesvirus 5
gcgccgugcucagcg

SEQ ID NO: 3977830 - RNA, 22 nt, Human herpesvirus 5
gcgccgugcucuuggcgccgcg

SEQ ID NO: 3977831 - RNA, 14 nt, Human herpesvirus 5
gcgcgacacggugg

SEQ ID NO: 3977832 - RNA, 18 nt, Human herpesvirus 5
gcgcgcacccgacggcgg

SEQ ID NO: 3977833 - RNA, 12 nt, Human herpesvirus 5
gcgcgcagacgc

SEQ ID NO: 3977834 - RNA, 12 nt, Human herpesvirus 5
gcgcgccccggc

SEQ ID NO: 3977835 - RNA, 19 nt, Human herpesvirus 5
gcgcgcgguuucgccgccg

SEQ ID NO: 3977836 - RNA, 17 nt, Human herpesvirus 5
gcgcgcgucuggacgcg

SEQ ID NO: 3977837 - RNA, 14 nt, Human herpesvirus 5
gcgcggcggcagcu

SEQ ID NO: 3977838 - RNA, 21 nt, Human herpesvirus 5
gcgcguuuguugcgcggcgac

SEQ ID NO: 3977839 - RNA, 24 nt, Human herpesvirus 5
gcgcuacgaaacuuuucugcgggu

SEQ ID NO: 3977840 - RNA, 13 nt, Human herpesvirus 5
gcgcucccugcuc

SEQ ID NO: 3977841 - RNA, 17 nt, Human herpesvirus 5
gcgcucgcccccgguuu

SEQ ID NO: 3977842 - RNA, 14 nt, Human herpesvirus 5
gcgcucggucagcu

SEQ ID NO: 3977843 - RNA, 18 nt, Human herpesvirus 5
gcgcuuuugaccgcgagc

SEQ ID NO: 3977844 - RNA, 15 nt, Human herpesvirus 5
gcggacgccugcgac

SEQ ID NO: 3977845 - RNA, 13 nt, Human herpesvirus 5
gcggaggagguga

SEQ ID NO: 3977846 - RNA, 23 nt, Human herpesvirus 5
gcggaggauccaaggccuccagc

SEQ ID NO: 3977847 - RNA, 15 nt, Human herpesvirus 5
gcggauaggcaccug

SEQ ID NO: 3977848 - RNA, 15 nt, Human herpesvirus 5
gcggcaccagagaca

SEQ ID NO: 3977849 - RNA, 21 nt, Human herpesvirus 5
gcggcaccagagacagagacc

SEQ ID NO: 3977850 - RNA, 21 nt, Human herpesvirus 5
gcggcaccaggaacacggugg

SEQ ID NO: 3977851 - RNA, 16 nt, Human herpesvirus 5
gcggcagccacggagg

SEQ ID NO: 3977852 - RNA, 15 nt, Human herpesvirus 5
gcggccgcagaaggc

SEQ ID NO: 3977853 - RNA, 18 nt, Human herpesvirus 5
gcggccgugguggccgug

SEQ ID NO: 3977854 - RNA, 15 nt, Human herpesvirus 5
gcggcggacaggccu

SEQ ID NO: 3977855 - RNA, 12 nt, Human herpesvirus 5
gcggcgguggag

SEQ ID NO: 3977856 - RNA, 19 nt, Human herpesvirus 5
gcggcgugauugcaaagcc

SEQ ID NO: 3977857 - RNA, 15 nt, Human herpesvirus 5
gcggcugcgcgcucg

SEQ ID NO: 3977858 - RNA, 23 nt, Human herpesvirus 5
gcggcuguauuauuagacgccgg

SEQ ID NO: 3977859 - RNA, 15 nt, Human herpesvirus 5
gcgggagacuagguc

SEQ ID NO: 3977860 - RNA, 16 nt, Human herpesvirus 5
gcgggugccgggacag

SEQ ID NO: 3977861 - RNA, 14 nt, Human herpesvirus 5
gcggguggagauga

SEQ ID NO: 3977862 - RNA, 23 nt, Human herpesvirus 5
gcggucagaaaaagaaaacgccg

SEQ ID NO: 3977863 - RNA, 22 nt, Human herpesvirus 5
gcggucaugaguuggugcagcu

SEQ ID NO: 3977864 - RNA, 16 nt, Human herpesvirus 5
gcggugcaggccgcgc

SEQ ID NO: 3977865 - RNA, 20 nt, Human herpesvirus 5
gcggugcgcugcagccggag

SEQ ID NO: 3977866 - RNA, 20 nt, Human herpesvirus 5
gcggugggugguaaaaaccg

SEQ ID NO: 3977867 - RNA, 15 nt, Human herpesvirus 5
gcgguuauggcuccg

SEQ ID NO: 3977868 - RNA, 16 nt, Human herpesvirus 5
gcguagcgcuccugga

SEQ ID NO: 3977869 - RNA, 15 nt, Human herpesvirus 5
gcguaggacgacgug

SEQ ID NO: 3977870 - RNA, 20 nt, Human herpesvirus 5
gcguaugguuaugaccaagc

SEQ ID NO: 3977871 - RNA, 23 nt, Human herpesvirus 5
gcguauguuaucaucauggagcu

SEQ ID NO: 3977872 - RNA, 14 nt, Human herpesvirus 5
gcgucacagagggc

SEQ ID NO: 3977873 - RNA, 17 nt, Human herpesvirus 5
gcgucagaagacgagcu

SEQ ID NO: 3977874 - RNA, 16 nt, Human herpesvirus 5
gcgucagcggccgccg

SEQ ID NO: 3977875 - RNA, 17 nt, Human herpesvirus 5
gcgucccuggggcugcu

SEQ ID NO: 3977876 - RNA, 14 nt, Human herpesvirus 5
gcguccgacgccgg

SEQ ID NO: 3977877 - RNA, 20 nt, Human herpesvirus 5
gcgucgucaaggacggcgug

SEQ ID NO: 3977878 - RNA, 15 nt, Human herpesvirus 5
gcgugucccugccag

SEQ ID NO: 3977879 - RNA, 12 nt, Human herpesvirus 5
gcuacagggagu

SEQ ID NO: 3977880 - RNA, 13 nt, Human herpesvirus 5
gcuacaugugucc

SEQ ID NO: 3977881 - RNA, 17 nt, Human herpesvirus 5
gcuaccagcugcaggca

SEQ ID NO: 3977882 - RNA, 17 nt, Human herpesvirus 5
gcuacgcggcgcccgcg

SEQ ID NO: 3977883 - RNA, 23 nt, Human herpesvirus 5
gcuacgguggcgcgacggugaug

SEQ ID NO: 3977884 - RNA, 19 nt, Human herpesvirus 5
gcuacguaggccuccucuc

SEQ ID NO: 3977885 - RNA, 16 nt, Human herpesvirus 5
uucuuccucucaguca

SEQ ID NO: 3977886 - RNA, 13 nt, Human herpesvirus 5
uugacgcugcugg

SEQ ID NO: 3977887 - RNA, 21 nt, Human herpesvirus 5
uugagaguggugggaaugcac

SEQ ID NO: 3977888 - RNA, 16 nt, Human herpesvirus 5
uugagcacaaacugcg

SEQ ID NO: 3977889 - RNA, 23 nt, Human herpesvirus 5
uugaggcgcucgugaaacagcag

SEQ ID NO: 3977890 - RNA, 20 nt, Human herpesvirus 5
uugauuucaacaaauaccaa

SEQ ID NO: 3977891 - RNA, 12 nt, Human herpesvirus 5
uugcccgcaaaa

SEQ ID NO: 3977892 - RNA, 13 nt, Human herpesvirus 5
uugcggccgccgc

SEQ ID NO: 3977893 - RNA, 16 nt, Human herpesvirus 5
uugcgggcccugcuga

SEQ ID NO: 3977894 - RNA, 13 nt, Human herpesvirus 5
uugcugcaacggc

SEQ ID NO: 3977895 - RNA, 22 nt, Human herpesvirus 5
uugcuggcuuggcucgccuucc

SEQ ID NO: 3977896 - RNA, 22 nt, Human herpesvirus 5
uuggacgaugcuuuccuggaca

SEQ ID NO: 3977897 - RNA, 18 nt, Human herpesvirus 5
uuggccgaccugugcgug

SEQ ID NO: 3977898 - RNA, 18 nt, Human herpesvirus 5
uuggcggucgggucuguc

SEQ ID NO: 3977899 - RNA, 20 nt, Human herpesvirus 5
uuggugcucgaccaggaggu

SEQ ID NO: 3977900 - RNA, 14 nt, Human herpesvirus 5
uuguaucauuacag

SEQ ID NO: 3977901 - RNA, 12 nt, Human herpesvirus 5
uugucccggggg

SEQ ID NO: 3977902 - RNA, 18 nt, Human herpesvirus 5
uuguuagacuagcacaga

SEQ ID NO: 3977903 - RNA, 15 nt, Human herpesvirus 5
uuguugagcauaugu

SEQ ID NO: 3977904 - RNA, 12 nt, Human herpesvirus 5
uuucgccgccgg

SEQ ID NO: 3977905 - RNA, 16 nt, Human herpesvirus 5
uuucgcugccaacgcc

SEQ ID NO: 3977906 - RNA, 19 nt, Human herpesvirus 5
uuucuaucauaaacuguuc

SEQ ID NO: 3977907 - RNA, 17 nt, Human herpesvirus 5
uuucugcgucggagcuc

SEQ ID NO: 3977908 - RNA, 17 nt, Human herpesvirus 5
uuugauaaccuaccugg

SEQ ID NO: 3977909 - RNA, 17 nt, Human herpesvirus 5
uuuggaggauguucugc

SEQ ID NO: 3977910 - RNA, 19 nt, Human herpesvirus 5
uuuggcucuuuccugugca

SEQ ID NO: 3977911 - RNA, 14 nt, Human herpesvirus 5
uuuguaacacuaca

SEQ ID NO: 3977912 - RNA, 20 nt, Human herpesvirus 5
uuuuaucgucucaauaaaag

SEQ ID NO: 3977913 - RNA, 13 nt, Human herpesvirus 5
uuuuaucuuuaaa

SEQ ID NO: 3977914 - RNA, 18 nt, Human herpesvirus 5
cgggugccgggacagcgu

SEQ ID NO: 3977915 - RNA, 14 nt, Human herpesvirus 5
cgguaccagacgcg

SEQ ID NO: 3977916 - RNA, 17 nt, Human herpesvirus 5
cgguaccgucuccacca

SEQ ID NO: 3977917 - RNA, 18 nt, Human herpesvirus 5
cgguacugaagccgccgu

SEQ ID NO: 3977918 - RNA, 20 nt, Human herpesvirus 5
cgguauggcugcgcgccucc

SEQ ID NO: 3977919 - RNA, 12 nt, Human herpesvirus 5
cggucuguucag

SEQ ID NO: 3977920 - RNA, 16 nt, Human herpesvirus 5
cggugagacccgcguc

SEQ ID NO: 3977921 - RNA, 18 nt, Human herpesvirus 5
cggugaggaggacggcga

SEQ ID NO: 3977922 - RNA, 18 nt, Human herpesvirus 5
cgguggucggcugccgcc

SEQ ID NO: 3977923 - RNA, 16 nt, Human herpesvirus 5
cgguggugacugggga

SEQ ID NO: 3977924 - RNA, 19 nt, Human herpesvirus 5
cgguuuccacgccaccgcc

SEQ ID NO: 3977925 - RNA, 16 nt, Human herpesvirus 5
cguaacgguggaauaa

SEQ ID NO: 3977926 - RNA, 19 nt, Human herpesvirus 5
cguaagcggcagcaugggc

SEQ ID NO: 3977927 - RNA, 13 nt, Human herpesvirus 5
cguaauguagaca

SEQ ID NO: 3977928 - RNA, 17 nt, Human herpesvirus 5
cguacaccgcuggagcu

SEQ ID NO: 3977929 - RNA, 12 nt, Human herpesvirus 5
cguaccagcugu

SEQ ID NO: 3977930 - RNA, 16 nt, Human herpesvirus 5
cguacgccguguacca

SEQ ID NO: 3977931 - RNA, 15 nt, Human herpesvirus 5
cguacggcaacgagc

SEQ ID NO: 3977932 - RNA, 16 nt, Human herpesvirus 5
cguacugcgacggcag

SEQ ID NO: 3977933 - RNA, 21 nt, Human herpesvirus 5
cguagccuccuccaccacggc

SEQ ID NO: 3977934 - RNA, 18 nt, Human herpesvirus 5
cguaguuguugcagaagu

SEQ ID NO: 3977935 - RNA, 20 nt, Human herpesvirus 5
cguauacaacaguucuauca

SEQ ID NO: 3977936 - RNA, 13 nt, Human herpesvirus 5
cguauauucuaca

SEQ ID NO: 3977937 - RNA, 14 nt, Human herpesvirus 5
cguauccuggucaa

SEQ ID NO: 3977938 - RNA, 20 nt, Human herpesvirus 5
cgucacucuuggcacgggga

SEQ ID NO: 3977939 - RNA, 16 nt, Human herpesvirus 5
cguccacacaccgcuu

SEQ ID NO: 3977940 - RNA, 16 nt, Human herpesvirus 5
cguccacgggcugcgc

SEQ ID NO: 3977941 - RNA, 17 nt, Human herpesvirus 5
cguccagcuucugguag

SEQ ID NO: 3977942 - RNA, 13 nt, Human herpesvirus 5
cgucccuggggcu

SEQ ID NO: 3977943 - RNA, 14 nt, Human herpesvirus 5
cguccgcuggaaau

SEQ ID NO: 3977944 - RNA, 15 nt, Human herpesvirus 5
cguccgggcuuuccu

SEQ ID NO: 3977945 - RNA, 14 nt, Human herpesvirus 5
cguccucguggcgg

SEQ ID NO: 3977946 - RNA, 14 nt, Human herpesvirus 5
cgucgacaugucgc

SEQ ID NO: 3977947 - RNA, 13 nt, Human herpesvirus 5
cgucgaccuugag

SEQ ID NO: 3977948 - RNA, 17 nt, Human herpesvirus 5
cgucgacgcaucuguca

SEQ ID NO: 3977949 - RNA, 15 nt, Human herpesvirus 5
cgucgagcacccguc

SEQ ID NO: 3977950 - RNA, 18 nt, Human herpesvirus 5
cgucgccugcgacggcgg

SEQ ID NO: 3977951 - RNA, 19 nt, Human herpesvirus 5
cgucgggggggacuuggcu

SEQ ID NO: 3977952 - RNA, 13 nt, Human herpesvirus 5
cgucggucccauc

SEQ ID NO: 3977953 - RNA, 23 nt, Human herpesvirus 5
cgucgugagcagcgugcaccugc

SEQ ID NO: 3977954 - RNA, 18 nt, Human herpesvirus 5
cgucuaccggcgagggug

SEQ ID NO: 3977955 - RNA, 22 nt, Human herpesvirus 5
cgucuccaugauugugccgcgu

SEQ ID NO: 3977956 - RNA, 21 nt, Human herpesvirus 5
cgucugcacgccccggagugc

SEQ ID NO: 3977957 - RNA, 14 nt, Human herpesvirus 5
cgugcaucugccga

SEQ ID NO: 3977958 - RNA, 13 nt, Human herpesvirus 5
cgugccgagcugc

SEQ ID NO: 3977959 - RNA, 20 nt, Human herpesvirus 5
cgugcgacgcgacuaugagg

SEQ ID NO: 3977960 - RNA, 14 nt, Human herpesvirus 5
cgugcgaggacaac

SEQ ID NO: 3977961 - RNA, 21 nt, Human herpesvirus 5
cgugcgccuuccaguccauac

SEQ ID NO: 3977962 - RNA, 17 nt, Human herpesvirus 5
cgugcucaagaggugag

SEQ ID NO: 3977963 - RNA, 21 nt, Human herpesvirus 5
cgugcucaagaggugagggua

SEQ ID NO: 3977964 - RNA, 18 nt, Human herpesvirus 5
cgugcucagcugguggcu

SEQ ID NO: 3977965 - RNA, 22 nt, Human herpesvirus 5
cguggacgacuggcucaacuuu

SEQ ID NO: 3977966 - RNA, 15 nt, Human herpesvirus 5
cguggaggcagcggg

SEQ ID NO: 3977967 - RNA, 18 nt, Human herpesvirus 5
cguggcccuggucuggcc

SEQ ID NO: 3977968 - RNA, 20 nt, Human herpesvirus 5
cguggcguaggaguggcgcc

SEQ ID NO: 3977969 - RNA, 19 nt, Human herpesvirus 5
cguggugacugagcacagc

SEQ ID NO: 3977970 - RNA, 20 nt, Human herpesvirus 5
cgugguggccgugcugggcu

SEQ ID NO: 3977971 - RNA, 14 nt, Human herpesvirus 5
cguguggcagcugg

SEQ ID NO: 3977972 - RNA, 23 nt, Human herpesvirus 5
cgugugguagaagagcacgcgga

SEQ ID NO: 3977973 - RNA, 21 nt, Human herpesvirus 5
cguguguuggcuacggcggac

SEQ ID NO: 3977974 - RNA, 19 nt, Human herpesvirus 5
cguguuucaaacagcacau

SEQ ID NO: 3977975 - RNA, 19 nt, Human herpesvirus 5
cguuccguggagucgucuc

SEQ ID NO: 3977976 - RNA, 17 nt, Human herpesvirus 5
cguugaugcggcgcgua

SEQ ID NO: 3977977 - RNA, 19 nt, Human herpesvirus 5
cguuuugagauuucugucg

SEQ ID NO: 3977978 - RNA, 22 nt, Human herpesvirus 5
cuacaauguauagauacacgug

SEQ ID NO: 3977979 - RNA, 13 nt, Human herpesvirus 5
cuacagucccgag

SEQ ID NO: 3977980 - RNA, 15 nt, Human herpesvirus 5
cuaccagcccaggga

SEQ ID NO: 3977981 - RNA, 15 nt, Human herpesvirus 5
cuaccauccuuuuca

SEQ ID NO: 3977982 - RNA, 14 nt, Human herpesvirus 5
cuaccgugccaccu

SEQ ID NO: 3977983 - RNA, 16 nt, Human herpesvirus 5
cuacgaaacuuuucug

SEQ ID NO: 3977984 - RNA, 17 nt, Human herpesvirus 5
cuacgaugcgagccacg

SEQ ID NO: 3977985 - RNA, 13 nt, Human herpesvirus 5
cuacgcgaccagc

SEQ ID NO: 3977986 - RNA, 17 nt, Human herpesvirus 5
cuacgcgugcacgcgcu

SEQ ID NO: 3977987 - RNA, 17 nt, Human herpesvirus 5
cuacgcuacgaccuggc

SEQ ID NO: 3977988 - RNA, 19 nt, Human herpesvirus 5
cuacgcuccuacgacaaca

SEQ ID NO: 3977989 - RNA, 14 nt, Human herpesvirus 5
cuacggcugcaucg

SEQ ID NO: 3977990 - RNA, 23 nt, Human herpesvirus 5
cuacgguggcgcgacggugaugc

SEQ ID NO: 3977991 - RNA, 21 nt, Human herpesvirus 5
cuacucgcacaaccuguggug

SEQ ID NO: 3977992 - RNA, 12 nt, Human herpesvirus 5
cuacuuuggaau

SEQ ID NO: 3977993 - RNA, 15 nt, Human herpesvirus 5
cuagaaagaccaaga

SEQ ID NO: 3977994 - RNA, 15 nt, Human herpesvirus 5
cuagacagauucauc

SEQ ID NO: 3977995 - RNA, 20 nt, Human herpesvirus 5
cuagacaggguaacagccuu

SEQ ID NO: 3977996 - RNA, 14 nt, Human herpesvirus 5
cuagccgggcagga

SEQ ID NO: 3977997 - RNA, 21 nt, Human herpesvirus 5
cuagcgacggcggccauggag

SEQ ID NO: 3977998 - RNA, 15 nt, Human herpesvirus 5
cuagcuacuuuggaa

SEQ ID NO: 3977999 - RNA, 14 nt, Human herpesvirus 5
cuaguaaaaaaagu

SEQ ID NO: 3978000 - RNA, 20 nt, Human herpesvirus 5
cuaguaaaagggacgucaaa

SEQ ID NO: 3978001 - RNA, 16 nt, Human herpesvirus 5
cuaguaauaccaccgu

SEQ ID NO: 3978002 - RNA, 15 nt, Human herpesvirus 5
cuauagggaggacga

SEQ ID NO: 3978003 - RNA, 16 nt, Human herpesvirus 5
cuaucuguguccgccc

SEQ ID NO: 3978004 - RNA, 14 nt, Human herpesvirus 5
cucaaacaccgcug

SEQ ID NO: 3978005 - RNA, 21 nt, Human herpesvirus 5
cucaacuuuggcgugcccagc

SEQ ID NO: 3978006 - RNA, 20 nt, Human herpesvirus 5
cucaagaggaccguuaagcu

SEQ ID NO: 3978007 - RNA, 16 nt, Human herpesvirus 5
cucacccgaguccugg

SEQ ID NO: 3978008 - RNA, 17 nt, Human herpesvirus 5
cucacccggcugcuggc

SEQ ID NO: 3978009 - RNA, 20 nt, Human herpesvirus 5
cucaccgugcucgugcccau

SEQ ID NO: 3978010 - RNA, 21 nt, Human herpesvirus 5
cucagccucgucgugcccguc

SEQ ID NO: 3978011 - RNA, 21 nt, Human herpesvirus 5
cucagggcugggauccgccgc

SEQ ID NO: 3978012 - RNA, 17 nt, Human herpesvirus 5
cuccacgcucgagggcu

SEQ ID NO: 3978013 - RNA, 20 nt, Human herpesvirus 5
cuccacggccuccgacgagc

SEQ ID NO: 3978014 - RNA, 17 nt, Human herpesvirus 5
cuccccggugugucuau

SEQ ID NO: 3978015 - RNA, 12 nt, Human herpesvirus 5
cucccuucucug

SEQ ID NO: 3978016 - RNA, 13 nt, Human herpesvirus 5
cuccgacagcgcg

SEQ ID NO: 3978017 - RNA, 14 nt, Human herpesvirus 5
cuccgucugcguca

SEQ ID NO: 3978018 - RNA, 22 nt, Human herpesvirus 5
cuccgugcggcccccagaggcc

SEQ ID NO: 3978019 - RNA, 18 nt, Human herpesvirus 5
cuccucgucggccugggc

SEQ ID NO: 3978020 - RNA, 12 nt, Human herpesvirus 5
cuccucugccug

SEQ ID NO: 3978021 - RNA, 17 nt, Human herpesvirus 5
cucgaccggcggcugcu

SEQ ID NO: 3978022 - RNA, 15 nt, Human herpesvirus 5
cucgacguuucugau

SEQ ID NO: 3978023 - RNA, 22 nt, Human herpesvirus 5
cucgagcuuauugagcgcagcc

SEQ ID NO: 3978024 - RNA, 23 nt, Human herpesvirus 5
cucgaugcgccuccgguggugcg

SEQ ID NO: 3978025 - RNA, 19 nt, Human herpesvirus 5
cucgcaaagacgugccacg

SEQ ID NO: 3978026 - RNA, 23 nt, Human herpesvirus 5
cucgccuauacuauguguaugau

SEQ ID NO: 3978027 - RNA, 16 nt, Human herpesvirus 5
cucgcgcccgcuccuu

SEQ ID NO: 3978028 - RNA, 20 nt, Human herpesvirus 5
cucgcgucuuagacgcgcgg

SEQ ID NO: 3978029 - RNA, 18 nt, Human herpesvirus 5
gaagucucuuucucugcu

SEQ ID NO: 3978030 - RNA, 21 nt, Human herpesvirus 5
gaaguuguugcaacuguuguu

SEQ ID NO: 3978031 - RNA, 18 nt, Human herpesvirus 5
gaauacccagcuggggaa

SEQ ID NO: 3978032 - RNA, 14 nt, Human herpesvirus 5
gaaucagcagugag

SEQ ID NO: 3978033 - RNA, 11 nt, Human herpesvirus 5
gaauccggcug

SEQ ID NO: 3978034 - RNA, 22 nt, Human herpesvirus 5
gaauccuaaucgcauccugcau

SEQ ID NO: 3978035 - RNA, 18 nt, Human herpesvirus 5
gaaucgcgagcugggcga

SEQ ID NO: 3978036 - RNA, 16 nt, Human herpesvirus 5
gaaugaaccuuguaau

SEQ ID NO: 3978037 - RNA, 22 nt, Human herpesvirus 5
gaaugaaccuuguaaugcuuau

SEQ ID NO: 3978038 - RNA, 17 nt, Human herpesvirus 5
gaaugccucuacuugga

SEQ ID NO: 3978039 - RNA, 16 nt, Human herpesvirus 5
gacaacggcuggaaau

SEQ ID NO: 3978040 - RNA, 20 nt, Human herpesvirus 5
gacaagucguuucagcccaa

SEQ ID NO: 3978041 - RNA, 16 nt, Human herpesvirus 5
gacacagcagcaccag

SEQ ID NO: 3978042 - RNA, 22 nt, Human herpesvirus 5
gacacagcggaaaaugccgccg

SEQ ID NO: 3978043 - RNA, 14 nt, Human herpesvirus 5
gacacaugcacaau

SEQ ID NO: 3978044 - RNA, 20 nt, Human herpesvirus 5
gacacaugcacaauacgaua

SEQ ID NO: 3978045 - RNA, 14 nt, Human herpesvirus 5
gacaccucaauguu

SEQ ID NO: 3978046 - RNA, 15 nt, Human herpesvirus 5
gacacggcgagaccg

SEQ ID NO: 3978047 - RNA, 17 nt, Human herpesvirus 5
gacacuuuaggcggcgc

SEQ ID NO: 3978048 - RNA, 22 nt, Human herpesvirus 5
gacagcugcaauccgguaacgu

SEQ ID NO: 3978049 - RNA, 16 nt, Human herpesvirus 5
gacaggaggcugugcg

SEQ ID NO: 3978050 - RNA, 19 nt, Human herpesvirus 5
gacaggaggcugugcgcgc

SEQ ID NO: 3978051 - RNA, 18 nt, Human herpesvirus 5
gacauggagacaguuucc

SEQ ID NO: 3978052 - RNA, 19 nt, Human herpesvirus 5
gacauggagacaguuucca

SEQ ID NO: 3978053 - RNA, 18 nt, Human herpesvirus 5
gaccacaagcucagcauc

SEQ ID NO: 3978054 - RNA, 23 nt, Human herpesvirus 5
gaccacguagucgcgcgcgaagg

SEQ ID NO: 3978055 - RNA, 21 nt, Human herpesvirus 5
gaccagccaccgucccucagc

SEQ ID NO: 3978056 - RNA, 18 nt, Human herpesvirus 5
gacccacgacccgagccg

SEQ ID NO: 3978057 - RNA, 16 nt, Human herpesvirus 5
gacccagcgacagauc

SEQ ID NO: 3978058 - RNA, 14 nt, Human herpesvirus 5
gacccgccgccgcc

SEQ ID NO: 3978059 - RNA, 18 nt, Human herpesvirus 5
gaccgcagguuagcggcg

SEQ ID NO: 3978060 - RNA, 14 nt, Human herpesvirus 5
gaccgcggcgcagg

SEQ ID NO: 3978061 - RNA, 23 nt, Human herpesvirus 5
gaccggcagcaccaguuggccac

SEQ ID NO: 3978062 - RNA, 18 nt, Human herpesvirus 5
gaccggggugguggugcu

SEQ ID NO: 3978063 - RNA, 15 nt, Human herpesvirus 5
gaccguuguccccgc

SEQ ID NO: 3978064 - RNA, 23 nt, Human herpesvirus 5
gaccuguuuaccucaugcggcaa

SEQ ID NO: 3978065 - RNA, 21 nt, Human herpesvirus 5
gaccuugcggauacgccgccg

SEQ ID NO: 3978066 - RNA, 19 nt, Human herpesvirus 5
gacgaagugccgcgccgcc

SEQ ID NO: 3978067 - RNA, 22 nt, Human herpesvirus 5
gacgacgguuuccacgccaccg

SEQ ID NO: 3978068 - RNA, 17 nt, Human herpesvirus 5
gacgacguggccuccuc

SEQ ID NO: 3978069 - RNA, 14 nt, Human herpesvirus 5
gacgagcaggcucg

SEQ ID NO: 3978070 - RNA, 15 nt, Human herpesvirus 5
gacgauaugucgcga

SEQ ID NO: 3978071 - RNA, 18 nt, Human herpesvirus 5
gacgcgguaaggagcaaa

SEQ ID NO: 3978072 - RNA, 18 nt, Human herpesvirus 5
gacggcagcgucacagag

SEQ ID NO: 3978073 - RNA, 11 nt, Human herpesvirus 5
gacggcagcua

SEQ ID NO: 3978074 - RNA, 19 nt, Human herpesvirus 5
gacggcagcuaucgugacu

SEQ ID NO: 3978075 - RNA, 17 nt, Human herpesvirus 5
gacggcguuuuggcgcc

SEQ ID NO: 3978076 - RNA, 15 nt, Human herpesvirus 5
gacggcuccaagaaa

SEQ ID NO: 3978077 - RNA, 21 nt, Human herpesvirus 5
gacgggucucuuugacacgag

SEQ ID NO: 3978078 - RNA, 18 nt, Human herpesvirus 5
gacggugaugcguguggc

SEQ ID NO: 3978079 - RNA, 20 nt, Human herpesvirus 5
gacgguuuccacgccaccgc

SEQ ID NO: 3978080 - RNA, 13 nt, Human herpesvirus 5
gacgucaaugaca

SEQ ID NO: 3978081 - RNA, 16 nt, Human herpesvirus 5
gacgucggcgguccuc

SEQ ID NO: 3978082 - RNA, 22 nt, Human herpesvirus 5
gacgucggugguggcuguaggc

SEQ ID NO: 3978083 - RNA, 15 nt, Human herpesvirus 5
gacgugacgguguuu

SEQ ID NO: 3978084 - RNA, 21 nt, Human herpesvirus 5
gacucaccagacuuuuugcuu

SEQ ID NO: 3978085 - RNA, 21 nt, Human herpesvirus 5
gacucagggcugggauccgcc

SEQ ID NO: 3978086 - RNA, 14 nt, Human herpesvirus 5
gacucgcggaugac

SEQ ID NO: 3978087 - RNA, 22 nt, Human herpesvirus 5
gacucgcugccgcagcugcugg

SEQ ID NO: 3978088 - RNA, 23 nt, Human herpesvirus 5
gacucgcugccgcagcugcugga

SEQ ID NO: 3978089 - RNA, 23 nt, Human herpesvirus 5
gacucggguguccuacaaaggaa

SEQ ID NO: 3978090 - RNA, 13 nt, Human herpesvirus 5
gacuggagagacu

SEQ ID NO: 3978091 - RNA, 15 nt, Human herpesvirus 5
gacuggucuggcccg

SEQ ID NO: 3978092 - RNA, 17 nt, Human herpesvirus 5
gacuuagaaucucuugc

SEQ ID NO: 3978093 - RNA, 22 nt, Human herpesvirus 5
gacuugaguaccaagugccgcc

SEQ ID NO: 3978094 - RNA, 14 nt, Human herpesvirus 5
gagacacuugaaua

SEQ ID NO: 3978095 - RNA, 14 nt, Human herpesvirus 5
gagacccggcuggc

SEQ ID NO: 3978096 - RNA, 15 nt, Human herpesvirus 5
gagaccgccgccgcg

SEQ ID NO: 3978097 - RNA, 13 nt, Human herpesvirus 5
gagagucugaaac

SEQ ID NO: 3978098 - RNA, 22 nt, Human herpesvirus 5
gagauccaguuacacucgcucu

SEQ ID NO: 3978099 - RNA, 19 nt, Human herpesvirus 5
gagcagcaaaacgaccaga

SEQ ID NO: 3978100 - RNA, 16 nt, Human herpesvirus 5
gagcaggucucgcgca

SEQ ID NO: 3978101 - RNA, 20 nt, Human herpesvirus 5
gagccgccgacgcuggcgcu

SEQ ID NO: 3978102 - RNA, 13 nt, Human herpesvirus 5
gagcgccgacugg

SEQ ID NO: 3978103 - RNA, 14 nt, Human herpesvirus 5
gagcgccggcgagc

SEQ ID NO: 3978104 - RNA, 16 nt, Human herpesvirus 5
gagcgcgaccgccuca

SEQ ID NO: 3978105 - RNA, 23 nt, Human herpesvirus 5
gaggaccauuuccaugugcagcu

SEQ ID NO: 3978106 - RNA, 12 nt, Human herpesvirus 5
gaggagcaggcu

SEQ ID NO: 3978107 - RNA, 17 nt, Human herpesvirus 5
gaggagcgccggggaga

SEQ ID NO: 3978108 - RNA, 16 nt, Human herpesvirus 5
gaggagugucagacac

SEQ ID NO: 3978109 - RNA, 21 nt, Human herpesvirus 5
gaggcacauacgggacuuaca

SEQ ID NO: 3978110 - RNA, 23 nt, Human herpesvirus 5
gaggcgcucgugaaacagcagcu

SEQ ID NO: 3978111 - RNA, 15 nt, Human herpesvirus 5
gaggcggaggagccg

SEQ ID NO: 3978112 - RNA, 15 nt, Human herpesvirus 5
gaggcucuguggacc

SEQ ID NO: 3978113 - RNA, 15 nt, Human herpesvirus 5
gaggcuguggccagc

SEQ ID NO: 3978114 - RNA, 13 nt, Human herpesvirus 5
gagguacugcagc

SEQ ID NO: 3978115 - RNA, 20 nt, Human herpesvirus 5
gaggucugggaugugcagca

SEQ ID NO: 3978116 - RNA, 17 nt, Human herpesvirus 5
gagguugucguccgaau

SEQ ID NO: 3978117 - RNA, 20 nt, Human herpesvirus 5
gaguaccgcauuacugggac

SEQ ID NO: 3978118 - RNA, 15 nt, Human herpesvirus 5
gaguccuggucuuuc

SEQ ID NO: 3978119 - RNA, 17 nt, Human herpesvirus 5
gagugguggcggcagcc

SEQ ID NO: 3978120 - RNA, 13 nt, Human herpesvirus 5
gauaaacgucacg

SEQ ID NO: 3978121 - RNA, 16 nt, Human herpesvirus 5
gauacagggugccgcc

SEQ ID NO: 3978122 - RNA, 20 nt, Human herpesvirus 5
gauacauugcccuucuggag

SEQ ID NO: 3978123 - RNA, 22 nt, Human herpesvirus 5
gauaccgggcgccgggacucug

SEQ ID NO: 3978124 - RNA, 20 nt, Human herpesvirus 5
gaucagcgaggccgaagccg

SEQ ID NO: 3978125 - RNA, 12 nt, Human herpesvirus 5
gauccagcugcu

SEQ ID NO: 3978126 - RNA, 11 nt, Human herpesvirus 5
gauccaggagg

SEQ ID NO: 3978127 - RNA, 21 nt, Human herpesvirus 5
gauccaguugcaccucgaccu

SEQ ID NO: 3978128 - RNA, 19 nt, Human herpesvirus 5
gauccuuggaagagggaag

SEQ ID NO: 3978129 - RNA, 15 nt, Human herpesvirus 5
gaucgcgccgccucg

SEQ ID NO: 3978130 - RNA, 17 nt, Human herpesvirus 5
gaucguacccaccaccu

SEQ ID NO: 3978131 - RNA, 10 nt, Human herpesvirus 5
gaugaaccuc

SEQ ID NO: 3978132 - RNA, 22 nt, Human herpesvirus 5
gaugaacguggugaggggcgug

SEQ ID NO: 3978133 - RNA, 19 nt, Human herpesvirus 5
gaugaacuguuccacggcc

SEQ ID NO: 3978134 - RNA, 23 nt, Human herpesvirus 5
accccuuuuggugugugucuaua

SEQ ID NO: 3978135 - RNA, 20 nt, Human herpesvirus 5
acccggcugcacguggccug

SEQ ID NO: 3978136 - RNA, 23 nt, Human herpesvirus 5
acccucaaaacaucaccaccauc

SEQ ID NO: 3978137 - RNA, 16 nt, Human herpesvirus 5
acccucgcgcggaguc

SEQ ID NO: 3978138 - RNA, 20 nt, Human herpesvirus 5
acccugcguccccgcacgac

SEQ ID NO: 3978139 - RNA, 17 nt, Human herpesvirus 5
accgacaaggcgcggcg

SEQ ID NO: 3978140 - RNA, 15 nt, Human herpesvirus 5
accgacauggagccc

SEQ ID NO: 3978141 - RNA, 19 nt, Human herpesvirus 5
accgacgacgacagucucc

SEQ ID NO: 3978142 - RNA, 14 nt, Human herpesvirus 5
accgagacggagga

SEQ ID NO: 3978143 - RNA, 16 nt, Human herpesvirus 5
accgcaguugcugccu

SEQ ID NO: 3978144 - RNA, 20 nt, Human herpesvirus 5
accgccguucggcucuccuc

SEQ ID NO: 3978145 - RNA, 13 nt, Human herpesvirus 5
accgcgacggcga

SEQ ID NO: 3978146 - RNA, 15 nt, Human herpesvirus 5
accgcgagcggcgga

SEQ ID NO: 3978147 - RNA, 16 nt, Human herpesvirus 5
accgcggcaccuacca

SEQ ID NO: 3978148 - RNA, 19 nt, Human herpesvirus 5
accgcuacaacgcgcgccu

SEQ ID NO: 3978149 - RNA, 23 nt, Human herpesvirus 5
accggccuccgacgacgccgagg

SEQ ID NO: 3978150 - RNA, 21 nt, Human herpesvirus 5
accggggugguggugcugcug

SEQ ID NO: 3978151 - RNA, 17 nt, Human herpesvirus 5
accgguuggagcagcuc

SEQ ID NO: 3978152 - RNA, 13 nt, Human herpesvirus 5
accgucagcugcg

SEQ ID NO: 3978153 - RNA, 16 nt, Human herpesvirus 5
accgucgucgcucuag

SEQ ID NO: 3978154 - RNA, 14 nt, Human herpesvirus 5
accgugcacgcgcu

SEQ ID NO: 3978155 - RNA, 16 nt, Human herpesvirus 5
accucagucaccgagu

SEQ ID NO: 3978156 - RNA, 22 nt, Human herpesvirus 5
accuccuccucccucgcgccgc

SEQ ID NO: 3978157 - RNA, 19 nt, Human herpesvirus 5
accucguuguccucuccuc

SEQ ID NO: 3978158 - RNA, 14 nt, Human herpesvirus 5
accucucgggccga

SEQ ID NO: 3978159 - RNA, 22 nt, Human herpesvirus 5
accucuuuccauucuuccgugu

SEQ ID NO: 3978160 - RNA, 14 nt, Human herpesvirus 5
accucuuugagcac

SEQ ID NO: 3978161 - RNA, 14 nt, Human herpesvirus 5
accuggaucugccc

SEQ ID NO: 3978162 - RNA, 23 nt, Human herpesvirus 5
accuguuggagcaacgggcggcc

SEQ ID NO: 3978163 - RNA, 16 nt, Human herpesvirus 5
acgaacgacguacguc

SEQ ID NO: 3978164 - RNA, 14 nt, Human herpesvirus 5
acgacauauguuuu

SEQ ID NO: 3978165 - RNA, 22 nt, Human herpesvirus 5
acgaccuccgcgucggucgccg

SEQ ID NO: 3978166 - RNA, 16 nt, Human herpesvirus 5
acgacgggacggcggc

SEQ ID NO: 3978167 - RNA, 17 nt, Human herpesvirus 5
acgagcaucgcaacaac

SEQ ID NO: 3978168 - RNA, 21 nt, Human herpesvirus 5
acgagcaucgcaacaacagca

SEQ ID NO: 3978169 - RNA, 19 nt, Human herpesvirus 5
acgagcgccguccugcaga

SEQ ID NO: 3978170 - RNA, 20 nt, Human herpesvirus 5
acgagcuggacaaguacagc

SEQ ID NO: 3978171 - RNA, 15 nt, Human herpesvirus 5
acgaucgcuggaaag

SEQ ID NO: 3978172 - RNA, 18 nt, Human herpesvirus 5
acgaugcuuuccuggaca

SEQ ID NO: 3978173 - RNA, 15 nt, Human herpesvirus 5
acgcaaacgcgggcc

SEQ ID NO: 3978174 - RNA, 21 nt, Human herpesvirus 5
acgcagcgggaaaccgcgucg

SEQ ID NO: 3978175 - RNA, 18 nt, Human herpesvirus 5
acgcaggugaggcucucg

SEQ ID NO: 3978176 - RNA, 19 nt, Human herpesvirus 5
acgccaaguaccuaugcgc

SEQ ID NO: 3978177 - RNA, 13 nt, Human herpesvirus 5
acgccacgucgga

SEQ ID NO: 3978178 - RNA, 16 nt, Human herpesvirus 5
acgcccuguaugagcu

SEQ ID NO: 3978179 - RNA, 18 nt, Human herpesvirus 5
acgccgaucauguccgag

SEQ ID NO: 3978180 - RNA, 17 nt, Human herpesvirus 5
acgccgcgcgaacgacg

SEQ ID NO: 3978181 - RNA, 23 nt, Human herpesvirus 5
acgccggcggagacgacggcggu

SEQ ID NO: 3978182 - RNA, 21 nt, Human herpesvirus 5
acgccggggaagccuccggaa

SEQ ID NO: 3978183 - RNA, 18 nt, Human herpesvirus 5
acgccgucaaggccgccu

SEQ ID NO: 3978184 - RNA, 17 nt, Human herpesvirus 5
acgccguugccacgagc

SEQ ID NO: 3978185 - RNA, 24 nt, Human herpesvirus 5
acgcgacuaugagggccugcggcg

SEQ ID NO: 3978186 - RNA, 22 nt, Human herpesvirus 5
acgcgauuggccagcacgggga

SEQ ID NO: 3978187 - RNA, 14 nt, Human herpesvirus 5
acgcgccgggcggc

SEQ ID NO: 3978188 - RNA, 22 nt, Human herpesvirus 5
acgcgcgcacggcgcggucccg

SEQ ID NO: 3978189 - RNA, 15 nt, Human herpesvirus 5
acgcgcggcuagagc

SEQ ID NO: 3978190 - RNA, 13 nt, Human herpesvirus 5
acgcggcagcggc

SEQ ID NO: 3978191 - RNA, 19 nt, Human herpesvirus 5
acgcggcguauccucaagu

SEQ ID NO: 3978192 - RNA, 20 nt, Human herpesvirus 5
acgcggucaugaguuggugc

SEQ ID NO: 3978193 - RNA, 19 nt, Human herpesvirus 5
acgcggugcagguucugaa

SEQ ID NO: 3978194 - RNA, 21 nt, Human herpesvirus 5
acgcgucagggcggugcggcg

SEQ ID NO: 3978195 - RNA, 17 nt, Human herpesvirus 5
acgcucgcucugacgcc

SEQ ID NO: 3978196 - RNA, 21 nt, Human herpesvirus 5
acgcugcgucgcagucagacc

SEQ ID NO: 3978197 - RNA, 14 nt, Human herpesvirus 5
acggaccgcagcac

SEQ ID NO: 3978198 - RNA, 15 nt, Human herpesvirus 5
acggacggcaaggcg

SEQ ID NO: 3978199 - RNA, 15 nt, Human herpesvirus 5
acggagcacgggcug

SEQ ID NO: 3978200 - RNA, 19 nt, Human herpesvirus 5
acggaguggugagcggguu

SEQ ID NO: 3978201 - RNA, 16 nt, Human herpesvirus 5
acggcaaggcggagga

SEQ ID NO: 3978202 - RNA, 11 nt, Human herpesvirus 5
acggccgccgc

SEQ ID NO: 3978203 - RNA, 19 nt, Human herpesvirus 5
acggcgguuucagcuggca

SEQ ID NO: 3978204 - RNA, 20 nt, Human herpesvirus 5
acggcguuuuggcgcccccc

SEQ ID NO: 3978205 - RNA, 20 nt, Human herpesvirus 5
acgggaggcugaucgcggcc

SEQ ID NO: 3978206 - RNA, 23 nt, Human herpesvirus 5
acggggcuggguggagagggaag

SEQ ID NO: 3978207 - RNA, 19 nt, Human herpesvirus 5
acgggggggaccgggggcg

SEQ ID NO: 3978208 - RNA, 19 nt, Human herpesvirus 5
acgguacgcagucacugcg

SEQ ID NO: 3978209 - RNA, 20 nt, Human herpesvirus 5
acggugaugcguguggccgc

SEQ ID NO: 3978210 - RNA, 22 nt, Human herpesvirus 5
acggugccauggaccugaccug

SEQ ID NO: 3978211 - RNA, 12 nt, Human herpesvirus 5
acgguggugugu

SEQ ID NO: 3978212 - RNA, 20 nt, Human herpesvirus 5
acgguuacuccacaaccugu

SEQ ID NO: 3978213 - RNA, 10 nt, Human herpesvirus 5
acgguuugac

SEQ ID NO: 3978214 - RNA, 17 nt, Human herpesvirus 5
acguagaaaaagaggaa

SEQ ID NO: 3978215 - RNA, 16 nt, Human herpesvirus 5
acguaggccuccucuc

SEQ ID NO: 3978216 - RNA, 15 nt, Human herpesvirus 5
acgucacgccagacu

SEQ ID NO: 3978217 - RNA, 15 nt, Human herpesvirus 5
acgucccgcgcggau

SEQ ID NO: 3978218 - RNA, 12 nt, Human herpesvirus 5
acgucuucugaa

SEQ ID NO: 3978219 - RNA, 14 nt, Human herpesvirus 5
acgugcgaccugga

SEQ ID NO: 3978220 - RNA, 20 nt, Human herpesvirus 5
acgugcuuuuggugcgccac

SEQ ID NO: 3978221 - RNA, 17 nt, Human herpesvirus 5
acguggguuucggugac

SEQ ID NO: 3978222 - RNA, 20 nt, Human herpesvirus 5
acgugguaacgauggcggcc

SEQ ID NO: 3978223 - RNA, 22 nt, Human herpesvirus 5
acgugguuuuuuuaacagugug

SEQ ID NO: 3978224 - RNA, 15 nt, Human herpesvirus 5
acguguccgcggaca

SEQ ID NO: 3978225 - RNA, 20 nt, Human herpesvirus 5
acguguuucaaacagcacau

SEQ ID NO: 3978226 - RNA, 22 nt, Human herpesvirus 5
acguguuucgcgaacuggcgcg

SEQ ID NO: 3978227 - RNA, 14 nt, Human herpesvirus 5
acguucgucgugac

SEQ ID NO: 3978228 - RNA, 23 nt, Human herpesvirus 5
acguugcuaggucccuuaacugu

SEQ ID NO: 3978229 - RNA, 18 nt, Human herpesvirus 5
acuacagaauugauuuca

SEQ ID NO: 3978230 - RNA, 16 nt, Human herpesvirus 5
acuaccgugccaccug

SEQ ID NO: 3978231 - RNA, 12 nt, Human herpesvirus 5
acuaccuccccu

SEQ ID NO: 3978232 - RNA, 20 nt, Human herpesvirus 5
acuagcgaaguacacaguuu

SEQ ID NO: 3978233 - RNA, 18 nt, Human herpesvirus 5
acuaucgacguguuauca

SEQ ID NO: 3978234 - RNA, 14 nt, Human herpesvirus 5
acuauuguauacuc

SEQ ID NO: 3978235 - RNA, 13 nt, Human herpesvirus 5
acucagaggccac

SEQ ID NO: 3978236 - RNA, 14 nt, Human herpesvirus 5
acugaaaacaccau

SEQ ID NO: 3978237 - RNA, 14 nt, Human herpesvirus 5
acugacacagcucc

SEQ ID NO: 3978238 - RNA, 21 nt, Human herpesvirus 5
acugcuauguaucaucuuuau

SEQ ID NO: 3978239 - RNA, 23 nt, Human herpesvirus 5
acugcuauguaucaucuuuauuu

SEQ ID NO: 3978240 - RNA, 18 nt, Human herpesvirus 5
acuggaccacguuguccg

SEQ ID NO: 3978241 - RNA, 18 nt, Human herpesvirus 5
acugggagacggccugga

SEQ ID NO: 3978242 - RNA, 15 nt, Human herpesvirus 5
acugggccucggcgu

SEQ ID NO: 3978243 - RNA, 12 nt, Human herpesvirus 5
acuuucaaugau

SEQ ID NO: 3978244 - RNA, 15 nt, Human herpesvirus 5
acuuucuccuuuggu

SEQ ID NO: 3978245 - RNA, 14 nt, Human herpesvirus 5
acuuuggcucuuuc

SEQ ID NO: 3978246 - RNA, 13 nt, Human herpesvirus 5
agaagcacggaga

SEQ ID NO: 3978247 - RNA, 19 nt, Human herpesvirus 5
agaauacuggaagcugcug

SEQ ID NO: 3978248 - RNA, 14 nt, Human herpesvirus 5
agaaugcugcucag

SEQ ID NO: 3978249 - RNA, 15 nt, Human herpesvirus 5
agaauggaccgucga

SEQ ID NO: 3978250 - RNA, 12 nt, Human herpesvirus 5
agacacuugaau

SEQ ID NO: 3978251 - RNA, 14 nt, Human herpesvirus 5
agacagacaggaca

SEQ ID NO: 3978252 - RNA, 18 nt, Human herpesvirus 5
agacaggcggccagcuuc

SEQ ID NO: 3978253 - RNA, 21 nt, Human herpesvirus 5
agacauuccccaccuucccuc

SEQ ID NO: 3978254 - RNA, 18 nt, Human herpesvirus 5
agaccaugacgacgguga

SEQ ID NO: 3978255 - RNA, 20 nt, Human herpesvirus 5
agaccgcaacaacagcagca

SEQ ID NO: 3978256 - RNA, 23 nt, Human herpesvirus 5
agaccgugggucgggagcacaua

SEQ ID NO: 3978257 - RNA, 23 nt, Human herpesvirus 5
agaccucauguacgccaccgauc

SEQ ID NO: 3978258 - RNA, 15 nt, Human herpesvirus 5
agacgaagaggacac

SEQ ID NO: 3978259 - RNA, 12 nt, Human herpesvirus 5
agacggccugga

SEQ ID NO: 3978260 - RNA, 14 nt, Human herpesvirus 5
agacugugguggga

SEQ ID NO: 3978261 - RNA, 20 nt, Human herpesvirus 5
agagacguugauaauaaccg

SEQ ID NO: 3978262 - RNA, 14 nt, Human herpesvirus 5
agagagucugaaac

SEQ ID NO: 3978263 - RNA, 19 nt, Human herpesvirus 5
agaggaagucgaucuggaa

SEQ ID NO: 3978264 - RNA, 20 nt, Human herpesvirus 5
agaguggugggaaugcacgu

SEQ ID NO: 3978265 - RNA, 14 nt, Human herpesvirus 5
agaucgucuacggc

SEQ ID NO: 3978266 - RNA, 21 nt, Human herpesvirus 5
agcacagagacaccaauugcu

SEQ ID NO: 3978267 - RNA, 12 nt, Human herpesvirus 5
agcaccgccggc

SEQ ID NO: 3978268 - RNA, 14 nt, Human herpesvirus 5
agcacuaccagcug

SEQ ID NO: 3978269 - RNA, 13 nt, Human herpesvirus 5
agcacugacaggg

SEQ ID NO: 3978270 - RNA, 21 nt, Human herpesvirus 5
agcagcaaugucguaguacaa

SEQ ID NO: 3978271 - RNA, 21 nt, Human herpesvirus 5
agcagcaucuggcgcggucug

SEQ ID NO: 3978272 - RNA, 17 nt, Human herpesvirus 5
agcagccgacacagcgg

SEQ ID NO: 3978273 - RNA, 13 nt, Human herpesvirus 5
agcauacggggag

SEQ ID NO: 3978274 - RNA, 18 nt, Human herpesvirus 5
agcccaaguucagcagca

SEQ ID NO: 3978275 - RNA, 17 nt, Human herpesvirus 5
agcccauccucguggaa

SEQ ID NO: 3978276 - RNA, 17 nt, Human herpesvirus 5
agcccgggccgccgcca

SEQ ID NO: 3978277 - RNA, 22 nt, Human herpesvirus 5
agcccggucggucuuccugcug

SEQ ID NO: 3978278 - RNA, 16 nt, Human herpesvirus 5
agcccguggcccagga

SEQ ID NO: 3978279 - RNA, 13 nt, Human herpesvirus 5
agccgagcgggag

SEQ ID NO: 3978280 - RNA, 11 nt, Human herpesvirus 5
agccggcagcu

SEQ ID NO: 3978281 - RNA, 12 nt, Human herpesvirus 5
agccggcagcug

SEQ ID NO: 3978282 - RNA, 15 nt, Human herpesvirus 5
agccggggugccgcc

SEQ ID NO: 3978283 - RNA, 14 nt, Human herpesvirus 5
agccugccgccggc

SEQ ID NO: 3978284 - RNA, 20 nt, Human herpesvirus 5
agcgacgucccgcgcggauc

SEQ ID NO: 3978285 - RNA, 23 nt, Human herpesvirus 5
agcgaguggggcaacugcugccu

SEQ ID NO: 3978286 - RNA, 19 nt, Human herpesvirus 5
agcgccagcggccuggccu

SEQ ID NO: 3978287 - RNA, 14 nt, Human herpesvirus 5
agcgcggcggcagc

SEQ ID NO: 3978288 - RNA, 14 nt, Human herpesvirus 5
agcgcgugaccugu

SEQ ID NO: 3978289 - RNA, 19 nt, Human herpesvirus 5
agcggcaggaaggccucgu

SEQ ID NO: 3978290 - RNA, 18 nt, Human herpesvirus 5
agcggcgcgccccggcgu

SEQ ID NO: 3978291 - RNA, 23 nt, Human herpesvirus 5
agcggcggcgguggugacugggg

SEQ ID NO: 3978292 - RNA, 21 nt, Human herpesvirus 5
agcggcgugauugcaaagccg

SEQ ID NO: 3978293 - RNA, 18 nt, Human herpesvirus 5
agcggcucgccgcagacc

SEQ ID NO: 3978294 - RNA, 17 nt, Human herpesvirus 5
agcggcucgggcuggcg

SEQ ID NO: 3978295 - RNA, 22 nt, Human herpesvirus 5
agcggcuguggcuucucuggag

SEQ ID NO: 3978296 - RNA, 22 nt, Human herpesvirus 5
agcggggguguauagaccccaa

SEQ ID NO: 3978297 - RNA, 22 nt, Human herpesvirus 5
agcguaaauccccgugugaugu

SEQ ID NO: 3978298 - RNA, 18 nt, Human herpesvirus 5
agcgucagaagacgagcu

SEQ ID NO: 3978299 - RNA, 16 nt, Human herpesvirus 5
agcguccgcuggaaau

SEQ ID NO: 3978300 - RNA, 22 nt, Human herpesvirus 5
agcguucaacacuuucucugga

SEQ ID NO: 3978301 - RNA, 16 nt, Human herpesvirus 5
agcucccgcgguccga

SEQ ID NO: 3978302 - RNA, 18 nt, Human herpesvirus 5
agcucguuucgccggcgc

SEQ ID NO: 3978303 - RNA, 14 nt, Human herpesvirus 5
agcucugucggcgc

SEQ ID NO: 3978304 - RNA, 17 nt, Human herpesvirus 5
agcugcuuucuuuuugc

SEQ ID NO: 3978305 - RNA, 17 nt, Human herpesvirus 5
agcuggugaucggccgc

SEQ ID NO: 3978306 - RNA, 16 nt, Human herpesvirus 5
agcuuuagccagguga

SEQ ID NO: 3978307 - RNA, 17 nt, Human herpesvirus 5
agcuuucuugacuggcc

SEQ ID NO: 3978308 - RNA, 15 nt, Human herpesvirus 5
aggaaugcaugugga

SEQ ID NO: 3978309 - RNA, 23 nt, Human herpesvirus 5
aggaaugcggcacccggcugcac

SEQ ID NO: 3978310 - RNA, 15 nt, Human herpesvirus 5
aggaauucaucuauc

SEQ ID NO: 3978311 - RNA, 17 nt, Human herpesvirus 5
aggaauuggcaggaaag

SEQ ID NO: 3978312 - RNA, 17 nt, Human herpesvirus 5
aggacaaaaaguacacu

SEQ ID NO: 3978313 - RNA, 23 nt, Human herpesvirus 5
aggaccauuuccaugugcagcug

SEQ ID NO: 3978314 - RNA, 18 nt, Human herpesvirus 5
aggacucgcucacgucgu

SEQ ID NO: 3978315 - RNA, 15 nt, Human herpesvirus 5
aggagacaccgucgc

SEQ ID NO: 3978316 - RNA, 18 nt, Human herpesvirus 5
aggaggccgagacgcugc

SEQ ID NO: 3978317 - RNA, 23 nt, Human herpesvirus 5
aggaggccgcacuggacgacguc

SEQ ID NO: 3978318 - RNA, 13 nt, Human herpesvirus 5
aggaguggcugcu

SEQ ID NO: 3978319 - RNA, 16 nt, Human herpesvirus 5
aggauucugagggccg

SEQ ID NO: 3978320 - RNA, 23 nt, Human herpesvirus 5
aggccaccgggacggccugggcg

SEQ ID NO: 3978321 - RNA, 19 nt, Human herpesvirus 5
aggccagcugccaccaggg

SEQ ID NO: 3978322 - RNA, 14 nt, Human herpesvirus 5
aggccguggagaug

SEQ ID NO: 3978323 - RNA, 14 nt, Human herpesvirus 5
aggccuccagcgcc

SEQ ID NO: 3978324 - RNA, 20 nt, Human herpesvirus 5
aggcggcgccggcgccuggu

SEQ ID NO: 3978325 - RNA, 16 nt, Human herpesvirus 5
aggcggcucgcuggaa

SEQ ID NO: 3978326 - RNA, 16 nt, Human herpesvirus 5
aggcugugcgcgccgg

SEQ ID NO: 3978327 - RNA, 21 nt, Human herpesvirus 5
agggaaaacauaagaauagga

SEQ ID NO: 3978328 - RNA, 17 nt, Human herpesvirus 5
agggacacguagauccc

SEQ ID NO: 3978329 - RNA, 17 nt, Human herpesvirus 5
agggccgauggcugccc

SEQ ID NO: 3978330 - RNA, 22 nt, Human herpesvirus 5
agggcucuucacggucgggcac

SEQ ID NO: 3978331 - RNA, 17 nt, Human herpesvirus 5
agggcugcucggcggcc

SEQ ID NO: 3978332 - RNA, 16 nt, Human herpesvirus 5
aggguagaaacgugag

SEQ ID NO: 3978333 - RNA, 15 nt, Human herpesvirus 5
aggguaucuggggag

SEQ ID NO: 3978334 - RNA, 14 nt, Human herpesvirus 5
agguacggacucua

SEQ ID NO: 3978335 - RNA, 18 nt, Human herpesvirus 5
aggucacacugggagacg

SEQ ID NO: 3978336 - RNA, 18 nt, Human herpesvirus 5
aggugcgccgcagcggcu

SEQ ID NO: 3978337 - RNA, 12 nt, Human herpesvirus 5
agguggaggaca

SEQ ID NO: 3978338 - RNA, 18 nt, Human herpesvirus 5
aggugggguggcucuugc

SEQ ID NO: 3978339 - RNA, 20 nt, Human herpesvirus 5
agguucuaagaccgcggcgc

SEQ ID NO: 3978340 - RNA, 17 nt, Human herpesvirus 5
agguuugucuggcggcu

SEQ ID NO: 3978341 - RNA, 19 nt, Human herpesvirus 5
aguacaaaacaggaaagga

SEQ ID NO: 3978342 - RNA, 12 nt, Human herpesvirus 5
aguagugguggg

SEQ ID NO: 3978343 - RNA, 20 nt, Human herpesvirus 5
aguaugaaagucccgugugu

SEQ ID NO: 3978344 - RNA, 20 nt, Human herpesvirus 5
aguaugaaaguuggcugcgc

SEQ ID NO: 3978345 - RNA, 23 nt, Human herpesvirus 5
aguccaccaggccgcaaagcugg

SEQ ID NO: 3978346 - RNA, 22 nt, Human herpesvirus 5
agucguaagaagcgcgaggacg

SEQ ID NO: 3978347 - RNA, 22 nt, Human herpesvirus 5
agucuagacaggguaacagccu

SEQ ID NO: 3978348 - RNA, 18 nt, Human herpesvirus 5
agucucuuucucugcuuc

SEQ ID NO: 3978349 - RNA, 15 nt, Human herpesvirus 5
agugacguggauacu

SEQ ID NO: 3978350 - RNA, 19 nt, Human herpesvirus 5
agugacguggauacuagua

SEQ ID NO: 3978351 - RNA, 18 nt, Human herpesvirus 5
agugcgccaagccaugca

SEQ ID NO: 3978352 - RNA, 14 nt, Human herpesvirus 5
agugcgcgcggcgc

SEQ ID NO: 3978353 - RNA, 23 nt, Human herpesvirus 5
aguggaugcgcgaagcugcgcag

SEQ ID NO: 3978354 - RNA, 18 nt, Human herpesvirus 5
aguggauuugggcgugga

SEQ ID NO: 3978355 - RNA, 15 nt, Human herpesvirus 5
aguggcgccccggcu

SEQ ID NO: 3978356 - RNA, 13 nt, Human herpesvirus 5
agugggccagccc

SEQ ID NO: 3978357 - RNA, 20 nt, Human herpesvirus 5
aguggucuuucacaucgcca

SEQ ID NO: 3978358 - RNA, 22 nt, Human herpesvirus 5
aguguauuggcauauagccaau

SEQ ID NO: 3978359 - RNA, 15 nt, Human herpesvirus 5
agugucagacacagc

SEQ ID NO: 3978360 - RNA, 18 nt, Human herpesvirus 5
aguugcaaaagaagcugc

SEQ ID NO: 3978361 - RNA, 14 nt, Human herpesvirus 5
aguuggcguugagc

SEQ ID NO: 3978362 - RNA, 17 nt, Human herpesvirus 5
aguuggugcagcugcgc

SEQ ID NO: 3978363 - RNA, 18 nt, Human herpesvirus 5
aguuguagucgcgguggc

SEQ ID NO: 3978364 - RNA, 19 nt, Human herpesvirus 5
auaaaacgccaugaugaca

SEQ ID NO: 3978365 - RNA, 23 nt, Human herpesvirus 5
auaaaauaauaagccggcagcug

SEQ ID NO: 3978366 - RNA, 23 nt, Human herpesvirus 5
auaaaaugcuguauuauauacaa

SEQ ID NO: 3978367 - RNA, 16 nt, Human herpesvirus 5
auaacaacacaucaac

SEQ ID NO: 3978368 - RNA, 19 nt, Human herpesvirus 5
auaauaagccggcagcugc

SEQ ID NO: 3978369 - RNA, 14 nt, Human herpesvirus 5
auaauauucuauau

SEQ ID NO: 3978370 - RNA, 17 nt, Human herpesvirus 5
auaaucggcucucaggc

SEQ ID NO: 3978371 - RNA, 15 nt, Human herpesvirus 5
auacgcaguguuguu

SEQ ID NO: 3978372 - RNA, 23 nt, Human herpesvirus 5
auacgcgcuggaggcccuggugg

SEQ ID NO: 3978373 - RNA, 18 nt, Human herpesvirus 5
auacuggaagcugcuggu

SEQ ID NO: 3978374 - RNA, 21 nt, Human herpesvirus 5
auacuucucguacgacgucug

SEQ ID NO: 3978375 - RNA, 14 nt, Human herpesvirus 5
auauaagaaaagac

SEQ ID NO: 3978376 - RNA, 18 nt, Human herpesvirus 5
auaucgagguacaugucc

SEQ ID NO: 3978377 - RNA, 11 nt, Human herpesvirus 5
auauguagcac

SEQ ID NO: 3978378 - RNA, 15 nt, Human herpesvirus 5
auauugaaaaugucg

SEQ ID NO: 3978379 - RNA, 18 nt, Human herpesvirus 5
auauuuuccauaaaucua

SEQ ID NO: 3978380 - RNA, 15 nt, Human herpesvirus 5
aucacaucacccaac

SEQ ID NO: 3978381 - RNA, 12 nt, Human herpesvirus 5
aucacccacaga

SEQ ID NO: 3978382 - RNA, 20 nt, Human herpesvirus 5
aucacgggacccgccgccgc

SEQ ID NO: 3978383 - RNA, 23 nt, Human herpesvirus 5
aucacgugugugcguuuucuagu

SEQ ID NO: 3978384 - RNA, 15 nt, Human herpesvirus 5
aucaucaacagcagc

SEQ ID NO: 3978385 - RNA, 21 nt, Human herpesvirus 5
aucaugcugggcgacacucag

SEQ ID NO: 3978386 - RNA, 23 nt, Human herpesvirus 5
aucauguuccuacacgccuugca

SEQ ID NO: 3978387 - RNA, 18 nt, Human herpesvirus 5
auccugggacaccacggu

SEQ ID NO: 3978388 - RNA, 16 nt, Human herpesvirus 5
auccuuuucaugcuca

SEQ ID NO: 3978389 - RNA, 17 nt, Human herpesvirus 5
aucgacugccuaacugu

SEQ ID NO: 3978390 - RNA, 16 nt, Human herpesvirus 5
aucgggcccgccggcc

SEQ ID NO: 3978391 - RNA, 14 nt, Human herpesvirus 5
aucucaacgucaac

SEQ ID NO: 3978392 - RNA, 20 nt, Human herpesvirus 5
aucucacaccgucagcugcg

SEQ ID NO: 3978393 - RNA, 15 nt, Human herpesvirus 5
aucuccgacagcgcg

SEQ ID NO: 3978394 - RNA, 15 nt, Human herpesvirus 5
aucuccgucucuggu

SEQ ID NO: 3978395 - RNA, 15 nt, Human herpesvirus 5
aucugccacuuuucu

SEQ ID NO: 3978396 - RNA, 15 nt, Human herpesvirus 5
aucugcugaaacugc

SEQ ID NO: 3978397 - RNA, 18 nt, Human herpesvirus 5
aucuuccccucugcugcu

SEQ ID NO: 3978398 - RNA, 15 nt, Human herpesvirus 5
aucuuucagcuggcu

SEQ ID NO: 3978399 - RNA, 19 nt, Human herpesvirus 5
augaaggaacgcacgcugg

SEQ ID NO: 3978400 - RNA, 16 nt, Human herpesvirus 5
augacacgaacgugac

SEQ ID NO: 3978401 - RNA, 23 nt, Human herpesvirus 5
augcagaccuacagcaccccccu

SEQ ID NO: 3978402 - RNA, 23 nt, Human herpesvirus 5
augcaugcuaagaugaacgggug

SEQ ID NO: 3978403 - RNA, 20 nt, Human herpesvirus 5
augcaugucgcgacagagag

SEQ ID NO: 3978404 - RNA, 22 nt, Human herpesvirus 5
augccaugcggauccagcugcu

SEQ ID NO: 3978405 - RNA, 12 nt, Human herpesvirus 5
augcgagcgggg

SEQ ID NO: 3978406 - RNA, 17 nt, Human herpesvirus 5
augcggucggucagccg

SEQ ID NO: 3978407 - RNA, 22 nt, Human herpesvirus 5
augcguguucaguugggcggca

SEQ ID NO: 3978408 - RNA, 16 nt, Human herpesvirus 5
augcucaagacagaca

SEQ ID NO: 3978409 - RNA, 23 nt, Human herpesvirus 5
augcuuuccuggacacucuggcc

SEQ ID NO: 3978410 - RNA, 21 nt, Human herpesvirus 5
auggaaauacaugaugaaugu

SEQ ID NO: 3978411 - RNA, 15 nt, Human herpesvirus 5
auggacugucugcac

SEQ ID NO: 3978412 - RNA, 17 nt, Human herpesvirus 5
auggagccgcaagugcu

SEQ ID NO: 3978413 - RNA, 13 nt, Human herpesvirus 5
auggcuggugugu

SEQ ID NO: 3978414 - RNA, 18 nt, Human herpesvirus 5
augggaaacggacacuag

SEQ ID NO: 3978415 - RNA, 17 nt, Human herpesvirus 5
auggggucguggcucag

SEQ ID NO: 3978416 - RNA, 16 nt, Human herpesvirus 5
auggucguugcccacg

SEQ ID NO: 3978417 - RNA, 12 nt, Human herpesvirus 5
augucuccaagu

SEQ ID NO: 3978418 - RNA, 17 nt, Human herpesvirus 5
augucuuacaaaucaca

SEQ ID NO: 3978419 - RNA, 14 nt, Human herpesvirus 5
augugcuuaagcag

SEQ ID NO: 3978420 - RNA, 19 nt, Human herpesvirus 5
augugugggaccuggucaa

SEQ ID NO: 3978421 - RNA, 23 nt, Human herpesvirus 5
auguuuuuauauaauacacgugg

SEQ ID NO: 3978422 - RNA, 20 nt, Human herpesvirus 5
auuagccccacaugcugcuu

SEQ ID NO: 3978423 - RNA, 15 nt, Human herpesvirus 5
auucacaaaaacacc

SEQ ID NO: 3978424 - RNA, 14 nt, Human herpesvirus 5
auucguaggcagcg

SEQ ID NO: 3978425 - RNA, 11 nt, Human herpesvirus 5
auucugacacg

SEQ ID NO: 3978426 - RNA, 20 nt, Human herpesvirus 5
auugacgcgguuuaucauga

SEQ ID NO: 3978427 - RNA, 15 nt, Human herpesvirus 5
auugcccuucuggag

SEQ ID NO: 3978428 - RNA, 15 nt, Human herpesvirus 5
auugcuuagcugcac

SEQ ID NO: 3978429 - RNA, 14 nt, Human herpesvirus 5
auugggcggacgug

SEQ ID NO: 3978430 - RNA, 22 nt, Human herpesvirus 5
auuugcgacaguugccggaacc

SEQ ID NO: 3978431 - RNA, 18 nt, Human herpesvirus 5
auuuuaugcgccgccagc

SEQ ID NO: 3978432 - RNA, 23 nt, Human herpesvirus 5
auuuugcgagagaugggccgcgg

SEQ ID NO: 3978433 - RNA, 13 nt, Human herpesvirus 5
auuuuugggcaua

SEQ ID NO: 3978434 - RNA, 20 nt, Human herpesvirus 5
auuuuuucggccgcggaggu

SEQ ID NO: 3978435 - RNA, 15 nt, Human herpesvirus 5
auuuuuuguaacacu

SEQ ID NO: 3978436 - RNA, 14 nt, Human herpesvirus 5
caaaagaagcugcc

SEQ ID NO: 3978437 - RNA, 23 nt, Human herpesvirus 5
caaacgccgcgacaacggccgcc

SEQ ID NO: 3978438 - RNA, 14 nt, Human herpesvirus 5
caaacgcugcuugg

SEQ ID NO: 3978439 - RNA, 19 nt, Human herpesvirus 5
caaagaaaagaaaaaaugg

SEQ ID NO: 3978440 - RNA, 15 nt, Human herpesvirus 5
caaagaacgaaaaca

SEQ ID NO: 3978441 - RNA, 22 nt, Human herpesvirus 5
caaaggacucgcucacgucguu

SEQ ID NO: 3978442 - RNA, 13 nt, Human herpesvirus 5
caaaguucaaagu

SEQ ID NO: 3978443 - RNA, 14 nt, Human herpesvirus 5
caacagcgggucaa

SEQ ID NO: 3978444 - RNA, 17 nt, Human herpesvirus 5
caaccacgucggggcug

SEQ ID NO: 3978445 - RNA, 20 nt, Human herpesvirus 5
caaccauuggcaacaucacc

SEQ ID NO: 3978446 - RNA, 17 nt, Human herpesvirus 5
caaccgcauccugccca

SEQ ID NO: 3978447 - RNA, 15 nt, Human herpesvirus 5
caaccguauauucua

SEQ ID NO: 3978448 - RNA, 20 nt, Human herpesvirus 5
caacgacguuuaaaguaaau

SEQ ID NO: 3978449 - RNA, 15 nt, Human herpesvirus 5
caacgcguggcccug

SEQ ID NO: 3978450 - RNA, 14 nt, Human herpesvirus 5
caacgcuuuggaaa

SEQ ID NO: 3978451 - RNA, 17 nt, Human herpesvirus 5
caacggccgccgcagcc

SEQ ID NO: 3978452 - RNA, 23 nt, Human herpesvirus 5
caacguggaaggcggcucgcugg

SEQ ID NO: 3978453 - RNA, 16 nt, Human herpesvirus 5
caacguucacgcugcu

SEQ ID NO: 3978454 - RNA, 19 nt, Human herpesvirus 5
caacuaucaccaaacaaca

SEQ ID NO: 3978455 - RNA, 13 nt, Human herpesvirus 5
caacuuaaccaca

SEQ ID NO: 3978456 - RNA, 17 nt, Human herpesvirus 5
caacuucuaccaucucc

SEQ ID NO: 3978457 - RNA, 15 nt, Human herpesvirus 5
caagagcaugcugug

SEQ ID NO: 3978458 - RNA, 21 nt, Human herpesvirus 5
caagagcaugcugugggccca

SEQ ID NO: 3978459 - RNA, 20 nt, Human herpesvirus 5
caagcgcccgaagccgcgcg

SEQ ID NO: 3978460 - RNA, 12 nt, Human herpesvirus 5
caagcggccgcc

SEQ ID NO: 3978461 - RNA, 22 nt, Human herpesvirus 5
caaggagcgacguaccagcugu

SEQ ID NO: 3978462 - RNA, 22 nt, Human herpesvirus 5
caaggugauuauuaaaccgccc

SEQ ID NO: 3978463 - RNA, 20 nt, Human herpesvirus 5
caagucccuggccccggcca

SEQ ID NO: 3978464 - RNA, 20 nt, Human herpesvirus 5
caauaaagacgucaaugaca

SEQ ID NO: 3978465 - RNA, 15 nt, Human herpesvirus 5
caauaaguaccucua

SEQ ID NO: 3978466 - RNA, 23 nt, Human herpesvirus 5
caaucaaaccuguuccugucaau

SEQ ID NO: 3978467 - RNA, 20 nt, Human herpesvirus 5
caaugacacucgaagcaaca

SEQ ID NO: 3978468 - RNA, 19 nt, Human herpesvirus 5
caauugcgggcccugcuga

SEQ ID NO: 3978469 - RNA, 21 nt, Human herpesvirus 5
cacaacggccgccgacgucgc

SEQ ID NO: 3978470 - RNA, 14 nt, Human herpesvirus 5
cacaagcgcccgaa

SEQ ID NO: 3978471 - RNA, 17 nt, Human herpesvirus 5
cacacaggccagcugcc

SEQ ID NO: 3978472 - RNA, 19 nt, Human herpesvirus 5
cacacaucugucaccucac

SEQ ID NO: 3978473 - RNA, 16 nt, Human herpesvirus 5
cacaccugccucgaca

SEQ ID NO: 3978474 - RNA, 23 nt, Human herpesvirus 5
cacacgguccgugggagacgcgg

SEQ ID NO: 3978475 - RNA, 18 nt, Human herpesvirus 5
cacacugggagacggccu

SEQ ID NO: 3978476 - RNA, 11 nt, Human herpesvirus 5
cacagaagaaa

SEQ ID NO: 3978477 - RNA, 12 nt, Human herpesvirus 5
cacagcagcacc

SEQ ID NO: 3978478 - RNA, 14 nt, Human herpesvirus 5
cacagcagcaccag

SEQ ID NO: 3978479 - RNA, 23 nt, Human herpesvirus 5
cacagcggaaaaugccgccgcca

SEQ ID NO: 3978480 - RNA, 23 nt, Human herpesvirus 5
cacagguagguggccaugaugac

SEQ ID NO: 3978481 - RNA, 14 nt, Human herpesvirus 5
caccacucccacca

SEQ ID NO: 3978482 - RNA, 21 nt, Human herpesvirus 5
caccaguuccugcgcgccuac

SEQ ID NO: 3978483 - RNA, 12 nt, Human herpesvirus 5
cacccaggccgc

SEQ ID NO: 3978484 - RNA, 18 nt, Human herpesvirus 5
cacccccgcgacccucgc

SEQ ID NO: 3978485 - RNA, 12 nt, Human herpesvirus 5
cacccgcggccg

SEQ ID NO: 3978486 - RNA, 20 nt, Human herpesvirus 5
cacccguacgcgcaggcagc

SEQ ID NO: 3978487 - RNA, 23 nt, Human herpesvirus 5
caccgacacagcagcaccaggcg

SEQ ID NO: 3978488 - RNA, 20 nt, Human herpesvirus 5
caccgagacgugcgaccugg

SEQ ID NO: 3978489 - RNA, 15 nt, Human herpesvirus 5
caccgaugccggccu

SEQ ID NO: 3978490 - RNA, 20 nt, Human herpesvirus 5
caccgcuuuggucguagacg

SEQ ID NO: 3978491 - RNA, 22 nt, Human herpesvirus 5
caccguaucagcuaccgccgca

SEQ ID NO: 3978492 - RNA, 17 nt, Human herpesvirus 5
caccgucaccacuccca

SEQ ID NO: 3978493 - RNA, 14 nt, Human herpesvirus 5
caccgucccucagc

SEQ ID NO: 3978494 - RNA, 18 nt, Human herpesvirus 5
caccguguucucccgacg

SEQ ID NO: 3978495 - RNA, 23 nt, Human herpesvirus 5
caccguugucggaggaacccugc

SEQ ID NO: 3978496 - RNA, 19 nt, Human herpesvirus 5
caccguuuucaugcccguc

SEQ ID NO: 3978497 - RNA, 13 nt, Human herpesvirus 5
cacgacgcaugca

SEQ ID NO: 3978498 - RNA, 17 nt, Human herpesvirus 5
cacgcaggugaggcucu

SEQ ID NO: 3978499 - RNA, 23 nt, Human herpesvirus 5
cacgccccugaguucacgcgcgg

SEQ ID NO: 3978500 - RNA, 17 nt, Human herpesvirus 5
cacgccgaugcuccgcg

SEQ ID NO: 3978501 - RNA, 15 nt, Human herpesvirus 5
cacgccgcgcgaacg

SEQ ID NO: 3978502 - RNA, 21 nt, Human herpesvirus 5
cacgcggcucacguagcaggc

SEQ ID NO: 3978503 - RNA, 16 nt, Human herpesvirus 5
cacgcgucgucaaaaa

SEQ ID NO: 3978504 - RNA, 18 nt, Human herpesvirus 5
cacgcugacaacccacuc

SEQ ID NO: 3978505 - RNA, 17 nt, Human herpesvirus 5
cacggacacgacaaaug

SEQ ID NO: 3978506 - RNA, 18 nt, Human herpesvirus 5
cacggagcacgggcugcu

SEQ ID NO: 3978507 - RNA, 18 nt, Human herpesvirus 5
cacggccagcuccacgcu

SEQ ID NO: 3978508 - RNA, 15 nt, Human herpesvirus 5
cacggcgaaccgccg

SEQ ID NO: 3978509 - RNA, 19 nt, Human herpesvirus 5
cacggcgaaccgccgucgc

SEQ ID NO: 3978510 - RNA, 19 nt, Human herpesvirus 5
cacggcggcggccugcucg

SEQ ID NO: 3978511 - RNA, 16 nt, Human herpesvirus 5
cacgggacccgccgcc

SEQ ID NO: 3978512 - RNA, 22 nt, Human herpesvirus 5
cacgggcucguguggcagcugg

SEQ ID NO: 3978513 - RNA, 19 nt, Human herpesvirus 5
cacgguggccaacaagcgg

SEQ ID NO: 3978514 - RNA, 16 nt, Human herpesvirus 5
cacgguuucuucccau

SEQ ID NO: 3978515 - RNA, 22 nt, Human herpesvirus 5
cacgucgaccaggugcugucgc

SEQ ID NO: 3978516 - RNA, 19 nt, Human herpesvirus 5
cacgucggcucgaagaggu

SEQ ID NO: 3978517 - RNA, 19 nt, Human herpesvirus 5
cacgucggggcugugucgc

SEQ ID NO: 3978518 - RNA, 19 nt, Human herpesvirus 5
cacuaauuuauccaagaua

SEQ ID NO: 3978519 - RNA, 12 nt, Human herpesvirus 5
cacuagccgggc

SEQ ID NO: 3978520 - RNA, 19 nt, Human herpesvirus 5
cacucacgcggccgucacg

SEQ ID NO: 3978521 - RNA, 13 nt, Human herpesvirus 5
cacucgcucgcuu

SEQ ID NO: 3978522 - RNA, 13 nt, Human herpesvirus 5
cacucuggcccug

SEQ ID NO: 3978523 - RNA, 18 nt, Human herpesvirus 5
cacucuggcccugcugua

SEQ ID NO: 3978524 - RNA, 22 nt, Human herpesvirus 5
cacugacaagucguuucagccc

SEQ ID NO: 3978525 - RNA, 14 nt, Human herpesvirus 5
cacuuuacauaaaa

SEQ ID NO: 3978526 - RNA, 19 nt, Human herpesvirus 5
cacuuuccacggcgccggu

SEQ ID NO: 3978527 - RNA, 21 nt, Human herpesvirus 5
cagaccgcaacaacagcagca

SEQ ID NO: 3978528 - RNA, 15 nt, Human herpesvirus 5
cagacgucggcgguc

SEQ ID NO: 3978529 - RNA, 18 nt, Human herpesvirus 5
cagacuuucgacgugcgc

SEQ ID NO: 3978530 - RNA, 19 nt, Human herpesvirus 5
cagagccaccaggugccgg

SEQ ID NO: 3978531 - RNA, 22 nt, Human herpesvirus 5
cagagccaccaggugccggcga

SEQ ID NO: 3978532 - RNA, 22 nt, Human herpesvirus 5
cagagggucguuguccuccucg

SEQ ID NO: 3978533 - RNA, 21 nt, Human herpesvirus 5
cagaucgucuacggcuccaca

SEQ ID NO: 3978534 - RNA, 15 nt, Human herpesvirus 5
cagcaacaacagucg

SEQ ID NO: 3978535 - RNA, 16 nt, Human herpesvirus 5
cagcacauuagacaca

SEQ ID NO: 3978536 - RNA, 23 nt, Human herpesvirus 5
cagcacauuguaugccgauacac

SEQ ID NO: 3978537 - RNA, 14 nt, Human herpesvirus 5
cagcagcaccaggc

SEQ ID NO: 3978538 - RNA, 12 nt, Human herpesvirus 5
cagcagcagcug

SEQ ID NO: 3978539 - RNA, 18 nt, Human herpesvirus 5
cagcaguaugacgugcga

SEQ ID NO: 3978540 - RNA, 13 nt, Human herpesvirus 5
cagcauacgggga

SEQ ID NO: 3978541 - RNA, 17 nt, Human herpesvirus 5
cagcauacggggaggag

SEQ ID NO: 3978542 - RNA, 16 nt, Human herpesvirus 5
cagcaucgcgugcgcc

SEQ ID NO: 3978543 - RNA, 20 nt, Human herpesvirus 5
cagccaccgcgaggccaccc

SEQ ID NO: 3978544 - RNA, 12 nt, Human herpesvirus 5
cagcccagggau

SEQ ID NO: 3978545 - RNA, 17 nt, Human herpesvirus 5
cagcccauccucgugga

SEQ ID NO: 3978546 - RNA, 15 nt, Human herpesvirus 5
cagccccgucaaaac

SEQ ID NO: 3978547 - RNA, 13 nt, Human herpesvirus 5
cagcccgaggugu

SEQ ID NO: 3978548 - RNA, 18 nt, Human herpesvirus 5
cagcgagcucgaggaggg

SEQ ID NO: 3978549 - RNA, 14 nt, Human herpesvirus 5
cagcgagcugcgcg

SEQ ID NO: 3978550 - RNA, 21 nt, Human herpesvirus 5
cagcgccaccauagccacuac

SEQ ID NO: 3978551 - RNA, 15 nt, Human herpesvirus 5
cagcgcggcggcagc

SEQ ID NO: 3978552 - RNA, 20 nt, Human herpesvirus 5
cagcggccgccggugcuucu

SEQ ID NO: 3978553 - RNA, 17 nt, Human herpesvirus 5
cagcggcgacagacggc

SEQ ID NO: 3978554 - RNA, 16 nt, Human herpesvirus 5
cagcgucacagagggc

SEQ ID NO: 3978555 - RNA, 13 nt, Human herpesvirus 5
cagcgucuggcca

SEQ ID NO: 3978556 - RNA, 18 nt, Human herpesvirus 5
cagcgugcaccugcugcc

SEQ ID NO: 3978557 - RNA, 20 nt, Human herpesvirus 5
cagcgugcucagcugguggc

SEQ ID NO: 3978558 - RNA, 17 nt, Human herpesvirus 5
cagcucguggaccucac

SEQ ID NO: 3978559 - RNA, 15 nt, Human herpesvirus 5
cagcugcgccuggac

SEQ ID NO: 3978560 - RNA, 12 nt, Human herpesvirus 5
cagcuggcuugu

SEQ ID NO: 3978561 - RNA, 22 nt, Human herpesvirus 5
ucguuaccacaacggccgccga

SEQ ID NO: 3978562 - RNA, 18 nt, Human herpesvirus 5
ucuacagcauggacuguc

SEQ ID NO: 3978563 - RNA, 16 nt, Human herpesvirus 5
ucuaccccgccgccgu

SEQ ID NO: 3978564 - RNA, 18 nt, Human herpesvirus 5
ucuauaaacgguuucuca

SEQ ID NO: 3978565 - RNA, 20 nt, Human herpesvirus 5
ucuccaucaggaucuggugc

SEQ ID NO: 3978566 - RNA, 14 nt, Human herpesvirus 5
ucuccgagcccccg

SEQ ID NO: 3978567 - RNA, 11 nt, Human herpesvirus 5
ucuccugugga

SEQ ID NO: 3978568 - RNA, 12 nt, Human herpesvirus 5
ucucgagcccca

SEQ ID NO: 3978569 - RNA, 13 nt, Human herpesvirus 5
ucucgcguucgug

SEQ ID NO: 3978570 - RNA, 15 nt, Human herpesvirus 5
ucucggagccgccga

SEQ ID NO: 3978571 - RNA, 15 nt, Human herpesvirus 5
ucugaaucugcucca

SEQ ID NO: 3978572 - RNA, 23 nt, Human herpesvirus 5
ucugaccuugcugaugugccagc

SEQ ID NO: 3978573 - RNA, 20 nt, Human herpesvirus 5
ucugcauagaguuacaugca

SEQ ID NO: 3978574 - RNA, 17 nt, Human herpesvirus 5
ucugcgacuccuggacc

SEQ ID NO: 3978575 - RNA, 20 nt, Human herpesvirus 5
ucugcgcgggcagcccaagu

SEQ ID NO: 3978576 - RNA, 15 nt, Human herpesvirus 5
ucuggcgaucugccu

SEQ ID NO: 3978577 - RNA, 20 nt, Human herpesvirus 5
ucuggugcuauggcugcuca

SEQ ID NO: 3978578 - RNA, 14 nt, Human herpesvirus 5
ucuguauauucagu

SEQ ID NO: 3978579 - RNA, 15 nt, Human herpesvirus 5
ucuguucuuccacca

SEQ ID NO: 3978580 - RNA, 11 nt, Human herpesvirus 5
ucuuaagaaac

SEQ ID NO: 3978581 - RNA, 12 nt, Human herpesvirus 5
ucuuccuccucg

SEQ ID NO: 3978582 - RNA, 12 nt, Human herpesvirus 5
ucuucuaccugg

SEQ ID NO: 3978583 - RNA, 15 nt, Human herpesvirus 5
ucuugcgcccucucg

SEQ ID NO: 3978584 - RNA, 21 nt, Human herpesvirus 5
ucuuggguagcuucucucugg

SEQ ID NO: 3978585 - RNA, 23 nt, Human herpesvirus 5
ucuugucgucauucgggccagga

SEQ ID NO: 3978586 - RNA, 21 nt, Human herpesvirus 5
ugaacgagucgcucaucguca

SEQ ID NO: 3978587 - RNA, 14 nt, Human herpesvirus 5
ugaagcggagugca

SEQ ID NO: 3978588 - RNA, 14 nt, Human herpesvirus 5
ugaagguaaagccc

SEQ ID NO: 3978589 - RNA, 14 nt, Human herpesvirus 5
ugaaguuguugauc

SEQ ID NO: 3978590 - RNA, 23 nt, Human herpesvirus 5
ugaaucuuccccucugcugcugg

SEQ ID NO: 3978591 - RNA, 17 nt, Human herpesvirus 5
ugaauugcgaagccagc

SEQ ID NO: 3978592 - RNA, 20 nt, Human herpesvirus 5
ugacacauagcguaccccug

SEQ ID NO: 3978593 - RNA, 20 nt, Human herpesvirus 5
ugaccuggguagcaaguccu

SEQ ID NO: 3978594 - RNA, 23 nt, Human herpesvirus 5
ugacgacggcgugguauccacgc

SEQ ID NO: 3978595 - RNA, 15 nt, Human herpesvirus 5
ugacgcggucgccgc

SEQ ID NO: 3978596 - RNA, 16 nt, Human herpesvirus 5
ugacgcugcuggccga

SEQ ID NO: 3978597 - RNA, 21 nt, Human herpesvirus 5
ugacggauaaacacgacaucc

SEQ ID NO: 3978598 - RNA, 16 nt, Human herpesvirus 5
ugacggcgacaucacg

SEQ ID NO: 3978599 - RNA, 20 nt, Human herpesvirus 5
ugacgucgcggcaccaggaa

SEQ ID NO: 3978600 - RNA, 19 nt, Human herpesvirus 5
ugacgugcucaagagguga

SEQ ID NO: 3978601 - RNA, 18 nt, Human herpesvirus 5
ugacuaccuuguuuuuua

SEQ ID NO: 3978602 - RNA, 15 nt, Human herpesvirus 5
ugagacaggacgagg

SEQ ID NO: 3978603 - RNA, 16 nt, Human herpesvirus 5
ugagauacauguucau

SEQ ID NO: 3978604 - RNA, 15 nt, Human herpesvirus 5
ugaggagggugguga

SEQ ID NO: 3978605 - RNA, 22 nt, Human herpesvirus 5
ugaggcgcucgugaaacagcag

SEQ ID NO: 3978606 - RNA, 22 nt, Human herpesvirus 5
ugaggcggcguggacugggacg

SEQ ID NO: 3978607 - RNA, 13 nt, Human herpesvirus 5
ugagguacugcag

SEQ ID NO: 3978608 - RNA, 14 nt, Human herpesvirus 5
ugaucgugggccag

SEQ ID NO: 3978609 - RNA, 24 nt, Human herpesvirus 5
ugaugcgcgaacaggccgccaucc

SEQ ID NO: 3978610 - RNA, 18 nt, Human herpesvirus 5
ugaugggugagggucgug

SEQ ID NO: 3978611 - RNA, 14 nt, Human herpesvirus 5
ugaugugccagccg

SEQ ID NO: 3978612 - RNA, 18 nt, Human herpesvirus 5
ugcaaagucaacauguag

SEQ ID NO: 3978613 - RNA, 17 nt, Human herpesvirus 5
ugcaaaguuauccuguu

SEQ ID NO: 3978614 - RNA, 17 nt, Human herpesvirus 5
ugcaacgccuggcguga

SEQ ID NO: 3978615 - RNA, 21 nt, Human herpesvirus 5
ugcacaccaguauugguucug

SEQ ID NO: 3978616 - RNA, 22 nt, Human herpesvirus 5
ugcacccccgauaugggccgcu

SEQ ID NO: 3978617 - RNA, 16 nt, Human herpesvirus 5
ugcaccucgaccuccg

SEQ ID NO: 3978618 - RNA, 17 nt, Human herpesvirus 5
ugcaccucgaccuccga

SEQ ID NO: 3978619 - RNA, 13 nt, Human herpesvirus 5
ugcacgccgccgu

SEQ ID NO: 3978620 - RNA, 18 nt, Human herpesvirus 5
ugcacgggcucgggugac

SEQ ID NO: 3978621 - RNA, 18 nt, Human herpesvirus 5
ugcacuuccuguacacau

SEQ ID NO: 3978622 - RNA, 14 nt, Human herpesvirus 5
ugcagacgguggug

SEQ ID NO: 3978623 - RNA, 15 nt, Human herpesvirus 5
ugcagcuuuugcacg

SEQ ID NO: 3978624 - RNA, 17 nt, Human herpesvirus 5
ugccauggaccugaccu

SEQ ID NO: 3978625 - RNA, 19 nt, Human herpesvirus 5
ugcccgaccacgacacggu

SEQ ID NO: 3978626 - RNA, 22 nt, Human herpesvirus 5
ugcccgaccacgacacggugcu

SEQ ID NO: 3978627 - RNA, 20 nt, Human herpesvirus 5
ugcccguuuucacagcagcc

SEQ ID NO: 3978628 - RNA, 14 nt, Human herpesvirus 5
ugcccugugggccc

SEQ ID NO: 3978629 - RNA, 15 nt, Human herpesvirus 5
ugcccugugggccca

SEQ ID NO: 3978630 - RNA, 21 nt, Human herpesvirus 5
ugccgcacgcgcuagccuuuc

SEQ ID NO: 3978631 - RNA, 11 nt, Human herpesvirus 5
ugccgccgcca

SEQ ID NO: 3978632 - RNA, 24 nt, Human herpesvirus 5
ugccgccgccaacgccgagcucug

SEQ ID NO: 3978633 - RNA, 19 nt, Human herpesvirus 5
ugccgugacgucgcggcac

SEQ ID NO: 3978634 - RNA, 22 nt, Human herpesvirus 5
ugccgugacgucgcggcaccag

SEQ ID NO: 3978635 - RNA, 14 nt, Human herpesvirus 5
ugccucuacuugga

SEQ ID NO: 3978636 - RNA, 16 nt, Human herpesvirus 5
ugccuguuccugcugc

SEQ ID NO: 3978637 - RNA, 15 nt, Human herpesvirus 5
ugcgaaguguugacc

SEQ ID NO: 3978638 - RNA, 16 nt, Human herpesvirus 5
ugcgacgccaugcuca

SEQ ID NO: 3978639 - RNA, 18 nt, Human herpesvirus 5
ugcgagcgggguucaccu

SEQ ID NO: 3978640 - RNA, 18 nt, Human herpesvirus 5
ugcgauuuggaccuggag

SEQ ID NO: 3978641 - RNA, 17 nt, Human herpesvirus 5
ugcgccguuuugcuguc

SEQ ID NO: 3978642 - RNA, 13 nt, Human herpesvirus 5
ugcgccuuccagu

SEQ ID NO: 3978643 - RNA, 14 nt, Human herpesvirus 5
ugcgcgacacggcu

SEQ ID NO: 3978644 - RNA, 16 nt, Human herpesvirus 5
ugcgcgccuccguccu

SEQ ID NO: 3978645 - RNA, 11 nt, Human herpesvirus 5
ugcgcgcggcg

SEQ ID NO: 3978646 - RNA, 14 nt, Human herpesvirus 5
ugcgcuucugcagc

SEQ ID NO: 3978647 - RNA, 15 nt, Human herpesvirus 5
ugcggcacagcgucg

SEQ ID NO: 3978648 - RNA, 18 nt, Human herpesvirus 5
ugcggcguucgcgugcac

SEQ ID NO: 3978649 - RNA, 19 nt, Human herpesvirus 5
ugcgggaacuggccuggcg

SEQ ID NO: 3978650 - RNA, 15 nt, Human herpesvirus 5
ugcgggguggugcuc

SEQ ID NO: 3978651 - RNA, 16 nt, Human herpesvirus 5
ugcgucaagacgggcc

SEQ ID NO: 3978652 - RNA, 15 nt, Human herpesvirus 5
ugcgugucgcugggc

SEQ ID NO: 3978653 - RNA, 20 nt, Human herpesvirus 5
ugcuauaccucaguuauccc

SEQ ID NO: 3978654 - RNA, 20 nt, Human herpesvirus 5
ugcuccucggagcacgggcg

SEQ ID NO: 3978655 - RNA, 15 nt, Human herpesvirus 5
ugcucuaaaaacacc

SEQ ID NO: 3978656 - RNA, 15 nt, Human herpesvirus 5
ugcucucccgcaugg

SEQ ID NO: 3978657 - RNA, 16 nt, Human herpesvirus 5
ugcugauucgcgccgu

SEQ ID NO: 3978658 - RNA, 15 nt, Human herpesvirus 5
ugcugcaacggccgu

SEQ ID NO: 3978659 - RNA, 23 nt, Human herpesvirus 5
ugcugcaaggccucuaucugcgc

SEQ ID NO: 3978660 - RNA, 14 nt, Human herpesvirus 5
ugcugccgggcggc

SEQ ID NO: 3978661 - RNA, 20 nt, Human herpesvirus 5
cagcuuaccgccaccgucgc

SEQ ID NO: 3978662 - RNA, 21 nt, Human herpesvirus 5
cagcuucuuucucaccgugcu

SEQ ID NO: 3978663 - RNA, 12 nt, Human herpesvirus 5
caggaaaguaug

SEQ ID NO: 3978664 - RNA, 19 nt, Human herpesvirus 5
caggaacacgguggcuuuc

SEQ ID NO: 3978665 - RNA, 17 nt, Human herpesvirus 5
caggacgucaaccacgu

SEQ ID NO: 3978666 - RNA, 19 nt, Human herpesvirus 5
caggcacgucauugacagc

SEQ ID NO: 3978667 - RNA, 16 nt, Human herpesvirus 5
caggccagcugcgucg

SEQ ID NO: 3978668 - RNA, 15 nt, Human herpesvirus 5
caggccgacucgcgg

SEQ ID NO: 3978669 - RNA, 22 nt, Human herpesvirus 5
caggccgccgcucaagccgcgg

SEQ ID NO: 3978670 - RNA, 19 nt, Human herpesvirus 5
caggcgaugcgcacggccg

SEQ ID NO: 3978671 - RNA, 23 nt, Human herpesvirus 5
caggcgcaggaggcuaacgcgcu

SEQ ID NO: 3978672 - RNA, 13 nt, Human herpesvirus 5
caggcggagauga

SEQ ID NO: 3978673 - RNA, 12 nt, Human herpesvirus 5
caggcuaaagaa

SEQ ID NO: 3978674 - RNA, 18 nt, Human herpesvirus 5
cagggaaagguuauauaa

SEQ ID NO: 3978675 - RNA, 20 nt, Human herpesvirus 5
cagggcugggauccgccgcc

SEQ ID NO: 3978676 - RNA, 17 nt, Human herpesvirus 5
caggggcuggacguggu

SEQ ID NO: 3978677 - RNA, 22 nt, Human herpesvirus 5
cagguaaaaacaacguguguga

SEQ ID NO: 3978678 - RNA, 19 nt, Human herpesvirus 5
cagguucugaaucugcucc

SEQ ID NO: 3978679 - RNA, 20 nt, Human herpesvirus 5
caguaccgacgacgacaguc

SEQ ID NO: 3978680 - RNA, 20 nt, Human herpesvirus 5
caguaccuggacgcggugaa

SEQ ID NO: 3978681 - RNA, 13 nt, Human herpesvirus 5
caguacgauccuc

SEQ ID NO: 3978682 - RNA, 23 nt, Human herpesvirus 5
caguacggccucugggcugagac

SEQ ID NO: 3978683 - RNA, 22 nt, Human herpesvirus 5
caguacggcuuucugcggaaug

SEQ ID NO: 3978684 - RNA, 15 nt, Human herpesvirus 5
gucgccuacacccgu

SEQ ID NO: 3978685 - RNA, 15 nt, Human herpesvirus 5
gucgcguguaggcga

SEQ ID NO: 3978686 - RNA, 17 nt, Human herpesvirus 5
uaccuagcuacuuugga

SEQ ID NO: 3978687 - RNA, 14 nt, Human herpesvirus 5
uaccuggaggagau

SEQ ID NO: 3978688 - RNA, 15 nt, Human herpesvirus 5
uacgcgaccagcugc

SEQ ID NO: 3978689 - RNA, 19 nt, Human herpesvirus 5
uacgcgccuuuugaucgcc

SEQ ID NO: 3978690 - RNA, 23 nt, Human herpesvirus 5
uacggcccggcagcaccaugccg

SEQ ID NO: 3978691 - RNA, 18 nt, Human herpesvirus 5
uacgugcgcgccacggcg

SEQ ID NO: 3978692 - RNA, 12 nt, Human herpesvirus 5
uacuauguguau

SEQ ID NO: 3978693 - RNA, 21 nt, Human herpesvirus 5
uacugcauccaucacaucacc

SEQ ID NO: 3978694 - RNA, 17 nt, Human herpesvirus 5
uacuucccccuccccuu

SEQ ID NO: 3978695 - RNA, 23 nt, Human herpesvirus 5
uagaccaaaccggacgcugccuc

SEQ ID NO: 3978696 - RNA, 21 nt, Human herpesvirus 5
uagacgauuuuaugcgccgcc

SEQ ID NO: 3978697 - RNA, 19 nt, Human herpesvirus 5
uagagcauuaagcauaguc

SEQ ID NO: 3978698 - RNA, 20 nt, Human herpesvirus 5
uagcaauaaucccuguaauu

SEQ ID NO: 3978699 - RNA, 17 nt, Human herpesvirus 5
uagcacgucagugguga

SEQ ID NO: 3978700 - RNA, 14 nt, Human herpesvirus 5
uagcccucugggcc

SEQ ID NO: 3978701 - RNA, 15 nt, Human herpesvirus 5
uagcgaucgcaugcu

SEQ ID NO: 3978702 - RNA, 16 nt, Human herpesvirus 5
uagcggcucgggcugg

SEQ ID NO: 3978703 - RNA, 21 nt, Human herpesvirus 5
uagcuagugcagccuuaggaa

SEQ ID NO: 3978704 - RNA, 12 nt, Human herpesvirus 5
uaggagacgagc

SEQ ID NO: 3978705 - RNA, 15 nt, Human herpesvirus 5
uaguauccacgucac

SEQ ID NO: 3978706 - RNA, 16 nt, Human herpesvirus 5
uauacaucuccgucuc

SEQ ID NO: 3978707 - RNA, 17 nt, Human herpesvirus 5
uauauucaaucauuacu

SEQ ID NO: 3978708 - RNA, 16 nt, Human herpesvirus 5
uaucagaaagcugcaa

SEQ ID NO: 3978709 - RNA, 14 nt, Human herpesvirus 5
uaucgcgacagaca

SEQ ID NO: 3978710 - RNA, 21 nt, Human herpesvirus 5
uaugauagaaagucacaggaa

SEQ ID NO: 3978711 - RNA, 14 nt, Human herpesvirus 5
uaugggggaacgcc

SEQ ID NO: 3978712 - RNA, 13 nt, Human herpesvirus 5
uauguaguccgua

SEQ ID NO: 3978713 - RNA, 11 nt, Human herpesvirus 5
uauucaacaau

SEQ ID NO: 3978714 - RNA, 13 nt, Human herpesvirus 5
uauuucuagagca

SEQ ID NO: 3978715 - RNA, 21 nt, Human herpesvirus 5
ucaaacagcacauuagacaca

SEQ ID NO: 3978716 - RNA, 12 nt, Human herpesvirus 5
ucaaaguucaaa

SEQ ID NO: 3978717 - RNA, 15 nt, Human herpesvirus 5
ucaacaaacagcucu

SEQ ID NO: 3978718 - RNA, 16 nt, Human herpesvirus 5
ucaacaaacagcucuu

SEQ ID NO: 3978719 - RNA, 20 nt, Human herpesvirus 5
ucaaccacgaguaacaccgu

SEQ ID NO: 3978720 - RNA, 17 nt, Human herpesvirus 5
ucaacgacgccacacac

SEQ ID NO: 3978721 - RNA, 15 nt, Human herpesvirus 5
ucaacgccugcacca

SEQ ID NO: 3978722 - RNA, 15 nt, Human herpesvirus 5
ucaaucacccacaga

SEQ ID NO: 3978723 - RNA, 19 nt, Human herpesvirus 5
ucacacaggccagcugcca

SEQ ID NO: 3978724 - RNA, 16 nt, Human herpesvirus 5
ucacaccuaucauaaa

SEQ ID NO: 3978725 - RNA, 13 nt, Human herpesvirus 5
ucacacugggaga

SEQ ID NO: 3978726 - RNA, 20 nt, Human herpesvirus 5
ucaccaccaucagcaaagcu

SEQ ID NO: 3978727 - RNA, 22 nt, Human herpesvirus 5
ucaccaccaucagcaaagcucc

SEQ ID NO: 3978728 - RNA, 17 nt, Human herpesvirus 5
ucaccaucgugccgcuc

SEQ ID NO: 3978729 - RNA, 15 nt, Human herpesvirus 5
ucacccgccucaugg

SEQ ID NO: 3978730 - RNA, 20 nt, Human herpesvirus 5
ucaccgaguccaucauguuc

SEQ ID NO: 3978731 - RNA, 14 nt, Human herpesvirus 5
ucaccgaugccggc

SEQ ID NO: 3978732 - RNA, 17 nt, Human herpesvirus 5
ucaccgcaguugcugcc

SEQ ID NO: 3978733 - RNA, 18 nt, Human herpesvirus 5
ucaccuagacgcaaacgc

SEQ ID NO: 3978734 - RNA, 14 nt, Human herpesvirus 5
ucacgccagacuug

SEQ ID NO: 3978735 - RNA, 22 nt, Human herpesvirus 5
ucacgcgcggaacccacaaagg

SEQ ID NO: 3978736 - RNA, 14 nt, Human herpesvirus 5
ucacuaucuucaac

SEQ ID NO: 3978737 - RNA, 17 nt, Human herpesvirus 5
ucacuaucuucaaccuc

SEQ ID NO: 3978738 - RNA, 22 nt, Human herpesvirus 5
ucagaaagcaccagaacccguc

SEQ ID NO: 3978739 - RNA, 20 nt, Human herpesvirus 5
ucagaccgcaacaacagcag

SEQ ID NO: 3978740 - RNA, 21 nt, Human herpesvirus 5
ucagaccgcaacaacagcagc

SEQ ID NO: 3978741 - RNA, 13 nt, Human herpesvirus 5
ucagccgugagaa

SEQ ID NO: 3978742 - RNA, 20 nt, Human herpesvirus 5
ucagcuaccgccgcaacagc

SEQ ID NO: 3978743 - RNA, 18 nt, Human herpesvirus 5
ucaggucgcccaggcuca

SEQ ID NO: 3978744 - RNA, 16 nt, Human herpesvirus 5
ucagucuauucucaac

SEQ ID NO: 3978745 - RNA, 19 nt, Human herpesvirus 5
ucaguguacacgcgcccag

SEQ ID NO: 3978746 - RNA, 21 nt, Human herpesvirus 5
ucauacaaaccccguguccgc

SEQ ID NO: 3978747 - RNA, 19 nt, Human herpesvirus 5
ucauauaaaagucuguaua

SEQ ID NO: 3978748 - RNA, 13 nt, Human herpesvirus 5
ucaucaacagcag

SEQ ID NO: 3978749 - RNA, 13 nt, Human herpesvirus 5
ucauggacccgcc

SEQ ID NO: 3978750 - RNA, 14 nt, Human herpesvirus 5
uccaaaacgugcca

SEQ ID NO: 3978751 - RNA, 16 nt, Human herpesvirus 5
uccaauaaacccaucc

SEQ ID NO: 3978752 - RNA, 19 nt, Human herpesvirus 5
uccaccacggcugcugauc

SEQ ID NO: 3978753 - RNA, 13 nt, Human herpesvirus 5
uccacggcgccgg

SEQ ID NO: 3978754 - RNA, 15 nt, Human herpesvirus 5
uccacuccaucacac

SEQ ID NO: 3978755 - RNA, 11 nt, Human herpesvirus 5
uccagccagca

SEQ ID NO: 3978756 - RNA, 17 nt, Human herpesvirus 5
uccagcuuaccgccacc

SEQ ID NO: 3978757 - RNA, 23 nt, Human herpesvirus 5
uccaggcggagaugaggacgacg

SEQ ID NO: 3978758 - RNA, 14 nt, Human herpesvirus 5
uccaugugcagcug

SEQ ID NO: 3978759 - RNA, 23 nt, Human herpesvirus 5
ucccaugcaacuucuucuacuca

SEQ ID NO: 3978760 - RNA, 20 nt, Human herpesvirus 5
uccccacccaguagacagac

SEQ ID NO: 3978761 - RNA, 13 nt, Human herpesvirus 5
ucccccugaucug

SEQ ID NO: 3978762 - RNA, 21 nt, Human herpesvirus 5
uccccgcaaacucccacuccu

SEQ ID NO: 3978763 - RNA, 17 nt, Human herpesvirus 5
uccccggugugucuauu

SEQ ID NO: 3978764 - RNA, 21 nt, Human herpesvirus 5
uccccuaguaauaccaccguc

SEQ ID NO: 3978765 - RNA, 14 nt, Human herpesvirus 5
uccccugacccucc

SEQ ID NO: 3978766 - RNA, 21 nt, Human herpesvirus 5
ucccgacaggcucgucguggg

SEQ ID NO: 3978767 - RNA, 22 nt, Human herpesvirus 5
ucccgcauagccucuacaaacu

SEQ ID NO: 3978768 - RNA, 19 nt, Human herpesvirus 5
ucccgcugugcuggccgcc

SEQ ID NO: 3978769 - RNA, 17 nt, Human herpesvirus 5
ucccucagccucugugu

SEQ ID NO: 3978770 - RNA, 12 nt, Human herpesvirus 5
ucccuccugcag

SEQ ID NO: 3978771 - RNA, 14 nt, Human herpesvirus 5
ucccucgcgccgcc

SEQ ID NO: 3978772 - RNA, 16 nt, Human herpesvirus 5
ucccucguuacccccg

SEQ ID NO: 3978773 - RNA, 16 nt, Human herpesvirus 5
ucccuggggcugcugc

SEQ ID NO: 3978774 - RNA, 19 nt, Human herpesvirus 5
uccgcgucggucgccgccu

SEQ ID NO: 3978775 - RNA, 21 nt, Human herpesvirus 5
uccgcgucggucgccgccucc

SEQ ID NO: 3978776 - RNA, 15 nt, Human herpesvirus 5
uccguuaccacgguu

SEQ ID NO: 3978777 - RNA, 17 nt, Human herpesvirus 5
uccuccucuuccucagu

SEQ ID NO: 3978778 - RNA, 17 nt, Human herpesvirus 5
uccucguccgggucuac

SEQ ID NO: 3978779 - RNA, 13 nt, Human herpesvirus 5
uccucgucgccuu

SEQ ID NO: 3978780 - RNA, 17 nt, Human herpesvirus 5
uccugcccaccgccucc

SEQ ID NO: 3978781 - RNA, 20 nt, Human herpesvirus 5
uccuggaucuuggcggccga

SEQ ID NO: 3978782 - RNA, 15 nt, Human herpesvirus 5
uccuguugcucuccu

SEQ ID NO: 3978783 - RNA, 11 nt, Human herpesvirus 5
uccuucaucuc

SEQ ID NO: 3978784 - RNA, 20 nt, Human herpesvirus 5
uccuuggaagagggaagcac

SEQ ID NO: 3978785 - RNA, 14 nt, Human herpesvirus 5
uccuuuuggcgcag

SEQ ID NO: 3978786 - RNA, 16 nt, Human herpesvirus 5
ucgacacuaauuuauc

SEQ ID NO: 3978787 - RNA, 19 nt, Human herpesvirus 5
ucgaccggcggcugcuguu

SEQ ID NO: 3978788 - RNA, 20 nt, Human herpesvirus 5
ucgacgaucuuuaguccgga

SEQ ID NO: 3978789 - RNA, 19 nt, Human herpesvirus 5
ucgacggcgguacugaagc

SEQ ID NO: 3978790 - RNA, 18 nt, Human herpesvirus 5
ucgacuggaggcucugug

SEQ ID NO: 3978791 - RNA, 23 nt, Human herpesvirus 5
ucgagcgcgcucuugaggcgcuc

SEQ ID NO: 3978792 - RNA, 12 nt, Human herpesvirus 5
ucgaucucaugu

SEQ ID NO: 3978793 - RNA, 13 nt, Human herpesvirus 5
ucgaugcugcaag

SEQ ID NO: 3978794 - RNA, 19 nt, Human herpesvirus 5
ucgauggggucguggcuca

SEQ ID NO: 3978795 - RNA, 17 nt, Human herpesvirus 5
ucgauuaccuacgucaa

SEQ ID NO: 3978796 - RNA, 17 nt, Human herpesvirus 5
ucgcagccacgcgcugg

SEQ ID NO: 3978797 - RNA, 18 nt, Human herpesvirus 5
ucgcaucaucaacagcag

SEQ ID NO: 3978798 - RNA, 20 nt, Human herpesvirus 5
ucgcaucaucaacagcagca

SEQ ID NO: 3978799 - RNA, 15 nt, Human herpesvirus 5
ucgcauccugcauca

SEQ ID NO: 3978800 - RNA, 19 nt, Human herpesvirus 5
ucgccaacuaccgugccac

SEQ ID NO: 3978801 - RNA, 16 nt, Human herpesvirus 5
gucggaugaggcaggc

SEQ ID NO: 3978802 - RNA, 18 nt, Human herpesvirus 5
gucggccgaucgcgccgc

SEQ ID NO: 3978803 - RNA, 15 nt, Human herpesvirus 5
gucggccugggcugc

SEQ ID NO: 3978804 - RNA, 13 nt, Human herpesvirus 5
gucggcgccgccg

SEQ ID NO: 3978805 - RNA, 21 nt, Human herpesvirus 5
gucggcugccuguuccugcug

SEQ ID NO: 3978806 - RNA, 23 nt, Human herpesvirus 5
gucggugauuucuugcuugcccg

SEQ ID NO: 3978807 - RNA, 17 nt, Human herpesvirus 5
gucgguggaaccgugcc

SEQ ID NO: 3978808 - RNA, 16 nt, Human herpesvirus 5
gucgugcucuugacgg

SEQ ID NO: 3978809 - RNA, 22 nt, Human herpesvirus 5
gucuccaugauugugccgcguu

SEQ ID NO: 3978810 - RNA, 22 nt, Human herpesvirus 5
gucucuaccaacgcuuccugcg

SEQ ID NO: 3978811 - RNA, 22 nt, Human herpesvirus 5
gucucuccaguccauauguugu

SEQ ID NO: 3978812 - RNA, 22 nt, Human herpesvirus 5
gucucuguuuuuuuuuguuaac

SEQ ID NO: 3978813 - RNA, 14 nt, Human herpesvirus 5
gucugagcgccgac

SEQ ID NO: 3978814 - RNA, 23 nt, Human herpesvirus 5
gucugcauguuggugccccagga

SEQ ID NO: 3978815 - RNA, 16 nt, Human herpesvirus 5
gucugcgacuccugga

SEQ ID NO: 3978816 - RNA, 21 nt, Human herpesvirus 5
gucugcgucaagacgggccug

SEQ ID NO: 3978817 - RNA, 19 nt, Human herpesvirus 5
gucuuggguagcuucucuc

SEQ ID NO: 3978818 - RNA, 14 nt, Human herpesvirus 5
gucuuuugcacgcg

SEQ ID NO: 3978819 - RNA, 16 nt, Human herpesvirus 5
gugaauucuggcaaga

SEQ ID NO: 3978820 - RNA, 19 nt, Human herpesvirus 5
gugacccgccccccggcag

SEQ ID NO: 3978821 - RNA, 14 nt, Human herpesvirus 5
gugacguggauacu

SEQ ID NO: 3978822 - RNA, 22 nt, Human herpesvirus 5
gugagggacccucgucggaagc

SEQ ID NO: 3978823 - RNA, 22 nt, Human herpesvirus 5
gugaucacguacguuuuccaaa

SEQ ID NO: 3978824 - RNA, 20 nt, Human herpesvirus 5
gugaucggccgcggugcgcu

SEQ ID NO: 3978825 - RNA, 19 nt, Human herpesvirus 5
gugaucgugggccaggacc

SEQ ID NO: 3978826 - RNA, 19 nt, Human herpesvirus 5
gugcaccugcugccgccac

SEQ ID NO: 3978827 - RNA, 19 nt, Human herpesvirus 5
gugcaucugccgaaacacc

SEQ ID NO: 3978828 - RNA, 17 nt, Human herpesvirus 5
gugcaugacaacgggaa

SEQ ID NO: 3978829 - RNA, 18 nt, Human herpesvirus 5
gugcccgaagaggacgaa

SEQ ID NO: 3978830 - RNA, 17 nt, Human herpesvirus 5
gugcccgucggcugccu

SEQ ID NO: 3978831 - RNA, 15 nt, Human herpesvirus 5
gugccgccgcugccg

SEQ ID NO: 3978832 - RNA, 15 nt, Human herpesvirus 5
gugccucauuuguau

SEQ ID NO: 3978833 - RNA, 14 nt, Human herpesvirus 5
gugccugcacgacc

SEQ ID NO: 3978834 - RNA, 14 nt, Human herpesvirus 5
gugcgccaagccau

SEQ ID NO: 3978835 - RNA, 13 nt, Human herpesvirus 5
gugcgcgccgccg

SEQ ID NO: 3978836 - RNA, 20 nt, Human herpesvirus 5
gugcuaccagcugcaggcag

SEQ ID NO: 3978837 - RNA, 20 nt, Human herpesvirus 5
gugcuacgagaucagccgug

SEQ ID NO: 3978838 - RNA, 13 nt, Human herpesvirus 5
gugcucaggccac

SEQ ID NO: 3978839 - RNA, 22 nt, Human herpesvirus 5
gugcucgacuuuacggugcgcg

SEQ ID NO: 3978840 - RNA, 18 nt, Human herpesvirus 5
gugcucgggcgugugggu

SEQ ID NO: 3978841 - RNA, 21 nt, Human herpesvirus 5
gugcugccgggcggcuuugcc

SEQ ID NO: 3978842 - RNA, 14 nt, Human herpesvirus 5
gugcuggcggccgu

SEQ ID NO: 3978843 - RNA, 11 nt, Human herpesvirus 5
guggaaggcac

SEQ ID NO: 3978844 - RNA, 14 nt, Human herpesvirus 5
guggaaggcaccgc

SEQ ID NO: 3978845 - RNA, 13 nt, Human herpesvirus 5
guggagggcgcgc

SEQ ID NO: 3978846 - RNA, 16 nt, Human herpesvirus 5
guggccgagcuaugcg

SEQ ID NO: 3978847 - RNA, 23 nt, Human herpesvirus 5
guggcugcacacggagcacgggc

SEQ ID NO: 3978848 - RNA, 12 nt, Human herpesvirus 5
guggcugggcuc

SEQ ID NO: 3978849 - RNA, 15 nt, Human herpesvirus 5
guggcugggcucacg

SEQ ID NO: 3978850 - RNA, 17 nt, Human herpesvirus 5
guggcuucucuggagac

SEQ ID NO: 3978851 - RNA, 16 nt, Human herpesvirus 5
gugggaaugguaaaga

SEQ ID NO: 3978852 - RNA, 22 nt, Human herpesvirus 5
gugggcaagaugggcaccgucu

SEQ ID NO: 3978853 - RNA, 22 nt, Human herpesvirus 5
guggggcugcgucgccugcgac

SEQ ID NO: 3978854 - RNA, 13 nt, Human herpesvirus 5
gugguaccugcaa

SEQ ID NO: 3978855 - RNA, 14 nt, Human herpesvirus 5
guggucgaugcuga

SEQ ID NO: 3978856 - RNA, 13 nt, Human herpesvirus 5
guggugacggugg

SEQ ID NO: 3978857 - RNA, 17 nt, Human herpesvirus 5
gugguggccgugcuggg

SEQ ID NO: 3978858 - RNA, 22 nt, Human herpesvirus 5
guggugguuguacgaguacacg

SEQ ID NO: 3978859 - RNA, 21 nt, Human herpesvirus 5
gugguguugccuucugcugcc

SEQ ID NO: 3978860 - RNA, 17 nt, Human herpesvirus 5
guguaccaucuggcgca

SEQ ID NO: 3978861 - RNA, 20 nt, Human herpesvirus 5
guguacgccaucuucaucuu

SEQ ID NO: 3978862 - RNA, 12 nt, Human herpesvirus 5
guguaugcaugu

SEQ ID NO: 3978863 - RNA, 19 nt, Human herpesvirus 5
guguccgcucaacuuucua

SEQ ID NO: 3978864 - RNA, 21 nt, Human herpesvirus 5
guguucccaacacgucccccc

SEQ ID NO: 3978865 - RNA, 18 nt, Human herpesvirus 5
guguuucgguccgaugua

SEQ ID NO: 3978866 - RNA, 17 nt, Human herpesvirus 5
guguuuucaccgacgug

SEQ ID NO: 3978867 - RNA, 18 nt, Human herpesvirus 5
guuaaggauucugagggc

SEQ ID NO: 3978868 - RNA, 14 nt, Human herpesvirus 5
guuacaaugucacu

SEQ ID NO: 3978869 - RNA, 23 nt, Human herpesvirus 5
guuacccugguauccaacuucac

SEQ ID NO: 3978870 - RNA, 14 nt, Human herpesvirus 5
guuaccggucacug

SEQ ID NO: 3978871 - RNA, 18 nt, Human herpesvirus 5
guuacgccggaggccgcc

SEQ ID NO: 3978872 - RNA, 15 nt, Human herpesvirus 5
guuaucuucccugag

SEQ ID NO: 3978873 - RNA, 15 nt, Human herpesvirus 5
guuauuucgugcgug

SEQ ID NO: 3978874 - RNA, 17 nt, Human herpesvirus 5
guucaucgucuacgucg

SEQ ID NO: 3978875 - RNA, 19 nt, Human herpesvirus 5
guucaucgucuacgucguu

SEQ ID NO: 3978876 - RNA, 14 nt, Human herpesvirus 5
guuccacggccagc

SEQ ID NO: 3978877 - RNA, 17 nt, Human herpesvirus 5
guuccuguaaauaaaaa

SEQ ID NO: 3978878 - RNA, 15 nt, Human herpesvirus 5
guucgucucugccuc

SEQ ID NO: 3978879 - RNA, 18 nt, Human herpesvirus 5
guugacccagggcugcuc

SEQ ID NO: 3978880 - RNA, 20 nt, Human herpesvirus 5
guugagcacgucuagcaggc

SEQ ID NO: 3978881 - RNA, 21 nt, Human herpesvirus 5
guuggaacccaucgaggaggc

SEQ ID NO: 3978882 - RNA, 17 nt, Human herpesvirus 5
guuggcuuacugccugc

SEQ ID NO: 3978883 - RNA, 22 nt, Human herpesvirus 5
guuguccucgcaccgggcuuug

SEQ ID NO: 3978884 - RNA, 14 nt, Human herpesvirus 5
guuguguuuugcuu

SEQ ID NO: 3978885 - RNA, 15 nt, Human herpesvirus 5
guuucucgcuuacgu

SEQ ID NO: 3978886 - RNA, 17 nt, Human herpesvirus 5
guuugcggcgcagacgu

SEQ ID NO: 3978887 - RNA, 11 nt, Human herpesvirus 5
guuuucuaguu

SEQ ID NO: 3978888 - RNA, 22 nt, Human herpesvirus 5
uaaaaugugcgaauuaggcaac

SEQ ID NO: 3978889 - RNA, 22 nt, Human herpesvirus 5
uaaagcuuucuuucucagucug

SEQ ID NO: 3978890 - RNA, 22 nt, Human herpesvirus 5
uaaaucacgucagguucacacg

SEQ ID NO: 3978891 - RNA, 18 nt, Human herpesvirus 5
uaaccacguugcgucgug

SEQ ID NO: 3978892 - RNA, 16 nt, Human herpesvirus 5
uaaccgagcugaagga

SEQ ID NO: 3978893 - RNA, 14 nt, Human herpesvirus 5
uaacggucaagaag

SEQ ID NO: 3978894 - RNA, 18 nt, Human herpesvirus 5
uaagcagccucuucgugg

SEQ ID NO: 3978895 - RNA, 16 nt, Human herpesvirus 5
uaagcgcgaccggcag

SEQ ID NO: 3978896 - RNA, 18 nt, Human herpesvirus 5
uaaggaaaacgugacuuu

SEQ ID NO: 3978897 - RNA, 22 nt, Human herpesvirus 5
uaauaagccggcagcugcuuuc

SEQ ID NO: 3978898 - RNA, 18 nt, Human herpesvirus 5
uaaugugucgcuauacac

SEQ ID NO: 3978899 - RNA, 15 nt, Human herpesvirus 5
uaauuguccuucucc

SEQ ID NO: 3978900 - RNA, 15 nt, Human herpesvirus 5
uacaagaaccacguu

SEQ ID NO: 3978901 - RNA, 22 nt, Human herpesvirus 5
uacaagacggcuauccagcagc

SEQ ID NO: 3978902 - RNA, 18 nt, Human herpesvirus 5
uacaaucauaauauucua

SEQ ID NO: 3978903 - RNA, 18 nt, Human herpesvirus 5
uacacgcacgcugguuac

SEQ ID NO: 3978904 - RNA, 17 nt, Human herpesvirus 5
uacagauacgcaaugca

SEQ ID NO: 3978905 - RNA, 14 nt, Human herpesvirus 5
uacauauacgugau

SEQ ID NO: 3978906 - RNA, 21 nt, Human herpesvirus 5
uacaucacugacaagucguuu

SEQ ID NO: 3978907 - RNA, 24 nt, Human herpesvirus 5
uacauugcccuucuggagcacacu

SEQ ID NO: 3978908 - RNA, 16 nt, Human herpesvirus 5
uaccagcccagggauc

SEQ ID NO: 3978909 - RNA, 18 nt, Human herpesvirus 5
ucgccgccgucgcgccuu

SEQ ID NO: 3978910 - RNA, 15 nt, Human herpesvirus 5
ucgccugcgacggcg

SEQ ID NO: 3978911 - RNA, 14 nt, Human herpesvirus 5
ucgcgagccccauc

SEQ ID NO: 3978912 - RNA, 17 nt, Human herpesvirus 5
ucgcgccuuccuccucu

SEQ ID NO: 3978913 - RNA, 20 nt, Human herpesvirus 5
ucgcucggccucgcucggaa

SEQ ID NO: 3978914 - RNA, 14 nt, Human herpesvirus 5
ucggcgccgccucg

SEQ ID NO: 3978915 - RNA, 15 nt, Human herpesvirus 5
ucgggcccgccacug

SEQ ID NO: 3978916 - RNA, 17 nt, Human herpesvirus 5
ucggggcgcagaaacuu

SEQ ID NO: 3978917 - RNA, 14 nt, Human herpesvirus 5
ucgucucaucacau

SEQ ID NO: 3978918 - RNA, 14 nt, Human herpesvirus 5
ucgucuccacguag

SEQ ID NO: 3978919 - RNA, 13 nt, Human herpesvirus 5
ucguguacuaccg

SEQ ID NO: 3978920 - RNA, 23 nt, Human herpesvirus 5
caguagcggguaauaaaaacaau

SEQ ID NO: 3978921 - RNA, 15 nt, Human herpesvirus 5
caguaugacgugcga

SEQ ID NO: 3978922 - RNA, 20 nt, Human herpesvirus 5
caguauuucuagagcacuga

SEQ ID NO: 3978923 - RNA, 23 nt, Human herpesvirus 5
cagucagacccacuaccuggagg

SEQ ID NO: 3978924 - RNA, 15 nt, Human herpesvirus 5
cagucagagagucug

SEQ ID NO: 3978925 - RNA, 20 nt, Human herpesvirus 5
caguccauugucaguauuuu

SEQ ID NO: 3978926 - RNA, 12 nt, Human herpesvirus 5
caguccgcuccg

SEQ ID NO: 3978927 - RNA, 22 nt, Human herpesvirus 5
cagucgacgggugguaccugca

SEQ ID NO: 3978928 - RNA, 19 nt, Human herpesvirus 5
cagugacgcuaggcggcgc

SEQ ID NO: 3978929 - RNA, 15 nt, Human herpesvirus 5
cagugcgucgcuguu

SEQ ID NO: 3978930 - RNA, 18 nt, Human herpesvirus 5
caguggcagcaggaccug

SEQ ID NO: 3978931 - RNA, 16 nt, Human herpesvirus 5
caguuaccaccgucgc

SEQ ID NO: 3978932 - RNA, 21 nt, Human herpesvirus 5
caguuuccgaagaugccgugu

SEQ ID NO: 3978933 - RNA, 20 nt, Human herpesvirus 5
cauaaugccgucaccgucgc

SEQ ID NO: 3978934 - RNA, 18 nt, Human herpesvirus 5
cauagcguaaauccccgu

SEQ ID NO: 3978935 - RNA, 14 nt, Human herpesvirus 5
cauauagccaauaa

SEQ ID NO: 3978936 - RNA, 22 nt, Human herpesvirus 5
cauauguagcacucaacauguu

SEQ ID NO: 3978937 - RNA, 14 nt, Human herpesvirus 5
caucacgcaaagca

SEQ ID NO: 3978938 - RNA, 22 nt, Human herpesvirus 5
caucaguuucugcggcguaccu

SEQ ID NO: 3978939 - RNA, 22 nt, Human herpesvirus 5
caucaucaacagcagcaacagc

SEQ ID NO: 3978940 - RNA, 13 nt, Human herpesvirus 5
caucauggcccaa

SEQ ID NO: 3978941 - RNA, 20 nt, Human herpesvirus 5
caucgaggaggccgcacugg

SEQ ID NO: 3978942 - RNA, 17 nt, Human herpesvirus 5
caucgcagccacgcgcu

SEQ ID NO: 3978943 - RNA, 21 nt, Human herpesvirus 5
caucgccgucgaguacgugcu

SEQ ID NO: 3978944 - RNA, 21 nt, Human herpesvirus 5
caucggcaacuucuuggugau

SEQ ID NO: 3978945 - RNA, 13 nt, Human herpesvirus 5
caucgucaaagcc

SEQ ID NO: 3978946 - RNA, 15 nt, Human herpesvirus 5
caucugccgaaacac

SEQ ID NO: 3978947 - RNA, 19 nt, Human herpesvirus 5
caucugcggcagcgguacc

SEQ ID NO: 3978948 - RNA, 16 nt, Human herpesvirus 5
caucuguuuuugcugc

SEQ ID NO: 3978949 - RNA, 17 nt, Human herpesvirus 5
caucuuucagcuggcuu

SEQ ID NO: 3978950 - RNA, 13 nt, Human herpesvirus 5
caugaagcggaug

SEQ ID NO: 3978951 - RNA, 23 nt, Human herpesvirus 5
caugaaucuuccccucugcugcu

SEQ ID NO: 3978952 - RNA, 19 nt, Human herpesvirus 5
caugagucgccgacgguca

SEQ ID NO: 3978953 - RNA, 19 nt, Human herpesvirus 5
caugaugaagauggccauc

SEQ ID NO: 3978954 - RNA, 18 nt, Human herpesvirus 5
caugcuauaagacagccu

SEQ ID NO: 3978955 - RNA, 19 nt, Human herpesvirus 5
caugcuucaugucgucccg

SEQ ID NO: 3978956 - RNA, 23 nt, Human herpesvirus 5
cauggacccgccgcuaccgucgc

SEQ ID NO: 3978957 - RNA, 17 nt, Human herpesvirus 5
cauggcggcggccacgg

SEQ ID NO: 3978958 - RNA, 17 nt, Human herpesvirus 5
caugucccuacucacca

SEQ ID NO: 3978959 - RNA, 17 nt, Human herpesvirus 5
caugucgcgacagagag

SEQ ID NO: 3978960 - RNA, 17 nt, Human herpesvirus 5
cauuacuaaacaaaaaa

SEQ ID NO: 3978961 - RNA, 16 nt, Human herpesvirus 5
cauuggagaacagugc

SEQ ID NO: 3978962 - RNA, 16 nt, Human herpesvirus 5
cauuggcaacaucacc

SEQ ID NO: 3978963 - RNA, 14 nt, Human herpesvirus 5
cauuuucuuucuag

SEQ ID NO: 3978964 - RNA, 15 nt, Human herpesvirus 5
cauuuucuuucuagu

SEQ ID NO: 3978965 - RNA, 19 nt, Human herpesvirus 5
ccaaaccgcaggagcugcu

SEQ ID NO: 3978966 - RNA, 22 nt, Human herpesvirus 5
ccaaagccgccgccgaagccug

SEQ ID NO: 3978967 - RNA, 15 nt, Human herpesvirus 5
ccaaccgacguacga

SEQ ID NO: 3978968 - RNA, 14 nt, Human herpesvirus 5
ccaacuucacuuca

SEQ ID NO: 3978969 - RNA, 18 nt, Human herpesvirus 5
ccaagagcaugcuguggg

SEQ ID NO: 3978970 - RNA, 20 nt, Human herpesvirus 5
ccaagccgcagcgcggaaac

SEQ ID NO: 3978971 - RNA, 18 nt, Human herpesvirus 5
ccaaggaaccaccguagc

SEQ ID NO: 3978972 - RNA, 12 nt, Human herpesvirus 5
ccaaguucagca

SEQ ID NO: 3978973 - RNA, 13 nt, Human herpesvirus 5
ccaaucgacugcc

SEQ ID NO: 3978974 - RNA, 21 nt, Human herpesvirus 5
ccacaagcgccgucacuuccc

SEQ ID NO: 3978975 - RNA, 11 nt, Human herpesvirus 5
ccacaguuucc

SEQ ID NO: 3978976 - RNA, 22 nt, Human herpesvirus 5
ccaccaggccgcaaagcuggac

SEQ ID NO: 3978977 - RNA, 17 nt, Human herpesvirus 5
ccaccccccgggccacc

SEQ ID NO: 3978978 - RNA, 13 nt, Human herpesvirus 5
ccaccgacaugga

SEQ ID NO: 3978979 - RNA, 16 nt, Human herpesvirus 5
ccaccgagacgugcga

SEQ ID NO: 3978980 - RNA, 14 nt, Human herpesvirus 5
ccaccucugcuacu

SEQ ID NO: 3978981 - RNA, 16 nt, Human herpesvirus 5
ccacgagugacgacga

SEQ ID NO: 3978982 - RNA, 17 nt, Human herpesvirus 5
ccacgccgaugcuccgc

SEQ ID NO: 3978983 - RNA, 22 nt, Human herpesvirus 5
ccacgccggccugagcgcgcuc

SEQ ID NO: 3978984 - RNA, 16 nt, Human herpesvirus 5
ccacgcucgagggcuc

SEQ ID NO: 3978985 - RNA, 21 nt, Human herpesvirus 5
ccacgcucgagggcuccgucu

SEQ ID NO: 3978986 - RNA, 17 nt, Human herpesvirus 5
ccacggcgaaccgccgu

SEQ ID NO: 3978987 - RNA, 17 nt, Human herpesvirus 5
ccacguccacucagaca

SEQ ID NO: 3978988 - RNA, 21 nt, Human herpesvirus 5
ccacguucuugcguccuucau

SEQ ID NO: 3978989 - RNA, 15 nt, Human herpesvirus 5
ccacuaauccgcacc

SEQ ID NO: 3978990 - RNA, 17 nt, Human herpesvirus 5
ccacuacuaccuccccu

SEQ ID NO: 3978991 - RNA, 14 nt, Human herpesvirus 5
ccacucccaccacg

SEQ ID NO: 3978992 - RNA, 18 nt, Human herpesvirus 5
ccacucgcaccggcagca

SEQ ID NO: 3978993 - RNA, 17 nt, Human herpesvirus 5
ccagaggcccgccgaga

SEQ ID NO: 3978994 - RNA, 13 nt, Human herpesvirus 5
ccagccccagagc

SEQ ID NO: 3978995 - RNA, 18 nt, Human herpesvirus 5
ccagccccgucaaaacac

SEQ ID NO: 3978996 - RNA, 17 nt, Human herpesvirus 5
ccagcccuauccuccau

SEQ ID NO: 3978997 - RNA, 12 nt, Human herpesvirus 5
ccagcgccacca

SEQ ID NO: 3978998 - RNA, 17 nt, Human herpesvirus 5
ccagcggccgcaguggg

SEQ ID NO: 3978999 - RNA, 17 nt, Human herpesvirus 5
ccagcugccaccagggc

SEQ ID NO: 3979000 - RNA, 14 nt, Human herpesvirus 5
ccaguacagcgccg

SEQ ID NO: 3979001 - RNA, 15 nt, Human herpesvirus 5
ccaguaccaccgcug

SEQ ID NO: 3979002 - RNA, 17 nt, Human herpesvirus 5
ccaguagacagacagga

SEQ ID NO: 3979003 - RNA, 12 nt, Human herpesvirus 5
ccaguugcuguu

SEQ ID NO: 3979004 - RNA, 19 nt, Human herpesvirus 5
ccaucaguacggcuuucug

SEQ ID NO: 3979005 - RNA, 18 nt, Human herpesvirus 5
ccauccucacacugacgg

SEQ ID NO: 3979006 - RNA, 16 nt, Human herpesvirus 5
ccaucgguacgaacgc

SEQ ID NO: 3979007 - RNA, 16 nt, Human herpesvirus 5
ccaugagaagagaaaa

SEQ ID NO: 3979008 - RNA, 19 nt, Human herpesvirus 5
ccaugagcggcaggaaggc

SEQ ID NO: 3979009 - RNA, 18 nt, Human herpesvirus 5
ccaugccggagcuacgcg

SEQ ID NO: 3979010 - RNA, 14 nt, Human herpesvirus 5
ccaugugcagcugg

SEQ ID NO: 3979011 - RNA, 14 nt, Human herpesvirus 5
cccaagccaaaaac

SEQ ID NO: 3979012 - RNA, 16 nt, Human herpesvirus 5
cccacuggaguugcuc

SEQ ID NO: 3979013 - RNA, 16 nt, Human herpesvirus 5
cccagcagaccagcca

SEQ ID NO: 3979014 - RNA, 21 nt, Human herpesvirus 5
cccaugacgcagucgcucauc

SEQ ID NO: 3979015 - RNA, 16 nt, Human herpesvirus 5
ccccacccaguagaca

SEQ ID NO: 3979016 - RNA, 13 nt, Human herpesvirus 5
ccccaccuucccu

SEQ ID NO: 3979017 - RNA, 18 nt, Human herpesvirus 5
cccccgucgcccgaggcg

SEQ ID NO: 3979018 - RNA, 18 nt, Human herpesvirus 5
ccccgaauuugggcggug

SEQ ID NO: 3979019 - RNA, 22 nt, Human herpesvirus 5
ccccgauaaucggcucucaggc

SEQ ID NO: 3979020 - RNA, 20 nt, Human herpesvirus 5
ccccggcagcggucucaucu

SEQ ID NO: 3979021 - RNA, 17 nt, Human herpesvirus 5
ccccgggccaccagccg

SEQ ID NO: 3979022 - RNA, 13 nt, Human herpesvirus 5
ccccucgcugggc

SEQ ID NO: 3979023 - RNA, 17 nt, Human herpesvirus 5
ccccucugcugcugguu

SEQ ID NO: 3979024 - RNA, 14 nt, Human herpesvirus 5
cccgaggcggagga

SEQ ID NO: 3979025 - RNA, 23 nt, Human herpesvirus 5
cccgaggucuuuugcacgcgcga

SEQ ID NO: 3979026 - RNA, 20 nt, Human herpesvirus 5
cccgaugugcagggacagug

SEQ ID NO: 3979027 - RNA, 16 nt, Human herpesvirus 5
cccgcacacuggcugg

SEQ ID NO: 3979028 - RNA, 17 nt, Human herpesvirus 5
cccgccggagcccgguc

SEQ ID NO: 3979029 - RNA, 23 nt, Human herpesvirus 5
cccgccggagcccggucugagcu

SEQ ID NO: 3979030 - RNA, 18 nt, Human herpesvirus 5
cccgccggcgggcggcug

SEQ ID NO: 3979031 - RNA, 20 nt, Human herpesvirus 5
cccgcuucaacgccugcacc

SEQ ID NO: 3979032 - RNA, 24 nt, Human herpesvirus 5
cccggucggucuuccugcugcgca

SEQ ID NO: 3979033 - RNA, 18 nt, Human herpesvirus 5
cccgguugcggccccgua

SEQ ID NO: 3979034 - RNA, 17 nt, Human herpesvirus 5
cccgucaaaacacacgc

SEQ ID NO: 3979035 - RNA, 19 nt, Human herpesvirus 5
cccguggacgacuggcuca

SEQ ID NO: 3979036 - RNA, 18 nt, Human herpesvirus 5
cccguggaucagccgccg

SEQ ID NO: 3979037 - RNA, 20 nt, Human herpesvirus 5
cccguuacgccggaggccgc

SEQ ID NO: 3979038 - RNA, 18 nt, Human herpesvirus 5
cccuccgacuuccuccuc

SEQ ID NO: 3979039 - RNA, 14 nt, Human herpesvirus 5
cccuccuuuucccc

SEQ ID NO: 3979040 - RNA, 18 nt, Human herpesvirus 5
cccucuucuuugccggcu

SEQ ID NO: 3979041 - RNA, 20 nt, Human herpesvirus 5
cccuggaagcgugugugggc

SEQ ID NO: 3979042 - RNA, 19 nt, Human herpesvirus 5
cccuguaugagcuguuucg

SEQ ID NO: 3979043 - RNA, 14 nt, Human herpesvirus 5
cccuuccaugacgc

SEQ ID NO: 3979044 - RNA, 19 nt, Human herpesvirus 5
cccuucuggagcacacugc

SEQ ID NO: 3979045 - RNA, 14 nt, Human herpesvirus 5
ccgaacagacuugg

SEQ ID NO: 3979046 - RNA, 13 nt, Human herpesvirus 5
ccgacaaccugcu

SEQ ID NO: 3979047 - RNA, 16 nt, Human herpesvirus 5
ccgacaaggcgcggcg

SEQ ID NO: 3979048 - RNA, 14 nt, Human herpesvirus 5
ccgacauggagaca

SEQ ID NO: 3979049 - RNA, 13 nt, Human herpesvirus 5
ccgacgacgacga

SEQ ID NO: 3979050 - RNA, 17 nt, Human herpesvirus 5
ccgacgcgcgaccgcga

SEQ ID NO: 3979051 - RNA, 20 nt, Human herpesvirus 5
ccgacggccaaucgcguggc

SEQ ID NO: 3979052 - RNA, 21 nt, Human herpesvirus 5
ccgacucgcugccgcagcugc

SEQ ID NO: 3979053 - RNA, 22 nt, Human herpesvirus 5
ccgagauaucagaggccaccca

SEQ ID NO: 3979054 - RNA, 14 nt, Human herpesvirus 5
ccgagcacguacac

SEQ ID NO: 3979055 - RNA, 19 nt, Human herpesvirus 5
ccgagcaggugcgcguggu

SEQ ID NO: 3979056 - RNA, 19 nt, Human herpesvirus 5
ccgagcccccgucgcccga

SEQ ID NO: 3979057 - RNA, 16 nt, Human herpesvirus 5
ccgagcuugugcuucu

SEQ ID NO: 3979058 - RNA, 17 nt, Human herpesvirus 5
ccgaguccaccucugcu

SEQ ID NO: 3979059 - RNA, 23 nt, Human herpesvirus 5
ccgaguccaccucugcuacuggc

SEQ ID NO: 3979060 - RNA, 18 nt, Human herpesvirus 5
ccgauccgcacgaccgcg

SEQ ID NO: 3979061 - RNA, 17 nt, Human herpesvirus 5
ccgcaacaacagcagca

SEQ ID NO: 3979062 - RNA, 19 nt, Human herpesvirus 5
ccgcacuggacgacgucaa

SEQ ID NO: 3979063 - RNA, 15 nt, Human herpesvirus 5
ccgcagacaccaagc

SEQ ID NO: 3979064 - RNA, 16 nt, Human herpesvirus 5
ccgcagcggcuuugug

SEQ ID NO: 3979065 - RNA, 18 nt, Human herpesvirus 5
ccgcagucuggcuugggu

SEQ ID NO: 3979066 - RNA, 15 nt, Human herpesvirus 5
ccgcagugggcccac

SEQ ID NO: 3979067 - RNA, 16 nt, Human herpesvirus 5
ccgccacgcugcuuca

SEQ ID NO: 3979068 - RNA, 18 nt, Human herpesvirus 5
ccgccaugucgcuccgcg

SEQ ID NO: 3979069 - RNA, 14 nt, Human herpesvirus 5
ccgccccagcagac

SEQ ID NO: 3979070 - RNA, 13 nt, Human herpesvirus 5
ccgcccgagcagg

SEQ ID NO: 3979071 - RNA, 21 nt, Human herpesvirus 5
ccgccgaagcuucgcgcgccg

SEQ ID NO: 3979072 - RNA, 16 nt, Human herpesvirus 5
ccgccgacucgcugcc

SEQ ID NO: 3979073 - RNA, 14 nt, Human herpesvirus 5
ccgccgcagccacg

SEQ ID NO: 3979074 - RNA, 18 nt, Human herpesvirus 5
ccgccucggaucuacuca

SEQ ID NO: 3979075 - RNA, 14 nt, Human herpesvirus 5
ccgcgacccucgcg

SEQ ID NO: 3979076 - RNA, 21 nt, Human herpesvirus 5
ccgcgaucgaggcggcggcga

SEQ ID NO: 3979077 - RNA, 14 nt, Human herpesvirus 5
ccgcgcccacugga

SEQ ID NO: 3979078 - RNA, 18 nt, Human herpesvirus 5
ccgcggacgccugcgacg

SEQ ID NO: 3979079 - RNA, 16 nt, Human herpesvirus 5
ccgcggcaccagagac

SEQ ID NO: 3979080 - RNA, 16 nt, Human herpesvirus 5
ccgcggcgguggccgu

SEQ ID NO: 3979081 - RNA, 18 nt, Human herpesvirus 5
ccgcgucagcggccgccg

SEQ ID NO: 3979082 - RNA, 16 nt, Human herpesvirus 5
ccgcgucccuggggcu

SEQ ID NO: 3979083 - RNA, 17 nt, Human herpesvirus 5
ccgcugugcuggccgcc

SEQ ID NO: 3979084 - RNA, 17 nt, Human herpesvirus 5
ccggaggacgacagcuc

SEQ ID NO: 3979085 - RNA, 17 nt, Human herpesvirus 5
ccggcagcacaccugcc

SEQ ID NO: 3979086 - RNA, 22 nt, Human herpesvirus 5
ccggccgcggugccggcggcua

SEQ ID NO: 3979087 - RNA, 22 nt, Human herpesvirus 5
ccggcgcaguuugcggcgcaga

SEQ ID NO: 3979088 - RNA, 18 nt, Human herpesvirus 5
ccggcgccugguugcugc

SEQ ID NO: 3979089 - RNA, 22 nt, Human herpesvirus 5
ccggcggggaaaauaccgaggc

SEQ ID NO: 3979090 - RNA, 13 nt, Human herpesvirus 5
ccggcuccgccgu

SEQ ID NO: 3979091 - RNA, 23 nt, Human herpesvirus 5
ccggcugcggcggcacucgcucc

SEQ ID NO: 3979092 - RNA, 14 nt, Human herpesvirus 5
ccgggcggcuuugc

SEQ ID NO: 3979093 - RNA, 18 nt, Human herpesvirus 5
ccgggcggcuuugccguc

SEQ ID NO: 3979094 - RNA, 20 nt, Human herpesvirus 5
ccgguauucggaaacagcgu

SEQ ID NO: 3979095 - RNA, 16 nt, Human herpesvirus 5
ccggugcgcgaccgca

SEQ ID NO: 3979096 - RNA, 20 nt, Human herpesvirus 5
ccguacuaagucucccgugu

SEQ ID NO: 3979097 - RNA, 18 nt, Human herpesvirus 5
ccguagcuagugcucggc

SEQ ID NO: 3979098 - RNA, 23 nt, Human herpesvirus 5
ccgucaacacggucauguuucuc

SEQ ID NO: 3979099 - RNA, 13 nt, Human herpesvirus 5
ccgucaccaccgc

SEQ ID NO: 3979100 - RNA, 13 nt, Human herpesvirus 5
ccgucacugccac

SEQ ID NO: 3979101 - RNA, 22 nt, Human herpesvirus 5
ccgucaucggcacgugcucuuu

SEQ ID NO: 3979102 - RNA, 12 nt, Human herpesvirus 5
ccgucgccgcga

SEQ ID NO: 3979103 - RNA, 20 nt, Human herpesvirus 5
ccgucgcuacauucgccgca

SEQ ID NO: 3979104 - RNA, 14 nt, Human herpesvirus 5
ccgucggcgccgcc

SEQ ID NO: 3979105 - RNA, 21 nt, Human herpesvirus 5
ccgucggcgucgcgucgcagg

SEQ ID NO: 3979106 - RNA, 21 nt, Human herpesvirus 5
ccgucuggagguggccugcau

SEQ ID NO: 3979107 - RNA, 13 nt, Human herpesvirus 5
ccgugccacggaa

SEQ ID NO: 3979108 - RNA, 14 nt, Human herpesvirus 5
ccgugccagcuggc

SEQ ID NO: 3979109 - RNA, 21 nt, Human herpesvirus 5
ccguggagaugcaggaggugg

SEQ ID NO: 3979110 - RNA, 20 nt, Human herpesvirus 5
ccgugguggccgugcugggc

SEQ ID NO: 3979111 - RNA, 16 nt, Human herpesvirus 5
ccguguucuuaaucuu

SEQ ID NO: 3979112 - RNA, 19 nt, Human herpesvirus 5
ccguugccgccucagaacc

SEQ ID NO: 3979113 - RNA, 21 nt, Human herpesvirus 5
ccuaaguccaacaucguggua

SEQ ID NO: 3979114 - RNA, 13 nt, Human herpesvirus 5
ccuaccgccgccg

SEQ ID NO: 3979115 - RNA, 19 nt, Human herpesvirus 5
ccuacgacaacaucccucc

SEQ ID NO: 3979116 - RNA, 19 nt, Human herpesvirus 5
ccuacgugcaacgccacca

SEQ ID NO: 3979117 - RNA, 23 nt, Human herpesvirus 5
ccuacucaccaaagccgccgccg

SEQ ID NO: 3979118 - RNA, 17 nt, Human herpesvirus 5
ccuagcgaucgcaugcu

SEQ ID NO: 3979119 - RNA, 19 nt, Human herpesvirus 5
ccuauaaaaccgugcccgu

SEQ ID NO: 3979120 - RNA, 15 nt, Human herpesvirus 5
ccuauccgcgcggcu

SEQ ID NO: 3979121 - RNA, 20 nt, Human herpesvirus 5
ccucagcuugcccgaccacg

SEQ ID NO: 3979122 - RNA, 15 nt, Human herpesvirus 5
ccucagguuccccga

SEQ ID NO: 3979123 - RNA, 15 nt, Human herpesvirus 5
ccucagucgccguca

SEQ ID NO: 3979124 - RNA, 13 nt, Human herpesvirus 5
ccucagucugccu

SEQ ID NO: 3979125 - RNA, 17 nt, Human herpesvirus 5
ccucauauacgguacac

SEQ ID NO: 3979126 - RNA, 22 nt, Human herpesvirus 5
ccuccgaacgcucgugagcaac

SEQ ID NO: 3979127 - RNA, 13 nt, Human herpesvirus 5
ccuccgcggcccg

SEQ ID NO: 3979128 - RNA, 14 nt, Human herpesvirus 5
ccuccgcggcccgu

SEQ ID NO: 3979129 - RNA, 18 nt, Human herpesvirus 5
ccuccggaacccucuggc

SEQ ID NO: 3979130 - RNA, 24 nt, Human herpesvirus 5
ccucgcucggaacgacgacucagg

SEQ ID NO: 3979131 - RNA, 17 nt, Human herpesvirus 5
ccucggagcacgggcga

SEQ ID NO: 3979132 - RNA, 15 nt, Human herpesvirus 5
ccucggccucuuccu

SEQ ID NO: 3979133 - RNA, 22 nt, Human herpesvirus 5
ccucgucgugcccgucggcugc

SEQ ID NO: 3979134 - RNA, 20 nt, Human herpesvirus 5
ccucuacaaacuagcauucu

SEQ ID NO: 3979135 - RNA, 13 nt, Human herpesvirus 5
ccucuaccccgcc

SEQ ID NO: 3979136 - RNA, 14 nt, Human herpesvirus 5
ccucuagagacaga

SEQ ID NO: 3979137 - RNA, 15 nt, Human herpesvirus 5
ccucuagagacagac

SEQ ID NO: 3979138 - RNA, 21 nt, Human herpesvirus 5
ccucugccugggcacgcgcgu

SEQ ID NO: 3979139 - RNA, 22 nt, Human herpesvirus 5
ccugacaguuuaugagaaaagg

SEQ ID NO: 3979140 - RNA, 17 nt, Human herpesvirus 5
ccugaguuccgucagca

SEQ ID NO: 3979141 - RNA, 14 nt, Human herpesvirus 5
ccugcacgccgccg

SEQ ID NO: 3979142 - RNA, 18 nt, Human herpesvirus 5
ccugccgaagaccucacc

SEQ ID NO: 3979143 - RNA, 20 nt, Human herpesvirus 5
ccugccuacgucuucaugac

SEQ ID NO: 3979144 - RNA, 21 nt, Human herpesvirus 5
ccugccucgacaucucgccgu

SEQ ID NO: 3979145 - RNA, 19 nt, Human herpesvirus 5
ccugcgaggaccguacacg

SEQ ID NO: 3979146 - RNA, 19 nt, Human herpesvirus 5
ccugcugccgccacugggc

SEQ ID NO: 3979147 - RNA, 18 nt, Human herpesvirus 5
ccuggaagcguguguggg

SEQ ID NO: 3979148 - RNA, 18 nt, Human herpesvirus 5
ccuggaccggugguacug

SEQ ID NO: 3979149 - RNA, 16 nt, Human herpesvirus 5
gcuacgucgacaugaa

SEQ ID NO: 3979150 - RNA, 20 nt, Human herpesvirus 5
gcuacuuuccgauccuugga

SEQ ID NO: 3979151 - RNA, 15 nt, Human herpesvirus 5
gcuaggcgggcugga

SEQ ID NO: 3979152 - RNA, 22 nt, Human herpesvirus 5
gcucaaaguacuugucggcgug

SEQ ID NO: 3979153 - RNA, 13 nt, Human herpesvirus 5
gcucaacuuucua

SEQ ID NO: 3979154 - RNA, 20 nt, Human herpesvirus 5
gcucaccgcaguugcugccu

SEQ ID NO: 3979155 - RNA, 16 nt, Human herpesvirus 5
gcucacguagcaggcc

SEQ ID NO: 3979156 - RNA, 23 nt, Human herpesvirus 5
gcucacguugaugaaaacgaggu

SEQ ID NO: 3979157 - RNA, 21 nt, Human herpesvirus 5
gcucagcugguggcucaugcc

SEQ ID NO: 3979158 - RNA, 21 nt, Human herpesvirus 5
gcucagcuugaugguguagga

SEQ ID NO: 3979159 - RNA, 19 nt, Human herpesvirus 5
gcucaggccacccgccgga

SEQ ID NO: 3979160 - RNA, 13 nt, Human herpesvirus 5
gcucagucgccua

SEQ ID NO: 3979161 - RNA, 16 nt, Human herpesvirus 5
gcuccacacgcaucug

SEQ ID NO: 3979162 - RNA, 21 nt, Human herpesvirus 5
gcucccugcuccgcaagcgcc

SEQ ID NO: 3979163 - RNA, 13 nt, Human herpesvirus 5
gcucgcucgcgcc

SEQ ID NO: 3979164 - RNA, 22 nt, Human herpesvirus 5
gcucggcgcccaaaccgcagga

SEQ ID NO: 3979165 - RNA, 12 nt, Human herpesvirus 5
gcucuacgcgug

SEQ ID NO: 3979166 - RNA, 16 nt, Human herpesvirus 5
gcucucgcagcccgag

SEQ ID NO: 3979167 - RNA, 17 nt, Human herpesvirus 5
gcucucgcggcccuuca

SEQ ID NO: 3979168 - RNA, 18 nt, Human herpesvirus 5
gcucucggaucugcggcu

SEQ ID NO: 3979169 - RNA, 21 nt, Human herpesvirus 5
gcugacgcggacgaggaacag

SEQ ID NO: 3979170 - RNA, 16 nt, Human herpesvirus 5
gcugauaagacggacu

SEQ ID NO: 3979171 - RNA, 14 nt, Human herpesvirus 5
gcugcaagguacgg

SEQ ID NO: 3979172 - RNA, 23 nt, Human herpesvirus 5
gcugcaccucaacaagggcuggc

SEQ ID NO: 3979173 - RNA, 18 nt, Human herpesvirus 5
gcugcccgucaagaccga

SEQ ID NO: 3979174 - RNA, 18 nt, Human herpesvirus 5
gcugccgcagcugcugga

SEQ ID NO: 3979175 - RNA, 18 nt, Human herpesvirus 5
gcugcuauaagaaggcca

SEQ ID NO: 3979176 - RNA, 19 nt, Human herpesvirus 5
gcugcuauaagaaggccau

SEQ ID NO: 3979177 - RNA, 13 nt, Human herpesvirus 5
gcugcugagacug

SEQ ID NO: 3979178 - RNA, 15 nt, Human herpesvirus 5
gcugcugcacgggcu

SEQ ID NO: 3979179 - RNA, 16 nt, Human herpesvirus 5
gcugcuuucgcacgca

SEQ ID NO: 3979180 - RNA, 21 nt, Human herpesvirus 5
gcuggacugacacagcuccug

SEQ ID NO: 3979181 - RNA, 18 nt, Human herpesvirus 5
gcuggaggcccuggugga

SEQ ID NO: 3979182 - RNA, 13 nt, Human herpesvirus 5
gcuggccggcuug

SEQ ID NO: 3979183 - RNA, 13 nt, Human herpesvirus 5
gcuggcgggccga

SEQ ID NO: 3979184 - RNA, 20 nt, Human herpesvirus 5
gcuggcgguauggcugcgcg

SEQ ID NO: 3979185 - RNA, 15 nt, Human herpesvirus 5
gcugggucagugcca

SEQ ID NO: 3979186 - RNA, 11 nt, Human herpesvirus 5
gcuggugucuc

SEQ ID NO: 3979187 - RNA, 19 nt, Human herpesvirus 5
gcugucguucuccgcuugc

SEQ ID NO: 3979188 - RNA, 17 nt, Human herpesvirus 5
gcuguugaccuggguag

SEQ ID NO: 3979189 - RNA, 19 nt, Human herpesvirus 5
gcuguuuuuguucacaacu

SEQ ID NO: 3979190 - RNA, 19 nt, Human herpesvirus 5
gcuucggccggcugcugca

SEQ ID NO: 3979191 - RNA, 16 nt, Human herpesvirus 5
gcuucuuuucuggggu

SEQ ID NO: 3979192 - RNA, 15 nt, Human herpesvirus 5
gcuugcuccucuucc

SEQ ID NO: 3979193 - RNA, 13 nt, Human herpesvirus 5
gcuuuagccaggu

SEQ ID NO: 3979194 - RNA, 19 nt, Human herpesvirus 5
gcuuuauccgacucgcugu

SEQ ID NO: 3979195 - RNA, 15 nt, Human herpesvirus 5
ggaacguaccuagcu

SEQ ID NO: 3979196 - RNA, 22 nt, Human herpesvirus 5
ggaacugguuuucggacagagc

SEQ ID NO: 3979197 - RNA, 22 nt, Human herpesvirus 5
ggaacuuugccgucaugccuug

SEQ ID NO: 3979198 - RNA, 19 nt, Human herpesvirus 5
ggaagaaaccguguuucgc

SEQ ID NO: 3979199 - RNA, 15 nt, Human herpesvirus 5
ggaagaagaagaaca

SEQ ID NO: 3979200 - RNA, 22 nt, Human herpesvirus 5
ggaagaagaagaacaagcggug

SEQ ID NO: 3979201 - RNA, 15 nt, Human herpesvirus 5
ggaagagggaagcac

SEQ ID NO: 3979202 - RNA, 16 nt, Human herpesvirus 5
ggaauacccagcuggg

SEQ ID NO: 3979203 - RNA, 12 nt, Human herpesvirus 5
ggaaucugggag

SEQ ID NO: 3979204 - RNA, 22 nt, Human herpesvirus 5
ggaaugcggucaguuggggagu

SEQ ID NO: 3979205 - RNA, 17 nt, Human herpesvirus 5
ggaaugguaaagacauc

SEQ ID NO: 3979206 - RNA, 20 nt, Human herpesvirus 5
ggacaaccgcauccugccca

SEQ ID NO: 3979207 - RNA, 14 nt, Human herpesvirus 5
ggacaaggcuccga

SEQ ID NO: 3979208 - RNA, 23 nt, Human herpesvirus 5
ggacacguagaucccacuggcaa

SEQ ID NO: 3979209 - RNA, 23 nt, Human herpesvirus 5
ggaccauuuccaugugcagcugg

SEQ ID NO: 3979210 - RNA, 13 nt, Human herpesvirus 5
ggacccguacugc

SEQ ID NO: 3979211 - RNA, 20 nt, Human herpesvirus 5
ggacccguacugcgacggca

SEQ ID NO: 3979212 - RNA, 14 nt, Human herpesvirus 5
ggacgaaagugggg

SEQ ID NO: 3979213 - RNA, 21 nt, Human herpesvirus 5
ggacgacgcaccggccuccga

SEQ ID NO: 3979214 - RNA, 21 nt, Human herpesvirus 5
ggacgauauaaagaggcacgg

SEQ ID NO: 3979215 - RNA, 12 nt, Human herpesvirus 5
ggacgaugagcc

SEQ ID NO: 3979216 - RNA, 17 nt, Human herpesvirus 5
ggacgcgccacgcucgc

SEQ ID NO: 3979217 - RNA, 19 nt, Human herpesvirus 5
ggacucuuuaaccgagcug

SEQ ID NO: 3979218 - RNA, 20 nt, Human herpesvirus 5
ggagcgaguggggcaacugc

SEQ ID NO: 3979219 - RNA, 20 nt, Human herpesvirus 5
ggaggagugucagacacagc

SEQ ID NO: 3979220 - RNA, 23 nt, Human herpesvirus 5
ggaggauccaaggccuccagcgc

SEQ ID NO: 3979221 - RNA, 21 nt, Human herpesvirus 5
ggagguccuuuggguccagcc

SEQ ID NO: 3979222 - RNA, 15 nt, Human herpesvirus 5
ggaggugaccuggcu

SEQ ID NO: 3979223 - RNA, 15 nt, Human herpesvirus 5
ggaucgucaccacca

SEQ ID NO: 3979224 - RNA, 23 nt, Human herpesvirus 5
ggaucuacucaucggcauguucg

SEQ ID NO: 3979225 - RNA, 18 nt, Human herpesvirus 5
ggaucuggcggccgccgg

SEQ ID NO: 3979226 - RNA, 19 nt, Human herpesvirus 5
ggaucuuauucgcuuugaa

SEQ ID NO: 3979227 - RNA, 20 nt, Human herpesvirus 5
ggcaagccaaaccacaaggc

SEQ ID NO: 3979228 - RNA, 17 nt, Human herpesvirus 5
ggcaccaucggacucgc

SEQ ID NO: 3979229 - RNA, 13 nt, Human herpesvirus 5
ggcaccggcagcc

SEQ ID NO: 3979230 - RNA, 21 nt, Human herpesvirus 5
ggcaccuaucuccgacagcgc

SEQ ID NO: 3979231 - RNA, 22 nt, Human herpesvirus 5
ggcaggcggguugcagcuuuug

SEQ ID NO: 3979232 - RNA, 17 nt, Human herpesvirus 5
ggcauacaaugugcugc

SEQ ID NO: 3979233 - RNA, 15 nt, Human herpesvirus 5
ggccacccacccggu

SEQ ID NO: 3979234 - RNA, 17 nt, Human herpesvirus 5
ggccagcgccugguacu

SEQ ID NO: 3979235 - RNA, 15 nt, Human herpesvirus 5
ggccauggagcugca

SEQ ID NO: 3979236 - RNA, 19 nt, Human herpesvirus 5
ggcccugcugacgcuguug

SEQ ID NO: 3979237 - RNA, 16 nt, Human herpesvirus 5
ggcccuucaacggcac

SEQ ID NO: 3979238 - RNA, 15 nt, Human herpesvirus 5
ggccgacggcagcgu

SEQ ID NO: 3979239 - RNA, 22 nt, Human herpesvirus 5
ggccgacggcagcgugcugugc

SEQ ID NO: 3979240 - RNA, 23 nt, Human herpesvirus 5
ggccgacggugguuuccgcgccc

SEQ ID NO: 3979241 - RNA, 23 nt, Human herpesvirus 5
ggccgagacggcgugacacagca

SEQ ID NO: 3979242 - RNA, 18 nt, Human herpesvirus 5
ggccgauccacgggccgc

SEQ ID NO: 3979243 - RNA, 19 nt, Human herpesvirus 5
ggccgcacuggacgacguc

SEQ ID NO: 3979244 - RNA, 11 nt, Human herpesvirus 5
ggccgccgccc

SEQ ID NO: 3979245 - RNA, 21 nt, Human herpesvirus 5
ggccgccgcucaagccgcggu

SEQ ID NO: 3979246 - RNA, 13 nt, Human herpesvirus 5
ggccgcggaggug

SEQ ID NO: 3979247 - RNA, 16 nt, Human herpesvirus 5
ggccgcucgggaacag

SEQ ID NO: 3979248 - RNA, 22 nt, Human herpesvirus 5
ggccucuaucugcgccaguacg

SEQ ID NO: 3979249 - RNA, 15 nt, Human herpesvirus 5
ggccugggcugcugu

SEQ ID NO: 3979250 - RNA, 18 nt, Human herpesvirus 5
ggcgaaccgccgucgccg

SEQ ID NO: 3979251 - RNA, 15 nt, Human herpesvirus 5
ggcgacaccgccucg

SEQ ID NO: 3979252 - RNA, 23 nt, Human herpesvirus 5
ggcgauggucauguucucccagg

SEQ ID NO: 3979253 - RNA, 17 nt, Human herpesvirus 5
ggcgcccgggccgccug

SEQ ID NO: 3979254 - RNA, 21 nt, Human herpesvirus 5
ggcgccuuuuucuucgccucg

SEQ ID NO: 3979255 - RNA, 14 nt, Human herpesvirus 5
ggcgcgcaucgccg

SEQ ID NO: 3979256 - RNA, 20 nt, Human herpesvirus 5
ggcgcgcaucgccgucgagu

SEQ ID NO: 3979257 - RNA, 17 nt, Human herpesvirus 5
ggcggacuuggcagcgg

SEQ ID NO: 3979258 - RNA, 22 nt, Human herpesvirus 5
ggcggcgaucgcagccuccucg

SEQ ID NO: 3979259 - RNA, 23 nt, Human herpesvirus 5
ggcggcgggguuaagcguccucg

SEQ ID NO: 3979260 - RNA, 21 nt, Human herpesvirus 5
ggcgggcuuuuuugucccggg

SEQ ID NO: 3979261 - RNA, 19 nt, Human herpesvirus 5
ggcgguccaguggcaggcc

SEQ ID NO: 3979262 - RNA, 15 nt, Human herpesvirus 5
ggcgguccuccagca

SEQ ID NO: 3979263 - RNA, 18 nt, Human herpesvirus 5
ggcgguggucggcugccg

SEQ ID NO: 3979264 - RNA, 22 nt, Human herpesvirus 5
ggcgguuucagcuggcaacgug

SEQ ID NO: 3979265 - RNA, 19 nt, Human herpesvirus 5
ggcgugaaugggcacgccg

SEQ ID NO: 3979266 - RNA, 15 nt, Human herpesvirus 5
ggcgugcgcacgccg

SEQ ID NO: 3979267 - RNA, 20 nt, Human herpesvirus 5
ggcgugcucaggccacccgc

SEQ ID NO: 3979268 - RNA, 19 nt, Human herpesvirus 5
ggcguuacuugcggcgcuu

SEQ ID NO: 3979269 - RNA, 15 nt, Human herpesvirus 5
ggcuaacgcgcugcu

SEQ ID NO: 3979270 - RNA, 21 nt, Human herpesvirus 5
ggcuacguagcgcgugucccu

SEQ ID NO: 3979271 - RNA, 17 nt, Human herpesvirus 5
ggcucaucaccaacgug

SEQ ID NO: 3979272 - RNA, 13 nt, Human herpesvirus 5
ggcuccgccggca

SEQ ID NO: 3979273 - RNA, 19 nt, Human herpesvirus 5
ggcucgaccggcggcugcu

SEQ ID NO: 3979274 - RNA, 14 nt, Human herpesvirus 5
ggcucguguggcag

SEQ ID NO: 3979275 - RNA, 22 nt, Human herpesvirus 5
ggcucguguggcagcuggcuug

SEQ ID NO: 3979276 - RNA, 16 nt, Human herpesvirus 5
ggcucuccuccucucc

SEQ ID NO: 3979277 - RNA, 22 nt, Human herpesvirus 5
ggcucuugcgcuucugcagcuc

SEQ ID NO: 3979278 - RNA, 21 nt, Human herpesvirus 5
ggcugacgcggacgaggaaca

SEQ ID NO: 3979279 - RNA, 15 nt, Human herpesvirus 5
ggcugaucgcggccu

SEQ ID NO: 3979280 - RNA, 17 nt, Human herpesvirus 5
ggcugccuguuccugcu

SEQ ID NO: 3979281 - RNA, 19 nt, Human herpesvirus 5
ggcugccuguuccugcugc

SEQ ID NO: 3979282 - RNA, 18 nt, Human herpesvirus 5
ggcugcgccuccucgucg

SEQ ID NO: 3979283 - RNA, 20 nt, Human herpesvirus 5
ggcugcgcggguuucaggua

SEQ ID NO: 3979284 - RNA, 21 nt, Human herpesvirus 5
ggcuggugucacuagacagau

SEQ ID NO: 3979285 - RNA, 15 nt, Human herpesvirus 5
ggcuuacugccugcc

SEQ ID NO: 3979286 - RNA, 15 nt, Human herpesvirus 5
ggcuucccuccugca

SEQ ID NO: 3979287 - RNA, 18 nt, Human herpesvirus 5
gggaaaaacaaagaaguc

SEQ ID NO: 3979288 - RNA, 22 nt, Human herpesvirus 5
gggaaacggacacuaggcgucc

SEQ ID NO: 3979289 - RNA, 20 nt, Human herpesvirus 5
gggaacuacguggguaagug

SEQ ID NO: 3979290 - RNA, 23 nt, Human herpesvirus 5
gggaggacgaaccgcgacaacac

SEQ ID NO: 3979291 - RNA, 12 nt, Human herpesvirus 5
gggaggcgguga

SEQ ID NO: 3979292 - RNA, 17 nt, Human herpesvirus 5
gggagucaacacuacca

SEQ ID NO: 3979293 - RNA, 19 nt, Human herpesvirus 5
gggagugguggcggcagcc

SEQ ID NO: 3979294 - RNA, 21 nt, Human herpesvirus 5
gggaucauuuucuuggccgug

SEQ ID NO: 3979295 - RNA, 18 nt, Human herpesvirus 5
gggcagcagcggcggcua

SEQ ID NO: 3979296 - RNA, 14 nt, Human herpesvirus 5
gggccagcccgagu

SEQ ID NO: 3979297 - RNA, 12 nt, Human herpesvirus 5
gggcgugugggu

SEQ ID NO: 3979298 - RNA, 15 nt, Human herpesvirus 5
gggcucgugcguguc

SEQ ID NO: 3979299 - RNA, 21 nt, Human herpesvirus 5
gggcucguguggcagcuggcu

SEQ ID NO: 3979300 - RNA, 23 nt, Human herpesvirus 5
gggcuuuccggccaacaugccca

SEQ ID NO: 3979301 - RNA, 12 nt, Human herpesvirus 5
ggggcugcugcu

SEQ ID NO: 3979302 - RNA, 13 nt, Human herpesvirus 5
gggucaaaagccu

SEQ ID NO: 3979303 - RNA, 18 nt, Human herpesvirus 5
gggucguuguccuccucg

SEQ ID NO: 3979304 - RNA, 10 nt, Human herpesvirus 5
ggguggaaac

SEQ ID NO: 3979305 - RNA, 15 nt, Human herpesvirus 5
ggguuggcagcuggc

SEQ ID NO: 3979306 - RNA, 12 nt, Human herpesvirus 5
gguacugcugug

SEQ ID NO: 3979307 - RNA, 17 nt, Human herpesvirus 5
gguagcuagugcagccu

SEQ ID NO: 3979308 - RNA, 21 nt, Human herpesvirus 5
gguaucucacaccgucagcug

SEQ ID NO: 3979309 - RNA, 16 nt, Human herpesvirus 5
ggucagcggcacgccg

SEQ ID NO: 3979310 - RNA, 21 nt, Human herpesvirus 5
ggucaugaguuggugcagcug

SEQ ID NO: 3979311 - RNA, 13 nt, Human herpesvirus 5
ggucgacugcgug

SEQ ID NO: 3979312 - RNA, 23 nt, Human herpesvirus 5
ggucgccgaggcuacugcugcuu

SEQ ID NO: 3979313 - RNA, 16 nt, Human herpesvirus 5
ggucgggcguguggua

SEQ ID NO: 3979314 - RNA, 17 nt, Human herpesvirus 5
ggucguuguccuccucg

SEQ ID NO: 3979315 - RNA, 16 nt, Human herpesvirus 5
ggucucacugugacgu

SEQ ID NO: 3979316 - RNA, 17 nt, Human herpesvirus 5
ggucugcuugcuggcuu

SEQ ID NO: 3979317 - RNA, 15 nt, Human herpesvirus 5
ggugaaggccgugga

SEQ ID NO: 3979318 - RNA, 21 nt, Human herpesvirus 5
ggugccccaggaugaagccaa

SEQ ID NO: 3979319 - RNA, 14 nt, Human herpesvirus 5
ggugccgggacagc

SEQ ID NO: 3979320 - RNA, 14 nt, Human herpesvirus 5
gguggugugugggg

SEQ ID NO: 3979321 - RNA, 15 nt, Human herpesvirus 5
ggugucuagcuggcg

SEQ ID NO: 3979322 - RNA, 18 nt, Human herpesvirus 5
ggugugcgugcuguacgu

SEQ ID NO: 3979323 - RNA, 17 nt, Human herpesvirus 5
guaaaagcugcaugaaa

SEQ ID NO: 3979324 - RNA, 14 nt, Human herpesvirus 5
guaaauaaaaagcu

SEQ ID NO: 3979325 - RNA, 17 nt, Human herpesvirus 5
guaagcggcagcauggg

SEQ ID NO: 3979326 - RNA, 22 nt, Human herpesvirus 5
guacaauaaacuguugauuuug

SEQ ID NO: 3979327 - RNA, 20 nt, Human herpesvirus 5
guacacagccaaggugcggg

SEQ ID NO: 3979328 - RNA, 14 nt, Human herpesvirus 5
guacaccgcuggag

SEQ ID NO: 3979329 - RNA, 18 nt, Human herpesvirus 5
guaccuagcuacuuugga

SEQ ID NO: 3979330 - RNA, 10 nt, Human herpesvirus 5
guaccugcau

SEQ ID NO: 3979331 - RNA, 21 nt, Human herpesvirus 5
guacuuuauuaggucagggau

SEQ ID NO: 3979332 - RNA, 18 nt, Human herpesvirus 5
guagacgaaagacaauga

SEQ ID NO: 3979333 - RNA, 15 nt, Human herpesvirus 5
guagaucccacuggc

SEQ ID NO: 3979334 - RNA, 11 nt, Human herpesvirus 5
guagcuucucu

SEQ ID NO: 3979335 - RNA, 13 nt, Human herpesvirus 5
guagguggccaug

SEQ ID NO: 3979336 - RNA, 19 nt, Human herpesvirus 5
guaguauuuuuucauaguu

SEQ ID NO: 3979337 - RNA, 17 nt, Human herpesvirus 5
guaguuggcguugagca

SEQ ID NO: 3979338 - RNA, 14 nt, Human herpesvirus 5
guauaaacuggggc

SEQ ID NO: 3979339 - RNA, 15 nt, Human herpesvirus 5
guauaacuaacgugu

SEQ ID NO: 3979340 - RNA, 10 nt, Human herpesvirus 5
guauccacgu

SEQ ID NO: 3979341 - RNA, 16 nt, Human herpesvirus 5
guauccauuggagaac

SEQ ID NO: 3979342 - RNA, 19 nt, Human herpesvirus 5
guauucccccggacgggca

SEQ ID NO: 3979343 - RNA, 19 nt, Human herpesvirus 5
gucaacacuaccaaguacc

SEQ ID NO: 3979344 - RNA, 13 nt, Human herpesvirus 5
gucaaccugcuga

SEQ ID NO: 3979345 - RNA, 14 nt, Human herpesvirus 5
gucaagacgcugaa

SEQ ID NO: 3979346 - RNA, 20 nt, Human herpesvirus 5
gucaaggccgccucuucugg

SEQ ID NO: 3979347 - RNA, 21 nt, Human herpesvirus 5
gucaagggucacggugccaug

SEQ ID NO: 3979348 - RNA, 16 nt, Human herpesvirus 5
gucaaucagacuuucg

SEQ ID NO: 3979349 - RNA, 19 nt, Human herpesvirus 5
gucacgcguuauacgccga

SEQ ID NO: 3979350 - RNA, 23 nt, Human herpesvirus 5
gucacuauccgaugguuucauua

SEQ ID NO: 3979351 - RNA, 13 nt, Human herpesvirus 5
gucacugccaccg

SEQ ID NO: 3979352 - RNA, 23 nt, Human herpesvirus 5
gucacuggagaacaauaaagcgu

SEQ ID NO: 3979353 - RNA, 16 nt, Human herpesvirus 5
gucagagagucugaaa

SEQ ID NO: 3979354 - RNA, 18 nt, Human herpesvirus 5
gucagcggcacgccgccg

SEQ ID NO: 3979355 - RNA, 20 nt, Human herpesvirus 5
gucaggacuggaagugucac

SEQ ID NO: 3979356 - RNA, 17 nt, Human herpesvirus 5
gucaguuuaucgagcgc

SEQ ID NO: 3979357 - RNA, 19 nt, Human herpesvirus 5
gucaucucauuugcuuuua

SEQ ID NO: 3979358 - RNA, 20 nt, Human herpesvirus 5
gucaugggcgacuuucaggg

SEQ ID NO: 3979359 - RNA, 17 nt, Human herpesvirus 5
guccaaccucgccgucg

SEQ ID NO: 3979360 - RNA, 21 nt, Human herpesvirus 5
guccagaucgucuacggcucc

SEQ ID NO: 3979361 - RNA, 13 nt, Human herpesvirus 5
guccagcuucugg

SEQ ID NO: 3979362 - RNA, 16 nt, Human herpesvirus 5
guccaguggcaggccc

SEQ ID NO: 3979363 - RNA, 21 nt, Human herpesvirus 5
guccauagugcgccaagccau

SEQ ID NO: 3979364 - RNA, 18 nt, Human herpesvirus 5
gucccagcagggcgcgcc

SEQ ID NO: 3979365 - RNA, 15 nt, Human herpesvirus 5
guccccuucugugga

SEQ ID NO: 3979366 - RNA, 12 nt, Human herpesvirus 5
gucccgugaugg

SEQ ID NO: 3979367 - RNA, 21 nt, Human herpesvirus 5
gucccuacucaccaaagccgc

SEQ ID NO: 3979368 - RNA, 16 nt, Human herpesvirus 5
gucccuggggcugcug

SEQ ID NO: 3979369 - RNA, 20 nt, Human herpesvirus 5
guccggccgucgcaagggcu

SEQ ID NO: 3979370 - RNA, 22 nt, Human herpesvirus 5
guccggccgucgcaagggcugc

SEQ ID NO: 3979371 - RNA, 15 nt, Human herpesvirus 5
guccgugaucgccgc

SEQ ID NO: 3979372 - RNA, 18 nt, Human herpesvirus 5
gucgaacuauaccgggcg

SEQ ID NO: 3979373 - RNA, 14 nt, Human herpesvirus 5
gucgacgacgccgu

SEQ ID NO: 3979374 - RNA, 23 nt, Human herpesvirus 5
gucgcaucaucaacagcagcaac

SEQ ID NO: 3979375 - RNA, 19 nt, Human herpesvirus 5
gucgcccgaggcggaggag

SEQ ID NO: 3979376 - RNA, 19 nt, Human herpesvirus 5
gucgccgcgucagcggccg

SEQ ID NO: 3979377 - RNA, 22 nt, Human herpesvirus 5
gucgccgcgucagcggccgccg

SEQ ID NO: 3979378 - RNA, 15 nt, Human herpesvirus 5
ugcugcgucugucuu

SEQ ID NO: 3979379 - RNA, 23 nt, Human herpesvirus 5
ugcuggccgccgcugcacggcau

SEQ ID NO: 3979380 - RNA, 19 nt, Human herpesvirus 5
ugcuggcggccguggccug

SEQ ID NO: 3979381 - RNA, 15 nt, Human herpesvirus 5
ugcuguccucguccg

SEQ ID NO: 3979382 - RNA, 20 nt, Human herpesvirus 5
ugcuuauucuagcccucugg

SEQ ID NO: 3979383 - RNA, 15 nt, Human herpesvirus 5
ugcuugaagauuucc

SEQ ID NO: 3979384 - RNA, 22 nt, Human herpesvirus 5
uggaaaugcccgccaccaugca

SEQ ID NO: 3979385 - RNA, 24 nt, Human herpesvirus 5
uggaaauucaauaaaaaccaccgu

SEQ ID NO: 3979386 - RNA, 14 nt, Human herpesvirus 5
uggaacgcgugcgc

SEQ ID NO: 3979387 - RNA, 18 nt, Human herpesvirus 5
uggaaggcguggaugagg

SEQ ID NO: 3979388 - RNA, 15 nt, Human herpesvirus 5
uggaaguaacaucau

SEQ ID NO: 3979389 - RNA, 14 nt, Human herpesvirus 5
uggacaacuuuucc

SEQ ID NO: 3979390 - RNA, 16 nt, Human herpesvirus 5
uggaccagacggcguc

SEQ ID NO: 3979391 - RNA, 19 nt, Human herpesvirus 5
uggaccggugguacugcug

SEQ ID NO: 3979392 - RNA, 15 nt, Human herpesvirus 5
uggacgacgcgcugg

SEQ ID NO: 3979393 - RNA, 21 nt, Human herpesvirus 5
uggacgccaucauggaagagg

SEQ ID NO: 3979394 - RNA, 19 nt, Human herpesvirus 5
uggacgccugggcgcgacg

SEQ ID NO: 3979395 - RNA, 15 nt, Human herpesvirus 5
uggacugggacgagg

SEQ ID NO: 3979396 - RNA, 15 nt, Human herpesvirus 5
uggacuguguucgug

SEQ ID NO: 3979397 - RNA, 21 nt, Human herpesvirus 5
uggagaaaccgccguucggcu

SEQ ID NO: 3979398 - RNA, 11 nt, Human herpesvirus 5
uggagcccacg

SEQ ID NO: 3979399 - RNA, 13 nt, Human herpesvirus 5
uggagcccacgcc

SEQ ID NO: 3979400 - RNA, 18 nt, Human herpesvirus 5
uggaggagaccauccuca

SEQ ID NO: 3979401 - RNA, 13 nt, Human herpesvirus 5
uggauacuaguaa

SEQ ID NO: 3979402 - RNA, 14 nt, Human herpesvirus 5
uggaugagggcucu

SEQ ID NO: 3979403 - RNA, 22 nt, Human herpesvirus 5
uggcauauagccaauaaagaga

SEQ ID NO: 3979404 - RNA, 12 nt, Human herpesvirus 5
uggcccugcugu

SEQ ID NO: 3979405 - RNA, 17 nt, Human herpesvirus 5
uggcccuggucuggccc

SEQ ID NO: 3979406 - RNA, 18 nt, Human herpesvirus 5
uggcccuggucuggccca

SEQ ID NO: 3979407 - RNA, 16 nt, Human herpesvirus 5
uggccgaacagcagcu

SEQ ID NO: 3979408 - RNA, 22 nt, Human herpesvirus 5
uggccgcacaccuguuggagca

SEQ ID NO: 3979409 - RNA, 13 nt, Human herpesvirus 5
uggccuacggcug

SEQ ID NO: 3979410 - RNA, 17 nt, Human herpesvirus 5
uggccucgauccauccu

SEQ ID NO: 3979411 - RNA, 16 nt, Human herpesvirus 5
uggccugcaucuuccc

SEQ ID NO: 3979412 - RNA, 18 nt, Human herpesvirus 5
uggcgcaaaagcaccaug

SEQ ID NO: 3979413 - RNA, 20 nt, Human herpesvirus 5
uggcggcgguggagggcgcg

SEQ ID NO: 3979414 - RNA, 21 nt, Human herpesvirus 5
uggcgggccgaccgccgccgc

SEQ ID NO: 3979415 - RNA, 16 nt, Human herpesvirus 5
uggcgguccaguggca

SEQ ID NO: 3979416 - RNA, 15 nt, Human herpesvirus 5
uggcguccgggcucg

SEQ ID NO: 3979417 - RNA, 16 nt, Human herpesvirus 5
uggcucgggucggcug

SEQ ID NO: 3979418 - RNA, 22 nt, Human herpesvirus 5
uggcugcgccuccucgucggcc

SEQ ID NO: 3979419 - RNA, 17 nt, Human herpesvirus 5
ugggagaugcggggugg

SEQ ID NO: 3979420 - RNA, 22 nt, Human herpesvirus 5
ugggaguuuuuagcgcgugacc

SEQ ID NO: 3979421 - RNA, 16 nt, Human herpesvirus 5
ugggauggguguuuuu

SEQ ID NO: 3979422 - RNA, 15 nt, Human herpesvirus 5
ugggcgguggcggcc

SEQ ID NO: 3979423 - RNA, 19 nt, Human herpesvirus 5
ugggcgguggucggcugcc

SEQ ID NO: 3979424 - RNA, 14 nt, Human herpesvirus 5
ugggcuggggugcg

SEQ ID NO: 3979425 - RNA, 23 nt, Human herpesvirus 5
uggggacgagcaccggcgccugc

SEQ ID NO: 3979426 - RNA, 24 nt, Human herpesvirus 5
uggggcaacugcugccucgaugcg

SEQ ID NO: 3979427 - RNA, 13 nt, Human herpesvirus 5
uggggcugcgucg

SEQ ID NO: 3979428 - RNA, 11 nt, Human herpesvirus 5
uggggcugcug

SEQ ID NO: 3979429 - RNA, 12 nt, Human herpesvirus 5
uggggcugcugc

SEQ ID NO: 3979430 - RNA, 15 nt, Human herpesvirus 5
uggguauccccgauu

SEQ ID NO: 3979431 - RNA, 11 nt, Human herpesvirus 5
ugggugcaaug

SEQ ID NO: 3979432 - RNA, 22 nt, Human herpesvirus 5
ugguacgcugacguggugcgcu

SEQ ID NO: 3979433 - RNA, 21 nt, Human herpesvirus 5
ugguaguugauacgcuagcag

SEQ ID NO: 3979434 - RNA, 18 nt, Human herpesvirus 5
uggucauguucucccagg

SEQ ID NO: 3979435 - RNA, 14 nt, Human herpesvirus 5
ugguggcucaugcc

SEQ ID NO: 3979436 - RNA, 23 nt, Human herpesvirus 5
ugguguacgugcgguaacuggca

SEQ ID NO: 3979437 - RNA, 23 nt, Human herpesvirus 5
ugguuuauaagaagacuccaccg

SEQ ID NO: 3979438 - RNA, 14 nt, Human herpesvirus 5
ugguuuuugcuucc

SEQ ID NO: 3979439 - RNA, 22 nt, Human herpesvirus 5
uguacgugcgguaacuggcaga

SEQ ID NO: 3979440 - RNA, 17 nt, Human herpesvirus 5
uguagcgggcugucaca

SEQ ID NO: 3979441 - RNA, 16 nt, Human herpesvirus 5
uguaggcgacuggcua

SEQ ID NO: 3979442 - RNA, 14 nt, Human herpesvirus 5
uguccaccgacgcg

SEQ ID NO: 3979443 - RNA, 22 nt, Human herpesvirus 5
uguccauagugcgccaagccau

SEQ ID NO: 3979444 - RNA, 17 nt, Human herpesvirus 5
uguccucgcaccgggcu

SEQ ID NO: 3979445 - RNA, 15 nt, Human herpesvirus 5
uguccucuccuccuu

SEQ ID NO: 3979446 - RNA, 22 nt, Human herpesvirus 5
ugucgccacuauguccuccgca

SEQ ID NO: 3979447 - RNA, 16 nt, Human herpesvirus 5
ugucgcgacaaucgcc

SEQ ID NO: 3979448 - RNA, 23 nt, Human herpesvirus 5
ugucggcgugaaugggcacgccg

SEQ ID NO: 3979449 - RNA, 19 nt, Human herpesvirus 5
ugucucucgacguuucuga

SEQ ID NO: 3979450 - RNA, 14 nt, Human herpesvirus 5
ugucuucuccgggu

SEQ ID NO: 3979451 - RNA, 17 nt, Human herpesvirus 5
uguggcaaguuggccac

SEQ ID NO: 3979452 - RNA, 21 nt, Human herpesvirus 5
uguggcccgaagauguacaca

SEQ ID NO: 3979453 - RNA, 16 nt, Human herpesvirus 5
uguggcuguuguugac

SEQ ID NO: 3979454 - RNA, 13 nt, Human herpesvirus 5
uguggggcugcuc

SEQ ID NO: 3979455 - RNA, 22 nt, Human herpesvirus 5
ugugguagcuagugcagccuua

SEQ ID NO: 3979456 - RNA, 15 nt, Human herpesvirus 5
uguuacgugcccugu

SEQ ID NO: 3979457 - RNA, 16 nt, Human herpesvirus 5
uguuccuauugggaag

SEQ ID NO: 3979458 - RNA, 14 nt, Human herpesvirus 5
uguuccuguccggu

SEQ ID NO: 3979459 - RNA, 23 nt, Human herpesvirus 5
uguucgagaaugccucuacuugg

SEQ ID NO: 3979460 - RNA, 20 nt, Human herpesvirus 5
uguugcacgggcucggguga

SEQ ID NO: 3979461 - RNA, 22 nt, Human herpesvirus 5
uguuggccaccaugcugagcaa

SEQ ID NO: 3979462 - RNA, 17 nt, Human herpesvirus 5
uguuggugccccaggau

SEQ ID NO: 3979463 - RNA, 16 nt, Human herpesvirus 5
uguuuuauugacgaag

SEQ ID NO: 3979464 - RNA, 14 nt, Human herpesvirus 5
uguuuuuuccuucc

SEQ ID NO: 3979465 - RNA, 12 nt, Human herpesvirus 5
uuaaaguaaaua

SEQ ID NO: 3979466 - RNA, 23 nt, Human herpesvirus 5
uuaacaugaugaagauggccauc

SEQ ID NO: 3979467 - RNA, 15 nt, Human herpesvirus 5
uuacaaugucacugu

SEQ ID NO: 3979468 - RNA, 17 nt, Human herpesvirus 5
uuaccaacguaacagca

SEQ ID NO: 3979469 - RNA, 21 nt, Human herpesvirus 5
uuaccgccgccgcccgacgcc

SEQ ID NO: 3979470 - RNA, 17 nt, Human herpesvirus 5
uuagacacacgggggcg

SEQ ID NO: 3979471 - RNA, 15 nt, Human herpesvirus 5
uuagcggucuguuca

SEQ ID NO: 3979472 - RNA, 19 nt, Human herpesvirus 5
uuaucaucugcucccgcug

SEQ ID NO: 3979473 - RNA, 21 nt, Human herpesvirus 5
uuaucaucugcucccgcugcu

SEQ ID NO: 3979474 - RNA, 18 nt, Human herpesvirus 5
uuaucugccucuuccucg

SEQ ID NO: 3979475 - RNA, 20 nt, Human herpesvirus 5
uuaugauaucuacagcagau

SEQ ID NO: 3979476 - RNA, 16 nt, Human herpesvirus 5
uucaaagggagcccca

SEQ ID NO: 3979477 - RNA, 22 nt, Human herpesvirus 5
uucaccuuugcgcauccccuga

SEQ ID NO: 3979478 - RNA, 22 nt, Human herpesvirus 5
uucacggggagaagaaacaaga

SEQ ID NO: 3979479 - RNA, 17 nt, Human herpesvirus 5
uucagaccgcaacaaca

SEQ ID NO: 3979480 - RNA, 17 nt, Human herpesvirus 5
uucagcguccggccucg

SEQ ID NO: 3979481 - RNA, 14 nt, Human herpesvirus 5
uucagcucacuguu

SEQ ID NO: 3979482 - RNA, 20 nt, Human herpesvirus 5
uuccccauaagcuguguacu

SEQ ID NO: 3979483 - RNA, 17 nt, Human herpesvirus 5
uuccgauccuuggaaga

SEQ ID NO: 3979484 - RNA, 19 nt, Human herpesvirus 5
uuccuccucgucgucgccg

SEQ ID NO: 3979485 - RNA, 16 nt, Human herpesvirus 5
uucgaguccguccucg

SEQ ID NO: 3979486 - RNA, 19 nt, Human herpesvirus 5
uucgcgaggacaaggcucc

SEQ ID NO: 3979487 - RNA, 16 nt, Human herpesvirus 5
uucggccggcugcugc

SEQ ID NO: 3979488 - RNA, 18 nt, Human herpesvirus 5
uucggccggcugcugcac

SEQ ID NO: 3979489 - RNA, 15 nt, Human herpesvirus 5
uucggcucuccuccg

SEQ ID NO: 3979490 - RNA, 14 nt, Human herpesvirus 5
uucgucgagcaccc

SEQ ID NO: 3979491 - RNA, 23 nt, Human herpesvirus 5
uucugucgccgacuaaauucaug

SEQ ID NO: 3979492 - RNA, 20 nt, Human herpesvirus 5
gcuucuuucucaccgugcuc

SEQ ID NO: 3979493 - RNA, 11 nt, Human herpesvirus 5
gcuucuuuucu

SEQ ID NO: 3979494 - RNA, 23 nt, Human herpesvirus 5
gcuuuagccaggugaccagcagu

SEQ ID NO: 3979495 - RNA, 22 nt, Human herpesvirus 5
gcuuucagcguacucauuagcg

SEQ ID NO: 3979496 - RNA, 16 nt, Human herpesvirus 5
ggaaacauguccccau

SEQ ID NO: 3979497 - RNA, 16 nt, Human herpesvirus 5
ggaagcgaauaagcgc

SEQ ID NO: 3979498 - RNA, 12 nt, Human herpesvirus 5
ggaagcugcugg

SEQ ID NO: 3979499 - RNA, 20 nt, Human herpesvirus 5
ggaaggcggcucgcuggaag

SEQ ID NO: 3979500 - RNA, 13 nt, Human herpesvirus 5
ggaaugcggucag

SEQ ID NO: 3979501 - RNA, 18 nt, Human herpesvirus 5
ggaaugcggucaguuggg

SEQ ID NO: 3979502 - RNA, 22 nt, Human herpesvirus 5
ggacagagcagccguuuccaga

SEQ ID NO: 3979503 - RNA, 15 nt, Human herpesvirus 5
ggacgaaacagcagg

SEQ ID NO: 3979504 - RNA, 15 nt, Human herpesvirus 5
ggacgacguggccuc

SEQ ID NO: 3979505 - RNA, 21 nt, Human herpesvirus 5
ggacgcucguccucucugucu

SEQ ID NO: 3979506 - RNA, 16 nt, Human herpesvirus 5
ggacggcgacgaccgc

SEQ ID NO: 3979507 - RNA, 13 nt, Human herpesvirus 5
ggacuuggcagcg

SEQ ID NO: 3979508 - RNA, 18 nt, Human herpesvirus 5
ggagaaaaguggcagaua

SEQ ID NO: 3979509 - RNA, 21 nt, Human herpesvirus 5
ggagcagcucuuuuccagcgu

SEQ ID NO: 3979510 - RNA, 20 nt, Human herpesvirus 5
ggagccaaacugcgagcagc

SEQ ID NO: 3979511 - RNA, 23 nt, Human herpesvirus 5
ggagcuaauagauuaaugugucg

SEQ ID NO: 3979512 - RNA, 21 nt, Human herpesvirus 5
ggagcuacgcgaccagcugcu

SEQ ID NO: 3979513 - RNA, 22 nt, Human herpesvirus 5
ggagcuacgcgaccagcugcug

SEQ ID NO: 3979514 - RNA, 14 nt, Human herpesvirus 5
ggagcucaaguacc

SEQ ID NO: 3979515 - RNA, 21 nt, Human herpesvirus 5
ggagcucacccggcugcuggc

SEQ ID NO: 3979516 - RNA, 19 nt, Human herpesvirus 5
ggaggugaccuggcugcuu

SEQ ID NO: 3979517 - RNA, 16 nt, Human herpesvirus 5
ggagucuaccuccugc

SEQ ID NO: 3979518 - RNA, 22 nt, Human herpesvirus 5
ggaucaauugcgggcccugcug

SEQ ID NO: 3979519 - RNA, 20 nt, Human herpesvirus 5
ggaucauuuucuuggccgug

SEQ ID NO: 3979520 - RNA, 20 nt, Human herpesvirus 5
ggauccaaggccuccagcgc

SEQ ID NO: 3979521 - RNA, 23 nt, Human herpesvirus 5
ggaucggacacuuuaggcggcgc

SEQ ID NO: 3979522 - RNA, 23 nt, Human herpesvirus 5
ggaucuggcguuugaagcgcggu

SEQ ID NO: 3979523 - RNA, 12 nt, Human herpesvirus 5
ggaugaccuggc

SEQ ID NO: 3979524 - RNA, 13 nt, Human herpesvirus 5
ggaugacgagcgu

SEQ ID NO: 3979525 - RNA, 14 nt, Human herpesvirus 5
ggaugggggggacc

SEQ ID NO: 3979526 - RNA, 13 nt, Human herpesvirus 5
ggauugggcggac

SEQ ID NO: 3979527 - RNA, 19 nt, Human herpesvirus 5
ggauugggcggacgugcgu

SEQ ID NO: 3979528 - RNA, 16 nt, Human herpesvirus 5
ggcaacucgagauggu

SEQ ID NO: 3979529 - RNA, 18 nt, Human herpesvirus 5
ggcaauagcgcacacgag

SEQ ID NO: 3979530 - RNA, 13 nt, Human herpesvirus 5
ggcacgcgcgucg

SEQ ID NO: 3979531 - RNA, 16 nt, Human herpesvirus 5
ggcacgcgcgucggcc

SEQ ID NO: 3979532 - RNA, 19 nt, Human herpesvirus 5
ggcacucggcugugccugu

SEQ ID NO: 3979533 - RNA, 12 nt, Human herpesvirus 5
ggcagaaacgag

SEQ ID NO: 3979534 - RNA, 23 nt, Human herpesvirus 5
ggcagauucaguaaccuggagca

SEQ ID NO: 3979535 - RNA, 13 nt, Human herpesvirus 5
ggcagcggaggug

SEQ ID NO: 3979536 - RNA, 22 nt, Human herpesvirus 5
ggcagcgucucuugcggcgccg

SEQ ID NO: 3979537 - RNA, 12 nt, Human herpesvirus 5
ggcagcuggcuu

SEQ ID NO: 3979538 - RNA, 19 nt, Human herpesvirus 5
ggccaacaaccacggcgaa

SEQ ID NO: 3979539 - RNA, 21 nt, Human herpesvirus 5
ggccaacaagagaaagaccca

SEQ ID NO: 3979540 - RNA, 23 nt, Human herpesvirus 5
ggccaacaagagaaagacccauc

SEQ ID NO: 3979541 - RNA, 15 nt, Human herpesvirus 5
ggccacgagccagac

SEQ ID NO: 3979542 - RNA, 17 nt, Human herpesvirus 5
ggccaguacggccucug

SEQ ID NO: 3979543 - RNA, 23 nt, Human herpesvirus 5
ggccaguacggccucugggcuga

SEQ ID NO: 3979544 - RNA, 22 nt, Human herpesvirus 5
ggccauaagaaagagaaacccc

SEQ ID NO: 3979545 - RNA, 22 nt, Human herpesvirus 5
ggcccaugagguagaagggcug

SEQ ID NO: 3979546 - RNA, 15 nt, Human herpesvirus 5
ggccgaccgccgccg

SEQ ID NO: 3979547 - RNA, 16 nt, Human herpesvirus 5
ggccgacgaggccggc

SEQ ID NO: 3979548 - RNA, 20 nt, Human herpesvirus 5
ggccgccggugcuucuucua

SEQ ID NO: 3979549 - RNA, 14 nt, Human herpesvirus 5
ggccggcugcugca

SEQ ID NO: 3979550 - RNA, 15 nt, Human herpesvirus 5
ggccgucgcuugccg

SEQ ID NO: 3979551 - RNA, 22 nt, Human herpesvirus 5
ggccgucggcgucgcgucgcag

SEQ ID NO: 3979552 - RNA, 20 nt, Human herpesvirus 5
ggccgucugcacgccccgga

SEQ ID NO: 3979553 - RNA, 14 nt, Human herpesvirus 5
ggccgugguggccg

SEQ ID NO: 3979554 - RNA, 21 nt, Human herpesvirus 5
ggccugcaucuuccccgcgca

SEQ ID NO: 3979555 - RNA, 21 nt, Human herpesvirus 5
ggccuguggauagauuucugc

SEQ ID NO: 3979556 - RNA, 20 nt, Human herpesvirus 5
ggcgacgcgguuaagggaga

SEQ ID NO: 3979557 - RNA, 21 nt, Human herpesvirus 5
ggcgauggcaaggugcugcac

SEQ ID NO: 3979558 - RNA, 22 nt, Human herpesvirus 5
ggcgcaucacccgccucaugga

SEQ ID NO: 3979559 - RNA, 14 nt, Human herpesvirus 5
ggcgccgcgguggu

SEQ ID NO: 3979560 - RNA, 20 nt, Human herpesvirus 5
ggcgccgggacucuggugcu

SEQ ID NO: 3979561 - RNA, 14 nt, Human herpesvirus 5
ggcgcguagccacc

SEQ ID NO: 3979562 - RNA, 16 nt, Human herpesvirus 5
ggcgcguuguccucgc

SEQ ID NO: 3979563 - RNA, 17 nt, Human herpesvirus 5
ggcgcuguacggcagcg

SEQ ID NO: 3979564 - RNA, 22 nt, Human herpesvirus 5
ggcgcuguacggcagcggggag

SEQ ID NO: 3979565 - RNA, 14 nt, Human herpesvirus 5
ggcgcuucgagggc

SEQ ID NO: 3979566 - RNA, 23 nt, Human herpesvirus 5
ggcggaggagagaacggaagaag

SEQ ID NO: 3979567 - RNA, 13 nt, Human herpesvirus 5
ggcggaggagccg

SEQ ID NO: 3979568 - RNA, 20 nt, Human herpesvirus 5
ggcggcagccacggaggaga

SEQ ID NO: 3979569 - RNA, 18 nt, Human herpesvirus 5
ggcggccguugccggcaa

SEQ ID NO: 3979570 - RNA, 12 nt, Human herpesvirus 5
ggcggccucuuu

SEQ ID NO: 3979571 - RNA, 13 nt, Human herpesvirus 5
ggcgguccuccag

SEQ ID NO: 3979572 - RNA, 12 nt, Human herpesvirus 5
ggcgucggagag

SEQ ID NO: 3979573 - RNA, 16 nt, Human herpesvirus 5
ggcgugcaucugccga

SEQ ID NO: 3979574 - RNA, 17 nt, Human herpesvirus 5
ggcguucggacgaccuc

SEQ ID NO: 3979575 - RNA, 21 nt, Human herpesvirus 5
ggcguuucguccggaggagcg

SEQ ID NO: 3979576 - RNA, 17 nt, Human herpesvirus 5
ggcucacguagcaggcc

SEQ ID NO: 3979577 - RNA, 21 nt, Human herpesvirus 5
ggcucacgucacuacucuggg

SEQ ID NO: 3979578 - RNA, 21 nt, Human herpesvirus 5
ggcucccagagcugcuaggaa

SEQ ID NO: 3979579 - RNA, 12 nt, Human herpesvirus 5
ggcuccgccggc

SEQ ID NO: 3979580 - RNA, 15 nt, Human herpesvirus 5
ggcucuacagugggu

SEQ ID NO: 3979581 - RNA, 12 nt, Human herpesvirus 5
ggcugaucugca

SEQ ID NO: 3979582 - RNA, 13 nt, Human herpesvirus 5
ggcugcugcacca

SEQ ID NO: 3979583 - RNA, 12 nt, Human herpesvirus 5
ggcuggaggacu

SEQ ID NO: 3979584 - RNA, 15 nt, Human herpesvirus 5
ggcugugcgcgccgg

SEQ ID NO: 3979585 - RNA, 22 nt, Human herpesvirus 5
ggcuucccuccugcagcugcac

SEQ ID NO: 3979586 - RNA, 13 nt, Human herpesvirus 5
ggcuucgaacauc

SEQ ID NO: 3979587 - RNA, 13 nt, Human herpesvirus 5
ggcuucucuggag

SEQ ID NO: 3979588 - RNA, 20 nt, Human herpesvirus 5
ggcuugcuccucuuccaaau

SEQ ID NO: 3979589 - RNA, 14 nt, Human herpesvirus 5
gggagacggccugg

SEQ ID NO: 3979590 - RNA, 21 nt, Human herpesvirus 5
gggaucuaccagcccagggau

SEQ ID NO: 3979591 - RNA, 15 nt, Human herpesvirus 5
gggaugaugauaagu

SEQ ID NO: 3979592 - RNA, 14 nt, Human herpesvirus 5
gggcaacugcugcc

SEQ ID NO: 3979593 - RNA, 19 nt, Human herpesvirus 5
gggccggcccucggggugc

SEQ ID NO: 3979594 - RNA, 13 nt, Human herpesvirus 5
gggcgcagaaacu

SEQ ID NO: 3979595 - RNA, 17 nt, Human herpesvirus 5
gggcgcaucacccgccu

SEQ ID NO: 3979596 - RNA, 18 nt, Human herpesvirus 5
gggcgcaucacccgccuc

SEQ ID NO: 3979597 - RNA, 14 nt, Human herpesvirus 5
gggcgcgacggcaa

SEQ ID NO: 3979598 - RNA, 18 nt, Human herpesvirus 5
gggcggccgugcagcaag

SEQ ID NO: 3979599 - RNA, 14 nt, Human herpesvirus 5
gggcggucgacugg

SEQ ID NO: 3979600 - RNA, 20 nt, Human herpesvirus 5
gggcuggggugcgcuuggua

SEQ ID NO: 3979601 - RNA, 16 nt, Human herpesvirus 5
ggggcugcgucgccug

SEQ ID NO: 3979602 - RNA, 22 nt, Human herpesvirus 5
gggggaaccuacggcggcgguc

SEQ ID NO: 3979603 - RNA, 16 nt, Human herpesvirus 5
gggugccgccacgguu

SEQ ID NO: 3979604 - RNA, 18 nt, Human herpesvirus 5
gggugggcgcgacggcaa

SEQ ID NO: 3979605 - RNA, 16 nt, Human herpesvirus 5
gguaccgucuccacca

SEQ ID NO: 3979606 - RNA, 13 nt, Human herpesvirus 5
gguacgcugacgu

SEQ ID NO: 3979607 - RNA, 19 nt, Human herpesvirus 5
gcagcugcuggagcgcggc

SEQ ID NO: 3979608 - RNA, 13 nt, Human herpesvirus 5
gcagcugcuuucu

SEQ ID NO: 3979609 - RNA, 15 nt, Human herpesvirus 5
gcagcuggugaucgg

SEQ ID NO: 3979610 - RNA, 18 nt, Human herpesvirus 5
gcaggaaugcggcacccg

SEQ ID NO: 3979611 - RNA, 23 nt, Human herpesvirus 5
gcaggaggugggguggcucuugc

SEQ ID NO: 3979612 - RNA, 13 nt, Human herpesvirus 5
gcaggccgcgcag

SEQ ID NO: 3979613 - RNA, 15 nt, Human herpesvirus 5
gcagggaauuuugaa

SEQ ID NO: 3979614 - RNA, 19 nt, Human herpesvirus 5
gcaggucucgcgcaucgcc

SEQ ID NO: 3979615 - RNA, 19 nt, Human herpesvirus 5
gcaguaccucaacacauug

SEQ ID NO: 3979616 - RNA, 20 nt, Human herpesvirus 5
gcagugcaucuacguggucg

SEQ ID NO: 3979617 - RNA, 17 nt, Human herpesvirus 5
gcauaagcgcggagguu

SEQ ID NO: 3979618 - RNA, 12 nt, Human herpesvirus 5
gcaucacccgcc

SEQ ID NO: 3979619 - RNA, 18 nt, Human herpesvirus 5
gcaucaguuucugcggcg

SEQ ID NO: 3979620 - RNA, 15 nt, Human herpesvirus 5
gcaucgucaaagccg

SEQ ID NO: 3979621 - RNA, 22 nt, Human herpesvirus 5
gccaaacgcgugcgggugcaug

SEQ ID NO: 3979622 - RNA, 18 nt, Human herpesvirus 5
gccaacuccgugcuguug

SEQ ID NO: 3979623 - RNA, 19 nt, Human herpesvirus 5
gccaccaugcaucccacca

SEQ ID NO: 3979624 - RNA, 14 nt, Human herpesvirus 5
gccaguugcuguug

SEQ ID NO: 3979625 - RNA, 21 nt, Human herpesvirus 5
gccaugagcggcaggaaggcc

SEQ ID NO: 3979626 - RNA, 13 nt, Human herpesvirus 5
gcccaggguacgg

SEQ ID NO: 3979627 - RNA, 14 nt, Human herpesvirus 5
gcccauuguuuccu

SEQ ID NO: 3979628 - RNA, 15 nt, Human herpesvirus 5
gccccagcagaccag

SEQ ID NO: 3979629 - RNA, 14 nt, Human herpesvirus 5
gccccaucgggccc

SEQ ID NO: 3979630 - RNA, 12 nt, Human herpesvirus 5
gcccccaccccc

SEQ ID NO: 3979631 - RNA, 16 nt, Human herpesvirus 5
gcccccguggccgcuu

SEQ ID NO: 3979632 - RNA, 21 nt, Human herpesvirus 5
gcccgaagccgcgcgagcgug

SEQ ID NO: 3979633 - RNA, 13 nt, Human herpesvirus 5
gcccgacagcugc

SEQ ID NO: 3979634 - RNA, 23 nt, Human herpesvirus 5
gcccgaggaucuggcggccgccg

SEQ ID NO: 3979635 - RNA, 14 nt, Human herpesvirus 5
gcccgcagacacca

SEQ ID NO: 3979636 - RNA, 22 nt, Human herpesvirus 5
gcccgcuucaacgccugcacca

SEQ ID NO: 3979637 - RNA, 14 nt, Human herpesvirus 5
gcccgggccgccgc

SEQ ID NO: 3979638 - RNA, 17 nt, Human herpesvirus 5
gcccgggggugacaagg

SEQ ID NO: 3979639 - RNA, 18 nt, Human herpesvirus 5
gcccguucuccccgugga

SEQ ID NO: 3979640 - RNA, 16 nt, Human herpesvirus 5
gcccguucuuccgagu

SEQ ID NO: 3979641 - RNA, 22 nt, Human herpesvirus 5
gcccguuguguaugcaugucgc

SEQ ID NO: 3979642 - RNA, 13 nt, Human herpesvirus 5
gcccucgcagugc

SEQ ID NO: 3979643 - RNA, 11 nt, Human herpesvirus 5
gccgaaacacc

SEQ ID NO: 3979644 - RNA, 14 nt, Human herpesvirus 5
gccgacaaccugcu

SEQ ID NO: 3979645 - RNA, 17 nt, Human herpesvirus 5
gccgacaaccugcugca

SEQ ID NO: 3979646 - RNA, 14 nt, Human herpesvirus 5
gccgaccgccgccg

SEQ ID NO: 3979647 - RNA, 19 nt, Human herpesvirus 5
gccgacgcgcgcccgcgcc

SEQ ID NO: 3979648 - RNA, 13 nt, Human herpesvirus 5
gccgacucgcugc

SEQ ID NO: 3979649 - RNA, 17 nt, Human herpesvirus 5
gccgagugggacggcaa

SEQ ID NO: 3979650 - RNA, 18 nt, Human herpesvirus 5
gccgcagagggcgcgccg

SEQ ID NO: 3979651 - RNA, 17 nt, Human herpesvirus 5
gccgccaccacccgacu

SEQ ID NO: 3979652 - RNA, 19 nt, Human herpesvirus 5
gccgccgaagccuggggca

SEQ ID NO: 3979653 - RNA, 12 nt, Human herpesvirus 5
gccgccgccucc

SEQ ID NO: 3979654 - RNA, 14 nt, Human herpesvirus 5
gccgccgcggcguu

SEQ ID NO: 3979655 - RNA, 14 nt, Human herpesvirus 5
gccgcgcaggccgc

SEQ ID NO: 3979656 - RNA, 15 nt, Human herpesvirus 5
gccgcgccgccugga

SEQ ID NO: 3979657 - RNA, 14 nt, Human herpesvirus 5
gccgcgcuccaggc

SEQ ID NO: 3979658 - RNA, 21 nt, Human herpesvirus 5
gccgcgguacgcacgucgccg

SEQ ID NO: 3979659 - RNA, 19 nt, Human herpesvirus 5
gccgcggugccggcggcua

SEQ ID NO: 3979660 - RNA, 19 nt, Human herpesvirus 5
gccgcgugccugggaacgc

SEQ ID NO: 3979661 - RNA, 22 nt, Human herpesvirus 5
gccgcucaagccgcggugcagg

SEQ ID NO: 3979662 - RNA, 20 nt, Human herpesvirus 5
gccgcucaggucgcccaggc

SEQ ID NO: 3979663 - RNA, 21 nt, Human herpesvirus 5
gccgcucgggaacagacccga

SEQ ID NO: 3979664 - RNA, 19 nt, Human herpesvirus 5
gccgcuggacugacacagc

SEQ ID NO: 3979665 - RNA, 20 nt, Human herpesvirus 5
gccggagcuacgcgaccagc

SEQ ID NO: 3979666 - RNA, 19 nt, Human herpesvirus 5
gccggccguuacgccgacg

SEQ ID NO: 3979667 - RNA, 16 nt, Human herpesvirus 5
gccggcggagacgacg

SEQ ID NO: 3979668 - RNA, 18 nt, Human herpesvirus 5
gccgggacucuggugcua

SEQ ID NO: 3979669 - RNA, 18 nt, Human herpesvirus 5
gccggggaagccuccgga

SEQ ID NO: 3979670 - RNA, 22 nt, Human herpesvirus 5
gccguacccgccccagcagacc

SEQ ID NO: 3979671 - RNA, 20 nt, Human herpesvirus 5
gccgugacacuuuggcucuu

SEQ ID NO: 3979672 - RNA, 13 nt, Human herpesvirus 5
gccgugacgucgc

SEQ ID NO: 3979673 - RNA, 12 nt, Human herpesvirus 5
gccgugcucagc

SEQ ID NO: 3979674 - RNA, 19 nt, Human herpesvirus 5
gccgugcucuuggcgccgc

SEQ ID NO: 3979675 - RNA, 22 nt, Human herpesvirus 5
gccguguaaugggggugggcga

SEQ ID NO: 3979676 - RNA, 20 nt, Human herpesvirus 5
gccguguuuuugcucgagac

SEQ ID NO: 3979677 - RNA, 22 nt, Human herpesvirus 5
gccuccgaacgcucgugagcaa

SEQ ID NO: 3979678 - RNA, 23 nt, Human herpesvirus 5
gccuccguccucgucgccuucca

SEQ ID NO: 3979679 - RNA, 13 nt, Human herpesvirus 5
gccucggguugcc

SEQ ID NO: 3979680 - RNA, 21 nt, Human herpesvirus 5
gccugagcgcgcucagcuacc

SEQ ID NO: 3979681 - RNA, 17 nt, Human herpesvirus 5
gccugcaccaaccgacg

SEQ ID NO: 3979682 - RNA, 23 nt, Human herpesvirus 5
gccugccgcacgcgcuagccuuu

SEQ ID NO: 3979683 - RNA, 17 nt, Human herpesvirus 5
gccugcgacguuggcuc

SEQ ID NO: 3979684 - RNA, 17 nt, Human herpesvirus 5
gccuggacgccugggcg

SEQ ID NO: 3979685 - RNA, 19 nt, Human herpesvirus 5
gccuggagcgaguggggca

SEQ ID NO: 3979686 - RNA, 21 nt, Human herpesvirus 5
gccugggaacgcgcgcacggc

SEQ ID NO: 3979687 - RNA, 21 nt, Human herpesvirus 5
caaagcccgggccgccgccag

SEQ ID NO: 3979688 - RNA, 23 nt, Human herpesvirus 5
caaagcuggacagugagagcuca

SEQ ID NO: 3979689 - RNA, 15 nt, Human herpesvirus 5
caaauaccaacacua

SEQ ID NO: 3979690 - RNA, 19 nt, Human herpesvirus 5
caacaaaaaaaaggaggac

SEQ ID NO: 3979691 - RNA, 14 nt, Human herpesvirus 5
caacaacagcaaca

SEQ ID NO: 3979692 - RNA, 18 nt, Human herpesvirus 5
caacaacgguagaugagc

SEQ ID NO: 3979693 - RNA, 13 nt, Human herpesvirus 5
caacaauaaagcu

SEQ ID NO: 3979694 - RNA, 15 nt, Human herpesvirus 5
caacagcagcaacag

SEQ ID NO: 3979695 - RNA, 22 nt, Human herpesvirus 5
caacagccuguggcaccgccuc

SEQ ID NO: 3979696 - RNA, 16 nt, Human herpesvirus 5
caacagcggcgacaga

SEQ ID NO: 3979697 - RNA, 21 nt, Human herpesvirus 5
caacaguuaucagcaauaaaa

SEQ ID NO: 3979698 - RNA, 23 nt, Human herpesvirus 5
caacauacaguacaacaguuauc

SEQ ID NO: 3979699 - RNA, 20 nt, Human herpesvirus 5
caacgcgcccgacagcugca

SEQ ID NO: 3979700 - RNA, 19 nt, Human herpesvirus 5
caacgcgugaaacaagagc

SEQ ID NO: 3979701 - RNA, 15 nt, Human herpesvirus 5
caacgucaugcauuc

SEQ ID NO: 3979702 - RNA, 24 nt, Human herpesvirus 5
caacuaccgugccaccugcgagga

SEQ ID NO: 3979703 - RNA, 18 nt, Human herpesvirus 5
caacucuaucgcgacaga

SEQ ID NO: 3979704 - RNA, 18 nt, Human herpesvirus 5
caacugguuccugcaggu

SEQ ID NO: 3979705 - RNA, 22 nt, Human herpesvirus 5
caacuuaaccacaagaaacgcu

SEQ ID NO: 3979706 - RNA, 12 nt, Human herpesvirus 5
caagacgcauga

SEQ ID NO: 3979707 - RNA, 18 nt, Human herpesvirus 5
caagacgcgccucucgga

SEQ ID NO: 3979708 - RNA, 22 nt, Human herpesvirus 5
caagagcaugcugugggcccac

SEQ ID NO: 3979709 - RNA, 17 nt, Human herpesvirus 5
caagcgccgucacuucc

SEQ ID NO: 3979710 - RNA, 16 nt, Human herpesvirus 5
caagcguauccugguc

SEQ ID NO: 3979711 - RNA, 13 nt, Human herpesvirus 5
caagcuugguaca

SEQ ID NO: 3979712 - RNA, 22 nt, Human herpesvirus 5
caaggacuguuuucucaaucug

SEQ ID NO: 3979713 - RNA, 16 nt, Human herpesvirus 5
caaggcgacauggccc

SEQ ID NO: 3979714 - RNA, 24 nt, Human herpesvirus 5
caaggcuccgaaaccgagcaagca

SEQ ID NO: 3979715 - RNA, 16 nt, Human herpesvirus 5
caaggucaacuacagc

SEQ ID NO: 3979716 - RNA, 18 nt, Human herpesvirus 5
caaguacagcggcucgcc

SEQ ID NO: 3979717 - RNA, 21 nt, Human herpesvirus 5
caaguucgaucucaugucgcu

SEQ ID NO: 3979718 - RNA, 14 nt, Human herpesvirus 5
caaucacccacaga

SEQ ID NO: 3979719 - RNA, 20 nt, Human herpesvirus 5
caaucgacugccuaacugua

SEQ ID NO: 3979720 - RNA, 20 nt, Human herpesvirus 5
caauggaagccauacuucuc

SEQ ID NO: 3979721 - RNA, 17 nt, Human herpesvirus 5
caauguuacacauuacu

SEQ ID NO: 3979722 - RNA, 14 nt, Human herpesvirus 5
caauuccccucgcc

SEQ ID NO: 3979723 - RNA, 11 nt, Human herpesvirus 5
cacacgcagac

SEQ ID NO: 3979724 - RNA, 22 nt, Human herpesvirus 5
cacacguguggaagacauggcg

SEQ ID NO: 3979725 - RNA, 23 nt, Human herpesvirus 5
cacacuggcuggaauacguggcg

SEQ ID NO: 3979726 - RNA, 16 nt, Human herpesvirus 5
cacagaccacgugccu

SEQ ID NO: 3979727 - RNA, 15 nt, Human herpesvirus 5
cacagcagccgcgcu

SEQ ID NO: 3979728 - RNA, 13 nt, Human herpesvirus 5
cacagcgccaggc

SEQ ID NO: 3979729 - RNA, 19 nt, Human herpesvirus 5
cacagcgucgccacauugg

SEQ ID NO: 3979730 - RNA, 16 nt, Human herpesvirus 5
cacagcgucuggccag

SEQ ID NO: 3979731 - RNA, 23 nt, Human herpesvirus 5
cacagggaauaauaauaccacaa

SEQ ID NO: 3979732 - RNA, 18 nt, Human herpesvirus 5
cacaucacccaacacugc

SEQ ID NO: 3979733 - RNA, 12 nt, Human herpesvirus 5
cacaucggugcc

SEQ ID NO: 3979734 - RNA, 18 nt, Human herpesvirus 5
cacaucugucaccucaca

SEQ ID NO: 3979735 - RNA, 12 nt, Human herpesvirus 5
cacaugcugcuu

SEQ ID NO: 3979736 - RNA, 13 nt, Human herpesvirus 5
caccaaccgacgu

SEQ ID NO: 3979737 - RNA, 13 nt, Human herpesvirus 5
caccaagaaacac

SEQ ID NO: 3979738 - RNA, 15 nt, Human herpesvirus 5
caccaauaggggagu

SEQ ID NO: 3979739 - RNA, 15 nt, Human herpesvirus 5
caccaauugcuuuaa

SEQ ID NO: 3979740 - RNA, 16 nt, Human herpesvirus 5
caccacccgacugcag

SEQ ID NO: 3979741 - RNA, 15 nt, Human herpesvirus 5
caccacgcagcaggc

SEQ ID NO: 3979742 - RNA, 17 nt, Human herpesvirus 5
caccccccgggccacca

SEQ ID NO: 3979743 - RNA, 17 nt, Human herpesvirus 5
caccccuuuuggugugu

SEQ ID NO: 3979744 - RNA, 23 nt, Human herpesvirus 5
caccccuuuuggugugugucuau

SEQ ID NO: 3979745 - RNA, 14 nt, Human herpesvirus 5
cacccgacugcagc

SEQ ID NO: 3979746 - RNA, 15 nt, Human herpesvirus 5
caccgacgacgacga

SEQ ID NO: 3979747 - RNA, 14 nt, Human herpesvirus 5
caccgccuccgacg

SEQ ID NO: 3979748 - RNA, 23 nt, Human herpesvirus 5
caccgcgaguaucgggccgucgc

SEQ ID NO: 3979749 - RNA, 20 nt, Human herpesvirus 5
caccgcgccgggacccacgg

SEQ ID NO: 3979750 - RNA, 22 nt, Human herpesvirus 5
caccggccuccgacgacgccga

SEQ ID NO: 3979751 - RNA, 14 nt, Human herpesvirus 5
caccgucagcugcg

SEQ ID NO: 3979752 - RNA, 15 nt, Human herpesvirus 5
caccgucgcccucag

SEQ ID NO: 3979753 - RNA, 12 nt, Human herpesvirus 5
caccugcugccg

SEQ ID NO: 3979754 - RNA, 22 nt, Human herpesvirus 5
caccuggacgggggggaccggg

SEQ ID NO: 3979755 - RNA, 17 nt, Human herpesvirus 5
caccuggacuucaaugu

SEQ ID NO: 3979756 - RNA, 23 nt, Human herpesvirus 5
caccuucccucuagagacagacg

SEQ ID NO: 3979757 - RNA, 12 nt, Human herpesvirus 5
cacgacuggcca

SEQ ID NO: 3979758 - RNA, 19 nt, Human herpesvirus 5
cacgagcaugaacugccac

SEQ ID NO: 3979759 - RNA, 19 nt, Human herpesvirus 5
cacgaucgcuggugucucu

SEQ ID NO: 3979760 - RNA, 23 nt, Human herpesvirus 5
cacgcaucugcaagucccuggcc

SEQ ID NO: 3979761 - RNA, 14 nt, Human herpesvirus 5
cacgccaaaccgcg

SEQ ID NO: 3979762 - RNA, 11 nt, Human herpesvirus 5
cacgccggcgg

SEQ ID NO: 3979763 - RNA, 14 nt, Human herpesvirus 5
cacgcgcgacuugg

SEQ ID NO: 3979764 - RNA, 15 nt, Human herpesvirus 5
cacgcggaugagcgu

SEQ ID NO: 3979765 - RNA, 23 nt, Human herpesvirus 5
cacgcggaugagcgugcugcucu

SEQ ID NO: 3979766 - RNA, 24 nt, Human herpesvirus 5
cacgcggcguacgucaccgcgcua

SEQ ID NO: 3979767 - RNA, 24 nt, Human herpesvirus 5
cacgcuugucauagucacgucgcu

SEQ ID NO: 3979768 - RNA, 17 nt, Human herpesvirus 5
cacggcaucaugcuggg

SEQ ID NO: 3979769 - RNA, 21 nt, Human herpesvirus 5
cacggcaucaugcugggcgac

SEQ ID NO: 3979770 - RNA, 19 nt, Human herpesvirus 5
cacggccugcgggcaggcg

SEQ ID NO: 3979771 - RNA, 22 nt, Human herpesvirus 5
cacggcgccggugacccgcccc

SEQ ID NO: 3979772 - RNA, 16 nt, Human herpesvirus 5
cacggcuaccaugcgc

SEQ ID NO: 3979773 - RNA, 23 nt, Human herpesvirus 5
cacgggcucgaccggcggcugcu

SEQ ID NO: 3979774 - RNA, 14 nt, Human herpesvirus 5
cacgggcugcuggu

SEQ ID NO: 3979775 - RNA, 18 nt, Human herpesvirus 5
cacggucgggcacucggc

SEQ ID NO: 3979776 - RNA, 17 nt, Human herpesvirus 5
cacguagaucccacugg

SEQ ID NO: 3979777 - RNA, 14 nt, Human herpesvirus 5
cacguccaugucgc

SEQ ID NO: 3979778 - RNA, 19 nt, Human herpesvirus 5
cacgucgauucccaucuca

SEQ ID NO: 3979779 - RNA, 21 nt, Human herpesvirus 5
cacgucuagcaggcccaggcc

SEQ ID NO: 3979780 - RNA, 17 nt, Human herpesvirus 5
cacguguggaagacaug

SEQ ID NO: 3979781 - RNA, 14 nt, Human herpesvirus 5
cacguuaauuccag

SEQ ID NO: 3979782 - RNA, 21 nt, Human herpesvirus 5
cacuaaauuguuauugccagu

SEQ ID NO: 3979783 - RNA, 20 nt, Human herpesvirus 5
cacuaccagcugggccuaca

SEQ ID NO: 3979784 - RNA, 14 nt, Human herpesvirus 5
cacucacgcggccg

SEQ ID NO: 3979785 - RNA, 23 nt, Human herpesvirus 5
cacuccacacgccauaacaaacc

SEQ ID NO: 3979786 - RNA, 13 nt, Human herpesvirus 5
cacuccguaagga

SEQ ID NO: 3979787 - RNA, 20 nt, Human herpesvirus 5
cacuuuuaacagcucaugcc

SEQ ID NO: 3979788 - RNA, 15 nt, Human herpesvirus 5
cagaacccgacgcgg

SEQ ID NO: 3979789 - RNA, 20 nt, Human herpesvirus 5
cagaaucuauaaauugcucu

SEQ ID NO: 3979790 - RNA, 17 nt, Human herpesvirus 5
cagaaugaaccuuguaa

SEQ ID NO: 3979791 - RNA, 14 nt, Human herpesvirus 5
cagacaccaagcau

SEQ ID NO: 3979792 - RNA, 22 nt, Human herpesvirus 5
cagaccgcaacaacagcagcaa

SEQ ID NO: 3979793 - RNA, 19 nt, Human herpesvirus 5
cagacgaugaaccuucccc

SEQ ID NO: 3979794 - RNA, 23 nt, Human herpesvirus 5
cagacgucggcgguccuccagca

SEQ ID NO: 3979795 - RNA, 12 nt, Human herpesvirus 5
cagagcugcuag

SEQ ID NO: 3979796 - RNA, 14 nt, Human herpesvirus 5
cagaggacggagga

SEQ ID NO: 3979797 - RNA, 17 nt, Human herpesvirus 5
cagaggucgccgcugau

SEQ ID NO: 3979798 - RNA, 20 nt, Human herpesvirus 5
cagaugacgagcgccggcga

SEQ ID NO: 3979799 - RNA, 13 nt, Human herpesvirus 5
cagcaaugucgua

SEQ ID NO: 3979800 - RNA, 20 nt, Human herpesvirus 5
cagcacauuagacacacggg

SEQ ID NO: 3979801 - RNA, 19 nt, Human herpesvirus 5
cagcacggggaucuugguc

SEQ ID NO: 3979802 - RNA, 18 nt, Human herpesvirus 5
cagcagcaacagcagcca

SEQ ID NO: 3979803 - RNA, 16 nt, Human herpesvirus 5
uccgcgugcuccacca

SEQ ID NO: 3979804 - RNA, 12 nt, Human herpesvirus 5
uccgcuggaaau

SEQ ID NO: 3979805 - RNA, 22 nt, Human herpesvirus 5
uccgguggcgcguagccaccug

SEQ ID NO: 3979806 - RNA, 16 nt, Human herpesvirus 5
uccgugauagccacga

SEQ ID NO: 3979807 - RNA, 13 nt, Human herpesvirus 5
uccgugccagcug

SEQ ID NO: 3979808 - RNA, 22 nt, Human herpesvirus 5
uccgugugcugugguacgucaa

SEQ ID NO: 3979809 - RNA, 21 nt, Human herpesvirus 5
uccuccaacucgaccugccgc

SEQ ID NO: 3979810 - RNA, 22 nt, Human herpesvirus 5
uccucggacgaaggggaggacg

SEQ ID NO: 3979811 - RNA, 17 nt, Human herpesvirus 5
uccucuaccccgccgcc

SEQ ID NO: 3979812 - RNA, 17 nt, Human herpesvirus 5
uccugcugcgcaucuac

SEQ ID NO: 3979813 - RNA, 11 nt, Human herpesvirus 5
uccugcugcua

SEQ ID NO: 3979814 - RNA, 15 nt, Human herpesvirus 5
uccuuaucugggugc

SEQ ID NO: 3979815 - RNA, 15 nt, Human herpesvirus 5
ucgaaaacaaccaca

SEQ ID NO: 3979816 - RNA, 16 nt, Human herpesvirus 5
ucgaaauaaccuacgu

SEQ ID NO: 3979817 - RNA, 14 nt, Human herpesvirus 5
ucgacgacgccguc

SEQ ID NO: 3979818 - RNA, 16 nt, Human herpesvirus 5
ucgacgcaucugucau

SEQ ID NO: 3979819 - RNA, 12 nt, Human herpesvirus 5
ucgacggcggua

SEQ ID NO: 3979820 - RNA, 12 nt, Human herpesvirus 5
ucgagcgcgacc

SEQ ID NO: 3979821 - RNA, 14 nt, Human herpesvirus 5
ucgaugugguucug

SEQ ID NO: 3979822 - RNA, 12 nt, Human herpesvirus 5
ucgccccucacg

SEQ ID NO: 3979823 - RNA, 15 nt, Human herpesvirus 5
ucgccgccgcgccac

SEQ ID NO: 3979824 - RNA, 12 nt, Human herpesvirus 5
ucgccgccggga

SEQ ID NO: 3979825 - RNA, 14 nt, Human herpesvirus 5
ucgcgagcugagcu

SEQ ID NO: 3979826 - RNA, 17 nt, Human herpesvirus 5
ucgcgccgugcgcgacg

SEQ ID NO: 3979827 - RNA, 12 nt, Human herpesvirus 5
ucgcgcgucacu

SEQ ID NO: 3979828 - RNA, 13 nt, Human herpesvirus 5
ucgcggacgaaag

SEQ ID NO: 3979829 - RNA, 16 nt, Human herpesvirus 5
ucgcgguggcggccgc

SEQ ID NO: 3979830 - RNA, 19 nt, Human herpesvirus 5
ucgcuccgcggucaggucc

SEQ ID NO: 3979831 - RNA, 22 nt, Human herpesvirus 5
ucgcuggaaagacaauaaacag

SEQ ID NO: 3979832 - RNA, 15 nt, Human herpesvirus 5
ucggaagcuguuuug

SEQ ID NO: 3979833 - RNA, 23 nt, Human herpesvirus 5
ucggagcacgggcgaaacgucag

SEQ ID NO: 3979834 - RNA, 22 nt, Human herpesvirus 5
ucggcacgcuggcgggccgacc

SEQ ID NO: 3979835 - RNA, 19 nt, Human herpesvirus 5
ucggugacaucaccgccuc

SEQ ID NO: 3979836 - RNA, 19 nt, Human herpesvirus 5
ucggugaccacaaccacgu

SEQ ID NO: 3979837 - RNA, 20 nt, Human herpesvirus 5
ucguacgacgucugcucaaa

SEQ ID NO: 3979838 - RNA, 22 nt, Human herpesvirus 5
ucgucugcauguucaucacgua

SEQ ID NO: 3979839 - RNA, 17 nt, Human herpesvirus 5
ucgugaaacagcagcuc

SEQ ID NO: 3979840 - RNA, 22 nt, Human herpesvirus 5
ucgugagcagcgugcaccugcu

SEQ ID NO: 3979841 - RNA, 16 nt, Human herpesvirus 5
ucguguccggacccca

SEQ ID NO: 3979842 - RNA, 19 nt, Human herpesvirus 5
ucguuguccucuccuccuu

SEQ ID NO: 3979843 - RNA, 18 nt, Human herpesvirus 5
ucuaccagcccagggauc

SEQ ID NO: 3979844 - RNA, 13 nt, Human herpesvirus 5
ucuacgcgugcac

SEQ ID NO: 3979845 - RNA, 20 nt, Human herpesvirus 5
ucuagacucacuuuauugaa

SEQ ID NO: 3979846 - RNA, 17 nt, Human herpesvirus 5
ucuagcuggcggccucu

SEQ ID NO: 3979847 - RNA, 14 nt, Human herpesvirus 5
ucuauguuauacuc

SEQ ID NO: 3979848 - RNA, 18 nt, Human herpesvirus 5
ucucacgaucgcuggugu

SEQ ID NO: 3979849 - RNA, 14 nt, Human herpesvirus 5
ucucccucugcugu

SEQ ID NO: 3979850 - RNA, 19 nt, Human herpesvirus 5
ucuccuccgucgcggccag

SEQ ID NO: 3979851 - RNA, 23 nt, Human herpesvirus 5
ucucguuguacgcauuacacagg

SEQ ID NO: 3979852 - RNA, 17 nt, Human herpesvirus 5
ucucucuggucuucccu

SEQ ID NO: 3979853 - RNA, 14 nt, Human herpesvirus 5
ucugacguccagca

SEQ ID NO: 3979854 - RNA, 14 nt, Human herpesvirus 5
ucugcaagucccug

SEQ ID NO: 3979855 - RNA, 23 nt, Human herpesvirus 5
ucugccggcugcggcggcacucg

SEQ ID NO: 3979856 - RNA, 21 nt, Human herpesvirus 5
ucugcgccuuuugcuggcugg

SEQ ID NO: 3979857 - RNA, 19 nt, Human herpesvirus 5
ucugcgguacgcgcacgcc

SEQ ID NO: 3979858 - RNA, 15 nt, Human herpesvirus 5
ucuggagacggccgu

SEQ ID NO: 3979859 - RNA, 13 nt, Human herpesvirus 5
ucuuaugaagcug

SEQ ID NO: 3979860 - RNA, 14 nt, Human herpesvirus 5
ucuucacuacguug

SEQ ID NO: 3979861 - RNA, 13 nt, Human herpesvirus 5
ucuucagaaaaca

SEQ ID NO: 3979862 - RNA, 13 nt, Human herpesvirus 5
ucuuccccucugc

SEQ ID NO: 3979863 - RNA, 17 nt, Human herpesvirus 5
ucuugauacagggcgaa

SEQ ID NO: 3979864 - RNA, 16 nt, Human herpesvirus 5
ucuugcccacgccguc

SEQ ID NO: 3979865 - RNA, 21 nt, Human herpesvirus 5
ucuugcgauguagcagaaaac

SEQ ID NO: 3979866 - RNA, 20 nt, Human herpesvirus 5
ucuuugcuuaucugccucuu

SEQ ID NO: 3979867 - RNA, 23 nt, Human herpesvirus 5
ucuuuucgaugaaccuccgcccu

SEQ ID NO: 3979868 - RNA, 15 nt, Human herpesvirus 5
ugaaaccuaccuggg

SEQ ID NO: 3979869 - RNA, 18 nt, Human herpesvirus 5
ugaaaccuaccugggcug

SEQ ID NO: 3979870 - RNA, 20 nt, Human herpesvirus 5
ugaaacgcuuuaagcugcuc

SEQ ID NO: 3979871 - RNA, 15 nt, Human herpesvirus 5
ugaaccuccgcccuu

SEQ ID NO: 3979872 - RNA, 12 nt, Human herpesvirus 5
ugaaccuucccc

SEQ ID NO: 3979873 - RNA, 17 nt, Human herpesvirus 5
ugaagcggaugauucgc

SEQ ID NO: 3979874 - RNA, 22 nt, Human herpesvirus 5
ugaaucuuccccucugcugcug

SEQ ID NO: 3979875 - RNA, 17 nt, Human herpesvirus 5
ugacaacggcuggaaau

SEQ ID NO: 3979876 - RNA, 13 nt, Human herpesvirus 5
ugacacggcgguu

SEQ ID NO: 3979877 - RNA, 13 nt, Human herpesvirus 5
ugaccggaggcua

SEQ ID NO: 3979878 - RNA, 14 nt, Human herpesvirus 5
ugacgaggagcuuc

SEQ ID NO: 3979879 - RNA, 19 nt, Human herpesvirus 5
ugacgcuaggcggcgccgg

SEQ ID NO: 3979880 - RNA, 18 nt, Human herpesvirus 5
ugacugcaacgacaccuc

SEQ ID NO: 3979881 - RNA, 21 nt, Human herpesvirus 5
ugagauucaggacgaggagcc

SEQ ID NO: 3979882 - RNA, 21 nt, Human herpesvirus 5
ugagcacaaacugcgacacgu

SEQ ID NO: 3979883 - RNA, 15 nt, Human herpesvirus 5
ugagcagcaaaacga

SEQ ID NO: 3979884 - RNA, 19 nt, Human herpesvirus 5
ugagcggcaggaaggccuc

SEQ ID NO: 3979885 - RNA, 21 nt, Human herpesvirus 5
ggcaacgugccacgugacuca

SEQ ID NO: 3979886 - RNA, 14 nt, Human herpesvirus 5
ggcaacugcugccu

SEQ ID NO: 3979887 - RNA, 19 nt, Human herpesvirus 5
ggcaccgcgacagcuaccg

SEQ ID NO: 3979888 - RNA, 19 nt, Human herpesvirus 5
ggcagacggacggugcggg

SEQ ID NO: 3979889 - RNA, 14 nt, Human herpesvirus 5
ggcagaggucgccg

SEQ ID NO: 3979890 - RNA, 12 nt, Human herpesvirus 5
ggcagcacaccu

SEQ ID NO: 3979891 - RNA, 18 nt, Human herpesvirus 5
ggcagcccauccucgugg

SEQ ID NO: 3979892 - RNA, 14 nt, Human herpesvirus 5
ggcagcgggccugu

SEQ ID NO: 3979893 - RNA, 20 nt, Human herpesvirus 5
ggcagcgguacccgacgcgg

SEQ ID NO: 3979894 - RNA, 14 nt, Human herpesvirus 5
ggcaggccgugggg

SEQ ID NO: 3979895 - RNA, 14 nt, Human herpesvirus 5
ggcauagugccagc

SEQ ID NO: 3979896 - RNA, 18 nt, Human herpesvirus 5
ggcauagugccagcccua

SEQ ID NO: 3979897 - RNA, 23 nt, Human herpesvirus 5
ggccaacagccuguggcaccgcc

SEQ ID NO: 3979898 - RNA, 18 nt, Human herpesvirus 5
ugcggcgcuucgagggcu

SEQ ID NO: 3979899 - RNA, 15 nt, Human herpesvirus 5
ugcggcugugucggg

SEQ ID NO: 3979900 - RNA, 23 nt, Human herpesvirus 5
ugcgggcaggcggguugcagcuu

SEQ ID NO: 3979901 - RNA, 14 nt, Human herpesvirus 5
ugcggggucgacug

SEQ ID NO: 3979902 - RNA, 18 nt, Human herpesvirus 5
ugcgggugccgggacagc

SEQ ID NO: 3979903 - RNA, 17 nt, Human herpesvirus 5
ugcgugcuguacgucac

SEQ ID NO: 3979904 - RNA, 13 nt, Human herpesvirus 5
ugcuccucuucca

SEQ ID NO: 3979905 - RNA, 20 nt, Human herpesvirus 5
ugcucgaaauguugacccag

SEQ ID NO: 3979906 - RNA, 15 nt, Human herpesvirus 5
ugcucgcgcacguag

SEQ ID NO: 3979907 - RNA, 21 nt, Human herpesvirus 5
ugcugagacugagacuggugg

SEQ ID NO: 3979908 - RNA, 13 nt, Human herpesvirus 5
ugcugaucgccgu

SEQ ID NO: 3979909 - RNA, 16 nt, Human herpesvirus 5
ugcugaugugccagcc

SEQ ID NO: 3979910 - RNA, 19 nt, Human herpesvirus 5
ugcugauuacaaugauggc

SEQ ID NO: 3979911 - RNA, 16 nt, Human herpesvirus 5
ugcugcacgggcucga

SEQ ID NO: 3979912 - RNA, 22 nt, Human herpesvirus 5
ugcugcugguuuuugcccccuc

SEQ ID NO: 3979913 - RNA, 23 nt, Human herpesvirus 5
ugcugcugguuuuugcccccucc

SEQ ID NO: 3979914 - RNA, 13 nt, Human herpesvirus 5
ugcuggcggccgu

SEQ ID NO: 3979915 - RNA, 13 nt, Human herpesvirus 5
ugcuuagcugcac

SEQ ID NO: 3979916 - RNA, 14 nt, Human herpesvirus 5
ugcuuagcugcaca

SEQ ID NO: 3979917 - RNA, 13 nt, Human herpesvirus 5
ugcuucuuuucug

SEQ ID NO: 3979918 - RNA, 13 nt, Human herpesvirus 5
uggaagcugcugg

SEQ ID NO: 3979919 - RNA, 20 nt, Human herpesvirus 5
uggacacucuggcccugcug

SEQ ID NO: 3979920 - RNA, 16 nt, Human herpesvirus 5
uggacaugauggaaau

SEQ ID NO: 3979921 - RNA, 18 nt, Human herpesvirus 5
uggacauuuggguuucca

SEQ ID NO: 3979922 - RNA, 14 nt, Human herpesvirus 5
uggagacaguuucc

SEQ ID NO: 3979923 - RNA, 18 nt, Human herpesvirus 5
uggagacaguuuccacgc

SEQ ID NO: 3979924 - RNA, 15 nt, Human herpesvirus 5
uggagcaacgggcgg

SEQ ID NO: 3979925 - RNA, 13 nt, Human herpesvirus 5
uggagcagcucuu

SEQ ID NO: 3979926 - RNA, 15 nt, Human herpesvirus 5
uggaggccaacaucu

SEQ ID NO: 3979927 - RNA, 18 nt, Human herpesvirus 5
uggauccgcuuccucagc

SEQ ID NO: 3979928 - RNA, 15 nt, Human herpesvirus 5
uggcaagaguucaaa

SEQ ID NO: 3979929 - RNA, 12 nt, Human herpesvirus 5
uggcagagccac

SEQ ID NO: 3979930 - RNA, 16 nt, Human herpesvirus 5
uggcccgacggcagcu

SEQ ID NO: 3979931 - RNA, 15 nt, Human herpesvirus 5
uggcccucgcagugc

SEQ ID NO: 3979932 - RNA, 19 nt, Human herpesvirus 5
uggccgauccacgggccgc

SEQ ID NO: 3979933 - RNA, 16 nt, Human herpesvirus 5
uggcgcguagccaccu

SEQ ID NO: 3979934 - RNA, 19 nt, Human herpesvirus 5
uggcgcuuggugcgcgacg

SEQ ID NO: 3979935 - RNA, 13 nt, Human herpesvirus 5
uggcucagcuuga

SEQ ID NO: 3979936 - RNA, 15 nt, Human herpesvirus 5
uggcugcgcgccucc

SEQ ID NO: 3979937 - RNA, 16 nt, Human herpesvirus 5
ugggcaccgucuguuc

SEQ ID NO: 3979938 - RNA, 19 nt, Human herpesvirus 5
ugggcgggcucugggaagc

SEQ ID NO: 3979939 - RNA, 17 nt, Human herpesvirus 5
uggggaaguacaauauc

SEQ ID NO: 3979940 - RNA, 12 nt, Human herpesvirus 5
uggggaugauga

SEQ ID NO: 3979941 - RNA, 15 nt, Human herpesvirus 5
uggggccgucugcac

SEQ ID NO: 3979942 - RNA, 15 nt, Human herpesvirus 5
uggggcugcugcugc

SEQ ID NO: 3979943 - RNA, 12 nt, Human herpesvirus 5
uggggggugagg

SEQ ID NO: 3979944 - RNA, 18 nt, Human herpesvirus 5
uggggucaaaagccuggg

SEQ ID NO: 3979945 - RNA, 12 nt, Human herpesvirus 5
uggggugggcgc

SEQ ID NO: 3979946 - RNA, 14 nt, Human herpesvirus 5
ugggucccggcgcg

SEQ ID NO: 3979947 - RNA, 15 nt, Human herpesvirus 5
ugguaggaggcgcgc

SEQ ID NO: 3979948 - RNA, 17 nt, Human herpesvirus 5
uggucggugacaucacc

SEQ ID NO: 3979949 - RNA, 20 nt, Human herpesvirus 5
uggugaccauggucggugac

SEQ ID NO: 3979950 - RNA, 15 nt, Human herpesvirus 5
ugguggcucaugccg

SEQ ID NO: 3979951 - RNA, 15 nt, Human herpesvirus 5
ugguguuguagcaac

SEQ ID NO: 3979952 - RNA, 21 nt, Human herpesvirus 5
ugguucaaaaaguucaccgua

SEQ ID NO: 3979953 - RNA, 16 nt, Human herpesvirus 5
uguacguaccacggua

SEQ ID NO: 3979954 - RNA, 22 nt, Human herpesvirus 5
uguacuaccgcgcccacuggag

SEQ ID NO: 3979955 - RNA, 14 nt, Human herpesvirus 5
ugucaaaaaucacu

SEQ ID NO: 3979956 - RNA, 20 nt, Human herpesvirus 5
ugucagucucugaaggacag

SEQ ID NO: 3979957 - RNA, 12 nt, Human herpesvirus 5
uguccgccccuc

SEQ ID NO: 3979958 - RNA, 16 nt, Human herpesvirus 5
ugucgcguccacgggc

SEQ ID NO: 3979959 - RNA, 16 nt, Human herpesvirus 5
ugucguccgaaucgcc

SEQ ID NO: 3979960 - RNA, 18 nt, Human herpesvirus 5
ugucuaagagauccuggg

SEQ ID NO: 3979961 - RNA, 12 nt, Human herpesvirus 5
ugugauugacgu

SEQ ID NO: 3979962 - RNA, 16 nt, Human herpesvirus 5
ugugcuuaagcagaaa

SEQ ID NO: 3979963 - RNA, 20 nt, Human herpesvirus 5
ugugcuuuuuaucagggaga

SEQ ID NO: 3979964 - RNA, 19 nt, Human herpesvirus 5
ugugguucaaccugaacau

SEQ ID NO: 3979965 - RNA, 13 nt, Human herpesvirus 5
uguguguuucuua

SEQ ID NO: 3979966 - RNA, 15 nt, Human herpesvirus 5
uguuaccgccgccgc

SEQ ID NO: 3979967 - RNA, 13 nt, Human herpesvirus 5
uguuacgaccugu

SEQ ID NO: 3979968 - RNA, 14 nt, Human herpesvirus 5
uguucuuacaguuu

SEQ ID NO: 3979969 - RNA, 21 nt, Human herpesvirus 5
uguucuuacaguuuucaugua

SEQ ID NO: 3979970 - RNA, 19 nt, Human herpesvirus 5
uguugacccagggcugcuc

SEQ ID NO: 3979971 - RNA, 16 nt, Human herpesvirus 5
uguugagaacauauau

SEQ ID NO: 3979972 - RNA, 14 nt, Human herpesvirus 5
uguugaucugcuga

SEQ ID NO: 3979973 - RNA, 13 nt, Human herpesvirus 5
uguugauucugga

SEQ ID NO: 3979974 - RNA, 20 nt, Human herpesvirus 5
uguuguacucguguuuuuua

SEQ ID NO: 3979975 - RNA, 23 nt, Human herpesvirus 5
uuaacuauuccuccguguucuua

SEQ ID NO: 3979976 - RNA, 14 nt, Human herpesvirus 5
uuacugccugccgc

SEQ ID NO: 3979977 - RNA, 19 nt, Human herpesvirus 5
uuagccccacaugcugcuu

SEQ ID NO: 3979978 - RNA, 11 nt, Human herpesvirus 5
uuauucaucau

SEQ ID NO: 3979979 - RNA, 16 nt, Human herpesvirus 5
uuauucccgucaguga

SEQ ID NO: 3979980 - RNA, 18 nt, Human herpesvirus 5
uuauuguguucuccugcc

SEQ ID NO: 3979981 - RNA, 17 nt, Human herpesvirus 5
uucaacaaauaccaaca

SEQ ID NO: 3979982 - RNA, 21 nt, Human herpesvirus 5
uucacaaccguauauucuaca

SEQ ID NO: 3979983 - RNA, 21 nt, Human herpesvirus 5
uucagaccgcaacaacagcag

SEQ ID NO: 3979984 - RNA, 15 nt, Human herpesvirus 5
uucaugucuuacaaa

SEQ ID NO: 3979985 - RNA, 22 nt, Human herpesvirus 5
uuccaaagccgacgucccugau

SEQ ID NO: 3979986 - RNA, 22 nt, Human herpesvirus 5
uuccaagccgcagcgcggaaac

SEQ ID NO: 3979987 - RNA, 10 nt, Human herpesvirus 5
uuccacgccg

SEQ ID NO: 3979988 - RNA, 15 nt, Human herpesvirus 5
uuccauaauaaaagu

SEQ ID NO: 3979989 - RNA, 22 nt, Human herpesvirus 5
uuccccgccccaucaccucgcc

SEQ ID NO: 3979990 - RNA, 17 nt, Human herpesvirus 5
uuccgcgugcuccacca

SEQ ID NO: 3979991 - RNA, 16 nt, Human herpesvirus 5
uuccggucucggcucg

SEQ ID NO: 3979992 - RNA, 20 nt, Human herpesvirus 5
uuccugcgcgccuaccugac

SEQ ID NO: 3979993 - RNA, 19 nt, Human herpesvirus 5
uucgagucggauggcuuuu

SEQ ID NO: 3979994 - RNA, 18 nt, Human herpesvirus 5
uucgcgauccgcucacca

SEQ ID NO: 3979995 - RNA, 15 nt, Human herpesvirus 5
uucggacgaccuccg

SEQ ID NO: 3979996 - RNA, 18 nt, Human herpesvirus 5
uucggccgcggaggugcu

SEQ ID NO: 3979997 - RNA, 15 nt, Human herpesvirus 5
uucggccggcugcug

SEQ ID NO: 3979998 - RNA, 14 nt, Human herpesvirus 5
uucggguuccgcgu

SEQ ID NO: 3979999 - RNA, 13 nt, Human herpesvirus 5
uucuggcgcuugg

SEQ ID NO: 3980000 - RNA, 15 nt, Human herpesvirus 5
uucuucgccggaggc

SEQ ID NO: 3980001 - RNA, 23 nt, Human herpesvirus 5
uugaagauuuccgcuacauuugu

SEQ ID NO: 3980002 - RNA, 23 nt, Human herpesvirus 5
uugacgaagaugccgauguguga

SEQ ID NO: 3980003 - RNA, 14 nt, Human herpesvirus 5
uugacgcugcuggc

SEQ ID NO: 3980004 - RNA, 15 nt, Human herpesvirus 5
uugaucugcugaaac

SEQ ID NO: 3980005 - RNA, 23 nt, Human herpesvirus 5
uugccgcaccgguuggagcagcu

SEQ ID NO: 3980006 - RNA, 18 nt, Human herpesvirus 5
uuggguaacgcuggcuca

SEQ ID NO: 3980007 - RNA, 16 nt, Human herpesvirus 5
uugguaucuacaucag

SEQ ID NO: 3980008 - RNA, 13 nt, Human herpesvirus 5
uuguagcaacugg

SEQ ID NO: 3980009 - RNA, 16 nt, Human herpesvirus 5
uugugccucugaaagc

SEQ ID NO: 3980010 - RNA, 14 nt, Human herpesvirus 5
uuguugccgcugga

SEQ ID NO: 3980011 - RNA, 22 nt, Human herpesvirus 5
uuuaaacgucguuguguucuua

SEQ ID NO: 3980012 - RNA, 17 nt, Human herpesvirus 5
uuuaacaagucacuaua

SEQ ID NO: 3980013 - RNA, 13 nt, Human herpesvirus 5
uuuaagcugcuca

SEQ ID NO: 3980014 - RNA, 16 nt, Human herpesvirus 5
uuuaauguaccaagaa

SEQ ID NO: 3980015 - RNA, 22 nt, Human herpesvirus 5
uuuaucaauacaaugacacuaa

SEQ ID NO: 3980016 - RNA, 14 nt, Human herpesvirus 5
cggucuuccugcug

SEQ ID NO: 3980017 - RNA, 14 nt, Human herpesvirus 5
cggugagacgaggc

SEQ ID NO: 3980018 - RNA, 14 nt, Human herpesvirus 5
cggugauuucuugc

SEQ ID NO: 3980019 - RNA, 22 nt, Human herpesvirus 5
cggugcguggaccagacggcgu

SEQ ID NO: 3980020 - RNA, 20 nt, Human herpesvirus 5
cgguggagggcgcgcggcaa

SEQ ID NO: 3980021 - RNA, 11 nt, Human herpesvirus 5
cgguggcggcc

SEQ ID NO: 3980022 - RNA, 22 nt, Human herpesvirus 5
cgguucucaaaaacuguaaggu

SEQ ID NO: 3980023 - RNA, 15 nt, Human herpesvirus 5
cgguuuccgaacacc

SEQ ID NO: 3980024 - RNA, 14 nt, Human herpesvirus 5
cguaauguagacag

SEQ ID NO: 3980025 - RNA, 17 nt, Human herpesvirus 5
cguaauguagacagcgc

SEQ ID NO: 3980026 - RNA, 21 nt, Human herpesvirus 5
cguagaauacuggaagcugcu

SEQ ID NO: 3980027 - RNA, 22 nt, Human herpesvirus 5
cguagaauacuggaagcugcug

SEQ ID NO: 3980028 - RNA, 17 nt, Human herpesvirus 5
cguagcgcgugucccug

SEQ ID NO: 3980029 - RNA, 13 nt, Human herpesvirus 5
cgucacaauaaca

SEQ ID NO: 3980030 - RNA, 18 nt, Human herpesvirus 5
cgucacgccucuguucag

SEQ ID NO: 3980031 - RNA, 17 nt, Human herpesvirus 5
cgucaggaaucugggag

SEQ ID NO: 3980032 - RNA, 20 nt, Human herpesvirus 5
cguccccacguccacccauc

SEQ ID NO: 3980033 - RNA, 16 nt, Human herpesvirus 5
cgucgagggcccggcc

SEQ ID NO: 3980034 - RNA, 19 nt, Human herpesvirus 5
cgucgcagccaccggcgca

SEQ ID NO: 3980035 - RNA, 20 nt, Human herpesvirus 5
cgucgcaucaucaacagcag

SEQ ID NO: 3980036 - RNA, 16 nt, Human herpesvirus 5
cgucgccgccgucgcg

SEQ ID NO: 3980037 - RNA, 15 nt, Human herpesvirus 5
cgucgccuuccagcu

SEQ ID NO: 3980038 - RNA, 15 nt, Human herpesvirus 5
cgucgugcccgucgg

SEQ ID NO: 3980039 - RNA, 20 nt, Human herpesvirus 5
cgucguuucccccacccgcc

SEQ ID NO: 3980040 - RNA, 22 nt, Human herpesvirus 5
cgucuccaccaaucaagccugu

SEQ ID NO: 3980041 - RNA, 14 nt, Human herpesvirus 5
cucuaccgcgacgg

SEQ ID NO: 3980042 - RNA, 14 nt, Human herpesvirus 5
cucuagagacagac

SEQ ID NO: 3980043 - RNA, 17 nt, Human herpesvirus 5
cucuaucgcgacagaca

SEQ ID NO: 3980044 - RNA, 22 nt, Human herpesvirus 5
cucuauuguguguacgacagcc

SEQ ID NO: 3980045 - RNA, 13 nt, Human herpesvirus 5
cucucggucggcg

SEQ ID NO: 3980046 - RNA, 17 nt, Human herpesvirus 5
cucucuauccgguggcg

SEQ ID NO: 3980047 - RNA, 18 nt, Human herpesvirus 5
cucugcaacgccuggcgu

SEQ ID NO: 3980048 - RNA, 19 nt, Human herpesvirus 5
cucugccugggcacgcgcg

SEQ ID NO: 3980049 - RNA, 16 nt, Human herpesvirus 5
cucugcguugccacgc

SEQ ID NO: 3980050 - RNA, 16 nt, Human herpesvirus 5
cucuggcgaucugccu

SEQ ID NO: 3980051 - RNA, 15 nt, Human herpesvirus 5
cucuugcgaggcuuu

SEQ ID NO: 3980052 - RNA, 13 nt, Human herpesvirus 5
cugaaaacaccau

SEQ ID NO: 3980053 - RNA, 16 nt, Human herpesvirus 5
cugaagccgccgucga

SEQ ID NO: 3980054 - RNA, 15 nt, Human herpesvirus 5
cugaaucugcuccag

SEQ ID NO: 3980055 - RNA, 17 nt, Human herpesvirus 5
cugaaucugcuccagaa

SEQ ID NO: 3980056 - RNA, 19 nt, Human herpesvirus 5
cugacaguucacggggaga

SEQ ID NO: 3980057 - RNA, 23 nt, Human herpesvirus 5
cugaccgguaaggcggaaaaaga

SEQ ID NO: 3980058 - RNA, 17 nt, Human herpesvirus 5
cugaccugucagaaggc

SEQ ID NO: 3980059 - RNA, 20 nt, Human herpesvirus 5
cugacguggugcgcugcguu

SEQ ID NO: 3980060 - RNA, 23 nt, Human herpesvirus 5
cugacuucuacggaguuuucccu

SEQ ID NO: 3980061 - RNA, 17 nt, Human herpesvirus 5
cugagcguguggaggac

SEQ ID NO: 3980062 - RNA, 20 nt, Human herpesvirus 5
cugagcuacgaugaccacga

SEQ ID NO: 3980063 - RNA, 18 nt, Human herpesvirus 5
cugauaauaaaggcucuc

SEQ ID NO: 3980064 - RNA, 15 nt, Human herpesvirus 5
cugaucgccuggagc

SEQ ID NO: 3980065 - RNA, 16 nt, Human herpesvirus 5
cugauggccgacgagg

SEQ ID NO: 3980066 - RNA, 23 nt, Human herpesvirus 5
cugauuuugaugguuugugccuc

SEQ ID NO: 3980067 - RNA, 17 nt, Human herpesvirus 5
cugcaccaaccgacgua

SEQ ID NO: 3980068 - RNA, 23 nt, Human herpesvirus 5
cugcacgacaucuuccgcgagca

SEQ ID NO: 3980069 - RNA, 18 nt, Human herpesvirus 5
cugcacgaccugcuccag

SEQ ID NO: 3980070 - RNA, 22 nt, Human herpesvirus 5
cugcacgccgccgugacugcga

SEQ ID NO: 3980071 - RNA, 14 nt, Human herpesvirus 5
cugcacgcucuguc

SEQ ID NO: 3980072 - RNA, 19 nt, Human herpesvirus 5
cugcauccaucacaucacc

SEQ ID NO: 3980073 - RNA, 13 nt, Human herpesvirus 5
cugcauguuggug

SEQ ID NO: 3980074 - RNA, 14 nt, Human herpesvirus 5
cugccaccagggcg

SEQ ID NO: 3980075 - RNA, 23 nt, Human herpesvirus 5
cugcccuuuacggugcugcgucu

SEQ ID NO: 3980076 - RNA, 13 nt, Human herpesvirus 5
cugccgcagcugc

SEQ ID NO: 3980077 - RNA, 15 nt, Human herpesvirus 5
cugccgcagcugcug

SEQ ID NO: 3980078 - RNA, 22 nt, Human herpesvirus 5
cugccgcucagcgagcucgucg

SEQ ID NO: 3980079 - RNA, 15 nt, Human herpesvirus 5
cugccggcugcggcg

SEQ ID NO: 3980080 - RNA, 17 nt, Human herpesvirus 5
cugccucgaugcgccuc

SEQ ID NO: 3980081 - RNA, 15 nt, Human herpesvirus 5
cugccucucauguuc

SEQ ID NO: 3980082 - RNA, 20 nt, Human herpesvirus 5
cugcgaggaccguacacgca

SEQ ID NO: 3980083 - RNA, 13 nt, Human herpesvirus 5
cugcgcaggccgc

SEQ ID NO: 3980084 - RNA, 16 nt, Human herpesvirus 5
cugcgccuccucgucg

SEQ ID NO: 3980085 - RNA, 20 nt, Human herpesvirus 5
cugcgcgccuaccugacgcc

SEQ ID NO: 3980086 - RNA, 22 nt, Human herpesvirus 5
cugcgcgucaccgaugccggcc

SEQ ID NO: 3980087 - RNA, 19 nt, Human herpesvirus 5
cugcggcggcuugggcagc

SEQ ID NO: 3980088 - RNA, 20 nt, Human herpesvirus 5
cugcgugaugccuggaccca

SEQ ID NO: 3980089 - RNA, 14 nt, Human herpesvirus 5
cugcgugcuccgau

SEQ ID NO: 3980090 - RNA, 13 nt, Human herpesvirus 5
cugcucgaccgcu

SEQ ID NO: 3980091 - RNA, 14 nt, Human herpesvirus 5
cugcugagacugag

SEQ ID NO: 3980092 - RNA, 15 nt, Human herpesvirus 5
cugcugagacugaga

SEQ ID NO: 3980093 - RNA, 17 nt, Human herpesvirus 5
cugcuguguugucuuua

SEQ ID NO: 3980094 - RNA, 22 nt, Human herpesvirus 5
cuggaaauucaauaaaaaccac

SEQ ID NO: 3980095 - RNA, 17 nt, Human herpesvirus 5
cuggaagcagcaauguc

SEQ ID NO: 3980096 - RNA, 18 nt, Human herpesvirus 5
cuggacacucuggcccug

SEQ ID NO: 3980097 - RNA, 19 nt, Human herpesvirus 5
cuggagaagcgcagcgucg

SEQ ID NO: 3980098 - RNA, 20 nt, Human herpesvirus 5
cuggaggacgcgcuggcugu

SEQ ID NO: 3980099 - RNA, 13 nt, Human herpesvirus 5
cuggaggcucugu

SEQ ID NO: 3980100 - RNA, 23 nt, Human herpesvirus 5
cuggauacaguugauaacaaaca

SEQ ID NO: 3980101 - RNA, 18 nt, Human herpesvirus 5
cuggcaacgugccacgug

SEQ ID NO: 3980102 - RNA, 16 nt, Human herpesvirus 5
cuggccgagacggcgu

SEQ ID NO: 3980103 - RNA, 15 nt, Human herpesvirus 5
cuggcggccgccggc

SEQ ID NO: 3980104 - RNA, 21 nt, Human herpesvirus 5
cugggacgaggaggaggggcc

SEQ ID NO: 3980105 - RNA, 17 nt, Human herpesvirus 5
cugggagguggcugggc

SEQ ID NO: 3980106 - RNA, 14 nt, Human herpesvirus 5
cugggcgcccccac

SEQ ID NO: 3980107 - RNA, 20 nt, Human herpesvirus 5
cugggcuggcccucgcagug

SEQ ID NO: 3980108 - RNA, 23 nt, Human herpesvirus 5
cuggguaucaaccccgcggcuga

SEQ ID NO: 3980109 - RNA, 14 nt, Human herpesvirus 5
cugggucgccaggu

SEQ ID NO: 3980110 - RNA, 20 nt, Human herpesvirus 5
cuggucucgugauguggggg

SEQ ID NO: 3980111 - RNA, 22 nt, Human herpesvirus 5
cuggucuggcccaaagaccgcu

SEQ ID NO: 3980112 - RNA, 21 nt, Human herpesvirus 5
cuggucuucccuacagcgacu

SEQ ID NO: 3980113 - RNA, 20 nt, Human herpesvirus 5
cuggugagauacauguucau

SEQ ID NO: 3980114 - RNA, 23 nt, Human herpesvirus 5
cugguuuuugcccccucccuucu

SEQ ID NO: 3980115 - RNA, 21 nt, Human herpesvirus 5
cuguacuacgacgggacggcg

SEQ ID NO: 3980116 - RNA, 14 nt, Human herpesvirus 5
cugucaucuaccua

SEQ ID NO: 3980117 - RNA, 19 nt, Human herpesvirus 5
cugucauggggagaaaaga

SEQ ID NO: 3980118 - RNA, 19 nt, Human herpesvirus 5
cuguccgggauggaucgca

SEQ ID NO: 3980119 - RNA, 15 nt, Human herpesvirus 5
cugucggggcgcaga

SEQ ID NO: 3980120 - RNA, 15 nt, Human herpesvirus 5
cugugaaacgccaac

SEQ ID NO: 3980121 - RNA, 13 nt, Human herpesvirus 5
cugugccugucau

SEQ ID NO: 3980122 - RNA, 15 nt, Human herpesvirus 5
cugugcgcgccggcc

SEQ ID NO: 3980123 - RNA, 16 nt, Human herpesvirus 5
cugugcuggccgccgc

SEQ ID NO: 3980124 - RNA, 16 nt, Human herpesvirus 5
cuguggacccugcgcg

SEQ ID NO: 3980125 - RNA, 21 nt, Human herpesvirus 5
cuguggauagauuucugcgug

SEQ ID NO: 3980126 - RNA, 16 nt, Human herpesvirus 5
cuguucuuccaccagc

SEQ ID NO: 3980127 - RNA, 20 nt, Human herpesvirus 5
cuguuggagcaacgggcggc

SEQ ID NO: 3980128 - RNA, 19 nt, Human herpesvirus 5
cuguuggcuuacugccugc

SEQ ID NO: 3980129 - RNA, 14 nt, Human herpesvirus 5
cuguuugucugugc

SEQ ID NO: 3980130 - RNA, 15 nt, Human herpesvirus 5
cuuaacaugaugaag

SEQ ID NO: 3980131 - RNA, 21 nt, Human herpesvirus 5
cuuacaguuuucauguaauaa

SEQ ID NO: 3980132 - RNA, 15 nt, Human herpesvirus 5
cuuacaucucacgga

SEQ ID NO: 3980133 - RNA, 18 nt, Human herpesvirus 5
cuuacgucuacagcaugg

SEQ ID NO: 3980134 - RNA, 19 nt, Human herpesvirus 5
cuucaaccucacguuaaac

SEQ ID NO: 3980135 - RNA, 21 nt, Human herpesvirus 5
cuucaucaucaccacccgaga

SEQ ID NO: 3980136 - RNA, 14 nt, Human herpesvirus 5
aggccagcugccac

SEQ ID NO: 3980137 - RNA, 19 nt, Human herpesvirus 5
aggccgagacgcugcgcua

SEQ ID NO: 3980138 - RNA, 18 nt, Human herpesvirus 5
aggccgcaaagcuggaca

SEQ ID NO: 3980139 - RNA, 18 nt, Human herpesvirus 5
aggccgcacuggacgacg

SEQ ID NO: 3980140 - RNA, 10 nt, Human herpesvirus 5
aggccgccgc

SEQ ID NO: 3980141 - RNA, 23 nt, Human herpesvirus 5
aggccgccgccgcucaggucgcc

SEQ ID NO: 3980142 - RNA, 15 nt, Human herpesvirus 5
aggccuccagcgccu

SEQ ID NO: 3980143 - RNA, 18 nt, Human herpesvirus 5
aggccuccagcgccuccu

SEQ ID NO: 3980144 - RNA, 18 nt, Human herpesvirus 5
aggcggugacggcgcucu

SEQ ID NO: 3980145 - RNA, 15 nt, Human herpesvirus 5
aggcuacugcugcuu

SEQ ID NO: 3980146 - RNA, 21 nt, Human herpesvirus 5
aggcucgcaaagacgugccac

SEQ ID NO: 3980147 - RNA, 17 nt, Human herpesvirus 5
aggcucuguggacccug

SEQ ID NO: 3980148 - RNA, 22 nt, Human herpesvirus 5
aggggccgcagccguuggugga

SEQ ID NO: 3980149 - RNA, 14 nt, Human herpesvirus 5
agggugaaggcaaa

SEQ ID NO: 3980150 - RNA, 18 nt, Human herpesvirus 5
agguacgggucuaccaaa

SEQ ID NO: 3980151 - RNA, 19 nt, Human herpesvirus 5
agguagguggccaugauga

SEQ ID NO: 3980152 - RNA, 20 nt, Human herpesvirus 5
aggucagcgugucugauacc

SEQ ID NO: 3980153 - RNA, 12 nt, Human herpesvirus 5
aggucgcgcgua

SEQ ID NO: 3980154 - RNA, 23 nt, Human herpesvirus 5
aggucguagugcggcgugcugca

SEQ ID NO: 3980155 - RNA, 15 nt, Human herpesvirus 5
agguguaguuuuguu

SEQ ID NO: 3980156 - RNA, 20 nt, Human herpesvirus 5
agguuguugccgcuggacug

SEQ ID NO: 3980157 - RNA, 17 nt, Human herpesvirus 5
aguaaccuggagcagcg

SEQ ID NO: 3980158 - RNA, 16 nt, Human herpesvirus 5
aguaauguauacuucc

SEQ ID NO: 3980159 - RNA, 19 nt, Human herpesvirus 5
aguacaauacaaaaagcuc

SEQ ID NO: 3980160 - RNA, 17 nt, Human herpesvirus 5
aguacccaccgauggca

SEQ ID NO: 3980161 - RNA, 21 nt, Human herpesvirus 5
aguacuucccaugcaacuucu

SEQ ID NO: 3980162 - RNA, 21 nt, Human herpesvirus 5
aguaggcgcgcacccgacggc

SEQ ID NO: 3980163 - RNA, 13 nt, Human herpesvirus 5
aguauagcaugca

SEQ ID NO: 3980164 - RNA, 23 nt, Human herpesvirus 5
agucauagagccaacgagacuau

SEQ ID NO: 3980165 - RNA, 13 nt, Human herpesvirus 5
aguccggaggacg

SEQ ID NO: 3980166 - RNA, 18 nt, Human herpesvirus 5
agucgcgccuugggacac

SEQ ID NO: 3980167 - RNA, 16 nt, Human herpesvirus 5
agucgcgcggucgccg

SEQ ID NO: 3980168 - RNA, 16 nt, Human herpesvirus 5
agucgcucggaaacga

SEQ ID NO: 3980169 - RNA, 17 nt, Human herpesvirus 5
agucguuucagcccaag

SEQ ID NO: 3980170 - RNA, 23 nt, Human herpesvirus 5
agucuagacaggguaacagccuu

SEQ ID NO: 3980171 - RNA, 17 nt, Human herpesvirus 5
agugacgcuaggcggcg

SEQ ID NO: 3980172 - RNA, 18 nt, Human herpesvirus 5
agugacgcuaggcggcgc

SEQ ID NO: 3980173 - RNA, 14 nt, Human herpesvirus 5
agugauacguuguu

SEQ ID NO: 3980174 - RNA, 16 nt, Human herpesvirus 5
agugaucuucauucac

SEQ ID NO: 3980175 - RNA, 15 nt, Human herpesvirus 5
aguggucuuucacau

SEQ ID NO: 3980176 - RNA, 13 nt, Human herpesvirus 5
agugucgauacuu

SEQ ID NO: 3980177 - RNA, 14 nt, Human herpesvirus 5
aguucgccgucgcc

SEQ ID NO: 3980178 - RNA, 23 nt, Human herpesvirus 5
aguugcaacgcgcccgacagcug

SEQ ID NO: 3980179 - RNA, 22 nt, Human herpesvirus 5
aguuguagucgcgguggcggcc

SEQ ID NO: 3980180 - RNA, 17 nt, Human herpesvirus 5
auaagccggcagcugcu

SEQ ID NO: 3980181 - RNA, 14 nt, Human herpesvirus 5
auaaguaccagaca

SEQ ID NO: 3980182 - RNA, 14 nt, Human herpesvirus 5
auaauaaaaguaaa

SEQ ID NO: 3980183 - RNA, 16 nt, Human herpesvirus 5
auacgcuagcagaaga

SEQ ID NO: 3980184 - RNA, 18 nt, Human herpesvirus 5
auagcaagccagauacua

SEQ ID NO: 3980185 - RNA, 13 nt, Human herpesvirus 5
auauaaagaaucu

SEQ ID NO: 3980186 - RNA, 16 nt, Human herpesvirus 5
auaugcaucggaaaau

SEQ ID NO: 3980187 - RNA, 16 nt, Human herpesvirus 5
auauucaaucauuacu

SEQ ID NO: 3980188 - RNA, 18 nt, Human herpesvirus 5
aucaacagcagcaacagc

SEQ ID NO: 3980189 - RNA, 15 nt, Human herpesvirus 5
aucaauacaaugaca

SEQ ID NO: 3980190 - RNA, 14 nt, Human herpesvirus 5
aucaaugaagacuu

SEQ ID NO: 3980191 - RNA, 21 nt, Human herpesvirus 5
aucaguguacacgcgcccaga

SEQ ID NO: 3980192 - RNA, 17 nt, Human herpesvirus 5
aucauaugcuaauauau

SEQ ID NO: 3980193 - RNA, 12 nt, Human herpesvirus 5
aucauggagcua

SEQ ID NO: 3980194 - RNA, 21 nt, Human herpesvirus 5
auccacgcucguucaauaauc

SEQ ID NO: 3980195 - RNA, 15 nt, Human herpesvirus 5
auccagaccucaugu

SEQ ID NO: 3980196 - RNA, 11 nt, Human herpesvirus 5
auccaggaggu

SEQ ID NO: 3980197 - RNA, 16 nt, Human herpesvirus 5
auccuggccaccaugu

SEQ ID NO: 3980198 - RNA, 18 nt, Human herpesvirus 5
aucgcagccacgcgcugg

SEQ ID NO: 3980199 - RNA, 21 nt, Human herpesvirus 5
aucgccgauagagauggcgau

SEQ ID NO: 3980200 - RNA, 14 nt, Human herpesvirus 5
aucgccgcggacgc

SEQ ID NO: 3980201 - RNA, 22 nt, Human herpesvirus 5
aucguuuacgggggauggcgau

SEQ ID NO: 3980202 - RNA, 20 nt, Human herpesvirus 5
aucuacaacuuaaccacaag

SEQ ID NO: 3980203 - RNA, 16 nt, Human herpesvirus 5
aucuccgucacgccuc

SEQ ID NO: 3980204 - RNA, 18 nt, Human herpesvirus 5
aucucggcauaguggugu

SEQ ID NO: 3980205 - RNA, 21 nt, Human herpesvirus 5
aucugcccuauccgcgcggcu

SEQ ID NO: 3980206 - RNA, 19 nt, Human herpesvirus 5
aucugggcagcggcugcgc

SEQ ID NO: 3980207 - RNA, 15 nt, Human herpesvirus 5
aucuuaccacaguug

SEQ ID NO: 3980208 - RNA, 15 nt, Human herpesvirus 5
aucuucgacuuucug

SEQ ID NO: 3980209 - RNA, 18 nt, Human herpesvirus 5
augaaguuguugaucugc

SEQ ID NO: 3980210 - RNA, 15 nt, Human herpesvirus 5
augaccggacgugcu

SEQ ID NO: 3980211 - RNA, 15 nt, Human herpesvirus 5
augagcgugcugcuc

SEQ ID NO: 3980212 - RNA, 14 nt, Human herpesvirus 5
augaggcacaugau

SEQ ID NO: 3980213 - RNA, 16 nt, Human herpesvirus 5
augaggcgguggcugc

SEQ ID NO: 3980214 - RNA, 18 nt, Human herpesvirus 5
augaugaaucaugugguc

SEQ ID NO: 3980215 - RNA, 23 nt, Human herpesvirus 5
augcauaagaagccaagggggug

SEQ ID NO: 3980216 - RNA, 17 nt, Human herpesvirus 5
augccgaugugugacua

SEQ ID NO: 3980217 - RNA, 14 nt, Human herpesvirus 5
augccgccacuuug

SEQ ID NO: 3980218 - RNA, 17 nt, Human herpesvirus 5
augcgcgucgaccuuga

SEQ ID NO: 3980219 - RNA, 19 nt, Human herpesvirus 5
augcgugucgccugccgaa

SEQ ID NO: 3980220 - RNA, 17 nt, Human herpesvirus 5
augcguguuaaacacua

SEQ ID NO: 3980221 - RNA, 18 nt, Human herpesvirus 5
augcuauaagacagccuu

SEQ ID NO: 3980222 - RNA, 23 nt, Human herpesvirus 5
auggaaaugcccgccaccaugca

SEQ ID NO: 3980223 - RNA, 21 nt, Human herpesvirus 5
auggccaacagccuguggcac

SEQ ID NO: 3980224 - RNA, 15 nt, Human herpesvirus 5
auggccgacgaggcc

SEQ ID NO: 3980225 - RNA, 14 nt, Human herpesvirus 5
auggcgacggacgu

SEQ ID NO: 3980226 - RNA, 20 nt, Human herpesvirus 5
auggcgacggacgucgggac

SEQ ID NO: 3980227 - RNA, 16 nt, Human herpesvirus 5
auggcuaacgucucgg

SEQ ID NO: 3980228 - RNA, 14 nt, Human herpesvirus 5
augggcuucccucc

SEQ ID NO: 3980229 - RNA, 17 nt, Human herpesvirus 5
augggucggaucgccgu

SEQ ID NO: 3980230 - RNA, 20 nt, Human herpesvirus 5
augguuugugccucugaaag

SEQ ID NO: 3980231 - RNA, 23 nt, Human herpesvirus 5
auguauccuggggaaaaaaauac

SEQ ID NO: 3980232 - RNA, 21 nt, Human herpesvirus 5
augucauuguuguuuacugaa

SEQ ID NO: 3980233 - RNA, 14 nt, Human herpesvirus 5
augucgcccagaaa

SEQ ID NO: 3980234 - RNA, 19 nt, Human herpesvirus 5
augugccucauuuguauuu

SEQ ID NO: 3980235 - RNA, 15 nt, Human herpesvirus 5
auguggaacagcucg

SEQ ID NO: 3980236 - RNA, 20 nt, Human herpesvirus 5
auguuggugccccaggauga

SEQ ID NO: 3980237 - RNA, 12 nt, Human herpesvirus 5
auuacacucuau

SEQ ID NO: 3980238 - RNA, 15 nt, Human herpesvirus 5
auuacaguaacgcag

SEQ ID NO: 3980239 - RNA, 22 nt, Human herpesvirus 5
auuaucaucaaucacccacaga

SEQ ID NO: 3980240 - RNA, 21 nt, Human herpesvirus 5
auuauuaaggcgcuaacgccu

SEQ ID NO: 3980241 - RNA, 20 nt, Human herpesvirus 5
auucuguguuacgaccuguu

SEQ ID NO: 3980242 - RNA, 16 nt, Human herpesvirus 5
auugccucuacacuug

SEQ ID NO: 3980243 - RNA, 15 nt, Human herpesvirus 5
auugcgggcccugcu

SEQ ID NO: 3980244 - RNA, 13 nt, Human herpesvirus 5
auuguuucuuauu

SEQ ID NO: 3980245 - RNA, 15 nt, Human herpesvirus 5
auuugaagccaggcg

SEQ ID NO: 3980246 - RNA, 12 nt, Human herpesvirus 5
auuuuauuggga

SEQ ID NO: 3980247 - RNA, 20 nt, Human herpesvirus 5
auuuuccucguaaacuuaug

SEQ ID NO: 3980248 - RNA, 14 nt, Human herpesvirus 5
caaaagccugggua

SEQ ID NO: 3980249 - RNA, 15 nt, Human herpesvirus 5
caaaagggguggaaa

SEQ ID NO: 3980250 - RNA, 16 nt, Human herpesvirus 5
caaacacagacaggcg

SEQ ID NO: 3980251 - RNA, 14 nt, Human herpesvirus 5
caaagaacgaaaac

SEQ ID NO: 3980252 - RNA, 16 nt, Human herpesvirus 5
caaagaagucucuuuc

SEQ ID NO: 3980253 - RNA, 14 nt, Human herpesvirus 5
cagcagccaccgac

SEQ ID NO: 3980254 - RNA, 21 nt, Human herpesvirus 5
cagcagcucgcgcuggcuuuc

SEQ ID NO: 3980255 - RNA, 21 nt, Human herpesvirus 5
cagccaaggugcgggagacua

SEQ ID NO: 3980256 - RNA, 23 nt, Human herpesvirus 5
cagccacggaggagacgagagaa

SEQ ID NO: 3980257 - RNA, 23 nt, Human herpesvirus 5
cagccccgaagguuagcgccgcg

SEQ ID NO: 3980258 - RNA, 17 nt, Human herpesvirus 5
cagccucgucgugcccg

SEQ ID NO: 3980259 - RNA, 23 nt, Human herpesvirus 5
cagcgagcgcacccacucgucgc

SEQ ID NO: 3980260 - RNA, 19 nt, Human herpesvirus 5
cagcgccagcggccuggcc

SEQ ID NO: 3980261 - RNA, 23 nt, Human herpesvirus 5
cagcgccgggugcgcgacacggc

SEQ ID NO: 3980262 - RNA, 16 nt, Human herpesvirus 5
cagcgcggaaaccgag

SEQ ID NO: 3980263 - RNA, 13 nt, Human herpesvirus 5
cagcgcgugcgca

SEQ ID NO: 3980264 - RNA, 17 nt, Human herpesvirus 5
cagcggaaaaugccgcc

SEQ ID NO: 3980265 - RNA, 19 nt, Human herpesvirus 5
cagcggaaaaugccgccgc

SEQ ID NO: 3980266 - RNA, 20 nt, Human herpesvirus 5
cagcggaaaaugccgccgcc

SEQ ID NO: 3980267 - RNA, 12 nt, Human herpesvirus 5
cagcggaggugg

SEQ ID NO: 3980268 - RNA, 14 nt, Human herpesvirus 5
cagcggcgacagac

SEQ ID NO: 3980269 - RNA, 17 nt, Human herpesvirus 5
cagcggcggcgguggug

SEQ ID NO: 3980270 - RNA, 13 nt, Human herpesvirus 5
cagcggcugcgcg

SEQ ID NO: 3980271 - RNA, 13 nt, Human herpesvirus 5
cagcgggcuuugc

SEQ ID NO: 3980272 - RNA, 14 nt, Human herpesvirus 5
cagcggucucaucu

SEQ ID NO: 3980273 - RNA, 18 nt, Human herpesvirus 5
cagcgugacgcggugcag

SEQ ID NO: 3980274 - RNA, 19 nt, Human herpesvirus 5
cagcgugcaccugcugccg

SEQ ID NO: 3980275 - RNA, 15 nt, Human herpesvirus 5
cagcuccaaaacgac

SEQ ID NO: 3980276 - RNA, 17 nt, Human herpesvirus 5
cagcucgcgcuggcuuu

SEQ ID NO: 3980277 - RNA, 13 nt, Human herpesvirus 5
cagcugcgccugg

SEQ ID NO: 3980278 - RNA, 17 nt, Human herpesvirus 5
cagcuggcaacgugcca

SEQ ID NO: 3980279 - RNA, 18 nt, Human herpesvirus 5
cagcugguggcucaugcc

SEQ ID NO: 3980280 - RNA, 15 nt, Human herpesvirus 5
cagcuugcccgacca

SEQ ID NO: 3980281 - RNA, 21 nt, Human herpesvirus 5
cagcuuuugcacggaucacga

SEQ ID NO: 3980282 - RNA, 15 nt, Human herpesvirus 5
caggaaaacggaaug

SEQ ID NO: 3980283 - RNA, 17 nt, Human herpesvirus 5
caggaacgauaaccgug

SEQ ID NO: 3980284 - RNA, 15 nt, Human herpesvirus 5
caggacgaggcaggg

SEQ ID NO: 3980285 - RNA, 18 nt, Human herpesvirus 5
caggaggcugugcgcgcc

SEQ ID NO: 3980286 - RNA, 22 nt, Human herpesvirus 5
cagggaauuuugaaaaccgcgc

SEQ ID NO: 3980287 - RNA, 16 nt, Human herpesvirus 5
cagggcgcgccggcgc

SEQ ID NO: 3980288 - RNA, 12 nt, Human herpesvirus 5
cagggcugcucc

SEQ ID NO: 3980289 - RNA, 16 nt, Human herpesvirus 5
caggguaaaaaccacg

SEQ ID NO: 3980290 - RNA, 17 nt, Human herpesvirus 5
caggguaaaaaccacgu

SEQ ID NO: 3980291 - RNA, 18 nt, Human herpesvirus 5
cagggugagaaagaggag

SEQ ID NO: 3980292 - RNA, 18 nt, Human herpesvirus 5
caggugacauccucgccc

SEQ ID NO: 3980293 - RNA, 12 nt, Human herpesvirus 5
cagguucugaau

SEQ ID NO: 3980294 - RNA, 14 nt, Human herpesvirus 5
caguaccaccgcug

SEQ ID NO: 3980295 - RNA, 13 nt, Human herpesvirus 5
caguagacagaca

SEQ ID NO: 3980296 - RNA, 16 nt, Human herpesvirus 5
caguagacagacagga

SEQ ID NO: 3980297 - RNA, 13 nt, Human herpesvirus 5
caguggcaggccc

SEQ ID NO: 3980298 - RNA, 15 nt, Human herpesvirus 5
cagugucgguguggu

SEQ ID NO: 3980299 - RNA, 17 nt, Human herpesvirus 5
caguuaccaccgucgcc

SEQ ID NO: 3980300 - RNA, 22 nt, Human herpesvirus 5
caguuuuuuuccauccuggcca

SEQ ID NO: 3980301 - RNA, 20 nt, Human herpesvirus 5
cauaagaauaggaagaaacc

SEQ ID NO: 3980302 - RNA, 18 nt, Human herpesvirus 5
cauacaaaccccgugucc

SEQ ID NO: 3980303 - RNA, 16 nt, Human herpesvirus 5
cauacacguugcuuuc

SEQ ID NO: 3980304 - RNA, 14 nt, Human herpesvirus 5
cauauuuguuuuca

SEQ ID NO: 3980305 - RNA, 21 nt, Human herpesvirus 5
caucaauaaacuuuuuuuaac

SEQ ID NO: 3980306 - RNA, 17 nt, Human herpesvirus 5
cgcggguucacgcgucg

SEQ ID NO: 3980307 - RNA, 22 nt, Human herpesvirus 5
cgcggucauauagccuccggcu

SEQ ID NO: 3980308 - RNA, 21 nt, Human herpesvirus 5
cgcgguccuagcacgucagug

SEQ ID NO: 3980309 - RNA, 15 nt, Human herpesvirus 5
cgcguacggacgagu

SEQ ID NO: 3980310 - RNA, 12 nt, Human herpesvirus 5
cgcguccacggg

SEQ ID NO: 3980311 - RNA, 15 nt, Human herpesvirus 5
cgcguccgaccggga

SEQ ID NO: 3980312 - RNA, 13 nt, Human herpesvirus 5
cgcguccgggcuu

SEQ ID NO: 3980313 - RNA, 16 nt, Human herpesvirus 5
cgcguccgggcuuucc

SEQ ID NO: 3980314 - RNA, 20 nt, Human herpesvirus 5
cgcgucgcaaacgcugcuug

SEQ ID NO: 3980315 - RNA, 22 nt, Human herpesvirus 5
cgcguggugaucgugggccagg

SEQ ID NO: 3980316 - RNA, 18 nt, Human herpesvirus 5
cgcuaagagcuuugacgc

SEQ ID NO: 3980317 - RNA, 19 nt, Human herpesvirus 5
cgcuacaacgcgcgccuga

SEQ ID NO: 3980318 - RNA, 24 nt, Human herpesvirus 5
cgcuccuggaucuuggcggccgag

SEQ ID NO: 3980319 - RNA, 13 nt, Human herpesvirus 5
cgcucggccucgc

SEQ ID NO: 3980320 - RNA, 20 nt, Human herpesvirus 5
cgcucgugaaacagcagcuc

SEQ ID NO: 3980321 - RNA, 15 nt, Human herpesvirus 5
cgcugccgcucagcg

SEQ ID NO: 3980322 - RNA, 13 nt, Human herpesvirus 5
cgcugcugcucuc

SEQ ID NO: 3980323 - RNA, 14 nt, Human herpesvirus 5
cgcuggcucggcgc

SEQ ID NO: 3980324 - RNA, 18 nt, Human herpesvirus 5
cgcuggcucggcgcggcu

SEQ ID NO: 3980325 - RNA, 17 nt, Human herpesvirus 5
cgcugguuuggcugggu

SEQ ID NO: 3980326 - RNA, 14 nt, Human herpesvirus 5
cgcuguguggcgug

SEQ ID NO: 3980327 - RNA, 22 nt, Human herpesvirus 5
cggaaacagcguccacaguuuc

SEQ ID NO: 3980328 - RNA, 13 nt, Human herpesvirus 5
cggaacccucugg

SEQ ID NO: 3980329 - RNA, 14 nt, Human herpesvirus 5
cggaacccuucccg

SEQ ID NO: 3980330 - RNA, 17 nt, Human herpesvirus 5
cggaagaagaagaacaa

SEQ ID NO: 3980331 - RNA, 13 nt, Human herpesvirus 5
cggacgggcagga

SEQ ID NO: 3980332 - RNA, 19 nt, Human herpesvirus 5
cggagcacgggcugcuggu

SEQ ID NO: 3980333 - RNA, 22 nt, Human herpesvirus 5
cggagcaggaaccuccuccgcg

SEQ ID NO: 3980334 - RNA, 23 nt, Human herpesvirus 5
cggagcaggaaccuccuccgcga

SEQ ID NO: 3980335 - RNA, 23 nt, Human herpesvirus 5
cggagcggaggaggugaccuggc

SEQ ID NO: 3980336 - RNA, 23 nt, Human herpesvirus 5
cggaggaaucgucggcagagguc

SEQ ID NO: 3980337 - RNA, 20 nt, Human herpesvirus 5
cggaggagacgagagaaccu

SEQ ID NO: 3980338 - RNA, 23 nt, Human herpesvirus 5
cggagggccgccaauuggcggcg

SEQ ID NO: 3980339 - RNA, 17 nt, Human herpesvirus 5
cggaggugcuggcggcc

SEQ ID NO: 3980340 - RNA, 12 nt, Human herpesvirus 5
cggagucauuau

SEQ ID NO: 3980341 - RNA, 17 nt, Human herpesvirus 5
cggaguggugagcgggu

SEQ ID NO: 3980342 - RNA, 20 nt, Human herpesvirus 5
cggaucaauugcgggcccug

SEQ ID NO: 3980343 - RNA, 24 nt, Human herpesvirus 5
cggcacgccguugccacgagcaug

SEQ ID NO: 3980344 - RNA, 15 nt, Human herpesvirus 5
cggcagcggggagaa

SEQ ID NO: 3980345 - RNA, 20 nt, Human herpesvirus 5
cggccaguacggccucuggg

SEQ ID NO: 3980346 - RNA, 12 nt, Human herpesvirus 5
cggcccugugcu

SEQ ID NO: 3980347 - RNA, 14 nt, Human herpesvirus 5
cggccgaccccgcc

SEQ ID NO: 3980348 - RNA, 16 nt, Human herpesvirus 5
cggccgacggcagcgu

SEQ ID NO: 3980349 - RNA, 16 nt, Human herpesvirus 5
cggccgagucuccgcg

SEQ ID NO: 3980350 - RNA, 19 nt, Human herpesvirus 5
cggccgcagaaggccauga

SEQ ID NO: 3980351 - RNA, 12 nt, Human herpesvirus 5
cggccgccgacg

SEQ ID NO: 3980352 - RNA, 20 nt, Human herpesvirus 5
cggccgcggugcgcugcagc

SEQ ID NO: 3980353 - RNA, 14 nt, Human herpesvirus 5
cggccggcugcugc

SEQ ID NO: 3980354 - RNA, 16 nt, Human herpesvirus 5
cggccgucgcaagggc

SEQ ID NO: 3980355 - RNA, 14 nt, Human herpesvirus 5
cggccugcucgcac

SEQ ID NO: 3980356 - RNA, 21 nt, Human herpesvirus 5
cggcgaauggaucaucuguuu

SEQ ID NO: 3980357 - RNA, 18 nt, Human herpesvirus 5
cggcgacagacggcgucg

SEQ ID NO: 3980358 - RNA, 20 nt, Human herpesvirus 5
cggcgcagacgucggcgguc

SEQ ID NO: 3980359 - RNA, 14 nt, Human herpesvirus 5
cggcgccccacagc

SEQ ID NO: 3980360 - RNA, 16 nt, Human herpesvirus 5
cggcgccugcugcucg

SEQ ID NO: 3980361 - RNA, 16 nt, Human herpesvirus 5
cggcggccacggccug

SEQ ID NO: 3980362 - RNA, 18 nt, Human herpesvirus 5
cggcggccacggccugcg

SEQ ID NO: 3980363 - RNA, 18 nt, Human herpesvirus 5
cggcgguacugaagccgc

SEQ ID NO: 3980364 - RNA, 14 nt, Human herpesvirus 5
cggcgucaccacuu

SEQ ID NO: 3980365 - RNA, 20 nt, Human herpesvirus 5
cggcgugaaugggcacgccg

SEQ ID NO: 3980366 - RNA, 20 nt, Human herpesvirus 5
cggcguguacagcuaccuca

SEQ ID NO: 3980367 - RNA, 15 nt, Human herpesvirus 5
cggcguguuggacgc

SEQ ID NO: 3980368 - RNA, 17 nt, Human herpesvirus 5
cggcuaccaugcgcaac

SEQ ID NO: 3980369 - RNA, 21 nt, Human herpesvirus 5
cggcuaucuguacugcaagac

SEQ ID NO: 3980370 - RNA, 14 nt, Human herpesvirus 5
cggcugcugcacca

SEQ ID NO: 3980371 - RNA, 21 nt, Human herpesvirus 5
cggcuguggcuucucuggaga

SEQ ID NO: 3980372 - RNA, 21 nt, Human herpesvirus 5
cgggaugcacagcgucuggcc

SEQ ID NO: 3980373 - RNA, 19 nt, Human herpesvirus 5
cgggcaacgcguggcccug

SEQ ID NO: 3980374 - RNA, 23 nt, Human herpesvirus 5
cgggccgcgugccugggaacgcg

SEQ ID NO: 3980375 - RNA, 18 nt, Human herpesvirus 5
cgggcucaccgcaguugc

SEQ ID NO: 3980376 - RNA, 14 nt, Human herpesvirus 5
cgggcuccaugcug

SEQ ID NO: 3980377 - RNA, 17 nt, Human herpesvirus 5
cgggcucgaccggcggc

SEQ ID NO: 3980378 - RNA, 22 nt, Human herpesvirus 5
cgggcugcuggucuccauggcc

SEQ ID NO: 3980379 - RNA, 20 nt, Human herpesvirus 5
cgggucucuuugacacgagc

SEQ ID NO: 3980380 - RNA, 15 nt, Human herpesvirus 5
cggguggagaugagg

SEQ ID NO: 3980381 - RNA, 11 nt, Human herpesvirus 5
cggguguccca

SEQ ID NO: 3980382 - RNA, 14 nt, Human herpesvirus 5
cgguaaaaccacgu

SEQ ID NO: 3980383 - RNA, 13 nt, Human herpesvirus 5
cgguacacguccc

SEQ ID NO: 3980384 - RNA, 14 nt, Human herpesvirus 5
cgguaccacuacua

SEQ ID NO: 3980385 - RNA, 20 nt, Human herpesvirus 5
cgguaugggucacggcggcg

SEQ ID NO: 3980386 - RNA, 15 nt, Human herpesvirus 5
cggucagaaaaagaa

SEQ ID NO: 3980387 - RNA, 17 nt, Human herpesvirus 5
cggucccgacauggaga

SEQ ID NO: 3980388 - RNA, 22 nt, Human herpesvirus 5
cgguccgcggugucuccucgcg

SEQ ID NO: 3980389 - RNA, 13 nt, Human herpesvirus 5
cgguccuccagca

SEQ ID NO: 3980390 - RNA, 18 nt, Human herpesvirus 5
acacggagcacgggcugc

SEQ ID NO: 3980391 - RNA, 20 nt, Human herpesvirus 5
acacgugcuuuuggugcgcc

SEQ ID NO: 3980392 - RNA, 20 nt, Human herpesvirus 5
acacuaaauuguuauugcca

SEQ ID NO: 3980393 - RNA, 19 nt, Human herpesvirus 5
acacuaagaauaaagaaaa

SEQ ID NO: 3980394 - RNA, 20 nt, Human herpesvirus 5
acacucuuuugccgcaccgc

SEQ ID NO: 3980395 - RNA, 21 nt, Human herpesvirus 5
acagacugggcgacgaagugc

SEQ ID NO: 3980396 - RNA, 16 nt, Human herpesvirus 5
acagcaacaacagucg

SEQ ID NO: 3980397 - RNA, 14 nt, Human herpesvirus 5
acagcaaggccgcc

SEQ ID NO: 3980398 - RNA, 21 nt, Human herpesvirus 5
acagccacaucaacauacagu

SEQ ID NO: 3980399 - RNA, 19 nt, Human herpesvirus 5
acaggacaccgcaacucgg

SEQ ID NO: 3980400 - RNA, 15 nt, Human herpesvirus 5
acaggcuaugggaag

SEQ ID NO: 3980401 - RNA, 12 nt, Human herpesvirus 5
acagggugccgc

SEQ ID NO: 3980402 - RNA, 14 nt, Human herpesvirus 5
acaucgcauaugac

SEQ ID NO: 3980403 - RNA, 20 nt, Human herpesvirus 5
acaucuccgucucuggucuc

SEQ ID NO: 3980404 - RNA, 19 nt, Human herpesvirus 5
acaugaaucuuccccucug

SEQ ID NO: 3980405 - RNA, 19 nt, Human herpesvirus 5
acaugcccagcaucuccuc

SEQ ID NO: 3980406 - RNA, 17 nt, Human herpesvirus 5
accaacgcgaccaccgu

SEQ ID NO: 3980407 - RNA, 21 nt, Human herpesvirus 5
accaacugagcuucggagguc

SEQ ID NO: 3980408 - RNA, 15 nt, Human herpesvirus 5
accaagaaacaccgg

SEQ ID NO: 3980409 - RNA, 22 nt, Human herpesvirus 5
accacccuguuccccgugacgu

SEQ ID NO: 3980410 - RNA, 15 nt, Human herpesvirus 5
accaccgagacgugc

SEQ ID NO: 3980411 - RNA, 14 nt, Human herpesvirus 5
accaccuccugggu

SEQ ID NO: 3980412 - RNA, 15 nt, Human herpesvirus 5
accaccuccugggua

SEQ ID NO: 3980413 - RNA, 20 nt, Human herpesvirus 5
accacgacacggugcugcug

SEQ ID NO: 3980414 - RNA, 18 nt, Human herpesvirus 5
accacguacaucggcguc

SEQ ID NO: 3980415 - RNA, 14 nt, Human herpesvirus 5
accagcccagggau

SEQ ID NO: 3980416 - RNA, 16 nt, Human herpesvirus 5
accagcugcaggcagg

SEQ ID NO: 3980417 - RNA, 21 nt, Human herpesvirus 5
accauuaacaauuccacgccg

SEQ ID NO: 3980418 - RNA, 13 nt, Human herpesvirus 5
accccaagccaaa

SEQ ID NO: 3980419 - RNA, 17 nt, Human herpesvirus 5
accccauacacgguuuc

SEQ ID NO: 3980420 - RNA, 17 nt, Human herpesvirus 5
acccccguacugccugg

SEQ ID NO: 3980421 - RNA, 14 nt, Human herpesvirus 5
accccgcgcgacgu

SEQ ID NO: 3980422 - RNA, 18 nt, Human herpesvirus 5
acccgcggccguacccgc

SEQ ID NO: 3980423 - RNA, 12 nt, Human herpesvirus 5
acccguacugcg

SEQ ID NO: 3980424 - RNA, 17 nt, Human herpesvirus 5
acccuguuccccgugac

SEQ ID NO: 3980425 - RNA, 18 nt, Human herpesvirus 5
accgacaaggcgcggcga

SEQ ID NO: 3980426 - RNA, 21 nt, Human herpesvirus 5
accgacgacgacagucuccuc

SEQ ID NO: 3980427 - RNA, 14 nt, Human herpesvirus 5
accgcaaaggccac

SEQ ID NO: 3980428 - RNA, 23 nt, Human herpesvirus 5
accgcaacaacagcagcaacagc

SEQ ID NO: 3980429 - RNA, 13 nt, Human herpesvirus 5
accgcaggagcug

SEQ ID NO: 3980430 - RNA, 17 nt, Human herpesvirus 5
accgcaguugcugccuu

SEQ ID NO: 3980431 - RNA, 14 nt, Human herpesvirus 5
accgcgagcggcgg

SEQ ID NO: 3980432 - RNA, 21 nt, Human herpesvirus 5
accgcgcccacuggaguugcu

SEQ ID NO: 3980433 - RNA, 13 nt, Human herpesvirus 5
accgcggcgcagg

SEQ ID NO: 3980434 - RNA, 20 nt, Human herpesvirus 5
accggcgcaguuugcggcgc

SEQ ID NO: 3980435 - RNA, 13 nt, Human herpesvirus 5
accguaaagagag

SEQ ID NO: 3980436 - RNA, 17 nt, Human herpesvirus 5
accgucgcccucagcgu

SEQ ID NO: 3980437 - RNA, 17 nt, Human herpesvirus 5
accgucgccgucacugc

SEQ ID NO: 3980438 - RNA, 19 nt, Human herpesvirus 5
accgucgccgucacugcca

SEQ ID NO: 3980439 - RNA, 20 nt, Human herpesvirus 5
accgucgcuacauucgccgc

SEQ ID NO: 3980440 - RNA, 20 nt, Human herpesvirus 5
accgugcccguuuucacagc

SEQ ID NO: 3980441 - RNA, 20 nt, Human herpesvirus 5
accguggggucaucgaccga

SEQ ID NO: 3980442 - RNA, 12 nt, Human herpesvirus 5
accgugucuccg

SEQ ID NO: 3980443 - RNA, 17 nt, Human herpesvirus 5
accguuguggggauuuu

SEQ ID NO: 3980444 - RNA, 14 nt, Human herpesvirus 5
accuaccugggcug

SEQ ID NO: 3980445 - RNA, 21 nt, Human herpesvirus 5
accuacgucaaagcggucuca

SEQ ID NO: 3980446 - RNA, 21 nt, Human herpesvirus 5
accucaguggaccgucaauuu

SEQ ID NO: 3980447 - RNA, 16 nt, Human herpesvirus 5
accucgugcgaggaca

SEQ ID NO: 3980448 - RNA, 15 nt, Human herpesvirus 5
accugagacuggucu

SEQ ID NO: 3980449 - RNA, 20 nt, Human herpesvirus 5
accugcucaaaguacuuguc

SEQ ID NO: 3980450 - RNA, 15 nt, Human herpesvirus 5
accuggacgcgguga

SEQ ID NO: 3980451 - RNA, 23 nt, Human herpesvirus 5
accuggguagcaaguccuccaac

SEQ ID NO: 3980452 - RNA, 21 nt, Human herpesvirus 5
accuggucaagguagaggaac

SEQ ID NO: 3980453 - RNA, 24 nt, Human herpesvirus 5
accugugugaucugggcagcggcu

SEQ ID NO: 3980454 - RNA, 12 nt, Human herpesvirus 5
accuugucuccc

SEQ ID NO: 3980455 - RNA, 13 nt, Human herpesvirus 5
acgaaaggcaccg

SEQ ID NO: 3980456 - RNA, 13 nt, Human herpesvirus 5
acgaagaggacac

SEQ ID NO: 3980457 - RNA, 20 nt, Human herpesvirus 5
acgaagaugccgauguguga

SEQ ID NO: 3980458 - RNA, 21 nt, Human herpesvirus 5
acgaagaugccgaugugugac

SEQ ID NO: 3980459 - RNA, 17 nt, Human herpesvirus 5
acgacagucuccuccug

SEQ ID NO: 3980460 - RNA, 14 nt, Human herpesvirus 5
acgacccaccgccg

SEQ ID NO: 3980461 - RNA, 23 nt, Human herpesvirus 5
acgacccaccgccgcuuucucau

SEQ ID NO: 3980462 - RNA, 17 nt, Human herpesvirus 5
agaugaggcggcgugga

SEQ ID NO: 3980463 - RNA, 13 nt, Human herpesvirus 5
agaugcuauccgc

SEQ ID NO: 3980464 - RNA, 18 nt, Human herpesvirus 5
agcaagaguugcaacgcg

SEQ ID NO: 3980465 - RNA, 12 nt, Human herpesvirus 5
agcacaccugcc

SEQ ID NO: 3980466 - RNA, 15 nt, Human herpesvirus 5
agcacauuagacaca

SEQ ID NO: 3980467 - RNA, 17 nt, Human herpesvirus 5
agcacauuagacacacg

SEQ ID NO: 3980468 - RNA, 18 nt, Human herpesvirus 5
agcacguacaaauagcag

SEQ ID NO: 3980469 - RNA, 16 nt, Human herpesvirus 5
agcacgucagugguga

SEQ ID NO: 3980470 - RNA, 18 nt, Human herpesvirus 5
agcagccaccgacacagc

SEQ ID NO: 3980471 - RNA, 17 nt, Human herpesvirus 5
agcaggguaaaaaccac

SEQ ID NO: 3980472 - RNA, 22 nt, Human herpesvirus 5
agcaucgcaacaacagcaacaa

SEQ ID NO: 3980473 - RNA, 17 nt, Human herpesvirus 5
agcaugcugugggccca

SEQ ID NO: 3980474 - RNA, 17 nt, Human herpesvirus 5
agccacggaggagacga

SEQ ID NO: 3980475 - RNA, 14 nt, Human herpesvirus 5
agccagacugcccu

SEQ ID NO: 3980476 - RNA, 12 nt, Human herpesvirus 5
agcccaccgccc

SEQ ID NO: 3980477 - RNA, 15 nt, Human herpesvirus 5
agcccgggccgccgc

SEQ ID NO: 3980478 - RNA, 17 nt, Human herpesvirus 5
agccgagcgggaggcgg

SEQ ID NO: 3980479 - RNA, 15 nt, Human herpesvirus 5
agccggcuccgccgu

SEQ ID NO: 3980480 - RNA, 21 nt, Human herpesvirus 5
agccuguuagaaccgcgggcc

SEQ ID NO: 3980481 - RNA, 17 nt, Human herpesvirus 5
agcgccguccugcagac

SEQ ID NO: 3980482 - RNA, 24 nt, Human herpesvirus 5
agcgcgaguugcaaaagaagcugc

SEQ ID NO: 3980483 - RNA, 23 nt, Human herpesvirus 5
agcgcggucgccaccuggaucug

SEQ ID NO: 3980484 - RNA, 20 nt, Human herpesvirus 5
agcgcguuuguugcgcggcg

SEQ ID NO: 3980485 - RNA, 23 nt, Human herpesvirus 5
agcggcagccaccgcgaggccac

SEQ ID NO: 3980486 - RNA, 12 nt, Human herpesvirus 5
agcggccgccgg

SEQ ID NO: 3980487 - RNA, 14 nt, Human herpesvirus 5
agcgggcugucaca

SEQ ID NO: 3980488 - RNA, 15 nt, Human herpesvirus 5
agcgguaccagacgc

SEQ ID NO: 3980489 - RNA, 16 nt, Human herpesvirus 5
agcgucugcgccuuuu

SEQ ID NO: 3980490 - RNA, 14 nt, Human herpesvirus 5
agcgugcaccugcu

SEQ ID NO: 3980491 - RNA, 20 nt, Human herpesvirus 5
agcgugcucagcugguggcu

SEQ ID NO: 3980492 - RNA, 23 nt, Human herpesvirus 5
agcgugcugugcuacgagaucag

SEQ ID NO: 3980493 - RNA, 19 nt, Human herpesvirus 5
agcuacgcgaccagcugcu

SEQ ID NO: 3980494 - RNA, 18 nt, Human herpesvirus 5
agcuagugcagccuuagg

SEQ ID NO: 3980495 - RNA, 17 nt, Human herpesvirus 5
agcuauauagccggugu

SEQ ID NO: 3980496 - RNA, 16 nt, Human herpesvirus 5
agcucguccacacgcc

SEQ ID NO: 3980497 - RNA, 19 nt, Human herpesvirus 5
agcucuuccaaugguugaa

SEQ ID NO: 3980498 - RNA, 18 nt, Human herpesvirus 5
agcugcgcaggccgccgc

SEQ ID NO: 3980499 - RNA, 18 nt, Human herpesvirus 5
agcugcuuuucgggccgc

SEQ ID NO: 3980500 - RNA, 19 nt, Human herpesvirus 5
agcuggggaaguacaauau

SEQ ID NO: 3980501 - RNA, 15 nt, Human herpesvirus 5
agcuggugcaucacg

SEQ ID NO: 3980502 - RNA, 15 nt, Human herpesvirus 5
agcuguguauaguuu

SEQ ID NO: 3980503 - RNA, 22 nt, Human herpesvirus 5
agcuuaccgccaccgucgcccu

SEQ ID NO: 3980504 - RNA, 17 nt, Human herpesvirus 5
agcuucggccggcugcu

SEQ ID NO: 3980505 - RNA, 18 nt, Human herpesvirus 5
agcuucugguaggaggcg

SEQ ID NO: 3980506 - RNA, 20 nt, Human herpesvirus 5
aggaacgcacgcuggaggac

SEQ ID NO: 3980507 - RNA, 17 nt, Human herpesvirus 5
aggacagcaaggccgcc

SEQ ID NO: 3980508 - RNA, 22 nt, Human herpesvirus 5
aggagauuauccguaucugcau

SEQ ID NO: 3980509 - RNA, 15 nt, Human herpesvirus 5
aggagcuucuccccg

SEQ ID NO: 3980510 - RNA, 16 nt, Human herpesvirus 5
aggauguucugcacgg

SEQ ID NO: 3980511 - RNA, 16 nt, Human herpesvirus 5
aggccacccacccggu

SEQ ID NO: 3980512 - RNA, 21 nt, Human herpesvirus 5
cgccgcgaucgaggcggcggc

SEQ ID NO: 3980513 - RNA, 13 nt, Human herpesvirus 5
cgccgcgcccguc

SEQ ID NO: 3980514 - RNA, 20 nt, Human herpesvirus 5
cgccgcgccguaguucuccg

SEQ ID NO: 3980515 - RNA, 12 nt, Human herpesvirus 5
cgccgcggcguu

SEQ ID NO: 3980516 - RNA, 17 nt, Human herpesvirus 5
cgccggccacgagccag

SEQ ID NO: 3980517 - RNA, 15 nt, Human herpesvirus 5
cgccgugcgcgacga

SEQ ID NO: 3980518 - RNA, 20 nt, Human herpesvirus 5
cgccgugcucuuggcgccgc

SEQ ID NO: 3980519 - RNA, 15 nt, Human herpesvirus 5
cgccgugggcggcga

SEQ ID NO: 3980520 - RNA, 21 nt, Human herpesvirus 5
cgccucaaaaagcagguggag

SEQ ID NO: 3980521 - RNA, 17 nt, Human herpesvirus 5
cgccucacgcugcacga

SEQ ID NO: 3980522 - RNA, 22 nt, Human herpesvirus 5
cgccuccucgucggccugggcu

SEQ ID NO: 3980523 - RNA, 15 nt, Human herpesvirus 5
cgccugcgacggcgg

SEQ ID NO: 3980524 - RNA, 17 nt, Human herpesvirus 5
cgccugguugcugccgc

SEQ ID NO: 3980525 - RNA, 19 nt, Human herpesvirus 5
cgccugguugcugccgcgu

SEQ ID NO: 3980526 - RNA, 15 nt, Human herpesvirus 5
cgccuuccuccucug

SEQ ID NO: 3980527 - RNA, 13 nt, Human herpesvirus 5
cgcgaccuucccu

SEQ ID NO: 3980528 - RNA, 13 nt, Human herpesvirus 5
cgcgagcgggcaa

SEQ ID NO: 3980529 - RNA, 12 nt, Human herpesvirus 5
cgcgagcugggc

SEQ ID NO: 3980530 - RNA, 20 nt, Human herpesvirus 5
cgcgaggucugggaugugca

SEQ ID NO: 3980531 - RNA, 18 nt, Human herpesvirus 5
cgcgcaucgccugcaccu

SEQ ID NO: 3980532 - RNA, 15 nt, Human herpesvirus 5
cgcgcccgacagcug

SEQ ID NO: 3980533 - RNA, 19 nt, Human herpesvirus 5
cgcgccucauggcggcggc

SEQ ID NO: 3980534 - RNA, 21 nt, Human herpesvirus 5
cgcgccucucggagccgccga

SEQ ID NO: 3980535 - RNA, 17 nt, Human herpesvirus 5
cgcgccuuccuccucug

SEQ ID NO: 3980536 - RNA, 19 nt, Human herpesvirus 5
cgcgcucuguaccguuauu

SEQ ID NO: 3980537 - RNA, 20 nt, Human herpesvirus 5
cgcgcuggcaaacuccgaca

SEQ ID NO: 3980538 - RNA, 20 nt, Human herpesvirus 5
cgcggaaaccgagacggagg

SEQ ID NO: 3980539 - RNA, 15 nt, Human herpesvirus 5
cgcggaaacgacgga

SEQ ID NO: 3980540 - RNA, 18 nt, Human herpesvirus 5
cgcggaggugcuggcggc

SEQ ID NO: 3980541 - RNA, 14 nt, Human herpesvirus 5
cgcggcgacgagga

SEQ ID NO: 3980542 - RNA, 14 nt, Human herpesvirus 5
cgcggcgguggccg

SEQ ID NO: 3980543 - RNA, 15 nt, Human herpesvirus 5
cgcggcuagagcgcg

SEQ ID NO: 3980544 - RNA, 15 nt, Human herpesvirus 5
cgcggguggccggcg

SEQ ID NO: 3980545 - RNA, 21 nt, Human herpesvirus 5
gaggaugggggggaccggggu

SEQ ID NO: 3980546 - RNA, 19 nt, Human herpesvirus 5
gaggccgagacgcugcgcu

SEQ ID NO: 3980547 - RNA, 19 nt, Human herpesvirus 5
gagggucuuucuacgcccu

SEQ ID NO: 3980548 - RNA, 16 nt, Human herpesvirus 5
gagguacugcagcacg

SEQ ID NO: 3980549 - RNA, 22 nt, Human herpesvirus 5
gagguccuuuggguccagccag

SEQ ID NO: 3980550 - RNA, 17 nt, Human herpesvirus 5
gaggucuaucacgggcu

SEQ ID NO: 3980551 - RNA, 21 nt, Human herpesvirus 5
gagucaccguaaucaccaaag

SEQ ID NO: 3980552 - RNA, 20 nt, Human herpesvirus 5
cuuccccacccaguagacag

SEQ ID NO: 3980553 - RNA, 17 nt, Human herpesvirus 5
cuuccccucugcugcug

SEQ ID NO: 3980554 - RNA, 18 nt, Human herpesvirus 5
cuucccgaccucccacga

SEQ ID NO: 3980555 - RNA, 22 nt, Human herpesvirus 5
cuucgcgccccucugcguucac

SEQ ID NO: 3980556 - RNA, 16 nt, Human herpesvirus 5
cuucggaaucgggccc

SEQ ID NO: 3980557 - RNA, 21 nt, Human herpesvirus 5
cuucuuugguaucuacaucag

SEQ ID NO: 3980558 - RNA, 20 nt, Human herpesvirus 5
cuugaaagacggacccgcca

SEQ ID NO: 3980559 - RNA, 21 nt, Human herpesvirus 5
cuugcgcuucugcagcuccgc

SEQ ID NO: 3980560 - RNA, 17 nt, Human herpesvirus 5
cuugcggcgcuucgagg

SEQ ID NO: 3980561 - RNA, 17 nt, Human herpesvirus 5
cuuggccgaccugugcg

SEQ ID NO: 3980562 - RNA, 17 nt, Human herpesvirus 5
ggccaccaagaaacacc

SEQ ID NO: 3980563 - RNA, 13 nt, Human herpesvirus 5
ggccacgagccag

SEQ ID NO: 3980564 - RNA, 16 nt, Human herpesvirus 5
ggcccgaacgcugcuu

SEQ ID NO: 3980565 - RNA, 17 nt, Human herpesvirus 5
ggcccgcuggcucggcg

SEQ ID NO: 3980566 - RNA, 23 nt, Human herpesvirus 5
ggcccguuuugcauaagcgcgga

SEQ ID NO: 3980567 - RNA, 23 nt, Human herpesvirus 5
ggcccugugcuuuugcuuacugu

SEQ ID NO: 3980568 - RNA, 15 nt, Human herpesvirus 5
ggccgaccugugcgu

SEQ ID NO: 3980569 - RNA, 21 nt, Human herpesvirus 5
ggccgccgccagcguccgcgc

SEQ ID NO: 3980570 - RNA, 12 nt, Human herpesvirus 5
ggccgccucuuc

SEQ ID NO: 3980571 - RNA, 20 nt, Human herpesvirus 5
ggccgucgcaagggcugcuc

SEQ ID NO: 3980572 - RNA, 23 nt, Human herpesvirus 5
ggccuccgacgacgccgaggacg

SEQ ID NO: 3980573 - RNA, 15 nt, Human herpesvirus 5
ggccugcgggcaggc

SEQ ID NO: 3980574 - RNA, 17 nt, Human herpesvirus 5
ggccugguauacgaggc

SEQ ID NO: 3980575 - RNA, 18 nt, Human herpesvirus 5
ggccuguggugcgacugc

SEQ ID NO: 3980576 - RNA, 18 nt, Human herpesvirus 5
ggccuugcgcucccugcu

SEQ ID NO: 3980577 - RNA, 19 nt, Human herpesvirus 5
ggcgacaagcuguggcugc

SEQ ID NO: 3980578 - RNA, 13 nt, Human herpesvirus 5
ggcgacccgcagu

SEQ ID NO: 3980579 - RNA, 21 nt, Human herpesvirus 5
ggcgauacgccggugcugccg

SEQ ID NO: 3980580 - RNA, 21 nt, Human herpesvirus 5
ggcgaugacgaguaggcgcgc

SEQ ID NO: 3980581 - RNA, 15 nt, Human herpesvirus 5
ggcgcagucgcgagc

SEQ ID NO: 3980582 - RNA, 18 nt, Human herpesvirus 5
ggcgcagucgcgagcuga

SEQ ID NO: 3980583 - RNA, 14 nt, Human herpesvirus 5
ggcgcccgcgacgu

SEQ ID NO: 3980584 - RNA, 15 nt, Human herpesvirus 5
ggcgccgucagagca

SEQ ID NO: 3980585 - RNA, 17 nt, Human herpesvirus 5
ggcgcgcgucuggacgc

SEQ ID NO: 3980586 - RNA, 20 nt, Human herpesvirus 5
ggcgcggucccgugauggag

SEQ ID NO: 3980587 - RNA, 14 nt, Human herpesvirus 5
ggcgcucuuucagc

SEQ ID NO: 3980588 - RNA, 18 nt, Human herpesvirus 5
ggcgcuguacauucugcu

SEQ ID NO: 3980589 - RNA, 21 nt, Human herpesvirus 5
ggcgcuguucuggauguauau

SEQ ID NO: 3980590 - RNA, 19 nt, Human herpesvirus 5
ggcggccgacggcagcgug

SEQ ID NO: 3980591 - RNA, 14 nt, Human herpesvirus 5
ggcggccgcagaag

SEQ ID NO: 3980592 - RNA, 19 nt, Human herpesvirus 5
ggcggcggugguggaggag

SEQ ID NO: 3980593 - RNA, 15 nt, Human herpesvirus 5
ggcggcuugggcagc

SEQ ID NO: 3980594 - RNA, 18 nt, Human herpesvirus 5
ggcgguggccgucuuggg

SEQ ID NO: 3980595 - RNA, 14 nt, Human herpesvirus 5
ggcgguggcugcgc

SEQ ID NO: 3980596 - RNA, 18 nt, Human herpesvirus 5
ggcgucgcgucgcaggcc

SEQ ID NO: 3980597 - RNA, 20 nt, Human herpesvirus 5
ggcgugcugcacgcucaccg

SEQ ID NO: 3980598 - RNA, 22 nt, Human herpesvirus 5
ggcuaacgcgcugcugcucucc

SEQ ID NO: 3980599 - RNA, 17 nt, Human herpesvirus 5
ggcucaaacaccgcugc

SEQ ID NO: 3980600 - RNA, 21 nt, Human herpesvirus 5
ggcucaccgcaguugcugccu

SEQ ID NO: 3980601 - RNA, 14 nt, Human herpesvirus 5
ggcucacgccggca

SEQ ID NO: 3980602 - RNA, 16 nt, Human herpesvirus 5
ggcuccaugcugacgu

SEQ ID NO: 3980603 - RNA, 20 nt, Human herpesvirus 5
ggcucgaccggcggcugcug

SEQ ID NO: 3980604 - RNA, 22 nt, Human herpesvirus 5
ggcucgccgcagaccauccuca

SEQ ID NO: 3980605 - RNA, 19 nt, Human herpesvirus 5
ggcucguguggcagcuggc

SEQ ID NO: 3980606 - RNA, 15 nt, Human herpesvirus 5
ggcucugggaagcug

SEQ ID NO: 3980607 - RNA, 17 nt, Human herpesvirus 5
ggcucuugcgcuucugc

SEQ ID NO: 3980608 - RNA, 23 nt, Human herpesvirus 5
ggcugacgcggacgaggaacagc

SEQ ID NO: 3980609 - RNA, 20 nt, Human herpesvirus 5
ggcugccgccgcuguggcug

SEQ ID NO: 3980610 - RNA, 21 nt, Human herpesvirus 5
ggcugccgccgcuguggcugc

SEQ ID NO: 3980611 - RNA, 18 nt, Human herpesvirus 5
ggcugccuguuccugcug

SEQ ID NO: 3980612 - RNA, 18 nt, Human herpesvirus 5
ggcugucacaucaacucu

SEQ ID NO: 3980613 - RNA, 22 nt, Human herpesvirus 5
ggcuguucacgcggaggacagc

SEQ ID NO: 3980614 - RNA, 12 nt, Human herpesvirus 5
ggcuucccuccu

SEQ ID NO: 3980615 - RNA, 16 nt, Human herpesvirus 5
ggcuugucauggucug

SEQ ID NO: 3980616 - RNA, 17 nt, Human herpesvirus 5
gggaacgccguguggga

SEQ ID NO: 3980617 - RNA, 11 nt, Human herpesvirus 5
gggaagggugu

SEQ ID NO: 3980618 - RNA, 14 nt, Human herpesvirus 5
gggaccgcagcgug

SEQ ID NO: 3980619 - RNA, 19 nt, Human herpesvirus 5
gggcacggaccgcaacgug

SEQ ID NO: 3980620 - RNA, 19 nt, Human herpesvirus 5
gggcacucggcugugccug

SEQ ID NO: 3980621 - RNA, 23 nt, Human herpesvirus 5
gggccucggcgugcucaggccac

SEQ ID NO: 3980622 - RNA, 19 nt, Human herpesvirus 5
gggcgaaaggcaccccgac

SEQ ID NO: 3980623 - RNA, 11 nt, Human herpesvirus 5
gggcggcaggg

SEQ ID NO: 3980624 - RNA, 18 nt, Human herpesvirus 5
gggcucguguggcagcug

SEQ ID NO: 3980625 - RNA, 16 nt, Human herpesvirus 5
gggcugagacaggacg

SEQ ID NO: 3980626 - RNA, 22 nt, Human herpesvirus 5
gggcugcaagguacggacucua

SEQ ID NO: 3980627 - RNA, 13 nt, Human herpesvirus 5
gggcugggugcau

SEQ ID NO: 3980628 - RNA, 14 nt, Human herpesvirus 5
gggcuucccuccug

SEQ ID NO: 3980629 - RNA, 20 nt, Human herpesvirus 5
gggcuuuccuugucacguug

SEQ ID NO: 3980630 - RNA, 15 nt, Human herpesvirus 5
ggggaaaaucacgaa

SEQ ID NO: 3980631 - RNA, 18 nt, Human herpesvirus 5
ggggcccguuuugcauaa

SEQ ID NO: 3980632 - RNA, 14 nt, Human herpesvirus 5
gggguggugcgcga

SEQ ID NO: 3980633 - RNA, 12 nt, Human herpesvirus 5
gggucugugccc

SEQ ID NO: 3980634 - RNA, 12 nt, Human herpesvirus 5
gguaacagccuu

SEQ ID NO: 3980635 - RNA, 19 nt, Human herpesvirus 5
gguaacgcuggcucacgcc

SEQ ID NO: 3980636 - RNA, 13 nt, Human herpesvirus 5
gguaacguggacg

SEQ ID NO: 3980637 - RNA, 13 nt, Human herpesvirus 5
gguaacuggcaga

SEQ ID NO: 3980638 - RNA, 22 nt, Human herpesvirus 5
gguacaugucccgcauauuuug

SEQ ID NO: 3980639 - RNA, 15 nt, Human herpesvirus 5
gguaccuaaagcccc

SEQ ID NO: 3980640 - RNA, 22 nt, Human herpesvirus 5
gguacggacucgaaggcgcccg

SEQ ID NO: 3980641 - RNA, 20 nt, Human herpesvirus 5
gguagcuucucucuggucuu

SEQ ID NO: 3980642 - RNA, 19 nt, Human herpesvirus 5
gguauccacgcucguucaa

SEQ ID NO: 3980643 - RNA, 18 nt, Human herpesvirus 5
ggucauguucucccagga

SEQ ID NO: 3980644 - RNA, 19 nt, Human herpesvirus 5
gguccguuauguccgcucg

SEQ ID NO: 3980645 - RNA, 12 nt, Human herpesvirus 5
ggucggcugccg

SEQ ID NO: 3980646 - RNA, 19 nt, Human herpesvirus 5
ggucguuguccuccucguc

SEQ ID NO: 3980647 - RNA, 16 nt, Human herpesvirus 5
ggucugcgagaggaag

SEQ ID NO: 3980648 - RNA, 18 nt, Human herpesvirus 5
ggucugcuugcuggcuug

SEQ ID NO: 3980649 - RNA, 18 nt, Human herpesvirus 5
ggucugggaugugcagca

SEQ ID NO: 3980650 - RNA, 21 nt, Human herpesvirus 5
ggucuucgacgucgcugccgu

SEQ ID NO: 3980651 - RNA, 14 nt, Human herpesvirus 5
ggugacauccucgc

SEQ ID NO: 3980652 - RNA, 17 nt, Human herpesvirus 5
ggugaugcguguggccg

SEQ ID NO: 3980653 - RNA, 20 nt, Human herpesvirus 5
ggugauucuauuacacucua

SEQ ID NO: 3980654 - RNA, 16 nt, Human herpesvirus 5
ggugccgccgcugccg

SEQ ID NO: 3980655 - RNA, 18 nt, Human herpesvirus 5
ggugcgcugcagccggag

SEQ ID NO: 3980656 - RNA, 20 nt, Human herpesvirus 5
ggugcuucuucuaccuggcu

SEQ ID NO: 3980657 - RNA, 17 nt, Human herpesvirus 5
gguggccgugcugggcu

SEQ ID NO: 3980658 - RNA, 18 nt, Human herpesvirus 5
gguggcgaggugugagga

SEQ ID NO: 3980659 - RNA, 12 nt, Human herpesvirus 5
gguggcggccuu

SEQ ID NO: 3980660 - RNA, 15 nt, Human herpesvirus 5
gguggcggcggugga

SEQ ID NO: 3980661 - RNA, 15 nt, Human herpesvirus 5
gguggcgggcugcgu

SEQ ID NO: 3980662 - RNA, 14 nt, Human herpesvirus 5
gguggcugggcuca

SEQ ID NO: 3980663 - RNA, 18 nt, Human herpesvirus 5
gguguccggacggcgaag

SEQ ID NO: 3980664 - RNA, 21 nt, Human herpesvirus 5
guggugaucgugggccaggac

SEQ ID NO: 3980665 - RNA, 16 nt, Human herpesvirus 5
guggugguggcucacg

SEQ ID NO: 3980666 - RNA, 14 nt, Human herpesvirus 5
guguacagcuaccu

SEQ ID NO: 3980667 - RNA, 19 nt, Human herpesvirus 5
guguacgccaucuucaucu

SEQ ID NO: 3980668 - RNA, 18 nt, Human herpesvirus 5
guguagauuuauggaaaa

SEQ ID NO: 3980669 - RNA, 15 nt, Human herpesvirus 5
gugucagacacagcc

SEQ ID NO: 3980670 - RNA, 13 nt, Human herpesvirus 5
guguccucggugc

SEQ ID NO: 3980671 - RNA, 12 nt, Human herpesvirus 5
gugucgugacgu

SEQ ID NO: 3980672 - RNA, 18 nt, Human herpesvirus 5
gugugaucugggcagcgg

SEQ ID NO: 3980673 - RNA, 13 nt, Human herpesvirus 5
gugugggaccugg

SEQ ID NO: 3980674 - RNA, 14 nt, Human herpesvirus 5
guguuccacuccau

SEQ ID NO: 3980675 - RNA, 16 nt, Human herpesvirus 5
guguucuuacuccguc

SEQ ID NO: 3980676 - RNA, 13 nt, Human herpesvirus 5
guguugacagggc

SEQ ID NO: 3980677 - RNA, 19 nt, Human herpesvirus 5
guguugccgacggcggcgc

SEQ ID NO: 3980678 - RNA, 16 nt, Human herpesvirus 5
guguugcuacagggag

SEQ ID NO: 3980679 - RNA, 16 nt, Human herpesvirus 5
guguuuuuuccuuccu

SEQ ID NO: 3980680 - RNA, 21 nt, Human herpesvirus 5
guuaacgucguuuuggagcug

SEQ ID NO: 3980681 - RNA, 15 nt, Human herpesvirus 5
guuacggcaacagcg

SEQ ID NO: 3980682 - RNA, 20 nt, Human herpesvirus 5
guucaacacuuucucuggau

SEQ ID NO: 3980683 - RNA, 13 nt, Human herpesvirus 5
guucaauaaucuc

SEQ ID NO: 3980684 - RNA, 19 nt, Human herpesvirus 5
guucacgcgcggaacccac

SEQ ID NO: 3980685 - RNA, 21 nt, Human herpesvirus 5
guucaucacguacacguuggg

SEQ ID NO: 3980686 - RNA, 21 nt, Human herpesvirus 5
ucagcuuuuuuuuuuguagua

SEQ ID NO: 3980687 - RNA, 20 nt, Human herpesvirus 5
ucauaaauucugacacggcg

SEQ ID NO: 3980688 - RNA, 13 nt, Human herpesvirus 5
ucaucucagccuc

SEQ ID NO: 3980689 - RNA, 19 nt, Human herpesvirus 5
ucaugaguuggugcagcug

SEQ ID NO: 3980690 - RNA, 13 nt, Human herpesvirus 5
ucaugccgccacc

SEQ ID NO: 3980691 - RNA, 15 nt, Human herpesvirus 5
ucauucguguugaca

SEQ ID NO: 3980692 - RNA, 15 nt, Human herpesvirus 5
uccaaccucgccguc

SEQ ID NO: 3980693 - RNA, 20 nt, Human herpesvirus 5
uccacgggccgcgcuccagg

SEQ ID NO: 3980694 - RNA, 17 nt, Human herpesvirus 5
uccacgucuucaaagua

SEQ ID NO: 3980695 - RNA, 22 nt, Human herpesvirus 5
uccacuuccgugauagccacga

SEQ ID NO: 3980696 - RNA, 20 nt, Human herpesvirus 5
uccagauacgcguuggccag

SEQ ID NO: 3980697 - RNA, 16 nt, Human herpesvirus 5
uccaucgcagccacgc

SEQ ID NO: 3980698 - RNA, 13 nt, Human herpesvirus 5
uccaugugcagcu

SEQ ID NO: 3980699 - RNA, 13 nt, Human herpesvirus 5
ucccaccacgguu

SEQ ID NO: 3980700 - RNA, 15 nt, Human herpesvirus 5
ucccaucucaacguc

SEQ ID NO: 3980701 - RNA, 13 nt, Human herpesvirus 5
uccccgugcccga

SEQ ID NO: 3980702 - RNA, 14 nt, Human herpesvirus 5
uccccugccaccuc

SEQ ID NO: 3980703 - RNA, 18 nt, Human herpesvirus 5
ucccgcuuguuggccacc

SEQ ID NO: 3980704 - RNA, 14 nt, Human herpesvirus 5
ucccuacagcgacu

SEQ ID NO: 3980705 - RNA, 13 nt, Human herpesvirus 5
ucccuccugcagc

SEQ ID NO: 3980706 - RNA, 12 nt, Human herpesvirus 5
ucccucugcugu

SEQ ID NO: 3980707 - RNA, 13 nt, Human herpesvirus 5
ucccugccagucu

SEQ ID NO: 3980708 - RNA, 14 nt, Human herpesvirus 5
uccgagcugcggua

SEQ ID NO: 3980709 - RNA, 16 nt, Human herpesvirus 5
uccgcaagcgccgcca

SEQ ID NO: 3980710 - RNA, 17 nt, Human herpesvirus 5
uccgcggacacccgcgg

SEQ ID NO: 3980711 - RNA, 15 nt, Human herpesvirus 5
uccgcggcccccacg

SEQ ID NO: 3980712 - RNA, 20 nt, Human herpesvirus 5
uccgcgucggucgccgccuc

SEQ ID NO: 3980713 - RNA, 14 nt, Human herpesvirus 5
ccucccuccgcggc

SEQ ID NO: 3980714 - RNA, 21 nt, Human herpesvirus 5
ccuccgcgaacggcgacggca

SEQ ID NO: 3980715 - RNA, 21 nt, Human herpesvirus 5
ccuccucgucgucgccgccgu

SEQ ID NO: 3980716 - RNA, 15 nt, Human herpesvirus 5
ccuccugcagcugca

SEQ ID NO: 3980717 - RNA, 20 nt, Human herpesvirus 5
ccucggguugccuggacgcc

SEQ ID NO: 3980718 - RNA, 21 nt, Human herpesvirus 5
ccucggguugccuggacgccu

SEQ ID NO: 3980719 - RNA, 16 nt, Human herpesvirus 5
ccucgucgccuuccag

SEQ ID NO: 3980720 - RNA, 13 nt, Human herpesvirus 5
ccucgucggaagc

SEQ ID NO: 3980721 - RNA, 17 nt, Human herpesvirus 5
ccucuaccccgccgccg

SEQ ID NO: 3980722 - RNA, 13 nt, Human herpesvirus 5
ccucuacuuggac

SEQ ID NO: 3980723 - RNA, 15 nt, Human herpesvirus 5
ccucuaucugcgcca

SEQ ID NO: 3980724 - RNA, 15 nt, Human herpesvirus 5
ccugagaacaugugg

SEQ ID NO: 3980725 - RNA, 21 nt, Human herpesvirus 5
ccugcacgacaucuuccgcga

SEQ ID NO: 3980726 - RNA, 13 nt, Human herpesvirus 5
ccugcgcagcgcg

SEQ ID NO: 3980727 - RNA, 22 nt, Human herpesvirus 5
ccugcgcgccuaccugacgccg

SEQ ID NO: 3980728 - RNA, 13 nt, Human herpesvirus 5
ccugcugcuacgc

SEQ ID NO: 3980729 - RNA, 19 nt, Human herpesvirus 5
ccuggacacucuggcccug

SEQ ID NO: 3980730 - RNA, 15 nt, Human herpesvirus 5
ccuggacgccugggc

SEQ ID NO: 3980731 - RNA, 19 nt, Human herpesvirus 5
ccuggacggcuacaugugu

SEQ ID NO: 3980732 - RNA, 16 nt, Human herpesvirus 5
ccuggccuucggcacg

SEQ ID NO: 3980733 - RNA, 21 nt, Human herpesvirus 5
ccuggguagcaaguccuccaa

SEQ ID NO: 3980734 - RNA, 23 nt, Human herpesvirus 5
ccugguuaguucgccgucgccgc

SEQ ID NO: 3980735 - RNA, 21 nt, Human herpesvirus 5
ccugucgucgacaugucgcga

SEQ ID NO: 3980736 - RNA, 19 nt, Human herpesvirus 5
ccuguuccugucaaugucc

SEQ ID NO: 3980737 - RNA, 14 nt, Human herpesvirus 5
ccuguugcucuccu

SEQ ID NO: 3980738 - RNA, 16 nt, Human herpesvirus 5
ccuguuggaacccauc

SEQ ID NO: 3980739 - RNA, 17 nt, Human herpesvirus 5
ccuguuggcuuacugcc

SEQ ID NO: 3980740 - RNA, 19 nt, Human herpesvirus 5
ccuguugugguggcuggga

SEQ ID NO: 3980741 - RNA, 23 nt, Human herpesvirus 5
ccuuccccacccaguagacagac

SEQ ID NO: 3980742 - RNA, 18 nt, Human herpesvirus 5
ccuuccgcgugcuccacc

SEQ ID NO: 3980743 - RNA, 17 nt, Human herpesvirus 5
ccuucucccccucaugu

SEQ ID NO: 3980744 - RNA, 20 nt, Human herpesvirus 5
ccuugcugaugugccagccg

SEQ ID NO: 3980745 - RNA, 13 nt, Human herpesvirus 5
ccuuggcgcucug

SEQ ID NO: 3980746 - RNA, 20 nt, Human herpesvirus 5
cgaaagcuucggccggcugc

SEQ ID NO: 3980747 - RNA, 14 nt, Human herpesvirus 5
cgaacgcgacuggc

SEQ ID NO: 3980748 - RNA, 15 nt, Human herpesvirus 5
cgaacgcgacuggcg

SEQ ID NO: 3980749 - RNA, 13 nt, Human herpesvirus 5
cgaacggagcagg

SEQ ID NO: 3980750 - RNA, 14 nt, Human herpesvirus 5
cgaacguccucgga

SEQ ID NO: 3980751 - RNA, 20 nt, Human herpesvirus 5
cgaagacgccgucacgcagg

SEQ ID NO: 3980752 - RNA, 15 nt, Human herpesvirus 5
cgaagcggcuguggc

SEQ ID NO: 3980753 - RNA, 12 nt, Human herpesvirus 5
cgaagugccgcg

SEQ ID NO: 3980754 - RNA, 20 nt, Human herpesvirus 5
cgaaucaccgucggcggggc

SEQ ID NO: 3980755 - RNA, 14 nt, Human herpesvirus 5
cgaauggcuggugu

SEQ ID NO: 3980756 - RNA, 22 nt, Human herpesvirus 5
cgaccacgacacggugcugcug

SEQ ID NO: 3980757 - RNA, 12 nt, Human herpesvirus 5
cgacccaccgcc

SEQ ID NO: 3980758 - RNA, 13 nt, Human herpesvirus 5
cgaccggcggcug

SEQ ID NO: 3980759 - RNA, 16 nt, Human herpesvirus 5
cgaccguuguccccgc

SEQ ID NO: 3980760 - RNA, 19 nt, Human herpesvirus 5
cgaccuugagcgacagcag

SEQ ID NO: 3980761 - RNA, 15 nt, Human herpesvirus 5
cgacgagcaggcucg

SEQ ID NO: 3980762 - RNA, 16 nt, Human herpesvirus 5
cgacgcgcgaccgcga

SEQ ID NO: 3980763 - RNA, 12 nt, Human herpesvirus 5
cgacggacgcga

SEQ ID NO: 3980764 - RNA, 20 nt, Human herpesvirus 5
cgacggcuuuccaagcuguc

SEQ ID NO: 3980765 - RNA, 14 nt, Human herpesvirus 5
cgacgggacggcgg

SEQ ID NO: 3980766 - RNA, 15 nt, Human herpesvirus 5
cgacgggacggcggc

SEQ ID NO: 3980767 - RNA, 19 nt, Human herpesvirus 5
cgacgggacggcggcgcgu

SEQ ID NO: 3980768 - RNA, 22 nt, Human herpesvirus 5
cgacguacgaaaugaccguggc

SEQ ID NO: 3980769 - RNA, 20 nt, Human herpesvirus 5
cgacguagguuaccgcgugc

SEQ ID NO: 3980770 - RNA, 16 nt, Human herpesvirus 5
cgacguggccuccucg

SEQ ID NO: 3980771 - RNA, 13 nt, Human herpesvirus 5
cgacucgcugccg

SEQ ID NO: 3980772 - RNA, 17 nt, Human herpesvirus 5
cgacugcggcgacuggc

SEQ ID NO: 3980773 - RNA, 16 nt, Human herpesvirus 5
cgacuggauccgcuuc

SEQ ID NO: 3980774 - RNA, 22 nt, Human herpesvirus 5
cgacuggggucaaaagccuggg

SEQ ID NO: 3980775 - RNA, 18 nt, Human herpesvirus 5
cgacuuuuuucugugaga

SEQ ID NO: 3980776 - RNA, 16 nt, Human herpesvirus 5
cgagaugguguacccg

SEQ ID NO: 3980777 - RNA, 19 nt, Human herpesvirus 5
cgagcauggaucacgcgcu

SEQ ID NO: 3980778 - RNA, 15 nt, Human herpesvirus 5
cgagcccccgucgcc

SEQ ID NO: 3980779 - RNA, 16 nt, Human herpesvirus 5
cgagcgcgaacgccgc

SEQ ID NO: 3980780 - RNA, 17 nt, Human herpesvirus 5
cgagcgggaggcgguga

SEQ ID NO: 3980781 - RNA, 19 nt, Human herpesvirus 5
cgagcguugcgcucgcgcu

SEQ ID NO: 3980782 - RNA, 14 nt, Human herpesvirus 5
cgagcuggccagca

SEQ ID NO: 3980783 - RNA, 14 nt, Human herpesvirus 5
cgaggaacccgcga

SEQ ID NO: 3980784 - RNA, 17 nt, Human herpesvirus 5
cgaggagccaaacugcg

SEQ ID NO: 3980785 - RNA, 15 nt, Human herpesvirus 5
cgaggaggccgcacu

SEQ ID NO: 3980786 - RNA, 19 nt, Human herpesvirus 5
cgaggcgcuggacgccauc

SEQ ID NO: 3980787 - RNA, 16 nt, Human herpesvirus 5
cgagggcucgugcgug

SEQ ID NO: 3980788 - RNA, 18 nt, Human herpesvirus 5
cgagucaccuagacgcaa

SEQ ID NO: 3980789 - RNA, 15 nt, Human herpesvirus 5
cgagugggccagccc

SEQ ID NO: 3980790 - RNA, 20 nt, Human herpesvirus 5
cgaguggggcaacugcugcc

SEQ ID NO: 3980791 - RNA, 18 nt, Human herpesvirus 5
cgaguuguagucgcggug

SEQ ID NO: 3980792 - RNA, 23 nt, Human herpesvirus 5
cgaguuguagucgcgguggcggc

SEQ ID NO: 3980793 - RNA, 11 nt, Human herpesvirus 5
cgauccuugga

SEQ ID NO: 3980794 - RNA, 18 nt, Human herpesvirus 5
cgaucguaacccaggcgc

SEQ ID NO: 3980795 - RNA, 14 nt, Human herpesvirus 5
cgaucuccucccgg

SEQ ID NO: 3980796 - RNA, 14 nt, Human herpesvirus 5
cgaucuggaaggcg

SEQ ID NO: 3980797 - RNA, 21 nt, Human herpesvirus 5
cgaucugugauccgugcgcuc

SEQ ID NO: 3980798 - RNA, 18 nt, Human herpesvirus 5
cgaucuugacgcugcugg

SEQ ID NO: 3980799 - RNA, 21 nt, Human herpesvirus 5
cgauggcaaggugcugcaccu

SEQ ID NO: 3980800 - RNA, 22 nt, Human herpesvirus 5
cgaugguauuacgcccgacgug

SEQ ID NO: 3980801 - RNA, 22 nt, Human herpesvirus 5
cgaugugugggaccuggucaag

SEQ ID NO: 3980802 - RNA, 15 nt, Human herpesvirus 5
cgcaaaggccacgug

SEQ ID NO: 3980803 - RNA, 14 nt, Human herpesvirus 5
cgcaagggcugcuc

SEQ ID NO: 3980804 - RNA, 15 nt, Human herpesvirus 5
cgcaagggcugcucg

SEQ ID NO: 3980805 - RNA, 15 nt, Human herpesvirus 5
cgcacauauguagca

SEQ ID NO: 3980806 - RNA, 14 nt, Human herpesvirus 5
cgcacccgacggcg

SEQ ID NO: 3980807 - RNA, 12 nt, Human herpesvirus 5
cgcacgacuggc

SEQ ID NO: 3980808 - RNA, 20 nt, Human herpesvirus 5
cgcacgacuggccagagguc

SEQ ID NO: 3980809 - RNA, 20 nt, Human herpesvirus 5
cgcacuuuuuuuacuaguau

SEQ ID NO: 3980810 - RNA, 18 nt, Human herpesvirus 5
cgcagcagagccaccagg

SEQ ID NO: 3980811 - RNA, 15 nt, Human herpesvirus 5
cgcaggagcugcugc

SEQ ID NO: 3980812 - RNA, 14 nt, Human herpesvirus 5
cgcaggccgccgcc

SEQ ID NO: 3980813 - RNA, 15 nt, Human herpesvirus 5
cgcaggccgccgccg

SEQ ID NO: 3980814 - RNA, 18 nt, Human herpesvirus 5
cgcaucgccugcaccucg

SEQ ID NO: 3980815 - RNA, 16 nt, Human herpesvirus 5
cgcaucuugccggugc

SEQ ID NO: 3980816 - RNA, 16 nt, Human herpesvirus 5
cgcaugucgucucauc

SEQ ID NO: 3980817 - RNA, 16 nt, Human herpesvirus 5
cgccaacgccgagcuc

SEQ ID NO: 3980818 - RNA, 13 nt, Human herpesvirus 5
cgccaccgucgcc

SEQ ID NO: 3980819 - RNA, 21 nt, Human herpesvirus 5
cgccacgcucgcucugacgcc

SEQ ID NO: 3980820 - RNA, 15 nt, Human herpesvirus 5
cgcccgacugcggac

SEQ ID NO: 3980821 - RNA, 14 nt, Human herpesvirus 5
cgcccgggccgccu

SEQ ID NO: 3980822 - RNA, 16 nt, Human herpesvirus 5
cgcccucgacggcggu

SEQ ID NO: 3980823 - RNA, 15 nt, Human herpesvirus 5
cgccgaacagacuug

SEQ ID NO: 3980824 - RNA, 21 nt, Human herpesvirus 5
cgccgaacagacuugguacgc

SEQ ID NO: 3980825 - RNA, 17 nt, Human herpesvirus 5
cgccgacgaagaagaac

SEQ ID NO: 3980826 - RNA, 18 nt, Human herpesvirus 5
cgccgcaacagcggcgac

SEQ ID NO: 3980827 - RNA, 16 nt, Human herpesvirus 5
cgccgcccgacgccga

SEQ ID NO: 3980828 - RNA, 15 nt, Human herpesvirus 5
cgccgccgacucgcu

SEQ ID NO: 3980829 - RNA, 21 nt, Human herpesvirus 5
cgccgcgacaacggccgccgc

SEQ ID NO: 3980830 - RNA, 17 nt, Human herpesvirus 5
cgccgcgaucgaggcgg

SEQ ID NO: 3980831 - RNA, 13 nt, Human herpesvirus 5
ccgaagaccucac

SEQ ID NO: 3980832 - RNA, 13 nt, Human herpesvirus 5
ccgacacagcagc

SEQ ID NO: 3980833 - RNA, 21 nt, Human herpesvirus 5
ccgacccugcguccccgcacg

SEQ ID NO: 3980834 - RNA, 19 nt, Human herpesvirus 5
ccgaccgggaaaccacgcc

SEQ ID NO: 3980835 - RNA, 18 nt, Human herpesvirus 5
ccgacgccggguuggcac

SEQ ID NO: 3980836 - RNA, 16 nt, Human herpesvirus 5
ccgacgcggcagcggc

SEQ ID NO: 3980837 - RNA, 16 nt, Human herpesvirus 5
ccgacgucgcgucggc

SEQ ID NO: 3980838 - RNA, 12 nt, Human herpesvirus 5
ccgagaaaggga

SEQ ID NO: 3980839 - RNA, 20 nt, Human herpesvirus 5
ccgagacgugcgaccuggac

SEQ ID NO: 3980840 - RNA, 20 nt, Human herpesvirus 5
ccgaggagauccaguuacac

SEQ ID NO: 3980841 - RNA, 14 nt, Human herpesvirus 5
ccgaggcggaggag

SEQ ID NO: 3980842 - RNA, 16 nt, Human herpesvirus 5
ccgagucggacgacga

SEQ ID NO: 3980843 - RNA, 16 nt, Human herpesvirus 5
ccgaugcuccgcgacc

SEQ ID NO: 3980844 - RNA, 20 nt, Human herpesvirus 5
ccgcaccagacuuggagaca

SEQ ID NO: 3980845 - RNA, 21 nt, Human herpesvirus 5
ccgcagcgaguugcugugcac

SEQ ID NO: 3980846 - RNA, 13 nt, Human herpesvirus 5
ccgcagcgguggc

SEQ ID NO: 3980847 - RNA, 18 nt, Human herpesvirus 5
ccgcagcguggccggcgu

SEQ ID NO: 3980848 - RNA, 15 nt, Human herpesvirus 5
ccgcagucuggcuug

SEQ ID NO: 3980849 - RNA, 21 nt, Human herpesvirus 5
ccgccacgacaaacacuaccg

SEQ ID NO: 3980850 - RNA, 14 nt, Human herpesvirus 5
ccgcccaaacaucu

SEQ ID NO: 3980851 - RNA, 17 nt, Human herpesvirus 5
ccgcccuugguggagac

SEQ ID NO: 3980852 - RNA, 16 nt, Human herpesvirus 5
ccgccgccgcgcuggc

SEQ ID NO: 3980853 - RNA, 22 nt, Human herpesvirus 5
ccgccguugcggccgccgcuca

SEQ ID NO: 3980854 - RNA, 13 nt, Human herpesvirus 5
ccgccuccacugc

SEQ ID NO: 3980855 - RNA, 14 nt, Human herpesvirus 5
ccgccuccacuucc

SEQ ID NO: 3980856 - RNA, 20 nt, Human herpesvirus 5
ccgcgacaacggccgccgca

SEQ ID NO: 3980857 - RNA, 15 nt, Human herpesvirus 5
ccgcgcacgacuggc

SEQ ID NO: 3980858 - RNA, 18 nt, Human herpesvirus 5
ccgcgcccgucgcgcacg

SEQ ID NO: 3980859 - RNA, 19 nt, Human herpesvirus 5
ccgcgccucacgcugcacg

SEQ ID NO: 3980860 - RNA, 13 nt, Human herpesvirus 5
ccgcgcuccaggc

SEQ ID NO: 3980861 - RNA, 18 nt, Human herpesvirus 5
ccgcggccgcugccgccg

SEQ ID NO: 3980862 - RNA, 15 nt, Human herpesvirus 5
ccgcgucagcggccg

SEQ ID NO: 3980863 - RNA, 19 nt, Human herpesvirus 5
ccgcgucgcuucgccgcca

SEQ ID NO: 3980864 - RNA, 20 nt, Human herpesvirus 5
ccgcuauugcuuagcugcac

SEQ ID NO: 3980865 - RNA, 16 nt, Human herpesvirus 5
ccgcucuucuggggcg

SEQ ID NO: 3980866 - RNA, 23 nt, Human herpesvirus 5
ccgcugauacuaucgggggagau

SEQ ID NO: 3980867 - RNA, 21 nt, Human herpesvirus 5
ccgcugccgcucagcgagcuc

SEQ ID NO: 3980868 - RNA, 18 nt, Human herpesvirus 5
ccgcuuaacaacgugucc

SEQ ID NO: 3980869 - RNA, 14 nt, Human herpesvirus 5
ccgcuuccucagcu

SEQ ID NO: 3980870 - RNA, 18 nt, Human herpesvirus 5
ccggccguuacgccgacg

SEQ ID NO: 3980871 - RNA, 15 nt, Human herpesvirus 5
ccggccuugcugugu

SEQ ID NO: 3980872 - RNA, 16 nt, Human herpesvirus 5
ccggcgggcggcugcc

SEQ ID NO: 3980873 - RNA, 14 nt, Human herpesvirus 5
ccggcgucgcuggc

SEQ ID NO: 3980874 - RNA, 15 nt, Human herpesvirus 5
ccggcguucagucgc

SEQ ID NO: 3980875 - RNA, 18 nt, Human herpesvirus 5
ccggcguuggggaucuac

SEQ ID NO: 3980876 - RNA, 16 nt, Human herpesvirus 5
ccgggacggccugggc

SEQ ID NO: 3980877 - RNA, 16 nt, Human herpesvirus 5
ccgggccgccgccagc

SEQ ID NO: 3980878 - RNA, 20 nt, Human herpesvirus 5
ccggggagacaaggugguga

SEQ ID NO: 3980879 - RNA, 22 nt, Human herpesvirus 5
ccggggugguggugcugcugcu

SEQ ID NO: 3980880 - RNA, 19 nt, Human herpesvirus 5
ccgguaacguggacgacgc

SEQ ID NO: 3980881 - RNA, 21 nt, Human herpesvirus 5
ccggucgucugcgacuccugg

SEQ ID NO: 3980882 - RNA, 14 nt, Human herpesvirus 5
ccggugcugccgca

SEQ ID NO: 3980883 - RNA, 20 nt, Human herpesvirus 5
ccggugguacugcuguggug

SEQ ID NO: 3980884 - RNA, 22 nt, Human herpesvirus 5
ccggugucuggcuuuaccgccg

SEQ ID NO: 3980885 - RNA, 18 nt, Human herpesvirus 5
ccgguguuggccaccaug

SEQ ID NO: 3980886 - RNA, 19 nt, Human herpesvirus 5
ccguaaccacgucgaccag

SEQ ID NO: 3980887 - RNA, 20 nt, Human herpesvirus 5
ccgucaaggccgccucuucu

SEQ ID NO: 3980888 - RNA, 22 nt, Human herpesvirus 5
ccgucggaaacccgacgagaca

SEQ ID NO: 3980889 - RNA, 22 nt, Human herpesvirus 5
ccgucggcgucgcgucgcaggc

SEQ ID NO: 3980890 - RNA, 21 nt, Human herpesvirus 5
ccgugacgucgcggcaccagg

SEQ ID NO: 3980891 - RNA, 13 nt, Human herpesvirus 5
ccgugcugggcug

SEQ ID NO: 3980892 - RNA, 19 nt, Human herpesvirus 5
ccguuaccaguaccaccgc

SEQ ID NO: 3980893 - RNA, 15 nt, Human herpesvirus 5
ccguuagccugguca

SEQ ID NO: 3980894 - RNA, 19 nt, Human herpesvirus 5
ccguuugcgccagugggug

SEQ ID NO: 3980895 - RNA, 15 nt, Human herpesvirus 5
ccguuuucacagcag

SEQ ID NO: 3980896 - RNA, 15 nt, Human herpesvirus 5
ccuagcacgucagug

SEQ ID NO: 3980897 - RNA, 15 nt, Human herpesvirus 5
ccuaguaaugcauua

SEQ ID NO: 3980898 - RNA, 14 nt, Human herpesvirus 5
ccuaugcgccguag

SEQ ID NO: 3980899 - RNA, 17 nt, Human herpesvirus 5
ccucaccgaccagcacu

SEQ ID NO: 3980900 - RNA, 19 nt, Human herpesvirus 5
ccucauguguauggcccug

SEQ ID NO: 3980901 - RNA, 19 nt, Human herpesvirus 5
ccucccgguauucggaaac

SEQ ID NO: 3980902 - RNA, 15 nt, Human herpesvirus 5
aggcaggcgaugcgc

SEQ ID NO: 3980903 - RNA, 20 nt, Human herpesvirus 5
aggccaacaucuucugcacu

SEQ ID NO: 3980904 - RNA, 12 nt, Human herpesvirus 5
aggccggcggcg

SEQ ID NO: 3980905 - RNA, 13 nt, Human herpesvirus 5
aggccuccucucc

SEQ ID NO: 3980906 - RNA, 14 nt, Human herpesvirus 5
aggccuccucuccg

SEQ ID NO: 3980907 - RNA, 15 nt, Human herpesvirus 5
aggcgccgcaaacau

SEQ ID NO: 3980908 - RNA, 18 nt, Human herpesvirus 5
aggcggaggagccggcgg

SEQ ID NO: 3980909 - RNA, 23 nt, Human herpesvirus 5
aggcggcgaggcgaaacuggugc

SEQ ID NO: 3980910 - RNA, 20 nt, Human herpesvirus 5
aggcucucggaucugcggcu

SEQ ID NO: 3980911 - RNA, 15 nt, Human herpesvirus 5
agggaagccgcgucc

SEQ ID NO: 3980912 - RNA, 16 nt, Human herpesvirus 5
agggcgcgccggcgcc

SEQ ID NO: 3980913 - RNA, 15 nt, Human herpesvirus 5
agggcgcgggcggcc

SEQ ID NO: 3980914 - RNA, 21 nt, Human herpesvirus 5
aggguucguacgcuucggcac

SEQ ID NO: 3980915 - RNA, 22 nt, Human herpesvirus 5
aggguuucaaguacccaccgau

SEQ ID NO: 3980916 - RNA, 15 nt, Human herpesvirus 5
agguaugccgcgucu

SEQ ID NO: 3980917 - RNA, 20 nt, Human herpesvirus 5
aggucgucuuggaagccgau

SEQ ID NO: 3980918 - RNA, 13 nt, Human herpesvirus 5
agguguggcggca

SEQ ID NO: 3980919 - RNA, 15 nt, Human herpesvirus 5
agguugcgccgcaag

SEQ ID NO: 3980920 - RNA, 19 nt, Human herpesvirus 5
agguugggagaugcggggu

SEQ ID NO: 3980921 - RNA, 14 nt, Human herpesvirus 5
aguacuuucacaac

SEQ ID NO: 3980922 - RNA, 15 nt, Human herpesvirus 5
aguaggcgcgcaccc

SEQ ID NO: 3980923 - RNA, 16 nt, Human herpesvirus 5
aguagugguggggcug

SEQ ID NO: 3980924 - RNA, 16 nt, Human herpesvirus 5
agucaacacuaccaag

SEQ ID NO: 3980925 - RNA, 13 nt, Human herpesvirus 5
aguccauacagca

SEQ ID NO: 3980926 - RNA, 13 nt, Human herpesvirus 5
agucgaucuggaa

SEQ ID NO: 3980927 - RNA, 19 nt, Human herpesvirus 5
agucuccgcaguuacacca

SEQ ID NO: 3980928 - RNA, 18 nt, Human herpesvirus 5
agugccgcgccgccugga

SEQ ID NO: 3980929 - RNA, 20 nt, Human herpesvirus 5
agugccgcgccgccuggagu

SEQ ID NO: 3980930 - RNA, 13 nt, Human herpesvirus 5
agugcgcgccgcc

SEQ ID NO: 3980931 - RNA, 13 nt, Human herpesvirus 5
agugcgcgcggcg

SEQ ID NO: 3980932 - RNA, 19 nt, Human herpesvirus 5
agugcgucuacgaccaaag

SEQ ID NO: 3980933 - RNA, 13 nt, Human herpesvirus 5
aguggaagggugc

SEQ ID NO: 3980934 - RNA, 20 nt, Human herpesvirus 5
aguggggcaacugcugccuc

SEQ ID NO: 3980935 - RNA, 20 nt, Human herpesvirus 5
aguucaccguauggcugcgc

SEQ ID NO: 3980936 - RNA, 13 nt, Human herpesvirus 5
aguugagcggggu

SEQ ID NO: 3980937 - RNA, 16 nt, Human herpesvirus 5
aguuggccaccaagaa

SEQ ID NO: 3980938 - RNA, 15 nt, Human herpesvirus 5
aguuggugcagcugc

SEQ ID NO: 3980939 - RNA, 21 nt, Human herpesvirus 5
aguuguggcaaagagccaugu

SEQ ID NO: 3980940 - RNA, 17 nt, Human herpesvirus 5
auaaaaaaagacacuca

SEQ ID NO: 3980941 - RNA, 14 nt, Human herpesvirus 5
auaaaaacacagag

SEQ ID NO: 3980942 - RNA, 21 nt, Human herpesvirus 5
auaaaaaccauugagaaagcu

SEQ ID NO: 3980943 - RNA, 17 nt, Human herpesvirus 5
auaaacgucacggaagu

SEQ ID NO: 3980944 - RNA, 21 nt, Human herpesvirus 5
auaaaggguggcgagguguga

SEQ ID NO: 3980945 - RNA, 13 nt, Human herpesvirus 5
auaaccuaccugg

SEQ ID NO: 3980946 - RNA, 10 nt, Human herpesvirus 5
auaacgugac

SEQ ID NO: 3980947 - RNA, 22 nt, Human herpesvirus 5
auacaucuccgucucuggucuc

SEQ ID NO: 3980948 - RNA, 19 nt, Human herpesvirus 5
auacccagcuggggaagua

SEQ ID NO: 3980949 - RNA, 20 nt, Human herpesvirus 5
auagauuagcagaaggaaua

SEQ ID NO: 3980950 - RNA, 19 nt, Human herpesvirus 5
auagcaugcauaagaagcc

SEQ ID NO: 3980951 - RNA, 20 nt, Human herpesvirus 5
auagguguggcgaaagccuc

SEQ ID NO: 3980952 - RNA, 16 nt, Human herpesvirus 5
auauaaauugggaaag

SEQ ID NO: 3980953 - RNA, 19 nt, Human herpesvirus 5
auauauggaguuuguguaa

SEQ ID NO: 3980954 - RNA, 20 nt, Human herpesvirus 5
auauggaguuuguguaaugc

SEQ ID NO: 3980955 - RNA, 20 nt, Human herpesvirus 5
auauuugaaaauauggcaua

SEQ ID NO: 3980956 - RNA, 13 nt, Human herpesvirus 5
aucacagaacaca

SEQ ID NO: 3980957 - RNA, 15 nt, Human herpesvirus 5
aucaccuggcgacgu

SEQ ID NO: 3980958 - RNA, 16 nt, Human herpesvirus 5
aucaccuggcgacguc

SEQ ID NO: 3980959 - RNA, 16 nt, Human herpesvirus 5
aucacgaaaggcaccg

SEQ ID NO: 3980960 - RNA, 11 nt, Human herpesvirus 5
aucacgugcca

SEQ ID NO: 3980961 - RNA, 21 nt, Human herpesvirus 5
aucagccgugagaacuuugua

SEQ ID NO: 3980962 - RNA, 22 nt, Human herpesvirus 5
aucagcuaccgccgcaacagcg

SEQ ID NO: 3980963 - RNA, 23 nt, Human herpesvirus 5
aucauggaagagggcgcgcgucu

SEQ ID NO: 3980964 - RNA, 16 nt, Human herpesvirus 5
aucauuacuaaacaaa

SEQ ID NO: 3980965 - RNA, 13 nt, Human herpesvirus 5
auccauccugggg

SEQ ID NO: 3980966 - RNA, 13 nt, Human herpesvirus 5
auccgcaccuguc

SEQ ID NO: 3980967 - RNA, 13 nt, Human herpesvirus 5
auccgucagccuc

SEQ ID NO: 3980968 - RNA, 16 nt, Human herpesvirus 5
aucgaggaggccgcac

SEQ ID NO: 3980969 - RNA, 16 nt, Human herpesvirus 5
aucgcgagccccaucg

SEQ ID NO: 3980970 - RNA, 15 nt, Human herpesvirus 5
aucggcguucugcuc

SEQ ID NO: 3980971 - RNA, 18 nt, Human herpesvirus 5
aucgucgcggacugccgg

SEQ ID NO: 3980972 - RNA, 14 nt, Human herpesvirus 5
aucgucggcagagg

SEQ ID NO: 3980973 - RNA, 15 nt, Human herpesvirus 5
aucgucuacgucguu

SEQ ID NO: 3980974 - RNA, 13 nt, Human herpesvirus 5
aucgucucaauaa

SEQ ID NO: 3980975 - RNA, 16 nt, Human herpesvirus 5
aucgugccgcuccauc

SEQ ID NO: 3980976 - RNA, 23 nt, Human herpesvirus 5
aucuauaaauguucucugaaacc

SEQ ID NO: 3980977 - RNA, 11 nt, Human herpesvirus 5
aucucagccuc

SEQ ID NO: 3980978 - RNA, 24 nt, Human herpesvirus 5
aucucgccguacggcaacgagcag

SEQ ID NO: 3980979 - RNA, 15 nt, Human herpesvirus 5
aucugcaagucccug

SEQ ID NO: 3980980 - RNA, 18 nt, Human herpesvirus 5
aucugcucccgcugcugc

SEQ ID NO: 3980981 - RNA, 16 nt, Human herpesvirus 5
aucuggcggccgccgg

SEQ ID NO: 3980982 - RNA, 14 nt, Human herpesvirus 5
aucugggugcaaug

SEQ ID NO: 3980983 - RNA, 14 nt, Human herpesvirus 5
aucugucguacugu

SEQ ID NO: 3980984 - RNA, 16 nt, Human herpesvirus 5
augaaaaacaucuuaa

SEQ ID NO: 3980985 - RNA, 16 nt, Human herpesvirus 5
augaaucuuccccucu

SEQ ID NO: 3980986 - RNA, 16 nt, Human herpesvirus 5
augaauuccucuauug

SEQ ID NO: 3980987 - RNA, 17 nt, Human herpesvirus 5
augagcgugcugcucug

SEQ ID NO: 3980988 - RNA, 18 nt, Human herpesvirus 5
augaggcgguggcugcgc

SEQ ID NO: 3980989 - RNA, 14 nt, Human herpesvirus 5
augauccugugguc

SEQ ID NO: 3980990 - RNA, 23 nt, Human herpesvirus 5
augauccuuguacagauguaaau

SEQ ID NO: 3980991 - RNA, 22 nt, Human herpesvirus 5
augaucuccaucgugugccuag

SEQ ID NO: 3980992 - RNA, 14 nt, Human herpesvirus 5
augaugcaaauaaa

SEQ ID NO: 3980993 - RNA, 12 nt, Human herpesvirus 5
augaugcugcug

SEQ ID NO: 3980994 - RNA, 13 nt, Human herpesvirus 5
augaugcugcuga

SEQ ID NO: 3980995 - RNA, 11 nt, Human herpesvirus 5
augcaggaggu

SEQ ID NO: 3980996 - RNA, 22 nt, Human herpesvirus 5
augcauuaucaucuaaagacua

SEQ ID NO: 3980997 - RNA, 20 nt, Human herpesvirus 5
augccuuccgcgugcuccac

SEQ ID NO: 3980998 - RNA, 10 nt, Human herpesvirus 5
augcgccgcc

SEQ ID NO: 3980999 - RNA, 17 nt, Human herpesvirus 5
augcuucaugucguccc

SEQ ID NO: 3981000 - RNA, 18 nt, Human herpesvirus 5
auggaccgucgaggaggu

SEQ ID NO: 3981001 - RNA, 13 nt, Human herpesvirus 5
auggccaacagcc

SEQ ID NO: 3981002 - RNA, 15 nt, Human herpesvirus 5
auggcuauguacaca

SEQ ID NO: 3981003 - RNA, 23 nt, Human herpesvirus 5
auggcuuggcgcagcgggcuuug

SEQ ID NO: 3981004 - RNA, 20 nt, Human herpesvirus 5
augggcgguggucggcugcc

SEQ ID NO: 3981005 - RNA, 23 nt, Human herpesvirus 5
augggcuucccuccugcagcugc

SEQ ID NO: 3981006 - RNA, 14 nt, Human herpesvirus 5
auggggugugguga

SEQ ID NO: 3981007 - RNA, 13 nt, Human herpesvirus 5
auguaaggcggcg

SEQ ID NO: 3981008 - RNA, 12 nt, Human herpesvirus 5
auguaguugcag

SEQ ID NO: 3981009 - RNA, 19 nt, Human herpesvirus 5
augucgcgacagagaggug

SEQ ID NO: 3981010 - RNA, 17 nt, Human herpesvirus 5
augucuccgaacucaga

SEQ ID NO: 3981011 - RNA, 22 nt, Human herpesvirus 5
augucuuugggcgggcucuggg

SEQ ID NO: 3981012 - RNA, 15 nt, Human herpesvirus 5
augugcucggaccgu

SEQ ID NO: 3981013 - RNA, 18 nt, Human herpesvirus 5
auguggcuccgccggcac

SEQ ID NO: 3981014 - RNA, 11 nt, Human herpesvirus 5
auguggucgcg

SEQ ID NO: 3981015 - RNA, 15 nt, Human herpesvirus 5
auguugacuaccuug

SEQ ID NO: 3981016 - RNA, 14 nt, Human herpesvirus 5
auuaaaaaaaaaac

SEQ ID NO: 3981017 - RNA, 18 nt, Human herpesvirus 5
auuaaaaagcuguaaggu

SEQ ID NO: 3981018 - RNA, 15 nt, Human herpesvirus 5
auuaugcaggagacg

SEQ ID NO: 3981019 - RNA, 17 nt, Human herpesvirus 5
auuauucuuggaugcua

SEQ ID NO: 3981020 - RNA, 21 nt, Human herpesvirus 5
acggccguuaucaaggccacu

SEQ ID NO: 3981021 - RNA, 13 nt, Human herpesvirus 5
acggcgaaccgcc

SEQ ID NO: 3981022 - RNA, 14 nt, Human herpesvirus 5
acggcgaccgucug

SEQ ID NO: 3981023 - RNA, 18 nt, Human herpesvirus 5
acggcggcgcguugccac

SEQ ID NO: 3981024 - RNA, 18 nt, Human herpesvirus 5
acggcgucuuccuccucg

SEQ ID NO: 3981025 - RNA, 14 nt, Human herpesvirus 5
acgggccgcgcucc

SEQ ID NO: 3981026 - RNA, 17 nt, Human herpesvirus 5
acgggguuaaacuggau

SEQ ID NO: 3981027 - RNA, 22 nt, Human herpesvirus 5
acgggucucuuugacacgagcg

SEQ ID NO: 3981028 - RNA, 13 nt, Human herpesvirus 5
acggugacgagcg

SEQ ID NO: 3981029 - RNA, 13 nt, Human herpesvirus 5
acggugcgcggcg

SEQ ID NO: 3981030 - RNA, 12 nt, Human herpesvirus 5
acgguggugugc

SEQ ID NO: 3981031 - RNA, 20 nt, Human herpesvirus 5
acggugucgccaccguugac

SEQ ID NO: 3981032 - RNA, 18 nt, Human herpesvirus 5
acguacgacugcgcggcc

SEQ ID NO: 3981033 - RNA, 22 nt, Human herpesvirus 5
acguacuguuuaaccacguugc

SEQ ID NO: 3981034 - RNA, 13 nt, Human herpesvirus 5
acguaggccuccu

SEQ ID NO: 3981035 - RNA, 14 nt, Human herpesvirus 5
acgucaaccacccg

SEQ ID NO: 3981036 - RNA, 13 nt, Human herpesvirus 5
acgucaacgguuu

SEQ ID NO: 3981037 - RNA, 19 nt, Human herpesvirus 5
acgucauucguguugacag

SEQ ID NO: 3981038 - RNA, 12 nt, Human herpesvirus 5
acguccccccgc

SEQ ID NO: 3981039 - RNA, 22 nt, Human herpesvirus 5
acgucgcagccaccggcgcagu

SEQ ID NO: 3981040 - RNA, 16 nt, Human herpesvirus 5
acgucguugaagacac

SEQ ID NO: 3981041 - RNA, 17 nt, Human herpesvirus 5
acgucguuuuggagcug

SEQ ID NO: 3981042 - RNA, 15 nt, Human herpesvirus 5
acgugauccaggagg

SEQ ID NO: 3981043 - RNA, 17 nt, Human herpesvirus 5
acgugauuuacgagguc

SEQ ID NO: 3981044 - RNA, 20 nt, Human herpesvirus 5
acgugcgauuuggaccugga

SEQ ID NO: 3981045 - RNA, 18 nt, Human herpesvirus 5
acgugcgguaacuggcag

SEQ ID NO: 3981046 - RNA, 20 nt, Human herpesvirus 5
acgugcuuggacugguacau

SEQ ID NO: 3981047 - RNA, 18 nt, Human herpesvirus 5
acguggacguuacacggg

SEQ ID NO: 3981048 - RNA, 12 nt, Human herpesvirus 5
acguguggcggg

SEQ ID NO: 3981049 - RNA, 21 nt, Human herpesvirus 5
acguguuucaaacagcacauu

SEQ ID NO: 3981050 - RNA, 14 nt, Human herpesvirus 5
acguugaugcggcg

SEQ ID NO: 3981051 - RNA, 19 nt, Human herpesvirus 5
acguuggcucucgcagccc

SEQ ID NO: 3981052 - RNA, 15 nt, Human herpesvirus 5
acguugggaagacgg

SEQ ID NO: 3981053 - RNA, 16 nt, Human herpesvirus 5
acuacaacagcggguc

SEQ ID NO: 3981054 - RNA, 13 nt, Human herpesvirus 5
acuacgaagauau

SEQ ID NO: 3981055 - RNA, 21 nt, Human herpesvirus 5
acuacgacgggacggcggcgc

SEQ ID NO: 3981056 - RNA, 23 nt, Human herpesvirus 5
acuacucuguguugcuacaggga

SEQ ID NO: 3981057 - RNA, 17 nt, Human herpesvirus 5
acuauuguauacucuau

SEQ ID NO: 3981058 - RNA, 18 nt, Human herpesvirus 5
acucacaauggaagccau

SEQ ID NO: 3981059 - RNA, 16 nt, Human herpesvirus 5
acuccgucuccagaca

SEQ ID NO: 3981060 - RNA, 15 nt, Human herpesvirus 5
acuccgugcuguugg

SEQ ID NO: 3981061 - RNA, 23 nt, Human herpesvirus 5
acuccuguuggcuuacugccugc

SEQ ID NO: 3981062 - RNA, 20 nt, Human herpesvirus 5
acucgcugccgcagcugcug

SEQ ID NO: 3981063 - RNA, 22 nt, Human herpesvirus 5
acucguugggauugacgcgguu

SEQ ID NO: 3981064 - RNA, 14 nt, Human herpesvirus 5
acucuggcccugcu

SEQ ID NO: 3981065 - RNA, 18 nt, Human herpesvirus 5
acugcguggggugcugga

SEQ ID NO: 3981066 - RNA, 15 nt, Human herpesvirus 5
acuggaagcugcugg

SEQ ID NO: 3981067 - RNA, 14 nt, Human herpesvirus 5
acugggacgaggag

SEQ ID NO: 3981068 - RNA, 22 nt, Human herpesvirus 5
acuggggucaaaagccugggua

SEQ ID NO: 3981069 - RNA, 16 nt, Human herpesvirus 5
acuggugcuggcggcg

SEQ ID NO: 3981070 - RNA, 14 nt, Human herpesvirus 5
acuucaaccacgag

SEQ ID NO: 3981071 - RNA, 18 nt, Human herpesvirus 5
acuucagaaucuauaaau

SEQ ID NO: 3981072 - RNA, 22 nt, Human herpesvirus 5
acuuuccucgccaccacuacca

SEQ ID NO: 3981073 - RNA, 12 nt, Human herpesvirus 5
acuuugcugcua

SEQ ID NO: 3981074 - RNA, 18 nt, Human herpesvirus 5
acuuuuacaugaacaaaa

SEQ ID NO: 3981075 - RNA, 17 nt, Human herpesvirus 5
agaaaccgcauguguug

SEQ ID NO: 3981076 - RNA, 18 nt, Human herpesvirus 5
agaaacgucgcagccacc

SEQ ID NO: 3981077 - RNA, 20 nt, Human herpesvirus 5
agaaugcaacgcuuucagga

SEQ ID NO: 3981078 - RNA, 12 nt, Human herpesvirus 5
agaauguugcga

SEQ ID NO: 3981079 - RNA, 19 nt, Human herpesvirus 5
agacacgcgcuucuggucg

SEQ ID NO: 3981080 - RNA, 16 nt, Human herpesvirus 5
agacagccuuacagcu

SEQ ID NO: 3981081 - RNA, 18 nt, Human herpesvirus 5
agacauggcgacuuuccg

SEQ ID NO: 3981082 - RNA, 16 nt, Human herpesvirus 5
agacccacuaccugga

SEQ ID NO: 3981083 - RNA, 22 nt, Human herpesvirus 5
agaccgaugugugggaccuggu

SEQ ID NO: 3981084 - RNA, 17 nt, Human herpesvirus 5
agacgaugaaccuuccc

SEQ ID NO: 3981085 - RNA, 21 nt, Human herpesvirus 5
agacgaugauaccgaaggcga

SEQ ID NO: 3981086 - RNA, 16 nt, Human herpesvirus 5
agacgugcgaccugga

SEQ ID NO: 3981087 - RNA, 15 nt, Human herpesvirus 5
agagaaagagcagcg

SEQ ID NO: 3981088 - RNA, 16 nt, Human herpesvirus 5
agagggugaaggcaaa

SEQ ID NO: 3981089 - RNA, 15 nt, Human herpesvirus 5
agauuagcagaagga

SEQ ID NO: 3981090 - RNA, 13 nt, Human herpesvirus 5
agcacaccugccu

SEQ ID NO: 3981091 - RNA, 16 nt, Human herpesvirus 5
agcacguacaccgcug

SEQ ID NO: 3981092 - RNA, 21 nt, Human herpesvirus 5
agcagaaggaauaauccgugc

SEQ ID NO: 3981093 - RNA, 18 nt, Human herpesvirus 5
agcagaggguuggcuggu

SEQ ID NO: 3981094 - RNA, 15 nt, Human herpesvirus 5
agcagccgacacagc

SEQ ID NO: 3981095 - RNA, 12 nt, Human herpesvirus 5
agcagcucuuuu

SEQ ID NO: 3981096 - RNA, 14 nt, Human herpesvirus 5
agcaugaacugcca

SEQ ID NO: 3981097 - RNA, 15 nt, Human herpesvirus 5
agcaugaacugccac

SEQ ID NO: 3981098 - RNA, 21 nt, Human herpesvirus 5
agcauguuuuaggaaugacac

SEQ ID NO: 3981099 - RNA, 16 nt, Human herpesvirus 5
agccaccgacacagca

SEQ ID NO: 3981100 - RNA, 22 nt, Human herpesvirus 5
agccaggugaccagcaguauga

SEQ ID NO: 3981101 - RNA, 13 nt, Human herpesvirus 5
agccaucacagcg

SEQ ID NO: 3981102 - RNA, 18 nt, Human herpesvirus 5
agccgccgacgcuggcgc

SEQ ID NO: 3981103 - RNA, 14 nt, Human herpesvirus 5
agccgccgccucca

SEQ ID NO: 3981104 - RNA, 21 nt, Human herpesvirus 5
agccgcggccgcugccgccgc

SEQ ID NO: 3981105 - RNA, 20 nt, Human herpesvirus 5
agccgugucgcgcacccggc

SEQ ID NO: 3981106 - RNA, 21 nt, Human herpesvirus 5
agccguguuuagucgcggcga

SEQ ID NO: 3981107 - RNA, 23 nt, Human herpesvirus 5
agccucgggugcaccgcggcacc

SEQ ID NO: 3981108 - RNA, 11 nt, Human herpesvirus 5
agcgacggcgg

SEQ ID NO: 3981109 - RNA, 16 nt, Human herpesvirus 5
agcgacguaccagcug

SEQ ID NO: 3981110 - RNA, 19 nt, Human herpesvirus 5
agcgcccgaagccgcgcga

SEQ ID NO: 3981111 - RNA, 12 nt, Human herpesvirus 5
agcgccgcggca

SEQ ID NO: 3981112 - RNA, 14 nt, Human herpesvirus 5
agcgccguccugca

SEQ ID NO: 3981113 - RNA, 21 nt, Human herpesvirus 5
agcgcguuuguugcgcggcga

SEQ ID NO: 3981114 - RNA, 12 nt, Human herpesvirus 5
agcggugcugau

SEQ ID NO: 3981115 - RNA, 16 nt, Human herpesvirus 5
agcguauccuggucaa

SEQ ID NO: 3981116 - RNA, 23 nt, Human herpesvirus 5
agcgugacuuugagcggcucgcc

SEQ ID NO: 3981117 - RNA, 16 nt, Human herpesvirus 5
agcgugcaccugcugc

SEQ ID NO: 3981118 - RNA, 19 nt, Human herpesvirus 5
agcgugcuaccagcugcag

SEQ ID NO: 3981119 - RNA, 17 nt, Human herpesvirus 5
agcuacgcgaccagcug

SEQ ID NO: 3981120 - RNA, 22 nt, Human herpesvirus 5
agcuacuuuggaaucacgcaga

SEQ ID NO: 3981121 - RNA, 14 nt, Human herpesvirus 5
agcucuacgagcug

SEQ ID NO: 3981122 - RNA, 15 nt, Human herpesvirus 5
agcucugaaacacag

SEQ ID NO: 3981123 - RNA, 18 nt, Human herpesvirus 5
agcugcacucacgcggcc

SEQ ID NO: 3981124 - RNA, 16 nt, Human herpesvirus 5
agcugcgcaggccgcc

SEQ ID NO: 3981125 - RNA, 13 nt, Human herpesvirus 5
agcugcuggagcg

SEQ ID NO: 3981126 - RNA, 12 nt, Human herpesvirus 5
agcuucggccgg

SEQ ID NO: 3981127 - RNA, 14 nt, Human herpesvirus 5
agcuucucucuggu

SEQ ID NO: 3981128 - RNA, 15 nt, Human herpesvirus 5
aggaacaaaauaaua

SEQ ID NO: 3981129 - RNA, 14 nt, Human herpesvirus 5
aggaagcggcggua

SEQ ID NO: 3981130 - RNA, 18 nt, Human herpesvirus 5
aggacagcaaggccgccg

SEQ ID NO: 3981131 - RNA, 19 nt, Human herpesvirus 5
aggaccauuuccaugugca

SEQ ID NO: 3981132 - RNA, 13 nt, Human herpesvirus 5
aggacgaggcagg

SEQ ID NO: 3981133 - RNA, 13 nt, Human herpesvirus 5
aggacgaguggcu

SEQ ID NO: 3981134 - RNA, 17 nt, Human herpesvirus 5
aggagccaaacugcgag

SEQ ID NO: 3981135 - RNA, 16 nt, Human herpesvirus 5
aggagcugcugcucgg

SEQ ID NO: 3981136 - RNA, 17 nt, Human herpesvirus 5
aggauccaaggccucca

SEQ ID NO: 3981137 - RNA, 11 nt, Human herpesvirus 5
aggcacacggu

SEQ ID NO: 3981138 - RNA, 15 nt, Human herpesvirus 5
auucagaaccaugua

SEQ ID NO: 3981139 - RNA, 22 nt, Human herpesvirus 5
auucaucgugcaguaccucaac

SEQ ID NO: 3981140 - RNA, 19 nt, Human herpesvirus 5
auuccaguagcaccggccc

SEQ ID NO: 3981141 - RNA, 17 nt, Human herpesvirus 5
auugcccuucuggagca

SEQ ID NO: 3981142 - RNA, 15 nt, Human herpesvirus 5
auuggcaggaaagac

SEQ ID NO: 3981143 - RNA, 17 nt, Human herpesvirus 5
auuggugaaggccgugg

SEQ ID NO: 3981144 - RNA, 15 nt, Human herpesvirus 5
auuguguguacgaca

SEQ ID NO: 3981145 - RNA, 19 nt, Human herpesvirus 5
auuguuuuuauuacccgcu

SEQ ID NO: 3981146 - RNA, 23 nt, Human herpesvirus 5
auuuacuacuucgauucucuaua

SEQ ID NO: 3981147 - RNA, 13 nt, Human herpesvirus 5
auuuagaaacacc

SEQ ID NO: 3981148 - RNA, 21 nt, Human herpesvirus 5
auuuaucaauacaaugacacu

SEQ ID NO: 3981149 - RNA, 12 nt, Human herpesvirus 5
auuugaagccag

SEQ ID NO: 3981150 - RNA, 15 nt, Human herpesvirus 5
auuuucuuucuagug

SEQ ID NO: 3981151 - RNA, 23 nt, Human herpesvirus 5
auuuugggucagcggcacgccgc

SEQ ID NO: 3981152 - RNA, 14 nt, Human herpesvirus 5
caaaaaaacauggg

SEQ ID NO: 3981153 - RNA, 22 nt, Human herpesvirus 5
caaaagacguuaucgaugcugc

SEQ ID NO: 3981154 - RNA, 20 nt, Human herpesvirus 5
caaacgcgggcccggacgcg

SEQ ID NO: 3981155 - RNA, 17 nt, Human herpesvirus 5
caaacgcgugcgggugc

SEQ ID NO: 3981156 - RNA, 21 nt, Human herpesvirus 5
caaacgcgugcgggugcauga

SEQ ID NO: 3981157 - RNA, 18 nt, Human herpesvirus 5
caaagaaaaaaaaaagga

SEQ ID NO: 3981158 - RNA, 15 nt, Human herpesvirus 5
caaagucaacaugua

SEQ ID NO: 3981159 - RNA, 22 nt, Human herpesvirus 5
caaaucuccgcggcgguggccg

SEQ ID NO: 3981160 - RNA, 14 nt, Human herpesvirus 5
caacaaaaaaaagg

SEQ ID NO: 3981161 - RNA, 17 nt, Human herpesvirus 5
caacaaauaccaacacu

SEQ ID NO: 3981162 - RNA, 17 nt, Human herpesvirus 5
caacaacagcagcaaca

SEQ ID NO: 3981163 - RNA, 16 nt, Human herpesvirus 5
caacaagagaaagacc

SEQ ID NO: 3981164 - RNA, 18 nt, Human herpesvirus 5
caacaaugacuaacccug

SEQ ID NO: 3981165 - RNA, 11 nt, Human herpesvirus 5
caacagcagca

SEQ ID NO: 3981166 - RNA, 16 nt, Human herpesvirus 5
caacagcagccaccga

SEQ ID NO: 3981167 - RNA, 14 nt, Human herpesvirus 5
caacaugcccagca

SEQ ID NO: 3981168 - RNA, 23 nt, Human herpesvirus 5
caacccguaucugagcggcggcg

SEQ ID NO: 3981169 - RNA, 13 nt, Human herpesvirus 5
caaccgcgagcgg

SEQ ID NO: 3981170 - RNA, 15 nt, Human herpesvirus 5
caacgcgaccaccgu

SEQ ID NO: 3981171 - RNA, 13 nt, Human herpesvirus 5
caacggccccugu

SEQ ID NO: 3981172 - RNA, 21 nt, Human herpesvirus 5
caacggccgccgcagccacga

SEQ ID NO: 3981173 - RNA, 14 nt, Human herpesvirus 5
caacggcuggagga

SEQ ID NO: 3981174 - RNA, 20 nt, Human herpesvirus 5
caacguaacagcaaacgcua

SEQ ID NO: 3981175 - RNA, 13 nt, Human herpesvirus 5
caacgucacuucu

SEQ ID NO: 3981176 - RNA, 21 nt, Human herpesvirus 5
caacugagcuucggagguccu

SEQ ID NO: 3981177 - RNA, 19 nt, Human herpesvirus 5
caagacgcugaauugcacg

SEQ ID NO: 3981178 - RNA, 13 nt, Human herpesvirus 5
caagagaagaaac

SEQ ID NO: 3981179 - RNA, 20 nt, Human herpesvirus 5
caagagcaugcugugggccc

SEQ ID NO: 3981180 - RNA, 17 nt, Human herpesvirus 5
caagaucguacccacca

SEQ ID NO: 3981181 - RNA, 21 nt, Human herpesvirus 5
caaggagcgacguaccagcug

SEQ ID NO: 3981182 - RNA, 14 nt, Human herpesvirus 5
caaggccgccgccg

SEQ ID NO: 3981183 - RNA, 23 nt, Human herpesvirus 5
caaggccgccucuucuggcccuc

SEQ ID NO: 3981184 - RNA, 16 nt, Human herpesvirus 5
caaggcuccgaaaccg

SEQ ID NO: 3981185 - RNA, 14 nt, Human herpesvirus 5
caagugccugcacg

SEQ ID NO: 3981186 - RNA, 19 nt, Human herpesvirus 5
caagugccugcacgaccug

SEQ ID NO: 3981187 - RNA, 22 nt, Human herpesvirus 5
caaguuggugguggaaugcggu

SEQ ID NO: 3981188 - RNA, 15 nt, Human herpesvirus 5
caauaaagagaguug

SEQ ID NO: 3981189 - RNA, 15 nt, Human herpesvirus 5
caauugcaugucgcc

SEQ ID NO: 3981190 - RNA, 17 nt, Human herpesvirus 5
caauuuuucuuuuuccu

SEQ ID NO: 3981191 - RNA, 17 nt, Human herpesvirus 5
caauuuuuucgcugcca

SEQ ID NO: 3981192 - RNA, 17 nt, Human herpesvirus 5
cacaaccguauauucua

SEQ ID NO: 3981193 - RNA, 14 nt, Human herpesvirus 5
cacaaccuguggug

SEQ ID NO: 3981194 - RNA, 16 nt, Human herpesvirus 5
cacacugcuacccugc

SEQ ID NO: 3981195 - RNA, 19 nt, Human herpesvirus 5
cacagagucgccaguccau

SEQ ID NO: 3981196 - RNA, 10 nt, Human herpesvirus 5
cacagcagcc

SEQ ID NO: 3981197 - RNA, 20 nt, Human herpesvirus 5
cacaucggugccggccaggu

SEQ ID NO: 3981198 - RNA, 13 nt, Human herpesvirus 5
cacaugggcccgu

SEQ ID NO: 3981199 - RNA, 18 nt, Human herpesvirus 5
cacauuuuuugacagaug

SEQ ID NO: 3981200 - RNA, 20 nt, Human herpesvirus 5
caccaccgagacgugcgacc

SEQ ID NO: 3981201 - RNA, 19 nt, Human herpesvirus 5
caccacuuugaccacccug

SEQ ID NO: 3981202 - RNA, 20 nt, Human herpesvirus 5
caccagcgucgcgguuacua

SEQ ID NO: 3981203 - RNA, 16 nt, Human herpesvirus 5
caccaggugccggcga

SEQ ID NO: 3981204 - RNA, 15 nt, Human herpesvirus 5
caccccccgggccac

SEQ ID NO: 3981205 - RNA, 18 nt, Human herpesvirus 5
caccccgaacuggagcuc

SEQ ID NO: 3981206 - RNA, 16 nt, Human herpesvirus 5
cacccgaguccugguc

SEQ ID NO: 3981207 - RNA, 22 nt, Human herpesvirus 5
cacccgucaugguacagaucca

SEQ ID NO: 3981208 - RNA, 15 nt, Human herpesvirus 5
caccgaaagcgcgcu

SEQ ID NO: 3981209 - RNA, 13 nt, Human herpesvirus 5
caccgacccugcg

SEQ ID NO: 3981210 - RNA, 21 nt, Human herpesvirus 5
caccgccgcuauggcggccau

SEQ ID NO: 3981211 - RNA, 19 nt, Human herpesvirus 5
caccggcgccugcugcucg

SEQ ID NO: 3981212 - RNA, 21 nt, Human herpesvirus 5
caccgguuggagcagcucuuu

SEQ ID NO: 3981213 - RNA, 19 nt, Human herpesvirus 5
caccgucaccacucccacc

SEQ ID NO: 3981214 - RNA, 20 nt, Human herpesvirus 5
caccgucaccacucccacca

SEQ ID NO: 3981215 - RNA, 19 nt, Human herpesvirus 5
caccgucgccgucacugcc

SEQ ID NO: 3981216 - RNA, 23 nt, Human herpesvirus 5
caccgucgcguccgacgcgacgg

SEQ ID NO: 3981217 - RNA, 22 nt, Human herpesvirus 5
caccgucggcggggcggacugc

SEQ ID NO: 3981218 - RNA, 14 nt, Human herpesvirus 5
caccuacgagcagg

SEQ ID NO: 3981219 - RNA, 15 nt, Human herpesvirus 5
caccucgaugaagcc

SEQ ID NO: 3981220 - RNA, 18 nt, Human herpesvirus 5
caccucgugcgaggacaa

SEQ ID NO: 3981221 - RNA, 14 nt, Human herpesvirus 5
caccugagacuggu

SEQ ID NO: 3981222 - RNA, 17 nt, Human herpesvirus 5
cacgaccaagugucucu

SEQ ID NO: 3981223 - RNA, 21 nt, Human herpesvirus 5
cacgacggaguuugacuacga

SEQ ID NO: 3981224 - RNA, 14 nt, Human herpesvirus 5
cacgagugggccag

SEQ ID NO: 3981225 - RNA, 15 nt, Human herpesvirus 5
cacgcacgacaugac

SEQ ID NO: 3981226 - RNA, 14 nt, Human herpesvirus 5
cacgccagacuugg

SEQ ID NO: 3981227 - RNA, 14 nt, Human herpesvirus 5
cacgccgugcucgc

SEQ ID NO: 3981228 - RNA, 17 nt, Human herpesvirus 5
cacgccguugccacgag

SEQ ID NO: 3981229 - RNA, 20 nt, Human herpesvirus 5
cacgcguuauacgccgagug

SEQ ID NO: 3981230 - RNA, 12 nt, Human herpesvirus 5
cacgcucgcucu

SEQ ID NO: 3981231 - RNA, 21 nt, Human herpesvirus 5
cacgcucgcucugacgccgcg

SEQ ID NO: 3981232 - RNA, 17 nt, Human herpesvirus 5
cacgcugauggccuacg

SEQ ID NO: 3981233 - RNA, 16 nt, Human herpesvirus 5
cacggccagcuccacg

SEQ ID NO: 3981234 - RNA, 12 nt, Human herpesvirus 5
cacggccugcgg

SEQ ID NO: 3981235 - RNA, 16 nt, Human herpesvirus 5
cacggccuuauguggc

SEQ ID NO: 3981236 - RNA, 20 nt, Human herpesvirus 5
cacggcggcggccugcucgc

SEQ ID NO: 3981237 - RNA, 21 nt, Human herpesvirus 5
cacggcgucuuccuccucguc

SEQ ID NO: 3981238 - RNA, 13 nt, Human herpesvirus 5
cacggcugcugau

SEQ ID NO: 3981239 - RNA, 14 nt, Human herpesvirus 5
cacgggugucccau

SEQ ID NO: 3981240 - RNA, 22 nt, Human herpesvirus 5
cacgguacgauaaaaacaacgu

SEQ ID NO: 3981241 - RNA, 23 nt, Human herpesvirus 5
cacggugacguagcagcacgcgg

SEQ ID NO: 3981242 - RNA, 21 nt, Human herpesvirus 5
cacguagaucccacuggcaau

SEQ ID NO: 3981243 - RNA, 22 nt, Human herpesvirus 5
cacgucaagaucguacccacca

SEQ ID NO: 3981244 - RNA, 17 nt, Human herpesvirus 5
cacgucaccgugcccca

SEQ ID NO: 3981245 - RNA, 14 nt, Human herpesvirus 5
cacgucgaccaggu

SEQ ID NO: 3981246 - RNA, 18 nt, Human herpesvirus 5
cacgucgauucccaucuc

SEQ ID NO: 3981247 - RNA, 20 nt, Human herpesvirus 5
cacgucgccguccaugucgc

SEQ ID NO: 3981248 - RNA, 17 nt, Human herpesvirus 5
cacgucgcugauccgca

SEQ ID NO: 3981249 - RNA, 21 nt, Human herpesvirus 5
cacgucggagccccugcgcgc

SEQ ID NO: 3981250 - RNA, 15 nt, Human herpesvirus 5
cacguucuugcgucc

SEQ ID NO: 3981251 - RNA, 21 nt, Human herpesvirus 5
cacuacguugggucugcgcug

SEQ ID NO: 3981252 - RNA, 13 nt, Human herpesvirus 5
cacucgcaccggc

SEQ ID NO: 3981253 - RNA, 14 nt, Human herpesvirus 5
cacuggcugcgccg

SEQ ID NO: 3981254 - RNA, 20 nt, Human herpesvirus 5
cacugugacguuagagaaag

SEQ ID NO: 3981255 - RNA, 21 nt, Human herpesvirus 5
cacuuccccuaguaauaccac

SEQ ID NO: 3981256 - RNA, 14 nt, Human herpesvirus 5
cacuuuaggcggcg

SEQ ID NO: 3981257 - RNA, 18 nt, Human herpesvirus 5
cagacaggcggccagcuu

SEQ ID NO: 3981258 - RNA, 13 nt, Human herpesvirus 5
cagaccagccacc

SEQ ID NO: 3981259 - RNA, 20 nt, Human herpesvirus 5
cagaccgcaacaacagcagc

SEQ ID NO: 3981260 - RNA, 17 nt, Human herpesvirus 5
cagagaccgccgccgcg

SEQ ID NO: 3981261 - RNA, 20 nt, Human herpesvirus 5
cagaggucgccgcugauacu

SEQ ID NO: 3981262 - RNA, 20 nt, Human herpesvirus 5
cagagucgccaguccauggu

SEQ ID NO: 3981263 - RNA, 21 nt, Human herpesvirus 5
cagaucguguuucggcggcug

SEQ ID NO: 3981264 - RNA, 16 nt, Human herpesvirus 5
cagaugcucccggcgc

SEQ ID NO: 3981265 - RNA, 13 nt, Human herpesvirus 5
cagauguaaauaa

SEQ ID NO: 3981266 - RNA, 17 nt, Human herpesvirus 5
cagcaacagcagccacc

SEQ ID NO: 3981267 - RNA, 20 nt, Human herpesvirus 5
cagcaacaguauuccccgcu

SEQ ID NO: 3981268 - RNA, 16 nt, Human herpesvirus 5
cagcaaccaccguuuc

SEQ ID NO: 3981269 - RNA, 22 nt, Human herpesvirus 5
cagcaaccaccguuucuacaaa

SEQ ID NO: 3981270 - RNA, 15 nt, Human herpesvirus 5
cagcacaccugccuc

SEQ ID NO: 3981271 - RNA, 13 nt, Human herpesvirus 5
cagcaccaugccg

SEQ ID NO: 3981272 - RNA, 23 nt, Human herpesvirus 5
cagcagagccaccaggugccggc

SEQ ID NO: 3981273 - RNA, 13 nt, Human herpesvirus 5
cagcagcagcugg

SEQ ID NO: 3981274 - RNA, 15 nt, Human herpesvirus 5
cagcagccaccgaca

SEQ ID NO: 3981275 - RNA, 23 nt, Human herpesvirus 5
cagcagccaccgacacagcagca

SEQ ID NO: 3981276 - RNA, 22 nt, Human herpesvirus 5
cagcagcucuuccaaugguuga

SEQ ID NO: 3981277 - RNA, 21 nt, Human herpesvirus 5
cagcagggagccagauggcga

SEQ ID NO: 3981278 - RNA, 17 nt, Human herpesvirus 5
cagcagggcgcgccggc

SEQ ID NO: 3981279 - RNA, 19 nt, Human herpesvirus 5
cagcauacggggaggagac

SEQ ID NO: 3981280 - RNA, 16 nt, Human herpesvirus 5
cagcaugggcgacacc

SEQ ID NO: 3981281 - RNA, 15 nt, Human herpesvirus 5
cagccaccggcgcag

SEQ ID NO: 3981282 - RNA, 18 nt, Human herpesvirus 5
cagccacgcgcugguggc

SEQ ID NO: 3981283 - RNA, 13 nt, Human herpesvirus 5
cagcccagggauc

SEQ ID NO: 3981284 - RNA, 16 nt, Human herpesvirus 5
cagcccauccucgugg

SEQ ID NO: 3981285 - RNA, 15 nt, Human herpesvirus 5
cagccgacacagcgg

SEQ ID NO: 3981286 - RNA, 22 nt, Human herpesvirus 5
cagccgcgcuugucgccaugcu

SEQ ID NO: 3981287 - RNA, 23 nt, Human herpesvirus 5
cagccggagcccgcacacuggcu

SEQ ID NO: 3981288 - RNA, 17 nt, Human herpesvirus 5
cagccucgggugcaccg

SEQ ID NO: 3981289 - RNA, 15 nt, Human herpesvirus 5
cagcgaacgacgcag

SEQ ID NO: 3981290 - RNA, 17 nt, Human herpesvirus 5
cagcgacgucccgcgcg

SEQ ID NO: 3981291 - RNA, 14 nt, Human herpesvirus 5
cagcgccagcggcc

SEQ ID NO: 3981292 - RNA, 15 nt, Human herpesvirus 5
cagcgccaggcggcu

SEQ ID NO: 3981293 - RNA, 23 nt, Human herpesvirus 5
cagcgccaggcggcugaucugca

SEQ ID NO: 3981294 - RNA, 14 nt, Human herpesvirus 5
cagcgcccuggggc

SEQ ID NO: 3981295 - RNA, 20 nt, Human herpesvirus 5
cagcggccgcagugggccca

SEQ ID NO: 3981296 - RNA, 23 nt, Human herpesvirus 5
cagcggcggcgguggugacuggg

SEQ ID NO: 3981297 - RNA, 21 nt, Human herpesvirus 5
cagcggucguuuuaaccgcag

SEQ ID NO: 3981298 - RNA, 20 nt, Human herpesvirus 5
cagcguucaaaggaauauua

SEQ ID NO: 3981299 - RNA, 19 nt, Human herpesvirus 5
cagcuaccgccgcaacagc

SEQ ID NO: 3981300 - RNA, 21 nt, Human herpesvirus 5
cagcuaccgccgcaacagcgg

SEQ ID NO: 3981301 - RNA, 23 nt, Human herpesvirus 5
cagcuaccgccgcaacagcggcg

SEQ ID NO: 3981302 - RNA, 15 nt, Human herpesvirus 5
cagcucgcgcuggcu

SEQ ID NO: 3981303 - RNA, 15 nt, Human herpesvirus 5
cagcucguggaccuc

SEQ ID NO: 3981304 - RNA, 17 nt, Human herpesvirus 5
cagcugcaccacggccu

SEQ ID NO: 3981305 - RNA, 14 nt, Human herpesvirus 5
cagcugcaggcagg

SEQ ID NO: 3981306 - RNA, 22 nt, Human herpesvirus 5
cagcugguggcucaugccgcca

SEQ ID NO: 3981307 - RNA, 14 nt, Human herpesvirus 5
cagcuuaccgccac

SEQ ID NO: 3981308 - RNA, 15 nt, Human herpesvirus 5
caggaaucugggagg

SEQ ID NO: 3981309 - RNA, 20 nt, Human herpesvirus 5
caggacuuuuuaauggccaa

SEQ ID NO: 3981310 - RNA, 21 nt, Human herpesvirus 5
caggaggcugugcgcgccggc

SEQ ID NO: 3981311 - RNA, 15 nt, Human herpesvirus 5
caggagguguugagu

SEQ ID NO: 3981312 - RNA, 13 nt, Human herpesvirus 5
caggccagcugcc

SEQ ID NO: 3981313 - RNA, 23 nt, Human herpesvirus 5
caggcuuaacacuagccaucaca

SEQ ID NO: 3981314 - RNA, 17 nt, Human herpesvirus 5
cagggcugcuccaacuu

SEQ ID NO: 3981315 - RNA, 22 nt, Human herpesvirus 5
cagguacggcccggcagcacca

SEQ ID NO: 3981316 - RNA, 13 nt, Human herpesvirus 5
cagguaggauucc

SEQ ID NO: 3981317 - RNA, 16 nt, Human herpesvirus 5
caggucgcccaggcuc

SEQ ID NO: 3981318 - RNA, 22 nt, Human herpesvirus 5
caggugacauccucgcccaggc

SEQ ID NO: 3981319 - RNA, 20 nt, Human herpesvirus 5
cagguggaggacaguauuua

SEQ ID NO: 3981320 - RNA, 19 nt, Human herpesvirus 5
caggugugcgcgucggcgc

SEQ ID NO: 3981321 - RNA, 15 nt, Human herpesvirus 5
caguaaccuggagca

SEQ ID NO: 3981322 - RNA, 21 nt, Human herpesvirus 5
caguacaacaguuaucagcaa

SEQ ID NO: 3981323 - RNA, 23 nt, Human herpesvirus 5
caguacgauccuccggcgcugag

SEQ ID NO: 3981324 - RNA, 12 nt, Human herpesvirus 5
caguagacagac

SEQ ID NO: 3981325 - RNA, 19 nt, Human herpesvirus 5
caguagacagacaggacac

SEQ ID NO: 3981326 - RNA, 15 nt, Human herpesvirus 5
caguauuuuugugcu

SEQ ID NO: 3981327 - RNA, 13 nt, Human herpesvirus 5
cagugacugggua

SEQ ID NO: 3981328 - RNA, 13 nt, Human herpesvirus 5
caguguagauuua

SEQ ID NO: 3981329 - RNA, 20 nt, Human herpesvirus 5
caguucacggggagaagaaa

SEQ ID NO: 3981330 - RNA, 23 nt, Human herpesvirus 5
caguugcuguugcucuaccgcga

SEQ ID NO: 3981331 - RNA, 12 nt, Human herpesvirus 5
ucgcgagcccca

SEQ ID NO: 3981332 - RNA, 16 nt, Human herpesvirus 5
ucgcgccuuccuccuc

SEQ ID NO: 3981333 - RNA, 22 nt, Human herpesvirus 5
ucgcgccuuccuccucugccug

SEQ ID NO: 3981334 - RNA, 22 nt, Human herpesvirus 5
ucgcggcccuucaacggcacca

SEQ ID NO: 3981335 - RNA, 16 nt, Human herpesvirus 5
ucgcugccgcagcugc

SEQ ID NO: 3981336 - RNA, 16 nt, Human herpesvirus 5
ucgcuucgccgccacc

SEQ ID NO: 3981337 - RNA, 16 nt, Human herpesvirus 5
ucggaaucgggcccgc

SEQ ID NO: 3981338 - RNA, 18 nt, Human herpesvirus 5
ucggauacagggugccgc

SEQ ID NO: 3981339 - RNA, 21 nt, Human herpesvirus 5
ucggauacagggugccgccac

SEQ ID NO: 3981340 - RNA, 13 nt, Human herpesvirus 5
ucggccgaaacau

SEQ ID NO: 3981341 - RNA, 19 nt, Human herpesvirus 5
ucggccggaccgugcacgc

SEQ ID NO: 3981342 - RNA, 19 nt, Human herpesvirus 5
ucggccggcugcugcacca

SEQ ID NO: 3981343 - RNA, 15 nt, Human herpesvirus 5
ucggcgccccacagc

SEQ ID NO: 3981344 - RNA, 17 nt, Human herpesvirus 5
ucggcgguccuccagca

SEQ ID NO: 3981345 - RNA, 21 nt, Human herpesvirus 5
ucggcugccuguuccugcugc

SEQ ID NO: 3981346 - RNA, 16 nt, Human herpesvirus 5
ucgggcgugugguaga

SEQ ID NO: 3981347 - RNA, 21 nt, Human herpesvirus 5
ucgggcgugugguagaagagc

SEQ ID NO: 3981348 - RNA, 17 nt, Human herpesvirus 5
ucguauucgucauuugu

SEQ ID NO: 3981349 - RNA, 20 nt, Human herpesvirus 5
ucgucaaggcucgcaaagac

SEQ ID NO: 3981350 - RNA, 19 nt, Human herpesvirus 5
ucguccgccuccacuuccg

SEQ ID NO: 3981351 - RNA, 12 nt, Human herpesvirus 5
ucgucugagccg

SEQ ID NO: 3981352 - RNA, 23 nt, Human herpesvirus 5
ucguggaaggcaccgcgacagcu

SEQ ID NO: 3981353 - RNA, 13 nt, Human herpesvirus 5
ucuacgcuguacu

SEQ ID NO: 3981354 - RNA, 18 nt, Human herpesvirus 5
ucuauauauauuggucac

SEQ ID NO: 3981355 - RNA, 13 nt, Human herpesvirus 5
ucuaucuguuggc

SEQ ID NO: 3981356 - RNA, 19 nt, Human herpesvirus 5
ucucacaccgucagcugcg

SEQ ID NO: 3981357 - RNA, 12 nt, Human herpesvirus 5
ucucaccgugcu

SEQ ID NO: 3981358 - RNA, 16 nt, Human herpesvirus 5
ucucaccgugcucgug

SEQ ID NO: 3981359 - RNA, 13 nt, Human herpesvirus 5
ucuccgucucugg

SEQ ID NO: 3981360 - RNA, 19 nt, Human herpesvirus 5
ucuccucuaccccgccgcc

SEQ ID NO: 3981361 - RNA, 14 nt, Human herpesvirus 5
ucucgcgcaucgcc

SEQ ID NO: 3981362 - RNA, 20 nt, Human herpesvirus 5
ucucugaaggacaguguauu

SEQ ID NO: 3981363 - RNA, 19 nt, Human herpesvirus 5
ucucugcaacgccuggcgu

SEQ ID NO: 3981364 - RNA, 22 nt, Human herpesvirus 5
ucugaccuugcugaugugccag

SEQ ID NO: 3981365 - RNA, 21 nt, Human herpesvirus 5
ucugauaccgggcgccgggac

SEQ ID NO: 3981366 - RNA, 19 nt, Human herpesvirus 5
ucugcagccggugcgcgac

SEQ ID NO: 3981367 - RNA, 14 nt, Human herpesvirus 5
ucugcgagaggaag

SEQ ID NO: 3981368 - RNA, 12 nt, Human herpesvirus 5
ucugcuccccca

SEQ ID NO: 3981369 - RNA, 19 nt, Human herpesvirus 5
ucugcuugcuggcuuggcu

SEQ ID NO: 3981370 - RNA, 16 nt, Human herpesvirus 5
ucugggaugugcagca

SEQ ID NO: 3981371 - RNA, 20 nt, Human herpesvirus 5
ucugugaugaacgacacaug

SEQ ID NO: 3981372 - RNA, 19 nt, Human herpesvirus 5
ucuuauaaggaggcaaaua

SEQ ID NO: 3981373 - RNA, 13 nt, Human herpesvirus 5
ucuucuggcccuc

SEQ ID NO: 3981374 - RNA, 19 nt, Human herpesvirus 5
ucuugacguuuauaaaccg

SEQ ID NO: 3981375 - RNA, 16 nt, Human herpesvirus 5
ucuugcgcccucucgg

SEQ ID NO: 3981376 - RNA, 19 nt, Human herpesvirus 5
ucuugcgcuucugcagcuc

SEQ ID NO: 3981377 - RNA, 18 nt, Human herpesvirus 5
ucuugcggcgccgacucc

SEQ ID NO: 3981378 - RNA, 20 nt, Human herpesvirus 5
ugaacaccagaugcucccgg

SEQ ID NO: 3981379 - RNA, 21 nt, Human herpesvirus 5
ugaaccgaacuauguggcucc

SEQ ID NO: 3981380 - RNA, 23 nt, Human herpesvirus 5
ugaacggcgcuacgucggccaac

SEQ ID NO: 3981381 - RNA, 22 nt, Human herpesvirus 5
ugaagccgucagucauagagcc

SEQ ID NO: 3981382 - RNA, 15 nt, Human herpesvirus 5
ugaauauacagacuu

SEQ ID NO: 3981383 - RNA, 18 nt, Human herpesvirus 5
ugaauggaaauacaugau

SEQ ID NO: 3981384 - RNA, 12 nt, Human herpesvirus 5
ugacacagcucc

SEQ ID NO: 3981385 - RNA, 14 nt, Human herpesvirus 5
ugacagacgauaug

SEQ ID NO: 3981386 - RNA, 22 nt, Human herpesvirus 5
ugacaguauuaacgugugguga

SEQ ID NO: 3981387 - RNA, 11 nt, Human herpesvirus 5
ugaccugggua

SEQ ID NO: 3981388 - RNA, 22 nt, Human herpesvirus 5
ugacgcacuuuuuuuacuagua

SEQ ID NO: 3981389 - RNA, 20 nt, Human herpesvirus 5
ugacggcgcucuuucagcgu

SEQ ID NO: 3981390 - RNA, 13 nt, Human herpesvirus 5
ugacguacauaua

SEQ ID NO: 3981391 - RNA, 15 nt, Human herpesvirus 5
ugacguggugcgcug

SEQ ID NO: 3981392 - RNA, 23 nt, Human herpesvirus 5
ugacuacgaugaagacgcgacuc

SEQ ID NO: 3981393 - RNA, 19 nt, Human herpesvirus 5
ugagacagccacaucaaca

SEQ ID NO: 3981394 - RNA, 21 nt, Human herpesvirus 5
ugagacccgcgucccuggggc

SEQ ID NO: 3981395 - RNA, 15 nt, Human herpesvirus 5
ugagacgaggccgcc

SEQ ID NO: 3981396 - RNA, 16 nt, Human herpesvirus 5
ugagacugguggugag

SEQ ID NO: 3981397 - RNA, 16 nt, Human herpesvirus 5
ugagcaacaaacacag

SEQ ID NO: 3981398 - RNA, 17 nt, Human herpesvirus 5
ugagcaacagucggcag

SEQ ID NO: 3981399 - RNA, 17 nt, Human herpesvirus 5
ugaggggcggcaugccg

SEQ ID NO: 3981400 - RNA, 16 nt, Human herpesvirus 5
ugauaaccuaccuggu

SEQ ID NO: 3981401 - RNA, 18 nt, Human herpesvirus 5
ugauacaucgcauaugac

SEQ ID NO: 3981402 - RNA, 13 nt, Human herpesvirus 5
ugauccaggaggu

SEQ ID NO: 3981403 - RNA, 15 nt, Human herpesvirus 5
ugaugaugcugcuga

SEQ ID NO: 3981404 - RNA, 20 nt, Human herpesvirus 5
ugauggaaaugcccgccacc

SEQ ID NO: 3981405 - RNA, 11 nt, Human herpesvirus 5
ugauggagaaa

SEQ ID NO: 3981406 - RNA, 22 nt, Human herpesvirus 5
ugcaauacagaagggaauuugu

SEQ ID NO: 3981407 - RNA, 18 nt, Human herpesvirus 5
ugcaaugccucauccuua

SEQ ID NO: 3981408 - RNA, 21 nt, Human herpesvirus 5
ugcacccccgauaugggccgc

SEQ ID NO: 3981409 - RNA, 13 nt, Human herpesvirus 5
ugcaccugcugcc

SEQ ID NO: 3981410 - RNA, 13 nt, Human herpesvirus 5
ugcaccugggugg

SEQ ID NO: 3981411 - RNA, 17 nt, Human herpesvirus 5
ugcacgagugggccagc

SEQ ID NO: 3981412 - RNA, 21 nt, Human herpesvirus 5
ugcacggcaucaugcugggcg

SEQ ID NO: 3981413 - RNA, 13 nt, Human herpesvirus 5
ugcagcugcgccu

SEQ ID NO: 3981414 - RNA, 12 nt, Human herpesvirus 5
ugcagcugguga

SEQ ID NO: 3981415 - RNA, 18 nt, Human herpesvirus 5
ugcagggacagugcgcca

SEQ ID NO: 3981416 - RNA, 18 nt, Human herpesvirus 5
ugcccauuccgcaacguc

SEQ ID NO: 3981417 - RNA, 22 nt, Human herpesvirus 5
ugcccgggggugacaaggaagc

SEQ ID NO: 3981418 - RNA, 13 nt, Human herpesvirus 5
ugcccgucggcug

SEQ ID NO: 3981419 - RNA, 18 nt, Human herpesvirus 5
ugcccuauccgcgcggcu

SEQ ID NO: 3981420 - RNA, 22 nt, Human herpesvirus 5
ugccggucuacagacugggcga

SEQ ID NO: 3981421 - RNA, 20 nt, Human herpesvirus 5
ugccuggacgccugggcgcg

SEQ ID NO: 3981422 - RNA, 14 nt, Human herpesvirus 5
ugccugggcacgcg

SEQ ID NO: 3981423 - RNA, 14 nt, Human herpesvirus 5
ugcgaggcuuugau

SEQ ID NO: 3981424 - RNA, 18 nt, Human herpesvirus 5
ugcgcaccuucggcggua

SEQ ID NO: 3981425 - RNA, 16 nt, Human herpesvirus 5
ugcgccgucucuucgc

SEQ ID NO: 3981426 - RNA, 16 nt, Human herpesvirus 5
ugcgccuuccagucca

SEQ ID NO: 3981427 - RNA, 13 nt, Human herpesvirus 5
ugcgcgucaaccg

SEQ ID NO: 3981428 - RNA, 13 nt, Human herpesvirus 5
ugcgcgucgaccu

SEQ ID NO: 3981429 - RNA, 12 nt, Human herpesvirus 5
ugcgcugcagcc

SEQ ID NO: 3981430 - RNA, 16 nt, Human herpesvirus 5
ugcgcuucugcagcuc

SEQ ID NO: 3981431 - RNA, 14 nt, Human herpesvirus 5
ugcggaucgcggua

SEQ ID NO: 3981432 - RNA, 14 nt, Human herpesvirus 5
ugcguggggugcug

SEQ ID NO: 3981433 - RNA, 14 nt, Human herpesvirus 5
ugcguguccagaua

SEQ ID NO: 3981434 - RNA, 22 nt, Human herpesvirus 5
ugcucaacuuuggcgugcccag

SEQ ID NO: 3981435 - RNA, 13 nt, Human herpesvirus 5
ugcuccaacuuug

SEQ ID NO: 3981436 - RNA, 15 nt, Human herpesvirus 5
ugcuggagcgcggcc

SEQ ID NO: 3981437 - RNA, 19 nt, Human herpesvirus 5
ugcuggccgagacggcgug

SEQ ID NO: 3981438 - RNA, 18 nt, Human herpesvirus 5
ugcugugcaccucggccu

SEQ ID NO: 3981439 - RNA, 15 nt, Human herpesvirus 5
ugcuuaaugaucucc

SEQ ID NO: 3981440 - RNA, 17 nt, Human herpesvirus 5
ugcuuacccuucaauuu

SEQ ID NO: 3981441 - RNA, 16 nt, Human herpesvirus 5
ugcuucauccagcucc

SEQ ID NO: 3981442 - RNA, 15 nt, Human herpesvirus 5
uggaaaucccucacc

SEQ ID NO: 3981443 - RNA, 13 nt, Human herpesvirus 5
uggaaguaacauc

SEQ ID NO: 3981444 - RNA, 18 nt, Human herpesvirus 5
uggacgguacaguuuaug

SEQ ID NO: 3981445 - RNA, 19 nt, Human herpesvirus 5
uggagaaaacgccggcgga

SEQ ID NO: 3981446 - RNA, 14 nt, Human herpesvirus 5
uggagcccacgccg

SEQ ID NO: 3981447 - RNA, 12 nt, Human herpesvirus 5
uggaggucgacg

SEQ ID NO: 3981448 - RNA, 23 nt, Human herpesvirus 5
uggcaauuacguggguugcaccc

SEQ ID NO: 3981449 - RNA, 16 nt, Human herpesvirus 5
uggccaucacgggcaa

SEQ ID NO: 3981450 - RNA, 15 nt, Human herpesvirus 5
uggccgagcuaugcg

SEQ ID NO: 3981451 - RNA, 17 nt, Human herpesvirus 5
uggcgcguagccaccug

SEQ ID NO: 3981452 - RNA, 22 nt, Human herpesvirus 5
uggcggcagcggaggugggccg

SEQ ID NO: 3981453 - RNA, 14 nt, Human herpesvirus 5
uggcugcgcgccuc

SEQ ID NO: 3981454 - RNA, 13 nt, Human herpesvirus 5
uggcuuggcgcag

SEQ ID NO: 3981455 - RNA, 19 nt, Human herpesvirus 5
ugggaagaugggacguggu

SEQ ID NO: 3981456 - RNA, 18 nt, Human herpesvirus 5
ugggauaccgcccgcaug

SEQ ID NO: 3981457 - RNA, 19 nt, Human herpesvirus 5
ugggcacgcgcgucggccg

SEQ ID NO: 3981458 - RNA, 16 nt, Human herpesvirus 5
ugggcgcgcuggagcu

SEQ ID NO: 3981459 - RNA, 14 nt, Human herpesvirus 5
ugggcuacguaggc

SEQ ID NO: 3981460 - RNA, 22 nt, Human herpesvirus 5
ugggcugugguucauguuucug

SEQ ID NO: 3981461 - RNA, 13 nt, Human herpesvirus 5
uggggauuuuuga

SEQ ID NO: 3981462 - RNA, 17 nt, Human herpesvirus 5
uggggucugcuguuacu

SEQ ID NO: 3981463 - RNA, 18 nt, Human herpesvirus 5
uggguccagccagcaucg

SEQ ID NO: 3981464 - RNA, 18 nt, Human herpesvirus 5
ugguagcuagugcagccu

SEQ ID NO: 3981465 - RNA, 16 nt, Human herpesvirus 5
uggucuucccuacagc

SEQ ID NO: 3981466 - RNA, 24 nt, Human herpesvirus 5
ugguggccgaacagcagcucuucc

SEQ ID NO: 3981467 - RNA, 14 nt, Human herpesvirus 5
ugguggucuacaag

SEQ ID NO: 3981468 - RNA, 18 nt, Human herpesvirus 5
ugguuaccggucacugga

SEQ ID NO: 3981469 - RNA, 22 nt, Human herpesvirus 5
ugguuuuugcuuccgagcugug

SEQ ID NO: 3981470 - RNA, 14 nt, Human herpesvirus 5
uguaaauaaaaagc

SEQ ID NO: 3981471 - RNA, 12 nt, Human herpesvirus 5
uguacugaaggg

SEQ ID NO: 3981472 - RNA, 11 nt, Human herpesvirus 5
uguauacugug

SEQ ID NO: 3981473 - RNA, 22 nt, Human herpesvirus 5
ugucacggaacauguccuggcg

SEQ ID NO: 3981474 - RNA, 17 nt, Human herpesvirus 5
ugucagcgccgggugcg

SEQ ID NO: 3981475 - RNA, 19 nt, Human herpesvirus 5
uguccccgcaaacucccac

SEQ ID NO: 3981476 - RNA, 16 nt, Human herpesvirus 5
ugucccugccagucuc

SEQ ID NO: 3981477 - RNA, 21 nt, Human herpesvirus 5
uguccgcggcgugaccacguc

SEQ ID NO: 3981478 - RNA, 16 nt, Human herpesvirus 5
ugucgcgacagagagg

SEQ ID NO: 3981479 - RNA, 19 nt, Human herpesvirus 5
ugucgcugcguccagcguc

SEQ ID NO: 3981480 - RNA, 14 nt, Human herpesvirus 5
ugucugcagccggu

SEQ ID NO: 3981481 - RNA, 19 nt, Human herpesvirus 5
uguguccgcccgagcaggu

SEQ ID NO: 3981482 - RNA, 19 nt, Human herpesvirus 5
uguuaucaucauggagcua

SEQ ID NO: 3981483 - RNA, 15 nt, Human herpesvirus 5
uguuauguuauuaua

SEQ ID NO: 3981484 - RNA, 14 nt, Human herpesvirus 5
uguucgugguuggc

SEQ ID NO: 3981485 - RNA, 16 nt, Human herpesvirus 5
uguugcuacagggagu

SEQ ID NO: 3981486 - RNA, 22 nt, Human herpesvirus 5
uguuugacauuuuuucggccgc

SEQ ID NO: 3981487 - RNA, 22 nt, Human herpesvirus 5
uuaaagaugucgauggaggucu

SEQ ID NO: 3981488 - RNA, 19 nt, Human herpesvirus 5
uuacacacuccuugguacu

SEQ ID NO: 3981489 - RNA, 19 nt, Human herpesvirus 5
uuaguacgugcguguuuuu

SEQ ID NO: 3981490 - RNA, 22 nt, Human herpesvirus 5
uuaugaggagcgcgcacaaagg

SEQ ID NO: 3981491 - RNA, 13 nt, Human herpesvirus 5
uuaugauucugca

SEQ ID NO: 3981492 - RNA, 14 nt, Human herpesvirus 5
uuaugauugucugc

SEQ ID NO: 3981493 - RNA, 14 nt, Human herpesvirus 5
uucagaaccaugua

SEQ ID NO: 3981494 - RNA, 18 nt, Human herpesvirus 5
uuccacgcagcgggaaac

SEQ ID NO: 3981495 - RNA, 23 nt, Human herpesvirus 5
uucccaccgcgacccagcgacag

SEQ ID NO: 3981496 - RNA, 23 nt, Human herpesvirus 5
uuccccugggaauucaugcugua

SEQ ID NO: 3981497 - RNA, 20 nt, Human herpesvirus 5
uucccucuagagacagacga

SEQ ID NO: 3981498 - RNA, 17 nt, Human herpesvirus 5
uuccgaagaugccgugu

SEQ ID NO: 3981499 - RNA, 19 nt, Human herpesvirus 5
uuccgcguuuggucgccug

SEQ ID NO: 3981500 - RNA, 22 nt, Human herpesvirus 5
uucgacagcggcaacaacgacg

SEQ ID NO: 3981501 - RNA, 15 nt, Human herpesvirus 5
uucgaguccugcugu

SEQ ID NO: 3981502 - RNA, 20 nt, Human herpesvirus 5
uucgauucucuauacacaua

SEQ ID NO: 3981503 - RNA, 18 nt, Human herpesvirus 5
uucgccaagaugcugcgg

SEQ ID NO: 3981504 - RNA, 22 nt, Human herpesvirus 5
uucuacggaguuuucccucagc

SEQ ID NO: 3981505 - RNA, 14 nt, Human herpesvirus 5
uucuucgcggaggc

SEQ ID NO: 3981506 - RNA, 23 nt, Human herpesvirus 5
uucuucugucucgucgacgucau

SEQ ID NO: 3981507 - RNA, 21 nt, Human herpesvirus 5
uucuugcaagaggaaugcaug

SEQ ID NO: 3981508 - RNA, 19 nt, Human herpesvirus 5
uucuugcccacgccgucgc

SEQ ID NO: 3981509 - RNA, 14 nt, Human herpesvirus 5
uugacccagggcug

SEQ ID NO: 3981510 - RNA, 20 nt, Human herpesvirus 5
uugagcaggguaaaaaccac

SEQ ID NO: 3981511 - RNA, 13 nt, Human herpesvirus 5
uugagcucggaca

SEQ ID NO: 3981512 - RNA, 17 nt, Human herpesvirus 5
uugaguaacgaggaggc

SEQ ID NO: 3981513 - RNA, 20 nt, Human herpesvirus 5
uugcaaaagaagcugcccgc

SEQ ID NO: 3981514 - RNA, 14 nt, Human herpesvirus 5
uugcaccugggugg

SEQ ID NO: 3981515 - RNA, 18 nt, Human herpesvirus 5
uugcauaagcgcggaggu

SEQ ID NO: 3981516 - RNA, 22 nt, Human herpesvirus 5
uugccggugccgaugagauaaa

SEQ ID NO: 3981517 - RNA, 12 nt, Human herpesvirus 5
uugcgcauggua

SEQ ID NO: 3981518 - RNA, 14 nt, Human herpesvirus 5
uugcuuuugcauau

SEQ ID NO: 3981519 - RNA, 20 nt, Human herpesvirus 5
uuggaacccaucgaggaggc

SEQ ID NO: 3981520 - RNA, 14 nt, Human herpesvirus 5
uuggcaacaucacc

SEQ ID NO: 3981521 - RNA, 16 nt, Human herpesvirus 5
uuggugaaggccgugg

SEQ ID NO: 3981522 - RNA, 17 nt, Human herpesvirus 5
uuguaaucauccuaauu

SEQ ID NO: 3981523 - RNA, 22 nt, Human herpesvirus 5
uuguacccucacggucugcuug

SEQ ID NO: 3981524 - RNA, 22 nt, Human herpesvirus 5
uuuaagguacgggucuaccaaa

SEQ ID NO: 3981525 - RNA, 13 nt, Human herpesvirus 5
uuucagucagaga

SEQ ID NO: 3981526 - RNA, 14 nt, Human herpesvirus 5
uuuccaaagccgac

SEQ ID NO: 3981527 - RNA, 11 nt, Human herpesvirus 5
uuuccacgcca

SEQ ID NO: 3981528 - RNA, 17 nt, Human herpesvirus 5
uuucgaguccguccucg

SEQ ID NO: 3981529 - RNA, 14 nt, Human herpesvirus 5
uuucgguuccaacu

SEQ ID NO: 3981530 - RNA, 16 nt, Human herpesvirus 5
uuugcauccuccucau

SEQ ID NO: 3981531 - RNA, 20 nt, Human herpesvirus 5
uuuggcgcagucgcgagcug

SEQ ID NO: 3981532 - RNA, 15 nt, Human herpesvirus 5
uuuuucuacgugucu

SEQ ID NO: 3981533 - RNA, 15 nt, Human herpesvirus 5
cugcuauaagaaggc

SEQ ID NO: 3981534 - RNA, 12 nt, Human herpesvirus 5
cugcuccagaag

SEQ ID NO: 3981535 - RNA, 20 nt, Human herpesvirus 5
cugcucccccaacccaggga

SEQ ID NO: 3981536 - RNA, 13 nt, Human herpesvirus 5
cugcuccucggag

SEQ ID NO: 3981537 - RNA, 19 nt, Human herpesvirus 5
cugcucgaccgcuggaggc

SEQ ID NO: 3981538 - RNA, 14 nt, Human herpesvirus 5
cugcugaaacugcg

SEQ ID NO: 3981539 - RNA, 21 nt, Human herpesvirus 5
cugcugcaccacagcgccagg

SEQ ID NO: 3981540 - RNA, 19 nt, Human herpesvirus 5
cugcugguuuuugcccccu

SEQ ID NO: 3981541 - RNA, 22 nt, Human herpesvirus 5
cugcuuacccuucaauuuccac

SEQ ID NO: 3981542 - RNA, 18 nt, Human herpesvirus 5
cugcuuuucgggccgcgg

SEQ ID NO: 3981543 - RNA, 23 nt, Human herpesvirus 5
cugcuuuuuugucuccuguggau

SEQ ID NO: 3981544 - RNA, 23 nt, Human herpesvirus 5
cuggaaggcguggaugagguacu

SEQ ID NO: 3981545 - RNA, 15 nt, Human herpesvirus 5
cuggacgccugggcg

SEQ ID NO: 3981546 - RNA, 15 nt, Human herpesvirus 5
cuggacgcugcgucg

SEQ ID NO: 3981547 - RNA, 15 nt, Human herpesvirus 5
cuggacuucaauguc

SEQ ID NO: 3981548 - RNA, 12 nt, Human herpesvirus 5
cuggagguggcc

SEQ ID NO: 3981549 - RNA, 13 nt, Human herpesvirus 5
cuggaucugcccu

SEQ ID NO: 3981550 - RNA, 14 nt, Human herpesvirus 5
cuggcaacgugcca

SEQ ID NO: 3981551 - RNA, 18 nt, Human herpesvirus 5
cuggccgagacggcguga

SEQ ID NO: 3981552 - RNA, 16 nt, Human herpesvirus 5
cuggccgauccacggg

SEQ ID NO: 3981553 - RNA, 17 nt, Human herpesvirus 5
cuggcgcggucugcgug

SEQ ID NO: 3981554 - RNA, 17 nt, Human herpesvirus 5
cuggcgguauggcugcg

SEQ ID NO: 3981555 - RNA, 13 nt, Human herpesvirus 5
cuggcuuggcucg

SEQ ID NO: 3981556 - RNA, 16 nt, Human herpesvirus 5
cugggcacgcgcgucg

SEQ ID NO: 3981557 - RNA, 13 nt, Human herpesvirus 5
cugggccacaggg

SEQ ID NO: 3981558 - RNA, 20 nt, Human herpesvirus 5
cugggcgaccgucucuacca

SEQ ID NO: 3981559 - RNA, 22 nt, Human herpesvirus 5
cuggggcccuucgugggcaaga

SEQ ID NO: 3981560 - RNA, 14 nt, Human herpesvirus 5
cuggggucaaaagc

SEQ ID NO: 3981561 - RNA, 18 nt, Human herpesvirus 5
cuggggugucuagcuggc

SEQ ID NO: 3981562 - RNA, 14 nt, Human herpesvirus 5
cugggucagugcca

SEQ ID NO: 3981563 - RNA, 18 nt, Human herpesvirus 5
cuggguccguaaccacgu

SEQ ID NO: 3981564 - RNA, 22 nt, Human herpesvirus 5
cuggguuaccccucgcugggcu

SEQ ID NO: 3981565 - RNA, 16 nt, Human herpesvirus 5
cuggucaaccugcuga

SEQ ID NO: 3981566 - RNA, 14 nt, Human herpesvirus 5
cuggucaacugcgu

SEQ ID NO: 3981567 - RNA, 21 nt, Human herpesvirus 5
cuguaccguuauuucgugcgu

SEQ ID NO: 3981568 - RNA, 22 nt, Human herpesvirus 5
cugucagcgccgggugcgcgac

SEQ ID NO: 3981569 - RNA, 15 nt, Human herpesvirus 5
cugucauccacuugg

SEQ ID NO: 3981570 - RNA, 19 nt, Human herpesvirus 5
cugucaugggucugcgcuu

SEQ ID NO: 3981571 - RNA, 23 nt, Human herpesvirus 5
cugucggaugaggcaggcgaugc

SEQ ID NO: 3981572 - RNA, 21 nt, Human herpesvirus 5
cugucguggugacugagcaca

SEQ ID NO: 3981573 - RNA, 22 nt, Human herpesvirus 5
cugucguucuccgcuugcugcg

SEQ ID NO: 3981574 - RNA, 18 nt, Human herpesvirus 5
cugugaaacgccaacucc

SEQ ID NO: 3981575 - RNA, 13 nt, Human herpesvirus 5
cugugcuggccgc

SEQ ID NO: 3981576 - RNA, 15 nt, Human herpesvirus 5
cuguggaauacccag

SEQ ID NO: 3981577 - RNA, 17 nt, Human herpesvirus 5
cuguggaauacccagcu

SEQ ID NO: 3981578 - RNA, 22 nt, Human herpesvirus 5
cuguggaauacccagcugggga

SEQ ID NO: 3981579 - RNA, 20 nt, Human herpesvirus 5
cuguggcuucucuggagacg

SEQ ID NO: 3981580 - RNA, 15 nt, Human herpesvirus 5
cuguguccgcccgag

SEQ ID NO: 3981581 - RNA, 13 nt, Human herpesvirus 5
cuguuccugcugc

SEQ ID NO: 3981582 - RNA, 16 nt, Human herpesvirus 5
cuguucgacagcggca

SEQ ID NO: 3981583 - RNA, 17 nt, Human herpesvirus 5
cuuaaaauuucguaaac

SEQ ID NO: 3981584 - RNA, 16 nt, Human herpesvirus 5
cuuaacgcgcaagugc

SEQ ID NO: 3981585 - RNA, 19 nt, Human herpesvirus 5
cuuagucgagacuugcacg

SEQ ID NO: 3981586 - RNA, 14 nt, Human herpesvirus 5
cuuaucugggugca

SEQ ID NO: 3981587 - RNA, 18 nt, Human herpesvirus 5
cuucccugagcgagcgcg

SEQ ID NO: 3981588 - RNA, 21 nt, Human herpesvirus 5
cuuccguguccccugccaccu

SEQ ID NO: 3981589 - RNA, 13 nt, Human herpesvirus 5
cuucgcgaggucu

SEQ ID NO: 3981590 - RNA, 21 nt, Human herpesvirus 5
cuucggaaucgggcccgccgg

SEQ ID NO: 3981591 - RNA, 19 nt, Human herpesvirus 5
cuucuaccuggcuggcgca

SEQ ID NO: 3981592 - RNA, 17 nt, Human herpesvirus 5
cuucuuccucucaguca

SEQ ID NO: 3981593 - RNA, 15 nt, Human herpesvirus 5
cuugagcgacagcag

SEQ ID NO: 3981594 - RNA, 17 nt, Human herpesvirus 5
cuugcaaacgguacgca

SEQ ID NO: 3981595 - RNA, 14 nt, Human herpesvirus 5
cuugcaagaggaau

SEQ ID NO: 3981596 - RNA, 14 nt, Human herpesvirus 5
cuugcccacgccgu

SEQ ID NO: 3981597 - RNA, 13 nt, Human herpesvirus 5
cuugcgcuucugc

SEQ ID NO: 3981598 - RNA, 18 nt, Human herpesvirus 5
cuugcgcuucugcagcuc

SEQ ID NO: 3981599 - RNA, 15 nt, Human herpesvirus 5
cuugcuccucuucca

SEQ ID NO: 3981600 - RNA, 13 nt, Human herpesvirus 5
cuuggcggccgag

SEQ ID NO: 3981601 - RNA, 14 nt, Human herpesvirus 5
cuugucgccaugcu

SEQ ID NO: 3981602 - RNA, 19 nt, Human herpesvirus 5
cuuguucucgaccacguag

SEQ ID NO: 3981603 - RNA, 20 nt, Human herpesvirus 5
cuuuaacccaaaaccaugcu

SEQ ID NO: 3981604 - RNA, 22 nt, Human herpesvirus 5
cuuuauucagaaagcaccagaa

SEQ ID NO: 3981605 - RNA, 20 nt, Human herpesvirus 5
cuuuccauucuuccgugucc

SEQ ID NO: 3981606 - RNA, 15 nt, Human herpesvirus 5
cuuucgcgcagcgcg

SEQ ID NO: 3981607 - RNA, 23 nt, Human herpesvirus 5
cuuugacgucccuuuuacuagua

SEQ ID NO: 3981608 - RNA, 11 nt, Human herpesvirus 5
cuuugcugcua

SEQ ID NO: 3981609 - RNA, 16 nt, Human herpesvirus 5
cuuugcuuaucugccu

SEQ ID NO: 3981610 - RNA, 21 nt, Human herpesvirus 5
cuuuuacggguaaugcaugcu

SEQ ID NO: 3981611 - RNA, 13 nt, Human herpesvirus 5
cuuuuacuaguau

SEQ ID NO: 3981612 - RNA, 16 nt, Human herpesvirus 5
cuuuuggcgcagucgc

SEQ ID NO: 3981613 - RNA, 19 nt, Human herpesvirus 5
cuuuuuuuaaccaauaaca

SEQ ID NO: 3981614 - RNA, 18 nt, Human herpesvirus 5
gaaaaaaugguguuacac

SEQ ID NO: 3981615 - RNA, 13 nt, Human herpesvirus 5
gaaaagagaugau

SEQ ID NO: 3981616 - RNA, 14 nt, Human herpesvirus 5
gaaaaucugugugu

SEQ ID NO: 3981617 - RNA, 21 nt, Human herpesvirus 5
gaaacagcguccacaguuucc

SEQ ID NO: 3981618 - RNA, 23 nt, Human herpesvirus 5
gaaaccacgccggcgguuacaga

SEQ ID NO: 3981619 - RNA, 18 nt, Human herpesvirus 5
gaaaccacgcgucagggc

SEQ ID NO: 3981620 - RNA, 20 nt, Human herpesvirus 5
gaaaccguacuaagucuccc

SEQ ID NO: 3981621 - RNA, 15 nt, Human herpesvirus 5
gaaacuacgugcaac

SEQ ID NO: 3981622 - RNA, 14 nt, Human herpesvirus 5
gaaaguuguccgcg

SEQ ID NO: 3981623 - RNA, 23 nt, Human herpesvirus 5
gaacagugccgccuucgaaacgg

SEQ ID NO: 3981624 - RNA, 22 nt, Human herpesvirus 5
gaaccaagucuugccgugacgu

SEQ ID NO: 3981625 - RNA, 16 nt, Human herpesvirus 5
gaacccuucccgaccu

SEQ ID NO: 3981626 - RNA, 18 nt, Human herpesvirus 5
gaacccuucccgaccucc

SEQ ID NO: 3981627 - RNA, 13 nt, Human herpesvirus 5
gaacgcgugcgcg

SEQ ID NO: 3981628 - RNA, 19 nt, Human herpesvirus 5
gaacgcuacuucccccucc

SEQ ID NO: 3981629 - RNA, 17 nt, Human herpesvirus 5
gaacgggugggcugggg

SEQ ID NO: 3981630 - RNA, 21 nt, Human herpesvirus 5
gaacugucgucgccggaagga

SEQ ID NO: 3981631 - RNA, 18 nt, Human herpesvirus 5
gaacuuuguagugcgcgc

SEQ ID NO: 3981632 - RNA, 14 nt, Human herpesvirus 5
gaagaagagauggc

SEQ ID NO: 3981633 - RNA, 16 nt, Human herpesvirus 5
gaagacaccuggaaag

SEQ ID NO: 3981634 - RNA, 18 nt, Human herpesvirus 5
gaagacuuugauguaguu

SEQ ID NO: 3981635 - RNA, 20 nt, Human herpesvirus 5
gaagaggacgaagugacgga

SEQ ID NO: 3981636 - RNA, 16 nt, Human herpesvirus 5
gaagaugccgaugugu

SEQ ID NO: 3981637 - RNA, 17 nt, Human herpesvirus 5
gaagccgccaauacagc

SEQ ID NO: 3981638 - RNA, 17 nt, Human herpesvirus 5
gaagcgaauaagcgcga

SEQ ID NO: 3981639 - RNA, 20 nt, Human herpesvirus 5
gaagcggagugcaucucgag

SEQ ID NO: 3981640 - RNA, 19 nt, Human herpesvirus 5
gaaggccaugagcggcagg

SEQ ID NO: 3981641 - RNA, 17 nt, Human herpesvirus 5
gaaggguguugugcgug

SEQ ID NO: 3981642 - RNA, 19 nt, Human herpesvirus 5
gaagucgaucuggaaggcg

SEQ ID NO: 3981643 - RNA, 22 nt, Human herpesvirus 5
gaagucuucaucaucgucgucg

SEQ ID NO: 3981644 - RNA, 18 nt, Human herpesvirus 5
gaauacuggaagcugcug

SEQ ID NO: 3981645 - RNA, 15 nt, Human herpesvirus 5
gaaugcuaguuugua

SEQ ID NO: 3981646 - RNA, 19 nt, Human herpesvirus 5
gaauuguuaccagaacucu

SEQ ID NO: 3981647 - RNA, 17 nt, Human herpesvirus 5
gacaaccugcugcacuu

SEQ ID NO: 3981648 - RNA, 20 nt, Human herpesvirus 5
gacaaggucguucuccucga

SEQ ID NO: 3981649 - RNA, 20 nt, Human herpesvirus 5
gacacagcagcaccaggcga

SEQ ID NO: 3981650 - RNA, 18 nt, Human herpesvirus 5
gacacagcgccgcgcugg

SEQ ID NO: 3981651 - RNA, 23 nt, Human herpesvirus 5
gacaccguaucagcuaccgccgc

SEQ ID NO: 3981652 - RNA, 14 nt, Human herpesvirus 5
gacacggaggauga

SEQ ID NO: 3981653 - RNA, 19 nt, Human herpesvirus 5
gacacggugcugcugcgcg

SEQ ID NO: 3981654 - RNA, 19 nt, Human herpesvirus 5
gacacuaggcguccgcgcc

SEQ ID NO: 3981655 - RNA, 20 nt, Human herpesvirus 5
gacacucuggcccugcugua

SEQ ID NO: 3981656 - RNA, 16 nt, Human herpesvirus 5
gacagagaccgccgcc

SEQ ID NO: 3981657 - RNA, 14 nt, Human herpesvirus 5
gacagcaaggccgc

SEQ ID NO: 3981658 - RNA, 15 nt, Human herpesvirus 5
gacaggcucgucgug

SEQ ID NO: 3981659 - RNA, 23 nt, Human herpesvirus 5
gacaguagcggguaauaaaaaca

SEQ ID NO: 3981660 - RNA, 15 nt, Human herpesvirus 5
gacauccgucagccu

SEQ ID NO: 3981661 - RNA, 17 nt, Human herpesvirus 5
gacauggagcccacgcc

SEQ ID NO: 3981662 - RNA, 17 nt, Human herpesvirus 5
gacauggcgacuuuccg

SEQ ID NO: 3981663 - RNA, 19 nt, Human herpesvirus 5
gaccaagagcaugcugugg

SEQ ID NO: 3981664 - RNA, 20 nt, Human herpesvirus 5
gaccaagcuaguagcggccg

SEQ ID NO: 3981665 - RNA, 23 nt, Human herpesvirus 5
gaccaagugucucuaaacgccac

SEQ ID NO: 3981666 - RNA, 13 nt, Human herpesvirus 5
gaccaugggcuac

SEQ ID NO: 3981667 - RNA, 23 nt, Human herpesvirus 5
gaccauuuccaugugcagcuggu

SEQ ID NO: 3981668 - RNA, 14 nt, Human herpesvirus 5
gaccgcgagcggcg

SEQ ID NO: 3981669 - RNA, 15 nt, Human herpesvirus 5
gaccggcggcugcug

SEQ ID NO: 3981670 - RNA, 16 nt, Human herpesvirus 5
gaccgggaucacgacg

SEQ ID NO: 3981671 - RNA, 20 nt, Human herpesvirus 5
gaccgggaucacgacgacgc

SEQ ID NO: 3981672 - RNA, 15 nt, Human herpesvirus 5
gaccgguaaggcgga

SEQ ID NO: 3981673 - RNA, 14 nt, Human herpesvirus 5
gaccugccgcuuga

SEQ ID NO: 3981674 - RNA, 18 nt, Human herpesvirus 5
gaccuuccuagcgacggc

SEQ ID NO: 3981675 - RNA, 23 nt, Human herpesvirus 5
gacgaccuacgggacacgcugau

SEQ ID NO: 3981676 - RNA, 14 nt, Human herpesvirus 5
gacgacgcgccccc

SEQ ID NO: 3981677 - RNA, 22 nt, Human herpesvirus 5
gacgagcggcggccgaccccgc

SEQ ID NO: 3981678 - RNA, 17 nt, Human herpesvirus 5
gacgagcguugcgcucg

SEQ ID NO: 3981679 - RNA, 23 nt, Human herpesvirus 5
gacgagcucuugcgaggcuuuga

SEQ ID NO: 3981680 - RNA, 17 nt, Human herpesvirus 5
gacgcagugcguggccg

SEQ ID NO: 3981681 - RNA, 17 nt, Human herpesvirus 5
gacgccugggcgcgacg

SEQ ID NO: 3981682 - RNA, 22 nt, Human herpesvirus 5
gacgcgccucucggagccgccg

SEQ ID NO: 3981683 - RNA, 15 nt, Human herpesvirus 5
gacggaguuggccuc

SEQ ID NO: 3981684 - RNA, 16 nt, Human herpesvirus 5
gacggcgacaucacgg

SEQ ID NO: 3981685 - RNA, 20 nt, Human herpesvirus 5
gacggcuuuccaagcugucg

SEQ ID NO: 3981686 - RNA, 16 nt, Human herpesvirus 5
gacgggacggcggcgc

SEQ ID NO: 3981687 - RNA, 17 nt, Human herpesvirus 5
gacgggacggcugccuc

SEQ ID NO: 3981688 - RNA, 12 nt, Human herpesvirus 5
gacgggccuggu

SEQ ID NO: 3981689 - RNA, 21 nt, Human herpesvirus 5
gacgggccugguauacgaggc

SEQ ID NO: 3981690 - RNA, 15 nt, Human herpesvirus 5
gacgggcgacagcac

SEQ ID NO: 3981691 - RNA, 23 nt, Human herpesvirus 5
gacggucaccaucgugccgcucc

SEQ ID NO: 3981692 - RNA, 17 nt, Human herpesvirus 5
gacgguuuccacgccac

SEQ ID NO: 3981693 - RNA, 16 nt, Human herpesvirus 5
gacguagguaccgacu

SEQ ID NO: 3981694 - RNA, 13 nt, Human herpesvirus 5
gacgucaaagcuc

SEQ ID NO: 3981695 - RNA, 20 nt, Human herpesvirus 5
gacgugaugcgcgucgaccu

SEQ ID NO: 3981696 - RNA, 18 nt, Human herpesvirus 5
gacgugauuuacgagguc

SEQ ID NO: 3981697 - RNA, 23 nt, Human herpesvirus 5
gacgugcgaugguauuacgcccg

SEQ ID NO: 3981698 - RNA, 23 nt, Human herpesvirus 5
gacguuagagaaagagcagcgcg

SEQ ID NO: 3981699 - RNA, 15 nt, Human herpesvirus 5
gacguugaugcggcg

SEQ ID NO: 3981700 - RNA, 14 nt, Human herpesvirus 5
gacugcagcccacc

SEQ ID NO: 3981701 - RNA, 21 nt, Human herpesvirus 5
gagaacuuuguagugcgcgcc

SEQ ID NO: 3981702 - RNA, 13 nt, Human herpesvirus 5
gagacagccacau

SEQ ID NO: 3981703 - RNA, 22 nt, Human herpesvirus 5
gagacaggacgaggcaggguga

SEQ ID NO: 3981704 - RNA, 22 nt, Human herpesvirus 5
gagacccgcgucccuggggcug

SEQ ID NO: 3981705 - RNA, 13 nt, Human herpesvirus 5
gagaccggcggac

SEQ ID NO: 3981706 - RNA, 16 nt, Human herpesvirus 5
gagacgcucacccguu

SEQ ID NO: 3981707 - RNA, 14 nt, Human herpesvirus 5
gagcacgggcugcu

SEQ ID NO: 3981708 - RNA, 16 nt, Human herpesvirus 5
gagcagccggagcccg

SEQ ID NO: 3981709 - RNA, 11 nt, Human herpesvirus 5
gagcaggccau

SEQ ID NO: 3981710 - RNA, 18 nt, Human herpesvirus 5
gagcaugcugugggccca

SEQ ID NO: 3981711 - RNA, 22 nt, Human herpesvirus 5
gagccacucggccauaagaaag

SEQ ID NO: 3981712 - RNA, 22 nt, Human herpesvirus 5
gagccccaucauggcccaagga

SEQ ID NO: 3981713 - RNA, 19 nt, Human herpesvirus 5
gagcccgcacacuggcugg

SEQ ID NO: 3981714 - RNA, 21 nt, Human herpesvirus 5
gagcggcucgccgccgcgcca

SEQ ID NO: 3981715 - RNA, 15 nt, Human herpesvirus 5
gagcguaccagggaa

SEQ ID NO: 3981716 - RNA, 18 nt, Human herpesvirus 5
gagcguguggaggacggg

SEQ ID NO: 3981717 - RNA, 15 nt, Human herpesvirus 5
gagcugcgcgucacc

SEQ ID NO: 3981718 - RNA, 18 nt, Human herpesvirus 5
gaggaggaugggggggac

SEQ ID NO: 3981719 - RNA, 21 nt, Human herpesvirus 5
gaggagugucagacacagccg

SEQ ID NO: 3981720 - RNA, 13 nt, Human herpesvirus 5
gaggauguucugc

SEQ ID NO: 3981721 - RNA, 20 nt, Human herpesvirus 5
gaggcaaauauacuagggaa

SEQ ID NO: 3981722 - RNA, 15 nt, Human herpesvirus 5
gaggcgcgcugcucc

SEQ ID NO: 3981723 - RNA, 19 nt, Human herpesvirus 5
gagggcgcgcggcaacucg

SEQ ID NO: 3981724 - RNA, 17 nt, Human herpesvirus 5
gaggguggugacuuaca

SEQ ID NO: 3981725 - RNA, 17 nt, Human herpesvirus 5
gaggucgacgacgccgu

SEQ ID NO: 3981726 - RNA, 22 nt, Human herpesvirus 5
gaggucgcgcguacggacgagu

SEQ ID NO: 3981727 - RNA, 18 nt, Human herpesvirus 5
gaggugaccuggcugcuu

SEQ ID NO: 3981728 - RNA, 19 nt, Human herpesvirus 5
gaggugugaggaugaaaca

SEQ ID NO: 3981729 - RNA, 22 nt, Human herpesvirus 5
gaguacacguuaccgucgcccu

SEQ ID NO: 3981730 - RNA, 18 nt, Human herpesvirus 5
gagucgcguguguuuuga

SEQ ID NO: 3981731 - RNA, 18 nt, Human herpesvirus 5
gaguggggcaacugcugc

SEQ ID NO: 3981732 - RNA, 15 nt, Human herpesvirus 5
gaguggugaggagcg

SEQ ID NO: 3981733 - RNA, 23 nt, Human herpesvirus 5
gaguuggugcagcugcgccugga

SEQ ID NO: 3981734 - RNA, 17 nt, Human herpesvirus 5
gauaacaaacaaugaca

SEQ ID NO: 3981735 - RNA, 18 nt, Human herpesvirus 5
gauaaccuaccugguguc

SEQ ID NO: 3981736 - RNA, 20 nt, Human herpesvirus 5
gauaagacggacuguuucau

SEQ ID NO: 3981737 - RNA, 19 nt, Human herpesvirus 5
gauacuaguaaaaaaagug

SEQ ID NO: 3981738 - RNA, 22 nt, Human herpesvirus 5
gauagucaucucauuugcuuuu

SEQ ID NO: 3981739 - RNA, 12 nt, Human herpesvirus 5
gauaucugcggg

SEQ ID NO: 3981740 - RNA, 19 nt, Human herpesvirus 5
gaucaucuguuuuugcugc

SEQ ID NO: 3981741 - RNA, 12 nt, Human herpesvirus 5
gauccaggaggu

SEQ ID NO: 3981742 - RNA, 17 nt, Human herpesvirus 5
gauccaguuucaccaag

SEQ ID NO: 3981743 - RNA, 23 nt, Human herpesvirus 5
gaucgccgcggacgccugcgacg

SEQ ID NO: 3981744 - RNA, 13 nt, Human herpesvirus 5
gaucgccuggagc

SEQ ID NO: 3981745 - RNA, 14 nt, Human herpesvirus 5
gaucgggcggucga

SEQ ID NO: 3981746 - RNA, 17 nt, Human herpesvirus 5
gaucuggaaggcgugga

SEQ ID NO: 3981747 - RNA, 17 nt, Human herpesvirus 5
gaucuugacgcugcugg

SEQ ID NO: 3981748 - RNA, 21 nt, Human herpesvirus 5
gaugaaaaacaucuuaagaaa

SEQ ID NO: 3981749 - RNA, 19 nt, Human herpesvirus 5
gaugaacguggugaggggc

SEQ ID NO: 3981750 - RNA, 22 nt, Human herpesvirus 5
gaugaacuguuccacggccagc

SEQ ID NO: 3981751 - RNA, 15 nt, Human herpesvirus 5
gaugacagcgagcuc

SEQ ID NO: 3981752 - RNA, 16 nt, Human herpesvirus 5
gaugagcaauugccuc

SEQ ID NO: 3981753 - RNA, 18 nt, Human herpesvirus 5
gaugagccccucagucug

SEQ ID NO: 3981754 - RNA, 22 nt, Human herpesvirus 5
gaugagccccucagucuguuuc

SEQ ID NO: 3981755 - RNA, 13 nt, Human herpesvirus 5
gaugcgcacggcc

SEQ ID NO: 3981756 - RNA, 18 nt, Human herpesvirus 5
gauggaaaugcccgccac

SEQ ID NO: 3981757 - RNA, 23 nt, Human herpesvirus 5
gauggccaucacgggcaaagagu

SEQ ID NO: 3981758 - RNA, 18 nt, Human herpesvirus 5
gauggggucguggcucag

SEQ ID NO: 3981759 - RNA, 20 nt, Human herpesvirus 5
gaugguacuauaugcgugag

SEQ ID NO: 3981760 - RNA, 15 nt, Human herpesvirus 5
gauucaggacgagga

SEQ ID NO: 3981761 - RNA, 15 nt, Human herpesvirus 5
gauuccagaacuuug

SEQ ID NO: 3981762 - RNA, 20 nt, Human herpesvirus 5
gauucccaucucaacgucaa

SEQ ID NO: 3981763 - RNA, 14 nt, Human herpesvirus 5
gauucgguuacgaa

SEQ ID NO: 3981764 - RNA, 23 nt, Human herpesvirus 5
gcaaaaacuuguccuugcgcgcg

SEQ ID NO: 3981765 - RNA, 13 nt, Human herpesvirus 5
gcaaagucaacau

SEQ ID NO: 3981766 - RNA, 20 nt, Human herpesvirus 5
gucggcaagccgagcgggag

SEQ ID NO: 3981767 - RNA, 18 nt, Human herpesvirus 5
gucggcgcccgggccgcc

SEQ ID NO: 3981768 - RNA, 14 nt, Human herpesvirus 5
gucgggccgucgcg

SEQ ID NO: 3981769 - RNA, 22 nt, Human herpesvirus 5
gucgguuuuuucaccgucgucg

SEQ ID NO: 3981770 - RNA, 14 nt, Human herpesvirus 5
gucguaugccgcca

SEQ ID NO: 3981771 - RNA, 19 nt, Human herpesvirus 5
gucuaguucgcuucucacu

SEQ ID NO: 3981772 - RNA, 12 nt, Human herpesvirus 5
gucucaucacau

SEQ ID NO: 3981773 - RNA, 20 nt, Human herpesvirus 5
gucuccgaacucagaggcca

SEQ ID NO: 3981774 - RNA, 21 nt, Human herpesvirus 5
gucucgggcucgcucggccuc

SEQ ID NO: 3981775 - RNA, 22 nt, Human herpesvirus 5
gucucgggcucgcucggccucg

SEQ ID NO: 3981776 - RNA, 15 nt, Human herpesvirus 5
gucucuucgcgcccc

SEQ ID NO: 3981777 - RNA, 15 nt, Human herpesvirus 5
gucugacgcugcucc

SEQ ID NO: 3981778 - RNA, 18 nt, Human herpesvirus 5
gucugagcgccgacugga

SEQ ID NO: 3981779 - RNA, 19 nt, Human herpesvirus 5
gucugagcgccgacuggau

SEQ ID NO: 3981780 - RNA, 17 nt, Human herpesvirus 5
gucugcauguucaucac

SEQ ID NO: 3981781 - RNA, 22 nt, Human herpesvirus 5
gucugcgucaagacgggccugg

SEQ ID NO: 3981782 - RNA, 21 nt, Human herpesvirus 5
gugacauccucgcccaggcug

SEQ ID NO: 3981783 - RNA, 19 nt, Human herpesvirus 5
gugacgcuaggcggcgccg

SEQ ID NO: 3981784 - RNA, 15 nt, Human herpesvirus 5
gugacgucaaucaaa

SEQ ID NO: 3981785 - RNA, 18 nt, Human herpesvirus 5
gugacguggauacuagua

SEQ ID NO: 3981786 - RNA, 14 nt, Human herpesvirus 5
gugagcaacagucg

SEQ ID NO: 3981787 - RNA, 16 nt, Human herpesvirus 5
gugagcggguucccac

SEQ ID NO: 3981788 - RNA, 16 nt, Human herpesvirus 5
gugaggcgcuccguca

SEQ ID NO: 3981789 - RNA, 17 nt, Human herpesvirus 5
gugauccaggagguggu

SEQ ID NO: 3981790 - RNA, 14 nt, Human herpesvirus 5
gugaucugggcagc

SEQ ID NO: 3981791 - RNA, 16 nt, Human herpesvirus 5
gugauuuaucugccac

SEQ ID NO: 3981792 - RNA, 23 nt, Human herpesvirus 5
gugcagcaucgcgugcgccuccg

SEQ ID NO: 3981793 - RNA, 16 nt, Human herpesvirus 5
gugcagcugcgccugg

SEQ ID NO: 3981794 - RNA, 16 nt, Human herpesvirus 5
gugcaggccgcgcagg

SEQ ID NO: 3981795 - RNA, 19 nt, Human herpesvirus 5
gugcaucgcuucgagguug

SEQ ID NO: 3981796 - RNA, 14 nt, Human herpesvirus 5
gugccauggaccug

SEQ ID NO: 3981797 - RNA, 16 nt, Human herpesvirus 5
gugcccgucaucagcc

SEQ ID NO: 3981798 - RNA, 13 nt, Human herpesvirus 5
gugccucccgcgc

SEQ ID NO: 3981799 - RNA, 13 nt, Human herpesvirus 5
gugccucugaaag

SEQ ID NO: 3981800 - RNA, 13 nt, Human herpesvirus 5
gugcgacgccaug

SEQ ID NO: 3981801 - RNA, 17 nt, Human herpesvirus 5
gugcgcccaucugcggc

SEQ ID NO: 3981802 - RNA, 12 nt, Human herpesvirus 5
gugcgcgccgcc

SEQ ID NO: 3981803 - RNA, 14 nt, Human herpesvirus 5
gugcgcguccacag

SEQ ID NO: 3981804 - RNA, 17 nt, Human herpesvirus 5
gugcgggugccgggaca

SEQ ID NO: 3981805 - RNA, 15 nt, Human herpesvirus 5
gugcuacgagaucag

SEQ ID NO: 3981806 - RNA, 21 nt, Human herpesvirus 5
gugcucagcggcguguacagc

SEQ ID NO: 3981807 - RNA, 22 nt, Human herpesvirus 5
gugcucagcggcguguacagcu

SEQ ID NO: 3981808 - RNA, 18 nt, Human herpesvirus 5
gugcucucuauaaaacuu

SEQ ID NO: 3981809 - RNA, 22 nt, Human herpesvirus 5
gugcugauucgcgccgugcgcg

SEQ ID NO: 3981810 - RNA, 11 nt, Human herpesvirus 5
gugcuguugga

SEQ ID NO: 3981811 - RNA, 14 nt, Human herpesvirus 5
gugcuuuucaucua

SEQ ID NO: 3981812 - RNA, 12 nt, Human herpesvirus 5
guggaaggcacc

SEQ ID NO: 3981813 - RNA, 15 nt, Human herpesvirus 5
guggagagggaaggu

SEQ ID NO: 3981814 - RNA, 19 nt, Human herpesvirus 5
guggccagcgccugguacu

SEQ ID NO: 3981815 - RNA, 23 nt, Human herpesvirus 5
guggccgcgcuggcucgcgacga

SEQ ID NO: 3981816 - RNA, 23 nt, Human herpesvirus 5
guggcucuugcgcuucugcagcu

SEQ ID NO: 3981817 - RNA, 20 nt, Human herpesvirus 5
gugguggcuguaggcuaccg

SEQ ID NO: 3981818 - RNA, 14 nt, Human herpesvirus 5
guguaggcgacugg

SEQ ID NO: 3981819 - RNA, 18 nt, Human herpesvirus 5
gugucacuagacagauuc

SEQ ID NO: 3981820 - RNA, 20 nt, Human herpesvirus 5
gugucuacggauugcugacg

SEQ ID NO: 3981821 - RNA, 21 nt, Human herpesvirus 5
gugucuagcuggcggccucuu

SEQ ID NO: 3981822 - RNA, 23 nt, Human herpesvirus 5
gugucucuaaacgccaccugcaa

SEQ ID NO: 3981823 - RNA, 20 nt, Human herpesvirus 5
gugugaagcgguggaaacca

SEQ ID NO: 3981824 - RNA, 20 nt, Human herpesvirus 5
guguuuuucccauucccugu

SEQ ID NO: 3981825 - RNA, 18 nt, Human herpesvirus 5
guuaacccccgacgagca

SEQ ID NO: 3981826 - RNA, 18 nt, Human herpesvirus 5
guuacaaaagauagagaa

SEQ ID NO: 3981827 - RNA, 18 nt, Human herpesvirus 5
guuagacuagcacagaga

SEQ ID NO: 3981828 - RNA, 21 nt, Human herpesvirus 5
guuagcuuuugcccgcacgcc

SEQ ID NO: 3981829 - RNA, 16 nt, Human herpesvirus 5
guuaucacagaacaca

SEQ ID NO: 3981830 - RNA, 21 nt, Human herpesvirus 5
guuauccggcgucgcuggcgc

SEQ ID NO: 3981831 - RNA, 17 nt, Human herpesvirus 5
guuauguccgcucgugu

SEQ ID NO: 3981832 - RNA, 23 nt, Human herpesvirus 5
guuccaccaggcucugcgccguc

SEQ ID NO: 3981833 - RNA, 17 nt, Human herpesvirus 5
guucccggucgucgugu

SEQ ID NO: 3981834 - RNA, 14 nt, Human herpesvirus 5
guucgccgucgccg

SEQ ID NO: 3981835 - RNA, 20 nt, Human herpesvirus 5
guucgugauucguaggcagc

SEQ ID NO: 3981836 - RNA, 19 nt, Human herpesvirus 5
guucuaucaaugguggaaa

SEQ ID NO: 3981837 - RNA, 15 nt, Human herpesvirus 5
guucugcacggcguc

SEQ ID NO: 3981838 - RNA, 12 nt, Human herpesvirus 5
guucugggcgcg

SEQ ID NO: 3981839 - RNA, 16 nt, Human herpesvirus 5
guucuggucgggcgug

SEQ ID NO: 3981840 - RNA, 14 nt, Human herpesvirus 5
guucuguaaucuuc

SEQ ID NO: 3981841 - RNA, 16 nt, Human herpesvirus 5
guucuuccaccagcua

SEQ ID NO: 3981842 - RNA, 17 nt, Human herpesvirus 5
guugaccguugugggga

SEQ ID NO: 3981843 - RNA, 19 nt, Human herpesvirus 5
guugcagcaacgcgugcuc

SEQ ID NO: 3981844 - RNA, 22 nt, Human herpesvirus 5
guugccgcuggacugacacagc

SEQ ID NO: 3981845 - RNA, 22 nt, Human herpesvirus 5
guugcucuccucuaccccgccg

SEQ ID NO: 3981846 - RNA, 19 nt, Human herpesvirus 5
guuggaucagacucacguc

SEQ ID NO: 3981847 - RNA, 17 nt, Human herpesvirus 5
guugggaccgcagcgug

SEQ ID NO: 3981848 - RNA, 20 nt, Human herpesvirus 5
guugggaccgcagcguggcc

SEQ ID NO: 3981849 - RNA, 18 nt, Human herpesvirus 5
guuucuggggugggcgcg

SEQ ID NO: 3981850 - RNA, 11 nt, Human herpesvirus 5
guuugcgucuc

SEQ ID NO: 3981851 - RNA, 21 nt, Human herpesvirus 5
guuuucccucagccucugugu

SEQ ID NO: 3981852 - RNA, 20 nt, Human herpesvirus 5
guuuuugucaggacuggaag

SEQ ID NO: 3981853 - RNA, 15 nt, Human herpesvirus 5
uaaaacaccgacgcu

SEQ ID NO: 3981854 - RNA, 17 nt, Human herpesvirus 5
uaaaaguaaaaaugccc

SEQ ID NO: 3981855 - RNA, 15 nt, Human herpesvirus 5
uaaagcccccacgac

SEQ ID NO: 3981856 - RNA, 15 nt, Human herpesvirus 5
uaacaacgucacuuc

SEQ ID NO: 3981857 - RNA, 18 nt, Human herpesvirus 5
uaacaauuuuucuuuuuc

SEQ ID NO: 3981858 - RNA, 17 nt, Human herpesvirus 5
uaacccaaaaccaugcu

SEQ ID NO: 3981859 - RNA, 20 nt, Human herpesvirus 5
uaacuagccuucccgugaga

SEQ ID NO: 3981860 - RNA, 16 nt, Human herpesvirus 5
uaacucacuguuugaa

SEQ ID NO: 3981861 - RNA, 12 nt, Human herpesvirus 5
uaacuguagcac

SEQ ID NO: 3981862 - RNA, 18 nt, Human herpesvirus 5
uaagacagaaugaaccuu

SEQ ID NO: 3981863 - RNA, 16 nt, Human herpesvirus 5
uaagagauccugggac

SEQ ID NO: 3981864 - RNA, 16 nt, Human herpesvirus 5
uaagaucguccgagau

SEQ ID NO: 3981865 - RNA, 13 nt, Human herpesvirus 5
uaagcuguguacu

SEQ ID NO: 3981866 - RNA, 13 nt, Human herpesvirus 5
uaaggagcucuga

SEQ ID NO: 3981867 - RNA, 21 nt, Human herpesvirus 5
uaauaagccggcagcugcuuu

SEQ ID NO: 3981868 - RNA, 14 nt, Human herpesvirus 5
uaauagacacaccg

SEQ ID NO: 3981869 - RNA, 16 nt, Human herpesvirus 5
uaaucgacaggaggcu

SEQ ID NO: 3981870 - RNA, 15 nt, Human herpesvirus 5
uaaugcauuaucauc

SEQ ID NO: 3981871 - RNA, 10 nt, Human herpesvirus 5
uaauguacca

SEQ ID NO: 3981872 - RNA, 15 nt, Human herpesvirus 5
uacacgccuugcacc

SEQ ID NO: 3981873 - RNA, 14 nt, Human herpesvirus 5
uacacgucccccug

SEQ ID NO: 3981874 - RNA, 15 nt, Human herpesvirus 5
uacagcccggcggug

SEQ ID NO: 3981875 - RNA, 16 nt, Human herpesvirus 5
uacagguggagauucu

SEQ ID NO: 3981876 - RNA, 21 nt, Human herpesvirus 5
uacaugcuauaagacagccuu

SEQ ID NO: 3981877 - RNA, 22 nt, Human herpesvirus 5
uacauucgccgcaaugggcuuc

SEQ ID NO: 3981878 - RNA, 17 nt, Human herpesvirus 5
uaccaccgugacaccgg

SEQ ID NO: 3981879 - RNA, 16 nt, Human herpesvirus 5
uaccacgguaauugcg

SEQ ID NO: 3981880 - RNA, 16 nt, Human herpesvirus 5
uacccgccccagcaga

SEQ ID NO: 3981881 - RNA, 16 nt, Human herpesvirus 5
uaccgccccaccgccg

SEQ ID NO: 3981882 - RNA, 13 nt, Human herpesvirus 5
uaccgcuacaacg

SEQ ID NO: 3981883 - RNA, 18 nt, Human herpesvirus 5
uaccgucgccaccaccgg

SEQ ID NO: 3981884 - RNA, 21 nt, Human herpesvirus 5
uaccuaugcgccguagguucu

SEQ ID NO: 3981885 - RNA, 12 nt, Human herpesvirus 5
uaccugggcugc

SEQ ID NO: 3981886 - RNA, 22 nt, Human herpesvirus 5
uacgaccuguuuaccucaugcg

SEQ ID NO: 3981887 - RNA, 20 nt, Human herpesvirus 5
uacgauaauugcuacgucac

SEQ ID NO: 3981888 - RNA, 17 nt, Human herpesvirus 5
uacgucgcuuuuuacuu

SEQ ID NO: 3981889 - RNA, 15 nt, Human herpesvirus 5
uacuaacgucacauu

SEQ ID NO: 3981890 - RNA, 21 nt, Human herpesvirus 5
uacuagggaaaacauaagaau

SEQ ID NO: 3981891 - RNA, 18 nt, Human herpesvirus 5
uacucguguuuuuuauuc

SEQ ID NO: 3981892 - RNA, 15 nt, Human herpesvirus 5
uagacagacaggaca

SEQ ID NO: 3981893 - RNA, 17 nt, Human herpesvirus 5
uagacauuccccaccuu

SEQ ID NO: 3981894 - RNA, 20 nt, Human herpesvirus 5
uagacauuccccaccuuccc

SEQ ID NO: 3981895 - RNA, 15 nt, Human herpesvirus 5
uagcaaguccuccaa

SEQ ID NO: 3981896 - RNA, 16 nt, Human herpesvirus 5
uagccuuucugaccuu

SEQ ID NO: 3981897 - RNA, 17 nt, Human herpesvirus 5
uagcuuuuuuuauacau

SEQ ID NO: 3981898 - RNA, 13 nt, Human herpesvirus 5
uaggcgggcugga

SEQ ID NO: 3981899 - RNA, 13 nt, Human herpesvirus 5
uaguauucugcgu

SEQ ID NO: 3981900 - RNA, 15 nt, Human herpesvirus 5
uagugcgcgccgccg

SEQ ID NO: 3981901 - RNA, 14 nt, Human herpesvirus 5
uaguuguugcagaa

SEQ ID NO: 3981902 - RNA, 23 nt, Human herpesvirus 5
uauaagcguggauggucauauau

SEQ ID NO: 3981903 - RNA, 14 nt, Human herpesvirus 5
uauacaacaggugu

SEQ ID NO: 3981904 - RNA, 15 nt, Human herpesvirus 5
uauagacacacacca

SEQ ID NO: 3981905 - RNA, 22 nt, Human herpesvirus 5
uauaggcuaagcuauaccauca

SEQ ID NO: 3981906 - RNA, 16 nt, Human herpesvirus 5
uauaucuuucuacaag

SEQ ID NO: 3981907 - RNA, 23 nt, Human herpesvirus 5
uaucagaggccacccacccggug

SEQ ID NO: 3981908 - RNA, 19 nt, Human herpesvirus 5
uauccaacuucacuucaaa

SEQ ID NO: 3981909 - RNA, 23 nt, Human herpesvirus 5
uauccgaguccaccucugcuacu

SEQ ID NO: 3981910 - RNA, 15 nt, Human herpesvirus 5
uaucgggauaucgcc

SEQ ID NO: 3981911 - RNA, 12 nt, Human herpesvirus 5
uaucuggggagg

SEQ ID NO: 3981912 - RNA, 16 nt, Human herpesvirus 5
uaucuggggaggaggu

SEQ ID NO: 3981913 - RNA, 16 nt, Human herpesvirus 5
uaugauaucuacagca

SEQ ID NO: 3981914 - RNA, 20 nt, Human herpesvirus 5
uaugcaugucgcgacagaga

SEQ ID NO: 3981915 - RNA, 15 nt, Human herpesvirus 5
uaugccgucuucacu

SEQ ID NO: 3981916 - RNA, 12 nt, Human herpesvirus 5
uaugcgccgcca

SEQ ID NO: 3981917 - RNA, 14 nt, Human herpesvirus 5
uaugggcggugguc

SEQ ID NO: 3981918 - RNA, 20 nt, Human herpesvirus 5
uauuaauuuaacaagucacu

SEQ ID NO: 3981919 - RNA, 23 nt, Human herpesvirus 5
uauugagcaggguaaaaaccacg

SEQ ID NO: 3981920 - RNA, 20 nt, Human herpesvirus 5
uauugggaagggugugacug

SEQ ID NO: 3981921 - RNA, 17 nt, Human herpesvirus 5
uauugguucugggcgcg

SEQ ID NO: 3981922 - RNA, 15 nt, Human herpesvirus 5
uauuuuucagcucac

SEQ ID NO: 3981923 - RNA, 17 nt, Human herpesvirus 5
ucaaacaccgcugcggc

SEQ ID NO: 3981924 - RNA, 22 nt, Human herpesvirus 5
ucaacacggcauucucuacgaa

SEQ ID NO: 3981925 - RNA, 21 nt, Human herpesvirus 5
ucaacgguggaauucgcuggg

SEQ ID NO: 3981926 - RNA, 22 nt, Human herpesvirus 5
ucaagaucguacccaccaccuc

SEQ ID NO: 3981927 - RNA, 22 nt, Human herpesvirus 5
ucacacaggccagcugccacca

SEQ ID NO: 3981928 - RNA, 13 nt, Human herpesvirus 5
ucacacuuaagaa

SEQ ID NO: 3981929 - RNA, 14 nt, Human herpesvirus 5
ucaccaccacggua

SEQ ID NO: 3981930 - RNA, 17 nt, Human herpesvirus 5
ucaccacgcagcaggcu

SEQ ID NO: 3981931 - RNA, 16 nt, Human herpesvirus 5
ucaccagacuuuuugc

SEQ ID NO: 3981932 - RNA, 16 nt, Human herpesvirus 5
ucacccggcugcuggc

SEQ ID NO: 3981933 - RNA, 15 nt, Human herpesvirus 5
ucacgaggaccauuu

SEQ ID NO: 3981934 - RNA, 22 nt, Human herpesvirus 5
ucacgaucgcuggugucucugc

SEQ ID NO: 3981935 - RNA, 13 nt, Human herpesvirus 5
ucacgcaggugag

SEQ ID NO: 3981936 - RNA, 18 nt, Human herpesvirus 5
ucacgggacccgccgccg

SEQ ID NO: 3981937 - RNA, 22 nt, Human herpesvirus 5
ucacgggcucguguggcagcug

SEQ ID NO: 3981938 - RNA, 14 nt, Human herpesvirus 5
ucacuacucuggga

SEQ ID NO: 3981939 - RNA, 13 nt, Human herpesvirus 5
ucacuaucuucaa

SEQ ID NO: 3981940 - RNA, 21 nt, Human herpesvirus 5
ucagaaagcaccagaacccgu

SEQ ID NO: 3981941 - RNA, 15 nt, Human herpesvirus 5
ucagaccgcaacaac

SEQ ID NO: 3981942 - RNA, 16 nt, Human herpesvirus 5
ucagcaugguggccaa

SEQ ID NO: 3981943 - RNA, 13 nt, Human herpesvirus 5
ucagccgccgccu

SEQ ID NO: 3981944 - RNA, 14 nt, Human herpesvirus 5
ucagccgccgccuc

SEQ ID NO: 3981945 - RNA, 17 nt, Human herpesvirus 5
ucagcuaccgccgcaac

SEQ ID NO: 3981946 - RNA, 20 nt, Human herpesvirus 5
ucagcuggcuuucagcuucg

SEQ ID NO: 3981947 - RNA, 15 nt, Human herpesvirus 5
ucagcuugcccgacc

SEQ ID NO: 3981948 - RNA, 14 nt, Human herpesvirus 5
ucagguggaugagg

SEQ ID NO: 3981949 - RNA, 16 nt, Human herpesvirus 5
ucaguccauugucagu

SEQ ID NO: 3981950 - RNA, 20 nt, Human herpesvirus 5
ucaguguacacgcgcccaga

SEQ ID NO: 3981951 - RNA, 21 nt, Human herpesvirus 5
ucauauacgguacacgucccc

SEQ ID NO: 3981952 - RNA, 21 nt, Human herpesvirus 5
ucauauagccuccggcuguca

SEQ ID NO: 3981953 - RNA, 15 nt, Human herpesvirus 5
uccacaaccugugga

SEQ ID NO: 3981954 - RNA, 21 nt, Human herpesvirus 5
uccacaggcgcguuggacggg

SEQ ID NO: 3981955 - RNA, 20 nt, Human herpesvirus 5
uccacgacucgcacggccug

SEQ ID NO: 3981956 - RNA, 14 nt, Human herpesvirus 5
uccacggccuccga

SEQ ID NO: 3981957 - RNA, 14 nt, Human herpesvirus 5
uccagcaccacguc

SEQ ID NO: 3981958 - RNA, 18 nt, Human herpesvirus 5
uccagcggccgcaguggg

SEQ ID NO: 3981959 - RNA, 14 nt, Human herpesvirus 5
uccaucgcagccac

SEQ ID NO: 3981960 - RNA, 21 nt, Human herpesvirus 5
uccauuucgcaggagcugcug

SEQ ID NO: 3981961 - RNA, 16 nt, Human herpesvirus 5
ucccacaggagucucu

SEQ ID NO: 3981962 - RNA, 18 nt, Human herpesvirus 5
ucccacaggagucucugg

SEQ ID NO: 3981963 - RNA, 21 nt, Human herpesvirus 5
ucccacuacacuauguucgug

SEQ ID NO: 3981964 - RNA, 13 nt, Human herpesvirus 5
ucccaucuucuaa

SEQ ID NO: 3981965 - RNA, 23 nt, Human herpesvirus 5
uccccacccaguagacagacagg

SEQ ID NO: 3981966 - RNA, 17 nt, Human herpesvirus 5
uccccgaauuugggcgg

SEQ ID NO: 3981967 - RNA, 19 nt, Human herpesvirus 5
uccccgcaaacucccacuc

SEQ ID NO: 3981968 - RNA, 14 nt, Human herpesvirus 5
uccccgugugaugu

SEQ ID NO: 3981969 - RNA, 12 nt, Human herpesvirus 5
uccccuaacguc

SEQ ID NO: 3981970 - RNA, 11 nt, Human herpesvirus 5
uccccugccua

SEQ ID NO: 3981971 - RNA, 23 nt, Human herpesvirus 5
ucccgacaggcucgucgugggcu

SEQ ID NO: 3981972 - RNA, 19 nt, Human herpesvirus 5
ucccgguauucggaaacag

SEQ ID NO: 3981973 - RNA, 15 nt, Human herpesvirus 5
ucccgucccucuccu

SEQ ID NO: 3981974 - RNA, 12 nt, Human herpesvirus 5
ucccucagccuc

SEQ ID NO: 3981975 - RNA, 15 nt, Human herpesvirus 5
ucccucgcgccgccc

SEQ ID NO: 3981976 - RNA, 18 nt, Human herpesvirus 5
uccgacagcgcgacgagc

SEQ ID NO: 3981977 - RNA, 23 nt, Human herpesvirus 5
uccgaccgggaaaccacgccggc

SEQ ID NO: 3981978 - RNA, 23 nt, Human herpesvirus 5
uccgccgucggugcgcccaucug

SEQ ID NO: 3981979 - RNA, 16 nt, Human herpesvirus 5
uccgccuccacuuccg

SEQ ID NO: 3981980 - RNA, 22 nt, Human herpesvirus 5
uccggcaagaugcucgggauac

SEQ ID NO: 3981981 - RNA, 18 nt, Human herpesvirus 5
uccggcgucgcuggcgcu

SEQ ID NO: 3981982 - RNA, 21 nt, Human herpesvirus 5
uccguccucgucgccuuccag

SEQ ID NO: 3981983 - RNA, 14 nt, Human herpesvirus 5
uccgugccagcugg

SEQ ID NO: 3981984 - RNA, 16 nt, Human herpesvirus 5
uccuccuucuuccucg

SEQ ID NO: 3981985 - RNA, 18 nt, Human herpesvirus 5
uccucggagcacgggcga

SEQ ID NO: 3981986 - RNA, 14 nt, Human herpesvirus 5
uccucggugcccgc

SEQ ID NO: 3981987 - RNA, 15 nt, Human herpesvirus 5
uccuucaugauggag

SEQ ID NO: 3981988 - RNA, 18 nt, Human herpesvirus 5
ucgaccggcggcugcugu

SEQ ID NO: 3981989 - RNA, 19 nt, Human herpesvirus 5
ucgaccuugagcgacagca

SEQ ID NO: 3981990 - RNA, 22 nt, Human herpesvirus 5
ucgaccuugagcgacagcagca

SEQ ID NO: 3981991 - RNA, 20 nt, Human herpesvirus 5
ucgagaccgaagacgccguc

SEQ ID NO: 3981992 - RNA, 16 nt, Human herpesvirus 5
ucgagccaagucgccg

SEQ ID NO: 3981993 - RNA, 19 nt, Human herpesvirus 5
ucgagucgcguguguuuug

SEQ ID NO: 3981994 - RNA, 14 nt, Human herpesvirus 5
ucgaugaagccuau

SEQ ID NO: 3981995 - RNA, 14 nt, Human herpesvirus 5
ucgcagccuccucg

SEQ ID NO: 3981996 - RNA, 16 nt, Human herpesvirus 5
ucgccaagaugcugcg

SEQ ID NO: 3981997 - RNA, 20 nt, Human herpesvirus 5
ucgccacgguuuguggcaag

SEQ ID NO: 3981998 - RNA, 16 nt, Human herpesvirus 5
ucgccgucacugccac

SEQ ID NO: 3981999 - RNA, 22 nt, Human herpesvirus 5
ucgccuuccagcuuaccgccac

SEQ ID NO: 3982000 - RNA, 19 nt, Human herpesvirus 5
cguucagucgcggcugagc

SEQ ID NO: 3982001 - RNA, 15 nt, Human herpesvirus 5
cguucgcaugucguc

SEQ ID NO: 3982002 - RNA, 20 nt, Human herpesvirus 5
cguugucuauccccaaaaaa

SEQ ID NO: 3982003 - RNA, 15 nt, Human herpesvirus 5
cuaaagcucgccaac

SEQ ID NO: 3982004 - RNA, 15 nt, Human herpesvirus 5
cuaagaggauacauc

SEQ ID NO: 3982005 - RNA, 19 nt, Human herpesvirus 5
cuaaucgcauccugcauca

SEQ ID NO: 3982006 - RNA, 11 nt, Human herpesvirus 5
cuaaugugcug

SEQ ID NO: 3982007 - RNA, 22 nt, Human herpesvirus 5
cuacacuuggugcucgaccagg

SEQ ID NO: 3982008 - RNA, 15 nt, Human herpesvirus 5
cuacagacugggcga

SEQ ID NO: 3982009 - RNA, 22 nt, Human herpesvirus 5
cuacauauuuuccauaaaucua

SEQ ID NO: 3982010 - RNA, 19 nt, Human herpesvirus 5
cuaccaacgcuuccugcgc

SEQ ID NO: 3982011 - RNA, 23 nt, Human herpesvirus 5
cuaccaauaaagauaaucugcca

SEQ ID NO: 3982012 - RNA, 14 nt, Human herpesvirus 5
cuaccaugcgcaac

SEQ ID NO: 3982013 - RNA, 16 nt, Human herpesvirus 5
cuaccgccgcaacagc

SEQ ID NO: 3982014 - RNA, 15 nt, Human herpesvirus 5
cuaccuagagaggcu

SEQ ID NO: 3982015 - RNA, 20 nt, Human herpesvirus 5
cuaccuuguaccaacugagc

SEQ ID NO: 3982016 - RNA, 20 nt, Human herpesvirus 5
cuacgaucgcuggaaagaca

SEQ ID NO: 3982017 - RNA, 15 nt, Human herpesvirus 5
cuacgaugcgagcca

SEQ ID NO: 3982018 - RNA, 15 nt, Human herpesvirus 5
cuacuaccuccccua

SEQ ID NO: 3982019 - RNA, 13 nt, Human herpesvirus 5
cuacucugggaua

SEQ ID NO: 3982020 - RNA, 13 nt, Human herpesvirus 5
cuagagacagacg

SEQ ID NO: 3982021 - RNA, 22 nt, Human herpesvirus 5
cuaguaaaaaaagugcgucaaa

SEQ ID NO: 3982022 - RNA, 20 nt, Human herpesvirus 5
cuaucuucaaccucacguua

SEQ ID NO: 3982023 - RNA, 13 nt, Human herpesvirus 5
cuaugaggacgac

SEQ ID NO: 3982024 - RNA, 22 nt, Human herpesvirus 5
cuauugcuuagcugcacaccag

SEQ ID NO: 3982025 - RNA, 22 nt, Human herpesvirus 5
cuauuucgcgauccgcucacca

SEQ ID NO: 3982026 - RNA, 19 nt, Human herpesvirus 5
cucaaaacaucaccaccau

SEQ ID NO: 3982027 - RNA, 17 nt, Human herpesvirus 5
cucaagucgcguccggg

SEQ ID NO: 3982028 - RNA, 17 nt, Human herpesvirus 5
cucacagucuaucccua

SEQ ID NO: 3982029 - RNA, 14 nt, Human herpesvirus 5
cucaccaaagccgc

SEQ ID NO: 3982030 - RNA, 19 nt, Human herpesvirus 5
cucaccuggaccgguggua

SEQ ID NO: 3982031 - RNA, 22 nt, Human herpesvirus 5
cucacgucguugggaaugucca

SEQ ID NO: 3982032 - RNA, 20 nt, Human herpesvirus 5
cucagcgugcucagcuggug

SEQ ID NO: 3982033 - RNA, 15 nt, Human herpesvirus 5
cucaggccacccgcc

SEQ ID NO: 3982034 - RNA, 21 nt, Human herpesvirus 5
cucagguuccccgagagggug

SEQ ID NO: 3982035 - RNA, 13 nt, Human herpesvirus 5
cucaucucagccu

SEQ ID NO: 3982036 - RNA, 14 nt, Human herpesvirus 5
cucaucucagccuc

SEQ ID NO: 3982037 - RNA, 19 nt, Human herpesvirus 5
cuccaggcggagaugagga

SEQ ID NO: 3982038 - RNA, 14 nt, Human herpesvirus 5
cuccaguccauaug

SEQ ID NO: 3982039 - RNA, 17 nt, Human herpesvirus 5
cuccaucuauuggcaga

SEQ ID NO: 3982040 - RNA, 17 nt, Human herpesvirus 5
cuccgacauucgcgucg

SEQ ID NO: 3982041 - RNA, 18 nt, Human herpesvirus 5
cuccgacgacgccgagga

SEQ ID NO: 3982042 - RNA, 22 nt, Human herpesvirus 5
cuccgcaagcgccgccaacgcg

SEQ ID NO: 3982043 - RNA, 15 nt, Human herpesvirus 5
cuccuccaccacggc

SEQ ID NO: 3982044 - RNA, 18 nt, Human herpesvirus 5
cuccucccucgcgccgcc

SEQ ID NO: 3982045 - RNA, 17 nt, Human herpesvirus 5
cuccuccgcgaacggcg

SEQ ID NO: 3982046 - RNA, 12 nt, Human herpesvirus 5
cuccuccucccu

SEQ ID NO: 3982047 - RNA, 14 nt, Human herpesvirus 5
cuccuccucccucg

SEQ ID NO: 3982048 - RNA, 14 nt, Human herpesvirus 5
cuccucuaccccgc

SEQ ID NO: 3982049 - RNA, 21 nt, Human herpesvirus 5
cuccuguuggcuuacugccug

SEQ ID NO: 3982050 - RNA, 15 nt, Human herpesvirus 5
cucgcacggccugug

SEQ ID NO: 3982051 - RNA, 15 nt, Human herpesvirus 5
cucgccgacguggug

SEQ ID NO: 3982052 - RNA, 21 nt, Human herpesvirus 5
cucgcgacgagggucugcgcg

SEQ ID NO: 3982053 - RNA, 22 nt, Human herpesvirus 5
cucgcucacgucguugggaaug

SEQ ID NO: 3982054 - RNA, 16 nt, Human herpesvirus 5
cucgcucgcgcccgcu

SEQ ID NO: 3982055 - RNA, 19 nt, Human herpesvirus 5
cucgcucuacgcgugcacg

SEQ ID NO: 3982056 - RNA, 12 nt, Human herpesvirus 5
cucgcugggcua

SEQ ID NO: 3982057 - RNA, 18 nt, Human herpesvirus 5
cucggaaacugugcguca

SEQ ID NO: 3982058 - RNA, 18 nt, Human herpesvirus 5
cucggagccgccgacgcu

SEQ ID NO: 3982059 - RNA, 22 nt, Human herpesvirus 5
cucggaucugcggcucaaacac

SEQ ID NO: 3982060 - RNA, 16 nt, Human herpesvirus 5
cucgggaaugccagag

SEQ ID NO: 3982061 - RNA, 17 nt, Human herpesvirus 5
cucgggccgaaccccgu

SEQ ID NO: 3982062 - RNA, 17 nt, Human herpesvirus 5
cucgggucggcuggucg

SEQ ID NO: 3982063 - RNA, 16 nt, Human herpesvirus 5
cucguaaacuuaugaa

SEQ ID NO: 3982064 - RNA, 14 nt, Human herpesvirus 5
cucgucgugcccgu

SEQ ID NO: 3982065 - RNA, 14 nt, Human herpesvirus 5
cucgugcgugucgc

SEQ ID NO: 3982066 - RNA, 21 nt, Human herpesvirus 5
cucgugugcuguugaccuggg

SEQ ID NO: 3982067 - RNA, 23 nt, Human herpesvirus 5
cucgugugcuguugaccugggua

SEQ ID NO: 3982068 - RNA, 14 nt, Human herpesvirus 5
cucguucccagcgc

SEQ ID NO: 3982069 - RNA, 22 nt, Human herpesvirus 5
cucguuguacgcauuacacagg

SEQ ID NO: 3982070 - RNA, 15 nt, Human herpesvirus 5
cucuacgagcugggc

SEQ ID NO: 3982071 - RNA, 13 nt, Human herpesvirus 5
cucuauacacaua

SEQ ID NO: 3982072 - RNA, 15 nt, Human herpesvirus 5
cucuaucugcgccag

SEQ ID NO: 3982073 - RNA, 15 nt, Human herpesvirus 5
cucugcuacuggccc

SEQ ID NO: 3982074 - RNA, 16 nt, Human herpesvirus 5
cucugcuucuuuucug

SEQ ID NO: 3982075 - RNA, 13 nt, Human herpesvirus 5
cucuggcccugcu

SEQ ID NO: 3982076 - RNA, 15 nt, Human herpesvirus 5
cucugggaagcugcg

SEQ ID NO: 3982077 - RNA, 15 nt, Human herpesvirus 5
cucugucggcgccgc

SEQ ID NO: 3982078 - RNA, 16 nt, Human herpesvirus 5
cucuguggacccugcg

SEQ ID NO: 3982079 - RNA, 20 nt, Human herpesvirus 5
cucuugcgcccucucggugu

SEQ ID NO: 3982080 - RNA, 20 nt, Human herpesvirus 5
cucuuggcgccgcggugguc

SEQ ID NO: 3982081 - RNA, 22 nt, Human herpesvirus 5
cugacguggugcgcugcguucg

SEQ ID NO: 3982082 - RNA, 20 nt, Human herpesvirus 5
cugagaacauguggaaauca

SEQ ID NO: 3982083 - RNA, 22 nt, Human herpesvirus 5
cugagaacauguggaaaucacc

SEQ ID NO: 3982084 - RNA, 22 nt, Human herpesvirus 5
cugagcuacgaugaccacgaag

SEQ ID NO: 3982085 - RNA, 22 nt, Human herpesvirus 5
cugaguucacgcgcggaaccca

SEQ ID NO: 3982086 - RNA, 17 nt, Human herpesvirus 5
cugaucacguuguccuu

SEQ ID NO: 3982087 - RNA, 19 nt, Human herpesvirus 5
cugcaacggcaucauguuc

SEQ ID NO: 3982088 - RNA, 22 nt, Human herpesvirus 5
cugcaagucccuggccccggcc

SEQ ID NO: 3982089 - RNA, 24 nt, Human herpesvirus 5
cugcacaccuauggcgccgugggu

SEQ ID NO: 3982090 - RNA, 17 nt, Human herpesvirus 5
cugcaccaggagggcuu

SEQ ID NO: 3982091 - RNA, 22 nt, Human herpesvirus 5
cugcacgacaucuuccgcgagc

SEQ ID NO: 3982092 - RNA, 13 nt, Human herpesvirus 5
cugcacgcucugu

SEQ ID NO: 3982093 - RNA, 15 nt, Human herpesvirus 5
cugcacguggccugg

SEQ ID NO: 3982094 - RNA, 16 nt, Human herpesvirus 5
cugcagaccgaggcgc

SEQ ID NO: 3982095 - RNA, 16 nt, Human herpesvirus 5
cugcagccggaggaag

SEQ ID NO: 3982096 - RNA, 19 nt, Human herpesvirus 5
cugcagcucgaacgucucu

SEQ ID NO: 3982097 - RNA, 16 nt, Human herpesvirus 5
cugcagguacggcccg

SEQ ID NO: 3982098 - RNA, 22 nt, Human herpesvirus 5
cugcagguacggcccggcagca

SEQ ID NO: 3982099 - RNA, 22 nt, Human herpesvirus 5
cugccaccgacauggagcccac

SEQ ID NO: 3982100 - RNA, 15 nt, Human herpesvirus 5
cugccgcgguacgca

SEQ ID NO: 3982101 - RNA, 22 nt, Human herpesvirus 5
cugccggucuacagacugggcg

SEQ ID NO: 3982102 - RNA, 23 nt, Human herpesvirus 5
cugccggucuacagacugggcga

SEQ ID NO: 3982103 - RNA, 18 nt, Human herpesvirus 5
cugccuauguaaggcggc

SEQ ID NO: 3982104 - RNA, 14 nt, Human herpesvirus 5
cugcgacacgugcu

SEQ ID NO: 3982105 - RNA, 16 nt, Human herpesvirus 5
cugcgacguggaggag

SEQ ID NO: 3982106 - RNA, 23 nt, Human herpesvirus 5
cugcgagaggaagucgaucugga

SEQ ID NO: 3982107 - RNA, 15 nt, Human herpesvirus 5
cugcgcccguuggug

SEQ ID NO: 3982108 - RNA, 18 nt, Human herpesvirus 5
cugcgccguuuugcuguc

SEQ ID NO: 3982109 - RNA, 15 nt, Human herpesvirus 5
cugcgcgccuccguc

SEQ ID NO: 3982110 - RNA, 14 nt, Human herpesvirus 5
cugcggccggccgc

SEQ ID NO: 3982111 - RNA, 15 nt, Human herpesvirus 5
cugcggcgacuggcg

SEQ ID NO: 3982112 - RNA, 22 nt, Human herpesvirus 5
cugcggcguaccuacggaccgc

SEQ ID NO: 3982113 - RNA, 18 nt, Human herpesvirus 5
cugcgguuaacccuagca

SEQ ID NO: 3982114 - RNA, 19 nt, Human herpesvirus 5
cugcgucgucaaggacggc

SEQ ID NO: 3982115 - RNA, 23 nt, Human herpesvirus 5
cugcuagaugaccauguucagcu

SEQ ID NO: 3982116 - RNA, 16 nt, Human herpesvirus 5
ccuggaucuuggcggc

SEQ ID NO: 3982117 - RNA, 18 nt, Human herpesvirus 5
ccuggccuucggcacgcu

SEQ ID NO: 3982118 - RNA, 23 nt, Human herpesvirus 5
ccuggggcugcugcugcacgggc

SEQ ID NO: 3982119 - RNA, 22 nt, Human herpesvirus 5
ccuggguacuuaugaggagcgc

SEQ ID NO: 3982120 - RNA, 14 nt, Human herpesvirus 5
ccuggucuggccca

SEQ ID NO: 3982121 - RNA, 15 nt, Human herpesvirus 5
ccugguugcugccgc

SEQ ID NO: 3982122 - RNA, 19 nt, Human herpesvirus 5
ccugucgucgacaugucgc

SEQ ID NO: 3982123 - RNA, 15 nt, Human herpesvirus 5
ccuguugcucuccuc

SEQ ID NO: 3982124 - RNA, 16 nt, Human herpesvirus 5
ccuucggcacgcuggc

SEQ ID NO: 3982125 - RNA, 15 nt, Human herpesvirus 5
ccuugagcgacagca

SEQ ID NO: 3982126 - RNA, 16 nt, Human herpesvirus 5
ccuuggcgcucuggau

SEQ ID NO: 3982127 - RNA, 16 nt, Human herpesvirus 5
cgaaagacaaugaaaa

SEQ ID NO: 3982128 - RNA, 20 nt, Human herpesvirus 5
cgaagguuagcgccgcggca

SEQ ID NO: 3982129 - RNA, 20 nt, Human herpesvirus 5
cgacacacguucgacaugga

SEQ ID NO: 3982130 - RNA, 18 nt, Human herpesvirus 5
cgacagcgcgacgagcgc

SEQ ID NO: 3982131 - RNA, 13 nt, Human herpesvirus 5
cgacagcugcaau

SEQ ID NO: 3982132 - RNA, 14 nt, Human herpesvirus 5
cgacauggacauga

SEQ ID NO: 3982133 - RNA, 18 nt, Human herpesvirus 5
cgaccacgacacggugcu

SEQ ID NO: 3982134 - RNA, 19 nt, Human herpesvirus 5
cgaccuacgggacacgcug

SEQ ID NO: 3982135 - RNA, 15 nt, Human herpesvirus 5
cgacgaaggacggga

SEQ ID NO: 3982136 - RNA, 12 nt, Human herpesvirus 5
cgacgacccacc

SEQ ID NO: 3982137 - RNA, 15 nt, Human herpesvirus 5
cgacgagcgcugcga

SEQ ID NO: 3982138 - RNA, 22 nt, Human herpesvirus 5
cgacggucaccaucgugccgcu

SEQ ID NO: 3982139 - RNA, 18 nt, Human herpesvirus 5
cgacguaccagcugucca

SEQ ID NO: 3982140 - RNA, 18 nt, Human herpesvirus 5
cgacgucggucccaucgc

SEQ ID NO: 3982141 - RNA, 19 nt, Human herpesvirus 5
cgacguuucgcgaggacaa

SEQ ID NO: 3982142 - RNA, 17 nt, Human herpesvirus 5
cgacugcagcccaccgc

SEQ ID NO: 3982143 - RNA, 19 nt, Human herpesvirus 5
cgagaacuaauauugcaau

SEQ ID NO: 3982144 - RNA, 17 nt, Human herpesvirus 5
cgagagaugggccgcgg

SEQ ID NO: 3982145 - RNA, 17 nt, Human herpesvirus 5
cgagaugaaggaacgca

SEQ ID NO: 3982146 - RNA, 18 nt, Human herpesvirus 5
cgagcaccccgaacugga

SEQ ID NO: 3982147 - RNA, 12 nt, Human herpesvirus 5
cgagcgacgcgg

SEQ ID NO: 3982148 - RNA, 18 nt, Human herpesvirus 5
cgagcgcgaacgccgcgc

SEQ ID NO: 3982149 - RNA, 18 nt, Human herpesvirus 5
cgagcgcggcacgccguu

SEQ ID NO: 3982150 - RNA, 20 nt, Human herpesvirus 5
cgagcucgucgccagcgcga

SEQ ID NO: 3982151 - RNA, 19 nt, Human herpesvirus 5
cgagcuuauugagcgcagc

SEQ ID NO: 3982152 - RNA, 21 nt, Human herpesvirus 5
cgaggcggaggagccggcggc

SEQ ID NO: 3982153 - RNA, 20 nt, Human herpesvirus 5
cgaggcucucuauccggugg

SEQ ID NO: 3982154 - RNA, 21 nt, Human herpesvirus 5
cgaguacacguuaccgucgcc

SEQ ID NO: 3982155 - RNA, 20 nt, Human herpesvirus 5
cgaguaccgcagcgaguugc

SEQ ID NO: 3982156 - RNA, 15 nt, Human herpesvirus 5
cgaguccguccucga

SEQ ID NO: 3982157 - RNA, 17 nt, Human herpesvirus 5
cgaguggugaggagcgc

SEQ ID NO: 3982158 - RNA, 21 nt, Human herpesvirus 5
cgaguugcaaaagaagcugcc

SEQ ID NO: 3982159 - RNA, 16 nt, Human herpesvirus 5
cgaucaccagaaggcg

SEQ ID NO: 3982160 - RNA, 19 nt, Human herpesvirus 5
cgaugaaccuuccccaccc

SEQ ID NO: 3982161 - RNA, 12 nt, Human herpesvirus 5
cgaugauacauc

SEQ ID NO: 3982162 - RNA, 17 nt, Human herpesvirus 5
cgaugcugcaaggccuc

SEQ ID NO: 3982163 - RNA, 17 nt, Human herpesvirus 5
cgaugucaaggaacgcg

SEQ ID NO: 3982164 - RNA, 21 nt, Human herpesvirus 5
cgaugugugggaccuggucaa

SEQ ID NO: 3982165 - RNA, 23 nt, Human herpesvirus 5
cgcaaaucuacaacggccccugu

SEQ ID NO: 3982166 - RNA, 20 nt, Human herpesvirus 5
cgcaacagcggcgacagacg

SEQ ID NO: 3982167 - RNA, 15 nt, Human herpesvirus 5
cgcaagacgcgccuc

SEQ ID NO: 3982168 - RNA, 22 nt, Human herpesvirus 5
cgcaaugggcuucccuccugca

SEQ ID NO: 3982169 - RNA, 19 nt, Human herpesvirus 5
cgcacccuaaaacaccgug

SEQ ID NO: 3982170 - RNA, 15 nt, Human herpesvirus 5
cgcaccggcagcaca

SEQ ID NO: 3982171 - RNA, 21 nt, Human herpesvirus 5
cgcaccggcagcacaccugcc

SEQ ID NO: 3982172 - RNA, 14 nt, Human herpesvirus 5
cgcacgagacgcga

SEQ ID NO: 3982173 - RNA, 18 nt, Human herpesvirus 5
cgcacgcuggaggacgcg

SEQ ID NO: 3982174 - RNA, 19 nt, Human herpesvirus 5
cgcacuuuuuuuacuagua

SEQ ID NO: 3982175 - RNA, 21 nt, Human herpesvirus 5
cgcagcagagccaccaggugc

SEQ ID NO: 3982176 - RNA, 18 nt, Human herpesvirus 5
cgcagcgguggcuggaga

SEQ ID NO: 3982177 - RNA, 12 nt, Human herpesvirus 5
cgcagcugcugg

SEQ ID NO: 3982178 - RNA, 15 nt, Human herpesvirus 5
cgcaggucacacugg

SEQ ID NO: 3982179 - RNA, 17 nt, Human herpesvirus 5
cgcagucagacccacua

SEQ ID NO: 3982180 - RNA, 19 nt, Human herpesvirus 5
cgcagugcguggccgcaca

SEQ ID NO: 3982181 - RNA, 17 nt, Human herpesvirus 5
cgcaucacccgccucau

SEQ ID NO: 3982182 - RNA, 14 nt, Human herpesvirus 5
cgcauccugcccac

SEQ ID NO: 3982183 - RNA, 20 nt, Human herpesvirus 5
cgcaucugcaagucccuggc

SEQ ID NO: 3982184 - RNA, 19 nt, Human herpesvirus 5
cgccaacuaccgugccacc

SEQ ID NO: 3982185 - RNA, 18 nt, Human herpesvirus 5
cgccaccauagccacuac

SEQ ID NO: 3982186 - RNA, 21 nt, Human herpesvirus 5
cgccacggugcuuuucaucua

SEQ ID NO: 3982187 - RNA, 12 nt, Human herpesvirus 5
cgccagcgcgag

SEQ ID NO: 3982188 - RNA, 22 nt, Human herpesvirus 5
cgccagcgcggucgccaccugg

SEQ ID NO: 3982189 - RNA, 14 nt, Human herpesvirus 5
cgccagcguccgcg

SEQ ID NO: 3982190 - RNA, 16 nt, Human herpesvirus 5
cgcccgguaggucagc

SEQ ID NO: 3982191 - RNA, 15 nt, Human herpesvirus 5
cgccgaggcuacugc

SEQ ID NO: 3982192 - RNA, 23 nt, Human herpesvirus 5
cgccgaggcuacugcugcuucug

SEQ ID NO: 3982193 - RNA, 17 nt, Human herpesvirus 5
cgccgauagaggcgaca

SEQ ID NO: 3982194 - RNA, 23 nt, Human herpesvirus 5
cgccgccgaagccuggggcaccu

SEQ ID NO: 3982195 - RNA, 18 nt, Human herpesvirus 5
cgccgccgaagcuucgcg

SEQ ID NO: 3982196 - RNA, 13 nt, Human herpesvirus 5
cgccgccgucacc

SEQ ID NO: 3982197 - RNA, 16 nt, Human herpesvirus 5
cgccgccuccgcggcc

SEQ ID NO: 3982198 - RNA, 14 nt, Human herpesvirus 5
cgccgcgacaacgg

SEQ ID NO: 3982199 - RNA, 13 nt, Human herpesvirus 5
cgccgcucagguc

SEQ ID NO: 3982200 - RNA, 17 nt, Human herpesvirus 5
cgccgcucaggucgccc

SEQ ID NO: 3982201 - RNA, 15 nt, Human herpesvirus 5
cgccggacgagcugg

SEQ ID NO: 3982202 - RNA, 15 nt, Human herpesvirus 5
cgccggcgggcggcu

SEQ ID NO: 3982203 - RNA, 17 nt, Human herpesvirus 5
cgccggcuugcuccucu

SEQ ID NO: 3982204 - RNA, 21 nt, Human herpesvirus 5
cgccguacggcaacgagcagg

SEQ ID NO: 3982205 - RNA, 13 nt, Human herpesvirus 5
cgccgucacuucc

SEQ ID NO: 3982206 - RNA, 13 nt, Human herpesvirus 5
cgccguccugcag

SEQ ID NO: 3982207 - RNA, 19 nt, Human herpesvirus 5
cgccgucucgucacacggc

SEQ ID NO: 3982208 - RNA, 18 nt, Human herpesvirus 5
cgccguguguuaccgccg

SEQ ID NO: 3982209 - RNA, 18 nt, Human herpesvirus 5
cgccguucggcucuccuc

SEQ ID NO: 3982210 - RNA, 19 nt, Human herpesvirus 5
cgccguugcggccgccgcu

SEQ ID NO: 3982211 - RNA, 20 nt, Human herpesvirus 5
cgccguuuugcuguccucgu

SEQ ID NO: 3982212 - RNA, 19 nt, Human herpesvirus 5
cgccuaccuuagaccgaca

SEQ ID NO: 3982213 - RNA, 20 nt, Human herpesvirus 5
cgccucauggcggcggccac

SEQ ID NO: 3982214 - RNA, 16 nt, Human herpesvirus 5
cgccuuccuccucugc

SEQ ID NO: 3982215 - RNA, 16 nt, Human herpesvirus 5
cgcgacacacguucga

SEQ ID NO: 3982216 - RNA, 20 nt, Human herpesvirus 5
cgcgaccgggaucacgacga

SEQ ID NO: 3982217 - RNA, 14 nt, Human herpesvirus 5
cgcgagcggcggac

SEQ ID NO: 3982218 - RNA, 22 nt, Human herpesvirus 5
cgcgagcggcggacuuggcagc

SEQ ID NO: 3982219 - RNA, 14 nt, Human herpesvirus 5
cgcgagcuggccag

SEQ ID NO: 3982220 - RNA, 18 nt, Human herpesvirus 5
cgcgagcuggccagcaaa

SEQ ID NO: 3982221 - RNA, 11 nt, Human herpesvirus 5
cgcgagcuggg

SEQ ID NO: 3982222 - RNA, 14 nt, Human herpesvirus 5
cgcgauccgcucac

SEQ ID NO: 3982223 - RNA, 16 nt, Human herpesvirus 5
cgcgcaagugccugca

SEQ ID NO: 3982224 - RNA, 15 nt, Human herpesvirus 5
cgcgcagcgcgcuuu

SEQ ID NO: 3982225 - RNA, 16 nt, Human herpesvirus 5
cgcgcaucgccugcac

SEQ ID NO: 3982226 - RNA, 19 nt, Human herpesvirus 5
cgcgccacaacgccguccg

SEQ ID NO: 3982227 - RNA, 16 nt, Human herpesvirus 5
cgcgccacacgcugag

SEQ ID NO: 3982228 - RNA, 22 nt, Human herpesvirus 5
cgcgcccacgguccgggcacaa

SEQ ID NO: 3982229 - RNA, 18 nt, Human herpesvirus 5
cgcgccucacgcugcacg

SEQ ID NO: 3982230 - RNA, 19 nt, Human herpesvirus 5
cgcgccucacgcugcacga

SEQ ID NO: 3982231 - RNA, 12 nt, Human herpesvirus 5
cgcgcgaccgcg

SEQ ID NO: 3982232 - RNA, 13 nt, Human herpesvirus 5
cgcgcgcccgcgc

SEQ ID NO: 3982233 - RNA, 22 nt, Human herpesvirus 5
cgcgcgucuggucaacugcgug

SEQ ID NO: 3982234 - RNA, 14 nt, Human herpesvirus 5
cgcgcugcuccucg

SEQ ID NO: 3982235 - RNA, 16 nt, Human herpesvirus 5
cgcgcugcuccucgga

SEQ ID NO: 3982236 - RNA, 14 nt, Human herpesvirus 5
cgcgcuuuugaccg

SEQ ID NO: 3982237 - RNA, 16 nt, Human herpesvirus 5
cgcggaaacgacggac

SEQ ID NO: 3982238 - RNA, 23 nt, Human herpesvirus 5
cgcggaacgagagcgguccgccc

SEQ ID NO: 3982239 - RNA, 15 nt, Human herpesvirus 5
cgcggaggacagcaa

SEQ ID NO: 3982240 - RNA, 13 nt, Human herpesvirus 5
cgcggccgucacg

SEQ ID NO: 3982241 - RNA, 19 nt, Human herpesvirus 5
cgcggccugcugcgcaaua

SEQ ID NO: 3982242 - RNA, 15 nt, Human herpesvirus 5
cgcggcgacgggugg

SEQ ID NO: 3982243 - RNA, 14 nt, Human herpesvirus 5
cgcggcgcguuguc

SEQ ID NO: 3982244 - RNA, 14 nt, Human herpesvirus 5
cgcggcgugaccac

SEQ ID NO: 3982245 - RNA, 22 nt, Human herpesvirus 5
cgcggcuacguacgacugcgcg

SEQ ID NO: 3982246 - RNA, 19 nt, Human herpesvirus 5
cgcgguagcgaggcggcaa

SEQ ID NO: 3982247 - RNA, 23 nt, Human herpesvirus 5
cgcgguggcggccgcagaaggcc

SEQ ID NO: 3982248 - RNA, 14 nt, Human herpesvirus 5
cgcgguuaagggag

SEQ ID NO: 3982249 - RNA, 16 nt, Human herpesvirus 5
cgcgguuucgccgccg

SEQ ID NO: 3982250 - RNA, 18 nt, Human herpesvirus 5
cgcguagccaccuguugg

SEQ ID NO: 3982251 - RNA, 16 nt, Human herpesvirus 5
cgcguagcgcuccugg

SEQ ID NO: 3982252 - RNA, 21 nt, Human herpesvirus 5
cgcgucccaccccccgggcca

SEQ ID NO: 3982253 - RNA, 23 nt, Human herpesvirus 5
cgcgucgcuucgccgccaccuuc

SEQ ID NO: 3982254 - RNA, 20 nt, Human herpesvirus 5
cgcgucggcguaacaacggc

SEQ ID NO: 3982255 - RNA, 17 nt, Human herpesvirus 5
cgcgugcacgcgcugcu

SEQ ID NO: 3982256 - RNA, 15 nt, Human herpesvirus 5
cgcgugccugggaac

SEQ ID NO: 3982257 - RNA, 19 nt, Human herpesvirus 5
cgcguguaggcgacuggcu

SEQ ID NO: 3982258 - RNA, 13 nt, Human herpesvirus 5
cgcgugucccugc

SEQ ID NO: 3982259 - RNA, 14 nt, Human herpesvirus 5
cgcuaagagcuuug

SEQ ID NO: 3982260 - RNA, 19 nt, Human herpesvirus 5
cgcuacgucggccaacaac

SEQ ID NO: 3982261 - RNA, 18 nt, Human herpesvirus 5
cgcuacugaucgccugga

SEQ ID NO: 3982262 - RNA, 15 nt, Human herpesvirus 5
cgcuauggcggccau

SEQ ID NO: 3982263 - RNA, 12 nt, Human herpesvirus 5
cgcucacagucu

SEQ ID NO: 3982264 - RNA, 23 nt, Human herpesvirus 5
cgcucacagucuaucccuauggc

SEQ ID NO: 3982265 - RNA, 16 nt, Human herpesvirus 5
cgcucagcgagcucgu

SEQ ID NO: 3982266 - RNA, 18 nt, Human herpesvirus 5
cgcucgugaaacagcagc

SEQ ID NO: 3982267 - RNA, 20 nt, Human herpesvirus 5
cgcucucgucaggcuuguca

SEQ ID NO: 3982268 - RNA, 16 nt, Human herpesvirus 5
cgcucugacgccgcgc

SEQ ID NO: 3982269 - RNA, 15 nt, Human herpesvirus 5
cgcucugccggcugc

SEQ ID NO: 3982270 - RNA, 20 nt, Human herpesvirus 5
cgcugacguugaugcggcgc

SEQ ID NO: 3982271 - RNA, 18 nt, Human herpesvirus 5
cgcugauaacgacguggu

SEQ ID NO: 3982272 - RNA, 13 nt, Human herpesvirus 5
cgcugcccgacca

SEQ ID NO: 3982273 - RNA, 20 nt, Human herpesvirus 5
cgcugcuucauccagcuccg

SEQ ID NO: 3982274 - RNA, 21 nt, Human herpesvirus 5
cgcugcuuucgcacgcaccug

SEQ ID NO: 3982275 - RNA, 15 nt, Human herpesvirus 5
cgcuggaggccuccu

SEQ ID NO: 3982276 - RNA, 23 nt, Human herpesvirus 5
cgcugguggccgaacagcagcuc

SEQ ID NO: 3982277 - RNA, 18 nt, Human herpesvirus 5
cgcuucaacgccugcacc

SEQ ID NO: 3982278 - RNA, 17 nt, Human herpesvirus 5
cgcuuccucagcuugcc

SEQ ID NO: 3982279 - RNA, 15 nt, Human herpesvirus 5
cgcuucggcacccca

SEQ ID NO: 3982280 - RNA, 18 nt, Human herpesvirus 5
cgcuucugcagcuccgcg

SEQ ID NO: 3982281 - RNA, 15 nt, Human herpesvirus 5
cgcuuucccaccgcg

SEQ ID NO: 3982282 - RNA, 12 nt, Human herpesvirus 5
cggaagaagaag

SEQ ID NO: 3982283 - RNA, 17 nt, Human herpesvirus 5
cggaaguuccgacgcga

SEQ ID NO: 3982284 - RNA, 17 nt, Human herpesvirus 5
cggaggagucugucgac

SEQ ID NO: 3982285 - RNA, 18 nt, Human herpesvirus 5
cggaggcgggguguuuuu

SEQ ID NO: 3982286 - RNA, 13 nt, Human herpesvirus 5
cggaucuacucau

SEQ ID NO: 3982287 - RNA, 21 nt, Human herpesvirus 5
cggauggcuuuugcgucgccc

SEQ ID NO: 3982288 - RNA, 17 nt, Human herpesvirus 5
cggcaagccgagcggga

SEQ ID NO: 3982289 - RNA, 21 nt, Human herpesvirus 5
cggcagauuuguucgggguga

SEQ ID NO: 3982290 - RNA, 14 nt, Human herpesvirus 5
cggcagccacggag

SEQ ID NO: 3982291 - RNA, 23 nt, Human herpesvirus 5
cggcagcuaucgugacugggagu

SEQ ID NO: 3982292 - RNA, 19 nt, Human herpesvirus 5
cggcagucuuuuccgugac

SEQ ID NO: 3982293 - RNA, 23 nt, Human herpesvirus 5
cggcauacaaugugcugcaugag

SEQ ID NO: 3982294 - RNA, 15 nt, Human herpesvirus 5
cggcauagugccagc

SEQ ID NO: 3982295 - RNA, 19 nt, Human herpesvirus 5
cggcaugccguuggcggcg

SEQ ID NO: 3982296 - RNA, 21 nt, Human herpesvirus 5
cggccaacaugcccagcaucu

SEQ ID NO: 3982297 - RNA, 21 nt, Human herpesvirus 5
cggcccucucgcgcccgcaga

SEQ ID NO: 3982298 - RNA, 13 nt, Human herpesvirus 5
cggccgaccccgc

SEQ ID NO: 3982299 - RNA, 22 nt, Human herpesvirus 5
cggccgcccguguccgugauga

SEQ ID NO: 3982300 - RNA, 13 nt, Human herpesvirus 5
cggccgccgcagc

SEQ ID NO: 3982301 - RNA, 15 nt, Human herpesvirus 5
cggccgcggaggugc

SEQ ID NO: 3982302 - RNA, 13 nt, Human herpesvirus 5
cggccgcggugcg

SEQ ID NO: 3982303 - RNA, 22 nt, Human herpesvirus 5
cggccgucacgacgcuccgucg

SEQ ID NO: 3982304 - RNA, 22 nt, Human herpesvirus 5
cggccgucgcaagggcugcucg

SEQ ID NO: 3982305 - RNA, 15 nt, Human herpesvirus 5
cggccgucuccacca

SEQ ID NO: 3982306 - RNA, 15 nt, Human herpesvirus 5
cggccgugguggccg

SEQ ID NO: 3982307 - RNA, 18 nt, Human herpesvirus 5
cggccgugguggccgugc

SEQ ID NO: 3982308 - RNA, 13 nt, Human herpesvirus 5
cggccugagcgcg

SEQ ID NO: 3982309 - RNA, 17 nt, Human herpesvirus 5
cggccuugcgcucccug

SEQ ID NO: 3982310 - RNA, 13 nt, Human herpesvirus 5
cggcgacaucacg

SEQ ID NO: 3982311 - RNA, 15 nt, Human herpesvirus 5
cggcgauaaccgccg

SEQ ID NO: 3982312 - RNA, 23 nt, Human herpesvirus 5
cggcgauggcggggcugguugcu

SEQ ID NO: 3982313 - RNA, 15 nt, Human herpesvirus 5
cggcgcccgggccgc

SEQ ID NO: 3982314 - RNA, 16 nt, Human herpesvirus 5
cggcgccggcgccugg

SEQ ID NO: 3982315 - RNA, 16 nt, Human herpesvirus 5
cggcgccgucagagca

SEQ ID NO: 3982316 - RNA, 12 nt, Human herpesvirus 5
cggcgccguccg

SEQ ID NO: 3982317 - RNA, 21 nt, Human herpesvirus 5
cggcgcguuguccucgcaccg

SEQ ID NO: 3982318 - RNA, 19 nt, Human herpesvirus 5
cggcgcugacagcccaagg

SEQ ID NO: 3982319 - RNA, 19 nt, Human herpesvirus 5
cggcgcuguacggcagcgg

SEQ ID NO: 3982320 - RNA, 15 nt, Human herpesvirus 5
cggcgcuucgagggc

SEQ ID NO: 3982321 - RNA, 15 nt, Human herpesvirus 5
cggcggcggugguga

SEQ ID NO: 3982322 - RNA, 21 nt, Human herpesvirus 5
cggcggcgugaccggcggugc

SEQ ID NO: 3982323 - RNA, 16 nt, Human herpesvirus 5
cggcgugacacagcac

SEQ ID NO: 3982324 - RNA, 17 nt, Human herpesvirus 5
cggcgugauugcaaagc

SEQ ID NO: 3982325 - RNA, 12 nt, Human herpesvirus 5
cggcguggucaa

SEQ ID NO: 3982326 - RNA, 15 nt, Human herpesvirus 5
cggcucaccacgcag

SEQ ID NO: 3982327 - RNA, 23 nt, Human herpesvirus 5
cggcuccaagugcaagcgccgcg

SEQ ID NO: 3982328 - RNA, 12 nt, Human herpesvirus 5
cggcucucaggc

SEQ ID NO: 3982329 - RNA, 15 nt, Human herpesvirus 5
cggcugcuguugcac

SEQ ID NO: 3982330 - RNA, 13 nt, Human herpesvirus 5
cggcugucauggg

SEQ ID NO: 3982331 - RNA, 17 nt, Human herpesvirus 5
cggcuguggcuucucug

SEQ ID NO: 3982332 - RNA, 14 nt, Human herpesvirus 5
cggcuugcaaaacu

SEQ ID NO: 3982333 - RNA, 14 nt, Human herpesvirus 5
cggcuugggcagca

SEQ ID NO: 3982334 - RNA, 14 nt, Human herpesvirus 5
cgggaacuggccug

SEQ ID NO: 3982335 - RNA, 15 nt, Human herpesvirus 5
cgggacccgccgccg

SEQ ID NO: 3982336 - RNA, 22 nt, Human herpesvirus 5
cgggacgauauaaagaggcacg

SEQ ID NO: 3982337 - RNA, 16 nt, Human herpesvirus 5
cgggacggccugggcg

SEQ ID NO: 3982338 - RNA, 17 nt, Human herpesvirus 5
cgggcacguucuuucca

SEQ ID NO: 3982339 - RNA, 17 nt, Human herpesvirus 5
cgggccgcgcuccaggc

SEQ ID NO: 3982340 - RNA, 22 nt, Human herpesvirus 5
cgggccgcgcuccaggcggaga

SEQ ID NO: 3982341 - RNA, 16 nt, Human herpesvirus 5
cgggccucggcuuggc

SEQ ID NO: 3982342 - RNA, 17 nt, Human herpesvirus 5
cgggcguuggccugugg

SEQ ID NO: 3982343 - RNA, 23 nt, Human herpesvirus 5
cgggcucguguggcagcuggcuu

SEQ ID NO: 3982344 - RNA, 17 nt, Human herpesvirus 5
cgggcuuuuuugucccg

SEQ ID NO: 3982345 - RNA, 17 nt, Human herpesvirus 5
cgggugccgggacagcg

SEQ ID NO: 3982346 - RNA, 23 nt, Human herpesvirus 5
cucgcguguuuugucugagcgcc

SEQ ID NO: 3982347 - RNA, 23 nt, Human herpesvirus 5
cucggcgugcucaggccacccgc

SEQ ID NO: 3982348 - RNA, 16 nt, Human herpesvirus 5
cucggguuccucggcc

SEQ ID NO: 3982349 - RNA, 20 nt, Human herpesvirus 5
cucggucaacgcguccagcu

SEQ ID NO: 3982350 - RNA, 15 nt, Human herpesvirus 5
cucgucgccagcgcg

SEQ ID NO: 3982351 - RNA, 16 nt, Human herpesvirus 5
cucguguggcagcugg

SEQ ID NO: 3982352 - RNA, 15 nt, Human herpesvirus 5
cucguucccagcgcg

SEQ ID NO: 3982353 - RNA, 17 nt, Human herpesvirus 5
cucguuguccucuccuc

SEQ ID NO: 3982354 - RNA, 16 nt, Human herpesvirus 5
cucuaccgcgacggcg

SEQ ID NO: 3982355 - RNA, 18 nt, Human herpesvirus 5
cucucuauccgguggcgc

SEQ ID NO: 3982356 - RNA, 15 nt, Human herpesvirus 5
cucugcaacgccugg

SEQ ID NO: 3982357 - RNA, 12 nt, Human herpesvirus 5
cucugcugcugg

SEQ ID NO: 3982358 - RNA, 16 nt, Human herpesvirus 5
cucuggcccugcugua

SEQ ID NO: 3982359 - RNA, 18 nt, Human herpesvirus 5
cucuugcgcuucugcagc

SEQ ID NO: 3982360 - RNA, 23 nt, Human herpesvirus 5
cugaacaauaaacuaaaacauuc

SEQ ID NO: 3982361 - RNA, 22 nt, Human herpesvirus 5
cugaagccgccgucgagccacu

SEQ ID NO: 3982362 - RNA, 14 nt, Human herpesvirus 5
cugaaucugcucca

SEQ ID NO: 3982363 - RNA, 14 nt, Human herpesvirus 5
cugacgcuggaaac

SEQ ID NO: 3982364 - RNA, 23 nt, Human herpesvirus 5
cugagccggggugccgccgcugc

SEQ ID NO: 3982365 - RNA, 20 nt, Human herpesvirus 5
cugaugccgaucaugugcuu

SEQ ID NO: 3982366 - RNA, 15 nt, Human herpesvirus 5
cugauguaccugcag

SEQ ID NO: 3982367 - RNA, 17 nt, Human herpesvirus 5
cugcaacgccuggcgug

SEQ ID NO: 3982368 - RNA, 13 nt, Human herpesvirus 5
cugcaccagcaac

SEQ ID NO: 3982369 - RNA, 17 nt, Human herpesvirus 5
cugcacgaccugcucca

SEQ ID NO: 3982370 - RNA, 19 nt, Human herpesvirus 5
cugcacgaccugcuccagu

SEQ ID NO: 3982371 - RNA, 22 nt, Human herpesvirus 5
cugccaacgccgucaaggccgc

SEQ ID NO: 3982372 - RNA, 22 nt, Human herpesvirus 5
cugcccuuuacggugcugcguc

SEQ ID NO: 3982373 - RNA, 14 nt, Human herpesvirus 5
cugccgcacgcgcu

SEQ ID NO: 3982374 - RNA, 19 nt, Human herpesvirus 5
cugccgcuacugaucgccu

SEQ ID NO: 3982375 - RNA, 20 nt, Human herpesvirus 5
cugccggcauguccggccgu

SEQ ID NO: 3982376 - RNA, 17 nt, Human herpesvirus 5
cugccucuccuccgucg

SEQ ID NO: 3982377 - RNA, 14 nt, Human herpesvirus 5
cugccugccgcacg

SEQ ID NO: 3982378 - RNA, 13 nt, Human herpesvirus 5
cugccuguuccug

SEQ ID NO: 3982379 - RNA, 18 nt, Human herpesvirus 5
cugccuguuccugcugcu

SEQ ID NO: 3982380 - RNA, 18 nt, Human herpesvirus 5
cugccuuacggcgaccgu

SEQ ID NO: 3982381 - RNA, 13 nt, Human herpesvirus 5
cugcgcgggcagc

SEQ ID NO: 3982382 - RNA, 14 nt, Human herpesvirus 5
cugcgcgggcagcc

SEQ ID NO: 3982383 - RNA, 22 nt, Human herpesvirus 5
cugcggaaugauuuggcugggu

SEQ ID NO: 3982384 - RNA, 18 nt, Human herpesvirus 5
cugcggacgccgacggcc

SEQ ID NO: 3982385 - RNA, 20 nt, Human herpesvirus 5
cugcggcggcuugggcagca

SEQ ID NO: 3982386 - RNA, 20 nt, Human herpesvirus 5
cugcgggcccacgguacgcc

SEQ ID NO: 3982387 - RNA, 14 nt, Human herpesvirus 5
cugcgggucauggg

SEQ ID NO: 3982388 - RNA, 17 nt, Human herpesvirus 5
cugcuauaagaaggcca

SEQ ID NO: 3982389 - RNA, 19 nt, Human herpesvirus 5
cugcucaaaguacuugucg

SEQ ID NO: 3982390 - RNA, 20 nt, Human herpesvirus 5
cugcugagacugagacuggu

SEQ ID NO: 3982391 - RNA, 20 nt, Human herpesvirus 5
cugcugcuacgcgguccguc

SEQ ID NO: 3982392 - RNA, 14 nt, Human herpesvirus 5
cugcuugcuggcuu

SEQ ID NO: 3982393 - RNA, 16 nt, Human herpesvirus 5
cugcuuuucgggccgc

SEQ ID NO: 3982394 - RNA, 22 nt, Human herpesvirus 5
cugcuuuuuugucuccugugga

SEQ ID NO: 3982395 - RNA, 15 nt, Human herpesvirus 5
cuggaagcugcuggu

SEQ ID NO: 3982396 - RNA, 22 nt, Human herpesvirus 5
cuggaccggugguacugcugug

SEQ ID NO: 3982397 - RNA, 21 nt, Human herpesvirus 5
cuggacgcggugaacgugcgc

SEQ ID NO: 3982398 - RNA, 19 nt, Human herpesvirus 5
cuggagaacaauaaagcgu

SEQ ID NO: 3982399 - RNA, 21 nt, Human herpesvirus 5
cuggaggacgcgcuggcuguc

SEQ ID NO: 3982400 - RNA, 16 nt, Human herpesvirus 5
cuggaucuuggcggcc

SEQ ID NO: 3982401 - RNA, 17 nt, Human herpesvirus 5
cuggccgccgcugcacg

SEQ ID NO: 3982402 - RNA, 13 nt, Human herpesvirus 5
cuggcggccgugg

SEQ ID NO: 3982403 - RNA, 21 nt, Human herpesvirus 5
cuggcguucaccacgccggcc

SEQ ID NO: 3982404 - RNA, 15 nt, Human herpesvirus 5
cugggcuacaagugc

SEQ ID NO: 3982405 - RNA, 22 nt, Human herpesvirus 5
cuggggucaaaagccuggguac

SEQ ID NO: 3982406 - RNA, 17 nt, Human herpesvirus 5
cugguauaaccagucau

SEQ ID NO: 3982407 - RNA, 13 nt, Human herpesvirus 5
cugucaccaccac

SEQ ID NO: 3982408 - RNA, 14 nt, Human herpesvirus 5
cugucugcagccgg

SEQ ID NO: 3982409 - RNA, 18 nt, Human herpesvirus 5
cuguggcuucucuggaga

SEQ ID NO: 3982410 - RNA, 23 nt, Human herpesvirus 5
cugugguguugccuucugcugcc

SEQ ID NO: 3982411 - RNA, 18 nt, Human herpesvirus 5
cuguguuauucagaacca

SEQ ID NO: 3982412 - RNA, 23 nt, Human herpesvirus 5
cuguuacugaaucuucuuuucau

SEQ ID NO: 3982413 - RNA, 20 nt, Human herpesvirus 5
cuguuugaauaccguaaaca

SEQ ID NO: 3982414 - RNA, 15 nt, Human herpesvirus 5
cuuacaaaucacguu

SEQ ID NO: 3982415 - RNA, 13 nt, Human herpesvirus 5
cuuaccggggacc

SEQ ID NO: 3982416 - RNA, 14 nt, Human herpesvirus 5
cuuagcuuucuuga

SEQ ID NO: 3982417 - RNA, 12 nt, Human herpesvirus 5
cuuauguuucug

SEQ ID NO: 3982418 - RNA, 14 nt, Human herpesvirus 5
cuuauucuagcccu

SEQ ID NO: 3982419 - RNA, 14 nt, Human herpesvirus 5
cuucacgccccuga

SEQ ID NO: 3982420 - RNA, 16 nt, Human herpesvirus 5
cuucagaaucuauaaa

SEQ ID NO: 3982421 - RNA, 13 nt, Human herpesvirus 5
cuucggagguccu

SEQ ID NO: 3982422 - RNA, 15 nt, Human herpesvirus 5
cuucggccggcugcu

SEQ ID NO: 3982423 - RNA, 18 nt, Human herpesvirus 5
cuucggccggcugcugca

SEQ ID NO: 3982424 - RNA, 13 nt, Human herpesvirus 5
cuucugcagcucc

SEQ ID NO: 3982425 - RNA, 14 nt, Human herpesvirus 5
cuucugcagcuccg

SEQ ID NO: 3982426 - RNA, 19 nt, Human herpesvirus 5
cuucuggagcacacugcua

SEQ ID NO: 3982427 - RNA, 20 nt, Human herpesvirus 5
cuucuuugccggcucuccuc

SEQ ID NO: 3982428 - RNA, 15 nt, Human herpesvirus 5
cuugacgcugcuggc

SEQ ID NO: 3982429 - RNA, 16 nt, Human herpesvirus 5
cuugagaaccugcuca

SEQ ID NO: 3982430 - RNA, 13 nt, Human herpesvirus 5
cuugcgcucccug

SEQ ID NO: 3982431 - RNA, 20 nt, Human herpesvirus 5
cuugcgcucggucagcuuga

SEQ ID NO: 3982432 - RNA, 19 nt, Human herpesvirus 5
cuugcggcgccgacuccuu

SEQ ID NO: 3982433 - RNA, 20 nt, Human herpesvirus 5
cuuggcggccgagucuccgc

SEQ ID NO: 3982434 - RNA, 20 nt, Human herpesvirus 5
cuuggguagcuucucucugg

SEQ ID NO: 3982435 - RNA, 18 nt, Human herpesvirus 5
cuuguucucgaccacgua

SEQ ID NO: 3982436 - RNA, 21 nt, Human herpesvirus 5
cuuucacaccgauuuucgcgg

SEQ ID NO: 3982437 - RNA, 22 nt, Human herpesvirus 5
cuuucaugaugacggugaggag

SEQ ID NO: 3982438 - RNA, 18 nt, Human herpesvirus 5
cuuugagcacaaacugcg

SEQ ID NO: 3982439 - RNA, 18 nt, Human herpesvirus 5
cuuuguagcgcucaaagg

SEQ ID NO: 3982440 - RNA, 19 nt, Human herpesvirus 5
cuuuuggugcgccacguag

SEQ ID NO: 3982441 - RNA, 11 nt, Human herpesvirus 5
cuuuuugcaaa

SEQ ID NO: 3982442 - RNA, 17 nt, Human herpesvirus 5
gaaaaaggguuucaagu

SEQ ID NO: 3982443 - RNA, 20 nt, Human herpesvirus 5
gaaaacgccggacgagcugg

SEQ ID NO: 3982444 - RNA, 22 nt, Human herpesvirus 5
gaaaacguacgugaucacggac

SEQ ID NO: 3982445 - RNA, 14 nt, Human herpesvirus 5
gaaacagcagcucg

SEQ ID NO: 3982446 - RNA, 22 nt, Human herpesvirus 5
gaaacuacgugcaacggcgacg

SEQ ID NO: 3982447 - RNA, 22 nt, Human herpesvirus 5
gaaagugauuauaucuuucuac

SEQ ID NO: 3982448 - RNA, 16 nt, Human herpesvirus 5
gaaaguuggcugcgcc

SEQ ID NO: 3982449 - RNA, 17 nt, Human herpesvirus 5
gaacaccagaugcuccc

SEQ ID NO: 3982450 - RNA, 15 nt, Human herpesvirus 5
gaaccgccgucgccg

SEQ ID NO: 3982451 - RNA, 21 nt, Human herpesvirus 5
gaaccgcucauauagaccaaa

SEQ ID NO: 3982452 - RNA, 14 nt, Human herpesvirus 5
gaacucagaggcca

SEQ ID NO: 3982453 - RNA, 18 nt, Human herpesvirus 5
gaacuggccuggcggcgg

SEQ ID NO: 3982454 - RNA, 23 nt, Human herpesvirus 5
gaacugguuuucggacagagcag

SEQ ID NO: 3982455 - RNA, 15 nt, Human herpesvirus 5
gaacuugagcacaaa

SEQ ID NO: 3982456 - RNA, 19 nt, Human herpesvirus 5
gaagacgccgucacgcagg

SEQ ID NO: 3982457 - RNA, 15 nt, Human herpesvirus 5
gaagcugcgcaggcc

SEQ ID NO: 3982458 - RNA, 22 nt, Human herpesvirus 5
gaaggcggcucgcuggaagccg

SEQ ID NO: 3982459 - RNA, 14 nt, Human herpesvirus 5
gaagggugugacug

SEQ ID NO: 3982460 - RNA, 12 nt, Human herpesvirus 5
gaugcaggaggu

SEQ ID NO: 3982461 - RNA, 12 nt, Human herpesvirus 5
gaugcgcacggc

SEQ ID NO: 3982462 - RNA, 15 nt, Human herpesvirus 5
gaugcuauccgcugc

SEQ ID NO: 3982463 - RNA, 20 nt, Human herpesvirus 5
gaugcuauccgcugcgacua

SEQ ID NO: 3982464 - RNA, 14 nt, Human herpesvirus 5
gauguaguugcaga

SEQ ID NO: 3982465 - RNA, 17 nt, Human herpesvirus 5
gaugugaguuucugugu

SEQ ID NO: 3982466 - RNA, 16 nt, Human herpesvirus 5
gcugcauaaagggcga

SEQ ID NO: 3982467 - RNA, 14 nt, Human herpesvirus 5
gcugccuguuccug

SEQ ID NO: 3982468 - RNA, 18 nt, Human herpesvirus 5
gcugccuguuccugcugc

SEQ ID NO: 3982469 - RNA, 18 nt, Human herpesvirus 5
gcugcgaagaugcuaucc

SEQ ID NO: 3982470 - RNA, 22 nt, Human herpesvirus 5
gcugcuagaugaccauguucag

SEQ ID NO: 3982471 - RNA, 22 nt, Human herpesvirus 5
gcugcucaaugccaccaugaac

SEQ ID NO: 3982472 - RNA, 22 nt, Human herpesvirus 5
gcugcuccucggagcacgggcg

SEQ ID NO: 3982473 - RNA, 14 nt, Human herpesvirus 5
gcugcugcacgggc

SEQ ID NO: 3982474 - RNA, 20 nt, Human herpesvirus 5
gcugcugcacgggcucgacc

SEQ ID NO: 3982475 - RNA, 18 nt, Human herpesvirus 5
gcugcuuaaugacagcga

SEQ ID NO: 3982476 - RNA, 22 nt, Human herpesvirus 5
gcuggaaguggaagcggugcug

SEQ ID NO: 3982477 - RNA, 17 nt, Human herpesvirus 5
gcuggccagcaaagugg

SEQ ID NO: 3982478 - RNA, 17 nt, Human herpesvirus 5
gcuggcgguauggcugc

SEQ ID NO: 3982479 - RNA, 17 nt, Human herpesvirus 5
gcuggcuuuccucgggc

SEQ ID NO: 3982480 - RNA, 21 nt, Human herpesvirus 5
gcuggugaucggccgcggugc

SEQ ID NO: 3982481 - RNA, 15 nt, Human herpesvirus 5
gcugguguugccgca

SEQ ID NO: 3982482 - RNA, 15 nt, Human herpesvirus 5
gcugguuuccccugc

SEQ ID NO: 3982483 - RNA, 13 nt, Human herpesvirus 5
gcuguaugggcag

SEQ ID NO: 3982484 - RNA, 22 nt, Human herpesvirus 5
gcugucccuuaucccguuacaa

SEQ ID NO: 3982485 - RNA, 20 nt, Human herpesvirus 5
gcugucuguuugucugugcg

SEQ ID NO: 3982486 - RNA, 15 nt, Human herpesvirus 5
gcugugcaacgcgug

SEQ ID NO: 3982487 - RNA, 17 nt, Human herpesvirus 5
gcuguggcuucucugga

SEQ ID NO: 3982488 - RNA, 18 nt, Human herpesvirus 5
gcuguuguugacgcugcu

SEQ ID NO: 3982489 - RNA, 17 nt, Human herpesvirus 5
gcuuaaagaugucgaug

SEQ ID NO: 3982490 - RNA, 18 nt, Human herpesvirus 5
gcuuaaaggcgcacuugu

SEQ ID NO: 3982491 - RNA, 20 nt, Human herpesvirus 5
gcuuacccuucaauuuccac

SEQ ID NO: 3982492 - RNA, 15 nt, Human herpesvirus 5
gcuuacugccugccg

SEQ ID NO: 3982493 - RNA, 17 nt, Human herpesvirus 5
gcuuaucugccucuucc

SEQ ID NO: 3982494 - RNA, 16 nt, Human herpesvirus 5
gcuucccuccugcagc

SEQ ID NO: 3982495 - RNA, 12 nt, Human herpesvirus 5
gcuucgccgcca

SEQ ID NO: 3982496 - RNA, 18 nt, Human herpesvirus 5
gcuucggccggcugcugc

SEQ ID NO: 3982497 - RNA, 14 nt, Human herpesvirus 5
gcuucugcagcucc

SEQ ID NO: 3982498 - RNA, 16 nt, Human herpesvirus 5
gccugguauacgaggc

SEQ ID NO: 3982499 - RNA, 14 nt, Human herpesvirus 5
gccuguggcaccgc

SEQ ID NO: 3982500 - RNA, 23 nt, Human herpesvirus 5
gccuguggugcgacugcggcgac

SEQ ID NO: 3982501 - RNA, 20 nt, Human herpesvirus 5
gccuuccagcuuaccgccac

SEQ ID NO: 3982502 - RNA, 16 nt, Human herpesvirus 5
gccuuccgcgugcucc

SEQ ID NO: 3982503 - RNA, 21 nt, Human herpesvirus 5
gccuucgcaaugucucaggca

SEQ ID NO: 3982504 - RNA, 23 nt, Human herpesvirus 5
gccuuuuuaauaaagucuggguu

SEQ ID NO: 3982505 - RNA, 23 nt, Human herpesvirus 5
gcgaaagcuucggccggcugcug

SEQ ID NO: 3982506 - RNA, 19 nt, Human herpesvirus 5
gcgaagcugcgcaggccgc

SEQ ID NO: 3982507 - RNA, 20 nt, Human herpesvirus 5
gcgacacacguucgacaugg

SEQ ID NO: 3982508 - RNA, 21 nt, Human herpesvirus 5
gcgacauuuugggucagcggc

SEQ ID NO: 3982509 - RNA, 23 nt, Human herpesvirus 5
gcgaccgccucaaaaagcaggug

SEQ ID NO: 3982510 - RNA, 20 nt, Human herpesvirus 5
gcgacgauaggucgaaagcc

SEQ ID NO: 3982511 - RNA, 13 nt, Human herpesvirus 5
gcgacggcagcgc

SEQ ID NO: 3982512 - RNA, 14 nt, Human herpesvirus 5
gcgacggguggcag

SEQ ID NO: 3982513 - RNA, 21 nt, Human herpesvirus 5
gcgacugcggcgacuggcgag

SEQ ID NO: 3982514 - RNA, 16 nt, Human herpesvirus 5
gcgagagaugggccgc

SEQ ID NO: 3982515 - RNA, 23 nt, Human herpesvirus 5
gcgagagcacugacagggguggc

SEQ ID NO: 3982516 - RNA, 18 nt, Human herpesvirus 5
gcgagccccaucgggccc

SEQ ID NO: 3982517 - RNA, 20 nt, Human herpesvirus 5
gcgagcggcggacuuggcag

SEQ ID NO: 3982518 - RNA, 16 nt, Human herpesvirus 5
gcgaguaucgggccgu

SEQ ID NO: 3982519 - RNA, 21 nt, Human herpesvirus 5
gcgccaguugucgcaggucca

SEQ ID NO: 3982520 - RNA, 16 nt, Human herpesvirus 5
gcgcccgacagcugca

SEQ ID NO: 3982521 - RNA, 22 nt, Human herpesvirus 5
gcgcccgagacggcggcauccu

SEQ ID NO: 3982522 - RNA, 13 nt, Human herpesvirus 5
gcgcccgcagaca

SEQ ID NO: 3982523 - RNA, 19 nt, Human herpesvirus 5
gcgccgccaacgcgagcug

SEQ ID NO: 3982524 - RNA, 15 nt, Human herpesvirus 5
gcgccgccgacucgc

SEQ ID NO: 3982525 - RNA, 13 nt, Human herpesvirus 5
gcgccgccuggag

SEQ ID NO: 3982526 - RNA, 16 nt, Human herpesvirus 5
gcgccguaguucuccg

SEQ ID NO: 3982527 - RNA, 14 nt, Human herpesvirus 5
gcgccgucagagca

SEQ ID NO: 3982528 - RNA, 19 nt, Human herpesvirus 5
gcgccgucucuucgcgccc

SEQ ID NO: 3982529 - RNA, 20 nt, Human herpesvirus 5
gcgccgugcucagcggcgug

SEQ ID NO: 3982530 - RNA, 14 nt, Human herpesvirus 5
gcgccuuccuccuc

SEQ ID NO: 3982531 - RNA, 20 nt, Human herpesvirus 5
gcgccuuuaagcuggaccug

SEQ ID NO: 3982532 - RNA, 15 nt, Human herpesvirus 5
gcaacagcagccacc

SEQ ID NO: 3982533 - RNA, 23 nt, Human herpesvirus 5
gcaacgcguggcccuggucuggc

SEQ ID NO: 3982534 - RNA, 16 nt, Human herpesvirus 5
gcaacggcaucauguu

SEQ ID NO: 3982535 - RNA, 14 nt, Human herpesvirus 5
gcaacucgguguug

SEQ ID NO: 3982536 - RNA, 17 nt, Human herpesvirus 5
gcaacuuaacgcgcaag

SEQ ID NO: 3982537 - RNA, 16 nt, Human herpesvirus 5
gcaagcagucaaaaaa

SEQ ID NO: 3982538 - RNA, 21 nt, Human herpesvirus 5
gcaaggccucuaucugcgcca

SEQ ID NO: 3982539 - RNA, 18 nt, Human herpesvirus 5
gcaauaaucccuguaauu

SEQ ID NO: 3982540 - RNA, 13 nt, Human herpesvirus 5
gcaaugacaugga

SEQ ID NO: 3982541 - RNA, 17 nt, Human herpesvirus 5
gcacaaacugcgacacg

SEQ ID NO: 3982542 - RNA, 19 nt, Human herpesvirus 5
gcacaacugguuccugcag

SEQ ID NO: 3982543 - RNA, 21 nt, Human herpesvirus 5
gcacauuagacacacgggggc

SEQ ID NO: 3982544 - RNA, 19 nt, Human herpesvirus 5
gcaccacggcuugcaaaac

SEQ ID NO: 3982545 - RNA, 22 nt, Human herpesvirus 5
gcaccacgucgauucccaucuc

SEQ ID NO: 3982546 - RNA, 22 nt, Human herpesvirus 5
gcaccaucgugguagcgccgcg

SEQ ID NO: 3982547 - RNA, 12 nt, Human herpesvirus 5
gcacccgacggc

SEQ ID NO: 3982548 - RNA, 20 nt, Human herpesvirus 5
gcaccgagggcagaacuggu

SEQ ID NO: 3982549 - RNA, 14 nt, Human herpesvirus 5
gcaccgcgacagcu

SEQ ID NO: 3982550 - RNA, 13 nt, Human herpesvirus 5
gcaccggcagcac

SEQ ID NO: 3982551 - RNA, 15 nt, Human herpesvirus 5
gcaccggcagcccau

SEQ ID NO: 3982552 - RNA, 20 nt, Human herpesvirus 5
gcaccggcgccugcugcucg

SEQ ID NO: 3982553 - RNA, 13 nt, Human herpesvirus 5
gcaccuaucuccg

SEQ ID NO: 3982554 - RNA, 17 nt, Human herpesvirus 5
gcaccugcugccgccac

SEQ ID NO: 3982555 - RNA, 15 nt, Human herpesvirus 5
gcacgaccugcucca

SEQ ID NO: 3982556 - RNA, 16 nt, Human herpesvirus 5
gcacgcaccuguguga

SEQ ID NO: 3982557 - RNA, 21 nt, Human herpesvirus 5
gcacgcucugucggaugaggc

SEQ ID NO: 3982558 - RNA, 22 nt, Human herpesvirus 5
gcacgggcucgggugacggcga

SEQ ID NO: 3982559 - RNA, 13 nt, Human herpesvirus 5
gcacgggcugcug

SEQ ID NO: 3982560 - RNA, 14 nt, Human herpesvirus 5
gcacgggcugcugg

SEQ ID NO: 3982561 - RNA, 18 nt, Human herpesvirus 5
gcagaaaagccggcucca

SEQ ID NO: 3982562 - RNA, 14 nt, Human herpesvirus 5
gcagagccaccagg

SEQ ID NO: 3982563 - RNA, 22 nt, Human herpesvirus 5
gcagauucaguaaccuggagca

SEQ ID NO: 3982564 - RNA, 20 nt, Human herpesvirus 5
gcagcagcuggugcaucacg

SEQ ID NO: 3982565 - RNA, 22 nt, Human herpesvirus 5
gcagccacgagcaucgcaacaa

SEQ ID NO: 3982566 - RNA, 20 nt, Human herpesvirus 5
gcagcccaaguucagcagca

SEQ ID NO: 3982567 - RNA, 13 nt, Human herpesvirus 5
gcagcgaguugcu

SEQ ID NO: 3982568 - RNA, 14 nt, Human herpesvirus 5
gcagcggcugcgcg

SEQ ID NO: 3982569 - RNA, 21 nt, Human herpesvirus 5
cgguuucgcuguagcuguggu

SEQ ID NO: 3982570 - RNA, 20 nt, Human herpesvirus 5
cguaaaaagaauggccaugu

SEQ ID NO: 3982571 - RNA, 14 nt, Human herpesvirus 5
cguaaagagaguca

SEQ ID NO: 3982572 - RNA, 16 nt, Human herpesvirus 5
cguacgauacacccug

SEQ ID NO: 3982573 - RNA, 14 nt, Human herpesvirus 5
cguacgucaccgcg

SEQ ID NO: 3982574 - RNA, 22 nt, Human herpesvirus 5
cguacuucaugccccgaugaac

SEQ ID NO: 3982575 - RNA, 17 nt, Human herpesvirus 5
cguagaauacuggaagc

SEQ ID NO: 3982576 - RNA, 23 nt, Human herpesvirus 5
cguagaauacuggaagcugcugg

SEQ ID NO: 3982577 - RNA, 15 nt, Human herpesvirus 5
cguagcagcacgcgg

SEQ ID NO: 3982578 - RNA, 14 nt, Human herpesvirus 5
cguaggccuccucu

SEQ ID NO: 3982579 - RNA, 14 nt, Human herpesvirus 5
cguagugagcuuug

SEQ ID NO: 3982580 - RNA, 18 nt, Human herpesvirus 5
cguagugagcuuugacgu

SEQ ID NO: 3982581 - RNA, 15 nt, Human herpesvirus 5
cguaguuguugcaga

SEQ ID NO: 3982582 - RNA, 16 nt, Human herpesvirus 5
cguauuccguuugcgc

SEQ ID NO: 3982583 - RNA, 12 nt, Human herpesvirus 5
cgucaaaacaca

SEQ ID NO: 3982584 - RNA, 21 nt, Human herpesvirus 5
cgucacuagaucaccacccug

SEQ ID NO: 3982585 - RNA, 22 nt, Human herpesvirus 5
cgucacucuuggcacggggaau

SEQ ID NO: 3982586 - RNA, 18 nt, Human herpesvirus 5
cgucaucucgccgacgug

SEQ ID NO: 3982587 - RNA, 20 nt, Human herpesvirus 5
cgucccgcgcggaucggaca

SEQ ID NO: 3982588 - RNA, 18 nt, Human herpesvirus 5
cgucccuggggcugcugc

SEQ ID NO: 3982589 - RNA, 21 nt, Human herpesvirus 5
cguccgaaucgccggcuugcu

SEQ ID NO: 3982590 - RNA, 19 nt, Human herpesvirus 5
cguccgcggaaacgacgga

SEQ ID NO: 3982591 - RNA, 20 nt, Human herpesvirus 5
cguccgggcuuuccuuguca

SEQ ID NO: 3982592 - RNA, 17 nt, Human herpesvirus 5
cgucgauucccaucuca

SEQ ID NO: 3982593 - RNA, 23 nt, Human herpesvirus 5
cgucgccacauuggugaaggccg

SEQ ID NO: 3982594 - RNA, 13 nt, Human herpesvirus 5
cgucggcugccug

SEQ ID NO: 3982595 - RNA, 20 nt, Human herpesvirus 5
cgucgguaccgucuccacca

SEQ ID NO: 3982596 - RNA, 16 nt, Human herpesvirus 5
cgucggugcgcccauc

SEQ ID NO: 3982597 - RNA, 13 nt, Human herpesvirus 5
cgucgucccagca

SEQ ID NO: 3982598 - RNA, 13 nt, Human herpesvirus 5
cgucguuagccag

SEQ ID NO: 3982599 - RNA, 21 nt, Human herpesvirus 5
cgucguuuuguucaccgucgc

SEQ ID NO: 3982600 - RNA, 15 nt, Human herpesvirus 5
cgucuggacgcgcgg

SEQ ID NO: 3982601 - RNA, 17 nt, Human herpesvirus 5
cgucuggacgcgcggcu

SEQ ID NO: 3982602 - RNA, 13 nt, Human herpesvirus 5
cgucuucugaagc

SEQ ID NO: 3982603 - RNA, 16 nt, Human herpesvirus 5
cgugaaacagcagcuc

SEQ ID NO: 3982604 - RNA, 20 nt, Human herpesvirus 5
cgugagcagcgugcaccugc

SEQ ID NO: 3982605 - RNA, 18 nt, Human herpesvirus 5
cgugauucguaggcagcg

SEQ ID NO: 3982606 - RNA, 18 nt, Human herpesvirus 5
cgugcaacggcgacgcgg

SEQ ID NO: 3982607 - RNA, 15 nt, Human herpesvirus 5
cgugcccgaagagga

SEQ ID NO: 3982608 - RNA, 16 nt, Human herpesvirus 5
cgugcccugugggccc

SEQ ID NO: 3982609 - RNA, 14 nt, Human herpesvirus 5
cgugcgcacgccgc

SEQ ID NO: 3982610 - RNA, 15 nt, Human herpesvirus 5
cgugcguagcuguau

SEQ ID NO: 3982611 - RNA, 18 nt, Human herpesvirus 5
cguggacugggacgagga

SEQ ID NO: 3982612 - RNA, 19 nt, Human herpesvirus 5
cguggcccuggucuggccc

SEQ ID NO: 3982613 - RNA, 18 nt, Human herpesvirus 5
cguggcgguccaguggca

SEQ ID NO: 3982614 - RNA, 12 nt, Human herpesvirus 5
cgugggccagga

SEQ ID NO: 3982615 - RNA, 16 nt, Human herpesvirus 5
cgugguagcgccgcga

SEQ ID NO: 3982616 - RNA, 23 nt, Human herpesvirus 5
cgugucgcugggcuggcccucgc

SEQ ID NO: 3982617 - RNA, 17 nt, Human herpesvirus 5
cgugucgucuccacgua

SEQ ID NO: 3982618 - RNA, 17 nt, Human herpesvirus 5
cgugugacguggauacu

SEQ ID NO: 3982619 - RNA, 17 nt, Human herpesvirus 5
cguguuuagucgcggcg

SEQ ID NO: 3982620 - RNA, 17 nt, Human herpesvirus 5
cguuaccaguaccaccg

SEQ ID NO: 3982621 - RNA, 15 nt, Human herpesvirus 5
cguuaucagaaagcu

SEQ ID NO: 3982622 - RNA, 20 nt, Human herpesvirus 5
cguuauguuucgaaaacuug

SEQ ID NO: 3982623 - RNA, 23 nt, Human herpesvirus 5
cguucacuuuuccguuuuacgug

SEQ ID NO: 3982624 - RNA, 22 nt, Human herpesvirus 5
aaguauauaacgccgaucaugu

SEQ ID NO: 3982625 - RNA, 21 nt, Human herpesvirus 5
aagucacacaggccagcugcc

SEQ ID NO: 3982626 - RNA, 21 nt, Human herpesvirus 5
aagugcgucuacgaccaaagc

SEQ ID NO: 3982627 - RNA, 19 nt, Human herpesvirus 5
aaguggauuugggcgugga

SEQ ID NO: 3982628 - RNA, 22 nt, Human herpesvirus 5
aauaaucccuguaauuauucca

SEQ ID NO: 3982629 - RNA, 14 nt, Human herpesvirus 5
aauaccaacguauc

SEQ ID NO: 3982630 - RNA, 15 nt, Human herpesvirus 5
aauacuggacuuuug

SEQ ID NO: 3982631 - RNA, 18 nt, Human herpesvirus 5
aaucagcagugaguacac

SEQ ID NO: 3982632 - RNA, 14 nt, Human herpesvirus 5
aaucgacaggaggc

SEQ ID NO: 3982633 - RNA, 14 nt, Human herpesvirus 5
aaucuccugagaca

SEQ ID NO: 3982634 - RNA, 22 nt, Human herpesvirus 5
aaucugggagguggcugggcuc

SEQ ID NO: 3982635 - RNA, 17 nt, Human herpesvirus 5
aaugacauggauaacga

SEQ ID NO: 3982636 - RNA, 18 nt, Human herpesvirus 5
aaugauauuuuacaggua

SEQ ID NO: 3982637 - RNA, 23 nt, Human herpesvirus 5
aaugccaugcggauccagcugcu

SEQ ID NO: 3982638 - RNA, 16 nt, Human herpesvirus 5
aaugugcugcaugaga

SEQ ID NO: 3982639 - RNA, 14 nt, Human herpesvirus 5
aauguugacccagg

SEQ ID NO: 3982640 - RNA, 19 nt, Human herpesvirus 5
acaaauagcagugacuggg

SEQ ID NO: 3982641 - RNA, 18 nt, Human herpesvirus 5
acaaccacggcgaaccgc

SEQ ID NO: 3982642 - RNA, 21 nt, Human herpesvirus 5
acaacggccgccgcagccacg

SEQ ID NO: 3982643 - RNA, 15 nt, Human herpesvirus 5
acaacggcuggaaau

SEQ ID NO: 3982644 - RNA, 13 nt, Human herpesvirus 5
acaacuuuuccau

SEQ ID NO: 3982645 - RNA, 14 nt, Human herpesvirus 5
acaagaaacacagg

SEQ ID NO: 3982646 - RNA, 23 nt, Human herpesvirus 5
acaaggaagcguccgcuggaaau

SEQ ID NO: 3982647 - RNA, 13 nt, Human herpesvirus 5
acaagguggugaa

SEQ ID NO: 3982648 - RNA, 23 nt, Human herpesvirus 5
acaaugugcugcaugagaacacg

SEQ ID NO: 3982649 - RNA, 22 nt, Human herpesvirus 5
acacaaaaucuucuaaaacggu

SEQ ID NO: 3982650 - RNA, 11 nt, Human herpesvirus 5
acacagcagca

SEQ ID NO: 3982651 - RNA, 17 nt, Human herpesvirus 5
acacagcgccgcgcugg

SEQ ID NO: 3982652 - RNA, 20 nt, Human herpesvirus 5
acaccacgguuuaccacagg

SEQ ID NO: 3982653 - RNA, 11 nt, Human herpesvirus 5
acacccugcgg

SEQ ID NO: 3982654 - RNA, 12 nt, Human herpesvirus 5
acaccgcugcgg

SEQ ID NO: 3982655 - RNA, 16 nt, Human herpesvirus 5
acaccguuuguggugu

SEQ ID NO: 3982656 - RNA, 12 nt, Human herpesvirus 5
acaccuauggcg

SEQ ID NO: 3982657 - RNA, 14 nt, Human herpesvirus 5
acacgacacuagcc

SEQ ID NO: 3982658 - RNA, 17 nt, Human herpesvirus 5
acacgcgggggaaaaac

SEQ ID NO: 3982659 - RNA, 10 nt, Human herpesvirus 5
acacuacagc

SEQ ID NO: 3982660 - RNA, 21 nt, Human herpesvirus 5
acagacgccuauaaagaaacc

SEQ ID NO: 3982661 - RNA, 12 nt, Human herpesvirus 5
acagcaaugaca

SEQ ID NO: 3982662 - RNA, 20 nt, Human herpesvirus 5
acagccgggcguuggccugu

SEQ ID NO: 3982663 - RNA, 20 nt, Human herpesvirus 5
acagcgccgacgugcuucgc

SEQ ID NO: 3982664 - RNA, 20 nt, Human herpesvirus 5
acaguauagcaugcauaaga

SEQ ID NO: 3982665 - RNA, 17 nt, Human herpesvirus 5
acaucccaagcacgcca

SEQ ID NO: 3982666 - RNA, 12 nt, Human herpesvirus 5
acaucuuaagaa

SEQ ID NO: 3982667 - RNA, 17 nt, Human herpesvirus 5
acaugcuauaagacagc

SEQ ID NO: 3982668 - RNA, 13 nt, Human herpesvirus 5
acauggacucuug

SEQ ID NO: 3982669 - RNA, 15 nt, Human herpesvirus 5
acauguccuggcgcg

SEQ ID NO: 3982670 - RNA, 17 nt, Human herpesvirus 5
acauucaauacaucaua

SEQ ID NO: 3982671 - RNA, 17 nt, Human herpesvirus 5
accacccgacugcagcc

SEQ ID NO: 3982672 - RNA, 17 nt, Human herpesvirus 5
accacgaguaacaccgu

SEQ ID NO: 3982673 - RNA, 16 nt, Human herpesvirus 5
accacgucaccgugcc

SEQ ID NO: 3982674 - RNA, 17 nt, Human herpesvirus 5
accacgucgaccaggug

SEQ ID NO: 3982675 - RNA, 18 nt, Human herpesvirus 5
accagaugcucccggcgc

SEQ ID NO: 3982676 - RNA, 21 nt, Human herpesvirus 5
accagcaaggucaacuacagc

SEQ ID NO: 3982677 - RNA, 19 nt, Human herpesvirus 5
accagcaguaugacgugcg

SEQ ID NO: 3982678 - RNA, 20 nt, Human herpesvirus 5
accauccgaagcuacagccg

SEQ ID NO: 3982679 - RNA, 14 nt, Human herpesvirus 5
accaucgugccgcu

SEQ ID NO: 3982680 - RNA, 15 nt, Human herpesvirus 5
accaucuggcgcaga

SEQ ID NO: 3982681 - RNA, 21 nt, Human herpesvirus 5
acccagcuggggaaguacaau

SEQ ID NO: 3982682 - RNA, 15 nt, Human herpesvirus 5
acccaucgcaccauc

SEQ ID NO: 3982683 - RNA, 13 nt, Human herpesvirus 5
acccccacccgug

SEQ ID NO: 3982684 - RNA, 19 nt, Human herpesvirus 5
accccccgggccaccagcc

SEQ ID NO: 3982685 - RNA, 16 nt, Human herpesvirus 5
accccucgcugggcua

SEQ ID NO: 3982686 - RNA, 16 nt, Human herpesvirus 5
acccgccggagcccgg

SEQ ID NO: 3982687 - RNA, 21 nt, Human herpesvirus 5
acccgggcaacgcguggcccu

SEQ ID NO: 3982688 - RNA, 12 nt, Human herpesvirus 5
acccuaaaacac

SEQ ID NO: 3982689 - RNA, 17 nt, Human herpesvirus 5
accgacauggagcccac

SEQ ID NO: 3982690 - RNA, 16 nt, Human herpesvirus 5
accgcaacaacagcag

SEQ ID NO: 3982691 - RNA, 14 nt, Human herpesvirus 5
accgcaacucggug

SEQ ID NO: 3982692 - RNA, 18 nt, Human herpesvirus 5
accgccgccgagaaaguc

SEQ ID NO: 3982693 - RNA, 17 nt, Human herpesvirus 5
accgccucggcgacguc

SEQ ID NO: 3982694 - RNA, 14 nt, Human herpesvirus 5
accgcgacgagguc

SEQ ID NO: 3982695 - RNA, 19 nt, Human herpesvirus 5
accgcgaguaucgggccgu

SEQ ID NO: 3982696 - RNA, 12 nt, Human herpesvirus 5
accgcgggccgc

SEQ ID NO: 3982697 - RNA, 23 nt, Human herpesvirus 5
accgcuacaacgcgcgccugacc

SEQ ID NO: 3982698 - RNA, 12 nt, Human herpesvirus 5
accgcugcggca

SEQ ID NO: 3982699 - RNA, 15 nt, Human herpesvirus 5
accggcgccugcugc

SEQ ID NO: 3982700 - RNA, 17 nt, Human herpesvirus 5
accggcucaccacgcag

SEQ ID NO: 3982701 - RNA, 23 nt, Human herpesvirus 5
accgucgauguuggacgaaacgu

SEQ ID NO: 3982702 - RNA, 14 nt, Human herpesvirus 5
accgucgcccucag

SEQ ID NO: 3982703 - RNA, 21 nt, Human herpesvirus 5
accgucgcguccgacgcgacg

SEQ ID NO: 3982704 - RNA, 14 nt, Human herpesvirus 5
accgugcucgugcc

SEQ ID NO: 3982705 - RNA, 21 nt, Human herpesvirus 5
accguuguccccgcaaacucc

SEQ ID NO: 3982706 - RNA, 16 nt, Human herpesvirus 5
accuagcuacuuugga

SEQ ID NO: 3982707 - RNA, 18 nt, Human herpesvirus 5
accuaucauaaagaaugc

SEQ ID NO: 3982708 - RNA, 21 nt, Human herpesvirus 5
accuccccuaacgucacuuca

SEQ ID NO: 3982709 - RNA, 14 nt, Human herpesvirus 5
accuggguagcaag

SEQ ID NO: 3982710 - RNA, 22 nt, Human herpesvirus 5
accuugagcgacagcagcauca

SEQ ID NO: 3982711 - RNA, 21 nt, Human herpesvirus 5
acgacaucuuccgcgagcacc

SEQ ID NO: 3982712 - RNA, 12 nt, Human herpesvirus 5
acgacgcggcgu

SEQ ID NO: 3982713 - RNA, 20 nt, Human herpesvirus 5
acgacgucguccagucguug

SEQ ID NO: 3982714 - RNA, 18 nt, Human herpesvirus 5
acgacuggcucaacuuuc

SEQ ID NO: 3982715 - RNA, 11 nt, Human herpesvirus 5
acgagcucuug

SEQ ID NO: 3982716 - RNA, 11 nt, Human herpesvirus 5
acgaggaggag

SEQ ID NO: 3982717 - RNA, 15 nt, Human herpesvirus 5
acgaggaggccgaga

SEQ ID NO: 3982718 - RNA, 18 nt, Human herpesvirus 5
acgauacacccugucacc

SEQ ID NO: 3982719 - RNA, 14 nt, Human herpesvirus 5
acgauaugucgcga

SEQ ID NO: 3982720 - RNA, 21 nt, Human herpesvirus 5
acgaugugagagccaccuugg

SEQ ID NO: 3982721 - RNA, 15 nt, Human herpesvirus 5
acgcagucugcccug

SEQ ID NO: 3982722 - RNA, 23 nt, Human herpesvirus 5
acgccaaguaccuaugcgccgua

SEQ ID NO: 3982723 - RNA, 13 nt, Human herpesvirus 5
acgccugggcgcg

SEQ ID NO: 3982724 - RNA, 15 nt, Human herpesvirus 5
acgcgacuggcgucg

SEQ ID NO: 3982725 - RNA, 21 nt, Human herpesvirus 5
acgcgcaagugccugcacgac

SEQ ID NO: 3982726 - RNA, 22 nt, Human herpesvirus 5
acgcgcgccugacccgcggcua

SEQ ID NO: 3982727 - RNA, 18 nt, Human herpesvirus 5
acgcgcucuucacacacu

SEQ ID NO: 3982728 - RNA, 17 nt, Human herpesvirus 5
acgcgucgaugccuguu

SEQ ID NO: 3982729 - RNA, 23 nt, Human herpesvirus 5
acgcuacuuuccgauccuuggaa

SEQ ID NO: 3982730 - RNA, 13 nt, Human herpesvirus 5
acgcucaaggaca

SEQ ID NO: 3982731 - RNA, 13 nt, Human herpesvirus 5
acgcucgagggcu

SEQ ID NO: 3982732 - RNA, 15 nt, Human herpesvirus 5
acgcugcacgaccug

SEQ ID NO: 3982733 - RNA, 18 nt, Human herpesvirus 5
acgcuguuagugguggcg

SEQ ID NO: 3982734 - RNA, 19 nt, Human herpesvirus 5
acgcuguugagcucggaca

SEQ ID NO: 3982735 - RNA, 20 nt, Human herpesvirus 5
acgcuucauauuaguauacu

SEQ ID NO: 3982736 - RNA, 16 nt, Human herpesvirus 5
acgcuuuaagcugcuc

SEQ ID NO: 3982737 - RNA, 14 nt, Human herpesvirus 5
acggaaaagcagug

SEQ ID NO: 3982738 - RNA, 13 nt, Human herpesvirus 5
acggagccguuac

SEQ ID NO: 3982739 - RNA, 12 nt, Human herpesvirus 5
acggagugguga

SEQ ID NO: 3982740 - RNA, 17 nt, Human herpesvirus 5
acggaguuuucccucag

SEQ ID NO: 3982741 - RNA, 21 nt, Human herpesvirus 5
acggauaaccgcaaaggccac

SEQ ID NO: 3982742 - RNA, 17 nt, Human herpesvirus 5
ccaccgacacagcagca

SEQ ID NO: 3982743 - RNA, 14 nt, Human herpesvirus 5
ccaccgacgcgcga

SEQ ID NO: 3982744 - RNA, 21 nt, Human herpesvirus 5
ccaccgagacgugcgaccugg

SEQ ID NO: 3982745 - RNA, 22 nt, Human herpesvirus 5
ccaccgucgcccucagcgugcu

SEQ ID NO: 3982746 - RNA, 13 nt, Human herpesvirus 5
ccaccgucgccgu

SEQ ID NO: 3982747 - RNA, 15 nt, Human herpesvirus 5
ccaccgucgccguca

SEQ ID NO: 3982748 - RNA, 16 nt, Human herpesvirus 5
ccaccuggacgggggg

SEQ ID NO: 3982749 - RNA, 21 nt, Human herpesvirus 5
ccacgcgucgaccccaaccuu

SEQ ID NO: 3982750 - RNA, 19 nt, Human herpesvirus 5
ccacgcucgagggcuccgu

SEQ ID NO: 3982751 - RNA, 18 nt, Human herpesvirus 5
ccacggccugcgggcagg

SEQ ID NO: 3982752 - RNA, 19 nt, Human herpesvirus 5
ccacggccugcgggcaggc

SEQ ID NO: 3982753 - RNA, 18 nt, Human herpesvirus 5
ccacggcgucuuccuccu

SEQ ID NO: 3982754 - RNA, 13 nt, Human herpesvirus 5
ccacgggccgcgc

SEQ ID NO: 3982755 - RNA, 15 nt, Human herpesvirus 5
ccacgggccgcgcuc

SEQ ID NO: 3982756 - RNA, 14 nt, Human herpesvirus 5
ccacggugcuuuuc

SEQ ID NO: 3982757 - RNA, 17 nt, Human herpesvirus 5
ccacgucgaccaggugc

SEQ ID NO: 3982758 - RNA, 18 nt, Human herpesvirus 5
ccagagacagagaccgcc

SEQ ID NO: 3982759 - RNA, 20 nt, Human herpesvirus 5
ccagauacaacgucaugcau

SEQ ID NO: 3982760 - RNA, 17 nt, Human herpesvirus 5
ccagcagcagcuggugc

SEQ ID NO: 3982761 - RNA, 18 nt, Human herpesvirus 5
ccagcaucuccucgccca

SEQ ID NO: 3982762 - RNA, 13 nt, Human herpesvirus 5
ccagccgcgauuc

SEQ ID NO: 3982763 - RNA, 15 nt, Human herpesvirus 5
ccagcgagcugcgcg

SEQ ID NO: 3982764 - RNA, 23 nt, Human herpesvirus 5
ccagcggccgcagugggcccacg

SEQ ID NO: 3982765 - RNA, 16 nt, Human herpesvirus 5
ccagcugcuucuggua

SEQ ID NO: 3982766 - RNA, 14 nt, Human herpesvirus 5
ccagggagacuuag

SEQ ID NO: 3982767 - RNA, 21 nt, Human herpesvirus 5
ccaggugucucuacgcuccua

SEQ ID NO: 3982768 - RNA, 23 nt, Human herpesvirus 5
ccaucaggugacauccucgccca

SEQ ID NO: 3982769 - RNA, 22 nt, Human herpesvirus 5
ccaucaguacggcuuucugcgg

SEQ ID NO: 3982770 - RNA, 13 nt, Human herpesvirus 5
ccaucccgccuuc

SEQ ID NO: 3982771 - RNA, 14 nt, Human herpesvirus 5
ccauccucguggaa

SEQ ID NO: 3982772 - RNA, 20 nt, Human herpesvirus 5
ccauccuuuucaugcucaua

SEQ ID NO: 3982773 - RNA, 20 nt, Human herpesvirus 5
ccaucgucccccuuucucua

SEQ ID NO: 3982774 - RNA, 15 nt, Human herpesvirus 5
ccaugaugacggcga

SEQ ID NO: 3982775 - RNA, 16 nt, Human herpesvirus 5
ccaugucgcgacacga

SEQ ID NO: 3982776 - RNA, 13 nt, Human herpesvirus 5
ccaugugcauggg

SEQ ID NO: 3982777 - RNA, 21 nt, Human herpesvirus 5
cccacaugcugcuuaauaaac

SEQ ID NO: 3982778 - RNA, 21 nt, Human herpesvirus 5
cccacccgguguuggccacca

SEQ ID NO: 3982779 - RNA, 12 nt, Human herpesvirus 5
cccaccgccucc

SEQ ID NO: 3982780 - RNA, 16 nt, Human herpesvirus 5
cccacgguggccaaca

SEQ ID NO: 3982781 - RNA, 15 nt, Human herpesvirus 5
cccaggacacauuuc

SEQ ID NO: 3982782 - RNA, 15 nt, Human herpesvirus 5
cccagggucaguugc

SEQ ID NO: 3982783 - RNA, 20 nt, Human herpesvirus 5
cccaguagacagacaggaca

SEQ ID NO: 3982784 - RNA, 21 nt, Human herpesvirus 5
cccaugcgggaacuggccugg

SEQ ID NO: 3982785 - RNA, 21 nt, Human herpesvirus 5
ccccaucgggcccgccacugc

SEQ ID NO: 3982786 - RNA, 14 nt, Human herpesvirus 5
cccccaucccgccu

SEQ ID NO: 3982787 - RNA, 13 nt, Human herpesvirus 5
ccccccaugccgg

SEQ ID NO: 3982788 - RNA, 22 nt, Human herpesvirus 5
cccccgggauccaagagacccg

SEQ ID NO: 3982789 - RNA, 14 nt, Human herpesvirus 5
cccccguggccgcu

SEQ ID NO: 3982790 - RNA, 17 nt, Human herpesvirus 5
ccccgauaugggccgcu

SEQ ID NO: 3982791 - RNA, 14 nt, Human herpesvirus 5
ccccgauucccaca

SEQ ID NO: 3982792 - RNA, 22 nt, Human herpesvirus 5
ccccggacgggcaggacgucaa

SEQ ID NO: 3982793 - RNA, 22 nt, Human herpesvirus 5
ccccggggcgugccgagcugcc

SEQ ID NO: 3982794 - RNA, 15 nt, Human herpesvirus 5
ccccgucgcccgagg

SEQ ID NO: 3982795 - RNA, 13 nt, Human herpesvirus 5
ccccguggccgcu

SEQ ID NO: 3982796 - RNA, 17 nt, Human herpesvirus 5
cccgaccacgacacggu

SEQ ID NO: 3982797 - RNA, 14 nt, Human herpesvirus 5
cccgagacggcggc

SEQ ID NO: 3982798 - RNA, 19 nt, Human herpesvirus 5
cccgcacgacgaccccgcu

SEQ ID NO: 3982799 - RNA, 15 nt, Human herpesvirus 5
cccgccggagcccgg

SEQ ID NO: 3982800 - RNA, 14 nt, Human herpesvirus 5
cccgccggcgggcg

SEQ ID NO: 3982801 - RNA, 20 nt, Human herpesvirus 5
cccgcgucccuggggcugcu

SEQ ID NO: 3982802 - RNA, 12 nt, Human herpesvirus 5
cccgcuagaaug

SEQ ID NO: 3982803 - RNA, 17 nt, Human herpesvirus 5
cccggcacccgagcacg

SEQ ID NO: 3982804 - RNA, 14 nt, Human herpesvirus 5
cccgggccaccagc

SEQ ID NO: 3982805 - RNA, 17 nt, Human herpesvirus 5
cccgggccgccugagga

SEQ ID NO: 3982806 - RNA, 19 nt, Human herpesvirus 5
cccgucaaaacacacgcga

SEQ ID NO: 3982807 - RNA, 19 nt, Human herpesvirus 5
cccguggaucagccgccgc

SEQ ID NO: 3982808 - RNA, 11 nt, Human herpesvirus 5
cccguggccca

SEQ ID NO: 3982809 - RNA, 21 nt, Human herpesvirus 5
cccuagcaacgcgacuacggu

SEQ ID NO: 3982810 - RNA, 17 nt, Human herpesvirus 5
cccuauggcacgucgcu

SEQ ID NO: 3982811 - RNA, 15 nt, Human herpesvirus 5
cccucagccucugug

SEQ ID NO: 3982812 - RNA, 19 nt, Human herpesvirus 5
cccucagcgugcucagcug

SEQ ID NO: 3982813 - RNA, 20 nt, Human herpesvirus 5
cccucucgcgcccgcagaca

SEQ ID NO: 3982814 - RNA, 11 nt, Human herpesvirus 5
cccucugcugc

SEQ ID NO: 3982815 - RNA, 23 nt, Human herpesvirus 5
cccucuucuuugccggcucuccu

SEQ ID NO: 3982816 - RNA, 19 nt, Human herpesvirus 5
cccugaguucacgcgcgga

SEQ ID NO: 3982817 - RNA, 19 nt, Human herpesvirus 5
cccugaguuccgucagcac

SEQ ID NO: 3982818 - RNA, 22 nt, Human herpesvirus 5
cccugcuccgcaagcgccgcca

SEQ ID NO: 3982819 - RNA, 17 nt, Human herpesvirus 5
cccugguauccaacuuc

SEQ ID NO: 3982820 - RNA, 12 nt, Human herpesvirus 5
cccuucucuggu

SEQ ID NO: 3982821 - RNA, 20 nt, Human herpesvirus 5
ccgaaggcuacacgcuuuuc

SEQ ID NO: 3982822 - RNA, 19 nt, Human herpesvirus 5
ccgaagguuagcgccgcgg

SEQ ID NO: 3982823 - RNA, 17 nt, Human herpesvirus 5
ccgaauuugggcggugg

SEQ ID NO: 3982824 - RNA, 16 nt, Human herpesvirus 5
ccgacaaccugcugca

SEQ ID NO: 3982825 - RNA, 13 nt, Human herpesvirus 5
ccgaccacgacac

SEQ ID NO: 3982826 - RNA, 17 nt, Human herpesvirus 5
ccgacccccaccagcgu

SEQ ID NO: 3982827 - RNA, 14 nt, Human herpesvirus 5
ccgaccugugcgug

SEQ ID NO: 3982828 - RNA, 12 nt, Human herpesvirus 5
ccgacgagcagg

SEQ ID NO: 3982829 - RNA, 23 nt, Human herpesvirus 5
ccgagcaagcagucaaaaaagaa

SEQ ID NO: 3982830 - RNA, 14 nt, Human herpesvirus 5
ccgagcccaacuuu

SEQ ID NO: 3982831 - RNA, 13 nt, Human herpesvirus 5
ccgaggaucuggc

SEQ ID NO: 3982832 - RNA, 14 nt, Human herpesvirus 5
ccgaggcgccgcca

SEQ ID NO: 3982833 - RNA, 20 nt, Human herpesvirus 5
ccgagucgugucgcugcguc

SEQ ID NO: 3982834 - RNA, 16 nt, Human herpesvirus 5
ccgauccacgggccgc

SEQ ID NO: 3982835 - RNA, 17 nt, Human herpesvirus 5
ccgauccuuggaagagg

SEQ ID NO: 3982836 - RNA, 14 nt, Human herpesvirus 5
ccgaugcuccgcga

SEQ ID NO: 3982837 - RNA, 13 nt, Human herpesvirus 5
ccgauucagaucu

SEQ ID NO: 3982838 - RNA, 13 nt, Human herpesvirus 5
ccgcaaaggccac

SEQ ID NO: 3982839 - RNA, 16 nt, Human herpesvirus 5
ccgcaaugggcuuccc

SEQ ID NO: 3982840 - RNA, 21 nt, Human herpesvirus 5
ccgcaccgguuggagcagcuc

SEQ ID NO: 3982841 - RNA, 14 nt, Human herpesvirus 5
ccgcagugggccca

SEQ ID NO: 3982842 - RNA, 20 nt, Human herpesvirus 5
ccgcauccugcccaccgccu

SEQ ID NO: 3982843 - RNA, 22 nt, Human herpesvirus 5
ccgccccagcagaccagccacc

SEQ ID NO: 3982844 - RNA, 15 nt, Human herpesvirus 5
ccgccgacucgcugc

SEQ ID NO: 3982845 - RNA, 20 nt, Human herpesvirus 5
ccgccgacucgcugccgcag

SEQ ID NO: 3982846 - RNA, 13 nt, Human herpesvirus 5
ccgccgcaacagc

SEQ ID NO: 3982847 - RNA, 13 nt, Human herpesvirus 5
ccgccgccgcccg

SEQ ID NO: 3982848 - RNA, 13 nt, Human herpesvirus 5
ccgccgccgcgcu

SEQ ID NO: 3982849 - RNA, 12 nt, Human herpesvirus 5
ccgccgcggcgu

SEQ ID NO: 3982850 - RNA, 18 nt, Human herpesvirus 5
ccgccggcacgucaguuu

SEQ ID NO: 3982851 - RNA, 16 nt, Human herpesvirus 5
ccgccgucaccaccgc

SEQ ID NO: 3982852 - RNA, 19 nt, Human herpesvirus 5
ccgccgucgcgccuuccuc

SEQ ID NO: 3982853 - RNA, 23 nt, Human herpesvirus 5
ccgccucggaucuacucaucggc

SEQ ID NO: 3982854 - RNA, 17 nt, Human herpesvirus 5
ccgccucuucuggcccu

SEQ ID NO: 3982855 - RNA, 14 nt, Human herpesvirus 5
ccgcgaacggcgac

SEQ ID NO: 3982856 - RNA, 17 nt, Human herpesvirus 5
ccgcgacccagcgacag

SEQ ID NO: 3982857 - RNA, 15 nt, Human herpesvirus 5
ccgcgccgccuggag

SEQ ID NO: 3982858 - RNA, 12 nt, Human herpesvirus 5
ccgcggaggugc

SEQ ID NO: 3982859 - RNA, 16 nt, Human herpesvirus 5
ccgcggaggugcuggc

SEQ ID NO: 3982860 - RNA, 18 nt, Human herpesvirus 5
ccgcggugcaggccgcgc

SEQ ID NO: 3982861 - RNA, 19 nt, Human herpesvirus 5
ccgcggugcaggccgcgca

SEQ ID NO: 3982862 - RNA, 19 nt, Human herpesvirus 5
ccgcggugcgcugcagccg

SEQ ID NO: 3982863 - RNA, 18 nt, Human herpesvirus 5
ccgcgguucuauccccga

SEQ ID NO: 3982864 - RNA, 13 nt, Human herpesvirus 5
ccgcguagcgcuc

SEQ ID NO: 3982865 - RNA, 15 nt, Human herpesvirus 5
ccgcgugcuccacca

SEQ ID NO: 3982866 - RNA, 15 nt, Human herpesvirus 5
ccgcucacuuuccuc

SEQ ID NO: 3982867 - RNA, 18 nt, Human herpesvirus 5
ccgcucaggucgcccagg

SEQ ID NO: 3982868 - RNA, 17 nt, Human herpesvirus 5
ccgcuccaucgcagcca

SEQ ID NO: 3982869 - RNA, 13 nt, Human herpesvirus 5
ccgcugcacggca

SEQ ID NO: 3982870 - RNA, 23 nt, Human herpesvirus 5
ccgcugugcuggccgccgcugca

SEQ ID NO: 3982871 - RNA, 14 nt, Human herpesvirus 5
ccggaccgugcacg

SEQ ID NO: 3982872 - RNA, 20 nt, Human herpesvirus 5
ccggacgugcuuggacuggu

SEQ ID NO: 3982873 - RNA, 22 nt, Human herpesvirus 5
ccggagcuacgcgaccagcugc

SEQ ID NO: 3982874 - RNA, 18 nt, Human herpesvirus 5
ccggauaucugcggggau

SEQ ID NO: 3982875 - RNA, 14 nt, Human herpesvirus 5
ccggcgcgguguua

SEQ ID NO: 3982876 - RNA, 22 nt, Human herpesvirus 5
ccggcgcgguguuagacauggg

SEQ ID NO: 3982877 - RNA, 20 nt, Human herpesvirus 5
ccggcggcgccgucagagca

SEQ ID NO: 3982878 - RNA, 13 nt, Human herpesvirus 5
ccggcggcgugca

SEQ ID NO: 3982879 - RNA, 23 nt, Human herpesvirus 5
ccggcggcugcuguugcacgggc

SEQ ID NO: 3982880 - RNA, 14 nt, Human herpesvirus 5
ccggcguggcggcc

SEQ ID NO: 3982881 - RNA, 21 nt, Human herpesvirus 5
ccggcguugccgccaugucgc

SEQ ID NO: 3982882 - RNA, 13 nt, Human herpesvirus 5
ccggcuacgucga

SEQ ID NO: 3982883 - RNA, 15 nt, Human herpesvirus 5
ccggcugcacguggc

SEQ ID NO: 3982884 - RNA, 13 nt, Human herpesvirus 5
ccggcugcugcac

SEQ ID NO: 3982885 - RNA, 16 nt, Human herpesvirus 5
ccgggcaacgcguggc

SEQ ID NO: 3982886 - RNA, 19 nt, Human herpesvirus 5
ccgggcggcuuccugcggc

SEQ ID NO: 3982887 - RNA, 21 nt, Human herpesvirus 5
ccggucgcuaacugauaacga

SEQ ID NO: 3982888 - RNA, 17 nt, Human herpesvirus 5
ccggugguacugcugug

SEQ ID NO: 3982889 - RNA, 17 nt, Human herpesvirus 5
ccguccugcagaccgag

SEQ ID NO: 3982890 - RNA, 21 nt, Human herpesvirus 5
ccgucgaggagguaguccccu

SEQ ID NO: 3982891 - RNA, 14 nt, Human herpesvirus 5
ccgucgccaccacc

SEQ ID NO: 3982892 - RNA, 22 nt, Human herpesvirus 5
ccgucgccauggcuauguacac

SEQ ID NO: 3982893 - RNA, 19 nt, Human herpesvirus 5
ccgucgcggacgaaagugg

SEQ ID NO: 3982894 - RNA, 21 nt, Human herpesvirus 5
ccgucuggacaccggaaugca

SEQ ID NO: 3982895 - RNA, 20 nt, Human herpesvirus 5
ccgugacacuuuggcucuuu

SEQ ID NO: 3982896 - RNA, 16 nt, Human herpesvirus 5
ccgugagugacgcggu

SEQ ID NO: 3982897 - RNA, 15 nt, Human herpesvirus 5
ccgugaucgccgcgg

SEQ ID NO: 3982898 - RNA, 13 nt, Human herpesvirus 5
ccgugccagcugg

SEQ ID NO: 3982899 - RNA, 20 nt, Human herpesvirus 5
ccgugcccguuuucacagca

SEQ ID NO: 3982900 - RNA, 15 nt, Human herpesvirus 5
ccgugcucagcggcg

SEQ ID NO: 3982901 - RNA, 16 nt, Human herpesvirus 5
ccgugcucgugcccau

SEQ ID NO: 3982902 - RNA, 16 nt, Human herpesvirus 5
ccgugcugggcugggu

SEQ ID NO: 3982903 - RNA, 20 nt, Human herpesvirus 5
ccguggaucagccgccgccu

SEQ ID NO: 3982904 - RNA, 19 nt, Human herpesvirus 5
ccguguuuuugcucgagac

SEQ ID NO: 3982905 - RNA, 22 nt, Human herpesvirus 5
ccguuacgccgacgugauccag

SEQ ID NO: 3982906 - RNA, 20 nt, Human herpesvirus 5
ccguuguguaugcaugucgc

SEQ ID NO: 3982907 - RNA, 13 nt, Human herpesvirus 5
ccuaacuguagca

SEQ ID NO: 3982908 - RNA, 18 nt, Human herpesvirus 5
ccuacgucuucaugacgg

SEQ ID NO: 3982909 - RNA, 16 nt, Human herpesvirus 5
ccuacucaccaaagcc

SEQ ID NO: 3982910 - RNA, 23 nt, Human herpesvirus 5
ccuaucauaaagaaugcaacgcu

SEQ ID NO: 3982911 - RNA, 16 nt, Human herpesvirus 5
ccuauccgcgcggcua

SEQ ID NO: 3982912 - RNA, 13 nt, Human herpesvirus 5
ccuaugaggacga

SEQ ID NO: 3982913 - RNA, 22 nt, Human herpesvirus 5
ccuauuagccccacaugcugcu

SEQ ID NO: 3982914 - RNA, 13 nt, Human herpesvirus 5
ccucacacugacg

SEQ ID NO: 3982915 - RNA, 17 nt, Human herpesvirus 5
ccucauggacccgccgc

SEQ ID NO: 3982916 - RNA, 18 nt, Human herpesvirus 5
ccuccagcagcagcuggu

SEQ ID NO: 3982917 - RNA, 16 nt, Human herpesvirus 5
ccuccgcgaacggcga

SEQ ID NO: 3982918 - RNA, 16 nt, Human herpesvirus 5
ccuccgucgcggccag

SEQ ID NO: 3982919 - RNA, 14 nt, Human herpesvirus 5
ccuccugcagcugc

SEQ ID NO: 3982920 - RNA, 13 nt, Human herpesvirus 5
ccucggacaccgg

SEQ ID NO: 3982921 - RNA, 16 nt, Human herpesvirus 5
ccucggugcccgcaca

SEQ ID NO: 3982922 - RNA, 20 nt, Human herpesvirus 5
ccucuccuccgucgcggcca

SEQ ID NO: 3982923 - RNA, 14 nt, Human herpesvirus 5
ccucuccuccuucu

SEQ ID NO: 3982924 - RNA, 22 nt, Human herpesvirus 5
ccugcagaccgaggcgcuggac

SEQ ID NO: 3982925 - RNA, 13 nt, Human herpesvirus 5
ccugcagcugcac

SEQ ID NO: 3982926 - RNA, 12 nt, Human herpesvirus 5
ccuggagcagcg

SEQ ID NO: 3982927 - RNA, 13 nt, Human herpesvirus 5
ccuggagcagcgg

SEQ ID NO: 3982928 - RNA, 18 nt, Human herpesvirus 5
ccugggaacgcgcgcacg

SEQ ID NO: 3982929 - RNA, 20 nt, Human herpesvirus 5
ccugguauacgaggcucucu

SEQ ID NO: 3982930 - RNA, 20 nt, Human herpesvirus 5
ccuguguaugaggaucagga

SEQ ID NO: 3982931 - RNA, 15 nt, Human herpesvirus 5
caguuugcggcgcag

SEQ ID NO: 3982932 - RNA, 21 nt, Human herpesvirus 5
cauaaacuguuccgcccugcu

SEQ ID NO: 3982933 - RNA, 16 nt, Human herpesvirus 5
cauacagcaacaccau

SEQ ID NO: 3982934 - RNA, 15 nt, Human herpesvirus 5
caucaccgacccugc

SEQ ID NO: 3982935 - RNA, 16 nt, Human herpesvirus 5
caucagcgcacggugg

SEQ ID NO: 3982936 - RNA, 20 nt, Human herpesvirus 5
caucaggaucuggugcaggc

SEQ ID NO: 3982937 - RNA, 12 nt, Human herpesvirus 5
caucauggagcu

SEQ ID NO: 3982938 - RNA, 20 nt, Human herpesvirus 5
cauccucguggaaggcaccg

SEQ ID NO: 3982939 - RNA, 23 nt, Human herpesvirus 5
caucgaagguaacuucagugggc

SEQ ID NO: 3982940 - RNA, 19 nt, Human herpesvirus 5
caucucgcguaacgugucu

SEQ ID NO: 3982941 - RNA, 18 nt, Human herpesvirus 5
caugaggcgguggcugcg

SEQ ID NO: 3982942 - RNA, 18 nt, Human herpesvirus 5
caugaugcaaauaaagau

SEQ ID NO: 3982943 - RNA, 20 nt, Human herpesvirus 5
caugauguacccgcuggugu

SEQ ID NO: 3982944 - RNA, 14 nt, Human herpesvirus 5
caugccggcagaac

SEQ ID NO: 3982945 - RNA, 22 nt, Human herpesvirus 5
cauggagacaguuuccacgcag

SEQ ID NO: 3982946 - RNA, 19 nt, Human herpesvirus 5
caugggcgacaccgccucg

SEQ ID NO: 3982947 - RNA, 16 nt, Human herpesvirus 5
cauggggagaaaagag

SEQ ID NO: 3982948 - RNA, 19 nt, Human herpesvirus 5
cauggucggugacaucacc

SEQ ID NO: 3982949 - RNA, 21 nt, Human herpesvirus 5
cauguagaagcacccauuaca

SEQ ID NO: 3982950 - RNA, 13 nt, Human herpesvirus 5
cauguccagccug

SEQ ID NO: 3982951 - RNA, 13 nt, Human herpesvirus 5
caugugcagcugg

SEQ ID NO: 3982952 - RNA, 16 nt, Human herpesvirus 5
caugugcagcugguga

SEQ ID NO: 3982953 - RNA, 21 nt, Human herpesvirus 5
cauguuucugguuuuuggacu

SEQ ID NO: 3982954 - RNA, 15 nt, Human herpesvirus 5
cauuccccaccuucc

SEQ ID NO: 3982955 - RNA, 22 nt, Human herpesvirus 5
cauucgauacgcugcuuuuggc

SEQ ID NO: 3982956 - RNA, 21 nt, Human herpesvirus 5
cauugaacgcgguacaugugc

SEQ ID NO: 3982957 - RNA, 22 nt, Human herpesvirus 5
cauugagaaagcuaacauuccc

SEQ ID NO: 3982958 - RNA, 21 nt, Human herpesvirus 5
ccaaacgcgugcgggugcaug

SEQ ID NO: 3982959 - RNA, 16 nt, Human herpesvirus 5
ccaaagccgccgccga

SEQ ID NO: 3982960 - RNA, 22 nt, Human herpesvirus 5
ccaagaauaaaaagugcgucua

SEQ ID NO: 3982961 - RNA, 17 nt, Human herpesvirus 5
ccaagagacccggcugg

SEQ ID NO: 3982962 - RNA, 17 nt, Human herpesvirus 5
ccaagagcaugcugugg

SEQ ID NO: 3982963 - RNA, 17 nt, Human herpesvirus 5
ccaagccaugcagcacg

SEQ ID NO: 3982964 - RNA, 13 nt, Human herpesvirus 5
ccaagccgcagcg

SEQ ID NO: 3982965 - RNA, 15 nt, Human herpesvirus 5
ccaagccgcagcgcg

SEQ ID NO: 3982966 - RNA, 13 nt, Human herpesvirus 5
ccacacacaucug

SEQ ID NO: 3982967 - RNA, 14 nt, Human herpesvirus 5
ccacagcgccaggc

SEQ ID NO: 3982968 - RNA, 19 nt, Human herpesvirus 5
ccacagcgccaggcggcug

SEQ ID NO: 3982969 - RNA, 18 nt, Human herpesvirus 5
ccaccacgaccaugaugg

SEQ ID NO: 3982970 - RNA, 18 nt, Human herpesvirus 5
ccacccgacugcagccca

SEQ ID NO: 3982971 - RNA, 22 nt, Human herpesvirus 5
aaaacggacgggaaaggcuaac

SEQ ID NO: 3982972 - RNA, 18 nt, Human herpesvirus 5
aaaagugcgucaaagcuc

SEQ ID NO: 3982973 - RNA, 23 nt, Human herpesvirus 5
aaaauuucguaaacgacgucguc

SEQ ID NO: 3982974 - RNA, 12 nt, Human herpesvirus 5
aaacaacaccac

SEQ ID NO: 3982975 - RNA, 18 nt, Human herpesvirus 5
aaacacgacgaaagcguu

SEQ ID NO: 3982976 - RNA, 23 nt, Human herpesvirus 5
aaacauuuuauuuacaucuguac

SEQ ID NO: 3982977 - RNA, 15 nt, Human herpesvirus 5
aaaccgcaggagcug

SEQ ID NO: 3982978 - RNA, 13 nt, Human herpesvirus 5
aaaccgcuuucag

SEQ ID NO: 3982979 - RNA, 22 nt, Human herpesvirus 5
aaaccgucgaaaacaaccacac

SEQ ID NO: 3982980 - RNA, 20 nt, Human herpesvirus 5
aaacuagcauucuggugaga

SEQ ID NO: 3982981 - RNA, 13 nt, Human herpesvirus 5
aaagaaaaaagac

SEQ ID NO: 3982982 - RNA, 14 nt, Human herpesvirus 5
aaagacuguggugg

SEQ ID NO: 3982983 - RNA, 16 nt, Human herpesvirus 5
aaagagccauguuaug

SEQ ID NO: 3982984 - RNA, 23 nt, Human herpesvirus 5
aaagucuacgaucgcuggaaaga

SEQ ID NO: 3982985 - RNA, 22 nt, Human herpesvirus 5
aaauacagggaaugggaaaaac

SEQ ID NO: 3982986 - RNA, 12 nt, Human herpesvirus 5
aaaucuaccuga

SEQ ID NO: 3982987 - RNA, 15 nt, Human herpesvirus 5
aaaucuuaccacagu

SEQ ID NO: 3982988 - RNA, 19 nt, Human herpesvirus 5
aaauuagugucgauacuuu

SEQ ID NO: 3982989 - RNA, 23 nt, Human herpesvirus 5
aacaaccuaugauauaaagcggu

SEQ ID NO: 3982990 - RNA, 18 nt, Human herpesvirus 5
aacaacgucacuucugcu

SEQ ID NO: 3982991 - RNA, 12 nt, Human herpesvirus 5
aacaccgcgagu

SEQ ID NO: 3982992 - RNA, 21 nt, Human herpesvirus 5
aacacguaacgucuucugaag

SEQ ID NO: 3982993 - RNA, 22 nt, Human herpesvirus 5
aacacugaaaacaccauuggaa

SEQ ID NO: 3982994 - RNA, 22 nt, Human herpesvirus 5
aacagacuugguacgcugacgu

SEQ ID NO: 3982995 - RNA, 22 nt, Human herpesvirus 5
aacagccuucccuuguaagaca

SEQ ID NO: 3982996 - RNA, 22 nt, Human herpesvirus 5
aacagcggguguccucggugcc

SEQ ID NO: 3982997 - RNA, 15 nt, Human herpesvirus 5
aacaugcccagcauc

SEQ ID NO: 3982998 - RNA, 19 nt, Human herpesvirus 5
aacccguaucugagcggcg

SEQ ID NO: 3982999 - RNA, 20 nt, Human herpesvirus 5
aaccucuaccucguccgccu

SEQ ID NO: 3983000 - RNA, 24 nt, Human herpesvirus 5
aacgacagugucggugugguagcu

SEQ ID NO: 3983001 - RNA, 22 nt, Human herpesvirus 5
aacgagacuaucuacaacacua

SEQ ID NO: 3983002 - RNA, 16 nt, Human herpesvirus 5
aacgccacgucggagc

SEQ ID NO: 3983003 - RNA, 13 nt, Human herpesvirus 5
aacggggugggag

SEQ ID NO: 3983004 - RNA, 16 nt, Human herpesvirus 5
aacgggugggcugggg

SEQ ID NO: 3983005 - RNA, 12 nt, Human herpesvirus 5
aacgugccaggc

SEQ ID NO: 3983006 - RNA, 23 nt, Human herpesvirus 5
aacuacaauguauagauacacgu

SEQ ID NO: 3983007 - RNA, 11 nt, Human herpesvirus 5
aacucagggaa

SEQ ID NO: 3983008 - RNA, 21 nt, Human herpesvirus 5
aacugcugccucgaugcgccu

SEQ ID NO: 3983009 - RNA, 16 nt, Human herpesvirus 5
aacuggccuggcggcg

SEQ ID NO: 3983010 - RNA, 14 nt, Human herpesvirus 5
aacugguuccugca

SEQ ID NO: 3983011 - RNA, 16 nt, Human herpesvirus 5
aacuucuaccaucucc

SEQ ID NO: 3983012 - RNA, 17 nt, Human herpesvirus 5
aacuucugucucggcac

SEQ ID NO: 3983013 - RNA, 13 nt, Human herpesvirus 5
aacuuugcugcua

SEQ ID NO: 3983014 - RNA, 20 nt, Human herpesvirus 5
aagaaucuaggaacacugaa

SEQ ID NO: 3983015 - RNA, 14 nt, Human herpesvirus 5
aagaccgcugccuc

SEQ ID NO: 3983016 - RNA, 16 nt, Human herpesvirus 5
aagacggacuguuuca

SEQ ID NO: 3983017 - RNA, 21 nt, Human herpesvirus 5
aagccgccaauacagcacgua

SEQ ID NO: 3983018 - RNA, 21 nt, Human herpesvirus 5
aagcuucggccggcugcugca

SEQ ID NO: 3983019 - RNA, 22 nt, Human herpesvirus 5
aaggcagugacgcuaggcggcg

SEQ ID NO: 3983020 - RNA, 14 nt, Human herpesvirus 5
aaggcugguuuccc

SEQ ID NO: 3983021 - RNA, 14 nt, Human herpesvirus 5
aaggguaggugcgc

SEQ ID NO: 3983022 - RNA, 18 nt, Human herpesvirus 5
aaguaagcauggcuuaca

SEQ ID NO: 3983023 - RNA, 17 nt, Human herpesvirus 5
aaguacaauaucaaaga

SEQ ID NO: 3983024 - RNA, 16 nt, Human herpesvirus 5
aaguacacgccacacg

SEQ ID NO: 3983025 - RNA, 14 nt, Human herpesvirus 5
aaaaagcucccaug

SEQ ID NO: 3983026 - RNA, 12 nt, Human herpesvirus 5
aaaaauacugac

SEQ ID NO: 3983027 - RNA, 19 nt, Human herpesvirus 5
aaaacaugcacauaaacaa

SEQ ID NO: 3983028 - RNA, 19 nt, Human herpesvirus 5
aaaagacuuaccaccuccu

SEQ ID NO: 3983029 - RNA, 13 nt, Human herpesvirus 5
aaaagcaccauga

SEQ ID NO: 3983030 - RNA, 17 nt, Human herpesvirus 5
aaaagugcgucaaagcu

SEQ ID NO: 3983031 - RNA, 23 nt, Human herpesvirus 5
aaaauaugggaauuccccugccu

SEQ ID NO: 3983032 - RNA, 12 nt, Human herpesvirus 5
aaacagcagcuc

SEQ ID NO: 3983033 - RNA, 19 nt, Human herpesvirus 5
aaacaggaaaggaauacaa

SEQ ID NO: 3983034 - RNA, 14 nt, Human herpesvirus 5
aaacaguacggaca

SEQ ID NO: 3983035 - RNA, 18 nt, Human herpesvirus 5
aaacauuuguugagucau

SEQ ID NO: 3983036 - RNA, 20 nt, Human herpesvirus 5
aaaccgcaggcccucggaag

SEQ ID NO: 3983037 - RNA, 13 nt, Human herpesvirus 5
aaacgcugcuugg

SEQ ID NO: 3983038 - RNA, 20 nt, Human herpesvirus 5
aaacguugagacuaccacau

SEQ ID NO: 3983039 - RNA, 18 nt, Human herpesvirus 5
aaacucgucguuuccccc

SEQ ID NO: 3983040 - RNA, 13 nt, Human herpesvirus 5
aaacucuauggac

SEQ ID NO: 3983041 - RNA, 20 nt, Human herpesvirus 5
aaagccgacaaccugcugca

SEQ ID NO: 3983042 - RNA, 19 nt, Human herpesvirus 5
aaagccgcgcucgcccccg

SEQ ID NO: 3983043 - RNA, 21 nt, Human herpesvirus 5
aaagcgucaaucagacuuucg

SEQ ID NO: 3983044 - RNA, 13 nt, Human herpesvirus 5
aaagcuaacauuc

SEQ ID NO: 3983045 - RNA, 18 nt, Human herpesvirus 5
aaagggcgaacguccucg

SEQ ID NO: 3983046 - RNA, 20 nt, Human herpesvirus 5
aaagugauuauaucuuucua

SEQ ID NO: 3983047 - RNA, 12 nt, Human herpesvirus 5
aaauaccaacac

SEQ ID NO: 3983048 - RNA, 12 nt, Human herpesvirus 5
acuagcacagag

SEQ ID NO: 3983049 - RNA, 18 nt, Human herpesvirus 5
acucaacauguuagcuuu

SEQ ID NO: 3983050 - RNA, 22 nt, Human herpesvirus 5
acuccgaauaacaacacaucaa

SEQ ID NO: 3983051 - RNA, 21 nt, Human herpesvirus 5
acucgcgacgcuucauauuag

SEQ ID NO: 3983052 - RNA, 21 nt, Human herpesvirus 5
acucgcugccgcagcugcugg

SEQ ID NO: 3983053 - RNA, 19 nt, Human herpesvirus 5
acucuaucgcgacagacau

SEQ ID NO: 3983054 - RNA, 13 nt, Human herpesvirus 5
acugcacuuccug

SEQ ID NO: 3983055 - RNA, 15 nt, Human herpesvirus 5
acugcauccaucaca

SEQ ID NO: 3983056 - RNA, 20 nt, Human herpesvirus 5
acugcgauaauaacggcgca

SEQ ID NO: 3983057 - RNA, 22 nt, Human herpesvirus 5
acuggacucgguuucgcuguag

SEQ ID NO: 3983058 - RNA, 20 nt, Human herpesvirus 5
acuggagagacuuucaauga

SEQ ID NO: 3983059 - RNA, 15 nt, Human herpesvirus 5
acuggccuggcggcg

SEQ ID NO: 3983060 - RNA, 21 nt, Human herpesvirus 5
acuggggucaaaagccugggu

SEQ ID NO: 3983061 - RNA, 15 nt, Human herpesvirus 5
acuugaguacuuuca

SEQ ID NO: 3983062 - RNA, 16 nt, Human herpesvirus 5
acuuguccuugcgcgc

SEQ ID NO: 3983063 - RNA, 15 nt, Human herpesvirus 5
acuuuacauaaaacc

SEQ ID NO: 3983064 - RNA, 15 nt, Human herpesvirus 5
agaaaaaaaagagag

SEQ ID NO: 3983065 - RNA, 15 nt, Human herpesvirus 5
agaacaagcgguggu

SEQ ID NO: 3983066 - RNA, 18 nt, Human herpesvirus 5
agaacgaucccuuuaucc

SEQ ID NO: 3983067 - RNA, 21 nt, Human herpesvirus 5
agaacuuuguagugcgcgccg

SEQ ID NO: 3983068 - RNA, 22 nt, Human herpesvirus 5
agaagagauggcguccgggcuc

SEQ ID NO: 3983069 - RNA, 16 nt, Human herpesvirus 5
agaagucucuuucucu

SEQ ID NO: 3983070 - RNA, 17 nt, Human herpesvirus 5
agaaugccucuacuugg

SEQ ID NO: 3983071 - RNA, 12 nt, Human herpesvirus 5
agacacacacca

SEQ ID NO: 3983072 - RNA, 19 nt, Human herpesvirus 5
agacaucuuaugaagcuga

SEQ ID NO: 3983073 - RNA, 13 nt, Human herpesvirus 5
agaccgacagcgg

SEQ ID NO: 3983074 - RNA, 13 nt, Human herpesvirus 5
agaccgccgccgc

SEQ ID NO: 3983075 - RNA, 12 nt, Human herpesvirus 5
agaccgcugccu

SEQ ID NO: 3983076 - RNA, 13 nt, Human herpesvirus 5
agaccuacagcac

SEQ ID NO: 3983077 - RNA, 20 nt, Human herpesvirus 5
agacgauuuuaugcgccgcc

SEQ ID NO: 3983078 - RNA, 12 nt, Human herpesvirus 5
agacgcugcgcu

SEQ ID NO: 3983079 - RNA, 17 nt, Human herpesvirus 5
agacggcgugacacagc

SEQ ID NO: 3983080 - RNA, 13 nt, Human herpesvirus 5
agacgggccuggu

SEQ ID NO: 3983081 - RNA, 16 nt, Human herpesvirus 5
agacgggguugaucaa

SEQ ID NO: 3983082 - RNA, 18 nt, Human herpesvirus 5
agacugcgguuaacccua

SEQ ID NO: 3983083 - RNA, 15 nt, Human herpesvirus 5
agacugguggugaga

SEQ ID NO: 3983084 - RNA, 18 nt, Human herpesvirus 5
agagaaggguaggugcgc

SEQ ID NO: 3983085 - RNA, 15 nt, Human herpesvirus 5
agagccaaaggugac

SEQ ID NO: 3983086 - RNA, 16 nt, Human herpesvirus 5
agagccaccaggugcc

SEQ ID NO: 3983087 - RNA, 17 nt, Human herpesvirus 5
agagccaccuuggugga

SEQ ID NO: 3983088 - RNA, 13 nt, Human herpesvirus 5
agagcgguccgcc

SEQ ID NO: 3983089 - RNA, 23 nt, Human herpesvirus 5
agaggaggaugggggggaccggg

SEQ ID NO: 3983090 - RNA, 18 nt, Human herpesvirus 5
agagggcgcgcgucugga

SEQ ID NO: 3983091 - RNA, 18 nt, Human herpesvirus 5
agaguagugguggggcug

SEQ ID NO: 3983092 - RNA, 14 nt, Human herpesvirus 5
agaguuacaugcaa

SEQ ID NO: 3983093 - RNA, 20 nt, Human herpesvirus 5
agaugcggggucgacugcgu

SEQ ID NO: 3983094 - RNA, 14 nt, Human herpesvirus 5
agauucuaaagcca

SEQ ID NO: 3983095 - RNA, 15 nt, Human herpesvirus 5
agauuucgcccgacu

SEQ ID NO: 3983096 - RNA, 11 nt, Human herpesvirus 5
agauuucuguc

SEQ ID NO: 3983097 - RNA, 13 nt, Human herpesvirus 5
agcacgcggauga

SEQ ID NO: 3983098 - RNA, 15 nt, Human herpesvirus 5
agcacgggcugcugg

SEQ ID NO: 3983099 - RNA, 21 nt, Human herpesvirus 5
agcacgucuagcaggcccagg

SEQ ID NO: 3983100 - RNA, 15 nt, Human herpesvirus 5
agcacucggcgcugu

SEQ ID NO: 3983101 - RNA, 13 nt, Human herpesvirus 5
agcagcucgcgcu

SEQ ID NO: 3983102 - RNA, 23 nt, Human herpesvirus 5
agcaggcuaaagaagaccaugac

SEQ ID NO: 3983103 - RNA, 23 nt, Human herpesvirus 5
agcauacggggaggagacacaga

SEQ ID NO: 3983104 - RNA, 21 nt, Human herpesvirus 5
agcaucaguuucugcggcgua

SEQ ID NO: 3983105 - RNA, 17 nt, Human herpesvirus 5
agccaacagcagggagc

SEQ ID NO: 3983106 - RNA, 18 nt, Human herpesvirus 5
agccaccgacacagcagc

SEQ ID NO: 3983107 - RNA, 19 nt, Human herpesvirus 5
agccaccgacacagcagca

SEQ ID NO: 3983108 - RNA, 16 nt, Human herpesvirus 5
agccaccgucccucag

SEQ ID NO: 3983109 - RNA, 14 nt, Human herpesvirus 5
agccacgcggcgua

SEQ ID NO: 3983110 - RNA, 18 nt, Human herpesvirus 5
agccagcuacagccacga

SEQ ID NO: 3983111 - RNA, 17 nt, Human herpesvirus 5
agccaggugaccagcag

SEQ ID NO: 3983112 - RNA, 16 nt, Human herpesvirus 5
agccccaagcgguacg

SEQ ID NO: 3983113 - RNA, 21 nt, Human herpesvirus 5
agccccaucauggcccaagga

SEQ ID NO: 3983114 - RNA, 16 nt, Human herpesvirus 5
agcccuacuuuguguu

SEQ ID NO: 3983115 - RNA, 14 nt, Human herpesvirus 5
agccgcagcgcgga

SEQ ID NO: 3983116 - RNA, 19 nt, Human herpesvirus 5
agccgcggugcaggccgcg

SEQ ID NO: 3983117 - RNA, 17 nt, Human herpesvirus 5
agccggucaucuccgag

SEQ ID NO: 3983118 - RNA, 18 nt, Human herpesvirus 5
agccucaagaauccgucc

SEQ ID NO: 3983119 - RNA, 19 nt, Human herpesvirus 5
agccuccggaacccucugg

SEQ ID NO: 3983120 - RNA, 13 nt, Human herpesvirus 5
agccuggggcacc

SEQ ID NO: 3983121 - RNA, 19 nt, Human herpesvirus 5
agccuuaggaacagggaag

SEQ ID NO: 3983122 - RNA, 19 nt, Human herpesvirus 5
agccuucccuuguaagaca

SEQ ID NO: 3983123 - RNA, 17 nt, Human herpesvirus 5
agcgacgucaacggugg

SEQ ID NO: 3983124 - RNA, 22 nt, Human herpesvirus 5
agcgaguggggcaacugcugcc

SEQ ID NO: 3983125 - RNA, 16 nt, Human herpesvirus 5
agcgccaggcggcuga

SEQ ID NO: 3983126 - RNA, 20 nt, Human herpesvirus 5
agcgccaggcggcugaucug

SEQ ID NO: 3983127 - RNA, 17 nt, Human herpesvirus 5
agcgcccgaagccgcgc

SEQ ID NO: 3983128 - RNA, 11 nt, Human herpesvirus 5
agcgccgccgc

SEQ ID NO: 3983129 - RNA, 18 nt, Human herpesvirus 5
agcgccgcggcaccagag

SEQ ID NO: 3983130 - RNA, 16 nt, Human herpesvirus 5
agcgccguccugcaga

SEQ ID NO: 3983131 - RNA, 21 nt, Human herpesvirus 5
agcgccgugcucagcggcgug

SEQ ID NO: 3983132 - RNA, 13 nt, Human herpesvirus 5
agcgcuacgugcg

SEQ ID NO: 3983133 - RNA, 18 nt, Human herpesvirus 5
agcggccgugguggccgu

SEQ ID NO: 3983134 - RNA, 17 nt, Human herpesvirus 5
agcggcggacuuggcag

SEQ ID NO: 3983135 - RNA, 20 nt, Human herpesvirus 5
agcggcggacuuggcagcgg

SEQ ID NO: 3983136 - RNA, 15 nt, Human herpesvirus 5
agcggcggcgguggu

SEQ ID NO: 3983137 - RNA, 17 nt, Human herpesvirus 5
agcguagucuggcagcg

SEQ ID NO: 3983138 - RNA, 20 nt, Human herpesvirus 5
agcguauuuucuacuccgaa

SEQ ID NO: 3983139 - RNA, 20 nt, Human herpesvirus 5
agcgucucauuugucuuuac

SEQ ID NO: 3983140 - RNA, 17 nt, Human herpesvirus 5
agcgucucuugcggcgc

SEQ ID NO: 3983141 - RNA, 15 nt, Human herpesvirus 5
agcgugcugcucugc

SEQ ID NO: 3983142 - RNA, 13 nt, Human herpesvirus 5
agcguuggcggcg

SEQ ID NO: 3983143 - RNA, 12 nt, Human herpesvirus 5
agcucagcaucg

SEQ ID NO: 3983144 - RNA, 21 nt, Human herpesvirus 5
agcuccauuaugcaggagacg

SEQ ID NO: 3983145 - RNA, 16 nt, Human herpesvirus 5
agcucgucgccagcgc

SEQ ID NO: 3983146 - RNA, 20 nt, Human herpesvirus 5
agcucuuaaaggacgugaug

SEQ ID NO: 3983147 - RNA, 16 nt, Human herpesvirus 5
agcugcccgccggcgg

SEQ ID NO: 3983148 - RNA, 16 nt, Human herpesvirus 5
agcugcuggacgacgu

SEQ ID NO: 3983149 - RNA, 17 nt, Human herpesvirus 5
agcugucagccucucac

SEQ ID NO: 3983150 - RNA, 15 nt, Human herpesvirus 5
agcuuuugcccgcac

SEQ ID NO: 3983151 - RNA, 21 nt, Human herpesvirus 5
agcuuuuuaauaaaaaacaag

SEQ ID NO: 3983152 - RNA, 21 nt, Human herpesvirus 5
aggaaccaccguagcacugcg

SEQ ID NO: 3983153 - RNA, 14 nt, Human herpesvirus 5
aggaaggaaaaaac

SEQ ID NO: 3983154 - RNA, 16 nt, Human herpesvirus 5
aggaagucgaucugga

SEQ ID NO: 3983155 - RNA, 16 nt, Human herpesvirus 5
aggaccguacacgcac

SEQ ID NO: 3983156 - RNA, 14 nt, Human herpesvirus 5
aggacgaggcaggg

SEQ ID NO: 3983157 - RNA, 14 nt, Human herpesvirus 5
aggacgcgcuggcu

SEQ ID NO: 3983158 - RNA, 21 nt, Human herpesvirus 5
aggacgggaugcacagcgucu

SEQ ID NO: 3983159 - RNA, 14 nt, Human herpesvirus 5
aggaggcaaauaua

SEQ ID NO: 3983160 - RNA, 17 nt, Human herpesvirus 5
aggaggugaccuggcug

SEQ ID NO: 3983161 - RNA, 21 nt, Human herpesvirus 5
aggcaaagaaaaaaaaaagga

SEQ ID NO: 3983162 - RNA, 15 nt, Human herpesvirus 5
aggcacgucggggcu

SEQ ID NO: 3983163 - RNA, 19 nt, Human herpesvirus 5
gcggguccauuggagccgc

SEQ ID NO: 3983164 - RNA, 12 nt, Human herpesvirus 5
gcgggugcauga

SEQ ID NO: 3983165 - RNA, 14 nt, Human herpesvirus 5
gcgguaacuggcag

SEQ ID NO: 3983166 - RNA, 15 nt, Human herpesvirus 5
gcgguaucgcgcaca

SEQ ID NO: 3983167 - RNA, 17 nt, Human herpesvirus 5
gcggugaacgugcgcga

SEQ ID NO: 3983168 - RNA, 13 nt, Human herpesvirus 5
gcguaccaacaua

SEQ ID NO: 3983169 - RNA, 12 nt, Human herpesvirus 5
gcgucaaagcuc

SEQ ID NO: 3983170 - RNA, 17 nt, Human herpesvirus 5
gcguccgacgccggguu

SEQ ID NO: 3983171 - RNA, 17 nt, Human herpesvirus 5
gcgucgaccccaaccuu

SEQ ID NO: 3983172 - RNA, 17 nt, Human herpesvirus 5
gcgucgcccucgacggc

SEQ ID NO: 3983173 - RNA, 20 nt, Human herpesvirus 5
gcgucuuuauuuacgaggua

SEQ ID NO: 3983174 - RNA, 15 nt, Human herpesvirus 5
gcgugcaccugcugc

SEQ ID NO: 3983175 - RNA, 22 nt, Human herpesvirus 5
gcgugcaccugcugccgccacu

SEQ ID NO: 3983176 - RNA, 19 nt, Human herpesvirus 5
gcguggaccagacggcguc

SEQ ID NO: 3983177 - RNA, 14 nt, Human herpesvirus 5
gcguggccggcgug

SEQ ID NO: 3983178 - RNA, 21 nt, Human herpesvirus 5
gcguggucaacgcuuuggaaa

SEQ ID NO: 3983179 - RNA, 20 nt, Human herpesvirus 5
gcguguguguuucuuaacua

SEQ ID NO: 3983180 - RNA, 18 nt, Human herpesvirus 5
gcguuaugauaucuacag

SEQ ID NO: 3983181 - RNA, 19 nt, Human herpesvirus 5
gcguuguuugggaacuuug

SEQ ID NO: 3983182 - RNA, 15 nt, Human herpesvirus 5
gcuaauuauugccau

SEQ ID NO: 3983183 - RNA, 23 nt, Human herpesvirus 5
gcuacauucgccgcaaugggcuu

SEQ ID NO: 3983184 - RNA, 20 nt, Human herpesvirus 5
gcuaccucaugacgcacgcc

SEQ ID NO: 3983185 - RNA, 15 nt, Human herpesvirus 5
gcuaguuagacaggc

SEQ ID NO: 3983186 - RNA, 16 nt, Human herpesvirus 5
gcuauaagacagccuu

SEQ ID NO: 3983187 - RNA, 19 nt, Human herpesvirus 5
gcuauugggucacagccgc

SEQ ID NO: 3983188 - RNA, 23 nt, Human herpesvirus 5
gcucacagucuaucccuauggca

SEQ ID NO: 3983189 - RNA, 19 nt, Human herpesvirus 5
gcucaucgucacgcucaag

SEQ ID NO: 3983190 - RNA, 22 nt, Human herpesvirus 5
gcuccaaaacgacguuaacgac

SEQ ID NO: 3983191 - RNA, 20 nt, Human herpesvirus 5
gcuccaagugcaagcgccgc

SEQ ID NO: 3983192 - RNA, 20 nt, Human herpesvirus 5
gcuccacacgcaucugcaag

SEQ ID NO: 3983193 - RNA, 21 nt, Human herpesvirus 5
gcucccacguuuacgcgaaac

SEQ ID NO: 3983194 - RNA, 14 nt, Human herpesvirus 5
gcuccgacgcagga

SEQ ID NO: 3983195 - RNA, 17 nt, Human herpesvirus 5
gcucgcucugacgccgc

SEQ ID NO: 3983196 - RNA, 19 nt, Human herpesvirus 5
gcucggaccgugacggugg

SEQ ID NO: 3983197 - RNA, 19 nt, Human herpesvirus 5
gcucggcggccacggcguc

SEQ ID NO: 3983198 - RNA, 21 nt, Human herpesvirus 5
gcucgggaacagacccgauac

SEQ ID NO: 3983199 - RNA, 19 nt, Human herpesvirus 5
gcucggucagcuugaggcu

SEQ ID NO: 3983200 - RNA, 23 nt, Human herpesvirus 5
gcucgugcgugucgcugggcugg

SEQ ID NO: 3983201 - RNA, 12 nt, Human herpesvirus 5
gcucuagguuug

SEQ ID NO: 3983202 - RNA, 21 nt, Human herpesvirus 5
gcucugucggaugaggcaggc

SEQ ID NO: 3983203 - RNA, 15 nt, Human herpesvirus 5
gcucuuggcgccgcg

SEQ ID NO: 3983204 - RNA, 14 nt, Human herpesvirus 5
gcugacgaugagca

SEQ ID NO: 3983205 - RNA, 23 nt, Human herpesvirus 5
gcugauaauaaaggcucucuguu

SEQ ID NO: 3983206 - RNA, 13 nt, Human herpesvirus 5
gcugauccgcagg

SEQ ID NO: 3983207 - RNA, 21 nt, Human herpesvirus 5
gcugcacacggagcacgggcu

SEQ ID NO: 3983208 - RNA, 13 nt, Human herpesvirus 5
gcugcaggcaggu

SEQ ID NO: 3983209 - RNA, 16 nt, Human herpesvirus 5
gcugcaugagaacacg

SEQ ID NO: 3983210 - RNA, 14 nt, Human herpesvirus 5
gcugccaccagggc

SEQ ID NO: 3983211 - RNA, 20 nt, Human herpesvirus 5
gcugccgccgcuguggcugc

SEQ ID NO: 3983212 - RNA, 19 nt, Human herpesvirus 5
gcugccgcucagcgagcuc

SEQ ID NO: 3983213 - RNA, 23 nt, Human herpesvirus 5
gcugccggucuacagacugggcg

SEQ ID NO: 3983214 - RNA, 14 nt, Human herpesvirus 5
gcugcgcaggccgc

SEQ ID NO: 3983215 - RNA, 15 nt, Human herpesvirus 5
gcugcgcaggccgcc

SEQ ID NO: 3983216 - RNA, 14 nt, Human herpesvirus 5
gcugcgucugucuu

SEQ ID NO: 3983217 - RNA, 15 nt, Human herpesvirus 5
gcugcuccucggagc

SEQ ID NO: 3983218 - RNA, 19 nt, Human herpesvirus 5
gcugcugagacugagacug

SEQ ID NO: 3983219 - RNA, 15 nt, Human herpesvirus 5
gcugcugcaccacag

SEQ ID NO: 3983220 - RNA, 20 nt, Human herpesvirus 5
gcugcuguugugggugcgga

SEQ ID NO: 3983221 - RNA, 14 nt, Human herpesvirus 5
gcugcuucauccag

SEQ ID NO: 3983222 - RNA, 17 nt, Human herpesvirus 5
gcugcuuucuuuuugca

SEQ ID NO: 3983223 - RNA, 23 nt, Human herpesvirus 5
gcuggcggccguggccuguggcc

SEQ ID NO: 3983224 - RNA, 21 nt, Human herpesvirus 5
gcuggcugucgagcugguuaa

SEQ ID NO: 3983225 - RNA, 16 nt, Human herpesvirus 5
gcugggauccgccgcc

SEQ ID NO: 3983226 - RNA, 17 nt, Human herpesvirus 5
gcugggauccgccgcca

SEQ ID NO: 3983227 - RNA, 20 nt, Human herpesvirus 5
gcuguccauagugcgccaag

SEQ ID NO: 3983228 - RNA, 19 nt, Human herpesvirus 5
gcuguggcuucucuggaga

SEQ ID NO: 3983229 - RNA, 15 nt, Human herpesvirus 5
gcuguugaccugggu

SEQ ID NO: 3983230 - RNA, 16 nt, Human herpesvirus 5
gcuuacugccugccgc

SEQ ID NO: 3983231 - RNA, 19 nt, Human herpesvirus 5
gcuuagacauuccccaccu

SEQ ID NO: 3983232 - RNA, 13 nt, Human herpesvirus 5
gcuucgcgacugg

SEQ ID NO: 3983233 - RNA, 21 nt, Human herpesvirus 5
gcuuuccaagcugucguggug

SEQ ID NO: 3983234 - RNA, 13 nt, Human herpesvirus 5
gcuuugacgcacu

SEQ ID NO: 3983235 - RNA, 14 nt, Human herpesvirus 5
gcuuugguggauaa

SEQ ID NO: 3983236 - RNA, 14 nt, Human herpesvirus 5
ggaaaaacaaagaa

SEQ ID NO: 3983237 - RNA, 13 nt, Human herpesvirus 5
ggaaacgacagua

SEQ ID NO: 3983238 - RNA, 20 nt, Human herpesvirus 5
ggaaaugcccgccaccaugc

SEQ ID NO: 3983239 - RNA, 17 nt, Human herpesvirus 5
ggaacaacccgucgucg

SEQ ID NO: 3983240 - RNA, 14 nt, Human herpesvirus 5
ggaacauguccugg

SEQ ID NO: 3983241 - RNA, 22 nt, Human herpesvirus 5
ggaaccaccguagcacugcgca

SEQ ID NO: 3983242 - RNA, 20 nt, Human herpesvirus 5
ggaagcgcugauguaccugc

SEQ ID NO: 3983243 - RNA, 14 nt, Human herpesvirus 5
ggaagcguccgcug

SEQ ID NO: 3983244 - RNA, 21 nt, Human herpesvirus 5
ggaaggcggcucgcuggaagc

SEQ ID NO: 3983245 - RNA, 11 nt, Human herpesvirus 5
ggacaaguauu

SEQ ID NO: 3983246 - RNA, 15 nt, Human herpesvirus 5
ggacacgguagacga

SEQ ID NO: 3983247 - RNA, 12 nt, Human herpesvirus 5
ggacacugggcg

SEQ ID NO: 3983248 - RNA, 23 nt, Human herpesvirus 5
ggaccggggugguggugcugcug

SEQ ID NO: 3983249 - RNA, 23 nt, Human herpesvirus 5
ggaccugaccugucagaaggcag

SEQ ID NO: 3983250 - RNA, 16 nt, Human herpesvirus 5
ggacggcaaggcggag

SEQ ID NO: 3983251 - RNA, 20 nt, Human herpesvirus 5
ggacggugaugaugcugcug

SEQ ID NO: 3983252 - RNA, 14 nt, Human herpesvirus 5
ggacgugguaacga

SEQ ID NO: 3983253 - RNA, 14 nt, Human herpesvirus 5
ggacuuucuccuuu

SEQ ID NO: 3983254 - RNA, 15 nt, Human herpesvirus 5
ggagagccgcacaga

SEQ ID NO: 3983255 - RNA, 12 nt, Human herpesvirus 5
ggagcccacgcc

SEQ ID NO: 3983256 - RNA, 13 nt, Human herpesvirus 5
ggaggacuuuuuc

SEQ ID NO: 3983257 - RNA, 22 nt, Human herpesvirus 5
ggaggccgcacuggacgacguc

SEQ ID NO: 3983258 - RNA, 18 nt, Human herpesvirus 5
ggagguggucgagcgcga

SEQ ID NO: 3983259 - RNA, 23 nt, Human herpesvirus 5
ggaucacgacgacgcgcccccca

SEQ ID NO: 3983260 - RNA, 22 nt, Human herpesvirus 5
ggaugcgcgaagcugcgcaggc

SEQ ID NO: 3983261 - RNA, 15 nt, Human herpesvirus 5
ggauugggcggacgu

SEQ ID NO: 3983262 - RNA, 19 nt, Human herpesvirus 5
ggcaaacuccgacauucgc

SEQ ID NO: 3983263 - RNA, 19 nt, Human herpesvirus 5
ggcaaagaguccaucugcu

SEQ ID NO: 3983264 - RNA, 19 nt, Human herpesvirus 5
ggcaauugcaugucgccca

SEQ ID NO: 3983265 - RNA, 17 nt, Human herpesvirus 5
ggcaccgggaacuuaug

SEQ ID NO: 3983266 - RNA, 15 nt, Human herpesvirus 5
ggcagcacaccugcc

SEQ ID NO: 3983267 - RNA, 14 nt, Human herpesvirus 5
ggccaugagcggca

SEQ ID NO: 3983268 - RNA, 23 nt, Human herpesvirus 5
ggcccaaagaccgcugccucguu

SEQ ID NO: 3983269 - RNA, 24 nt, Human herpesvirus 5
ggcccgagcgguugccgugacgca

SEQ ID NO: 3983270 - RNA, 17 nt, Human herpesvirus 5
ggcccguucgaaggcua

SEQ ID NO: 3983271 - RNA, 19 nt, Human herpesvirus 5
ggcccguuucgacgaaauc

SEQ ID NO: 3983272 - RNA, 12 nt, Human herpesvirus 5
ggccgacgaggc

SEQ ID NO: 3983273 - RNA, 16 nt, Human herpesvirus 5
ggccgacggcagcgug

SEQ ID NO: 3983274 - RNA, 19 nt, Human herpesvirus 5
ggccgccucuucuggcccu

SEQ ID NO: 3983275 - RNA, 23 nt, Human herpesvirus 5
ggccgccugaggaaggggaggag

SEQ ID NO: 3983276 - RNA, 13 nt, Human herpesvirus 5
ggccgcgcaggcc

SEQ ID NO: 3983277 - RNA, 16 nt, Human herpesvirus 5
ggccgucggcgucgcg

SEQ ID NO: 3983278 - RNA, 18 nt, Human herpesvirus 5
guuccgcguuuggucgcc

SEQ ID NO: 3983279 - RNA, 17 nt, Human herpesvirus 5
guuccucauucaaccug

SEQ ID NO: 3983280 - RNA, 18 nt, Human herpesvirus 5
guucuccugccgagacga

SEQ ID NO: 3983281 - RNA, 16 nt, Human herpesvirus 5
guugagagugguggga

SEQ ID NO: 3983282 - RNA, 17 nt, Human herpesvirus 5
guugccgcguggcgcug

SEQ ID NO: 3983283 - RNA, 11 nt, Human herpesvirus 5
guugcgccgca

SEQ ID NO: 3983284 - RNA, 15 nt, Human herpesvirus 5
guuggacuccugugu

SEQ ID NO: 3983285 - RNA, 20 nt, Human herpesvirus 5
guuggccaccaagaaacacc

SEQ ID NO: 3983286 - RNA, 19 nt, Human herpesvirus 5
guuggcucccgcugugcug

SEQ ID NO: 3983287 - RNA, 21 nt, Human herpesvirus 5
guuggucacugacgugcagga

SEQ ID NO: 3983288 - RNA, 15 nt, Human herpesvirus 5
guuguacauggguag

SEQ ID NO: 3983289 - RNA, 17 nt, Human herpesvirus 5
guuguccucuccuccuu

SEQ ID NO: 3983290 - RNA, 16 nt, Human herpesvirus 5
guuuauuucaauaaau

SEQ ID NO: 3983291 - RNA, 21 nt, Human herpesvirus 5
guuuccagagaacgcagcgca

SEQ ID NO: 3983292 - RNA, 21 nt, Human herpesvirus 5
guuucuggaacaagaaacaca

SEQ ID NO: 3983293 - RNA, 16 nt, Human herpesvirus 5
guuugcgccagugggu

SEQ ID NO: 3983294 - RNA, 23 nt, Human herpesvirus 5
guuuuccaaaacgugccaggcug

SEQ ID NO: 3983295 - RNA, 18 nt, Human herpesvirus 5
guuuuuagcgcgugaccu

SEQ ID NO: 3983296 - RNA, 12 nt, Human herpesvirus 5
guuuuuauucau

SEQ ID NO: 3983297 - RNA, 19 nt, Human herpesvirus 5
uaaaagggacgucaaagcu

SEQ ID NO: 3983298 - RNA, 22 nt, Human herpesvirus 5
uaaaccgcccgugccucccgcg

SEQ ID NO: 3983299 - RNA, 16 nt, Human herpesvirus 5
uaaagaaucuaggaac

SEQ ID NO: 3983300 - RNA, 19 nt, Human herpesvirus 5
uaaagucuggguuuccaga

SEQ ID NO: 3983301 - RNA, 14 nt, Human herpesvirus 5
uaacaacacaucaa

SEQ ID NO: 3983302 - RNA, 20 nt, Human herpesvirus 5
uaacccccgacgagcaggcu

SEQ ID NO: 3983303 - RNA, 11 nt, Human herpesvirus 5
uaaccgcaaag

SEQ ID NO: 3983304 - RNA, 15 nt, Human herpesvirus 5
uaaccuacguccgug

SEQ ID NO: 3983305 - RNA, 13 nt, Human herpesvirus 5
uaacgauaugucg

SEQ ID NO: 3983306 - RNA, 13 nt, Human herpesvirus 5
uaacgccacggug

SEQ ID NO: 3983307 - RNA, 15 nt, Human herpesvirus 5
uaagauauaaagaau

SEQ ID NO: 3983308 - RNA, 14 nt, Human herpesvirus 5
uaagccggcagcug

SEQ ID NO: 3983309 - RNA, 15 nt, Human herpesvirus 5
uaagccggcagcugc

SEQ ID NO: 3983310 - RNA, 18 nt, Human herpesvirus 5
uaagcgcgaccggcagca

SEQ ID NO: 3983311 - RNA, 19 nt, Human herpesvirus 5
uaaggagcaaaaccgggua

SEQ ID NO: 3983312 - RNA, 22 nt, Human herpesvirus 5
uaagugacguggauacuaguaa

SEQ ID NO: 3983313 - RNA, 20 nt, Human herpesvirus 5
uaaucugucguacuguccuu

SEQ ID NO: 3983314 - RNA, 16 nt, Human herpesvirus 5
uaauuggagacacaac

SEQ ID NO: 3983315 - RNA, 23 nt, Human herpesvirus 5
uacaaggagcgacguaccagcug

SEQ ID NO: 3983316 - RNA, 19 nt, Human herpesvirus 5
uacaaguauguggaacagc

SEQ ID NO: 3983317 - RNA, 20 nt, Human herpesvirus 5
uacaccaguucguagaucac

SEQ ID NO: 3983318 - RNA, 19 nt, Human herpesvirus 5
uacacccugucaccgaaag

SEQ ID NO: 3983319 - RNA, 15 nt, Human herpesvirus 5
uacaccgcuggagcu

SEQ ID NO: 3983320 - RNA, 19 nt, Human herpesvirus 5
uacagccuugagaaccugc

SEQ ID NO: 3983321 - RNA, 15 nt, Human herpesvirus 5
uacagggugccgcca

SEQ ID NO: 3983322 - RNA, 13 nt, Human herpesvirus 5
uacauaaaaccac

SEQ ID NO: 3983323 - RNA, 12 nt, Human herpesvirus 5
uacaucauacaa

SEQ ID NO: 3983324 - RNA, 20 nt, Human herpesvirus 5
uacaugaugaaugucaucau

SEQ ID NO: 3983325 - RNA, 16 nt, Human herpesvirus 5
uaccaacgcuuccugc

SEQ ID NO: 3983326 - RNA, 17 nt, Human herpesvirus 5
uaccaauacugcaucca

SEQ ID NO: 3983327 - RNA, 19 nt, Human herpesvirus 5
uaccagacgcgauggcccg

SEQ ID NO: 3983328 - RNA, 15 nt, Human herpesvirus 5
uaccaucuggcgcag

SEQ ID NO: 3983329 - RNA, 13 nt, Human herpesvirus 5
uaccccgccgccg

SEQ ID NO: 3983330 - RNA, 14 nt, Human herpesvirus 5
uaccccucgcuggg

SEQ ID NO: 3983331 - RNA, 19 nt, Human herpesvirus 5
uacccgccccagcagacca

SEQ ID NO: 3983332 - RNA, 15 nt, Human herpesvirus 5
uaccgaggcgccgcc

SEQ ID NO: 3983333 - RNA, 19 nt, Human herpesvirus 5
uaccgcauuacugggacgc

SEQ ID NO: 3983334 - RNA, 13 nt, Human herpesvirus 5
uaccgccccaccg

SEQ ID NO: 3983335 - RNA, 16 nt, Human herpesvirus 5
uaccucggccuuuuca

SEQ ID NO: 3983336 - RNA, 17 nt, Human herpesvirus 5
uaccuggaggagauggc

SEQ ID NO: 3983337 - RNA, 16 nt, Human herpesvirus 5
uaccuggcuggcgcag

SEQ ID NO: 3983338 - RNA, 14 nt, Human herpesvirus 5
uacgcacgucgccg

SEQ ID NO: 3983339 - RNA, 18 nt, Human herpesvirus 5
uacgcgaccagcugcugg

SEQ ID NO: 3983340 - RNA, 18 nt, Human herpesvirus 5
uacgcgcuggaggcccug

SEQ ID NO: 3983341 - RNA, 19 nt, Human herpesvirus 5
uacggcccggcagcaccau

SEQ ID NO: 3983342 - RNA, 14 nt, Human herpesvirus 5
uacuaccuccccua

SEQ ID NO: 3983343 - RNA, 14 nt, Human herpesvirus 5
uacuacuaccaaua

SEQ ID NO: 3983344 - RNA, 19 nt, Human herpesvirus 5
uacuauagggaggacgaac

SEQ ID NO: 3983345 - RNA, 16 nt, Human herpesvirus 5
uacuaucguaauguag

SEQ ID NO: 3983346 - RNA, 17 nt, Human herpesvirus 5
uagaagcacccauuaca

SEQ ID NO: 3983347 - RNA, 18 nt, Human herpesvirus 5
uagacaggguaacagccu

SEQ ID NO: 3983348 - RNA, 19 nt, Human herpesvirus 5
uagacaucacaguucacca

SEQ ID NO: 3983349 - RNA, 11 nt, Human herpesvirus 5
uagagaggcug

SEQ ID NO: 3983350 - RNA, 22 nt, Human herpesvirus 5
uagccagcuguguauaguuugu

SEQ ID NO: 3983351 - RNA, 13 nt, Human herpesvirus 5
uagcgggcuguca

SEQ ID NO: 3983352 - RNA, 23 nt, Human herpesvirus 5
uaggcggcgcagcgccagccuua

SEQ ID NO: 3983353 - RNA, 19 nt, Human herpesvirus 5
uagguguggcgaaagccuc

SEQ ID NO: 3983354 - RNA, 22 nt, Human herpesvirus 5
uaguaauggaaaguaucgucac

SEQ ID NO: 3983355 - RNA, 22 nt, Human herpesvirus 5
uagugacgugucgggaaaggag

SEQ ID NO: 3983356 - RNA, 20 nt, Human herpesvirus 5
uaguggucuuucacaucgcc

SEQ ID NO: 3983357 - RNA, 14 nt, Human herpesvirus 5
uauaaagauucacu

SEQ ID NO: 3983358 - RNA, 21 nt, Human herpesvirus 5
uauagcaaucuccgucacgcc

SEQ ID NO: 3983359 - RNA, 16 nt, Human herpesvirus 5
uaucaucaaucaccca

SEQ ID NO: 3983360 - RNA, 18 nt, Human herpesvirus 5
uaucaucuaaagacuaua

SEQ ID NO: 3983361 - RNA, 22 nt, Human herpesvirus 5
uaucaucugucugcgagcaccu

SEQ ID NO: 3983362 - RNA, 17 nt, Human herpesvirus 5
uauccaauaaacccauc

SEQ ID NO: 3983363 - RNA, 22 nt, Human herpesvirus 5
uaucuguguccgcccgagcagg

SEQ ID NO: 3983364 - RNA, 21 nt, Human herpesvirus 5
uaucuuuguagccucaagaau

SEQ ID NO: 3983365 - RNA, 13 nt, Human herpesvirus 5
uaugagggccugc

SEQ ID NO: 3983366 - RNA, 18 nt, Human herpesvirus 5
uaugaugcuccgacuguc

SEQ ID NO: 3983367 - RNA, 16 nt, Human herpesvirus 5
uaugcuaauauaucca

SEQ ID NO: 3983368 - RNA, 12 nt, Human herpesvirus 5
uauggugaccau

SEQ ID NO: 3983369 - RNA, 22 nt, Human herpesvirus 5
uaugugcucccgacccacgguc

SEQ ID NO: 3983370 - RNA, 13 nt, Human herpesvirus 5
uauguggcugcgc

SEQ ID NO: 3983371 - RNA, 22 nt, Human herpesvirus 5
uauucucaacacguaacgucuu

SEQ ID NO: 3983372 - RNA, 16 nt, Human herpesvirus 5
uauugaaaucuaccug

SEQ ID NO: 3983373 - RNA, 13 nt, Human herpesvirus 5
uauuuuacaggua

SEQ ID NO: 3983374 - RNA, 15 nt, Human herpesvirus 5
ucaaaagccugggua

SEQ ID NO: 3983375 - RNA, 22 nt, Human herpesvirus 5
ucaaauuuuaucuuggauaaau

SEQ ID NO: 3983376 - RNA, 14 nt, Human herpesvirus 5
ucaacagcagcaac

SEQ ID NO: 3983377 - RNA, 17 nt, Human herpesvirus 5
ucaacagcagcaacagc

SEQ ID NO: 3983378 - RNA, 19 nt, Human herpesvirus 5
ucaaccauuggcaacauca

SEQ ID NO: 3983379 - RNA, 20 nt, Human herpesvirus 5
ucaacgacgagaugaaggaa

SEQ ID NO: 3983380 - RNA, 22 nt, Human herpesvirus 5
ucaagaccgaugugugggaccu

SEQ ID NO: 3983381 - RNA, 19 nt, Human herpesvirus 5
ucaagggucacggugccau

SEQ ID NO: 3983382 - RNA, 16 nt, Human herpesvirus 5
ucaauaaucuccugag

SEQ ID NO: 3983383 - RNA, 18 nt, Human herpesvirus 5
ucaauaaucuccugagac

SEQ ID NO: 3983384 - RNA, 21 nt, Human herpesvirus 5
ucaauugcgggcccugcugac

SEQ ID NO: 3983385 - RNA, 21 nt, Human herpesvirus 5
ucacacuaagaauaaagaaaa

SEQ ID NO: 3983386 - RNA, 15 nt, Human herpesvirus 5
ucacacuuaagaaaa

SEQ ID NO: 3983387 - RNA, 18 nt, Human herpesvirus 5
ucaccaaggcgagccacu

SEQ ID NO: 3983388 - RNA, 14 nt, Human herpesvirus 5
ucaccaccaucagc

SEQ ID NO: 3983389 - RNA, 18 nt, Human herpesvirus 5
ucaccaucgugccgcucc

SEQ ID NO: 3983390 - RNA, 12 nt, Human herpesvirus 5
ucacccgccuca

SEQ ID NO: 3983391 - RNA, 20 nt, Human herpesvirus 5
ucaccguauggcugcgcgug

SEQ ID NO: 3983392 - RNA, 14 nt, Human herpesvirus 5
ucaccugcagcgcu

SEQ ID NO: 3983393 - RNA, 21 nt, Human herpesvirus 5
aacuauuccuccguguucuua

SEQ ID NO: 3983394 - RNA, 20 nt, Human herpesvirus 5
aagaaacccucaaaacauca

SEQ ID NO: 3983395 - RNA, 15 nt, Human herpesvirus 5
aagaagaaccugccg

SEQ ID NO: 3983396 - RNA, 19 nt, Human herpesvirus 5
aagaaugcaacgcuuucag

SEQ ID NO: 3983397 - RNA, 22 nt, Human herpesvirus 5
aagaccauuaacaauuccacgc

SEQ ID NO: 3983398 - RNA, 20 nt, Human herpesvirus 5
aagaggaagccgcugcuaaa

SEQ ID NO: 3983399 - RNA, 20 nt, Human herpesvirus 5
aagaugggacgugguaacga

SEQ ID NO: 3983400 - RNA, 17 nt, Human herpesvirus 5
aagcccguggcccagga

SEQ ID NO: 3983401 - RNA, 23 nt, Human herpesvirus 5
aagcccuacuuuguguuucucgc

SEQ ID NO: 3983402 - RNA, 19 nt, Human herpesvirus 5
aagccgacaaccugcugca

SEQ ID NO: 3983403 - RNA, 13 nt, Human herpesvirus 5
aagcguucagugu

SEQ ID NO: 3983404 - RNA, 18 nt, Human herpesvirus 5
aagcugcggcggcuuggg

SEQ ID NO: 3983405 - RNA, 12 nt, Human herpesvirus 5
aagcuguaaggu

SEQ ID NO: 3983406 - RNA, 17 nt, Human herpesvirus 5
aaggccgugccgccgcg

SEQ ID NO: 3983407 - RNA, 17 nt, Human herpesvirus 5
aaggcgcgggugguguu

SEQ ID NO: 3983408 - RNA, 16 nt, Human herpesvirus 5
aagggauaguggcucg

SEQ ID NO: 3983409 - RNA, 18 nt, Human herpesvirus 5
aagggcgcgggcggccag

SEQ ID NO: 3983410 - RNA, 20 nt, Human herpesvirus 5
aaguaccucuaacaacguca

SEQ ID NO: 3983411 - RNA, 13 nt, Human herpesvirus 5
aagucacaggaaa

SEQ ID NO: 3983412 - RNA, 15 nt, Human herpesvirus 5
aaguccccccacgga

SEQ ID NO: 3983413 - RNA, 22 nt, Human herpesvirus 5
aagugccugcacgaccugcucc

SEQ ID NO: 3983414 - RNA, 13 nt, Human herpesvirus 5
aaguguugaccac

SEQ ID NO: 3983415 - RNA, 13 nt, Human herpesvirus 5
aauaaaaaacagc

SEQ ID NO: 3983416 - RNA, 18 nt, Human herpesvirus 5
aauacggcugccacuaca

SEQ ID NO: 3983417 - RNA, 19 nt, Human herpesvirus 5
aaucaccgucgagaaaacu

SEQ ID NO: 3983418 - RNA, 19 nt, Human herpesvirus 5
aaucacuuuuaacagcuca

SEQ ID NO: 3983419 - RNA, 12 nt, Human herpesvirus 5
aauccggcggcg

SEQ ID NO: 3983420 - RNA, 20 nt, Human herpesvirus 5
aaucuaggaacacugaaaac

SEQ ID NO: 3983421 - RNA, 15 nt, Human herpesvirus 5
aauucaauaaaaacc

SEQ ID NO: 3983422 - RNA, 22 nt, Human herpesvirus 5
aauugcgaagccagcuacagcc

SEQ ID NO: 3983423 - RNA, 20 nt, Human herpesvirus 5
aauugcucuacugcaacugc

SEQ ID NO: 3983424 - RNA, 18 nt, Human herpesvirus 5
acaaaaaaaaggaggaca

SEQ ID NO: 3983425 - RNA, 17 nt, Human herpesvirus 5
acaaagcccgggccgcc

SEQ ID NO: 3983426 - RNA, 14 nt, Human herpesvirus 5
acaaccugcugcac

SEQ ID NO: 3983427 - RNA, 16 nt, Human herpesvirus 5
acaaccugugguguac

SEQ ID NO: 3983428 - RNA, 18 nt, Human herpesvirus 5
acaagacggaggagacac

SEQ ID NO: 3983429 - RNA, 19 nt, Human herpesvirus 5
acaagcuguggcugcacac

SEQ ID NO: 3983430 - RNA, 13 nt, Human herpesvirus 5
acaaugucacugu

SEQ ID NO: 3983431 - RNA, 17 nt, Human herpesvirus 5
acacaggccagcugcca

SEQ ID NO: 3983432 - RNA, 22 nt, Human herpesvirus 5
acaccaguauugguucugggcg

SEQ ID NO: 3983433 - RNA, 18 nt, Human herpesvirus 5
acaccugagacuggucug

SEQ ID NO: 3983434 - RNA, 19 nt, Human herpesvirus 5
acaccuguuggagcaacgg

SEQ ID NO: 3983435 - RNA, 23 nt, Human herpesvirus 5
acacgccauaacaaaccacggac

SEQ ID NO: 3983436 - RNA, 13 nt, Human herpesvirus 5
acgacgacgcgcc

SEQ ID NO: 3983437 - RNA, 17 nt, Human herpesvirus 5
acgacgacgcgcccccc

SEQ ID NO: 3983438 - RNA, 13 nt, Human herpesvirus 5
acgacgcggcguu

SEQ ID NO: 3983439 - RNA, 18 nt, Human herpesvirus 5
acgacggcgguuucagcu

SEQ ID NO: 3983440 - RNA, 20 nt, Human herpesvirus 5
acgagcgccguccugcagac

SEQ ID NO: 3983441 - RNA, 19 nt, Human herpesvirus 5
acgaguaucucgacgacug

SEQ ID NO: 3983442 - RNA, 22 nt, Human herpesvirus 5
acgagugacgacgacgcugcuu

SEQ ID NO: 3983443 - RNA, 21 nt, Human herpesvirus 5
acgauaaaaauccuauuguuu

SEQ ID NO: 3983444 - RNA, 16 nt, Human herpesvirus 5
acgaucgcuggugucu

SEQ ID NO: 3983445 - RNA, 20 nt, Human herpesvirus 5
acgcacuuuuuauucuuggu

SEQ ID NO: 3983446 - RNA, 15 nt, Human herpesvirus 5
acgcaggugaggcuc

SEQ ID NO: 3983447 - RNA, 17 nt, Human herpesvirus 5
acgccaacuccgugcca

SEQ ID NO: 3983448 - RNA, 19 nt, Human herpesvirus 5
acgccgcgacaacggccgc

SEQ ID NO: 3983449 - RNA, 16 nt, Human herpesvirus 5
acgccgugggcggcga

SEQ ID NO: 3983450 - RNA, 18 nt, Human herpesvirus 5
acgccuugcaccugggug

SEQ ID NO: 3983451 - RNA, 18 nt, Human herpesvirus 5
acgcgccucauggcggcg

SEQ ID NO: 3983452 - RNA, 17 nt, Human herpesvirus 5
acgcgcgcccgcgccuc

SEQ ID NO: 3983453 - RNA, 15 nt, Human herpesvirus 5
acgcgcggcggcgga

SEQ ID NO: 3983454 - RNA, 22 nt, Human herpesvirus 5
acgcgcggcuagagcgcgaguu

SEQ ID NO: 3983455 - RNA, 15 nt, Human herpesvirus 5
acgcgcgucggccgc

SEQ ID NO: 3983456 - RNA, 16 nt, Human herpesvirus 5
acgcgcuggaggcccu

SEQ ID NO: 3983457 - RNA, 23 nt, Human herpesvirus 5
acgcggaccgaucaccagaaggc

SEQ ID NO: 3983458 - RNA, 13 nt, Human herpesvirus 5
acgcgugcgggug

SEQ ID NO: 3983459 - RNA, 17 nt, Human herpesvirus 5
acgcguggcccuggucu

SEQ ID NO: 3983460 - RNA, 17 nt, Human herpesvirus 5
acgcuacgaccuggccu

SEQ ID NO: 3983461 - RNA, 14 nt, Human herpesvirus 5
acgcugauggccua

SEQ ID NO: 3983462 - RNA, 13 nt, Human herpesvirus 5
acgcuggaggacg

SEQ ID NO: 3983463 - RNA, 19 nt, Human herpesvirus 5
acgcuggcucacgccggca

SEQ ID NO: 3983464 - RNA, 20 nt, Human herpesvirus 5
acgcugucuugcuuaaugau

SEQ ID NO: 3983465 - RNA, 14 nt, Human herpesvirus 5
acgcuuccugcgcg

SEQ ID NO: 3983466 - RNA, 12 nt, Human herpesvirus 5
acgcuuucagga

SEQ ID NO: 3983467 - RNA, 16 nt, Human herpesvirus 5
acgcuuuuaugaaggu

SEQ ID NO: 3983468 - RNA, 17 nt, Human herpesvirus 5
acggacggcaaggcgga

SEQ ID NO: 3983469 - RNA, 22 nt, Human herpesvirus 5
acggagcucccacguuuacgcg

SEQ ID NO: 3983470 - RNA, 11 nt, Human herpesvirus 5
acggaggagac

SEQ ID NO: 3983471 - RNA, 21 nt, Human herpesvirus 5
acggaguuuucccucagccuc

SEQ ID NO: 3983472 - RNA, 19 nt, Human herpesvirus 5
acggauugcgccaguuguc

SEQ ID NO: 3983473 - RNA, 22 nt, Human herpesvirus 5
acggcagcgccagcggccuggc

SEQ ID NO: 3983474 - RNA, 17 nt, Human herpesvirus 5
acggcauagugccagcc

SEQ ID NO: 3983475 - RNA, 18 nt, Human herpesvirus 5
acggcaucaugcugggcg

SEQ ID NO: 3983476 - RNA, 14 nt, Human herpesvirus 5
acggccagcuccac

SEQ ID NO: 3983477 - RNA, 15 nt, Human herpesvirus 5
acggcccggcagcac

SEQ ID NO: 3983478 - RNA, 15 nt, Human herpesvirus 5
acggccucugggcug

SEQ ID NO: 3983479 - RNA, 22 nt, Human herpesvirus 5
acggccucugggcugagacagg

SEQ ID NO: 3983480 - RNA, 14 nt, Human herpesvirus 5
acggccuguggugc

SEQ ID NO: 3983481 - RNA, 16 nt, Human herpesvirus 5
acggcgcucuuucagc

SEQ ID NO: 3983482 - RNA, 17 nt, Human herpesvirus 5
acggcggaggagacggc

SEQ ID NO: 3983483 - RNA, 13 nt, Human herpesvirus 5
acggcgguuugaa

SEQ ID NO: 3983484 - RNA, 14 nt, Human herpesvirus 5
acggcgucuuccuc

SEQ ID NO: 3983485 - RNA, 14 nt, Human herpesvirus 5
acgggacggcggcg

SEQ ID NO: 3983486 - RNA, 14 nt, Human herpesvirus 5
acgggcugcugguc

SEQ ID NO: 3983487 - RNA, 20 nt, Human herpesvirus 5
acgguaccgcugggaugggu

SEQ ID NO: 3983488 - RNA, 22 nt, Human herpesvirus 5
acgguacgcagucacugcgugu

SEQ ID NO: 3983489 - RNA, 13 nt, Human herpesvirus 5
acggucugcuugc

SEQ ID NO: 3983490 - RNA, 21 nt, Human herpesvirus 5
acggugcgcggcgacaagcug

SEQ ID NO: 3983491 - RNA, 14 nt, Human herpesvirus 5
acgucaaagcucac

SEQ ID NO: 3983492 - RNA, 20 nt, Human herpesvirus 5
acgucacuauccgaugguuu

SEQ ID NO: 3983493 - RNA, 18 nt, Human herpesvirus 5
acgucaguuuaucgagcg

SEQ ID NO: 3983494 - RNA, 22 nt, Human herpesvirus 5
acgucgaucuugacgcugcugg

SEQ ID NO: 3983495 - RNA, 21 nt, Human herpesvirus 5
acgucggccaacaaccacggc

SEQ ID NO: 3983496 - RNA, 23 nt, Human herpesvirus 5
acgucguuagccagcgucggcau

SEQ ID NO: 3983497 - RNA, 22 nt, Human herpesvirus 5
acguggaaggcggcucgcugga

SEQ ID NO: 3983498 - RNA, 23 nt, Human herpesvirus 5
acguuggcucucgcagcccgagg

SEQ ID NO: 3983499 - RNA, 19 nt, Human herpesvirus 5
acuaacguguccgcggaca

SEQ ID NO: 3983500 - RNA, 16 nt, Human herpesvirus 5
acuacguugggucugc

SEQ ID NO: 3983501 - RNA, 19 nt, Human herpesvirus 5
acuacguugggucugcgcu

SEQ ID NO: 3983502 - RNA, 15 nt, Human herpesvirus 5
acuauguggcuccgc

SEQ ID NO: 3983503 - RNA, 15 nt, Human herpesvirus 5
acuauuguauacucu

SEQ ID NO: 3983504 - RNA, 23 nt, Human herpesvirus 5
acuauuuuuuguaacacuacagc

SEQ ID NO: 3983505 - RNA, 16 nt, Human herpesvirus 5
acucagagccacugau

SEQ ID NO: 3983506 - RNA, 17 nt, Human herpesvirus 5
acucccaccacgguuuc

SEQ ID NO: 3983507 - RNA, 19 nt, Human herpesvirus 5
acucgcacaaccuguggug

SEQ ID NO: 3983508 - RNA, 18 nt, Human herpesvirus 5
acucgcaccggcagcaca

SEQ ID NO: 3983509 - RNA, 22 nt, Human herpesvirus 5
acucgcugccgcagcugcugga

SEQ ID NO: 3983510 - RNA, 23 nt, Human herpesvirus 5
acucgcugccgcagcugcuggag

SEQ ID NO: 3983511 - RNA, 17 nt, Human herpesvirus 5
acucuauguuauacucu

SEQ ID NO: 3983512 - RNA, 19 nt, Human herpesvirus 5
acucuauguuauacucugu

SEQ ID NO: 3983513 - RNA, 16 nt, Human herpesvirus 5
acugacacagcuccug

SEQ ID NO: 3983514 - RNA, 21 nt, Human herpesvirus 5
acugaccaagcuaguagcggc

SEQ ID NO: 3983515 - RNA, 14 nt, Human herpesvirus 5
acugaucgccugga

SEQ ID NO: 3983516 - RNA, 19 nt, Human herpesvirus 5
acugcgacggcagcgccag

SEQ ID NO: 3983517 - RNA, 16 nt, Human herpesvirus 5
acugggagacggccug

SEQ ID NO: 3983518 - RNA, 23 nt, Human herpesvirus 5
acuggggacggugaugaugcugc

SEQ ID NO: 3983519 - RNA, 21 nt, Human herpesvirus 5
acugggugcugccgggcggcu

SEQ ID NO: 3983520 - RNA, 21 nt, Human herpesvirus 5
acugucgccacuauguccucc

SEQ ID NO: 3983521 - RNA, 16 nt, Human herpesvirus 5
acugucggggcgcaga

SEQ ID NO: 3983522 - RNA, 15 nt, Human herpesvirus 5
acuucccccuccccu

SEQ ID NO: 3983523 - RNA, 22 nt, Human herpesvirus 5
acuucgcuagucaauaaagaaa

SEQ ID NO: 3983524 - RNA, 12 nt, Human herpesvirus 5
acuucuacggag

SEQ ID NO: 3983525 - RNA, 13 nt, Human herpesvirus 5
acuugaguaccaa

SEQ ID NO: 3983526 - RNA, 15 nt, Human herpesvirus 5
acuuuaggcggcgca

SEQ ID NO: 3983527 - RNA, 22 nt, Human herpesvirus 5
acuuuguagugcgcgccgccga

SEQ ID NO: 3983528 - RNA, 19 nt, Human herpesvirus 5
acuuuguggggcugcucaa

SEQ ID NO: 3983529 - RNA, 13 nt, Human herpesvirus 5
agaaagagcagcg

SEQ ID NO: 3983530 - RNA, 15 nt, Human herpesvirus 5
agaaagucacaggaa

SEQ ID NO: 3983531 - RNA, 22 nt, Human herpesvirus 5
agaaaguuguccgcgggcaauu

SEQ ID NO: 3983532 - RNA, 15 nt, Human herpesvirus 5
agaacuuugcugcua

SEQ ID NO: 3983533 - RNA, 23 nt, Human herpesvirus 5
agacaaccaaaacgucaggaauc

SEQ ID NO: 3983534 - RNA, 10 nt, Human herpesvirus 5
agacacaccg

SEQ ID NO: 3983535 - RNA, 21 nt, Human herpesvirus 5
agaccaagagcaugcuguggg

SEQ ID NO: 3983536 - RNA, 15 nt, Human herpesvirus 5
agacccacuaccugg

SEQ ID NO: 3983537 - RNA, 17 nt, Human herpesvirus 5
agacccaucgcaccauc

SEQ ID NO: 3983538 - RNA, 21 nt, Human herpesvirus 5
agacggcgugacacagcacgc

SEQ ID NO: 3983539 - RNA, 20 nt, Human herpesvirus 5
agacuacaugcuauaagaca

SEQ ID NO: 3983540 - RNA, 16 nt, Human herpesvirus 5
agagaaacccccaccc

SEQ ID NO: 3983541 - RNA, 17 nt, Human herpesvirus 5
agagacaccaauugcuu

SEQ ID NO: 3983542 - RNA, 15 nt, Human herpesvirus 5
agagacagagaccgc

SEQ ID NO: 3983543 - RNA, 15 nt, Human herpesvirus 5
agagccaugaagcgg

SEQ ID NO: 3983544 - RNA, 17 nt, Human herpesvirus 5
agagcucggucaacgcg

SEQ ID NO: 3983545 - RNA, 16 nt, Human herpesvirus 5
agaguuguggcaaaga

SEQ ID NO: 3983546 - RNA, 12 nt, Human herpesvirus 5
agauagagaaac

SEQ ID NO: 3983547 - RNA, 22 nt, Human herpesvirus 5
uuuaugacgcgcguggccgcgc

SEQ ID NO: 3983548 - RNA, 14 nt, Human herpesvirus 5
uuucaacaaauacc

SEQ ID NO: 3983549 - RNA, 12 nt, Human herpesvirus 5
uuucucaucuca

SEQ ID NO: 3983550 - RNA, 15 nt, Human herpesvirus 5
uuuggcgugcccagc

SEQ ID NO: 3983551 - RNA, 21 nt, Human herpesvirus 5
uuuuaucgucucaauaaaagc

SEQ ID NO: 3983552 - RNA, 21 nt, Human herpesvirus 5
uuuugggucagcggcacgccg

SEQ ID NO: 3983553 - RNA, 20 nt, Human herpesvirus 5
uuuuuaauaaaaaacaaggu

SEQ ID NO: 3983554 - RNA, 22 nt, Human herpesvirus 5
uuuuucuaugauaugcgugucu

SEQ ID NO: 3983555 - RNA, 14 nt, Human herpesvirus 5
gagugcaucucgag

SEQ ID NO: 3983556 - RNA, 15 nt, Human herpesvirus 5
gaguggcugcugugu

SEQ ID NO: 3983557 - RNA, 20 nt, Human herpesvirus 5
gaguggggcaacugcugccu

SEQ ID NO: 3983558 - RNA, 19 nt, Human herpesvirus 5
gaguuggugcagcugcgcc

SEQ ID NO: 3983559 - RNA, 22 nt, Human herpesvirus 5
gauaaaauuugauuacuccgug

SEQ ID NO: 3983560 - RNA, 15 nt, Human herpesvirus 5
gauaaccuaccuggu

SEQ ID NO: 3983561 - RNA, 17 nt, Human herpesvirus 5
gauaaccuaccuggugu

SEQ ID NO: 3983562 - RNA, 18 nt, Human herpesvirus 5
gauacagggugccgccac

SEQ ID NO: 3983563 - RNA, 15 nt, Human herpesvirus 5
gauacuaguaaaagg

SEQ ID NO: 3983564 - RNA, 13 nt, Human herpesvirus 5
gaucaccacccug

SEQ ID NO: 3983565 - RNA, 21 nt, Human herpesvirus 5
gaucacgccuugcgcggccgu

SEQ ID NO: 3983566 - RNA, 23 nt, Human herpesvirus 5
gaucaucuguuuuugcugcaacg

SEQ ID NO: 3983567 - RNA, 21 nt, Human herpesvirus 5
gaucgugggugguagaacuga

SEQ ID NO: 3983568 - RNA, 15 nt, Human herpesvirus 5
gaugaaaacgagguc

SEQ ID NO: 3983569 - RNA, 20 nt, Human herpesvirus 5
gaugaacgggugggcugggg

SEQ ID NO: 3983570 - RNA, 13 nt, Human herpesvirus 5
gaugaaucaugug

SEQ ID NO: 3983571 - RNA, 15 nt, Human herpesvirus 5
gaugaauuguuacca

SEQ ID NO: 3983572 - RNA, 18 nt, Human herpesvirus 5
gaugaccauguucagcuu

SEQ ID NO: 3983573 - RNA, 15 nt, Human herpesvirus 5
gaugagauaaaagua

SEQ ID NO: 3983574 - RNA, 17 nt, Human herpesvirus 5
gaugaucauggagccgc

SEQ ID NO: 3983575 - RNA, 20 nt, Human herpesvirus 5
gaugcgccuccgguggugcg

SEQ ID NO: 3983576 - RNA, 17 nt, Human herpesvirus 5
gauggccaucacgggca

SEQ ID NO: 3983577 - RNA, 15 nt, Human herpesvirus 5
gauggccgacgaggc

SEQ ID NO: 3983578 - RNA, 19 nt, Human herpesvirus 5
gauguaccugcagcucgaa

SEQ ID NO: 3983579 - RNA, 16 nt, Human herpesvirus 5
gauguacgcgugccug

SEQ ID NO: 3983580 - RNA, 21 nt, Human herpesvirus 5
gauguaguacaucgcgugcga

SEQ ID NO: 3983581 - RNA, 14 nt, Human herpesvirus 5
gaugugcagggaca

SEQ ID NO: 3983582 - RNA, 24 nt, Human herpesvirus 5
gauuuucaugaauccacaggcugc

SEQ ID NO: 3983583 - RNA, 17 nt, Human herpesvirus 5
gauuuucgcgcucuugu

SEQ ID NO: 3983584 - RNA, 17 nt, Human herpesvirus 5
gcaacaacgguagauga

SEQ ID NO: 3983585 - RNA, 22 nt, Human herpesvirus 5
gcaacagcagccaccgacacag

SEQ ID NO: 3983586 - RNA, 23 nt, Human herpesvirus 5
gcaacagcagccaccgacacagc

SEQ ID NO: 3983587 - RNA, 17 nt, Human herpesvirus 5
gcaacggaccgcugucg

SEQ ID NO: 3983588 - RNA, 23 nt, Human herpesvirus 5
gcaagacuacaugcuauaagaca

SEQ ID NO: 3983589 - RNA, 13 nt, Human herpesvirus 5
gcaagagccggaa

SEQ ID NO: 3983590 - RNA, 16 nt, Human herpesvirus 5
gcaagaugggcaccgu

SEQ ID NO: 3983591 - RNA, 16 nt, Human herpesvirus 5
gcaagggcugcucggc

SEQ ID NO: 3983592 - RNA, 14 nt, Human herpesvirus 5
gcaagugcucgacu

SEQ ID NO: 3983593 - RNA, 13 nt, Human herpesvirus 5
gcacaugaugcaa

SEQ ID NO: 3983594 - RNA, 21 nt, Human herpesvirus 5
gcaccacggccuuauguggcu

SEQ ID NO: 3983595 - RNA, 20 nt, Human herpesvirus 5
gcaccagacuuggagacaug

SEQ ID NO: 3983596 - RNA, 16 nt, Human herpesvirus 5
gcaccaugagaagaga

SEQ ID NO: 3983597 - RNA, 17 nt, Human herpesvirus 5
gcacccgucaugguaca

SEQ ID NO: 3983598 - RNA, 13 nt, Human herpesvirus 5
gcaccgcgacagc

SEQ ID NO: 3983599 - RNA, 21 nt, Human herpesvirus 5
gcaccgcgacagcuaccgagg

SEQ ID NO: 3983600 - RNA, 16 nt, Human herpesvirus 5
gcaccggccuccgacg

SEQ ID NO: 3983601 - RNA, 20 nt, Human herpesvirus 5
gcaccugugugaucugggca

SEQ ID NO: 3983602 - RNA, 22 nt, Human herpesvirus 5
gcacgacaucuuccgcgagcac

SEQ ID NO: 3983603 - RNA, 15 nt, Human herpesvirus 5
gcacgcgauuggcca

SEQ ID NO: 3983604 - RNA, 18 nt, Human herpesvirus 5
gcacgcgcuagccuuucu

SEQ ID NO: 3983605 - RNA, 14 nt, Human herpesvirus 5
gcacguggccuggc

SEQ ID NO: 3983606 - RNA, 13 nt, Human herpesvirus 5
gcacguugccggc

SEQ ID NO: 3983607 - RNA, 17 nt, Human herpesvirus 5
gcacuugucauuaaaca

SEQ ID NO: 3983608 - RNA, 19 nt, Human herpesvirus 5
gcagaacccgguugcggcc

SEQ ID NO: 3983609 - RNA, 13 nt, Human herpesvirus 5
gcagaaugaacaa

SEQ ID NO: 3983610 - RNA, 17 nt, Human herpesvirus 5
gcagaccuacagcaccc

SEQ ID NO: 3983611 - RNA, 21 nt, Human herpesvirus 5
gcagauucaguaaccuggagc

SEQ ID NO: 3983612 - RNA, 15 nt, Human herpesvirus 5
gcagcaacagcagcc

SEQ ID NO: 3983613 - RNA, 15 nt, Human herpesvirus 5
gcagcaacagccccg

SEQ ID NO: 3983614 - RNA, 19 nt, Human herpesvirus 5
gcagcaauagcagccgaca

SEQ ID NO: 3983615 - RNA, 20 nt, Human herpesvirus 5
gcagcaccaugccggagcua

SEQ ID NO: 3983616 - RNA, 15 nt, Human herpesvirus 5
gcagcaucgcgugcg

SEQ ID NO: 3983617 - RNA, 22 nt, Human herpesvirus 5
gcagcaugggcgacaccgccuc

SEQ ID NO: 3983618 - RNA, 17 nt, Human herpesvirus 5
gcagcauucaccuccag

SEQ ID NO: 3983619 - RNA, 13 nt, Human herpesvirus 5
gcagcccaccgcc

SEQ ID NO: 3983620 - RNA, 19 nt, Human herpesvirus 5
gcagcccggcuccgcgcag

SEQ ID NO: 3983621 - RNA, 16 nt, Human herpesvirus 5
gcagccgacacagcgg

SEQ ID NO: 3983622 - RNA, 14 nt, Human herpesvirus 5
gcagccgccgcgug

SEQ ID NO: 3983623 - RNA, 16 nt, Human herpesvirus 5
gcagccggaggagcag

SEQ ID NO: 3983624 - RNA, 18 nt, Human herpesvirus 5
gcagccguuuccagagaa

SEQ ID NO: 3983625 - RNA, 19 nt, Human herpesvirus 5
gcagccguuuccagagaac

SEQ ID NO: 3983626 - RNA, 22 nt, Human herpesvirus 5
gcagcggggagaaaaguggcag

SEQ ID NO: 3983627 - RNA, 17 nt, Human herpesvirus 5
gcagcgucacagagggc

SEQ ID NO: 3983628 - RNA, 18 nt, Human herpesvirus 5
gcagcgugcaccugcugc

SEQ ID NO: 3983629 - RNA, 22 nt, Human herpesvirus 5
gcagcguggccggcguggcggc

SEQ ID NO: 3983630 - RNA, 23 nt, Human herpesvirus 5
gcaggagcugcuuuucgggccgc

SEQ ID NO: 3983631 - RNA, 13 nt, Human herpesvirus 5
gcagucuggcuug

SEQ ID NO: 3983632 - RNA, 21 nt, Human herpesvirus 5
gcauaagaagccaagggggug

SEQ ID NO: 3983633 - RNA, 18 nt, Human herpesvirus 5
gcauacaaugugcugcau

SEQ ID NO: 3983634 - RNA, 21 nt, Human herpesvirus 5
gcauacggggaggagacacag

SEQ ID NO: 3983635 - RNA, 13 nt, Human herpesvirus 5
gcaucacccgccu

SEQ ID NO: 3983636 - RNA, 14 nt, Human herpesvirus 5
gcaucccaccacgg

SEQ ID NO: 3983637 - RNA, 18 nt, Human herpesvirus 5
gcauccgcuacucccgag

SEQ ID NO: 3983638 - RNA, 15 nt, Human herpesvirus 5
gcaucgcaacaacag

SEQ ID NO: 3983639 - RNA, 16 nt, Human herpesvirus 5
gcaucgccugcaccuc

SEQ ID NO: 3983640 - RNA, 15 nt, Human herpesvirus 5
gcaucuccucgccca

SEQ ID NO: 3983641 - RNA, 21 nt, Human herpesvirus 5
gcaugcugugggcccacugcg

SEQ ID NO: 3983642 - RNA, 18 nt, Human herpesvirus 5
gccaaaaucugacgcugu

SEQ ID NO: 3983643 - RNA, 20 nt, Human herpesvirus 5
gccaacuccgugccagcugg

SEQ ID NO: 3983644 - RNA, 12 nt, Human herpesvirus 5
gccacacgcgcu

SEQ ID NO: 3983645 - RNA, 20 nt, Human herpesvirus 5
gccacauuggugaaggccgu

SEQ ID NO: 3983646 - RNA, 24 nt, Human herpesvirus 5
gccaccacccgacugcagcccacc

SEQ ID NO: 3983647 - RNA, 13 nt, Human herpesvirus 5
gccaccacuacca

SEQ ID NO: 3983648 - RNA, 20 nt, Human herpesvirus 5
gccaccaggugccggcgacu

SEQ ID NO: 3983649 - RNA, 23 nt, Human herpesvirus 5
gccaccaggugccggcgacugac

SEQ ID NO: 3983650 - RNA, 12 nt, Human herpesvirus 5
gccaccgugggu

SEQ ID NO: 3983651 - RNA, 22 nt, Human herpesvirus 5
gccagcgaacaccaucucgcgg

SEQ ID NO: 3983652 - RNA, 19 nt, Human herpesvirus 5
gccagcgcgagcgcucggc

SEQ ID NO: 3983653 - RNA, 21 nt, Human herpesvirus 5
gccagcugccaccagggcgac

SEQ ID NO: 3983654 - RNA, 23 nt, Human herpesvirus 5
gccagugauaaguaccagacauc

SEQ ID NO: 3983655 - RNA, 11 nt, Human herpesvirus 5
gccaugaugac

SEQ ID NO: 3983656 - RNA, 11 nt, Human herpesvirus 5
gccaugccuuc

SEQ ID NO: 3983657 - RNA, 21 nt, Human herpesvirus 5
gccccgaagguuagcgccgcg

SEQ ID NO: 3983658 - RNA, 11 nt, Human herpesvirus 5
gcccgagcagg

SEQ ID NO: 3983659 - RNA, 22 nt, Human herpesvirus 5
gcccgaggaucuggcggccgcc

SEQ ID NO: 3983660 - RNA, 15 nt, Human herpesvirus 5
gcccgggccgccgcc

SEQ ID NO: 3983661 - RNA, 20 nt, Human herpesvirus 5
gcccggucggucuuccugcu

SEQ ID NO: 3983662 - RNA, 13 nt, Human herpesvirus 5
gcccgucggcugc

SEQ ID NO: 3983663 - RNA, 16 nt, Human herpesvirus 5
gcccgucggcugccug

SEQ ID NO: 3983664 - RNA, 15 nt, Human herpesvirus 5
guuccacggccagcg

SEQ ID NO: 3983665 - RNA, 17 nt, Human herpesvirus 5
guuccacggccagcgcc

SEQ ID NO: 3983666 - RNA, 23 nt, Human herpesvirus 5
guuccagaccagcgccaccauag

SEQ ID NO: 3983667 - RNA, 14 nt, Human herpesvirus 5
guuccggcggcgug

SEQ ID NO: 3983668 - RNA, 13 nt, Human herpesvirus 5
guuccugcgcgcc

SEQ ID NO: 3983669 - RNA, 18 nt, Human herpesvirus 5
guucgcccugucugcagc

SEQ ID NO: 3983670 - RNA, 14 nt, Human herpesvirus 5
guucgcgauucuca

SEQ ID NO: 3983671 - RNA, 21 nt, Human herpesvirus 5
guucuuccgagucgugucgcu

SEQ ID NO: 3983672 - RNA, 20 nt, Human herpesvirus 5
guugaagacaccuggaaaga

SEQ ID NO: 3983673 - RNA, 21 nt, Human herpesvirus 5
guugcguguuacgcggccgcc

SEQ ID NO: 3983674 - RNA, 19 nt, Human herpesvirus 5
guugcguugggccgagccc

SEQ ID NO: 3983675 - RNA, 18 nt, Human herpesvirus 5
guuggcucccgcugugcu

SEQ ID NO: 3983676 - RNA, 17 nt, Human herpesvirus 5
guuggcucucgcagccc

SEQ ID NO: 3983677 - RNA, 13 nt, Human herpesvirus 5
guuggcugguguc

SEQ ID NO: 3983678 - RNA, 15 nt, Human herpesvirus 5
guugugggugcggac

SEQ ID NO: 3983679 - RNA, 15 nt, Human herpesvirus 5
guuuaugagaaaagg

SEQ ID NO: 3983680 - RNA, 12 nt, Human herpesvirus 5
guuucaaaccca

SEQ ID NO: 3983681 - RNA, 20 nt, Human herpesvirus 5
guuucagcuggcaacgugcc

SEQ ID NO: 3983682 - RNA, 13 nt, Human herpesvirus 5
guuuccacgccac

SEQ ID NO: 3983683 - RNA, 16 nt, Human herpesvirus 5
guuucccccacccgcc

SEQ ID NO: 3983684 - RNA, 20 nt, Human herpesvirus 5
guuucggaguaccgaguaga

SEQ ID NO: 3983685 - RNA, 22 nt, Human herpesvirus 5
guuugcccgaagcggcuguggc

SEQ ID NO: 3983686 - RNA, 12 nt, Human herpesvirus 5
uaaaaaaaccac

SEQ ID NO: 3983687 - RNA, 16 nt, Human herpesvirus 5
uaaaaacaacgucccc

SEQ ID NO: 3983688 - RNA, 12 nt, Human herpesvirus 5
uaaaaaggcaau

SEQ ID NO: 3983689 - RNA, 19 nt, Human herpesvirus 5
uaaacccacgaccauuucc

SEQ ID NO: 3983690 - RNA, 18 nt, Human herpesvirus 5
uaaagauaaucugccaau

SEQ ID NO: 3983691 - RNA, 15 nt, Human herpesvirus 5
uaacaauuccacgcc

SEQ ID NO: 3983692 - RNA, 18 nt, Human herpesvirus 5
uaacaccaaaaauccaga

SEQ ID NO: 3983693 - RNA, 11 nt, Human herpesvirus 5
uaacagccuuc

SEQ ID NO: 3983694 - RNA, 18 nt, Human herpesvirus 5
uaacaugucucuguuuuu

SEQ ID NO: 3983695 - RNA, 21 nt, Human herpesvirus 5
uaaccacgucgaccaggugcu

SEQ ID NO: 3983696 - RNA, 13 nt, Human herpesvirus 5
uaagcaccguggg

SEQ ID NO: 3983697 - RNA, 15 nt, Human herpesvirus 5
uaauguaccaagaau

SEQ ID NO: 3983698 - RNA, 15 nt, Human herpesvirus 5
uacaaguauguggaa

SEQ ID NO: 3983699 - RNA, 22 nt, Human herpesvirus 5
uacagcaccccccucacgcuug

SEQ ID NO: 3983700 - RNA, 22 nt, Human herpesvirus 5
uacaugcuauaagacagccuua

SEQ ID NO: 3983701 - RNA, 13 nt, Human herpesvirus 5
uaccaagaauaaa

SEQ ID NO: 3983702 - RNA, 22 nt, Human herpesvirus 5
uaccaauaaagauaaucugcca

SEQ ID NO: 3983703 - RNA, 14 nt, Human herpesvirus 5
uaccacuacuaccu

SEQ ID NO: 3983704 - RNA, 14 nt, Human herpesvirus 5
uacccacauuuugc

SEQ ID NO: 3983705 - RNA, 16 nt, Human herpesvirus 5
uaccgaggcgccgcca

SEQ ID NO: 3983706 - RNA, 18 nt, Human herpesvirus 5
uaccuucuugcccacgcc

SEQ ID NO: 3983707 - RNA, 19 nt, Human herpesvirus 5
uacgagaucagccgugaga

SEQ ID NO: 3983708 - RNA, 21 nt, Human herpesvirus 5
uacggcagaaaagccggcucc

SEQ ID NO: 3983709 - RNA, 13 nt, Human herpesvirus 5
uacuucccccucc

SEQ ID NO: 3983710 - RNA, 12 nt, Human herpesvirus 5
uacuuuaccuag

SEQ ID NO: 3983711 - RNA, 13 nt, Human herpesvirus 5
uacuuuuacauga

SEQ ID NO: 3983712 - RNA, 19 nt, Human herpesvirus 5
uagaacugaguuuagugcu

SEQ ID NO: 3983713 - RNA, 14 nt, Human herpesvirus 5
uagcacugcgcaac

SEQ ID NO: 3983714 - RNA, 21 nt, Human herpesvirus 5
uagcgcguuuguugcgcggcg

SEQ ID NO: 3983715 - RNA, 13 nt, Human herpesvirus 5
uagcgcucaaagg

SEQ ID NO: 3983716 - RNA, 15 nt, Human herpesvirus 5
uagcgcuccuggauc

SEQ ID NO: 3983717 - RNA, 17 nt, Human herpesvirus 5
uagcgcuugcggcacag

SEQ ID NO: 3983718 - RNA, 14 nt, Human herpesvirus 5
uagcuacuuuggaa

SEQ ID NO: 3983719 - RNA, 19 nt, Human herpesvirus 5
uagggaucauuuucuuggc

SEQ ID NO: 3983720 - RNA, 19 nt, Human herpesvirus 5
uauaaagaaaccacgcguc

SEQ ID NO: 3983721 - RNA, 22 nt, Human herpesvirus 5
uauacaaucauaauauucuaua

SEQ ID NO: 3983722 - RNA, 18 nt, Human herpesvirus 5
uauagauagcggcacuuu

SEQ ID NO: 3983723 - RNA, 14 nt, Human herpesvirus 5
uauagccaauaaag

SEQ ID NO: 3983724 - RNA, 22 nt, Human herpesvirus 5
uauauucaguccauugucagua

SEQ ID NO: 3983725 - RNA, 18 nt, Human herpesvirus 5
uauccaauacggcugcca

SEQ ID NO: 3983726 - RNA, 18 nt, Human herpesvirus 5
uaucgagcgguguagcau

SEQ ID NO: 3983727 - RNA, 21 nt, Human herpesvirus 5
uaucgcguguguucuauggcc

SEQ ID NO: 3983728 - RNA, 12 nt, Human herpesvirus 5
uaucggaagcug

SEQ ID NO: 3983729 - RNA, 14 nt, Human herpesvirus 5
uaugagaaaaggga

SEQ ID NO: 3983730 - RNA, 21 nt, Human herpesvirus 5
uauggacaauuccccucgccu

SEQ ID NO: 3983731 - RNA, 17 nt, Human herpesvirus 5
ucaacacggucauguuu

SEQ ID NO: 3983732 - RNA, 11 nt, Human herpesvirus 5
ucaaguucagu

SEQ ID NO: 3983733 - RNA, 14 nt, Human herpesvirus 5
ucaauaaaaaccac

SEQ ID NO: 3983734 - RNA, 17 nt, Human herpesvirus 5
ucaauaaagaaaaccac

SEQ ID NO: 3983735 - RNA, 18 nt, Human herpesvirus 5
ucaauacaucauaugcua

SEQ ID NO: 3983736 - RNA, 23 nt, Human herpesvirus 5
ucaaucagacuuucgacgugcgc

SEQ ID NO: 3983737 - RNA, 16 nt, Human herpesvirus 5
ucaauugcgggcccug

SEQ ID NO: 3983738 - RNA, 17 nt, Human herpesvirus 5
ucaccaaagccgccgcc

SEQ ID NO: 3983739 - RNA, 20 nt, Human herpesvirus 5
ucaccaccuugucuccccgg

SEQ ID NO: 3983740 - RNA, 15 nt, Human herpesvirus 5
ucaccacucccacca

SEQ ID NO: 3983741 - RNA, 20 nt, Human herpesvirus 5
ucaccagaaugcuaguuugu

SEQ ID NO: 3983742 - RNA, 16 nt, Human herpesvirus 5
ucaccgugccccacuc

SEQ ID NO: 3983743 - RNA, 23 nt, Human herpesvirus 5
ucaccgugcucgugcccaucguc

SEQ ID NO: 3983744 - RNA, 21 nt, Human herpesvirus 5
ucacgaaaggcaccggcagcc

SEQ ID NO: 3983745 - RNA, 18 nt, Human herpesvirus 5
ucacgccuugcgcggccg

SEQ ID NO: 3983746 - RNA, 13 nt, Human herpesvirus 5
ucacuacucuggg

SEQ ID NO: 3983747 - RNA, 17 nt, Human herpesvirus 5
ucacuuuauugaaaucu

SEQ ID NO: 3983748 - RNA, 17 nt, Human herpesvirus 5
ucagaaagcugcaauca

SEQ ID NO: 3983749 - RNA, 17 nt, Human herpesvirus 5
ucagaccgcaacaacag

SEQ ID NO: 3983750 - RNA, 13 nt, Human herpesvirus 5
ucagcagcaccuc

SEQ ID NO: 3983751 - RNA, 21 nt, Human herpesvirus 5
ucagccucuguguucccaaca

SEQ ID NO: 3983752 - RNA, 19 nt, Human herpesvirus 5
ucagcgacgucccgcgcgg

SEQ ID NO: 3983753 - RNA, 13 nt, Human herpesvirus 5
ucagcgaggccga

SEQ ID NO: 3983754 - RNA, 22 nt, Human herpesvirus 5
ucagcggcguguacagcuaccu

SEQ ID NO: 3983755 - RNA, 11 nt, Human herpesvirus 5
guaaggcggcg

SEQ ID NO: 3983756 - RNA, 23 nt, Human herpesvirus 5
guaaugccaugcggauccagcug

SEQ ID NO: 3983757 - RNA, 16 nt, Human herpesvirus 5
guacaccgcuggagcu

SEQ ID NO: 3983758 - RNA, 23 nt, Human herpesvirus 5
guacaccgcuggagcuaucugug

SEQ ID NO: 3983759 - RNA, 16 nt, Human herpesvirus 5
guaccaucuggcgcag

SEQ ID NO: 3983760 - RNA, 19 nt, Human herpesvirus 5
guaccgucuccaccacagu

SEQ ID NO: 3983761 - RNA, 20 nt, Human herpesvirus 5
guaccuagcuacuuuggaau

SEQ ID NO: 3983762 - RNA, 22 nt, Human herpesvirus 5
guaccugaaaccuaccugggcu

SEQ ID NO: 3983763 - RNA, 19 nt, Human herpesvirus 5
guacucgcaggugugcgcg

SEQ ID NO: 3983764 - RNA, 14 nt, Human herpesvirus 5
guagaacugaguuu

SEQ ID NO: 3983765 - RNA, 20 nt, Human herpesvirus 5
guagcaccggccccacgcug

SEQ ID NO: 3983766 - RNA, 12 nt, Human herpesvirus 5
guauggcugcgc

SEQ ID NO: 3983767 - RNA, 22 nt, Human herpesvirus 5
gucaaagccgacaaccugcugc

SEQ ID NO: 3983768 - RNA, 17 nt, Human herpesvirus 5
gucaacaucaucagcgc

SEQ ID NO: 3983769 - RNA, 20 nt, Human herpesvirus 5
gucaccaguuccugcgcgcc

SEQ ID NO: 3983770 - RNA, 17 nt, Human herpesvirus 5
gucaccucucgggccga

SEQ ID NO: 3983771 - RNA, 14 nt, Human herpesvirus 5
gucacgcaggugag

SEQ ID NO: 3983772 - RNA, 16 nt, Human herpesvirus 5
gucacggugccaugga

SEQ ID NO: 3983773 - RNA, 23 nt, Human herpesvirus 5
gucacuucugcugucaccaccac

SEQ ID NO: 3983774 - RNA, 15 nt, Human herpesvirus 5
gucaggacuggaagu

SEQ ID NO: 3983775 - RNA, 13 nt, Human herpesvirus 5
gucagucagaagu

SEQ ID NO: 3983776 - RNA, 17 nt, Human herpesvirus 5
gucagucagaaguggau

SEQ ID NO: 3983777 - RNA, 13 nt, Human herpesvirus 5
gucagucuauucu

SEQ ID NO: 3983778 - RNA, 19 nt, Human herpesvirus 5
gucauguucucccaggacc

SEQ ID NO: 3983779 - RNA, 22 nt, Human herpesvirus 5
guccacacgccgucucgucaca

SEQ ID NO: 3983780 - RNA, 13 nt, Human herpesvirus 5
guccagccagcau

SEQ ID NO: 3983781 - RNA, 22 nt, Human herpesvirus 5
gucccuggaagcgugugugggc

SEQ ID NO: 3983782 - RNA, 15 nt, Human herpesvirus 5
gucccuggccccggc

SEQ ID NO: 3983783 - RNA, 14 nt, Human herpesvirus 5
guccgcggaaacga

SEQ ID NO: 3983784 - RNA, 18 nt, Human herpesvirus 5
guccgcggacacccgcgg

SEQ ID NO: 3983785 - RNA, 20 nt, Human herpesvirus 5
guccgcucugagccggcucc

SEQ ID NO: 3983786 - RNA, 23 nt, Human herpesvirus 5
guccggaggagcguccgacgccg

SEQ ID NO: 3983787 - RNA, 16 nt, Human herpesvirus 5
guccgucaugcuggca

SEQ ID NO: 3983788 - RNA, 23 nt, Human herpesvirus 5
guccuccagcagcagcuggugca

SEQ ID NO: 3983789 - RNA, 22 nt, Human herpesvirus 5
guccucuccuccuucuuccucg

SEQ ID NO: 3983790 - RNA, 15 nt, Human herpesvirus 5
gucgagacggcuccg

SEQ ID NO: 3983791 - RNA, 18 nt, Human herpesvirus 5
gucgaucuugacgcugcu

SEQ ID NO: 3983792 - RNA, 21 nt, Human herpesvirus 5
gucgcacaaagaagucucuuu

SEQ ID NO: 3983793 - RNA, 19 nt, Human herpesvirus 5
gucgcagcccccguggccg

SEQ ID NO: 3983794 - RNA, 18 nt, Human herpesvirus 5
gucgcaucaucaacagca

SEQ ID NO: 3983795 - RNA, 21 nt, Human herpesvirus 5
gucgcaucaucaacagcagca

SEQ ID NO: 3983796 - RNA, 12 nt, Human herpesvirus 5
gucgccaccugg

SEQ ID NO: 3983797 - RNA, 20 nt, Human herpesvirus 5
gucgccggccgacgcgcgcc

SEQ ID NO: 3983798 - RNA, 12 nt, Human herpesvirus 5
gucgccgucacu

SEQ ID NO: 3983799 - RNA, 17 nt, Human herpesvirus 5
gucgccgucacugccac

SEQ ID NO: 3983800 - RNA, 15 nt, Human herpesvirus 5
gucgcgcggucgccg

SEQ ID NO: 3983801 - RNA, 18 nt, Human herpesvirus 5
gucgcgucggcguaacaa

SEQ ID NO: 3983802 - RNA, 15 nt, Human herpesvirus 5
gucgcuucgccgcca

SEQ ID NO: 3983803 - RNA, 20 nt, Human herpesvirus 5
gucggaugaggcaggcgaug

SEQ ID NO: 3983804 - RNA, 16 nt, Human herpesvirus 5
gucggcgccccacagc

SEQ ID NO: 3983805 - RNA, 13 nt, Human herpesvirus 5
gucggcgccgccu

SEQ ID NO: 3983806 - RNA, 13 nt, Human herpesvirus 5
gucggugcgccca

SEQ ID NO: 3983807 - RNA, 16 nt, Human herpesvirus 5
gucgucgccggaagga

SEQ ID NO: 3983808 - RNA, 22 nt, Human herpesvirus 5
gucgugagcagcgugcaccugc

SEQ ID NO: 3983809 - RNA, 19 nt, Human herpesvirus 5
gucgugccuucggccagcg

SEQ ID NO: 3983810 - RNA, 16 nt, Human herpesvirus 5
gucuacgaucgcugga

SEQ ID NO: 3983811 - RNA, 20 nt, Human herpesvirus 5
gucuccaccaaucaagccug

SEQ ID NO: 3983812 - RNA, 16 nt, Human herpesvirus 5
gucuccgaacucagag

SEQ ID NO: 3983813 - RNA, 21 nt, Human herpesvirus 5
gucucgcgucuucgcgagguc

SEQ ID NO: 3983814 - RNA, 12 nt, Human herpesvirus 5
gucucuacggca

SEQ ID NO: 3983815 - RNA, 16 nt, Human herpesvirus 5
gucugacgcugcuccu

SEQ ID NO: 3983816 - RNA, 23 nt, Human herpesvirus 5
gucugcaacaugcggcugugucg

SEQ ID NO: 3983817 - RNA, 20 nt, Human herpesvirus 5
gugaagagggugaaggcaaa

SEQ ID NO: 3983818 - RNA, 16 nt, Human herpesvirus 5
gugaaggccguggaga

SEQ ID NO: 3983819 - RNA, 13 nt, Human herpesvirus 5
gugaauggaaaua

SEQ ID NO: 3983820 - RNA, 23 nt, Human herpesvirus 5
gugacgcagucugcccugcgcag

SEQ ID NO: 3983821 - RNA, 13 nt, Human herpesvirus 5
gugagaguuuaug

SEQ ID NO: 3983822 - RNA, 22 nt, Human herpesvirus 5
gugagauacauguucauaaacu

SEQ ID NO: 3983823 - RNA, 17 nt, Human herpesvirus 5
gugaucugggcagcggc

SEQ ID NO: 3983824 - RNA, 22 nt, Human herpesvirus 5
gugaugguacuauaugcgugag

SEQ ID NO: 3983825 - RNA, 14 nt, Human herpesvirus 5
gugcaaugccucau

SEQ ID NO: 3983826 - RNA, 11 nt, Human herpesvirus 5
gugcagcuggu

SEQ ID NO: 3983827 - RNA, 14 nt, Human herpesvirus 5
gugcagcuggugau

SEQ ID NO: 3983828 - RNA, 16 nt, Human herpesvirus 5
gugcagggacagugcg

SEQ ID NO: 3983829 - RNA, 19 nt, Human herpesvirus 5
gugcaucuacguggucggg

SEQ ID NO: 3983830 - RNA, 16 nt, Human herpesvirus 5
gugccgaauacaaaag

SEQ ID NO: 3983831 - RNA, 19 nt, Human herpesvirus 5
gugccgaugagauaaaagu

SEQ ID NO: 3983832 - RNA, 13 nt, Human herpesvirus 5
gugccgcgccgcc

SEQ ID NO: 3983833 - RNA, 15 nt, Human herpesvirus 5
gugccuucggccagc

SEQ ID NO: 3983834 - RNA, 14 nt, Human herpesvirus 5
gugcgcacgccgcg

SEQ ID NO: 3983835 - RNA, 18 nt, Human herpesvirus 5
gugcgccguggugcuggg

SEQ ID NO: 3983836 - RNA, 22 nt, Human herpesvirus 5
gugcgcggcgacaagcuguggc

SEQ ID NO: 3983837 - RNA, 18 nt, Human herpesvirus 5
gugcgcguccacagcgug

SEQ ID NO: 3983838 - RNA, 16 nt, Human herpesvirus 5
gugcggacggugcggg

SEQ ID NO: 3983839 - RNA, 20 nt, Human herpesvirus 5
gugcgguaacuggcagagcc

SEQ ID NO: 3983840 - RNA, 20 nt, Human herpesvirus 5
guggacggguuucagcgucc

SEQ ID NO: 3983841 - RNA, 16 nt, Human herpesvirus 5
guggauuugggcgugg

SEQ ID NO: 3983842 - RNA, 14 nt, Human herpesvirus 5
guggcaccgccucc

SEQ ID NO: 3983843 - RNA, 18 nt, Human herpesvirus 5
guggcccuggucuggccc

SEQ ID NO: 3983844 - RNA, 18 nt, Human herpesvirus 5
guggccgaacagcagcuc

SEQ ID NO: 3983845 - RNA, 14 nt, Human herpesvirus 5
guggccgcacaccu

SEQ ID NO: 3983846 - RNA, 14 nt, Human herpesvirus 5
guggccgugcuggg

SEQ ID NO: 3983847 - RNA, 18 nt, Human herpesvirus 5
guggcgcugcacaccuau

SEQ ID NO: 3983848 - RNA, 12 nt, Human herpesvirus 5
guggggcugcuc

SEQ ID NO: 3983849 - RNA, 13 nt, Human herpesvirus 5
guggugaucgugg

SEQ ID NO: 3983850 - RNA, 23 nt, Human herpesvirus 5
cuuggucacggcuauaaaaaaga

SEQ ID NO: 3983851 - RNA, 13 nt, Human herpesvirus 5
cuuuaagcugcuc

SEQ ID NO: 3983852 - RNA, 20 nt, Human herpesvirus 5
cuuuaggcggcgcagcgcca

SEQ ID NO: 3983853 - RNA, 17 nt, Human herpesvirus 5
cuuucucaucucagccu

SEQ ID NO: 3983854 - RNA, 23 nt, Human herpesvirus 5
cuuucuugacuggccggacggca

SEQ ID NO: 3983855 - RNA, 15 nt, Human herpesvirus 5
cuuuggguccagcca

SEQ ID NO: 3983856 - RNA, 17 nt, Human herpesvirus 5
cuuuguggggcugcuca

SEQ ID NO: 3983857 - RNA, 20 nt, Human herpesvirus 5
cuuuguuauuuuccucguaa

SEQ ID NO: 3983858 - RNA, 20 nt, Human herpesvirus 5
cuuuuaccaacguaacagca

SEQ ID NO: 3983859 - RNA, 14 nt, Human herpesvirus 5
gaaaaaagaccgga

SEQ ID NO: 3983860 - RNA, 15 nt, Human herpesvirus 5
gaaacaaacgucacu

SEQ ID NO: 3983861 - RNA, 21 nt, Human herpesvirus 5
gaaaccguacuaagucucccg

SEQ ID NO: 3983862 - RNA, 13 nt, Human herpesvirus 5
gaacauguccugg

SEQ ID NO: 3983863 - RNA, 16 nt, Human herpesvirus 5
gaaccagcugguaccu

SEQ ID NO: 3983864 - RNA, 13 nt, Human herpesvirus 5
gaaccuuccccac

SEQ ID NO: 3983865 - RNA, 19 nt, Human herpesvirus 5
gaacgacgacucagggcug

SEQ ID NO: 3983866 - RNA, 15 nt, Human herpesvirus 5
gaacggagcaggaac

SEQ ID NO: 3983867 - RNA, 14 nt, Human herpesvirus 5
gaacggagugguga

SEQ ID NO: 3983868 - RNA, 16 nt, Human herpesvirus 5
gaacuggcgcguacgg

SEQ ID NO: 3983869 - RNA, 14 nt, Human herpesvirus 5
gaacuuugcugcua

SEQ ID NO: 3983870 - RNA, 17 nt, Human herpesvirus 5
gaagauggccaucacgg

SEQ ID NO: 3983871 - RNA, 18 nt, Human herpesvirus 5
gaagcacggagacugcgg

SEQ ID NO: 3983872 - RNA, 14 nt, Human herpesvirus 5
gaagccauacuucu

SEQ ID NO: 3983873 - RNA, 14 nt, Human herpesvirus 5
gaagcggcuguggc

SEQ ID NO: 3983874 - RNA, 14 nt, Human herpesvirus 5
gaagcgguggagga

SEQ ID NO: 3983875 - RNA, 13 nt, Human herpesvirus 5
gaagcugcgcagg

SEQ ID NO: 3983876 - RNA, 16 nt, Human herpesvirus 5
gaagcugcggcucugc

SEQ ID NO: 3983877 - RNA, 13 nt, Human herpesvirus 5
gaagugacggacg

SEQ ID NO: 3983878 - RNA, 20 nt, Human herpesvirus 5
gaauaccguaaacauaauga

SEQ ID NO: 3983879 - RNA, 20 nt, Human herpesvirus 5
gaauacuggaagcugcuggu

SEQ ID NO: 3983880 - RNA, 16 nt, Human herpesvirus 5
gaaucucuugcgcccu

SEQ ID NO: 3983881 - RNA, 17 nt, Human herpesvirus 5
gaauugagcaacaaaca

SEQ ID NO: 3983882 - RNA, 22 nt, Human herpesvirus 5
gacaaacacuaccgucgccacc

SEQ ID NO: 3983883 - RNA, 16 nt, Human herpesvirus 5
gacaaccugcugcacu

SEQ ID NO: 3983884 - RNA, 19 nt, Human herpesvirus 5
gacaacggccgccgcagcc

SEQ ID NO: 3983885 - RNA, 20 nt, Human herpesvirus 5
gacaacggccgccgcagcca

SEQ ID NO: 3983886 - RNA, 19 nt, Human herpesvirus 5
gacaacggcuggaaaugga

SEQ ID NO: 3983887 - RNA, 16 nt, Human herpesvirus 5
gacaccaauugcuuua

SEQ ID NO: 3983888 - RNA, 22 nt, Human herpesvirus 5
gacaccgucgccgugcccgaag

SEQ ID NO: 3983889 - RNA, 16 nt, Human herpesvirus 5
gacacgcgcuucuggu

SEQ ID NO: 3983890 - RNA, 21 nt, Human herpesvirus 5
gacacguagaucccacuggca

SEQ ID NO: 3983891 - RNA, 14 nt, Human herpesvirus 5
gacagacgaugaac

SEQ ID NO: 3983892 - RNA, 20 nt, Human herpesvirus 5
gacagcacguuaguuacagc

SEQ ID NO: 3983893 - RNA, 15 nt, Human herpesvirus 5
gacaggcggccagcu

SEQ ID NO: 3983894 - RNA, 23 nt, Human herpesvirus 5
gacagguaugggcgguggucggc

SEQ ID NO: 3983895 - RNA, 14 nt, Human herpesvirus 5
gacaucacggucac

SEQ ID NO: 3983896 - RNA, 17 nt, Human herpesvirus 5
gacaucccccugcacgu

SEQ ID NO: 3983897 - RNA, 14 nt, Human herpesvirus 5
gacauggacucuug

SEQ ID NO: 3983898 - RNA, 12 nt, Human herpesvirus 5
gacauuccccac

SEQ ID NO: 3983899 - RNA, 17 nt, Human herpesvirus 5
gaccacguagucgcgcg

SEQ ID NO: 3983900 - RNA, 19 nt, Human herpesvirus 5
gaccagaaucagcagugag

SEQ ID NO: 3983901 - RNA, 20 nt, Human herpesvirus 5
gaccagcgccaccauagcca

SEQ ID NO: 3983902 - RNA, 13 nt, Human herpesvirus 5
gaccagcugcugg

SEQ ID NO: 3983903 - RNA, 14 nt, Human herpesvirus 5
gacccagggcugcu

SEQ ID NO: 3983904 - RNA, 21 nt, Human herpesvirus 5
gacccggcuggcgacccgcag

SEQ ID NO: 3983905 - RNA, 16 nt, Human herpesvirus 5
gacccguacugcgacg

SEQ ID NO: 3983906 - RNA, 14 nt, Human herpesvirus 5
gaccgaggcgcugg

SEQ ID NO: 3983907 - RNA, 12 nt, Human herpesvirus 5
gaccggcagcac

SEQ ID NO: 3983908 - RNA, 14 nt, Human herpesvirus 5
gaccgucuggaggu

SEQ ID NO: 3983909 - RNA, 21 nt, Human herpesvirus 5
gaccuccgcgucggucgccgc

SEQ ID NO: 3983910 - RNA, 15 nt, Human herpesvirus 5
gaccucguuguccuc

SEQ ID NO: 3983911 - RNA, 19 nt, Human herpesvirus 5
gaccuugcugaugugccag

SEQ ID NO: 3983912 - RNA, 15 nt, Human herpesvirus 5
gacgaagaggacacc

SEQ ID NO: 3983913 - RNA, 16 nt, Human herpesvirus 5
gacgacccaccgccgc

SEQ ID NO: 3983914 - RNA, 18 nt, Human herpesvirus 5
gacgagaugaaggaacgc

SEQ ID NO: 3983915 - RNA, 21 nt, Human herpesvirus 5
gacgaguaggcgcgcacccga

SEQ ID NO: 3983916 - RNA, 20 nt, Human herpesvirus 5
gacgauuuuaugcgccgcca

SEQ ID NO: 3983917 - RNA, 20 nt, Human herpesvirus 5
gacgcagugcguggccgcac

SEQ ID NO: 3983918 - RNA, 22 nt, Human herpesvirus 5
gacgccaucauggaagagggcg

SEQ ID NO: 3983919 - RNA, 12 nt, Human herpesvirus 5
gacgccgugggc

SEQ ID NO: 3983920 - RNA, 18 nt, Human herpesvirus 5
gacgcgccccccaccuac

SEQ ID NO: 3983921 - RNA, 14 nt, Human herpesvirus 5
gacgcgccucaugg

SEQ ID NO: 3983922 - RNA, 16 nt, Human herpesvirus 5
gacgcuucauauuagu

SEQ ID NO: 3983923 - RNA, 20 nt, Human herpesvirus 5
gacggagccguuaccgccuc

SEQ ID NO: 3983924 - RNA, 19 nt, Human herpesvirus 5
gacggcgguacugaagccg

SEQ ID NO: 3983925 - RNA, 22 nt, Human herpesvirus 5
gacgggaugcacagcgucuggc

SEQ ID NO: 3983926 - RNA, 20 nt, Human herpesvirus 5
gacggugaugaugcugcuga

SEQ ID NO: 3983927 - RNA, 20 nt, Human herpesvirus 5
gacggugaugcguguggccg

SEQ ID NO: 3983928 - RNA, 18 nt, Human herpesvirus 5
gacggugguuuccgcgcc

SEQ ID NO: 3983929 - RNA, 15 nt, Human herpesvirus 5
gacgguuuccacgcc

SEQ ID NO: 3983930 - RNA, 17 nt, Human herpesvirus 5
gacguaaauccagaccu

SEQ ID NO: 3983931 - RNA, 21 nt, Human herpesvirus 5
gacguagaaaaguaacacacg

SEQ ID NO: 3983932 - RNA, 14 nt, Human herpesvirus 5
gacgugaggcgcuc

SEQ ID NO: 3983933 - RNA, 15 nt, Human herpesvirus 5
gacguggaggagacc

SEQ ID NO: 3983934 - RNA, 23 nt, Human herpesvirus 5
gacuaacccugggcuauaugcau

SEQ ID NO: 3983935 - RNA, 23 nt, Human herpesvirus 5
gacucuuuaaccgagcugaagga

SEQ ID NO: 3983936 - RNA, 18 nt, Human herpesvirus 5
gacugagacuggugguga

SEQ ID NO: 3983937 - RNA, 16 nt, Human herpesvirus 5
gacugcagcccaccgc

SEQ ID NO: 3983938 - RNA, 18 nt, Human herpesvirus 5
gacugcggcgacuggcga

SEQ ID NO: 3983939 - RNA, 21 nt, Human herpesvirus 5
gacuugaguaccaagugccgc

SEQ ID NO: 3983940 - RNA, 14 nt, Human herpesvirus 5
gagaccgucgccac

SEQ ID NO: 3983941 - RNA, 15 nt, Human herpesvirus 5
gagacgugcgaccug

SEQ ID NO: 3983942 - RNA, 22 nt, Human herpesvirus 5
gagauucaggacgaggagccaa

SEQ ID NO: 3983943 - RNA, 14 nt, Human herpesvirus 5
gagcaccggcgccu

SEQ ID NO: 3983944 - RNA, 21 nt, Human herpesvirus 5
gagcacgucuagcaggcccag

SEQ ID NO: 3983945 - RNA, 13 nt, Human herpesvirus 5
gagcaggcucgcg

SEQ ID NO: 3983946 - RNA, 18 nt, Human herpesvirus 5
gagcaucgcaacaacagc

SEQ ID NO: 3983947 - RNA, 18 nt, Human herpesvirus 5
gagcgacguaccagcugu

SEQ ID NO: 3983948 - RNA, 15 nt, Human herpesvirus 5
gagcgccuucugcua

SEQ ID NO: 3983949 - RNA, 16 nt, Human herpesvirus 5
gagcuaucuguguccg

SEQ ID NO: 3983950 - RNA, 18 nt, Human herpesvirus 5
gaggaacccugcggcgcc

SEQ ID NO: 3983951 - RNA, 15 nt, Human herpesvirus 5
gaggaagcgggggug

SEQ ID NO: 3983952 - RNA, 19 nt, Human herpesvirus 5
gaggaagucgaucuggaag

SEQ ID NO: 3983953 - RNA, 21 nt, Human herpesvirus 5
gaggaaugcauguggaagcug

SEQ ID NO: 3983954 - RNA, 18 nt, Human herpesvirus 5
gaggacauggacucgcca

SEQ ID NO: 3983955 - RNA, 15 nt, Human herpesvirus 5
gaggacgacagcucg

SEQ ID NO: 3983956 - RNA, 14 nt, Human herpesvirus 5
gaggaggccgcacu

SEQ ID NO: 3983957 - RNA, 22 nt, Human herpesvirus 5
cccacaaaggguaucuggggag

SEQ ID NO: 3983958 - RNA, 14 nt, Human herpesvirus 5
cccaccacgggggc

SEQ ID NO: 3983959 - RNA, 22 nt, Human herpesvirus 5
cccaccgccgcuuucucaucuc

SEQ ID NO: 3983960 - RNA, 23 nt, Human herpesvirus 5
cccacgacuguucgucgagcacc

SEQ ID NO: 3983961 - RNA, 21 nt, Human herpesvirus 5
cccagcagaccagccaccguc

SEQ ID NO: 3983962 - RNA, 23 nt, Human herpesvirus 5
cccagcagggcgcgccggcgcca

SEQ ID NO: 3983963 - RNA, 15 nt, Human herpesvirus 5
cccagggcugcucca

SEQ ID NO: 3983964 - RNA, 23 nt, Human herpesvirus 5
cccaucucaacgucaacgguuuc

SEQ ID NO: 3983965 - RNA, 21 nt, Human herpesvirus 5
cccccgcugagcguuggcggc

SEQ ID NO: 3983966 - RNA, 17 nt, Human herpesvirus 5
ccccgcaaacucccacu

SEQ ID NO: 3983967 - RNA, 11 nt, Human herpesvirus 5
ccccgcugucg

SEQ ID NO: 3983968 - RNA, 12 nt, Human herpesvirus 5
ccccggcagcgg

SEQ ID NO: 3983969 - RNA, 15 nt, Human herpesvirus 5
ccccucugcugcugg

SEQ ID NO: 3983970 - RNA, 23 nt, Human herpesvirus 5
cccgauaaucggcucucaggcgc

SEQ ID NO: 3983971 - RNA, 16 nt, Human herpesvirus 5
cccgauaugggccgcu

SEQ ID NO: 3983972 - RNA, 22 nt, Human herpesvirus 5
cccgcacacagacgacgcgccg

SEQ ID NO: 3983973 - RNA, 12 nt, Human herpesvirus 5
cccgcacacugg

SEQ ID NO: 3983974 - RNA, 17 nt, Human herpesvirus 5
cccgccguugcggccgc

SEQ ID NO: 3983975 - RNA, 17 nt, Human herpesvirus 5
cccgcgucccuggggcu

SEQ ID NO: 3983976 - RNA, 13 nt, Human herpesvirus 5
cccgcugcugcug

SEQ ID NO: 3983977 - RNA, 16 nt, Human herpesvirus 5
cccggucggucuuccu

SEQ ID NO: 3983978 - RNA, 23 nt, Human herpesvirus 5
cccguauacgcgcuggaggcccu

SEQ ID NO: 3983979 - RNA, 16 nt, Human herpesvirus 5
cccgucggcugccugu

SEQ ID NO: 3983980 - RNA, 19 nt, Human herpesvirus 5
cccgucgugcucuugacgg

SEQ ID NO: 3983981 - RNA, 21 nt, Human herpesvirus 5
cccguggaucagccgccgccu

SEQ ID NO: 3983982 - RNA, 12 nt, Human herpesvirus 5
cccguggcccag

SEQ ID NO: 3983983 - RNA, 14 nt, Human herpesvirus 5
cccuauccuccauc

SEQ ID NO: 3983984 - RNA, 19 nt, Human herpesvirus 5
cccucaaaacaucaccacc

SEQ ID NO: 3983985 - RNA, 12 nt, Human herpesvirus 5
cccuccacaggc

SEQ ID NO: 3983986 - RNA, 15 nt, Human herpesvirus 5
cccucgcugggcuac

SEQ ID NO: 3983987 - RNA, 23 nt, Human herpesvirus 5
cccucggggugcggguggcgggc

SEQ ID NO: 3983988 - RNA, 12 nt, Human herpesvirus 5
cccucugcugcu

SEQ ID NO: 3983989 - RNA, 14 nt, Human herpesvirus 5
cccucugcugcugg

SEQ ID NO: 3983990 - RNA, 15 nt, Human herpesvirus 5
cccugccagucuccg

SEQ ID NO: 3983991 - RNA, 14 nt, Human herpesvirus 5
cccugcggcgccgu

SEQ ID NO: 3983992 - RNA, 19 nt, Human herpesvirus 5
cccugcugacgcuguugag

SEQ ID NO: 3983993 - RNA, 17 nt, Human herpesvirus 5
cccuggggcugcugcug

SEQ ID NO: 3983994 - RNA, 15 nt, Human herpesvirus 5
cccuggucuggccca

SEQ ID NO: 3983995 - RNA, 18 nt, Human herpesvirus 5
cccuguaauuauuccagc

SEQ ID NO: 3983996 - RNA, 19 nt, Human herpesvirus 5
cccugugggcccaugacgc

SEQ ID NO: 3983997 - RNA, 17 nt, Human herpesvirus 5
cccuguuccccgugacg

SEQ ID NO: 3983998 - RNA, 14 nt, Human herpesvirus 5
ccgaacagcagcuc

SEQ ID NO: 3983999 - RNA, 15 nt, Human herpesvirus 5
ccgaacgcgacuggc

SEQ ID NO: 3984000 - RNA, 12 nt, Human herpesvirus 5
ccgaacgcugcu

SEQ ID NO: 3984001 - RNA, 19 nt, Human herpesvirus 5
ccgaacuauguggcuccgc

SEQ ID NO: 3984002 - RNA, 13 nt, Human herpesvirus 5
ccgaacucagagg

SEQ ID NO: 3984003 - RNA, 22 nt, Human herpesvirus 5
ggugucucugcaacgccuggcg

SEQ ID NO: 3984004 - RNA, 16 nt, Human herpesvirus 5
gguguggcggcagcgg

SEQ ID NO: 3984005 - RNA, 20 nt, Human herpesvirus 5
ggugugguagcuagugcagc

SEQ ID NO: 3984006 - RNA, 18 nt, Human herpesvirus 5
gguuauggauaugaggaa

SEQ ID NO: 3984007 - RNA, 15 nt, Human herpesvirus 5
gguuauggcuccgcg

SEQ ID NO: 3984008 - RNA, 20 nt, Human herpesvirus 5
gguucacacgucguuagcca

SEQ ID NO: 3984009 - RNA, 19 nt, Human herpesvirus 5
gguucugaaucugcuccag

SEQ ID NO: 3984010 - RNA, 12 nt, Human herpesvirus 5
gguuuggccgug

SEQ ID NO: 3984011 - RNA, 17 nt, Human herpesvirus 5
gguuuucggacagagca

SEQ ID NO: 3984012 - RNA, 21 nt, Human herpesvirus 5
guaaacuuaugaauccggcug

SEQ ID NO: 3984013 - RNA, 20 nt, Human herpesvirus 5
guaaagagagucacacuuaa

SEQ ID NO: 3984014 - RNA, 18 nt, Human herpesvirus 5
guaaauaaaauguuuuua

SEQ ID NO: 3984015 - RNA, 21 nt, Human herpesvirus 5
guaacagccuucccuuguaag

SEQ ID NO: 3984016 - RNA, 20 nt, Human herpesvirus 5
guaaccacgucgaccaggug

SEQ ID NO: 3984017 - RNA, 17 nt, Human herpesvirus 5
guaacgccacggugcuu

SEQ ID NO: 3984018 - RNA, 13 nt, Human herpesvirus 5
acaucauacugac

SEQ ID NO: 3984019 - RNA, 16 nt, Human herpesvirus 5
acaucccaagcacgcc

SEQ ID NO: 3984020 - RNA, 17 nt, Human herpesvirus 5
acaugauggaaaugccc

SEQ ID NO: 3984021 - RNA, 15 nt, Human herpesvirus 5
acauggagacaguuu

SEQ ID NO: 3984022 - RNA, 17 nt, Human herpesvirus 5
acauuuuuucggccgcg

SEQ ID NO: 3984023 - RNA, 14 nt, Human herpesvirus 5
accaaggaaccacc

SEQ ID NO: 3984024 - RNA, 21 nt, Human herpesvirus 5
accaagucuugccgugacguc

SEQ ID NO: 3984025 - RNA, 20 nt, Human herpesvirus 5
accacaacggccgccgacgu

SEQ ID NO: 3984026 - RNA, 20 nt, Human herpesvirus 5
accacccgacugcagcccac

SEQ ID NO: 3984027 - RNA, 16 nt, Human herpesvirus 5
accacgaguaacaccg

SEQ ID NO: 3984028 - RNA, 19 nt, Human herpesvirus 5
accacucccaccacgguuu

SEQ ID NO: 3984029 - RNA, 17 nt, Human herpesvirus 5
accagacauccaauuac

SEQ ID NO: 3984030 - RNA, 13 nt, Human herpesvirus 5
accagacggcguc

SEQ ID NO: 3984031 - RNA, 23 nt, Human herpesvirus 5
accagggaggagggguuaagagg

SEQ ID NO: 3984032 - RNA, 20 nt, Human herpesvirus 5
accauccucaccccgcgcga

SEQ ID NO: 3984033 - RNA, 21 nt, Human herpesvirus 5
accaucucacguacaggcaua

SEQ ID NO: 3984034 - RNA, 20 nt, Human herpesvirus 5
accaugcaggcgcaggaggc

SEQ ID NO: 3984035 - RNA, 22 nt, Human herpesvirus 5
accauuuccaugugcagcuggu

SEQ ID NO: 3984036 - RNA, 16 nt, Human herpesvirus 5
acccacgaccauuucc

SEQ ID NO: 3984037 - RNA, 16 nt, Human herpesvirus 5
acccaguagacagaca

SEQ ID NO: 3984038 - RNA, 17 nt, Human herpesvirus 5
acccgacugcagcccac

SEQ ID NO: 3984039 - RNA, 20 nt, Human herpesvirus 5
acccgcgucccuggggcugc

SEQ ID NO: 3984040 - RNA, 12 nt, Human herpesvirus 5
acccggcugcug

SEQ ID NO: 3984041 - RNA, 17 nt, Human herpesvirus 5
acccugggcuauaugca

SEQ ID NO: 3984042 - RNA, 14 nt, Human herpesvirus 5
accgcaacaacagc

SEQ ID NO: 3984043 - RNA, 16 nt, Human herpesvirus 5
accgcagcgguggcug

SEQ ID NO: 3984044 - RNA, 18 nt, Human herpesvirus 5
accgcagguuagcggcga

SEQ ID NO: 3984045 - RNA, 17 nt, Human herpesvirus 5
accgccgccgcccuccc

SEQ ID NO: 3984046 - RNA, 20 nt, Human herpesvirus 5
accgccuccgaacgcucgug

SEQ ID NO: 3984047 - RNA, 13 nt, Human herpesvirus 5
accgcgacccagc

SEQ ID NO: 3984048 - RNA, 17 nt, Human herpesvirus 5
accggcgccugcugcuc

SEQ ID NO: 3984049 - RNA, 12 nt, Human herpesvirus 5
accgggucgccu

SEQ ID NO: 3984050 - RNA, 23 nt, Human herpesvirus 5
accgucgaaaacaaccacacaga

SEQ ID NO: 3984051 - RNA, 19 nt, Human herpesvirus 5
accgugcccguuuucacag

SEQ ID NO: 3984052 - RNA, 13 nt, Human herpesvirus 5
accuaccugggcu

SEQ ID NO: 3984053 - RNA, 23 nt, Human herpesvirus 5
accucguuguccucuccuccuuc

SEQ ID NO: 3984054 - RNA, 12 nt, Human herpesvirus 5
accugaccuguc

SEQ ID NO: 3984055 - RNA, 17 nt, Human herpesvirus 5
accugauuucuuuguua

SEQ ID NO: 3984056 - RNA, 16 nt, Human herpesvirus 5
accuggcuggcgcagu

SEQ ID NO: 3984057 - RNA, 19 nt, Human herpesvirus 5
accuggguggaacgagcgc

SEQ ID NO: 3984058 - RNA, 19 nt, Human herpesvirus 5
accuguuuaccucaugcgg

SEQ ID NO: 3984059 - RNA, 17 nt, Human herpesvirus 5
accuucccucuccaccc

SEQ ID NO: 3984060 - RNA, 18 nt, Human herpesvirus 5
accuucuugcccacgccg

SEQ ID NO: 3984061 - RNA, 18 nt, Human herpesvirus 5
accuugucuccccggugu

SEQ ID NO: 3984062 - RNA, 22 nt, Human herpesvirus 5
acgaaccagcugguaccugaaa

SEQ ID NO: 3984063 - RNA, 23 nt, Human herpesvirus 5
acgaagaagaacaagacggagga

SEQ ID NO: 3984064 - RNA, 18 nt, Human herpesvirus 5
acgaccuggccuguggug

SEQ ID NO: 3984065 - RNA, 16 nt, Human herpesvirus 5
acgacgcgccccccac

SEQ ID NO: 3984066 - RNA, 16 nt, Human herpesvirus 5
acgacggaaauggcac

SEQ ID NO: 3984067 - RNA, 12 nt, Human herpesvirus 5
acgacggcgguu

SEQ ID NO: 3984068 - RNA, 20 nt, Human herpesvirus 5
acgacggcgguuucagcugg

SEQ ID NO: 3984069 - RNA, 16 nt, Human herpesvirus 5
acgacguuuaaaguaa

SEQ ID NO: 3984070 - RNA, 19 nt, Human herpesvirus 5
acgacuguucgucgagcac

SEQ ID NO: 3984071 - RNA, 20 nt, Human herpesvirus 5
acgagcaucgcaacaacagc

SEQ ID NO: 3984072 - RNA, 22 nt, Human herpesvirus 5
acgaucguaacccaggcgcgua

SEQ ID NO: 3984073 - RNA, 19 nt, Human herpesvirus 5
acgaucuuuaguccggagg

SEQ ID NO: 3984074 - RNA, 19 nt, Human herpesvirus 5
acgcagugcguggccgcac

SEQ ID NO: 3984075 - RNA, 18 nt, Human herpesvirus 5
acgcaguugagcggggua

SEQ ID NO: 3984076 - RNA, 12 nt, Human herpesvirus 5
acgccaccgccg

SEQ ID NO: 3984077 - RNA, 16 nt, Human herpesvirus 5
acgccaugcucaagac

SEQ ID NO: 3984078 - RNA, 18 nt, Human herpesvirus 5
acgccgucacgcagguga

SEQ ID NO: 3984079 - RNA, 15 nt, Human herpesvirus 5
acgccgugggcggcg

SEQ ID NO: 3984080 - RNA, 22 nt, Human herpesvirus 5
acgccugcgacguuggcucucg

SEQ ID NO: 3984081 - RNA, 17 nt, Human herpesvirus 5
acgcgaccagcugcugg

SEQ ID NO: 3984082 - RNA, 16 nt, Human herpesvirus 5
acgcgccccccaccua

SEQ ID NO: 3984083 - RNA, 18 nt, Human herpesvirus 5
acgcgcccgacagcugca

SEQ ID NO: 3984084 - RNA, 14 nt, Human herpesvirus 5
acgcgccucauggc

SEQ ID NO: 3984085 - RNA, 23 nt, Human herpesvirus 5
acgcgccucauggcggcggccac

SEQ ID NO: 3984086 - RNA, 23 nt, Human herpesvirus 5
acgcggaugagcgugcugcucug

SEQ ID NO: 3984087 - RNA, 22 nt, Human herpesvirus 5
acgcggguccauuggagccgcc

SEQ ID NO: 3984088 - RNA, 18 nt, Human herpesvirus 5
acgcggugaacgugcgcg

SEQ ID NO: 3984089 - RNA, 23 nt, Human herpesvirus 5
acgcgucagggcggugcggcguu

SEQ ID NO: 3984090 - RNA, 15 nt, Human herpesvirus 5
acgcugacguggugc

SEQ ID NO: 3984091 - RNA, 21 nt, Human herpesvirus 5
acgcugcuauaagaaggccau

SEQ ID NO: 3984092 - RNA, 23 nt, Human herpesvirus 5
acgcugcuugguacccgaggucu

SEQ ID NO: 3984093 - RNA, 14 nt, Human herpesvirus 5
acggagcacgggcu

SEQ ID NO: 3984094 - RNA, 14 nt, Human herpesvirus 5
acggcaacgagcag

SEQ ID NO: 3984095 - RNA, 19 nt, Human herpesvirus 5
acggcccccuaccugcgcg

SEQ ID NO: 3984096 - RNA, 15 nt, Human herpesvirus 5
acggccgccgacguc

SEQ ID NO: 3984097 - RNA, 21 nt, Human herpesvirus 5
acggccuuauguggcugcgcc

SEQ ID NO: 3984098 - RNA, 17 nt, Human herpesvirus 5
acggcgucuuccuccuc

SEQ ID NO: 3984099 - RNA, 15 nt, Human herpesvirus 5
acggcuuuccaagcu

SEQ ID NO: 3984100 - RNA, 20 nt, Human herpesvirus 5
acgggccgcgcuccaggcgg

SEQ ID NO: 3984101 - RNA, 20 nt, Human herpesvirus 5
acgggccugguauacgaggc

SEQ ID NO: 3984102 - RNA, 17 nt, Human herpesvirus 5
acggggcgucggagagu

SEQ ID NO: 3984103 - RNA, 14 nt, Human herpesvirus 5
acgguccgggcaca

SEQ ID NO: 3984104 - RNA, 23 nt, Human herpesvirus 5
acgguccguuauguccgcucgug

SEQ ID NO: 3984105 - RNA, 14 nt, Human herpesvirus 5
acggugcgcggcga

SEQ ID NO: 3984106 - RNA, 12 nt, Human herpesvirus 5
acgguggcggcg

SEQ ID NO: 3984107 - RNA, 21 nt, Human herpesvirus 5
acgguuaccuucuugcccacg

SEQ ID NO: 3984108 - RNA, 16 nt, Human herpesvirus 5
acgguuuccacgccac

SEQ ID NO: 3984109 - RNA, 21 nt, Human herpesvirus 5
acguacaagaaccacguuguc

SEQ ID NO: 3984110 - RNA, 22 nt, Human herpesvirus 5
acguacgacugcgcggccugcu

SEQ ID NO: 3984111 - RNA, 22 nt, Human herpesvirus 5
acguagaaaaguaacacacggc

SEQ ID NO: 3984112 - RNA, 17 nt, Human herpesvirus 5
acguagaauacuggaag

SEQ ID NO: 3984113 - RNA, 15 nt, Human herpesvirus 5
acguaggccuccucu

SEQ ID NO: 3984114 - RNA, 20 nt, Human herpesvirus 5
acguaguuccccuacgugac

SEQ ID NO: 3984115 - RNA, 19 nt, Human herpesvirus 5
acgucaacgguuucuggaa

SEQ ID NO: 3984116 - RNA, 16 nt, Human herpesvirus 5
acgucaccgugcccca

SEQ ID NO: 3984117 - RNA, 12 nt, Human herpesvirus 5
acgucaggaauc

SEQ ID NO: 3984118 - RNA, 19 nt, Human herpesvirus 5
acgucaggaaucugggagg

SEQ ID NO: 3984119 - RNA, 21 nt, Human herpesvirus 5
acgucagguucacacgucguu

SEQ ID NO: 3984120 - RNA, 20 nt, Human herpesvirus 5
acgucgcuuuuuacuuugua

SEQ ID NO: 3984121 - RNA, 20 nt, Human herpesvirus 5
acgucggcgguccuccagca

SEQ ID NO: 3984122 - RNA, 14 nt, Human herpesvirus 5
acgucuaugagaaa

SEQ ID NO: 3984123 - RNA, 16 nt, Human herpesvirus 5
acgucucggacggacg

SEQ ID NO: 3984124 - RNA, 18 nt, Human herpesvirus 5
acgucugcguguguguuu

SEQ ID NO: 3984125 - RNA, 17 nt, Human herpesvirus 5
acgugaccgugggacaa

SEQ ID NO: 3984126 - RNA, 20 nt, Human herpesvirus 5
acgugauuauacaacaggug

SEQ ID NO: 3984127 - RNA, 23 nt, Human herpesvirus 5
acgugcaggauguuacgcgaguc

SEQ ID NO: 3984128 - RNA, 11 nt, Human herpesvirus 5
acguggccugg

SEQ ID NO: 3984129 - RNA, 15 nt, Human herpesvirus 5
acgugucuucuucgc

SEQ ID NO: 3984130 - RNA, 20 nt, Human herpesvirus 5
acguucuccaagggagacau

SEQ ID NO: 3984131 - RNA, 21 nt, Human herpesvirus 5
acuaccagcugggccuacacc

SEQ ID NO: 3984132 - RNA, 16 nt, Human herpesvirus 5
gcccccgucgcccgag

SEQ ID NO: 3984133 - RNA, 22 nt, Human herpesvirus 5
gccccgaagguuagcgccgcgg

SEQ ID NO: 3984134 - RNA, 23 nt, Human herpesvirus 5
gccccgauaaucggcucucaggc

SEQ ID NO: 3984135 - RNA, 22 nt, Human herpesvirus 5
gcccgacgugauuuacgagguc

SEQ ID NO: 3984136 - RNA, 16 nt, Human herpesvirus 5
gcccuauccgcgcggc

SEQ ID NO: 3984137 - RNA, 17 nt, Human herpesvirus 5
gcccucagcgugcucag

SEQ ID NO: 3984138 - RNA, 17 nt, Human herpesvirus 5
gcccuuuacggugcugc

SEQ ID NO: 3984139 - RNA, 17 nt, Human herpesvirus 5
gccgaacagcagcucuu

SEQ ID NO: 3984140 - RNA, 13 nt, Human herpesvirus 5
gccgacgcuggcg

SEQ ID NO: 3984141 - RNA, 13 nt, Human herpesvirus 5
gccgacggcggcg

SEQ ID NO: 3984142 - RNA, 13 nt, Human herpesvirus 5
gccgagacggcgu

SEQ ID NO: 3984143 - RNA, 22 nt, Human herpesvirus 5
gccgagcuaugcgagcggggac

SEQ ID NO: 3984144 - RNA, 18 nt, Human herpesvirus 5
gccgaggcuacugcugcu

SEQ ID NO: 3984145 - RNA, 20 nt, Human herpesvirus 5
gccgauccacgggccgcgcu

SEQ ID NO: 3984146 - RNA, 20 nt, Human herpesvirus 5
gccgcaacuucuaccaucuc

SEQ ID NO: 3984147 - RNA, 20 nt, Human herpesvirus 5
gccgcacgcgcuuaggacga

SEQ ID NO: 3984148 - RNA, 19 nt, Human herpesvirus 5
gccgcagccguugguggaa

SEQ ID NO: 3984149 - RNA, 13 nt, Human herpesvirus 5
gccgcagcugcug

SEQ ID NO: 3984150 - RNA, 14 nt, Human herpesvirus 5
gccgcagcugcugg

SEQ ID NO: 3984151 - RNA, 22 nt, Human herpesvirus 5
gccgccaccacccgacugcagc

SEQ ID NO: 3984152 - RNA, 15 nt, Human herpesvirus 5
gccgccccgugacga

SEQ ID NO: 3984153 - RNA, 17 nt, Human herpesvirus 5
gccgcccucccucaaca

SEQ ID NO: 3984154 - RNA, 15 nt, Human herpesvirus 5
gccgccgcucaagcc

SEQ ID NO: 3984155 - RNA, 19 nt, Human herpesvirus 5
gccgcgcaggccgccgccg

SEQ ID NO: 3984156 - RNA, 16 nt, Human herpesvirus 5
gccgcgcgagcgugcg

SEQ ID NO: 3984157 - RNA, 12 nt, Human herpesvirus 5
gccgcggcagca

SEQ ID NO: 3984158 - RNA, 17 nt, Human herpesvirus 5
gccgcggugcaggccgc

SEQ ID NO: 3984159 - RNA, 18 nt, Human herpesvirus 5
gccgcggugcaggccgcg

SEQ ID NO: 3984160 - RNA, 20 nt, Human herpesvirus 5
gccgcgucgcaaacgcugcu

SEQ ID NO: 3984161 - RNA, 14 nt, Human herpesvirus 5
gccgcgugccuggg

SEQ ID NO: 3984162 - RNA, 22 nt, Human herpesvirus 5
gccgcuacugaucgccuggagc

SEQ ID NO: 3984163 - RNA, 18 nt, Human herpesvirus 5
gccgcuuucucaucucag

SEQ ID NO: 3984164 - RNA, 17 nt, Human herpesvirus 5
gccgcuuuucagaccgc

SEQ ID NO: 3984165 - RNA, 18 nt, Human herpesvirus 5
gccggaaacaccgcgagu

SEQ ID NO: 3984166 - RNA, 15 nt, Human herpesvirus 5
gccggacggcagcgu

SEQ ID NO: 3984167 - RNA, 14 nt, Human herpesvirus 5
gccggaggcugugg

SEQ ID NO: 3984168 - RNA, 18 nt, Human herpesvirus 5
gccggcggagacgacggc

SEQ ID NO: 3984169 - RNA, 12 nt, Human herpesvirus 5
gccggcugcugc

SEQ ID NO: 3984170 - RNA, 16 nt, Human herpesvirus 5
gccggggugccgccgc

SEQ ID NO: 3984171 - RNA, 17 nt, Human herpesvirus 5
gccggguuggcacgacg

SEQ ID NO: 3984172 - RNA, 22 nt, Human herpesvirus 5
gccgucagcgucgucguccgug

SEQ ID NO: 3984173 - RNA, 17 nt, Human herpesvirus 5
gccgucgaguacgugcu

SEQ ID NO: 3984174 - RNA, 14 nt, Human herpesvirus 5
gccgucgcuugccg

SEQ ID NO: 3984175 - RNA, 22 nt, Human herpesvirus 5
gccgucucuucgcgccccucug

SEQ ID NO: 3984176 - RNA, 18 nt, Human herpesvirus 5
gccgugcgcgacgagauc

SEQ ID NO: 3984177 - RNA, 22 nt, Human herpesvirus 5
gccguguguuggcuacggcgga

SEQ ID NO: 3984178 - RNA, 18 nt, Human herpesvirus 5
gccguuauguucaguguc

SEQ ID NO: 3984179 - RNA, 16 nt, Human herpesvirus 5
gccuaccugacgccga

SEQ ID NO: 3984180 - RNA, 19 nt, Human herpesvirus 5
gccuaggucuguugcguug

SEQ ID NO: 3984181 - RNA, 14 nt, Human herpesvirus 5
gccucauccuuaug

SEQ ID NO: 3984182 - RNA, 17 nt, Human herpesvirus 5
gccuccgacgacgccga

SEQ ID NO: 3984183 - RNA, 11 nt, Human herpesvirus 5
gccuccggcug

SEQ ID NO: 3984184 - RNA, 13 nt, Human herpesvirus 5
gccuccucgcugg

SEQ ID NO: 3984185 - RNA, 14 nt, Human herpesvirus 5
gccucucauguucu

SEQ ID NO: 3984186 - RNA, 15 nt, Human herpesvirus 5
gccucuuuugacaug

SEQ ID NO: 3984187 - RNA, 18 nt, Human herpesvirus 5
gccugcacgaccugcucc

SEQ ID NO: 3984188 - RNA, 23 nt, Human herpesvirus 5
gccugcacgaccugcuccaguac

SEQ ID NO: 3984189 - RNA, 21 nt, Human herpesvirus 5
gccugcgggcaggcggguugc

SEQ ID NO: 3984190 - RNA, 18 nt, Human herpesvirus 5
gccugggcugcuguuggg

SEQ ID NO: 3984191 - RNA, 13 nt, Human herpesvirus 5
gccugguugcugc

SEQ ID NO: 3984192 - RNA, 18 nt, Human herpesvirus 5
gccuguggauagauuucu

SEQ ID NO: 3984193 - RNA, 21 nt, Human herpesvirus 5
gccuguggugcgacugcggcg

SEQ ID NO: 3984194 - RNA, 18 nt, Human herpesvirus 5
gccuuaucgugcuaggca

SEQ ID NO: 3984195 - RNA, 19 nt, Human herpesvirus 5
gccuugcgcucccugcucc

SEQ ID NO: 3984196 - RNA, 20 nt, Human herpesvirus 5
gcgaagccagcuacagccac

SEQ ID NO: 3984197 - RNA, 20 nt, Human herpesvirus 5
gcgacaagcuguggcugcac

SEQ ID NO: 3984198 - RNA, 22 nt, Human herpesvirus 5
gcgacaagcuguggcugcacac

SEQ ID NO: 3984199 - RNA, 21 nt, Human herpesvirus 5
gcgacaccguaucagcuaccg

SEQ ID NO: 3984200 - RNA, 12 nt, Human herpesvirus 5
gcgacacgugcu

SEQ ID NO: 3984201 - RNA, 12 nt, Human herpesvirus 5
gcgacagacauc

SEQ ID NO: 3984202 - RNA, 16 nt, Human herpesvirus 5
gcgacagcagcaucag

SEQ ID NO: 3984203 - RNA, 13 nt, Human herpesvirus 5
gcgaccagcugcu

SEQ ID NO: 3984204 - RNA, 14 nt, Human herpesvirus 5
gcgacccagcgaca

SEQ ID NO: 3984205 - RNA, 23 nt, Human herpesvirus 5
gcgacgagcgcugcgaagaugcu

SEQ ID NO: 3984206 - RNA, 18 nt, Human herpesvirus 5
gcgacggcgaauggauca

SEQ ID NO: 3984207 - RNA, 20 nt, Human herpesvirus 5
gcgacggcggguggagauga

SEQ ID NO: 3984208 - RNA, 20 nt, Human herpesvirus 5
gcgagcgggguucaccugca

SEQ ID NO: 3984209 - RNA, 15 nt, Human herpesvirus 5
gcgaggcggcaacug

SEQ ID NO: 3984210 - RNA, 19 nt, Human herpesvirus 5
gcgauggcccgcuaucgca

SEQ ID NO: 3984211 - RNA, 14 nt, Human herpesvirus 5
gcgcaagugccugc

SEQ ID NO: 3984212 - RNA, 16 nt, Human herpesvirus 5
gcgcaagugccugcac

SEQ ID NO: 3984213 - RNA, 12 nt, Human herpesvirus 5
gcgcacggcguc

SEQ ID NO: 3984214 - RNA, 12 nt, Human herpesvirus 5
gcgcagcgggcu

SEQ ID NO: 3984215 - RNA, 16 nt, Human herpesvirus 5
gcgcaucgccugcacc

SEQ ID NO: 3984216 - RNA, 23 nt, Human herpesvirus 5
gcgccacguagccgaugcugaug

SEQ ID NO: 3984217 - RNA, 19 nt, Human herpesvirus 5
gcgccaguacgauccuccg

SEQ ID NO: 3984218 - RNA, 16 nt, Human herpesvirus 5
gcgcccacuggaguug

SEQ ID NO: 3984219 - RNA, 20 nt, Human herpesvirus 5
gcgcccgaagccgcgcgagc

SEQ ID NO: 3984220 - RNA, 22 nt, Human herpesvirus 5
gcgccucacgcugcacgaccug

SEQ ID NO: 3984221 - RNA, 19 nt, Human herpesvirus 5
gcgccugguugcugccgcg

SEQ ID NO: 3984222 - RNA, 16 nt, Human herpesvirus 5
gcgcgcacccgacggc

SEQ ID NO: 3984223 - RNA, 14 nt, Human herpesvirus 5
gcgcgcggcgcguu

SEQ ID NO: 3984224 - RNA, 19 nt, Human herpesvirus 5
gcgcgucaucggcaccauc

SEQ ID NO: 3984225 - RNA, 15 nt, Human herpesvirus 5
gcgcuacgugcgcgc

SEQ ID NO: 3984226 - RNA, 12 nt, Human herpesvirus 5
gcgcucccugcu

SEQ ID NO: 3984227 - RNA, 13 nt, Human herpesvirus 5
gcgcuccucgagc

SEQ ID NO: 3984228 - RNA, 21 nt, Human herpesvirus 5
gcgcucuugugucucccgaca

SEQ ID NO: 3984229 - RNA, 18 nt, Human herpesvirus 5
gcgcugcggucccgacau

SEQ ID NO: 3984230 - RNA, 19 nt, Human herpesvirus 5
gcgcugguggccgaacagc

SEQ ID NO: 3984231 - RNA, 18 nt, Human herpesvirus 5
gcgcuucuggucgguuuu

SEQ ID NO: 3984232 - RNA, 14 nt, Human herpesvirus 5
gcgcuugcggcaca

SEQ ID NO: 3984233 - RNA, 19 nt, Human herpesvirus 5
gcggcagcggaacucgacc

SEQ ID NO: 3984234 - RNA, 19 nt, Human herpesvirus 5
gcggccacggccugcgggc

SEQ ID NO: 3984235 - RNA, 18 nt, Human herpesvirus 5
gcggcccuucaacggcac

SEQ ID NO: 3984236 - RNA, 13 nt, Human herpesvirus 5
gcggccguggccu

SEQ ID NO: 3984237 - RNA, 17 nt, Human herpesvirus 5
gcggcgacaagcugugg

SEQ ID NO: 3984238 - RNA, 13 nt, Human herpesvirus 5
gcggcgccgacuc

SEQ ID NO: 3984239 - RNA, 20 nt, Human herpesvirus 5
gcggcgguggugacugggga

SEQ ID NO: 3984240 - RNA, 18 nt, Human herpesvirus 5
gcggcucgggcuggcgug

SEQ ID NO: 3984241 - RNA, 15 nt, Human herpesvirus 5
gcggcuuauguuucu

SEQ ID NO: 3984242 - RNA, 15 nt, Human herpesvirus 5
gcgggaacuggccug

SEQ ID NO: 3984243 - RNA, 22 nt, Human herpesvirus 5
gcgggcaauugcaugucgccca

SEQ ID NO: 3984244 - RNA, 19 nt, Human herpesvirus 5
gcgggcacuggggacggug

SEQ ID NO: 3984245 - RNA, 17 nt, Human herpesvirus 5
gcgggccgaccgccgcc

SEQ ID NO: 3984246 - RNA, 14 nt, Human herpesvirus 5
gcggguccauugga

SEQ ID NO: 3984247 - RNA, 17 nt, Human herpesvirus 5
guacggcaacgagcagg

SEQ ID NO: 3984248 - RNA, 15 nt, Human herpesvirus 5
guacggcccggcagc

SEQ ID NO: 3984249 - RNA, 15 nt, Human herpesvirus 5
guacggccucugggc

SEQ ID NO: 3984250 - RNA, 10 nt, Human herpesvirus 5
guacugaagc

SEQ ID NO: 3984251 - RNA, 16 nt, Human herpesvirus 5
guacugcgacggcagc

SEQ ID NO: 3984252 - RNA, 22 nt, Human herpesvirus 5
guagccaccuguuggaacccau

SEQ ID NO: 3984253 - RNA, 18 nt, Human herpesvirus 5
guagcgggcugucacauc

SEQ ID NO: 3984254 - RNA, 14 nt, Human herpesvirus 5
guagcuagugcagc

SEQ ID NO: 3984255 - RNA, 19 nt, Human herpesvirus 5
guagcuuuuuuuauacauc

SEQ ID NO: 3984256 - RNA, 13 nt, Human herpesvirus 5
guaggaggcgcgc

SEQ ID NO: 3984257 - RNA, 14 nt, Human herpesvirus 5
guaggaguggcgcc

SEQ ID NO: 3984258 - RNA, 14 nt, Human herpesvirus 5
guauauucaaucau

SEQ ID NO: 3984259 - RNA, 20 nt, Human herpesvirus 5
guaucgggccgucgcuugcc

SEQ ID NO: 3984260 - RNA, 23 nt, Human herpesvirus 5
guaucugagcggcggcgugaccg

SEQ ID NO: 3984261 - RNA, 16 nt, Human herpesvirus 5
guauguggaacagcuc

SEQ ID NO: 3984262 - RNA, 19 nt, Human herpesvirus 5
guauucaucgggucgucuc

SEQ ID NO: 3984263 - RNA, 16 nt, Human herpesvirus 5
gucaaaagccugggua

SEQ ID NO: 3984264 - RNA, 13 nt, Human herpesvirus 5
gucaaagcucacu

SEQ ID NO: 3984265 - RNA, 18 nt, Human herpesvirus 5
gucaacaucaucagcgcc

SEQ ID NO: 3984266 - RNA, 23 nt, Human herpesvirus 5
gucacacaggccagcugccacca

SEQ ID NO: 3984267 - RNA, 15 nt, Human herpesvirus 5
gucacgucgggacga

SEQ ID NO: 3984268 - RNA, 18 nt, Human herpesvirus 5
gucacuaaggaccgacac

SEQ ID NO: 3984269 - RNA, 10 nt, Human herpesvirus 5
gucacuuccc

SEQ ID NO: 3984270 - RNA, 21 nt, Human herpesvirus 5
gucagcgaacgacgcagugcg

SEQ ID NO: 3984271 - RNA, 17 nt, Human herpesvirus 5
gucagcggcacgccgcc

SEQ ID NO: 3984272 - RNA, 14 nt, Human herpesvirus 5
gucaggacuggaag

SEQ ID NO: 3984273 - RNA, 17 nt, Human herpesvirus 5
gucaugccuuggcgcuc

SEQ ID NO: 3984274 - RNA, 23 nt, Human herpesvirus 5
gucaugggcgacuuucagggcau

SEQ ID NO: 3984275 - RNA, 21 nt, Human herpesvirus 5
gucaugucuccgaacucagag

SEQ ID NO: 3984276 - RNA, 22 nt, Human herpesvirus 5
guccaagcgcguccuguuucau

SEQ ID NO: 3984277 - RNA, 16 nt, Human herpesvirus 5
guccacacaccgcuuu

SEQ ID NO: 3984278 - RNA, 23 nt, Human herpesvirus 5
guccacccaucccgagcacucca

SEQ ID NO: 3984279 - RNA, 21 nt, Human herpesvirus 5
guccaccucugcuacuggccc

SEQ ID NO: 3984280 - RNA, 19 nt, Human herpesvirus 5
gucccagcagggcgcgccg

SEQ ID NO: 3984281 - RNA, 21 nt, Human herpesvirus 5
guccccugccaccucagugga

SEQ ID NO: 3984282 - RNA, 19 nt, Human herpesvirus 5
gucccgaaaugauauccgu

SEQ ID NO: 3984283 - RNA, 20 nt, Human herpesvirus 5
gucccgcgcggaucggacac

SEQ ID NO: 3984284 - RNA, 15 nt, Human herpesvirus 5
gucccgugugugggg

SEQ ID NO: 3984285 - RNA, 23 nt, Human herpesvirus 5
gucccuuuuacuaguauccacgu

SEQ ID NO: 3984286 - RNA, 16 nt, Human herpesvirus 5
guccgcggugucuccu

SEQ ID NO: 3984287 - RNA, 16 nt, Human herpesvirus 5
guccucgcccggugag

SEQ ID NO: 3984288 - RNA, 22 nt, Human herpesvirus 5
guccuucaucucuucgugacgg

SEQ ID NO: 3984289 - RNA, 18 nt, Human herpesvirus 5
gucgacuguugccgcgug

SEQ ID NO: 3984290 - RNA, 15 nt, Human herpesvirus 5
gucgaugccuguugg

SEQ ID NO: 3984291 - RNA, 20 nt, Human herpesvirus 5
gucgcaagggcugcucggcg

SEQ ID NO: 3984292 - RNA, 20 nt, Human herpesvirus 5
gucgccagcgcgagcgcucg

SEQ ID NO: 3984293 - RNA, 15 nt, Human herpesvirus 5
gucgccaugcuucau

SEQ ID NO: 3984294 - RNA, 16 nt, Human herpesvirus 5
gucgccgacgaagaag

SEQ ID NO: 3984295 - RNA, 16 nt, Human herpesvirus 5
gucgcgcccacggucc

SEQ ID NO: 3984296 - RNA, 12 nt, Human herpesvirus 5
gucgcguccggg

SEQ ID NO: 3984297 - RNA, 15 nt, Human herpesvirus 5
gucgcuauacaccaa

SEQ ID NO: 3984298 - RNA, 14 nt, Human herpesvirus 5
gucgcuccgcgucg

SEQ ID NO: 3984299 - RNA, 18 nt, Human herpesvirus 5
gucggagccccugcgcgc

SEQ ID NO: 3984300 - RNA, 17 nt, Human herpesvirus 5
gucggccugggcugcug

SEQ ID NO: 3984301 - RNA, 16 nt, Human herpesvirus 5
gucggcgguccuccag

SEQ ID NO: 3984302 - RNA, 13 nt, Human herpesvirus 5
gucggcugccugu

SEQ ID NO: 3984303 - RNA, 19 nt, Human herpesvirus 5
gucgguaccgucuccacca

SEQ ID NO: 3984304 - RNA, 19 nt, Human herpesvirus 5
gucggucccaucgcccaca

SEQ ID NO: 3984305 - RNA, 15 nt, Human herpesvirus 5
gucguggaggcagcg

SEQ ID NO: 3984306 - RNA, 17 nt, Human herpesvirus 5
gucguguccgugaucac

SEQ ID NO: 3984307 - RNA, 18 nt, Human herpesvirus 5
gucuacagacugggcgac

SEQ ID NO: 3984308 - RNA, 18 nt, Human herpesvirus 5
gucuacgaucgcuggaaa

SEQ ID NO: 3984309 - RNA, 20 nt, Human herpesvirus 5
gucuagauagucccacaggg

SEQ ID NO: 3984310 - RNA, 18 nt, Human herpesvirus 5
gucuccaagucuggugcg

SEQ ID NO: 3984311 - RNA, 13 nt, Human herpesvirus 5
gucuccaccacag

SEQ ID NO: 3984312 - RNA, 14 nt, Human herpesvirus 5
gucuccaccacagu

SEQ ID NO: 3984313 - RNA, 22 nt, Human herpesvirus 5
gucucccgacaggcucgucgug

SEQ ID NO: 3984314 - RNA, 14 nt, Human herpesvirus 5
gucugcgcuuuccc

SEQ ID NO: 3984315 - RNA, 18 nt, Human herpesvirus 5
gucuggagguggccugca

SEQ ID NO: 3984316 - RNA, 15 nt, Human herpesvirus 5
gucuggcccaaagac

SEQ ID NO: 3984317 - RNA, 20 nt, Human herpesvirus 5
gucuggcuuuaccgccgucg

SEQ ID NO: 3984318 - RNA, 15 nt, Human herpesvirus 5
gucuucugaagccgu

SEQ ID NO: 3984319 - RNA, 15 nt, Human herpesvirus 5
gucuuugucauaccc

SEQ ID NO: 3984320 - RNA, 13 nt, Human herpesvirus 5
gugaacgugcgcg

SEQ ID NO: 3984321 - RNA, 23 nt, Human herpesvirus 5
gugaccacgucaccgugccccac

SEQ ID NO: 3984322 - RNA, 15 nt, Human herpesvirus 5
gugacgcuaggcggc

SEQ ID NO: 3984323 - RNA, 22 nt, Human herpesvirus 5
gugaucggccgcggugcgcugc

SEQ ID NO: 3984324 - RNA, 18 nt, Human herpesvirus 5
gugauuauaucuuucuac

SEQ ID NO: 3984325 - RNA, 22 nt, Human herpesvirus 5
gugcagcaagaguugcaacgcg

SEQ ID NO: 3984326 - RNA, 13 nt, Human herpesvirus 5
gugcagcugguga

SEQ ID NO: 3984327 - RNA, 24 nt, Human herpesvirus 5
gugcagguucugaaucugcuccag

SEQ ID NO: 3984328 - RNA, 11 nt, Human herpesvirus 5
gugccaacaau

SEQ ID NO: 3984329 - RNA, 13 nt, Human herpesvirus 5
gugccagcuggcg

SEQ ID NO: 3984330 - RNA, 17 nt, Human herpesvirus 5
gugccgagaccgucgcc

SEQ ID NO: 3984331 - RNA, 21 nt, Human herpesvirus 5
gugccguugcuuuggcggcag

SEQ ID NO: 3984332 - RNA, 23 nt, Human herpesvirus 5
gugcgacugcggcgacuggcgag

SEQ ID NO: 3984333 - RNA, 18 nt, Human herpesvirus 5
gugcgccuuccaguccau

SEQ ID NO: 3984334 - RNA, 22 nt, Human herpesvirus 5
gugcgcgaccgcaaccgcgagc

SEQ ID NO: 3984335 - RNA, 19 nt, Human herpesvirus 5
gugcggcccccagaggccc

SEQ ID NO: 3984336 - RNA, 13 nt, Human herpesvirus 5
gugcgggugcaug

SEQ ID NO: 3984337 - RNA, 15 nt, Human herpesvirus 5
gugcguggaccagac

SEQ ID NO: 3984338 - RNA, 14 nt, Human herpesvirus 5
gugcucgugcccau

SEQ ID NO: 3984339 - RNA, 15 nt, Human herpesvirus 5
gugcugggucagugc

SEQ ID NO: 3984340 - RNA, 16 nt, Human herpesvirus 5
guggagaugaggcggc

SEQ ID NO: 3984341 - RNA, 22 nt, Human herpesvirus 5
guggaucgucgcggacugccgg

SEQ ID NO: 3984342 - RNA, 18 nt, Human herpesvirus 5
guggaugagggcucuuca

SEQ ID NO: 3984343 - RNA, 12 nt, Human herpesvirus 5
guggcaaagagc

SEQ ID NO: 3984344 - RNA, 15 nt, Human herpesvirus 5
guggcccuggucugg

SEQ ID NO: 3984345 - RNA, 19 nt, Human herpesvirus 5
guggcgccccggcuucauu

SEQ ID NO: 3984346 - RNA, 21 nt, Human herpesvirus 5
guggcggcgguggagggcgcg

SEQ ID NO: 3984347 - RNA, 12 nt, Human herpesvirus 5
guggcuggagaa

SEQ ID NO: 3984348 - RNA, 14 nt, Human herpesvirus 5
guggcuguuguuga

SEQ ID NO: 3984349 - RNA, 14 nt, Human herpesvirus 5
gugggccggggccc

SEQ ID NO: 3984350 - RNA, 15 nt, Human herpesvirus 5
gugggcuacuuugac

SEQ ID NO: 3984351 - RNA, 13 nt, Human herpesvirus 5
guggggcugcuca

SEQ ID NO: 3984352 - RNA, 18 nt, Human herpesvirus 5
guggggcugcucaacuuu

SEQ ID NO: 3984353 - RNA, 13 nt, Human herpesvirus 5
guggucccggaua

SEQ ID NO: 3984354 - RNA, 16 nt, Human herpesvirus 5
gugucgcgcacccggc

SEQ ID NO: 3984355 - RNA, 15 nt, Human herpesvirus 5
gugucgcugggcugg

SEQ ID NO: 3984356 - RNA, 16 nt, Human herpesvirus 5
gugugaucugggcagc

SEQ ID NO: 3984357 - RNA, 15 nt, Human herpesvirus 5
guuaaaaaaaccacg

SEQ ID NO: 3984358 - RNA, 22 nt, Human herpesvirus 5
guuagcgccgcggcaccagaga

SEQ ID NO: 3984359 - RNA, 15 nt, Human herpesvirus 5
guucacacgucguua

SEQ ID NO: 3984360 - RNA, 18 nt, Human herpesvirus 5
guucagguggaugagggc

SEQ ID NO: 3984361 - RNA, 14 nt, Human herpesvirus 5
guucccagcgcggc

SEQ ID NO: 3984362 - RNA, 13 nt, Human herpesvirus 5
aaaaaaaggcguu

SEQ ID NO: 3984363 - RNA, 19 nt, Human herpesvirus 5
aaaaacacgacgaaagcgu

SEQ ID NO: 3984364 - RNA, 16 nt, Human herpesvirus 5
aaaacuaaaagaccua

SEQ ID NO: 3984365 - RNA, 16 nt, Human herpesvirus 5
aaaagaccuaauacua

SEQ ID NO: 3984366 - RNA, 19 nt, Human herpesvirus 5
aaaagggacgucaaagcuc

SEQ ID NO: 3984367 - RNA, 14 nt, Human herpesvirus 5
aaaauaauagauua

SEQ ID NO: 3984368 - RNA, 15 nt, Human herpesvirus 5
aaaauaauauacaca

SEQ ID NO: 3984369 - RNA, 17 nt, Human herpesvirus 5
aaaauacuggacuuuug

SEQ ID NO: 3984370 - RNA, 18 nt, Human herpesvirus 5
aaacaccguguggugguu

SEQ ID NO: 3984371 - RNA, 21 nt, Human herpesvirus 5
aaacccacgaccauuuccgug

SEQ ID NO: 3984372 - RNA, 23 nt, Human herpesvirus 5
aaacgcgagaugaacuguuccac

SEQ ID NO: 3984373 - RNA, 20 nt, Human herpesvirus 5
aaacgguacgcagucacugc

SEQ ID NO: 3984374 - RNA, 22 nt, Human herpesvirus 5
aaagcacaauacacaugugguu

SEQ ID NO: 3984375 - RNA, 21 nt, Human herpesvirus 5
aaaggauggacguacuggacc

SEQ ID NO: 3984376 - RNA, 22 nt, Human herpesvirus 5
aaaguaccacauuuuuugacag

SEQ ID NO: 3984377 - RNA, 16 nt, Human herpesvirus 5
aaauuauaacggaaau

SEQ ID NO: 3984378 - RNA, 14 nt, Human herpesvirus 5
aacaaacaaugaca

SEQ ID NO: 3984379 - RNA, 17 nt, Human herpesvirus 5
aacaacagcaacaacag

SEQ ID NO: 3984380 - RNA, 12 nt, Human herpesvirus 5
aacaacgucacu

SEQ ID NO: 3984381 - RNA, 20 nt, Human herpesvirus 5
aacaagccgacccccaccag

SEQ ID NO: 3984382 - RNA, 19 nt, Human herpesvirus 5
aacacagacaggcggccag

SEQ ID NO: 3984383 - RNA, 21 nt, Human herpesvirus 5
aacaccguguucucccgacgu

SEQ ID NO: 3984384 - RNA, 15 nt, Human herpesvirus 5
aacagcagcaacagc

SEQ ID NO: 3984385 - RNA, 17 nt, Human herpesvirus 5
aacagguccagcuuaaa

SEQ ID NO: 3984386 - RNA, 18 nt, Human herpesvirus 5
aacaguacggacaaguau

SEQ ID NO: 3984387 - RNA, 19 nt, Human herpesvirus 5
aacaugaaucuuccccucu

SEQ ID NO: 3984388 - RNA, 18 nt, Human herpesvirus 5
aacauggcucccagagcu

SEQ ID NO: 3984389 - RNA, 17 nt, Human herpesvirus 5
aaccacaagaaacgcug

SEQ ID NO: 3984390 - RNA, 16 nt, Human herpesvirus 5
aaccaccgugucuccg

SEQ ID NO: 3984391 - RNA, 18 nt, Human herpesvirus 5
aacccagcagccggagga

SEQ ID NO: 3984392 - RNA, 17 nt, Human herpesvirus 5
aaccgcccgugccuccc

SEQ ID NO: 3984393 - RNA, 18 nt, Human herpesvirus 5
aaccguaguugucggcgc

SEQ ID NO: 3984394 - RNA, 14 nt, Human herpesvirus 5
aaccgugguccgcu

SEQ ID NO: 3984395 - RNA, 14 nt, Human herpesvirus 5
aacgcguggcccug

SEQ ID NO: 3984396 - RNA, 14 nt, Human herpesvirus 5
aacguugagacuac

SEQ ID NO: 3984397 - RNA, 23 nt, Human herpesvirus 5
caucaccaacguuaccuccgacu

SEQ ID NO: 3984398 - RNA, 21 nt, Human herpesvirus 5
caucacccgccucauggaccc

SEQ ID NO: 3984399 - RNA, 13 nt, Human herpesvirus 5
caucaccgccucc

SEQ ID NO: 3984400 - RNA, 23 nt, Human herpesvirus 5
caucacgugccacguucuugcgu

SEQ ID NO: 3984401 - RNA, 22 nt, Human herpesvirus 5
caucaggaucuggugcaggcca

SEQ ID NO: 3984402 - RNA, 17 nt, Human herpesvirus 5
caucauaaacuuaugau

SEQ ID NO: 3984403 - RNA, 23 nt, Human herpesvirus 5
caucaucagcgccgugcucagcg

SEQ ID NO: 3984404 - RNA, 23 nt, Human herpesvirus 5
cauccaucacaucacccaacacu

SEQ ID NO: 3984405 - RNA, 22 nt, Human herpesvirus 5
caucgguugccucuggguguug

SEQ ID NO: 3984406 - RNA, 19 nt, Human herpesvirus 5
caucgugguagcgccgcga

SEQ ID NO: 3984407 - RNA, 17 nt, Human herpesvirus 5
caucuccgucucugguc

SEQ ID NO: 3984408 - RNA, 23 nt, Human herpesvirus 5
caugaggaagcggggguguauag

SEQ ID NO: 3984409 - RNA, 14 nt, Human herpesvirus 5
caugcaucccacca

SEQ ID NO: 3984410 - RNA, 20 nt, Human herpesvirus 5
caugcgggaacuggccuggc

SEQ ID NO: 3984411 - RNA, 15 nt, Human herpesvirus 5
caugcgguguuuccg

SEQ ID NO: 3984412 - RNA, 19 nt, Human herpesvirus 5
caugcugugggcccacugc

SEQ ID NO: 3984413 - RNA, 20 nt, Human herpesvirus 5
cauggaggucuaucacgggc

SEQ ID NO: 3984414 - RNA, 15 nt, Human herpesvirus 5
cauggucggugacau

SEQ ID NO: 3984415 - RNA, 19 nt, Human herpesvirus 5
caugugcaaaaacuugucc

SEQ ID NO: 3984416 - RNA, 14 nt, Human herpesvirus 5
caugugcagcuggu

SEQ ID NO: 3984417 - RNA, 18 nt, Human herpesvirus 5
cauguucucccaggacca

SEQ ID NO: 3984418 - RNA, 16 nt, Human herpesvirus 5
cauuacuaaacaaaaa

SEQ ID NO: 3984419 - RNA, 17 nt, Human herpesvirus 5
cauuggaaguaacauca

SEQ ID NO: 3984420 - RNA, 14 nt, Human herpesvirus 5
ccaaaaccaugcua

SEQ ID NO: 3984421 - RNA, 13 nt, Human herpesvirus 5
ccaaggcgagcca

SEQ ID NO: 3984422 - RNA, 13 nt, Human herpesvirus 5
ccaauaacauguc

SEQ ID NO: 3984423 - RNA, 20 nt, Human herpesvirus 5
ccacaacgaggaacccgcga

SEQ ID NO: 3984424 - RNA, 22 nt, Human herpesvirus 5
ccaccgauccgcacgaccgcga

SEQ ID NO: 3984425 - RNA, 23 nt, Human herpesvirus 5
ccaccgugaugucaacacugacg

SEQ ID NO: 3984426 - RNA, 19 nt, Human herpesvirus 5
ccacgacgcagaaagaggg

SEQ ID NO: 3984427 - RNA, 20 nt, Human herpesvirus 5
ccacggaaguuccgacgcga

SEQ ID NO: 3984428 - RNA, 22 nt, Human herpesvirus 5
ccacggccuuauguggcugcgc

SEQ ID NO: 3984429 - RNA, 21 nt, Human herpesvirus 5
ccacggcgggucguuggcucc

SEQ ID NO: 3984430 - RNA, 16 nt, Human herpesvirus 5
ccacggcgucuuccuc

SEQ ID NO: 3984431 - RNA, 20 nt, Human herpesvirus 5
ccacggcugcugaucgccgu

SEQ ID NO: 3984432 - RNA, 19 nt, Human herpesvirus 5
ccacggugcuuuucaucua

SEQ ID NO: 3984433 - RNA, 19 nt, Human herpesvirus 5
ccacgguuuguggcaaggc

SEQ ID NO: 3984434 - RNA, 18 nt, Human herpesvirus 5
ccacguccacccaucccg

SEQ ID NO: 3984435 - RNA, 18 nt, Human herpesvirus 5
ccacuauguccuccgcac

SEQ ID NO: 3984436 - RNA, 14 nt, Human herpesvirus 5
ccagaacucucugc

SEQ ID NO: 3984437 - RNA, 22 nt, Human herpesvirus 5
ccagcagggcgcgccggcgcca

SEQ ID NO: 3984438 - RNA, 23 nt, Human herpesvirus 5
ccagccccgucaaaacacacgcg

SEQ ID NO: 3984439 - RNA, 23 nt, Human herpesvirus 5
ccagccuguuuaaugacaagugc

SEQ ID NO: 3984440 - RNA, 18 nt, Human herpesvirus 5
ccagcgccaccauagcca

SEQ ID NO: 3984441 - RNA, 16 nt, Human herpesvirus 5
ccagcggccgcagugg

SEQ ID NO: 3984442 - RNA, 13 nt, Human herpesvirus 5
ccagcggccuggc

SEQ ID NO: 3984443 - RNA, 16 nt, Human herpesvirus 5
ccagcuacagccacga

SEQ ID NO: 3984444 - RNA, 20 nt, Human herpesvirus 5
ccagcuaucaggccagcugc

SEQ ID NO: 3984445 - RNA, 23 nt, Human herpesvirus 5
ccagcuaucaggccagcugcguc

SEQ ID NO: 3984446 - RNA, 20 nt, Human herpesvirus 5
ccaggauuucaccgccgcua

SEQ ID NO: 3984447 - RNA, 22 nt, Human herpesvirus 5
ccaggcugucaaucaugccggu

SEQ ID NO: 3984448 - RNA, 12 nt, Human herpesvirus 5
ccaggugaccag

SEQ ID NO: 3984449 - RNA, 22 nt, Human herpesvirus 5
ccaguuucaccaaggcgagcca

SEQ ID NO: 3984450 - RNA, 15 nt, Human herpesvirus 5
ccaucgggcccgcca

SEQ ID NO: 3984451 - RNA, 15 nt, Human herpesvirus 5
ccaucucgcguaacg

SEQ ID NO: 3984452 - RNA, 20 nt, Human herpesvirus 5
ccaucucgcguaacgugucu

SEQ ID NO: 3984453 - RNA, 13 nt, Human herpesvirus 5
ccaucuucaucuu

SEQ ID NO: 3984454 - RNA, 17 nt, Human herpesvirus 5
ccaugaagcggaugauu

SEQ ID NO: 3984455 - RNA, 14 nt, Human herpesvirus 5
ccaugacgcgccuc

SEQ ID NO: 3984456 - RNA, 14 nt, Human herpesvirus 5
ccaugagcggcagg

SEQ ID NO: 3984457 - RNA, 23 nt, Human herpesvirus 5
ccaugcugagcaaguacacgcgc

SEQ ID NO: 3984458 - RNA, 15 nt, Human herpesvirus 5
ccauggagcugcacu

SEQ ID NO: 3984459 - RNA, 20 nt, Human herpesvirus 5
cccaaaagaagaaaaaaggc

SEQ ID NO: 3984460 - RNA, 20 nt, Human herpesvirus 5
cgucugagccggggugccgc

SEQ ID NO: 3984461 - RNA, 16 nt, Human herpesvirus 5
cgucugcgacuccugg

SEQ ID NO: 3984462 - RNA, 19 nt, Human herpesvirus 5
cgucuucaaaguagcugug

SEQ ID NO: 3984463 - RNA, 18 nt, Human herpesvirus 5
cgugaaugggcacgccgu

SEQ ID NO: 3984464 - RNA, 18 nt, Human herpesvirus 5
cgugacgcagucugcccu

SEQ ID NO: 3984465 - RNA, 22 nt, Human herpesvirus 5
cgugacggauaagcgcuuucug

SEQ ID NO: 3984466 - RNA, 14 nt, Human herpesvirus 5
cgugacuuggggcg

SEQ ID NO: 3984467 - RNA, 15 nt, Human herpesvirus 5
cgugcaacgccacca

SEQ ID NO: 3984468 - RNA, 19 nt, Human herpesvirus 5
cgugcaacggcgacgcggu

SEQ ID NO: 3984469 - RNA, 14 nt, Human herpesvirus 5
cgugcacgcgcugc

SEQ ID NO: 3984470 - RNA, 17 nt, Human herpesvirus 5
cgugccaggcuguucac

SEQ ID NO: 3984471 - RNA, 20 nt, Human herpesvirus 5
cgugcccguuuucacagcag

SEQ ID NO: 3984472 - RNA, 16 nt, Human herpesvirus 5
cgugccugggaacgcg

SEQ ID NO: 3984473 - RNA, 18 nt, Human herpesvirus 5
cgugcgaccuggacggcu

SEQ ID NO: 3984474 - RNA, 17 nt, Human herpesvirus 5
cgugcgguaacuggcag

SEQ ID NO: 3984475 - RNA, 15 nt, Human herpesvirus 5
cgugcucgcgcacgu

SEQ ID NO: 3984476 - RNA, 20 nt, Human herpesvirus 5
cgugcucgggcgugugggug

SEQ ID NO: 3984477 - RNA, 16 nt, Human herpesvirus 5
cgugcucgugcccauc

SEQ ID NO: 3984478 - RNA, 22 nt, Human herpesvirus 5
cgugcuuuuggugcgccacgua

SEQ ID NO: 3984479 - RNA, 14 nt, Human herpesvirus 5
cguggaaggcaccg

SEQ ID NO: 3984480 - RNA, 14 nt, Human herpesvirus 5
cguggacgacuggc

SEQ ID NO: 3984481 - RNA, 20 nt, Human herpesvirus 5
cguggacugggacgaggagg

SEQ ID NO: 3984482 - RNA, 23 nt, Human herpesvirus 5
cguggcggccgacggcagcgugc

SEQ ID NO: 3984483 - RNA, 19 nt, Human herpesvirus 5
cguggcuuucuccgacgug

SEQ ID NO: 3984484 - RNA, 16 nt, Human herpesvirus 5
cguguaggcgacuggc

SEQ ID NO: 3984485 - RNA, 17 nt, Human herpesvirus 5
cguguucucccgacguc

SEQ ID NO: 3984486 - RNA, 19 nt, Human herpesvirus 5
cguguugccgacggcggcg

SEQ ID NO: 3984487 - RNA, 20 nt, Human herpesvirus 5
cguuaacuauuccacuagua

SEQ ID NO: 3984488 - RNA, 16 nt, Human herpesvirus 5
cguuaagcguugagcc

SEQ ID NO: 3984489 - RNA, 16 nt, Human herpesvirus 5
cguuaccgccucuguc

SEQ ID NO: 3984490 - RNA, 20 nt, Human herpesvirus 5
cguuagagaaagagcagcgc

SEQ ID NO: 3984491 - RNA, 22 nt, Human herpesvirus 5
cguucuccucgacgcgcggcgg

SEQ ID NO: 3984492 - RNA, 14 nt, Human herpesvirus 5
cguugguggaaacu

SEQ ID NO: 3984493 - RNA, 22 nt, Human herpesvirus 5
cguuguucgucucugccucucc

SEQ ID NO: 3984494 - RNA, 15 nt, Human herpesvirus 5
cguuugcgccagugg

SEQ ID NO: 3984495 - RNA, 15 nt, Human herpesvirus 5
cuaaagcccccacga

SEQ ID NO: 3984496 - RNA, 17 nt, Human herpesvirus 5
cuaacacuccucucccc

SEQ ID NO: 3984497 - RNA, 18 nt, Human herpesvirus 5
cuaacauuccccugggaa

SEQ ID NO: 3984498 - RNA, 20 nt, Human herpesvirus 5
cuaaccacuaccgcaacagc

SEQ ID NO: 3984499 - RNA, 23 nt, Human herpesvirus 5
cuacacgccuugcaccugggugg

SEQ ID NO: 3984500 - RNA, 20 nt, Human herpesvirus 5
cuacauccuuaucugggugc

SEQ ID NO: 3984501 - RNA, 22 nt, Human herpesvirus 5
cuacaugcuauaagacagccuu

SEQ ID NO: 3984502 - RNA, 14 nt, Human herpesvirus 5
cuaccagcugggcc

SEQ ID NO: 3984503 - RNA, 15 nt, Human herpesvirus 5
cuacccucaaguacg

SEQ ID NO: 3984504 - RNA, 15 nt, Human herpesvirus 5
cuaccgcgacggcga

SEQ ID NO: 3984505 - RNA, 22 nt, Human herpesvirus 5
cuaccuagaugcuagcaauaau

SEQ ID NO: 3984506 - RNA, 14 nt, Human herpesvirus 5
cuaccucaugacgc

SEQ ID NO: 3984507 - RNA, 17 nt, Human herpesvirus 5
cuaccuggcuggcgcag

SEQ ID NO: 3984508 - RNA, 14 nt, Human herpesvirus 5
cuacgacaacaucc

SEQ ID NO: 3984509 - RNA, 13 nt, Human herpesvirus 5
cuacgagcugggc

SEQ ID NO: 3984510 - RNA, 15 nt, Human herpesvirus 5
cuacggaccgcagca

SEQ ID NO: 3984511 - RNA, 17 nt, Human herpesvirus 5
cuacggaguuuucccuc

SEQ ID NO: 3984512 - RNA, 19 nt, Human herpesvirus 5
cuacggaguuuucccucag

SEQ ID NO: 3984513 - RNA, 22 nt, Human herpesvirus 5
cuacggaguuuucccucagccu

SEQ ID NO: 3984514 - RNA, 23 nt, Human herpesvirus 5
cuacggaguuuucccucagccuc

SEQ ID NO: 3984515 - RNA, 14 nt, Human herpesvirus 5
cuacggcggaccgc

SEQ ID NO: 3984516 - RNA, 15 nt, Human herpesvirus 5
cuacguacgauacac

SEQ ID NO: 3984517 - RNA, 20 nt, Human herpesvirus 5
cuacucacaauggaagccau

SEQ ID NO: 3984518 - RNA, 15 nt, Human herpesvirus 5
cuacucacguuggug

SEQ ID NO: 3984519 - RNA, 17 nt, Human herpesvirus 5
cuacugaucgccuggag

SEQ ID NO: 3984520 - RNA, 17 nt, Human herpesvirus 5
cuagacgaagaggacac

SEQ ID NO: 3984521 - RNA, 17 nt, Human herpesvirus 5
cuagacucacuuuauug

SEQ ID NO: 3984522 - RNA, 16 nt, Human herpesvirus 5
cuaggaacacugaaaa

SEQ ID NO: 3984523 - RNA, 17 nt, Human herpesvirus 5
cuaggcuacuccgccgu

SEQ ID NO: 3984524 - RNA, 15 nt, Human herpesvirus 5
cuauaagacagccuu

SEQ ID NO: 3984525 - RNA, 23 nt, Human herpesvirus 5
cuaucacgggcucguguggcagc

SEQ ID NO: 3984526 - RNA, 22 nt, Human herpesvirus 5
cuauggacaauuccccucgccu

SEQ ID NO: 3984527 - RNA, 17 nt, Human herpesvirus 5
cuauguaaauguuuuua

SEQ ID NO: 3984528 - RNA, 16 nt, Human herpesvirus 5
cuauugcuuagcugca

SEQ ID NO: 3984529 - RNA, 22 nt, Human herpesvirus 5
cuauuggcagaagcauagcgau

SEQ ID NO: 3984530 - RNA, 22 nt, Human herpesvirus 5
cucaaagcagaccaaguacgac

SEQ ID NO: 3984531 - RNA, 16 nt, Human herpesvirus 5
cucacccggcugcugg

SEQ ID NO: 3984532 - RNA, 17 nt, Human herpesvirus 5
cucaccgugcucgugcc

SEQ ID NO: 3984533 - RNA, 13 nt, Human herpesvirus 5
cucacgggaaggc

SEQ ID NO: 3984534 - RNA, 13 nt, Human herpesvirus 5
cucacuguuugaa

SEQ ID NO: 3984535 - RNA, 17 nt, Human herpesvirus 5
cucagcccgcguaagaa

SEQ ID NO: 3984536 - RNA, 20 nt, Human herpesvirus 5
cucagccucuguguucccaa

SEQ ID NO: 3984537 - RNA, 20 nt, Human herpesvirus 5
cucagguuccccgagagggu

SEQ ID NO: 3984538 - RNA, 18 nt, Human herpesvirus 5
cucagucucucggugcgu

SEQ ID NO: 3984539 - RNA, 14 nt, Human herpesvirus 5
cucauaauaaagcu

SEQ ID NO: 3984540 - RNA, 15 nt, Human herpesvirus 5
cucaucggcauguuc

SEQ ID NO: 3984541 - RNA, 16 nt, Human herpesvirus 5
cuccaagucuggugcg

SEQ ID NO: 3984542 - RNA, 18 nt, Human herpesvirus 5
cuccaccgagacgcucac

SEQ ID NO: 3984543 - RNA, 13 nt, Human herpesvirus 5
cuccacggccucc

SEQ ID NO: 3984544 - RNA, 20 nt, Human herpesvirus 5
cuccagcagcagcuggugca

SEQ ID NO: 3984545 - RNA, 17 nt, Human herpesvirus 5
cuccgaacucagaggcc

SEQ ID NO: 3984546 - RNA, 18 nt, Human herpesvirus 5
cuccgaacucagaggcca

SEQ ID NO: 3984547 - RNA, 22 nt, Human herpesvirus 5
cuccgaaggcggacggaggagu

SEQ ID NO: 3984548 - RNA, 16 nt, Human herpesvirus 5
cuccgacuuccuccuc

SEQ ID NO: 3984549 - RNA, 21 nt, Human herpesvirus 5
cuccggcugucaugggucugc

SEQ ID NO: 3984550 - RNA, 15 nt, Human herpesvirus 5
cuccgugccagcugg

SEQ ID NO: 3984551 - RNA, 22 nt, Human herpesvirus 5
gcgucgccaguaccgacgacga

SEQ ID NO: 3984552 - RNA, 22 nt, Human herpesvirus 5
gcgucgcccucgacggcgguac

SEQ ID NO: 3984553 - RNA, 19 nt, Human herpesvirus 5
gcgucgccugcgacggcgg

SEQ ID NO: 3984554 - RNA, 16 nt, Human herpesvirus 5
gcgucggcgccccaca

SEQ ID NO: 3984555 - RNA, 16 nt, Human herpesvirus 5
gcgucgucccagcagg

SEQ ID NO: 3984556 - RNA, 14 nt, Human herpesvirus 5
gcgucuuccuccuc

SEQ ID NO: 3984557 - RNA, 14 nt, Human herpesvirus 5
gcguggacugggac

SEQ ID NO: 3984558 - RNA, 15 nt, Human herpesvirus 5
gcguggauggucaua

SEQ ID NO: 3984559 - RNA, 19 nt, Human herpesvirus 5
gcguguggaggacggggug

SEQ ID NO: 3984560 - RNA, 17 nt, Human herpesvirus 5
gcgugugggugaaaccg

SEQ ID NO: 3984561 - RNA, 16 nt, Human herpesvirus 5
gcguuccaaugcaccg

SEQ ID NO: 3984562 - RNA, 16 nt, Human herpesvirus 5
gcguuguuuacccccg

SEQ ID NO: 3984563 - RNA, 21 nt, Human herpesvirus 5
gcuacgcgaccagcugcugga

SEQ ID NO: 3984564 - RNA, 19 nt, Human herpesvirus 5
gcuacgguggugugugggg

SEQ ID NO: 3984565 - RNA, 18 nt, Human herpesvirus 5
gcuacguacgacugcgcg

SEQ ID NO: 3984566 - RNA, 17 nt, Human herpesvirus 5
gcuacguaggccuccuc

SEQ ID NO: 3984567 - RNA, 14 nt, Human herpesvirus 5
gcuacgugcgcgcc

SEQ ID NO: 3984568 - RNA, 20 nt, Human herpesvirus 5
gcuaucuguguccgcccgag

SEQ ID NO: 3984569 - RNA, 21 nt, Human herpesvirus 5
gcuaugcgggaugcugcggcg

SEQ ID NO: 3984570 - RNA, 23 nt, Human herpesvirus 5
gcucagcggcguguacagcuacc

SEQ ID NO: 3984571 - RNA, 19 nt, Human herpesvirus 5
gcucauccacaacgaggaa

SEQ ID NO: 3984572 - RNA, 14 nt, Human herpesvirus 5
gcucaugccgccac

SEQ ID NO: 3984573 - RNA, 21 nt, Human herpesvirus 5
gcuccagaagauacucgaugg

SEQ ID NO: 3984574 - RNA, 21 nt, Human herpesvirus 5
gcuccgcgucgcuucgccgcc

SEQ ID NO: 3984575 - RNA, 15 nt, Human herpesvirus 5
gcuccuaccgccgcc

SEQ ID NO: 3984576 - RNA, 15 nt, Human herpesvirus 5
gcuccucggagcacg

SEQ ID NO: 3984577 - RNA, 20 nt, Human herpesvirus 5
gcucgaaauguugacccagg

SEQ ID NO: 3984578 - RNA, 13 nt, Human herpesvirus 5
gcucgaccaggag

SEQ ID NO: 3984579 - RNA, 21 nt, Human herpesvirus 5
gcucgaccaggagguguugag

SEQ ID NO: 3984580 - RNA, 22 nt, Human herpesvirus 5
gcucgcuuagacauuccccacc

SEQ ID NO: 3984581 - RNA, 18 nt, Human herpesvirus 5
gcucggacacagcgccgc

SEQ ID NO: 3984582 - RNA, 20 nt, Human herpesvirus 5
gcucgugaaacagcagcucg

SEQ ID NO: 3984583 - RNA, 21 nt, Human herpesvirus 5
gcucgugcgugucgcugggcu

SEQ ID NO: 3984584 - RNA, 12 nt, Human herpesvirus 5
gcugagacagga

SEQ ID NO: 3984585 - RNA, 14 nt, Human herpesvirus 5
gcugagcgugugga

SEQ ID NO: 3984586 - RNA, 12 nt, Human herpesvirus 5
gcugaugucugc

SEQ ID NO: 3984587 - RNA, 13 nt, Human herpesvirus 5
gcugaugugccag

SEQ ID NO: 3984588 - RNA, 14 nt, Human herpesvirus 5
gcugcaccaggagg

SEQ ID NO: 3984589 - RNA, 16 nt, Human herpesvirus 5
gcugcacgaccugcac

SEQ ID NO: 3984590 - RNA, 22 nt, Human herpesvirus 5
gcugcccgggggugacaaggaa

SEQ ID NO: 3984591 - RNA, 19 nt, Human herpesvirus 5
gcugccgcagcugcuggag

SEQ ID NO: 3984592 - RNA, 17 nt, Human herpesvirus 5
gcugccgcucagcgagc

SEQ ID NO: 3984593 - RNA, 16 nt, Human herpesvirus 5
gcugccuguuccugcu

SEQ ID NO: 3984594 - RNA, 20 nt, Human herpesvirus 5
gcugcgcaauaugacgcuga

SEQ ID NO: 3984595 - RNA, 12 nt, Human herpesvirus 5
gcugcgcaggcc

SEQ ID NO: 3984596 - RNA, 13 nt, Human herpesvirus 5
gcugcgucgccug

SEQ ID NO: 3984597 - RNA, 18 nt, Human herpesvirus 5
gcugcucggcguggucaa

SEQ ID NO: 3984598 - RNA, 17 nt, Human herpesvirus 5
gcugcuguugcacgggc

SEQ ID NO: 3984599 - RNA, 18 nt, Human herpesvirus 5
gcugcuguugcacgggcu

SEQ ID NO: 3984600 - RNA, 17 nt, Human herpesvirus 5
gcugcuguugugggugc

SEQ ID NO: 3984601 - RNA, 19 nt, Human herpesvirus 5
gcugcuuuggagcacggga

SEQ ID NO: 3984602 - RNA, 16 nt, Human herpesvirus 5
gcuggagcuaucugug

SEQ ID NO: 3984603 - RNA, 19 nt, Human herpesvirus 5
gcuggccgauccacgggcc

SEQ ID NO: 3984604 - RNA, 16 nt, Human herpesvirus 5
gcuggccgccgcugca

SEQ ID NO: 3984605 - RNA, 21 nt, Human herpesvirus 5
gcuggcgguauggcugcgcgc

SEQ ID NO: 3984606 - RNA, 21 nt, Human herpesvirus 5
gcuggcuuuccucgggcgagu

SEQ ID NO: 3984607 - RNA, 17 nt, Human herpesvirus 5
gcugguggcucaugccg

SEQ ID NO: 3984608 - RNA, 20 nt, Human herpesvirus 5
gcuguacgucacgccagacu

SEQ ID NO: 3984609 - RNA, 21 nt, Human herpesvirus 5
gcuguccauagugcgccaagc

SEQ ID NO: 3984610 - RNA, 14 nt, Human herpesvirus 5
gcuguucacgcgga

SEQ ID NO: 3984611 - RNA, 13 nt, Human herpesvirus 5
gcuuaucugccuc

SEQ ID NO: 3984612 - RNA, 17 nt, Human herpesvirus 5
gcuuccauaaacgcuuu

SEQ ID NO: 3984613 - RNA, 17 nt, Human herpesvirus 5
gcuucgagggcucgugc

SEQ ID NO: 3984614 - RNA, 20 nt, Human herpesvirus 5
gcuucucucuggucuucccu

SEQ ID NO: 3984615 - RNA, 16 nt, Human herpesvirus 5
gcuugcuccucuucca

SEQ ID NO: 3984616 - RNA, 13 nt, Human herpesvirus 5
gcuugcuggcuug

SEQ ID NO: 3984617 - RNA, 19 nt, Human herpesvirus 5
gcuuucgcgucuuuuuucu

SEQ ID NO: 3984618 - RNA, 17 nt, Human herpesvirus 5
gcuuuuggugcgccacg

SEQ ID NO: 3984619 - RNA, 14 nt, Human herpesvirus 5
gcuuuuuugucccg

SEQ ID NO: 3984620 - RNA, 20 nt, Human herpesvirus 5
ggaaaaagguugggagaugc

SEQ ID NO: 3984621 - RNA, 23 nt, Human herpesvirus 5
ggaaacagcguccacaguuuccg

SEQ ID NO: 3984622 - RNA, 17 nt, Human herpesvirus 5
ggaaauacaugaugaau

SEQ ID NO: 3984623 - RNA, 19 nt, Human herpesvirus 5
ggaaauacaugaugaaugu

SEQ ID NO: 3984624 - RNA, 14 nt, Human herpesvirus 5
ggaacggagcagcc

SEQ ID NO: 3984625 - RNA, 21 nt, Human herpesvirus 5
ggaagccggucgucugcgacu

SEQ ID NO: 3984626 - RNA, 14 nt, Human herpesvirus 5
ggaagcggugcuga

SEQ ID NO: 3984627 - RNA, 22 nt, Human herpesvirus 5
ggaagcuuuggucgccugcacu

SEQ ID NO: 3984628 - RNA, 24 nt, Human herpesvirus 5
ggaaugucagaugacgagcgccgg

SEQ ID NO: 3984629 - RNA, 23 nt, Human herpesvirus 5
ggaaugugcuuucccggcauggg

SEQ ID NO: 3984630 - RNA, 15 nt, Human herpesvirus 5
ggacaaguacagcgg

SEQ ID NO: 3984631 - RNA, 23 nt, Human herpesvirus 5
ggacaugauggaaaugcccgcca

SEQ ID NO: 3984632 - RNA, 16 nt, Human herpesvirus 5
ggacauggacucgcca

SEQ ID NO: 3984633 - RNA, 18 nt, Human herpesvirus 5
ggacauggacucgccacg

SEQ ID NO: 3984634 - RNA, 15 nt, Human herpesvirus 5
ggaccgacacggagg

SEQ ID NO: 3984635 - RNA, 16 nt, Human herpesvirus 5
ggaccgacacggagga

SEQ ID NO: 3984636 - RNA, 23 nt, Human herpesvirus 5
ggacggcuacauguguccgggca

SEQ ID NO: 3984637 - RNA, 21 nt, Human herpesvirus 5
ggacucgguuucggcgacgug

SEQ ID NO: 3984638 - RNA, 18 nt, Human herpesvirus 5
ggacugacacagcuccug

SEQ ID NO: 3984639 - RNA, 15 nt, Human herpesvirus 5
ggagaaaagagauga

SEQ ID NO: 3984640 - RNA, 19 nt, Human herpesvirus 5
ggagcccgcacacuggcug

SEQ ID NO: 3984641 - RNA, 14 nt, Human herpesvirus 5
ggagcgggucgccg

SEQ ID NO: 3984642 - RNA, 19 nt, Human herpesvirus 5
ggagcgggucgccgaggcu

SEQ ID NO: 3984643 - RNA, 16 nt, Human herpesvirus 5
ggagcguaccagggaa

SEQ ID NO: 3984644 - RNA, 19 nt, Human herpesvirus 5
ggagcuacgcgaccagcug

SEQ ID NO: 3984645 - RNA, 14 nt, Human herpesvirus 5
ggagcucacccggc

SEQ ID NO: 3984646 - RNA, 17 nt, Human herpesvirus 5
ggagcugcugcucggcg

SEQ ID NO: 3984647 - RNA, 17 nt, Human herpesvirus 5
ggaggacucagagccac

SEQ ID NO: 3984648 - RNA, 14 nt, Human herpesvirus 5
ggaggaugacgaua

SEQ ID NO: 3984649 - RNA, 21 nt, Human herpesvirus 5
ggaggugcuggcggccguggc

SEQ ID NO: 3984650 - RNA, 16 nt, Human herpesvirus 5
ggaguuuguguaaugc

SEQ ID NO: 3984651 - RNA, 19 nt, Human herpesvirus 5
ggauagguguggcgaaagc

SEQ ID NO: 3984652 - RNA, 21 nt, Human herpesvirus 5
ggauccaaggccuccagcgcc

SEQ ID NO: 3984653 - RNA, 14 nt, Human herpesvirus 5
ggaugagggcucuu

SEQ ID NO: 3984654 - RNA, 12 nt, Human herpesvirus 5
gcccucgccggc

SEQ ID NO: 3984655 - RNA, 17 nt, Human herpesvirus 5
gcccugcugacgcuguu

SEQ ID NO: 3984656 - RNA, 20 nt, Human herpesvirus 5
gcccugcugacgcuguugag

SEQ ID NO: 3984657 - RNA, 22 nt, Human herpesvirus 5
gcccuguaugagcuguuucgac

SEQ ID NO: 3984658 - RNA, 11 nt, Human herpesvirus 5
gccgacgaggc

SEQ ID NO: 3984659 - RNA, 15 nt, Human herpesvirus 5
gccgacgaggccggc

SEQ ID NO: 3984660 - RNA, 15 nt, Human herpesvirus 5
gccgagacggcguga

SEQ ID NO: 3984661 - RNA, 21 nt, Human herpesvirus 5
gccgagacggcgugacacagc

SEQ ID NO: 3984662 - RNA, 16 nt, Human herpesvirus 5
gccgagcuaugcgagc

SEQ ID NO: 3984663 - RNA, 14 nt, Human herpesvirus 5
gccgaucaugugcu

SEQ ID NO: 3984664 - RNA, 11 nt, Human herpesvirus 5
gccgcaacagc

SEQ ID NO: 3984665 - RNA, 22 nt, Human herpesvirus 5
gccgcaaugggcuucccuccug

SEQ ID NO: 3984666 - RNA, 22 nt, Human herpesvirus 5
gccgcacgcgcuagccuuucug

SEQ ID NO: 3984667 - RNA, 18 nt, Human herpesvirus 5
gccgcagccguuggugga

SEQ ID NO: 3984668 - RNA, 15 nt, Human herpesvirus 5
gccgcagcugcugga

SEQ ID NO: 3984669 - RNA, 18 nt, Human herpesvirus 5
gccgccgucaccaccgcc

SEQ ID NO: 3984670 - RNA, 19 nt, Human herpesvirus 5
gccgccgucgcgccuuccu

SEQ ID NO: 3984671 - RNA, 13 nt, Human herpesvirus 5
gccgccgugacgu

SEQ ID NO: 3984672 - RNA, 23 nt, Human herpesvirus 5
gccgccuuccaagauacgcgguc

SEQ ID NO: 3984673 - RNA, 14 nt, Human herpesvirus 5
gccgcgacaacggc

SEQ ID NO: 3984674 - RNA, 19 nt, Human herpesvirus 5
gccgcgacaacggccgccg

SEQ ID NO: 3984675 - RNA, 22 nt, Human herpesvirus 5
gccgcgacaacggccgccgcag

SEQ ID NO: 3984676 - RNA, 13 nt, Human herpesvirus 5
gccgcgacacacg

SEQ ID NO: 3984677 - RNA, 23 nt, Human herpesvirus 5
gccgcgauucgucugacgcugcu

SEQ ID NO: 3984678 - RNA, 14 nt, Human herpesvirus 5
gccgcggugcaggc

SEQ ID NO: 3984679 - RNA, 15 nt, Human herpesvirus 5
gccgcggugcaggcc

SEQ ID NO: 3984680 - RNA, 19 nt, Human herpesvirus 5
gccgcucaagccgcggugc

SEQ ID NO: 3984681 - RNA, 16 nt, Human herpesvirus 5
gccgcucagcgagcuc

SEQ ID NO: 3984682 - RNA, 19 nt, Human herpesvirus 5
gccgcuccaucgcagccac

SEQ ID NO: 3984683 - RNA, 14 nt, Human herpesvirus 5
gccgcugccgccgc

SEQ ID NO: 3984684 - RNA, 16 nt, Human herpesvirus 5
gccgcugccgcucagc

SEQ ID NO: 3984685 - RNA, 20 nt, Human herpesvirus 5
gccgcuuucucaucucagcc

SEQ ID NO: 3984686 - RNA, 18 nt, Human herpesvirus 5
gccggcgacugacgccgg

SEQ ID NO: 3984687 - RNA, 22 nt, Human herpesvirus 5
gccggcuucgaacaucgcgucg

SEQ ID NO: 3984688 - RNA, 14 nt, Human herpesvirus 5
gccgggacucuggu

SEQ ID NO: 3984689 - RNA, 15 nt, Human herpesvirus 5
gccggggagacgacg

SEQ ID NO: 3984690 - RNA, 22 nt, Human herpesvirus 5
gccgucacugccaccgacaugg

SEQ ID NO: 3984691 - RNA, 14 nt, Human herpesvirus 5
gccguccaugucgc

SEQ ID NO: 3984692 - RNA, 14 nt, Human herpesvirus 5
gccgucgcaagggc

SEQ ID NO: 3984693 - RNA, 11 nt, Human herpesvirus 5
gccgugcucag

SEQ ID NO: 3984694 - RNA, 22 nt, Human herpesvirus 5
gccgugcucuuggcgccgcggu

SEQ ID NO: 3984695 - RNA, 19 nt, Human herpesvirus 5
gccguggccuguggcccga

SEQ ID NO: 3984696 - RNA, 21 nt, Human herpesvirus 5
gccguguguuaccgccgccgc

SEQ ID NO: 3984697 - RNA, 17 nt, Human herpesvirus 5
gccguugcggccgccgc

SEQ ID NO: 3984698 - RNA, 18 nt, Human herpesvirus 5
gccucaaaaagcaggugg

SEQ ID NO: 3984699 - RNA, 15 nt, Human herpesvirus 5
gccuccagcgccucc

SEQ ID NO: 3984700 - RNA, 16 nt, Human herpesvirus 5
gccucgauccauccug

SEQ ID NO: 3984701 - RNA, 17 nt, Human herpesvirus 5
gccucuacacuuggugc

SEQ ID NO: 3984702 - RNA, 12 nt, Human herpesvirus 5
gccucuuccucg

SEQ ID NO: 3984703 - RNA, 19 nt, Human herpesvirus 5
gccugaggaaggggaggag

SEQ ID NO: 3984704 - RNA, 20 nt, Human herpesvirus 5
gccuguugugguggcuggga

SEQ ID NO: 3984705 - RNA, 15 nt, Human herpesvirus 5
gccuucagcgucuca

SEQ ID NO: 3984706 - RNA, 16 nt, Human herpesvirus 5
gcgaagguguggcggc

SEQ ID NO: 3984707 - RNA, 22 nt, Human herpesvirus 5
gcgaccgucuggagguggccug

SEQ ID NO: 3984708 - RNA, 23 nt, Human herpesvirus 5
gcgaccgucuggagguggccugc

SEQ ID NO: 3984709 - RNA, 19 nt, Human herpesvirus 5
gcgacgagaucuacgcugu

SEQ ID NO: 3984710 - RNA, 14 nt, Human herpesvirus 5
gcgacggcagcgcc

SEQ ID NO: 3984711 - RNA, 16 nt, Human herpesvirus 5
gcgacguaccagcugu

SEQ ID NO: 3984712 - RNA, 13 nt, Human herpesvirus 5
gcgacguggagga

SEQ ID NO: 3984713 - RNA, 19 nt, Human herpesvirus 5
gcgacguggaggagaccau

SEQ ID NO: 3984714 - RNA, 13 nt, Human herpesvirus 5
gcgacuccuggac

SEQ ID NO: 3984715 - RNA, 18 nt, Human herpesvirus 5
gcgagaugaacuguucca

SEQ ID NO: 3984716 - RNA, 21 nt, Human herpesvirus 5
gcgagccccaucgggcccgcc

SEQ ID NO: 3984717 - RNA, 23 nt, Human herpesvirus 5
gcgagcggaacccgggcucaccg

SEQ ID NO: 3984718 - RNA, 23 nt, Human herpesvirus 5
gcgagcgggcaaucaaugcgucu

SEQ ID NO: 3984719 - RNA, 15 nt, Human herpesvirus 5
gcgagcuggccagca

SEQ ID NO: 3984720 - RNA, 12 nt, Human herpesvirus 5
gcgaggcggcaa

SEQ ID NO: 3984721 - RNA, 12 nt, Human herpesvirus 5
gcgcacgccaaa

SEQ ID NO: 3984722 - RNA, 22 nt, Human herpesvirus 5
gcgcaggccgccgccgcucagg

SEQ ID NO: 3984723 - RNA, 21 nt, Human herpesvirus 5
gcgcccaaaccgcaggagcug

SEQ ID NO: 3984724 - RNA, 19 nt, Human herpesvirus 5
gcgccccccaccuacgagc

SEQ ID NO: 3984725 - RNA, 14 nt, Human herpesvirus 5
gcgcccccgugugu

SEQ ID NO: 3984726 - RNA, 16 nt, Human herpesvirus 5
gcgccgccagcgcggu

SEQ ID NO: 3984727 - RNA, 19 nt, Human herpesvirus 5
gcgccgggcgccacggcca

SEQ ID NO: 3984728 - RNA, 14 nt, Human herpesvirus 5
gcgccguccugcag

SEQ ID NO: 3984729 - RNA, 20 nt, Human herpesvirus 5
gcgccguggguuggcagcug

SEQ ID NO: 3984730 - RNA, 18 nt, Human herpesvirus 5
gcgccguuuugcuguccu

SEQ ID NO: 3984731 - RNA, 12 nt, Human herpesvirus 5
gcgccuccuggu

SEQ ID NO: 3984732 - RNA, 14 nt, Human herpesvirus 5
gcgccugcugcucg

SEQ ID NO: 3984733 - RNA, 20 nt, Human herpesvirus 5
gcgccugguugcugccgcgu

SEQ ID NO: 3984734 - RNA, 20 nt, Human herpesvirus 5
gcgcgccuaccugacgccga

SEQ ID NO: 3984735 - RNA, 12 nt, Human herpesvirus 5
gcgcgcugcgug

SEQ ID NO: 3984736 - RNA, 14 nt, Human herpesvirus 5
gcgcggccugcugc

SEQ ID NO: 3984737 - RNA, 13 nt, Human herpesvirus 5
gcgcggcuacacg

SEQ ID NO: 3984738 - RNA, 14 nt, Human herpesvirus 5
gcgcgguguuagac

SEQ ID NO: 3984739 - RNA, 17 nt, Human herpesvirus 5
gcgcgguuucgccgccg

SEQ ID NO: 3984740 - RNA, 16 nt, Human herpesvirus 5
gcgcguccacagcgug

SEQ ID NO: 3984741 - RNA, 15 nt, Human herpesvirus 5
gcgcuaacgccucgu

SEQ ID NO: 3984742 - RNA, 20 nt, Human herpesvirus 5
gcgcuccaggcggagaugag

SEQ ID NO: 3984743 - RNA, 16 nt, Human herpesvirus 5
gcgcuucugcagcucc

SEQ ID NO: 3984744 - RNA, 19 nt, Human herpesvirus 5
gcgcuuucccaccgcgacc

SEQ ID NO: 3984745 - RNA, 23 nt, Human herpesvirus 5
gcggaagauaccgucggcgccgc

SEQ ID NO: 3984746 - RNA, 15 nt, Human herpesvirus 5
gcggacuuggcagcg

SEQ ID NO: 3984747 - RNA, 21 nt, Human herpesvirus 5
gcggaggaggugaccuggcug

SEQ ID NO: 3984748 - RNA, 13 nt, Human herpesvirus 5
gcggcaaucggug

SEQ ID NO: 3984749 - RNA, 13 nt, Human herpesvirus 5
gcggcaccaggaa

SEQ ID NO: 3984750 - RNA, 16 nt, Human herpesvirus 5
gcggccgacggcagcg

SEQ ID NO: 3984751 - RNA, 17 nt, Human herpesvirus 5
gcggccgcagaaggcca

SEQ ID NO: 3984752 - RNA, 14 nt, Human herpesvirus 5
gcggccguggccug

SEQ ID NO: 3984753 - RNA, 13 nt, Human herpesvirus 5
gcggcgccgggaa

SEQ ID NO: 3984754 - RNA, 23 nt, Human herpesvirus 5
gcggcgcuucgagggcucgugcg

SEQ ID NO: 3984755 - RNA, 13 nt, Human herpesvirus 5
gcggcggcacucg

SEQ ID NO: 3984756 - RNA, 24 nt, Human herpesvirus 5
gcggcgguagaaacgucgcagcca

SEQ ID NO: 3984757 - RNA, 15 nt, Human herpesvirus 5
gcggcgguggccguc

SEQ ID NO: 3984758 - RNA, 16 nt, Human herpesvirus 5
gcggcgugcgcacgcc

SEQ ID NO: 3984759 - RNA, 16 nt, Human herpesvirus 5
gcggcguggacuggga

SEQ ID NO: 3984760 - RNA, 23 nt, Human herpesvirus 5
gcggcuuauguuucugggguggg

SEQ ID NO: 3984761 - RNA, 16 nt, Human herpesvirus 5
gcgggagacuaggucg

SEQ ID NO: 3984762 - RNA, 17 nt, Human herpesvirus 5
gcgguacccgacgcggc

SEQ ID NO: 3984763 - RNA, 16 nt, Human herpesvirus 5
gcgguacugaagccgc

SEQ ID NO: 3984764 - RNA, 19 nt, Human herpesvirus 5
gcgguaugggucacggcgg

SEQ ID NO: 3984765 - RNA, 17 nt, Human herpesvirus 5
gcgguggucgaugcuga

SEQ ID NO: 3984766 - RNA, 19 nt, Human herpesvirus 5
gcgguguuuccgauggugg

SEQ ID NO: 3984767 - RNA, 19 nt, Human herpesvirus 5
gcgguuucguguugaaacc

SEQ ID NO: 3984768 - RNA, 20 nt, Human herpesvirus 5
gcguagucuggcagcguuau

SEQ ID NO: 3984769 - RNA, 18 nt, Human herpesvirus 5
gcgucccuggggcugcug

SEQ ID NO: 3984770 - RNA, 16 nt, Human herpesvirus 5
gcguccgggcuuuccu

SEQ ID NO: 3984771 - RNA, 21 nt, Human herpesvirus 5
ugaggcgguggcugcgccucc

SEQ ID NO: 3984772 - RNA, 16 nt, Human herpesvirus 5
ugauauuuuacaggua

SEQ ID NO: 3984773 - RNA, 16 nt, Human herpesvirus 5
ugaucgugggccagga

SEQ ID NO: 3984774 - RNA, 12 nt, Human herpesvirus 5
ugaucugucauc

SEQ ID NO: 3984775 - RNA, 15 nt, Human herpesvirus 5
ugauguaguugcaga

SEQ ID NO: 3984776 - RNA, 17 nt, Human herpesvirus 5
ugcacagcgucuggcca

SEQ ID NO: 3984777 - RNA, 21 nt, Human herpesvirus 5
ugcacaucaauaaacuuuuuu

SEQ ID NO: 3984778 - RNA, 16 nt, Human herpesvirus 5
ugcacgagugggccag

SEQ ID NO: 3984779 - RNA, 20 nt, Human herpesvirus 5
ugcagaccgaggcgcuggac

SEQ ID NO: 3984780 - RNA, 12 nt, Human herpesvirus 5
ugcagcccaccg

SEQ ID NO: 3984781 - RNA, 22 nt, Human herpesvirus 5
ugcagcgaauugagcaacaaac

SEQ ID NO: 3984782 - RNA, 13 nt, Human herpesvirus 5
ugcagcugcacca

SEQ ID NO: 3984783 - RNA, 17 nt, Human herpesvirus 5
ugcagcugcaccacggc

SEQ ID NO: 3984784 - RNA, 15 nt, Human herpesvirus 5
ugcaguccgcuccgg

SEQ ID NO: 3984785 - RNA, 20 nt, Human herpesvirus 5
ugcaugucgcccagaaagaa

SEQ ID NO: 3984786 - RNA, 14 nt, Human herpesvirus 5
ugccacguucuugc

SEQ ID NO: 3984787 - RNA, 19 nt, Human herpesvirus 5
ugccagcccuauccuccau

SEQ ID NO: 3984788 - RNA, 20 nt, Human herpesvirus 5
ugccccccgggauccaagag

SEQ ID NO: 3984789 - RNA, 14 nt, Human herpesvirus 5
ugcccgcgauuucu

SEQ ID NO: 3984790 - RNA, 14 nt, Human herpesvirus 5
ugccgaaacaccgu

SEQ ID NO: 3984791 - RNA, 13 nt, Human herpesvirus 5
ugccgcagcugcu

SEQ ID NO: 3984792 - RNA, 22 nt, Human herpesvirus 5
ugccgccgcuguggcugccgcu

SEQ ID NO: 3984793 - RNA, 19 nt, Human herpesvirus 5
ugccggcauguccggccgu

SEQ ID NO: 3984794 - RNA, 24 nt, Human herpesvirus 5
ugccggucuacagacugggcgacg

SEQ ID NO: 3984795 - RNA, 12 nt, Human herpesvirus 5
ugccuguuccug

SEQ ID NO: 3984796 - RNA, 16 nt, Human herpesvirus 5
ugcgacugcggcgacu

SEQ ID NO: 3984797 - RNA, 18 nt, Human herpesvirus 5
ugcgcaucuacauccuua

SEQ ID NO: 3984798 - RNA, 23 nt, Human herpesvirus 5
ugcgccgagcggccguugcccgg

SEQ ID NO: 3984799 - RNA, 18 nt, Human herpesvirus 5
ugcgcgaauggcuggugu

SEQ ID NO: 3984800 - RNA, 11 nt, Human herpesvirus 5
ugcgcgccgcc

SEQ ID NO: 3984801 - RNA, 15 nt, Human herpesvirus 5
ugcgcggcgacgagg

SEQ ID NO: 3984802 - RNA, 17 nt, Human herpesvirus 5
ugcgcucuugggcgaca

SEQ ID NO: 3984803 - RNA, 21 nt, Human herpesvirus 5
ugcggauacgccgccgggcgc

SEQ ID NO: 3984804 - RNA, 20 nt, Human herpesvirus 5
ugcggcccccagaggcccgc

SEQ ID NO: 3984805 - RNA, 14 nt, Human herpesvirus 5
ugcggcgcagacgu

SEQ ID NO: 3984806 - RNA, 21 nt, Human herpesvirus 5
ugcggcgcagacgucggcggu

SEQ ID NO: 3984807 - RNA, 23 nt, Human herpesvirus 5
ccugugugaucugggcagcggcu

SEQ ID NO: 3984808 - RNA, 19 nt, Human herpesvirus 5
ccuguuggcuuacugccug

SEQ ID NO: 3984809 - RNA, 21 nt, Human herpesvirus 5
ccuguuggcuuacugccugcc

SEQ ID NO: 3984810 - RNA, 15 nt, Human herpesvirus 5
ccuguuucggauguu

SEQ ID NO: 3984811 - RNA, 18 nt, Human herpesvirus 5
ccuuaucugggugcaaug

SEQ ID NO: 3984812 - RNA, 23 nt, Human herpesvirus 5
ccuuccagcuuaccgccaccguc

SEQ ID NO: 3984813 - RNA, 12 nt, Human herpesvirus 5
ccuucucccccu

SEQ ID NO: 3984814 - RNA, 12 nt, Human herpesvirus 5
ccuucuugccca

SEQ ID NO: 3984815 - RNA, 17 nt, Human herpesvirus 5
ccuugagcgacagcagc

SEQ ID NO: 3984816 - RNA, 20 nt, Human herpesvirus 5
ccuugcgcucccugcuccgc

SEQ ID NO: 3984817 - RNA, 22 nt, Human herpesvirus 5
ccuugcgcucccugcuccgcaa

SEQ ID NO: 3984818 - RNA, 13 nt, Human herpesvirus 5
ccuuuugcuggcu

SEQ ID NO: 3984819 - RNA, 15 nt, Human herpesvirus 5
cgaacggcgacggca

SEQ ID NO: 3984820 - RNA, 18 nt, Human herpesvirus 5
cgaagcugcgcaggccgc

SEQ ID NO: 3984821 - RNA, 15 nt, Human herpesvirus 5
cgaaggcuacucuau

SEQ ID NO: 3984822 - RNA, 23 nt, Human herpesvirus 5
cgaaucgccggcuugcuccucuu

SEQ ID NO: 3984823 - RNA, 15 nt, Human herpesvirus 5
cgacaaccugcugca

SEQ ID NO: 3984824 - RNA, 14 nt, Human herpesvirus 5
cgacacagcagcac

SEQ ID NO: 3984825 - RNA, 21 nt, Human herpesvirus 5
cgacagaugcggcgguuacac

SEQ ID NO: 3984826 - RNA, 17 nt, Human herpesvirus 5
cgacagucuccuccuga

SEQ ID NO: 3984827 - RNA, 15 nt, Human herpesvirus 5
cgaccagcugcugga

SEQ ID NO: 3984828 - RNA, 20 nt, Human herpesvirus 5
cgaccuugagcgacagcagc

SEQ ID NO: 3984829 - RNA, 17 nt, Human herpesvirus 5
cgacgacuaugaugaag

SEQ ID NO: 3984830 - RNA, 13 nt, Human herpesvirus 5
cgacgacucaggg

SEQ ID NO: 3984831 - RNA, 16 nt, Human herpesvirus 5
cgacgcagugcguggc

SEQ ID NO: 3984832 - RNA, 13 nt, Human herpesvirus 5
cgacgccgucgcu

SEQ ID NO: 3984833 - RNA, 22 nt, Human herpesvirus 5
cgacggcagcuaucgugacugg

SEQ ID NO: 3984834 - RNA, 22 nt, Human herpesvirus 5
cgacgugauuuacgaggucugc

SEQ ID NO: 3984835 - RNA, 17 nt, Human herpesvirus 5
cgacguucuccaaggga

SEQ ID NO: 3984836 - RNA, 20 nt, Human herpesvirus 5
cgacguuucgcgaggacaag

SEQ ID NO: 3984837 - RNA, 21 nt, Human herpesvirus 5
cgacuacgguuacuccacaac

SEQ ID NO: 3984838 - RNA, 18 nt, Human herpesvirus 5
cgacuggggucaaaagcc

SEQ ID NO: 3984839 - RNA, 14 nt, Human herpesvirus 5
cgagaaaacuaaaa

SEQ ID NO: 3984840 - RNA, 22 nt, Human herpesvirus 5
cgagacggcgugacacagcacg

SEQ ID NO: 3984841 - RNA, 16 nt, Human herpesvirus 5
cgagacuaucuacaac

SEQ ID NO: 3984842 - RNA, 20 nt, Human herpesvirus 5
cgagagguagccaacagcag

SEQ ID NO: 3984843 - RNA, 19 nt, Human herpesvirus 5
cgagcaccggcgccugcug

SEQ ID NO: 3984844 - RNA, 14 nt, Human herpesvirus 5
cgagcaggccaugg

SEQ ID NO: 3984845 - RNA, 23 nt, Human herpesvirus 5
cgagcaucgcaacaacagcaaca

SEQ ID NO: 3984846 - RNA, 13 nt, Human herpesvirus 5
cgagcgcucggcg

SEQ ID NO: 3984847 - RNA, 16 nt, Human herpesvirus 5
cgagcggcggacuugg

SEQ ID NO: 3984848 - RNA, 14 nt, Human herpesvirus 5
cgaggaacgagggc

SEQ ID NO: 3984849 - RNA, 19 nt, Human herpesvirus 5
cgaggacaaccgcauccug

SEQ ID NO: 3984850 - RNA, 16 nt, Human herpesvirus 5
cgaggacaaggcuccg

SEQ ID NO: 3984851 - RNA, 14 nt, Human herpesvirus 5
cgaggacgcgcuuc

SEQ ID NO: 3984852 - RNA, 15 nt, Human herpesvirus 5
cgaggccggcggcgg

SEQ ID NO: 3984853 - RNA, 20 nt, Human herpesvirus 5
cgagggcccucgccggcggc

SEQ ID NO: 3984854 - RNA, 12 nt, Human herpesvirus 5
cgagguggucaa

SEQ ID NO: 3984855 - RNA, 16 nt, Human herpesvirus 5
cgagucggauggcuuu

SEQ ID NO: 3984856 - RNA, 22 nt, Human herpesvirus 5
cgaguggugaggagcgccgggg

SEQ ID NO: 3984857 - RNA, 23 nt, Human herpesvirus 5
cgauagagauggcgauauuggaa

SEQ ID NO: 3984858 - RNA, 12 nt, Human herpesvirus 5
cgauccuuggaa

SEQ ID NO: 3984859 - RNA, 16 nt, Human herpesvirus 5
cgaugcugcaaggccu

SEQ ID NO: 3984860 - RNA, 17 nt, Human herpesvirus 5
cgaugugagagccaccu

SEQ ID NO: 3984861 - RNA, 17 nt, Human herpesvirus 5
cgaugugaguuucugug

SEQ ID NO: 3984862 - RNA, 22 nt, Human herpesvirus 5
cgauguuucggaguaccgagua

SEQ ID NO: 3984863 - RNA, 16 nt, Human herpesvirus 5
cgcaaacucccacucc

SEQ ID NO: 3984864 - RNA, 14 nt, Human herpesvirus 5
cgcaaaucuacaac

SEQ ID NO: 3984865 - RNA, 18 nt, Human herpesvirus 5
cgcaacaacagcagcaac

SEQ ID NO: 3984866 - RNA, 21 nt, Human herpesvirus 5
cgcaacaacagcagcaacagc

SEQ ID NO: 3984867 - RNA, 20 nt, Human herpesvirus 5
cgcaacuucugucucggcac

SEQ ID NO: 3984868 - RNA, 21 nt, Human herpesvirus 5
cgcaacuuuuggccgccacac

SEQ ID NO: 3984869 - RNA, 15 nt, Human herpesvirus 5
cgcacacuggcugga

SEQ ID NO: 3984870 - RNA, 13 nt, Human herpesvirus 5
cgcacgaccgcga

SEQ ID NO: 3984871 - RNA, 14 nt, Human herpesvirus 5
cgcacgcuggagga

SEQ ID NO: 3984872 - RNA, 21 nt, Human herpesvirus 5
cgcacggaaaagcaguggcag

SEQ ID NO: 3984873 - RNA, 18 nt, Human herpesvirus 5
cgcacuggacgacgucaa

SEQ ID NO: 3984874 - RNA, 13 nt, Human herpesvirus 5
cgcagccaccggc

SEQ ID NO: 3984875 - RNA, 14 nt, Human herpesvirus 5
cgcagccuccucgc

SEQ ID NO: 3984876 - RNA, 12 nt, Human herpesvirus 5
cgcagcgcacca

SEQ ID NO: 3984877 - RNA, 14 nt, Human herpesvirus 5
cgcagcgccagccu

SEQ ID NO: 3984878 - RNA, 14 nt, Human herpesvirus 5
cgcagucgcucauc

SEQ ID NO: 3984879 - RNA, 20 nt, Human herpesvirus 5
cgcagugcgccgagcggccg

SEQ ID NO: 3984880 - RNA, 13 nt, Human herpesvirus 5
cgcagugggccca

SEQ ID NO: 3984881 - RNA, 14 nt, Human herpesvirus 5
cgcagugggcccac

SEQ ID NO: 3984882 - RNA, 14 nt, Human herpesvirus 5
cgcaguugcugccu

SEQ ID NO: 3984883 - RNA, 14 nt, Human herpesvirus 5
cgcauaaagggugg

SEQ ID NO: 3984884 - RNA, 17 nt, Human herpesvirus 5
cgcauagccucuacaaa

SEQ ID NO: 3984885 - RNA, 19 nt, Human herpesvirus 5
cgcaucacccgccucaugg

SEQ ID NO: 3984886 - RNA, 17 nt, Human herpesvirus 5
cgccaacgcgagcuggc

SEQ ID NO: 3984887 - RNA, 12 nt, Human herpesvirus 5
cgccacacgugu

SEQ ID NO: 3984888 - RNA, 21 nt, Human herpesvirus 5
cgccacauuggugaaggccgu

SEQ ID NO: 3984889 - RNA, 13 nt, Human herpesvirus 5
cgccaccgguggc

SEQ ID NO: 3984890 - RNA, 21 nt, Human herpesvirus 5
cgccagcguccgcgccugcac

SEQ ID NO: 3984891 - RNA, 15 nt, Human herpesvirus 5
cgcccgagacggcgg

SEQ ID NO: 3984892 - RNA, 14 nt, Human herpesvirus 5
cgcccgcgccucac

SEQ ID NO: 3984893 - RNA, 18 nt, Human herpesvirus 5
cgcccgggccgccugagg

SEQ ID NO: 3984894 - RNA, 15 nt, Human herpesvirus 5
cgcccucgacggcgg

SEQ ID NO: 3984895 - RNA, 17 nt, Human herpesvirus 5
cgccgacgugcuucgcg

SEQ ID NO: 3984896 - RNA, 16 nt, Human herpesvirus 5
cgccgaggcuacugcu

SEQ ID NO: 3984897 - RNA, 18 nt, Human herpesvirus 5
cgccgauagagauggcga

SEQ ID NO: 3984898 - RNA, 15 nt, Human herpesvirus 5
cgccgauagaggcga

SEQ ID NO: 3984899 - RNA, 17 nt, Human herpesvirus 5
cgccgaucauguccgag

SEQ ID NO: 3984900 - RNA, 11 nt, Human herpesvirus 5
cgccgcagacc

SEQ ID NO: 3984901 - RNA, 19 nt, Human herpesvirus 5
cgccgccaacgcgagcugg

SEQ ID NO: 3984902 - RNA, 15 nt, Human herpesvirus 5
cgccgcgacaacggc

SEQ ID NO: 3984903 - RNA, 16 nt, Human herpesvirus 5
cgccgcggcagcacca

SEQ ID NO: 3984904 - RNA, 16 nt, Human herpesvirus 5
cgccggcguugccgcc

SEQ ID NO: 3984905 - RNA, 17 nt, Human herpesvirus 5
cgccggggagacgacga

SEQ ID NO: 3984906 - RNA, 15 nt, Human herpesvirus 5
cgccgucaaggccgc

SEQ ID NO: 3984907 - RNA, 22 nt, Human herpesvirus 5
cgccgucgcgccuuccuccucu

SEQ ID NO: 3984908 - RNA, 22 nt, Human herpesvirus 5
cgccgucggugcgcccaucugc

SEQ ID NO: 3984909 - RNA, 16 nt, Human herpesvirus 5
cgccgucucccucugc

SEQ ID NO: 3984910 - RNA, 16 nt, Human herpesvirus 5
cgccgugacguccgcu

SEQ ID NO: 3984911 - RNA, 20 nt, Human herpesvirus 5
cgccguggguuggcagcugg

SEQ ID NO: 3984912 - RNA, 17 nt, Human herpesvirus 5
cgccucuucuggcccuc

SEQ ID NO: 3984913 - RNA, 20 nt, Human herpesvirus 5
cgccuuuugaucgccaccgc

SEQ ID NO: 3984914 - RNA, 16 nt, Human herpesvirus 5
cgccuuuugcuggcug

SEQ ID NO: 3984915 - RNA, 13 nt, Human herpesvirus 5
cgcgaacgccgcg

SEQ ID NO: 3984916 - RNA, 13 nt, Human herpesvirus 5
cgcgacacccggg

SEQ ID NO: 3984917 - RNA, 11 nt, Human herpesvirus 5
cgcgacacggu

SEQ ID NO: 3984918 - RNA, 23 nt, Human herpesvirus 5
cgcgaccagcugcuggacgacgu

SEQ ID NO: 3984919 - RNA, 14 nt, Human herpesvirus 5
cgcgaccgccucaa

SEQ ID NO: 3984920 - RNA, 20 nt, Human herpesvirus 5
cgcgacguguugcgggaccu

SEQ ID NO: 3984921 - RNA, 18 nt, Human herpesvirus 5
cgcgagcggaacccgggc

SEQ ID NO: 3984922 - RNA, 17 nt, Human herpesvirus 5
cgcgaggugucauguuc

SEQ ID NO: 3984923 - RNA, 14 nt, Human herpesvirus 5
cgcgcccacuggag

SEQ ID NO: 3984924 - RNA, 13 nt, Human herpesvirus 5
cgcgcccgucgcg

SEQ ID NO: 3984925 - RNA, 15 nt, Human herpesvirus 5
cgcgccgggcggcuu

SEQ ID NO: 3984926 - RNA, 14 nt, Human herpesvirus 5
cgcgcgagcgugcg

SEQ ID NO: 3984927 - RNA, 23 nt, Human herpesvirus 5
cgcgcggucauauagccuccggc

SEQ ID NO: 3984928 - RNA, 14 nt, Human herpesvirus 5
cgcgcuggcucgcg

SEQ ID NO: 3984929 - RNA, 19 nt, Human herpesvirus 5
cgcgcuggcuuuccucggg

SEQ ID NO: 3984930 - RNA, 17 nt, Human herpesvirus 5
cgcggacgccugcgacg

SEQ ID NO: 3984931 - RNA, 21 nt, Human herpesvirus 5
cgcggagguuugucuggcggc

SEQ ID NO: 3984932 - RNA, 23 nt, Human herpesvirus 5
cgcggagguuugucuggcggcuu

SEQ ID NO: 3984933 - RNA, 22 nt, Human herpesvirus 5
cgcggaugagcgugcugcucug

SEQ ID NO: 3984934 - RNA, 19 nt, Human herpesvirus 5
cgcggcaacucgagauggu

SEQ ID NO: 3984935 - RNA, 14 nt, Human herpesvirus 5
cgcggcagcggcgc

SEQ ID NO: 3984936 - RNA, 18 nt, Human herpesvirus 5
cgcggcccccacggcggc

SEQ ID NO: 3984937 - RNA, 17 nt, Human herpesvirus 5
cgcggcgacaagcugug

SEQ ID NO: 3984938 - RNA, 16 nt, Human herpesvirus 5
cgcggggacgcgugac

SEQ ID NO: 3984939 - RNA, 13 nt, Human herpesvirus 5
cgcgguagagcuc

SEQ ID NO: 3984940 - RNA, 15 nt, Human herpesvirus 5
cgcggugcaggccgc

SEQ ID NO: 3984941 - RNA, 16 nt, Human herpesvirus 5
cgcguaagaaaccgcg

SEQ ID NO: 3984942 - RNA, 12 nt, Human herpesvirus 5
cgcguacggugg

SEQ ID NO: 3984943 - RNA, 15 nt, Human herpesvirus 5
cgcguagccuccucc

SEQ ID NO: 3984944 - RNA, 20 nt, Human herpesvirus 5
cgcguagccuccuccaccac

SEQ ID NO: 3984945 - RNA, 20 nt, Human herpesvirus 5
cgcgucggcgcccgggccgc

SEQ ID NO: 3984946 - RNA, 22 nt, Human herpesvirus 5
cgcgucggucgccgccuccgcg

SEQ ID NO: 3984947 - RNA, 15 nt, Human herpesvirus 5
cgcgucuuagacgcg

SEQ ID NO: 3984948 - RNA, 16 nt, Human herpesvirus 5
cgcgucuucgcgaggu

SEQ ID NO: 3984949 - RNA, 18 nt, Human herpesvirus 5
cgcguuuaccgaggagau

SEQ ID NO: 3984950 - RNA, 19 nt, Human herpesvirus 5
cgcguuuguugcgcggcga

SEQ ID NO: 3984951 - RNA, 17 nt, Human herpesvirus 5
cgcuaaaggugcaugac

SEQ ID NO: 3984952 - RNA, 22 nt, Human herpesvirus 5
cgcuacaacgcgcgccugaccc

SEQ ID NO: 3984953 - RNA, 13 nt, Human herpesvirus 5
cgcuauggcggcc

SEQ ID NO: 3984954 - RNA, 14 nt, Human herpesvirus 5
cgcuccaucgcagc

SEQ ID NO: 3984955 - RNA, 16 nt, Human herpesvirus 5
cgcucccugcuccgca

SEQ ID NO: 3984956 - RNA, 19 nt, Human herpesvirus 5
cgcucgcuuuggagcgcga

SEQ ID NO: 3984957 - RNA, 19 nt, Human herpesvirus 5
cgcucgucuccacgcucga

SEQ ID NO: 3984958 - RNA, 13 nt, Human herpesvirus 5
cgcugaagcggau

SEQ ID NO: 3984959 - RNA, 19 nt, Human herpesvirus 5
cgcugacagcauacgggga

SEQ ID NO: 3984960 - RNA, 23 nt, Human herpesvirus 5
cgcugauacuaucgggggagaug

SEQ ID NO: 3984961 - RNA, 20 nt, Human herpesvirus 5
cgcugcggucccgacaugga

SEQ ID NO: 3984962 - RNA, 22 nt, Human herpesvirus 5
cgcuggccgauccacgggccgc

SEQ ID NO: 3984963 - RNA, 14 nt, Human herpesvirus 5
cgcuuagccaccac

SEQ ID NO: 3984964 - RNA, 13 nt, Human herpesvirus 5
cgcuuuccgccgc

SEQ ID NO: 3984965 - RNA, 14 nt, Human herpesvirus 5
cggaaaaaccgcgc

SEQ ID NO: 3984966 - RNA, 22 nt, Human herpesvirus 5
cggaagcuuuggucgccugcac

SEQ ID NO: 3984967 - RNA, 13 nt, Human herpesvirus 5
cggaccgcagcac

SEQ ID NO: 3984968 - RNA, 13 nt, Human herpesvirus 5
cggagcagagggu

SEQ ID NO: 3984969 - RNA, 23 nt, Human herpesvirus 5
cggagcccggucugagcuccgac

SEQ ID NO: 3984970 - RNA, 18 nt, Human herpesvirus 5
cggaggacgcagaauaaa

SEQ ID NO: 3984971 - RNA, 12 nt, Human herpesvirus 5
cggaggagcguc

SEQ ID NO: 3984972 - RNA, 20 nt, Human herpesvirus 5
cggauaagcgcuuucugaau

SEQ ID NO: 3984973 - RNA, 17 nt, Human herpesvirus 5
cggaucggacaucauac

SEQ ID NO: 3984974 - RNA, 15 nt, Human herpesvirus 5
cggaugaccuggccg

SEQ ID NO: 3984975 - RNA, 14 nt, Human herpesvirus 5
cggcaaucggugcg

SEQ ID NO: 3984976 - RNA, 20 nt, Human herpesvirus 5
cggcaccaucggacucgcca

SEQ ID NO: 3984977 - RNA, 19 nt, Human herpesvirus 5
cggcacgccgccgaagcuu

SEQ ID NO: 3984978 - RNA, 19 nt, Human herpesvirus 5
cggcacgccguugccacga

SEQ ID NO: 3984979 - RNA, 21 nt, Human herpesvirus 5
cggcacuuuacauaaaaccac

SEQ ID NO: 3984980 - RNA, 17 nt, Human herpesvirus 5
cggcagcaugggcgaca

SEQ ID NO: 3984981 - RNA, 15 nt, Human herpesvirus 5
cggcagcgccagcgg

SEQ ID NO: 3984982 - RNA, 17 nt, Human herpesvirus 5
cggcaggaaggccucgu

SEQ ID NO: 3984983 - RNA, 13 nt, Human herpesvirus 5
cggcauccucggg

SEQ ID NO: 3984984 - RNA, 20 nt, Human herpesvirus 5
cggccagcgugacgcggugc

SEQ ID NO: 3984985 - RNA, 15 nt, Human herpesvirus 5
cggcccccuaccugc

SEQ ID NO: 3984986 - RNA, 19 nt, Human herpesvirus 5
cggccgaccccgucacugu

SEQ ID NO: 3984987 - RNA, 13 nt, Human herpesvirus 5
cggccgccggcgg

SEQ ID NO: 3984988 - RNA, 16 nt, Human herpesvirus 5
cggccgugcagcaaga

SEQ ID NO: 3984989 - RNA, 18 nt, Human herpesvirus 5
cggccguuaucaaggcca

SEQ ID NO: 3984990 - RNA, 19 nt, Human herpesvirus 5
cggccuuauguggcugcgc

SEQ ID NO: 3984991 - RNA, 22 nt, Human herpesvirus 5
cggcgagcgaagguagaggagu

SEQ ID NO: 3984992 - RNA, 15 nt, Human herpesvirus 5
cggcgaucgcgcuuu

SEQ ID NO: 3984993 - RNA, 17 nt, Human herpesvirus 5
cggcgauggucauguuc

SEQ ID NO: 3984994 - RNA, 21 nt, Human herpesvirus 5
cggcgcaacuucugucucggc

SEQ ID NO: 3984995 - RNA, 13 nt, Human herpesvirus 5
cggcgcagcacca

SEQ ID NO: 3984996 - RNA, 13 nt, Human herpesvirus 5
cggcgccugguug

SEQ ID NO: 3984997 - RNA, 14 nt, Human herpesvirus 5
cggcggcagcuugg

SEQ ID NO: 3984998 - RNA, 20 nt, Human herpesvirus 5
cggcggcuguucgacagcgg

SEQ ID NO: 3984999 - RNA, 21 nt, Human herpesvirus 5
cggcggcuugggcagcagcgg

SEQ ID NO: 3985000 - RNA, 14 nt, Human herpesvirus 5
cggcgguccuccag

SEQ ID NO: 3985001 - RNA, 20 nt, Human herpesvirus 5
cggcgucuuccuccucgucg

SEQ ID NO: 3985002 - RNA, 13 nt, Human herpesvirus 5
cggcgugcugcac

SEQ ID NO: 3985003 - RNA, 17 nt, Human herpesvirus 5
cggcguucgcgugcacg

SEQ ID NO: 3985004 - RNA, 19 nt, Human herpesvirus 5
cggcuaacaaagcccgggc

SEQ ID NO: 3985005 - RNA, 17 nt, Human herpesvirus 5
cggcucgccgccgcgcc

SEQ ID NO: 3985006 - RNA, 19 nt, Human herpesvirus 5
cggcugccggucuacagac

SEQ ID NO: 3985007 - RNA, 11 nt, Human herpesvirus 5
cggcugcugca

SEQ ID NO: 3985008 - RNA, 12 nt, Human herpesvirus 5
cggcugcugcac

SEQ ID NO: 3985009 - RNA, 19 nt, Human herpesvirus 5
cgggaaacauguccccauc

SEQ ID NO: 3985010 - RNA, 20 nt, Human herpesvirus 5
cgggcaaagaguccaucugc

SEQ ID NO: 3985011 - RNA, 15 nt, Human herpesvirus 5
cgggcacggaccgca

SEQ ID NO: 3985012 - RNA, 15 nt, Human herpesvirus 5
cgggcgacagcacgu

SEQ ID NO: 3985013 - RNA, 17 nt, Human herpesvirus 5
cgggcgcgcaucgccgu

SEQ ID NO: 3985014 - RNA, 17 nt, Human herpesvirus 5
cgggcucguguggcagc

SEQ ID NO: 3985015 - RNA, 15 nt, Human herpesvirus 5
cggggugccgccgcu

SEQ ID NO: 3985016 - RNA, 21 nt, Human herpesvirus 5
cggggugguggugcugcugcu

SEQ ID NO: 3985017 - RNA, 13 nt, Human herpesvirus 5
cgggugacggcga

SEQ ID NO: 3985018 - RNA, 16 nt, Human herpesvirus 5
cgguccaguggcaggc

SEQ ID NO: 3985019 - RNA, 17 nt, Human herpesvirus 5
cgguccuccagcagcag

SEQ ID NO: 3985020 - RNA, 21 nt, Human herpesvirus 5
cggucugagcuccgacgcagg

SEQ ID NO: 3985021 - RNA, 23 nt, Human herpesvirus 5
cggucugcuugcuggcuuggcuc

SEQ ID NO: 3985022 - RNA, 19 nt, Human herpesvirus 5
cggugacgucggugguggc

SEQ ID NO: 3985023 - RNA, 12 nt, Human herpesvirus 5
cggugagacccg

SEQ ID NO: 3985024 - RNA, 13 nt, Human herpesvirus 5
cggugcaggccgc

SEQ ID NO: 3985025 - RNA, 15 nt, Human herpesvirus 5
cggugcaggccgcgc

SEQ ID NO: 3985026 - RNA, 19 nt, Human herpesvirus 5
cggugcgcugcagccggag

SEQ ID NO: 3985027 - RNA, 18 nt, Human herpesvirus 5
cggugcugcugcgcgaca

SEQ ID NO: 3985028 - RNA, 13 nt, Human herpesvirus 5
cgguggcggccgc

SEQ ID NO: 3985029 - RNA, 21 nt, Human herpesvirus 5
cgguggucggcugccgccgcu

SEQ ID NO: 3985030 - RNA, 15 nt, Human herpesvirus 5
cgguugcggcuuggu

SEQ ID NO: 3985031 - RNA, 20 nt, Human herpesvirus 5
cgguuuaccacaggcgccgc

SEQ ID NO: 3985032 - RNA, 14 nt, Human herpesvirus 5
cgguuuccacgcca

SEQ ID NO: 3985033 - RNA, 19 nt, Human herpesvirus 5
gguacuucaguaugaaagu

SEQ ID NO: 3985034 - RNA, 15 nt, Human herpesvirus 5
gguaggugcgccgca

SEQ ID NO: 3985035 - RNA, 22 nt, Human herpesvirus 5
ggucaacgcguccagcuucugg

SEQ ID NO: 3985036 - RNA, 21 nt, Human herpesvirus 5
ggucccggauaauuguccuuc

SEQ ID NO: 3985037 - RNA, 17 nt, Human herpesvirus 5
ggucggcaagagccgga

SEQ ID NO: 3985038 - RNA, 20 nt, Human herpesvirus 5
ggucgggcacucggcugugc

SEQ ID NO: 3985039 - RNA, 17 nt, Human herpesvirus 5
ggucguagugcggcgug

SEQ ID NO: 3985040 - RNA, 16 nt, Human herpesvirus 5
ggucugcgcuuuccca

SEQ ID NO: 3985041 - RNA, 18 nt, Human herpesvirus 5
ggugagggucguggcgcg

SEQ ID NO: 3985042 - RNA, 17 nt, Human herpesvirus 5
ggugcaucaucugguag

SEQ ID NO: 3985043 - RNA, 14 nt, Human herpesvirus 5
ggugcgcgcagaag

SEQ ID NO: 3985044 - RNA, 18 nt, Human herpesvirus 5
ggugcgggagacuagguc

SEQ ID NO: 3985045 - RNA, 17 nt, Human herpesvirus 5
ggugcgggugccgggac

SEQ ID NO: 3985046 - RNA, 18 nt, Human herpesvirus 5
ggugcucgaccaggaggu

SEQ ID NO: 3985047 - RNA, 18 nt, Human herpesvirus 5
gguggaaaucccucaccc

SEQ ID NO: 3985048 - RNA, 19 nt, Human herpesvirus 5
gguggaaccgugccguugc

SEQ ID NO: 3985049 - RNA, 20 nt, Human herpesvirus 5
gguggcucuugcgcuucugc

SEQ ID NO: 3985050 - RNA, 13 nt, Human herpesvirus 5
gguggcugggcuc

SEQ ID NO: 3985051 - RNA, 23 nt, Human herpesvirus 5
gguguacgugcgguaacuggcag

SEQ ID NO: 3985052 - RNA, 17 nt, Human herpesvirus 5
gguguuaaggauucuga

SEQ ID NO: 3985053 - RNA, 20 nt, Human herpesvirus 5
gguguugccuucugcugccc

SEQ ID NO: 3985054 - RNA, 13 nt, Human herpesvirus 5
gguucgcugacga

SEQ ID NO: 3985055 - RNA, 22 nt, Human herpesvirus 5
gguugaaacgcuuuaagcugcu

SEQ ID NO: 3985056 - RNA, 18 nt, Human herpesvirus 5
gguuguuccggcggcgug

SEQ ID NO: 3985057 - RNA, 13 nt, Human herpesvirus 5
gguuucagcuggc

SEQ ID NO: 3985058 - RNA, 14 nt, Human herpesvirus 5
gguuucggcgacgu

SEQ ID NO: 3985059 - RNA, 16 nt, Human herpesvirus 5
guaaagcccguggccc

SEQ ID NO: 3985060 - RNA, 18 nt, Human herpesvirus 5
guaacuggcagagccacg

SEQ ID NO: 3985061 - RNA, 23 nt, Human herpesvirus 5
guaagguuuugcucuaaaaacac

SEQ ID NO: 3985062 - RNA, 16 nt, Human herpesvirus 5
guaaucuuccauaaua

SEQ ID NO: 3985063 - RNA, 21 nt, Human herpesvirus 5
guaaucuuccauaauaaaagu

SEQ ID NO: 3985064 - RNA, 19 nt, Human herpesvirus 5
guaccaacauagaggugag

SEQ ID NO: 3985065 - RNA, 17 nt, Human herpesvirus 5
guaccuaaagcccccac

SEQ ID NO: 3985066 - RNA, 21 nt, Human herpesvirus 5
guaccugaaaccuaccugggc

SEQ ID NO: 3985067 - RNA, 23 nt, Human herpesvirus 5
guaccuuaacaugaugaagaugg

SEQ ID NO: 3985068 - RNA, 13 nt, Human herpesvirus 5
guacgcgcacgcc

SEQ ID NO: 3985069 - RNA, 21 nt, Human herpesvirus 5
guacgcgcuaaaggugcauga

SEQ ID NO: 3985070 - RNA, 18 nt, Human herpesvirus 5
guacggcagcggggagaa

SEQ ID NO: 3985071 - RNA, 14 nt, Human herpesvirus 5
guagcaacuggcaa

SEQ ID NO: 3985072 - RNA, 14 nt, Human herpesvirus 5
guagccgaugcuga

SEQ ID NO: 3985073 - RNA, 20 nt, Human herpesvirus 5
guagcgcuugcggcacagcg

SEQ ID NO: 3985074 - RNA, 15 nt, Human herpesvirus 5
guaggaucuucgucg

SEQ ID NO: 3985075 - RNA, 16 nt, Human herpesvirus 5
guagugagcuuugacg

SEQ ID NO: 3985076 - RNA, 15 nt, Human herpesvirus 5
guauaaagauucacu

SEQ ID NO: 3985077 - RNA, 13 nt, Human herpesvirus 5
guauaugauuuug

SEQ ID NO: 3985078 - RNA, 14 nt, Human herpesvirus 5
guauccacgucaca

SEQ ID NO: 3985079 - RNA, 14 nt, Human herpesvirus 5
guauccacgucacu

SEQ ID NO: 3985080 - RNA, 21 nt, Human herpesvirus 5
guaugcaugucgcgacagaga

SEQ ID NO: 3985081 - RNA, 21 nt, Human herpesvirus 5
guaugccgcgucugcuggaag

SEQ ID NO: 3985082 - RNA, 22 nt, Human herpesvirus 5
guaugggcgguggucggcugcc

SEQ ID NO: 3985083 - RNA, 20 nt, Human herpesvirus 5
gucaaccacccgccggaacg

SEQ ID NO: 3985084 - RNA, 23 nt, Human herpesvirus 5
gucaaggccgccucuucuggccc

SEQ ID NO: 3985085 - RNA, 20 nt, Human herpesvirus 5
gucaaggcucgcaaagacgu

SEQ ID NO: 3985086 - RNA, 19 nt, Human herpesvirus 5
gucaauaaagaaaaccaca

SEQ ID NO: 3985087 - RNA, 16 nt, Human herpesvirus 5
gucaccaucgugccgc

SEQ ID NO: 3985088 - RNA, 16 nt, Human herpesvirus 5
gucacuacucugggau

SEQ ID NO: 3985089 - RNA, 12 nt, Human herpesvirus 5
gucagacacagc

SEQ ID NO: 3985090 - RNA, 19 nt, Human herpesvirus 5
gucagacccacuaccugga

SEQ ID NO: 3985091 - RNA, 17 nt, Human herpesvirus 5
gucaggcgcugcucuca

SEQ ID NO: 3985092 - RNA, 21 nt, Human herpesvirus 5
gucaucggcacgugcucuuuu

SEQ ID NO: 3985093 - RNA, 21 nt, Human herpesvirus 5
guccagauagcccggucgguc

SEQ ID NO: 3985094 - RNA, 13 nt, Human herpesvirus 5
guccagucacauu

SEQ ID NO: 3985095 - RNA, 14 nt, Human herpesvirus 5
guccaucauguucg

SEQ ID NO: 3985096 - RNA, 17 nt, Human herpesvirus 5
gucccagccccagagcg

SEQ ID NO: 3985097 - RNA, 16 nt, Human herpesvirus 5
gucccgcgcggaucgg

SEQ ID NO: 3985098 - RNA, 16 nt, Human herpesvirus 5
gucccuacggaaccug

SEQ ID NO: 3985099 - RNA, 21 nt, Human herpesvirus 5
guccgcgccugcacgccgccg

SEQ ID NO: 3985100 - RNA, 12 nt, Human herpesvirus 5
guccgcggacac

SEQ ID NO: 3985101 - RNA, 21 nt, Human herpesvirus 5
guccgcggacacccgcggccg

SEQ ID NO: 3985102 - RNA, 18 nt, Human herpesvirus 5
guccgucgaucgaccguu

SEQ ID NO: 3985103 - RNA, 16 nt, Human herpesvirus 5
guccgugaucgccgcg

SEQ ID NO: 3985104 - RNA, 17 nt, Human herpesvirus 5
guccuagcacgucagug

SEQ ID NO: 3985105 - RNA, 17 nt, Human herpesvirus 5
guccucggugcccgcac

SEQ ID NO: 3985106 - RNA, 17 nt, Human herpesvirus 5
gucgagacuugcacgcu

SEQ ID NO: 3985107 - RNA, 15 nt, Human herpesvirus 5
gucgcacaaagaagu

SEQ ID NO: 3985108 - RNA, 12 nt, Human herpesvirus 5
gucgcagccccc

SEQ ID NO: 3985109 - RNA, 15 nt, Human herpesvirus 5
gucgcagucagaccc

SEQ ID NO: 3985110 - RNA, 17 nt, Human herpesvirus 5
gucgccgccgucaccac

SEQ ID NO: 3985111 - RNA, 21 nt, Human herpesvirus 5
gucgccgcgucagcggccgcc

SEQ ID NO: 3985112 - RNA, 16 nt, Human herpesvirus 5
gucgccgucacugcca

SEQ ID NO: 3985113 - RNA, 13 nt, Human herpesvirus 5
gucgccugcgacg

SEQ ID NO: 3985114 - RNA, 14 nt, Human herpesvirus 5
gucgccuuccagcu

SEQ ID NO: 3985115 - RNA, 22 nt, Human herpesvirus 5
gucgccuuccagcuuaccgcca

SEQ ID NO: 3985116 - RNA, 16 nt, Human herpesvirus 5
gucgcgauuugcuuga

SEQ ID NO: 3985117 - RNA, 15 nt, Human herpesvirus 5
gucgcuuagccacca

SEQ ID NO: 3985118 - RNA, 11 nt, Human herpesvirus 5
gucggaaacgg

SEQ ID NO: 3985119 - RNA, 15 nt, Human herpesvirus 5
gcgcgaacaggccgc

SEQ ID NO: 3985120 - RNA, 16 nt, Human herpesvirus 5
gcgcgcaucgccgucg

SEQ ID NO: 3985121 - RNA, 20 nt, Human herpesvirus 5
gcgcgccacaacgccguccg

SEQ ID NO: 3985122 - RNA, 15 nt, Human herpesvirus 5
gcgcggaguccuggg

SEQ ID NO: 3985123 - RNA, 18 nt, Human herpesvirus 5
gcgcggucgccaccugga

SEQ ID NO: 3985124 - RNA, 13 nt, Human herpesvirus 5
gcgcguacggugg

SEQ ID NO: 3985125 - RNA, 21 nt, Human herpesvirus 5
gcgcgucaaccgccagcgagc

SEQ ID NO: 3985126 - RNA, 14 nt, Human herpesvirus 5
gcgcguguacuugc

SEQ ID NO: 3985127 - RNA, 14 nt, Human herpesvirus 5
gcgcguuauaagca

SEQ ID NO: 3985128 - RNA, 12 nt, Human herpesvirus 5
gcgcuggacucu

SEQ ID NO: 3985129 - RNA, 13 nt, Human herpesvirus 5
gcgcuggcucgcg

SEQ ID NO: 3985130 - RNA, 23 nt, Human herpesvirus 5
gcgcugguggccgaacagcagcu

SEQ ID NO: 3985131 - RNA, 20 nt, Human herpesvirus 5
gcgcuguacggcagcgggga

SEQ ID NO: 3985132 - RNA, 13 nt, Human herpesvirus 5
gcgcuugucgcca

SEQ ID NO: 3985133 - RNA, 12 nt, Human herpesvirus 5
gcgcuuucugaa

SEQ ID NO: 3985134 - RNA, 21 nt, Human herpesvirus 5
gcggaccgaucaccagaaggc

SEQ ID NO: 3985135 - RNA, 22 nt, Human herpesvirus 5
gcggacgccgucgguaccgucu

SEQ ID NO: 3985136 - RNA, 21 nt, Human herpesvirus 5
gcggaugagcgugcugcucug

SEQ ID NO: 3985137 - RNA, 13 nt, Human herpesvirus 5
gcggcacccggcu

SEQ ID NO: 3985138 - RNA, 13 nt, Human herpesvirus 5
gcggcaggaaggc

SEQ ID NO: 3985139 - RNA, 23 nt, Human herpesvirus 5
gcggccacggccugcgggcaggc

SEQ ID NO: 3985140 - RNA, 23 nt, Human herpesvirus 5
gcggccccguaccgcucuucugg

SEQ ID NO: 3985141 - RNA, 18 nt, Human herpesvirus 5
gcggccgcagugggccca

SEQ ID NO: 3985142 - RNA, 13 nt, Human herpesvirus 5
gcggcgguggccg

SEQ ID NO: 3985143 - RNA, 20 nt, Human herpesvirus 5
gcggcguaccuacggaccgc

SEQ ID NO: 3985144 - RNA, 11 nt, Human herpesvirus 5
gcggcgugcau

SEQ ID NO: 3985145 - RNA, 17 nt, Human herpesvirus 5
gcggcucaaacaccgcu

SEQ ID NO: 3985146 - RNA, 20 nt, Human herpesvirus 5
gcggcuuauguuucuggggu

SEQ ID NO: 3985147 - RNA, 13 nt, Human herpesvirus 5
gcgggcccugcug

SEQ ID NO: 3985148 - RNA, 21 nt, Human herpesvirus 5
gcgggggaaaaacaaagaagu

SEQ ID NO: 3985149 - RNA, 13 nt, Human herpesvirus 5
gcgguagagcucg

SEQ ID NO: 3985150 - RNA, 18 nt, Human herpesvirus 5
gcgguauggcugcgcgcc

SEQ ID NO: 3985151 - RNA, 16 nt, Human herpesvirus 5
gcggucagaaaaagaa

SEQ ID NO: 3985152 - RNA, 23 nt, Human herpesvirus 5
gcggucaugaguuggugcagcug

SEQ ID NO: 3985153 - RNA, 18 nt, Human herpesvirus 5
gcggucgcggguggccgg

SEQ ID NO: 3985154 - RNA, 16 nt, Human herpesvirus 5
gcggugggugguaaaa

SEQ ID NO: 3985155 - RNA, 12 nt, Human herpesvirus 5
gcggugguaagu

SEQ ID NO: 3985156 - RNA, 12 nt, Human herpesvirus 5
gcggugucuccu

SEQ ID NO: 3985157 - RNA, 16 nt, Human herpesvirus 5
gcgguuauggcuccgc

SEQ ID NO: 3985158 - RNA, 19 nt, Human herpesvirus 5
gcgguucgcugacgaugag

SEQ ID NO: 3985159 - RNA, 13 nt, Human herpesvirus 5
gcguacgguggac

SEQ ID NO: 3985160 - RNA, 18 nt, Human herpesvirus 5
gcguagccaccuguugga

SEQ ID NO: 3985161 - RNA, 13 nt, Human herpesvirus 5
gcguccacgggcu

SEQ ID NO: 3985162 - RNA, 22 nt, Human herpesvirus 5
gcgucccaccccccgggccacc

SEQ ID NO: 3985163 - RNA, 14 nt, Human herpesvirus 5
gcgucccuggggcu

SEQ ID NO: 3985164 - RNA, 20 nt, Human herpesvirus 5
gcguccucguguggcaaguu

SEQ ID NO: 3985165 - RNA, 23 nt, Human herpesvirus 5
gcgucguguaauccacgacucgc

SEQ ID NO: 3985166 - RNA, 16 nt, Human herpesvirus 5
gcgugccgaauacaaa

SEQ ID NO: 3985167 - RNA, 16 nt, Human herpesvirus 5
gcgugcgggugcauga

SEQ ID NO: 3985168 - RNA, 12 nt, Human herpesvirus 5
gcgugcuccacc

SEQ ID NO: 3985169 - RNA, 17 nt, Human herpesvirus 5
gcguggcggccgacggc

SEQ ID NO: 3985170 - RNA, 17 nt, Human herpesvirus 5
gcguguuuuauaaaaga

SEQ ID NO: 3985171 - RNA, 16 nt, Human herpesvirus 5
gcguucgcccugucug

SEQ ID NO: 3985172 - RNA, 21 nt, Human herpesvirus 5
gcguucgugauucguaggcag

SEQ ID NO: 3985173 - RNA, 14 nt, Human herpesvirus 5
gcguuuggucgccu

SEQ ID NO: 3985174 - RNA, 16 nt, Human herpesvirus 5
gcuaagagcuuugacg

SEQ ID NO: 3985175 - RNA, 17 nt, Human herpesvirus 5
gcuaagaugaacgggug

SEQ ID NO: 3985176 - RNA, 13 nt, Human herpesvirus 5
gcuacaccugaga

SEQ ID NO: 3985177 - RNA, 23 nt, Human herpesvirus 5
gcuacagccacgaccaagugucu

SEQ ID NO: 3985178 - RNA, 16 nt, Human herpesvirus 5
gcuacgaaacuuuucu

SEQ ID NO: 3985179 - RNA, 20 nt, Human herpesvirus 5
gcuacgcgaccagcugcugg

SEQ ID NO: 3985180 - RNA, 16 nt, Human herpesvirus 5
gcuacugaucgccugg

SEQ ID NO: 3985181 - RNA, 23 nt, Human herpesvirus 5
gcuacuucccccuccccuucugu

SEQ ID NO: 3985182 - RNA, 15 nt, Human herpesvirus 5
gcuaggauaaucaua

SEQ ID NO: 3985183 - RNA, 17 nt, Human herpesvirus 5
gcuaugggaagaaaccg

SEQ ID NO: 3985184 - RNA, 23 nt, Human herpesvirus 5
gcucacguagcaggccgacucgc

SEQ ID NO: 3985185 - RNA, 23 nt, Human herpesvirus 5
gcucacgucacuacucugggaua

SEQ ID NO: 3985186 - RNA, 18 nt, Human herpesvirus 5
gcucaggucgcccaggcu

SEQ ID NO: 3985187 - RNA, 13 nt, Human herpesvirus 5
gcucaucgucacg

SEQ ID NO: 3985188 - RNA, 16 nt, Human herpesvirus 5
gcuccgcaagcgccgc

SEQ ID NO: 3985189 - RNA, 22 nt, Human herpesvirus 5
gcucgccuuccccgaugugcag

SEQ ID NO: 3985190 - RNA, 19 nt, Human herpesvirus 5
gcucgggucggcuggucgg

SEQ ID NO: 3985191 - RNA, 20 nt, Human herpesvirus 5
gcucguguggcagcuggcuu

SEQ ID NO: 3985192 - RNA, 21 nt, Human herpesvirus 5
gcucguguggcagcuggcuug

SEQ ID NO: 3985193 - RNA, 16 nt, Human herpesvirus 5
gcucucuauccggugg

SEQ ID NO: 3985194 - RNA, 18 nt, Human herpesvirus 5
gcugacgcggacgaggaa

SEQ ID NO: 3985195 - RNA, 19 nt, Human herpesvirus 5
gcugagacaggacgaggca

SEQ ID NO: 3985196 - RNA, 22 nt, Human herpesvirus 5
gcugagcuacgaugaccacgaa

SEQ ID NO: 3985197 - RNA, 23 nt, Human herpesvirus 5
gcugauacuaucgggggagauga

SEQ ID NO: 3985198 - RNA, 16 nt, Human herpesvirus 5
gcugaucgccgucacu

SEQ ID NO: 3985199 - RNA, 16 nt, Human herpesvirus 5
gcugauucgcgccgug

SEQ ID NO: 3985200 - RNA, 22 nt, Human herpesvirus 5
gcugcagccggaggaagcggcg

SEQ ID NO: 3985201 - RNA, 20 nt, Human herpesvirus 5
cuccgugcggcccccagagg

SEQ ID NO: 3985202 - RNA, 23 nt, Human herpesvirus 5
cuccgugcggcccccagaggccc

SEQ ID NO: 3985203 - RNA, 14 nt, Human herpesvirus 5
cuccucgucgucgc

SEQ ID NO: 3985204 - RNA, 19 nt, Human herpesvirus 5
cuccucuuccaaaucuccg

SEQ ID NO: 3985205 - RNA, 18 nt, Human herpesvirus 5
cuccuguguaugaggauc

SEQ ID NO: 3985206 - RNA, 16 nt, Human herpesvirus 5
cuccuguugcucuccu

SEQ ID NO: 3985207 - RNA, 16 nt, Human herpesvirus 5
cucgaccaggaggugu

SEQ ID NO: 3985208 - RNA, 19 nt, Human herpesvirus 5
cucgaccggcggcugcugu

SEQ ID NO: 3985209 - RNA, 22 nt, Human herpesvirus 5
cucgaccuccgacccgaagaau

SEQ ID NO: 3985210 - RNA, 19 nt, Human herpesvirus 5
cucgccgcagaccauccuc

SEQ ID NO: 3985211 - RNA, 13 nt, Human herpesvirus 5
cucgcucucgucg

SEQ ID NO: 3985212 - RNA, 22 nt, Human herpesvirus 5
cucgcugggcuacaagugcagc

SEQ ID NO: 3985213 - RNA, 19 nt, Human herpesvirus 5
cucggaacgacgacucagg

SEQ ID NO: 3985214 - RNA, 16 nt, Human herpesvirus 5
cucggacggacguaga

SEQ ID NO: 3985215 - RNA, 22 nt, Human herpesvirus 5
cucggccuuucuaggcuacucc

SEQ ID NO: 3985216 - RNA, 17 nt, Human herpesvirus 5
cucggcggccacggcgu

SEQ ID NO: 3985217 - RNA, 17 nt, Human herpesvirus 5
cucgggugcaccgcggc

SEQ ID NO: 3985218 - RNA, 21 nt, Human herpesvirus 5
cucgguaaugcguguccagau

SEQ ID NO: 3985219 - RNA, 17 nt, Human herpesvirus 5
cucgguaguggacaugg

SEQ ID NO: 3985220 - RNA, 19 nt, Human herpesvirus 5
cucgucggccugggcugcu

SEQ ID NO: 3985221 - RNA, 19 nt, Human herpesvirus 5
cucgugaaacagcagcucg

SEQ ID NO: 3985222 - RNA, 15 nt, Human herpesvirus 6
agguguuuccugccc

SEQ ID NO: 3985223 - RNA, 17 nt, Human herpesvirus 6
agguguuuccugcccag

SEQ ID NO: 3985224 - RNA, 15 nt, Human herpesvirus 6
agguguuugcagaug

SEQ ID NO: 3985225 - RNA, 13 nt, Human herpesvirus 6
agguuagugggga

SEQ ID NO: 3985226 - RNA, 13 nt, Human herpesvirus 6
agguugagaauga

SEQ ID NO: 3985227 - RNA, 22 nt, Human herpesvirus 6
agguuuuauucguucagaaugu

SEQ ID NO: 3985228 - RNA, 15 nt, Human herpesvirus 6
agguuuugucguuug

SEQ ID NO: 3985229 - RNA, 15 nt, Human herpesvirus 6
aguaaaacuauugac

SEQ ID NO: 3985230 - RNA, 23 nt, Human herpesvirus 6
aguaaaucucucgguagauugga

SEQ ID NO: 3985231 - RNA, 15 nt, Human herpesvirus 6
aguaaauuaaaguuu

SEQ ID NO: 3985232 - RNA, 16 nt, Human herpesvirus 6
aguaacggaaaaauuu

SEQ ID NO: 3985233 - RNA, 19 nt, Human herpesvirus 6
aguagaaacuauggggcug

SEQ ID NO: 3985234 - RNA, 12 nt, Human herpesvirus 6
aguauugaagaa

SEQ ID NO: 3985235 - RNA, 11 nt, Human herpesvirus 6
agucagugggu

SEQ ID NO: 3985236 - RNA, 17 nt, Human herpesvirus 6
agucaguuuaauaguuu

SEQ ID NO: 3985237 - RNA, 22 nt, Human herpesvirus 6
aguccauuucuaccgauaguuu

SEQ ID NO: 3985238 - RNA, 20 nt, Human herpesvirus 6
agucccaucuauacacccug

SEQ ID NO: 3985239 - RNA, 15 nt, Human herpesvirus 6
aguccugugcuccac

SEQ ID NO: 3985240 - RNA, 14 nt, Human herpesvirus 6
agucgcgaagugcu

SEQ ID NO: 3985241 - RNA, 15 nt, Human herpesvirus 6
agucugaaugcgagu

SEQ ID NO: 3985242 - RNA, 13 nt, Human herpesvirus 6
agucugcuauuuu

SEQ ID NO: 3985243 - RNA, 19 nt, Human herpesvirus 6
agucuuuccccagcacacc

SEQ ID NO: 3985244 - RNA, 19 nt, Human herpesvirus 6
agugaaaaagguggcauca

SEQ ID NO: 3985245 - RNA, 17 nt, Human herpesvirus 6
agugauuagaauguuug

SEQ ID NO: 3985246 - RNA, 14 nt, Human herpesvirus 6
agugcgcuggcuua

SEQ ID NO: 3985247 - RNA, 16 nt, Human herpesvirus 6
agugcugugcucuuua

SEQ ID NO: 3985248 - RNA, 13 nt, Human herpesvirus 6
agugcuuuaucua

SEQ ID NO: 3985249 - RNA, 18 nt, Human herpesvirus 6
agugguuuaauggaaacc

SEQ ID NO: 3985250 - RNA, 22 nt, Human herpesvirus 6
agugguuuuuuggauaagcaga

SEQ ID NO: 3985251 - RNA, 14 nt, Human herpesvirus 6
aguguaacgagaau

SEQ ID NO: 3985252 - RNA, 19 nt, Human herpesvirus 6
aguguucgcauuagaaaau

SEQ ID NO: 3985253 - RNA, 22 nt, Human herpesvirus 6
aguuaugcgucuguuuauugcc

SEQ ID NO: 3985254 - RNA, 18 nt, Human herpesvirus 6
aguugggacuuggaaacg

SEQ ID NO: 3985255 - RNA, 22 nt, Human herpesvirus 6
aguuguauuuaacuugauguau

SEQ ID NO: 3985256 - RNA, 19 nt, Human herpesvirus 6
aguuuuacaucaucgccuu

SEQ ID NO: 3985257 - RNA, 19 nt, Human herpesvirus 6
aguuuuuuuucuuuaccga

SEQ ID NO: 3985258 - RNA, 22 nt, Human herpesvirus 6
auaaaaaguuugugcgaauugu

SEQ ID NO: 3985259 - RNA, 16 nt, Human herpesvirus 6
auaaaggucagugggu

SEQ ID NO: 3985260 - RNA, 14 nt, Human herpesvirus 6
auaaaguuaaaggu

SEQ ID NO: 3985261 - RNA, 13 nt, Human herpesvirus 6
auaaaguuaauuc

SEQ ID NO: 3985262 - RNA, 15 nt, Human herpesvirus 6
auaaaguuuaaagau

SEQ ID NO: 3985263 - RNA, 22 nt, Human herpesvirus 6
auaaaugaauagauaauaauca

SEQ ID NO: 3985264 - RNA, 22 nt, Human herpesvirus 6
auaacccuucaccgucucugaa

SEQ ID NO: 3985265 - RNA, 17 nt, Human herpesvirus 6
auaaccucacuacugaa

SEQ ID NO: 3985266 - RNA, 21 nt, Human herpesvirus 6
auaacuuuacauuaaacacua

SEQ ID NO: 3985267 - RNA, 17 nt, Human herpesvirus 6
auaaguacauagaauuu

SEQ ID NO: 3985268 - RNA, 16 nt, Human herpesvirus 6
auaauggcaugcauua

SEQ ID NO: 3985269 - RNA, 17 nt, Human herpesvirus 6
auaauuccgacuguguu

SEQ ID NO: 3985270 - RNA, 18 nt, Human herpesvirus 6
auaauuuauggaaauucg

SEQ ID NO: 3985271 - RNA, 18 nt, Human herpesvirus 6
auacaauaguaacuucuc

SEQ ID NO: 3985272 - RNA, 22 nt, Human herpesvirus 6
auacgccuugggacauguauau

SEQ ID NO: 3985273 - RNA, 17 nt, Human herpesvirus 6
auacguuugccaaagcu

SEQ ID NO: 3985274 - RNA, 13 nt, Human herpesvirus 6
auagaccuugauc

SEQ ID NO: 3985275 - RNA, 12 nt, Human herpesvirus 6
auauaaauagug

SEQ ID NO: 3985276 - RNA, 15 nt, Human herpesvirus 6
auauaucaaagaugu

SEQ ID NO: 3985277 - RNA, 17 nt, Human herpesvirus 6
auaucuugaaaucuacu

SEQ ID NO: 3985278 - RNA, 13 nt, Human herpesvirus 6
auaugaaaagcug

SEQ ID NO: 3985279 - RNA, 17 nt, Human herpesvirus 6
auaugaaaagcuggaaa

SEQ ID NO: 3985280 - RNA, 15 nt, Human herpesvirus 6
auaugaugcuguaga

SEQ ID NO: 3985281 - RNA, 22 nt, Human herpesvirus 6
auauuaauuaccuauagucaau

SEQ ID NO: 3985282 - RNA, 18 nt, Human herpesvirus 6
auauuggaauugggaagc

SEQ ID NO: 3985283 - RNA, 20 nt, Human herpesvirus 6
aucagaauccaccaaugaca

SEQ ID NO: 3985284 - RNA, 16 nt, Human herpesvirus 6
aucagucaaaaucuga

SEQ ID NO: 3985285 - RNA, 18 nt, Human herpesvirus 6
auccaacgaauacuucuc

SEQ ID NO: 3985286 - RNA, 21 nt, Human herpesvirus 6
auccaaucacaacaaaaaugc

SEQ ID NO: 3985287 - RNA, 15 nt, Human herpesvirus 6
auccgccccgauaaa

SEQ ID NO: 3985288 - RNA, 20 nt, Human herpesvirus 6
aucgaaaucguauacguuaa

SEQ ID NO: 3985289 - RNA, 13 nt, Human herpesvirus 6
aucgauuuaaccu

SEQ ID NO: 3985290 - RNA, 17 nt, Human herpesvirus 6
aucgcgaagccuguccg

SEQ ID NO: 3985291 - RNA, 14 nt, Human herpesvirus 6
aucgcgcaccgcug

SEQ ID NO: 3985292 - RNA, 18 nt, Human herpesvirus 6
aucgcgcgcgacgugcca

SEQ ID NO: 3985293 - RNA, 20 nt, Human herpesvirus 6
aucuacgccuauuccaaacu

SEQ ID NO: 3985294 - RNA, 21 nt, Human herpesvirus 6
aucuauuauaagcaaacaugu

SEQ ID NO: 3985295 - RNA, 14 nt, Human herpesvirus 6
aucuccaaaagcgc

SEQ ID NO: 3985296 - RNA, 17 nt, Human herpesvirus 6
aucugaucgaaauacuu

SEQ ID NO: 3985297 - RNA, 17 nt, Human herpesvirus 6
aucuguuggcggaaacg

SEQ ID NO: 3985298 - RNA, 15 nt, Human herpesvirus 6
aucuuauucaaaaau

SEQ ID NO: 3985299 - RNA, 22 nt, Human herpesvirus 6
aucuucccuuuuacaauacaca

SEQ ID NO: 3985300 - RNA, 18 nt, Human herpesvirus 6
aucuucugggugggaaga

SEQ ID NO: 3985301 - RNA, 12 nt, Human herpesvirus 6
aucuuuaacaug

SEQ ID NO: 3985302 - RNA, 18 nt, Human herpesvirus 6
augaaccacguuuuucca

SEQ ID NO: 3985303 - RNA, 15 nt, Human herpesvirus 6
augacucuaaauacg

SEQ ID NO: 3985304 - RNA, 14 nt, Human herpesvirus 6
augaggauuugcuu

SEQ ID NO: 3985305 - RNA, 16 nt, Human herpesvirus 6
augaggggaacacgcc

SEQ ID NO: 3985306 - RNA, 23 nt, Human herpesvirus 6
augauaaauugaugaaauuguga

SEQ ID NO: 3985307 - RNA, 16 nt, Human herpesvirus 6
augauauuccagacaa

SEQ ID NO: 3985308 - RNA, 20 nt, Human herpesvirus 6
augauccgguauaucgagaa

SEQ ID NO: 3985309 - RNA, 17 nt, Human herpesvirus 6
augaucgacauuuguau

SEQ ID NO: 3985310 - RNA, 17 nt, Human herpesvirus 6
augcaacgcaucacaca

SEQ ID NO: 3985311 - RNA, 20 nt, Human herpesvirus 6
augcuuugggaccuucagga

SEQ ID NO: 3985312 - RNA, 19 nt, Human herpesvirus 6
augcuuugguuucaguagu

SEQ ID NO: 3985313 - RNA, 20 nt, Human herpesvirus 6
augcuuuuagauggaaaauu

SEQ ID NO: 3985314 - RNA, 17 nt, Human herpesvirus 6
auggaugugcacuuucu

SEQ ID NO: 3985315 - RNA, 18 nt, Human herpesvirus 6
auggcgcauaacggaaaa

SEQ ID NO: 3985316 - RNA, 22 nt, Human herpesvirus 6
auggcuaacguacucaaagaaa

SEQ ID NO: 3985317 - RNA, 20 nt, Human herpesvirus 6
auguaaacacgaaauugcuu

SEQ ID NO: 3985318 - RNA, 15 nt, Human herpesvirus 6
auguagauaaauaua

SEQ ID NO: 3985319 - RNA, 18 nt, Human herpesvirus 6
auguaguuaaugcugcug

SEQ ID NO: 3985320 - RNA, 21 nt, Human herpesvirus 6
auguaguuaaugcugcugcug

SEQ ID NO: 3985321 - RNA, 16 nt, Human herpesvirus 6
auguaucguuugagau

SEQ ID NO: 3985322 - RNA, 15 nt, Human herpesvirus 6
augucggccucugcc

SEQ ID NO: 3985323 - RNA, 15 nt, Human herpesvirus 6
auguggcaucggcuu

SEQ ID NO: 3985324 - RNA, 17 nt, Human herpesvirus 6
auguuaacucagguggu

SEQ ID NO: 3985325 - RNA, 14 nt, Human herpesvirus 6
auguucaauuacuc

SEQ ID NO: 3985326 - RNA, 13 nt, Human herpesvirus 6
auguuuggauaau

SEQ ID NO: 3985327 - RNA, 22 nt, Human herpesvirus 6
auuaaauguuacugaacuuugu

SEQ ID NO: 3985328 - RNA, 13 nt, Human herpesvirus 6
auuacaaaacaau

SEQ ID NO: 3985329 - RNA, 22 nt, Human herpesvirus 6
auuacauaagcaaauguaacuu

SEQ ID NO: 3985330 - RNA, 18 nt, Human herpesvirus 6
auuagccauuuuuuucuu

SEQ ID NO: 3985331 - RNA, 15 nt, Human herpesvirus 6
auuaugguuaucauc

SEQ ID NO: 3985332 - RNA, 16 nt, Human herpesvirus 6
auucaaaacgacaucg

SEQ ID NO: 3985333 - RNA, 13 nt, Human herpesvirus 6
auucaaagaaagu

SEQ ID NO: 3985334 - RNA, 19 nt, Human herpesvirus 6
auucaaaugcaguaaauga

SEQ ID NO: 3985335 - RNA, 21 nt, Human herpesvirus 6
auuccuuaauucuaaauacga

SEQ ID NO: 3985336 - RNA, 20 nt, Human herpesvirus 6
auucgacgaucgcgaagccu

SEQ ID NO: 3985337 - RNA, 13 nt, Human herpesvirus 6
aaaguucaguaac

SEQ ID NO: 3985338 - RNA, 18 nt, Human herpesvirus 6
aaaguucaguaacauuua

SEQ ID NO: 3985339 - RNA, 16 nt, Human herpesvirus 6
aaaguuucggaaaaug

SEQ ID NO: 3985340 - RNA, 20 nt, Human herpesvirus 6
aaaguuuguguuuguaaaug

SEQ ID NO: 3985341 - RNA, 12 nt, Human herpesvirus 6
aaaguuuucuaa

SEQ ID NO: 3985342 - RNA, 23 nt, Human herpesvirus 6
aaauaaaguuuaaagauguguua

SEQ ID NO: 3985343 - RNA, 15 nt, Human herpesvirus 6
aaauacuagcuaaaa

SEQ ID NO: 3985344 - RNA, 16 nt, Human herpesvirus 6
aaauaucgaaauaacg

SEQ ID NO: 3985345 - RNA, 17 nt, Human herpesvirus 6
acccacgguggccuggc

SEQ ID NO: 3985346 - RNA, 17 nt, Human herpesvirus 6
accccucccaucccccu

SEQ ID NO: 3985347 - RNA, 16 nt, Human herpesvirus 6
acccgcguccuccauc

SEQ ID NO: 3985348 - RNA, 16 nt, Human herpesvirus 6
accgacuuauaucgaa

SEQ ID NO: 3985349 - RNA, 12 nt, Human herpesvirus 6
accgaucuguga

SEQ ID NO: 3985350 - RNA, 16 nt, Human herpesvirus 6
accgauucagaaaguu

SEQ ID NO: 3985351 - RNA, 22 nt, Human herpesvirus 6
accgcggccguucucucuccuc

SEQ ID NO: 3985352 - RNA, 16 nt, Human herpesvirus 6
accgucugggacccac

SEQ ID NO: 3985353 - RNA, 16 nt, Human herpesvirus 6
accuaauaaacugugu

SEQ ID NO: 3985354 - RNA, 15 nt, Human herpesvirus 6
accuaauuacaauuu

SEQ ID NO: 3985355 - RNA, 23 nt, Human herpesvirus 6
accucacuacugaaaccaaagca

SEQ ID NO: 3985356 - RNA, 14 nt, Human herpesvirus 6
accucgcgcaccgc

SEQ ID NO: 3985357 - RNA, 21 nt, Human herpesvirus 6
accucuaaaacaagacagacc

SEQ ID NO: 3985358 - RNA, 14 nt, Human herpesvirus 6
accucucgccgacc

SEQ ID NO: 3985359 - RNA, 14 nt, Human herpesvirus 6
accugucucugcuu

SEQ ID NO: 3985360 - RNA, 14 nt, Human herpesvirus 6
acgaagaauuauuu

SEQ ID NO: 3985361 - RNA, 16 nt, Human herpesvirus 6
acgacacgcuggagca

SEQ ID NO: 3985362 - RNA, 13 nt, Human herpesvirus 6
acgagagcugacu

SEQ ID NO: 3985363 - RNA, 14 nt, Human herpesvirus 6
acgauagcagcucu

SEQ ID NO: 3985364 - RNA, 19 nt, Human herpesvirus 6
acgccacgggcauuccucg

SEQ ID NO: 3985365 - RNA, 15 nt, Human herpesvirus 6
acgccaguccguaaa

SEQ ID NO: 3985366 - RNA, 18 nt, Human herpesvirus 6
acgccuugauguuuccug

SEQ ID NO: 3985367 - RNA, 18 nt, Human herpesvirus 6
acggcagcggaagugaaa

SEQ ID NO: 3985368 - RNA, 20 nt, Human herpesvirus 6
acgggucgggggucugcaaa

SEQ ID NO: 3985369 - RNA, 14 nt, Human herpesvirus 6
acgguggccuggca

SEQ ID NO: 3985370 - RNA, 15 nt, Human herpesvirus 6
acgguggccuggcac

SEQ ID NO: 3985371 - RNA, 18 nt, Human herpesvirus 6
acggugucacacagcaug

SEQ ID NO: 3985372 - RNA, 19 nt, Human herpesvirus 6
acguaagaaaaaaaacgaa

SEQ ID NO: 3985373 - RNA, 19 nt, Human herpesvirus 6
acguaauagccaaacaagg

SEQ ID NO: 3985374 - RNA, 19 nt, Human herpesvirus 6
acguaucccuaauaaaugu

SEQ ID NO: 3985375 - RNA, 19 nt, Human herpesvirus 6
acgugaaauaaaguuuaaa

SEQ ID NO: 3985376 - RNA, 20 nt, Human herpesvirus 6
acgugccaccgucugggacc

SEQ ID NO: 3985377 - RNA, 17 nt, Human herpesvirus 6
acguuuuccaugugaau

SEQ ID NO: 3985378 - RNA, 19 nt, Human herpesvirus 6
acuaacauagcgaauuuga

SEQ ID NO: 3985379 - RNA, 19 nt, Human herpesvirus 6
acuaagcaggaacccagau

SEQ ID NO: 3985380 - RNA, 14 nt, Human herpesvirus 6
acuacguuuugugu

SEQ ID NO: 3985381 - RNA, 15 nt, Human herpesvirus 6
acuagcgaaugaauu

SEQ ID NO: 3985382 - RNA, 20 nt, Human herpesvirus 6
acucuucgauccaauaagaa

SEQ ID NO: 3985383 - RNA, 15 nt, Human herpesvirus 6
acugaaaccaaagca

SEQ ID NO: 3985384 - RNA, 17 nt, Human herpesvirus 6
acugaaucggaaacuga

SEQ ID NO: 3985385 - RNA, 15 nt, Human herpesvirus 6
acugcacgcugggcu

SEQ ID NO: 3985386 - RNA, 18 nt, Human herpesvirus 6
acugcauacguuugccaa

SEQ ID NO: 3985387 - RNA, 20 nt, Human herpesvirus 6
acugccgguaacgcugucgu

SEQ ID NO: 3985388 - RNA, 18 nt, Human herpesvirus 6
acugcgaauccgucuccg

SEQ ID NO: 3985389 - RNA, 15 nt, Human herpesvirus 6
acuuagcuagaugug

SEQ ID NO: 3985390 - RNA, 19 nt, Human herpesvirus 6
acuugccucacaaauauug

SEQ ID NO: 3985391 - RNA, 22 nt, Human herpesvirus 6
acuuucauaggaaguaaauaca

SEQ ID NO: 3985392 - RNA, 12 nt, Human herpesvirus 6
acuuucauccug

SEQ ID NO: 3985393 - RNA, 23 nt, Human herpesvirus 6
acuuuccccauauuguguaacuc

SEQ ID NO: 3985394 - RNA, 17 nt, Human herpesvirus 6
acuuuguccuuacaaau

SEQ ID NO: 3985395 - RNA, 20 nt, Human herpesvirus 6
agaaaaaaaaauaaguacau

SEQ ID NO: 3985396 - RNA, 13 nt, Human herpesvirus 6
agaaaaacaacga

SEQ ID NO: 3985397 - RNA, 16 nt, Human herpesvirus 6
agaaaacuauauugcc

SEQ ID NO: 3985398 - RNA, 17 nt, Human herpesvirus 6
agaaaauugcagaucua

SEQ ID NO: 3985399 - RNA, 15 nt, Human herpesvirus 6
agaacaucucagauc

SEQ ID NO: 3985400 - RNA, 17 nt, Human herpesvirus 6
agaaccugaaaucugag

SEQ ID NO: 3985401 - RNA, 13 nt, Human herpesvirus 6
agaaguuacaaga

SEQ ID NO: 3985402 - RNA, 16 nt, Human herpesvirus 6
agaaucguuaaaugag

SEQ ID NO: 3985403 - RNA, 16 nt, Human herpesvirus 6
agaaucugcagauuuu

SEQ ID NO: 3985404 - RNA, 19 nt, Human herpesvirus 6
agaaugaaaaaaaaaauau

SEQ ID NO: 3985405 - RNA, 22 nt, Human herpesvirus 6
agacaaaacuguccucuuugaa

SEQ ID NO: 3985406 - RNA, 16 nt, Human herpesvirus 6
agacaguaaaaugugu

SEQ ID NO: 3985407 - RNA, 22 nt, Human herpesvirus 6
agacauccagaaaagcaaacau

SEQ ID NO: 3985408 - RNA, 22 nt, Human herpesvirus 6
agacaucgauuugcugguaaau

SEQ ID NO: 3985409 - RNA, 20 nt, Human herpesvirus 6
agacccugccuauacaggca

SEQ ID NO: 3985410 - RNA, 15 nt, Human herpesvirus 6
agaccuauauguguu

SEQ ID NO: 3985411 - RNA, 13 nt, Human herpesvirus 6
agacgagauguuu

SEQ ID NO: 3985412 - RNA, 10 nt, Human herpesvirus 6
agagaggaaa

SEQ ID NO: 3985413 - RNA, 16 nt, Human herpesvirus 6
agagauuuuggaagca

SEQ ID NO: 3985414 - RNA, 22 nt, Human herpesvirus 6
agagcaaaugccgacaagcuuu

SEQ ID NO: 3985415 - RNA, 16 nt, Human herpesvirus 6
agagcuggggaguugc

SEQ ID NO: 3985416 - RNA, 17 nt, Human herpesvirus 6
agaggaaauaaaaacac

SEQ ID NO: 3985417 - RNA, 19 nt, Human herpesvirus 6
agauaucauaaucugcguu

SEQ ID NO: 3985418 - RNA, 18 nt, Human herpesvirus 6
agaucacguucaggauga

SEQ ID NO: 3985419 - RNA, 14 nt, Human herpesvirus 6
agaucuaauucaca

SEQ ID NO: 3985420 - RNA, 21 nt, Human herpesvirus 6
agaugaaaccuagauguaaau

SEQ ID NO: 3985421 - RNA, 17 nt, Human herpesvirus 6
agaugacaucugcaaaa

SEQ ID NO: 3985422 - RNA, 21 nt, Human herpesvirus 6
agaugauuccaaguggugguu

SEQ ID NO: 3985423 - RNA, 15 nt, Human herpesvirus 6
agauguagcuggaua

SEQ ID NO: 3985424 - RNA, 21 nt, Human herpesvirus 6
agauuacggcaacauacccuu

SEQ ID NO: 3985425 - RNA, 19 nt, Human herpesvirus 6
agauucuaaugauaaauug

SEQ ID NO: 3985426 - RNA, 20 nt, Human herpesvirus 6
agcaauaggcaccuaucuag

SEQ ID NO: 3985427 - RNA, 16 nt, Human herpesvirus 6
agcagcuagagaaauu

SEQ ID NO: 3985428 - RNA, 24 nt, Human herpesvirus 6
agcagucugcuggaugcugaugaa

SEQ ID NO: 3985429 - RNA, 17 nt, Human herpesvirus 6
agccaaagaaacagaua

SEQ ID NO: 3985430 - RNA, 23 nt, Human herpesvirus 6
agccuguccgugacacacagaau

SEQ ID NO: 3985431 - RNA, 22 nt, Human herpesvirus 6
agcgacuuuuuaacaaaauggu

SEQ ID NO: 3985432 - RNA, 23 nt, Human herpesvirus 6
agcgccaacgaaaagcaucucaa

SEQ ID NO: 3985433 - RNA, 20 nt, Human herpesvirus 6
agcguguuauuucgggacaa

SEQ ID NO: 3985434 - RNA, 16 nt, Human herpesvirus 6
agcuaaacaccacuug

SEQ ID NO: 3985435 - RNA, 17 nt, Human herpesvirus 6
agcuguccaucuucaga

SEQ ID NO: 3985436 - RNA, 21 nt, Human herpesvirus 6
agcuuuucauaugaaaagcug

SEQ ID NO: 3985437 - RNA, 15 nt, Human herpesvirus 6
aggaacgauaugcug

SEQ ID NO: 3985438 - RNA, 14 nt, Human herpesvirus 6
aggaaguaaauaca

SEQ ID NO: 3985439 - RNA, 22 nt, Human herpesvirus 6
aggacuucguucuugacagaga

SEQ ID NO: 3985440 - RNA, 18 nt, Human herpesvirus 6
aggagacaacaacgaaaa

SEQ ID NO: 3985441 - RNA, 20 nt, Human herpesvirus 6
aggagauuucagguaauauu

SEQ ID NO: 3985442 - RNA, 18 nt, Human herpesvirus 6
aggaucgaacucuucgau

SEQ ID NO: 3985443 - RNA, 19 nt, Human herpesvirus 6
aggcaugugauugucuuuu

SEQ ID NO: 3985444 - RNA, 19 nt, Human herpesvirus 6
aggcuaucacuuagacacg

SEQ ID NO: 3985445 - RNA, 13 nt, Human herpesvirus 6
aggcuaugugucu

SEQ ID NO: 3985446 - RNA, 16 nt, Human herpesvirus 6
aggcuaugugucuccg

SEQ ID NO: 3985447 - RNA, 12 nt, Human herpesvirus 6
aggcugaaauuu

SEQ ID NO: 3985448 - RNA, 13 nt, Human herpesvirus 6
aggggaagggaau

SEQ ID NO: 3985449 - RNA, 15 nt, Human herpesvirus 6
agggggggucucugu

SEQ ID NO: 3985450 - RNA, 18 nt, Human herpesvirus 6
agggugagucacauagau

SEQ ID NO: 3985451 - RNA, 13 nt, Human herpesvirus 6
agguaaagaucug

SEQ ID NO: 3985452 - RNA, 12 nt, Human herpesvirus 6
aggucagugggu

SEQ ID NO: 3985453 - RNA, 16 nt, Human herpesvirus 6
aggucaucaugcugug

SEQ ID NO: 3985454 - RNA, 20 nt, Human herpesvirus 6
agguccccccucggacagau

SEQ ID NO: 3985455 - RNA, 22 nt, Human herpesvirus 6
agguggcaucagaauccagaaa

SEQ ID NO: 3985456 - RNA, 13 nt, Human herpesvirus 6
caaacuacggaaa

SEQ ID NO: 3985457 - RNA, 21 nt, Human herpesvirus 6
caaacuuuuugccgucacacu

SEQ ID NO: 3985458 - RNA, 18 nt, Human herpesvirus 6
caaagacaucgauuugcu

SEQ ID NO: 3985459 - RNA, 14 nt, Human herpesvirus 6
caaaggaaaccacc

SEQ ID NO: 3985460 - RNA, 20 nt, Human herpesvirus 6
caaaguucaguaacauuuaa

SEQ ID NO: 3985461 - RNA, 15 nt, Human herpesvirus 6
caaauaaaagcauuu

SEQ ID NO: 3985462 - RNA, 13 nt, Human herpesvirus 6
caaaugauuuuac

SEQ ID NO: 3985463 - RNA, 16 nt, Human herpesvirus 6
caaaugcaguaaauga

SEQ ID NO: 3985464 - RNA, 20 nt, Human herpesvirus 6
caaauuaauuaagugcgcug

SEQ ID NO: 3985465 - RNA, 20 nt, Human herpesvirus 6
caaauucuuacauuuuguac

SEQ ID NO: 3985466 - RNA, 13 nt, Human herpesvirus 6
caacaaccacagc

SEQ ID NO: 3985467 - RNA, 15 nt, Human herpesvirus 6
caacaucuuaaaaga

SEQ ID NO: 3985468 - RNA, 16 nt, Human herpesvirus 6
caacauuuauguuucu

SEQ ID NO: 3985469 - RNA, 16 nt, Human herpesvirus 6
caaccccgcacgcaua

SEQ ID NO: 3985470 - RNA, 15 nt, Human herpesvirus 6
caacgcuccuccccu

SEQ ID NO: 3985471 - RNA, 12 nt, Human herpesvirus 6
caacggagaaaa

SEQ ID NO: 3985472 - RNA, 14 nt, Human herpesvirus 6
caacugaauuugca

SEQ ID NO: 3985473 - RNA, 14 nt, Human herpesvirus 6
caagaaaagaaaca

SEQ ID NO: 3985474 - RNA, 17 nt, Human herpesvirus 6
caagcuguccaucuuca

SEQ ID NO: 3985475 - RNA, 17 nt, Human herpesvirus 6
caaguuugaauuuauac

SEQ ID NO: 3985476 - RNA, 21 nt, Human herpesvirus 6
caaucagccugcucagagcug

SEQ ID NO: 3985477 - RNA, 14 nt, Human herpesvirus 6
caaucauguuuauu

SEQ ID NO: 3985478 - RNA, 21 nt, Human herpesvirus 6
caaucgaugugacaaaucugu

SEQ ID NO: 3985479 - RNA, 19 nt, Human herpesvirus 6
caaucuaucuccgcaaacc

SEQ ID NO: 3985480 - RNA, 17 nt, Human herpesvirus 6
caauguuuuugacaaau

SEQ ID NO: 3985481 - RNA, 16 nt, Human herpesvirus 6
caauuacucaacauua

SEQ ID NO: 3985482 - RNA, 14 nt, Human herpesvirus 6
caauuaguccauua

SEQ ID NO: 3985483 - RNA, 13 nt, Human herpesvirus 6
caccaacacaccu

SEQ ID NO: 3985484 - RNA, 17 nt, Human herpesvirus 6
caccagcauaacuggaa

SEQ ID NO: 3985485 - RNA, 20 nt, Human herpesvirus 6
caccccggggggugggagga

SEQ ID NO: 3985486 - RNA, 22 nt, Human herpesvirus 6
caccgagggcggacggacggcu

SEQ ID NO: 3985487 - RNA, 15 nt, Human herpesvirus 6
caccgucucugaagc

SEQ ID NO: 3985488 - RNA, 18 nt, Human herpesvirus 6
caccuucccucccacccc

SEQ ID NO: 3985489 - RNA, 18 nt, Human herpesvirus 6
cacgaagacgaagaggaa

SEQ ID NO: 3985490 - RNA, 16 nt, Human herpesvirus 6
cacgaucuacacaccg

SEQ ID NO: 3985491 - RNA, 16 nt, Human herpesvirus 6
cacgcauagacaaacc

SEQ ID NO: 3985492 - RNA, 14 nt, Human herpesvirus 6
cacgcccccaccuc

SEQ ID NO: 3985493 - RNA, 16 nt, Human herpesvirus 6
cacgcuaaaaacagac

SEQ ID NO: 3985494 - RNA, 14 nt, Human herpesvirus 6
cacgguggccuggc

SEQ ID NO: 3985495 - RNA, 18 nt, Human herpesvirus 6
cacguggcagucugcucg

SEQ ID NO: 3985496 - RNA, 20 nt, Human herpesvirus 6
cacguuuuuccaugucuucu

SEQ ID NO: 3985497 - RNA, 18 nt, Human herpesvirus 6
cacugugauaugcaaacu

SEQ ID NO: 3985498 - RNA, 14 nt, Human herpesvirus 6
cagaagacuuuaaa

SEQ ID NO: 3985499 - RNA, 13 nt, Human herpesvirus 6
cagaccacacccc

SEQ ID NO: 3985500 - RNA, 16 nt, Human herpesvirus 6
cagaccacaccccugu

SEQ ID NO: 3985501 - RNA, 17 nt, Human herpesvirus 6
cagagacgguguuuuca

SEQ ID NO: 3985502 - RNA, 23 nt, Human herpesvirus 6
cagagacgugaccggagaaaauc

SEQ ID NO: 3985503 - RNA, 15 nt, Human herpesvirus 6
cagagccgaucagau

SEQ ID NO: 3985504 - RNA, 19 nt, Human herpesvirus 6
cagagccuagaccaagaau

SEQ ID NO: 3985505 - RNA, 19 nt, Human herpesvirus 6
cagcaaguugcuaccgcug

SEQ ID NO: 3985506 - RNA, 14 nt, Human herpesvirus 6
cagcauguuuucuc

SEQ ID NO: 3985507 - RNA, 19 nt, Human herpesvirus 6
caggacagcuucuauuacu

SEQ ID NO: 3985508 - RNA, 14 nt, Human herpesvirus 6
caggcgaacgagaa

SEQ ID NO: 3985509 - RNA, 16 nt, Human herpesvirus 6
cagucucgggagagga

SEQ ID NO: 3985510 - RNA, 18 nt, Human herpesvirus 6
cagucuucaauaaaaacu

SEQ ID NO: 3985511 - RNA, 22 nt, Human herpesvirus 6
cagucuucaauaaaaacucaau

SEQ ID NO: 3985512 - RNA, 12 nt, Human herpesvirus 6
cagugaaacgga

SEQ ID NO: 3985513 - RNA, 21 nt, Human herpesvirus 6
cagugaaggcugccaugaaac

SEQ ID NO: 3985514 - RNA, 17 nt, Human herpesvirus 6
cagugucguuagaaugu

SEQ ID NO: 3985515 - RNA, 16 nt, Human herpesvirus 6
caguucaacgcugucu

SEQ ID NO: 3985516 - RNA, 17 nt, Human herpesvirus 6
cauaacauagaaaaaug

SEQ ID NO: 3985517 - RNA, 22 nt, Human herpesvirus 6
cauaaggcgcgaguuggugcua

SEQ ID NO: 3985518 - RNA, 21 nt, Human herpesvirus 6
cauacauucucguaguugcau

SEQ ID NO: 3985519 - RNA, 15 nt, Human herpesvirus 6
cauagaaaaaugaga

SEQ ID NO: 3985520 - RNA, 14 nt, Human herpesvirus 6
cauagaauuucuaa

SEQ ID NO: 3985521 - RNA, 16 nt, Human herpesvirus 6
cauagagaaacgagag

SEQ ID NO: 3985522 - RNA, 14 nt, Human herpesvirus 6
cauagcgaauuuga

SEQ ID NO: 3985523 - RNA, 14 nt, Human herpesvirus 6
cauauaaacagauu

SEQ ID NO: 3985524 - RNA, 16 nt, Human herpesvirus 6
gauucccuucagacau

SEQ ID NO: 3985525 - RNA, 17 nt, Human herpesvirus 6
gauugaugaaagcuuca

SEQ ID NO: 3985526 - RNA, 22 nt, Human herpesvirus 6
gauuucaagauuguguuucugu

SEQ ID NO: 3985527 - RNA, 12 nt, Human herpesvirus 6
gauuuugugaau

SEQ ID NO: 3985528 - RNA, 16 nt, Human herpesvirus 6
gcaaccuugacagaua

SEQ ID NO: 3985529 - RNA, 15 nt, Human herpesvirus 6
gcacaaaccaaaaug

SEQ ID NO: 3985530 - RNA, 16 nt, Human herpesvirus 6
gcacacacaagaacag

SEQ ID NO: 3985531 - RNA, 21 nt, Human herpesvirus 6
gcacacacaagaacagagaga

SEQ ID NO: 3985532 - RNA, 16 nt, Human herpesvirus 6
gcagacgcugaaauca

SEQ ID NO: 3985533 - RNA, 17 nt, Human herpesvirus 6
gcagaguccggcgcacg

SEQ ID NO: 3985534 - RNA, 21 nt, Human herpesvirus 6
gcagcuuccacgcgacagauc

SEQ ID NO: 3985535 - RNA, 20 nt, Human herpesvirus 6
gcaugucgaacagcuuuuca

SEQ ID NO: 3985536 - RNA, 13 nt, Human herpesvirus 6
gcauguugcaguu

SEQ ID NO: 3985537 - RNA, 15 nt, Human herpesvirus 6
gccaacgaaaagcau

SEQ ID NO: 3985538 - RNA, 22 nt, Human herpesvirus 6
gccagacaucgaccgccggagg

SEQ ID NO: 3985539 - RNA, 16 nt, Human herpesvirus 6
gccauauccuagcauu

SEQ ID NO: 3985540 - RNA, 14 nt, Human herpesvirus 6
gcccagauguggaa

SEQ ID NO: 3985541 - RNA, 15 nt, Human herpesvirus 6
gcccccauacacacc

SEQ ID NO: 3985542 - RNA, 19 nt, Human herpesvirus 6
gcccccauacacacccagc

SEQ ID NO: 3985543 - RNA, 22 nt, Human herpesvirus 6
gcccgaaugugauuaugccaaa

SEQ ID NO: 3985544 - RNA, 13 nt, Human herpesvirus 6
gcccgauccgccc

SEQ ID NO: 3985545 - RNA, 20 nt, Human herpesvirus 6
gccuauacaggcaaccgccg

SEQ ID NO: 3985546 - RNA, 21 nt, Human herpesvirus 6
gccucuacggcaacgcuccuc

SEQ ID NO: 3985547 - RNA, 16 nt, Human herpesvirus 6
gccuggcacggugcca

SEQ ID NO: 3985548 - RNA, 14 nt, Human herpesvirus 6
gcgacgugccaccg

SEQ ID NO: 3985549 - RNA, 19 nt, Human herpesvirus 6
gcgacucccggcccagaga

SEQ ID NO: 3985550 - RNA, 13 nt, Human herpesvirus 6
gcgauacccagcg

SEQ ID NO: 3985551 - RNA, 14 nt, Human herpesvirus 6
gcgccauaaaaaua

SEQ ID NO: 3985552 - RNA, 13 nt, Human herpesvirus 6
gcgcccauaccug

SEQ ID NO: 3985553 - RNA, 18 nt, Human herpesvirus 6
gcgccggugguaccuguc

SEQ ID NO: 3985554 - RNA, 20 nt, Human herpesvirus 6
gcgccugccuacacugcgaa

SEQ ID NO: 3985555 - RNA, 19 nt, Human herpesvirus 6
gcgcgagacagcggacagc

SEQ ID NO: 3985556 - RNA, 22 nt, Human herpesvirus 6
gcgcgaggugacggaggcgacg

SEQ ID NO: 3985557 - RNA, 23 nt, Human herpesvirus 6
gcgguauaaugcaugauggugcg

SEQ ID NO: 3985558 - RNA, 17 nt, Human herpesvirus 6
gcguggaauuuguggaa

SEQ ID NO: 3985559 - RNA, 13 nt, Human herpesvirus 6
gcguuccucucuc

SEQ ID NO: 3985560 - RNA, 15 nt, Human herpesvirus 6
gcuaauaugaacaau

SEQ ID NO: 3985561 - RNA, 14 nt, Human herpesvirus 6
gcuccgcgccccuc

SEQ ID NO: 3985562 - RNA, 18 nt, Human herpesvirus 6
gcuccgcgccccucgccc

SEQ ID NO: 3985563 - RNA, 23 nt, Human herpesvirus 6
gcuccguguuacugauggcaggu

SEQ ID NO: 3985564 - RNA, 15 nt, Human herpesvirus 6
gcucgaaucuaaauu

SEQ ID NO: 3985565 - RNA, 19 nt, Human herpesvirus 6
gcugacaacaaaggaguga

SEQ ID NO: 3985566 - RNA, 16 nt, Human herpesvirus 6
gcugauuuuguuuucu

SEQ ID NO: 3985567 - RNA, 15 nt, Human herpesvirus 6
gcuguccaucuucag

SEQ ID NO: 3985568 - RNA, 16 nt, Human herpesvirus 6
gcuguccaucuucaga

SEQ ID NO: 3985569 - RNA, 16 nt, Human herpesvirus 6
gcuguccgccuguucc

SEQ ID NO: 3985570 - RNA, 23 nt, Human herpesvirus 6
gcuuauacuguuguaaaauauag

SEQ ID NO: 3985571 - RNA, 22 nt, Human herpesvirus 6
gcuucgcaagacgccacgggca

SEQ ID NO: 3985572 - RNA, 22 nt, Human herpesvirus 6
ggaaaacuaaaagucagugggu

SEQ ID NO: 3985573 - RNA, 22 nt, Human herpesvirus 6
ggaaaauuaaaggucagugggu

SEQ ID NO: 3985574 - RNA, 16 nt, Human herpesvirus 6
ggaacgauaugcugcc

SEQ ID NO: 3985575 - RNA, 23 nt, Human herpesvirus 6
ggaagcgagcgggcuaauguaug

SEQ ID NO: 3985576 - RNA, 22 nt, Human herpesvirus 6
ggaaucaugucggccucugccg

SEQ ID NO: 3985577 - RNA, 14 nt, Human herpesvirus 6
ggaauugcauccaa

SEQ ID NO: 3985578 - RNA, 18 nt, Human herpesvirus 6
ggacaaaaaaaaaacguc

SEQ ID NO: 3985579 - RNA, 15 nt, Human herpesvirus 6
ggaccgagcggcgga

SEQ ID NO: 3985580 - RNA, 14 nt, Human herpesvirus 6
ggaccuggcggaca

SEQ ID NO: 3985581 - RNA, 14 nt, Human herpesvirus 6
ggacggacaggggg

SEQ ID NO: 3985582 - RNA, 13 nt, Human herpesvirus 6
ggacgggaagaac

SEQ ID NO: 3985583 - RNA, 18 nt, Human herpesvirus 6
ggacugugaaguaaaacu

SEQ ID NO: 3985584 - RNA, 18 nt, Human herpesvirus 6
ggagagacgcaccacggc

SEQ ID NO: 3985585 - RNA, 17 nt, Human herpesvirus 6
ggagcacacacgccgac

SEQ ID NO: 3985586 - RNA, 13 nt, Human herpesvirus 6
ggauccgcuccgc

SEQ ID NO: 3985587 - RNA, 14 nt, Human herpesvirus 6
ggaucgggcccggg

SEQ ID NO: 3985588 - RNA, 23 nt, Human herpesvirus 6
ggcaaccugaaacuccccagaga

SEQ ID NO: 3985589 - RNA, 18 nt, Human herpesvirus 6
ggcaccuaucuagaucaa

SEQ ID NO: 3985590 - RNA, 12 nt, Human herpesvirus 6
ggcacggugcca

SEQ ID NO: 3985591 - RNA, 24 nt, Human herpesvirus 6
ggcagcugcaugguccacagaugu

SEQ ID NO: 3985592 - RNA, 16 nt, Human herpesvirus 6
ggcaucugcggcucug

SEQ ID NO: 3985593 - RNA, 13 nt, Human herpesvirus 6
ggccagagacgug

SEQ ID NO: 3985594 - RNA, 23 nt, Human herpesvirus 6
ggccauauuaggcugcagcccca

SEQ ID NO: 3985595 - RNA, 15 nt, Human herpesvirus 6
ggccguucucucucc

SEQ ID NO: 3985596 - RNA, 20 nt, Human herpesvirus 6
ggccuccgccacugcgaggc

SEQ ID NO: 3985597 - RNA, 18 nt, Human herpesvirus 6
ggccugacacaaucagaa

SEQ ID NO: 3985598 - RNA, 22 nt, Human herpesvirus 6
ggcgaugaccgcuaaauugaua

SEQ ID NO: 3985599 - RNA, 20 nt, Human herpesvirus 6
ggcgcgagacagcggacagc

SEQ ID NO: 3985600 - RNA, 18 nt, Human herpesvirus 6
ggcgcgcauguugcaguu

SEQ ID NO: 3985601 - RNA, 15 nt, Human herpesvirus 6
ggcggauggagcccg

SEQ ID NO: 3985602 - RNA, 13 nt, Human herpesvirus 6
ccccucccauccc

SEQ ID NO: 3985603 - RNA, 15 nt, Human herpesvirus 6
ccccucccauccccc

SEQ ID NO: 3985604 - RNA, 15 nt, Human herpesvirus 6
cccgcagcuccuuuc

SEQ ID NO: 3985605 - RNA, 14 nt, Human herpesvirus 6
cccgcguccuccau

SEQ ID NO: 3985606 - RNA, 14 nt, Human herpesvirus 6
cccuacuacagugg

SEQ ID NO: 3985607 - RNA, 19 nt, Human herpesvirus 6
cccucgguccaaccccucc

SEQ ID NO: 3985608 - RNA, 14 nt, Human herpesvirus 6
ccgaacuagaaaaa

SEQ ID NO: 3985609 - RNA, 14 nt, Human herpesvirus 6
ccgaugaauucugg

SEQ ID NO: 3985610 - RNA, 20 nt, Human herpesvirus 6
ccgauuaauguguuuuucuu

SEQ ID NO: 3985611 - RNA, 15 nt, Human herpesvirus 6
ccgcaagauacuggu

SEQ ID NO: 3985612 - RNA, 23 nt, Human herpesvirus 6
ccgcaguuccuguucuucucaga

SEQ ID NO: 3985613 - RNA, 23 nt, Human herpesvirus 6
ccgcaguuccuguuuuucucgga

SEQ ID NO: 3985614 - RNA, 16 nt, Human herpesvirus 6
ccgcauaucgccccca

SEQ ID NO: 3985615 - RNA, 23 nt, Human herpesvirus 6
ccgccuuuucuuauauuuuucug

SEQ ID NO: 3985616 - RNA, 18 nt, Human herpesvirus 6
ccgguuuaagaagggcuu

SEQ ID NO: 3985617 - RNA, 12 nt, Human herpesvirus 6
ccguagaggcgu

SEQ ID NO: 3985618 - RNA, 19 nt, Human herpesvirus 6
ccguauagguguuuuugga

SEQ ID NO: 3985619 - RNA, 24 nt, Human herpesvirus 6
ccgucaaaucucgccgaacuagaa

SEQ ID NO: 3985620 - RNA, 16 nt, Human herpesvirus 6
ccgucucugaagcaaa

SEQ ID NO: 3985621 - RNA, 11 nt, Human herpesvirus 6
ccguuuaugcg

SEQ ID NO: 3985622 - RNA, 13 nt, Human herpesvirus 6
ccuccgccacugc

SEQ ID NO: 3985623 - RNA, 17 nt, Human herpesvirus 6
ccucgcgcaccgccucc

SEQ ID NO: 3985624 - RNA, 20 nt, Human herpesvirus 6
ccucuaaaacaagacagacc

SEQ ID NO: 3985625 - RNA, 17 nt, Human herpesvirus 6
ccucuaaacccagaccu

SEQ ID NO: 3985626 - RNA, 13 nt, Human herpesvirus 6
ccugaucacagag

SEQ ID NO: 3985627 - RNA, 11 nt, Human herpesvirus 6
ccugcacaggc

SEQ ID NO: 3985628 - RNA, 13 nt, Human herpesvirus 6
ccuucaccgucuc

SEQ ID NO: 3985629 - RNA, 20 nt, Human herpesvirus 6
ccuuguggaggauuucugag

SEQ ID NO: 3985630 - RNA, 19 nt, Human herpesvirus 6
ccuuuaacuuuuugcauuc

SEQ ID NO: 3985631 - RNA, 14 nt, Human herpesvirus 6
cgaaaagcaucuca

SEQ ID NO: 3985632 - RNA, 14 nt, Human herpesvirus 6
cgaaaucaaugagu

SEQ ID NO: 3985633 - RNA, 15 nt, Human herpesvirus 6
cgacagggugaguca

SEQ ID NO: 3985634 - RNA, 22 nt, Human herpesvirus 6
cgacaucgcgcgcgacgugcca

SEQ ID NO: 3985635 - RNA, 18 nt, Human herpesvirus 6
cgaccugaucacagagaa

SEQ ID NO: 3985636 - RNA, 16 nt, Human herpesvirus 6
cgacuauacgaaauaa

SEQ ID NO: 3985637 - RNA, 21 nt, Human herpesvirus 6
cgacuucaaacaccucacaau

SEQ ID NO: 3985638 - RNA, 18 nt, Human herpesvirus 6
cgagaacucuaaaagcug

SEQ ID NO: 3985639 - RNA, 20 nt, Human herpesvirus 6
cgagaacucuaaaagcugcu

SEQ ID NO: 3985640 - RNA, 14 nt, Human herpesvirus 6
cgauguacaguuuc

SEQ ID NO: 3985641 - RNA, 15 nt, Human herpesvirus 6
cgauuugcugguaaa

SEQ ID NO: 3985642 - RNA, 14 nt, Human herpesvirus 6
cgcaguggacggcg

SEQ ID NO: 3985643 - RNA, 15 nt, Human herpesvirus 6
cgcaguggacggcgg

SEQ ID NO: 3985644 - RNA, 16 nt, Human herpesvirus 6
cgcaguuucuguuuuu

SEQ ID NO: 3985645 - RNA, 14 nt, Human herpesvirus 6
cgcccuccccgagc

SEQ ID NO: 3985646 - RNA, 14 nt, Human herpesvirus 6
cgccuuguauuuca

SEQ ID NO: 3985647 - RNA, 17 nt, Human herpesvirus 6
cgcgacgugccaccguc

SEQ ID NO: 3985648 - RNA, 20 nt, Human herpesvirus 6
cgcgguuugggggucuuucc

SEQ ID NO: 3985649 - RNA, 14 nt, Human herpesvirus 6
cgcguacacgaaaa

SEQ ID NO: 3985650 - RNA, 21 nt, Human herpesvirus 6
cgcugggaauugcauccaaag

SEQ ID NO: 3985651 - RNA, 22 nt, Human herpesvirus 6
cggaaaaaaaaucuauccgcua

SEQ ID NO: 3985652 - RNA, 16 nt, Human herpesvirus 6
cggaaaauuaaaaguc

SEQ ID NO: 3985653 - RNA, 22 nt, Human herpesvirus 6
cggagaacguggccguuacagu

SEQ ID NO: 3985654 - RNA, 16 nt, Human herpesvirus 6
cggaggcgacgaaaga

SEQ ID NO: 3985655 - RNA, 18 nt, Human herpesvirus 6
cggauuuaaaauggauua

SEQ ID NO: 3985656 - RNA, 17 nt, Human herpesvirus 6
cggcagcuauauggcga

SEQ ID NO: 3985657 - RNA, 16 nt, Human herpesvirus 6
cggccauuuaacggaa

SEQ ID NO: 3985658 - RNA, 16 nt, Human herpesvirus 6
cggcccauccaccuuc

SEQ ID NO: 3985659 - RNA, 18 nt, Human herpesvirus 6
cggccggagugccguuga

SEQ ID NO: 3985660 - RNA, 20 nt, Human herpesvirus 6
cggcggauggagcccgcucg

SEQ ID NO: 3985661 - RNA, 20 nt, Human herpesvirus 6
cgggcccggggacggacagg

SEQ ID NO: 3985662 - RNA, 13 nt, Human herpesvirus 6
cgggcggggcgga

SEQ ID NO: 3985663 - RNA, 21 nt, Human herpesvirus 6
cggggcggacggggacgacac

SEQ ID NO: 3985664 - RNA, 13 nt, Human herpesvirus 6
cgguacucuuuuc

SEQ ID NO: 3985665 - RNA, 18 nt, Human herpesvirus 6
cgguccaaggauuaugau

SEQ ID NO: 3985666 - RNA, 20 nt, Human herpesvirus 6
cggucgagaauacgcugugu

SEQ ID NO: 3985667 - RNA, 20 nt, Human herpesvirus 6
cggugagaagaucugcguga

SEQ ID NO: 3985668 - RNA, 19 nt, Human herpesvirus 6
cgguggccuggcacggugc

SEQ ID NO: 3985669 - RNA, 13 nt, Human herpesvirus 6
cguaacgcggcaa

SEQ ID NO: 3985670 - RNA, 13 nt, Human herpesvirus 6
cguaaugugcaaa

SEQ ID NO: 3985671 - RNA, 14 nt, Human herpesvirus 6
cgucauguguggac

SEQ ID NO: 3985672 - RNA, 13 nt, Human herpesvirus 6
cgucgccgcuucg

SEQ ID NO: 3985673 - RNA, 16 nt, Human herpesvirus 6
cgucuauaacaauugu

SEQ ID NO: 3985674 - RNA, 18 nt, Human herpesvirus 6
cgugccaccgucugggac

SEQ ID NO: 3985675 - RNA, 21 nt, Human herpesvirus 6
cgugccaccgucugggaccca

SEQ ID NO: 3985676 - RNA, 14 nt, Human herpesvirus 6
cguuaaaaaaaaug

SEQ ID NO: 3985677 - RNA, 22 nt, Human herpesvirus 6
gguggccuggcacggugccaaa

SEQ ID NO: 3985678 - RNA, 13 nt, Human herpesvirus 6
gguuaaauuuauc

SEQ ID NO: 3985679 - RNA, 15 nt, Human herpesvirus 6
gguuggaugccugca

SEQ ID NO: 3985680 - RNA, 16 nt, Human herpesvirus 6
gguuggggucuuuccu

SEQ ID NO: 3985681 - RNA, 23 nt, Human herpesvirus 6
gguuugaaacacugcaagguuuc

SEQ ID NO: 3985682 - RNA, 19 nt, Human herpesvirus 6
gguuuuaagagcagacaag

SEQ ID NO: 3985683 - RNA, 19 nt, Human herpesvirus 6
guaaacuuauugaggaaau

SEQ ID NO: 3985684 - RNA, 14 nt, Human herpesvirus 6
guaacgcugucguu

SEQ ID NO: 3985685 - RNA, 12 nt, Human herpesvirus 6
guaauacaucau

SEQ ID NO: 3985686 - RNA, 15 nt, Human herpesvirus 6
guaauuuguguaauu

SEQ ID NO: 3985687 - RNA, 23 nt, Human herpesvirus 6
guagaacggaaaaaaaaucuauc

SEQ ID NO: 3985688 - RNA, 14 nt, Human herpesvirus 6
guagaguggaguug

SEQ ID NO: 3985689 - RNA, 23 nt, Human herpesvirus 6
guagccuaggccuucaccugucu

SEQ ID NO: 3985690 - RNA, 20 nt, Human herpesvirus 6
guauauuuuuuuuuauuuuu

SEQ ID NO: 3985691 - RNA, 12 nt, Human herpesvirus 6
guauugaagaaa

SEQ ID NO: 3985692 - RNA, 15 nt, Human herpesvirus 6
gucaccuguauagau

SEQ ID NO: 3985693 - RNA, 17 nt, Human herpesvirus 6
guccagaaguccuucau

SEQ ID NO: 3985694 - RNA, 22 nt, Human herpesvirus 6
gucccaucuauacacccugccg

SEQ ID NO: 3985695 - RNA, 20 nt, Human herpesvirus 6
gucgagaaccaccagagaca

SEQ ID NO: 3985696 - RNA, 13 nt, Human herpesvirus 6
gucgcccccccgc

SEQ ID NO: 3985697 - RNA, 19 nt, Human herpesvirus 6
gucgcccccccgcagcucc

SEQ ID NO: 3985698 - RNA, 22 nt, Human herpesvirus 6
gucgucgccuccccgggugcuc

SEQ ID NO: 3985699 - RNA, 15 nt, Human herpesvirus 6
gucuagauucuaaug

SEQ ID NO: 3985700 - RNA, 19 nt, Human herpesvirus 6
gucuaucgcaaauucucuc

SEQ ID NO: 3985701 - RNA, 22 nt, Human herpesvirus 6
gucuuuccccagcacaccccau

SEQ ID NO: 3985702 - RNA, 11 nt, Human herpesvirus 6
gucuuuccugc

SEQ ID NO: 3985703 - RNA, 12 nt, Human herpesvirus 6
gucuuuccugcc

SEQ ID NO: 3985704 - RNA, 15 nt, Human herpesvirus 6
gucuuuccugcccaa

SEQ ID NO: 3985705 - RNA, 13 nt, Human herpesvirus 6
gugcaaaagcuga

SEQ ID NO: 3985706 - RNA, 18 nt, Human herpesvirus 6
gugccaaaggaaaccacc

SEQ ID NO: 3985707 - RNA, 17 nt, Human herpesvirus 6
gugccaccgucugggac

SEQ ID NO: 3985708 - RNA, 18 nt, Human herpesvirus 6
gugccaccgucugggacc

SEQ ID NO: 3985709 - RNA, 22 nt, Human herpesvirus 6
gugccaccgucugggacccacg

SEQ ID NO: 3985710 - RNA, 19 nt, Human herpesvirus 6
guggacguucugucugcag

SEQ ID NO: 3985711 - RNA, 18 nt, Human herpesvirus 6
guggucaugaucugcuug

SEQ ID NO: 3985712 - RNA, 21 nt, Human herpesvirus 6
gugucaguucaacgcugucuu

SEQ ID NO: 3985713 - RNA, 17 nt, Human herpesvirus 6
gugucggcuacgacacg

SEQ ID NO: 3985714 - RNA, 23 nt, Human herpesvirus 6
guguuaaaggaugcggacucuga

SEQ ID NO: 3985715 - RNA, 16 nt, Human herpesvirus 6
guguuagcuuugcgau

SEQ ID NO: 3985716 - RNA, 18 nt, Human herpesvirus 6
guguuaugaucuagcuau

SEQ ID NO: 3985717 - RNA, 21 nt, Human herpesvirus 6
guguucguuaaaaaaaaugug

SEQ ID NO: 3985718 - RNA, 16 nt, Human herpesvirus 6
guguuuacauauacau

SEQ ID NO: 3985719 - RNA, 13 nt, Human herpesvirus 6
guguuuguucuuu

SEQ ID NO: 3985720 - RNA, 13 nt, Human herpesvirus 6
guuaaauaauauu

SEQ ID NO: 3985721 - RNA, 23 nt, Human herpesvirus 6
guuaauuguguuguuguauaugu

SEQ ID NO: 3985722 - RNA, 15 nt, Human herpesvirus 6
guuauacauaaggca

SEQ ID NO: 3985723 - RNA, 14 nt, Human herpesvirus 6
guucaauuacucaa

SEQ ID NO: 3985724 - RNA, 20 nt, Human herpesvirus 6
guucaccacugugauaugca

SEQ ID NO: 3985725 - RNA, 19 nt, Human herpesvirus 6
guucagaagagaugaaaga

SEQ ID NO: 3985726 - RNA, 14 nt, Human herpesvirus 6
guucaucagccauu

SEQ ID NO: 3985727 - RNA, 14 nt, Human herpesvirus 6
guucgauugccaaa

SEQ ID NO: 3985728 - RNA, 16 nt, Human herpesvirus 6
guugaaguauguacaa

SEQ ID NO: 3985729 - RNA, 21 nt, Human herpesvirus 6
guugagguguuuccugcccag

SEQ ID NO: 3985730 - RNA, 12 nt, Human herpesvirus 6
guugaguuucag

SEQ ID NO: 3985731 - RNA, 21 nt, Human herpesvirus 6
guugcuauagauuagaaauua

SEQ ID NO: 3985732 - RNA, 13 nt, Human herpesvirus 6
guuuccugcccag

SEQ ID NO: 3985733 - RNA, 13 nt, Human herpesvirus 6
guuucuguccaau

SEQ ID NO: 3985734 - RNA, 15 nt, Human herpesvirus 6
guuugaaacacugca

SEQ ID NO: 3985735 - RNA, 22 nt, Human herpesvirus 6
guuugaguugggacuuggaaac

SEQ ID NO: 3985736 - RNA, 12 nt, Human herpesvirus 6
guuuuuauuuua

SEQ ID NO: 3985737 - RNA, 22 nt, Human herpesvirus 6
guuuuucauaaaugguagcuau

SEQ ID NO: 3985738 - RNA, 12 nt, Human herpesvirus 6
guuuuuuaagag

SEQ ID NO: 3985739 - RNA, 19 nt, Human herpesvirus 6
uaaaaaaguguaacauccc

SEQ ID NO: 3985740 - RNA, 16 nt, Human herpesvirus 6
uaaaacaguaaauuca

SEQ ID NO: 3985741 - RNA, 16 nt, Human herpesvirus 6
uaaaagcuauguauga

SEQ ID NO: 3985742 - RNA, 16 nt, Human herpesvirus 6
uaaaagucagugggua

SEQ ID NO: 3985743 - RNA, 21 nt, Human herpesvirus 6
uaaaauaccgacaagaaaaua

SEQ ID NO: 3985744 - RNA, 22 nt, Human herpesvirus 6
uaaaauccacgaacguagacag

SEQ ID NO: 3985745 - RNA, 20 nt, Human herpesvirus 6
uaaaaucucguaacgcggca

SEQ ID NO: 3985746 - RNA, 18 nt, Human herpesvirus 6
uaaacauuuauaaaagga

SEQ ID NO: 3985747 - RNA, 22 nt, Human herpesvirus 6
uaaaccguuuaucgaugugcga

SEQ ID NO: 3985748 - RNA, 22 nt, Human herpesvirus 6
uaaacuaugcaaacgaaaccau

SEQ ID NO: 3985749 - RNA, 16 nt, Human herpesvirus 6
uaaagaacaugugaca

SEQ ID NO: 3985750 - RNA, 15 nt, Human herpesvirus 6
uaaagauagaauaau

SEQ ID NO: 3985751 - RNA, 14 nt, Human herpesvirus 6
uaaaguuauauucu

SEQ ID NO: 3985752 - RNA, 23 nt, Human herpesvirus 6
uaaauauaucaaagauguacuca

SEQ ID NO: 3985753 - RNA, 21 nt, Human herpesvirus 6
uaaaugaauagauaauaauca

SEQ ID NO: 3985754 - RNA, 22 nt, Human herpesvirus 6
uaaauguuuauuauccaaacau

SEQ ID NO: 3985755 - RNA, 20 nt, Human herpesvirus 6
uaacaucucguaacgcggca

SEQ ID NO: 3985756 - RNA, 22 nt, Human herpesvirus 6
uaaccauuuugaaaaaacaguu

SEQ ID NO: 3985757 - RNA, 18 nt, Human herpesvirus 6
uaaccucacuacugaaac

SEQ ID NO: 3985758 - RNA, 14 nt, Human herpesvirus 6
uaacgcagcaacaa

SEQ ID NO: 3985759 - RNA, 15 nt, Human herpesvirus 6
uaacuaagauugugc

SEQ ID NO: 3985760 - RNA, 16 nt, Human herpesvirus 6
uaacuaagauugugca

SEQ ID NO: 3985761 - RNA, 20 nt, Human herpesvirus 6
uaacucuuuuuguugcuaua

SEQ ID NO: 3985762 - RNA, 21 nt, Human herpesvirus 6
uaagaagaaaaaaacacaaau

SEQ ID NO: 3985763 - RNA, 14 nt, Human herpesvirus 6
uaagcaaaaacaga

SEQ ID NO: 3985764 - RNA, 23 nt, Human herpesvirus 6
uaagucuuugggaacauguaacu

SEQ ID NO: 3985765 - RNA, 15 nt, Human herpesvirus 6
uaauaaacuuuuaaa

SEQ ID NO: 3985766 - RNA, 20 nt, Human herpesvirus 6
uaauaaaucgcuuaaagcgu

SEQ ID NO: 3985767 - RNA, 19 nt, Human herpesvirus 6
uaauacauauaaaagcuaa

SEQ ID NO: 3985768 - RNA, 22 nt, Human herpesvirus 6
uaauacgcaguugucuggcagc

SEQ ID NO: 3985769 - RNA, 18 nt, Human herpesvirus 6
uaaugagaggacagucaa

SEQ ID NO: 3985770 - RNA, 16 nt, Human herpesvirus 6
uaauguaaaguuauau

SEQ ID NO: 3985771 - RNA, 12 nt, Human herpesvirus 6
uaauguccagug

SEQ ID NO: 3985772 - RNA, 19 nt, Human herpesvirus 6
uaauuguguuguuguauau

SEQ ID NO: 3985773 - RNA, 18 nt, Human herpesvirus 6
uacacgcauuugcaauug

SEQ ID NO: 3985774 - RNA, 13 nt, Human herpesvirus 6
uacauaaacaccc

SEQ ID NO: 3985775 - RNA, 12 nt, Human herpesvirus 6
uacauauaguca

SEQ ID NO: 3985776 - RNA, 17 nt, Human herpesvirus 6
uacaucguuuguugaau

SEQ ID NO: 3985777 - RNA, 19 nt, Human herpesvirus 6
uacauuuuguacaaacuuu

SEQ ID NO: 3985778 - RNA, 23 nt, Human herpesvirus 6
uacccuaagugaaauucaaaaua

SEQ ID NO: 3985779 - RNA, 21 nt, Human herpesvirus 6
uaccgcgguuugggggucuuu

SEQ ID NO: 3985780 - RNA, 23 nt, Human herpesvirus 6
uacgacacgcuggagcagcuucc

SEQ ID NO: 3985781 - RNA, 15 nt, Human herpesvirus 6
uacggagaacgggca

SEQ ID NO: 3985782 - RNA, 15 nt, Human herpesvirus 6
uacggcagcggacca

SEQ ID NO: 3985783 - RNA, 23 nt, Human herpesvirus 6
uacguuaaauaucuauuuaaaau

SEQ ID NO: 3985784 - RNA, 16 nt, Human herpesvirus 6
uacuauuuuagucaca

SEQ ID NO: 3985785 - RNA, 22 nt, Human herpesvirus 6
uacuguacaaaaucaaacucac

SEQ ID NO: 3985786 - RNA, 19 nt, Human herpesvirus 6
uacuuacaucgauccaaaa

SEQ ID NO: 3985787 - RNA, 20 nt, Human herpesvirus 6
uagacgaaaauuguaacuuc

SEQ ID NO: 3985788 - RNA, 13 nt, Human herpesvirus 6
uagacuuggugau

SEQ ID NO: 3985789 - RNA, 21 nt, Human herpesvirus 6
uagcaucuuaccuucaaagug

SEQ ID NO: 3985790 - RNA, 19 nt, Human herpesvirus 6
uagccuauuaagcagccgc

SEQ ID NO: 3985791 - RNA, 17 nt, Human herpesvirus 6
uugugcgucagcuuuga

SEQ ID NO: 3985792 - RNA, 18 nt, Human herpesvirus 6
uuguggacaauauaaaag

SEQ ID NO: 3985793 - RNA, 11 nt, Human herpesvirus 6
uuuaacauuuu

SEQ ID NO: 3985794 - RNA, 14 nt, Human herpesvirus 6
uuuaaccggaaaaa

SEQ ID NO: 3985795 - RNA, 16 nt, Human herpesvirus 6
uuuaacuauccauuuu

SEQ ID NO: 3985796 - RNA, 13 nt, Human herpesvirus 6
uuuaaggauaaga

SEQ ID NO: 3985797 - RNA, 15 nt, Human herpesvirus 6
uuuaaugcaaguuug

SEQ ID NO: 3985798 - RNA, 19 nt, Human herpesvirus 6
uuuaaugcaaguuugaauu

SEQ ID NO: 3985799 - RNA, 13 nt, Human herpesvirus 6
uuuaauuuugaaa

SEQ ID NO: 3985800 - RNA, 19 nt, Human herpesvirus 6
uuuacagucuuuaaaugag

SEQ ID NO: 3985801 - RNA, 23 nt, Human herpesvirus 6
uuuacauuaaacacuaaauuacc

SEQ ID NO: 3985802 - RNA, 15 nt, Human herpesvirus 6
uuuaccgguuuggug

SEQ ID NO: 3985803 - RNA, 14 nt, Human herpesvirus 6
uuuacugcaugcua

SEQ ID NO: 3985804 - RNA, 18 nt, Human herpesvirus 6
uuuagaaacauuugcuga

SEQ ID NO: 3985805 - RNA, 16 nt, Human herpesvirus 6
uuuagccuuuauucug

SEQ ID NO: 3985806 - RNA, 14 nt, Human herpesvirus 6
uuuauaugcaggua

SEQ ID NO: 3985807 - RNA, 20 nt, Human herpesvirus 6
uuuaucgcaacacacaguga

SEQ ID NO: 3985808 - RNA, 24 nt, Human herpesvirus 6
uuuauuuugucagucaacgcaauu

SEQ ID NO: 3985809 - RNA, 19 nt, Human herpesvirus 6
uuucaguauuaacuaguug

SEQ ID NO: 3985810 - RNA, 15 nt, Human herpesvirus 6
uuuccagguagaguu

SEQ ID NO: 3985811 - RNA, 16 nt, Human herpesvirus 6
uuucgccgugugugua

SEQ ID NO: 3985812 - RNA, 14 nt, Human herpesvirus 6
uuucgucuccuggg

SEQ ID NO: 3985813 - RNA, 24 nt, Human herpesvirus 6
uuucguuacgacgaacaauauaga

SEQ ID NO: 3985814 - RNA, 21 nt, Human herpesvirus 6
uuucguuuacgaauucaaugu

SEQ ID NO: 3985815 - RNA, 20 nt, Human herpesvirus 6
uuucuaacagaggguuuaga

SEQ ID NO: 3985816 - RNA, 12 nt, Human herpesvirus 6
uuucucugcaaa

SEQ ID NO: 3985817 - RNA, 14 nt, Human herpesvirus 6
uuucuguuuuaauu

SEQ ID NO: 3985818 - RNA, 18 nt, Human herpesvirus 6
uuugaaacugaggaacug

SEQ ID NO: 3985819 - RNA, 23 nt, Human herpesvirus 6
uuugaauuuauacugugugcgau

SEQ ID NO: 3985820 - RNA, 19 nt, Human herpesvirus 6
uuugacugauacuugaaac

SEQ ID NO: 3985821 - RNA, 17 nt, Human herpesvirus 6
uuugccaaaauaugcua

SEQ ID NO: 3985822 - RNA, 12 nt, Human herpesvirus 6
uuugccaaagcu

SEQ ID NO: 3985823 - RNA, 17 nt, Human herpesvirus 6
uuugcgucuucuauauu

SEQ ID NO: 3985824 - RNA, 14 nt, Human herpesvirus 6
uuugcgugugugua

SEQ ID NO: 3985825 - RNA, 16 nt, Human herpesvirus 6
uuuguacaaacuuuuu

SEQ ID NO: 3985826 - RNA, 21 nt, Human herpesvirus 6
uuuuaacaaaaugguuaugac

SEQ ID NO: 3985827 - RNA, 20 nt, Human herpesvirus 6
uuuuaaccggaaaaaugaaa

SEQ ID NO: 3985828 - RNA, 12 nt, Human herpesvirus 6
uuuuaauuccaa

SEQ ID NO: 3985829 - RNA, 18 nt, Human herpesvirus 6
uuuuaugaucgacauuug

SEQ ID NO: 3985830 - RNA, 20 nt, Human herpesvirus 6
uuuuauuuuuuggcuauuug

SEQ ID NO: 3985831 - RNA, 15 nt, Human herpesvirus 6
uuuucggauuuugaa

SEQ ID NO: 3985832 - RNA, 16 nt, Human herpesvirus 6
uuuuugucagguuuga

SEQ ID NO: 3985833 - RNA, 16 nt, Human herpesvirus 6
uuuuuuaacagugucu

SEQ ID NO: 3985834 - RNA, 13 nt, Human herpesvirus 6
uuuuuuuuucaua

SEQ ID NO: 3985835 - RNA, 20 nt, Human herpesvirus 6
auaacgauauauaaaaaacu

SEQ ID NO: 3985836 - RNA, 21 nt, Human herpesvirus 6
auaacgauauauaaaaaacug

SEQ ID NO: 3985837 - RNA, 15 nt, Human herpesvirus 6
auaagcagaagaguu

SEQ ID NO: 3985838 - RNA, 18 nt, Human herpesvirus 6
auaaguacauagaauuuc

SEQ ID NO: 3985839 - RNA, 22 nt, Human herpesvirus 6
auaaucugaucgaaauacuucu

SEQ ID NO: 3985840 - RNA, 14 nt, Human herpesvirus 6
auaauuaugcauuu

SEQ ID NO: 3985841 - RNA, 15 nt, Human herpesvirus 6
auaauuuauggaaau

SEQ ID NO: 3985842 - RNA, 23 nt, Human herpesvirus 6
auacacugcaagaacugcgacuc

SEQ ID NO: 3985843 - RNA, 21 nt, Human herpesvirus 6
auacagauguguauuauguaa

SEQ ID NO: 3985844 - RNA, 21 nt, Human herpesvirus 6
auacauuccuuaagaaugaaa

SEQ ID NO: 3985845 - RNA, 22 nt, Human herpesvirus 6
auacgaaccucaugaguguuua

SEQ ID NO: 3985846 - RNA, 23 nt, Human herpesvirus 6
auacgacaaauaaaagcauuuuu

SEQ ID NO: 3985847 - RNA, 17 nt, Human herpesvirus 6
auacggaagcugaaaaa

SEQ ID NO: 3985848 - RNA, 17 nt, Human herpesvirus 6
auacugaaguuaauagg

SEQ ID NO: 3985849 - RNA, 18 nt, Human herpesvirus 6
auacuguuguaaaauaua

SEQ ID NO: 3985850 - RNA, 20 nt, Human herpesvirus 6
auagaaaaaaauauuuugaa

SEQ ID NO: 3985851 - RNA, 22 nt, Human herpesvirus 6
auagaucuucggcgcugauucc

SEQ ID NO: 3985852 - RNA, 18 nt, Human herpesvirus 6
auauaaagagaccaauuu

SEQ ID NO: 3985853 - RNA, 15 nt, Human herpesvirus 6
auauauuugcauaca

SEQ ID NO: 3985854 - RNA, 22 nt, Human herpesvirus 6
auaucccgcguuagguguaaau

SEQ ID NO: 3985855 - RNA, 17 nt, Human herpesvirus 6
auauccuagcauuuccg

SEQ ID NO: 3985856 - RNA, 17 nt, Human herpesvirus 6
auaucguggaauggcug

SEQ ID NO: 3985857 - RNA, 22 nt, Human herpesvirus 6
auauuaaucguuacaaaauuga

SEQ ID NO: 3985858 - RNA, 22 nt, Human herpesvirus 6
auauuaauuacauauagucaau

SEQ ID NO: 3985859 - RNA, 18 nt, Human herpesvirus 6
auauuauuuucccacaga

SEQ ID NO: 3985860 - RNA, 16 nt, Human herpesvirus 6
auauuugccugccgac

SEQ ID NO: 3985861 - RNA, 20 nt, Human herpesvirus 6
aucaaaugauuuuacaaaga

SEQ ID NO: 3985862 - RNA, 19 nt, Human herpesvirus 6
aucacaccaauggucacac

SEQ ID NO: 3985863 - RNA, 18 nt, Human herpesvirus 6
aucaccaccaacacaccu

SEQ ID NO: 3985864 - RNA, 17 nt, Human herpesvirus 6
aucacuuagacacggcc

SEQ ID NO: 3985865 - RNA, 20 nt, Human herpesvirus 6
aucaucucgugcaaaagcug

SEQ ID NO: 3985866 - RNA, 18 nt, Human herpesvirus 6
aucaugcugugagagaau

SEQ ID NO: 3985867 - RNA, 14 nt, Human herpesvirus 6
aucauuguuugaau

SEQ ID NO: 3985868 - RNA, 15 nt, Human herpesvirus 6
auccaccuucccucc

SEQ ID NO: 3985869 - RNA, 18 nt, Human herpesvirus 6
aucgccccugucugugau

SEQ ID NO: 3985870 - RNA, 21 nt, Human herpesvirus 6
aucgcuuaaagcguuugcaaa

SEQ ID NO: 3985871 - RNA, 22 nt, Human herpesvirus 6
aucguuugagauucuuuaacuu

SEQ ID NO: 3985872 - RNA, 22 nt, Human herpesvirus 6
aucuaaauuucuacaaaaauac

SEQ ID NO: 3985873 - RNA, 19 nt, Human herpesvirus 6
aucuacugcaguccagaag

SEQ ID NO: 3985874 - RNA, 17 nt, Human herpesvirus 6
aucuauugucgaagaac

SEQ ID NO: 3985875 - RNA, 12 nt, Human herpesvirus 6
aucucuacuugu

SEQ ID NO: 3985876 - RNA, 24 nt, Human herpesvirus 6
aucuuauuaauuuccugaucacag

SEQ ID NO: 3985877 - RNA, 22 nt, Human herpesvirus 6
augaaaguccucaaacuuuuag

SEQ ID NO: 3985878 - RNA, 17 nt, Human herpesvirus 6
augacaccgauucagaa

SEQ ID NO: 3985879 - RNA, 15 nt, Human herpesvirus 6
augacgcggaaucua

SEQ ID NO: 3985880 - RNA, 22 nt, Human herpesvirus 6
augacuguacacaagagccgua

SEQ ID NO: 3985881 - RNA, 22 nt, Human herpesvirus 6
augagggggagggacccacagg

SEQ ID NO: 3985882 - RNA, 18 nt, Human herpesvirus 6
augaucgccgcuaggcag

SEQ ID NO: 3985883 - RNA, 21 nt, Human herpesvirus 6
augaucucacgucacaguuuu

SEQ ID NO: 3985884 - RNA, 21 nt, Human herpesvirus 6
augauuauaucgcaagcaaaa

SEQ ID NO: 3985885 - RNA, 18 nt, Human herpesvirus 6
augauuauucugucuuga

SEQ ID NO: 3985886 - RNA, 14 nt, Human herpesvirus 6
augcaauuuaaaag

SEQ ID NO: 3985887 - RNA, 13 nt, Human herpesvirus 6
augcauucacaag

SEQ ID NO: 3985888 - RNA, 19 nt, Human herpesvirus 6
augccccgguuaaaguaga

SEQ ID NO: 3985889 - RNA, 16 nt, Human herpesvirus 6
augccugcauaugcag

SEQ ID NO: 3985890 - RNA, 21 nt, Human herpesvirus 6
augcuacccacaugaaaucac

SEQ ID NO: 3985891 - RNA, 13 nt, Human herpesvirus 6
auggaaauucgcu

SEQ ID NO: 3985892 - RNA, 16 nt, Human herpesvirus 6
auggaauggaauuucu

SEQ ID NO: 3985893 - RNA, 16 nt, Human herpesvirus 6
auggcgucgaaguauu

SEQ ID NO: 3985894 - RNA, 16 nt, Human herpesvirus 6
augggugagugcauua

SEQ ID NO: 3985895 - RNA, 18 nt, Human herpesvirus 6
augguucgauugcgcgau

SEQ ID NO: 3985896 - RNA, 15 nt, Human herpesvirus 6
auguaaaaguuguga

SEQ ID NO: 3985897 - RNA, 20 nt, Human herpesvirus 6
auguaguuaaugcugcugcu

SEQ ID NO: 3985898 - RNA, 13 nt, Human herpesvirus 6
augucgguaaacu

SEQ ID NO: 3985899 - RNA, 13 nt, Human herpesvirus 6
augucuugccucu

SEQ ID NO: 3985900 - RNA, 22 nt, Human herpesvirus 6
auguucgaugauuauucugucu

SEQ ID NO: 3985901 - RNA, 18 nt, Human herpesvirus 6
auguugaaguauguacaa

SEQ ID NO: 3985902 - RNA, 17 nt, Human herpesvirus 6
auguuugggagaacuga

SEQ ID NO: 3985903 - RNA, 19 nt, Human herpesvirus 6
auguuuuucauaaauggua

SEQ ID NO: 3985904 - RNA, 14 nt, Human herpesvirus 6
auuaaaguuuacug

SEQ ID NO: 3985905 - RNA, 16 nt, Human herpesvirus 6
auuaaauauaccugaa

SEQ ID NO: 3985906 - RNA, 17 nt, Human herpesvirus 6
auuaaauguuacugaac

SEQ ID NO: 3985907 - RNA, 17 nt, Human herpesvirus 6
auuaacuguaaaaagug

SEQ ID NO: 3985908 - RNA, 14 nt, Human herpesvirus 6
auuaauaaaucgcu

SEQ ID NO: 3985909 - RNA, 13 nt, Human herpesvirus 6
auuacauuaucca

SEQ ID NO: 3985910 - RNA, 20 nt, Human herpesvirus 6
auuaccaccagaaaaguaua

SEQ ID NO: 3985911 - RNA, 19 nt, Human herpesvirus 6
auuaggggagagacaucca

SEQ ID NO: 3985912 - RNA, 22 nt, Human herpesvirus 6
auuauaaauguagcauacgaca

SEQ ID NO: 3985913 - RNA, 20 nt, Human herpesvirus 6
auuaucacaguugauaaaca

SEQ ID NO: 3985914 - RNA, 16 nt, Human herpesvirus 6
auucagagugaauucc

SEQ ID NO: 3985915 - RNA, 16 nt, Human herpesvirus 6
auucaggcuuuaacua

SEQ ID NO: 3985916 - RNA, 22 nt, Human herpesvirus 6
auucauauuauauuuaaaugaa

SEQ ID NO: 3985917 - RNA, 21 nt, Human herpesvirus 6
auuccacgugcuugucucaca

SEQ ID NO: 3985918 - RNA, 13 nt, Human herpesvirus 6
auucguuacaauc

SEQ ID NO: 3985919 - RNA, 16 nt, Human herpesvirus 6
auucguuuuuuuucuu

SEQ ID NO: 3985920 - RNA, 20 nt, Human herpesvirus 6
auucuaaauacgauauuaac

SEQ ID NO: 3985921 - RNA, 13 nt, Human herpesvirus 6
auucuaacgucug

SEQ ID NO: 3985922 - RNA, 19 nt, Human herpesvirus 6
auucugcauuuauaucaaa

SEQ ID NO: 3985923 - RNA, 19 nt, Human herpesvirus 6
auucuuaccaagaaaucau

SEQ ID NO: 3985924 - RNA, 15 nt, Human herpesvirus 6
auugguuaaaaggaa

SEQ ID NO: 3985925 - RNA, 14 nt, Human herpesvirus 6
auuguaaaagggaa

SEQ ID NO: 3985926 - RNA, 20 nt, Human herpesvirus 6
auuguacgauaauaaaaguu

SEQ ID NO: 3985927 - RNA, 17 nt, Human herpesvirus 6
auugucugauauggcaa

SEQ ID NO: 3985928 - RNA, 14 nt, Human herpesvirus 6
auugugacaaggaa

SEQ ID NO: 3985929 - RNA, 18 nt, Human herpesvirus 6
auuuaaacucgacuucuu

SEQ ID NO: 3985930 - RNA, 16 nt, Human herpesvirus 6
auuuaaccuuuucacu

SEQ ID NO: 3985931 - RNA, 18 nt, Human herpesvirus 6
auuucaagagaacaugau

SEQ ID NO: 3985932 - RNA, 17 nt, Human herpesvirus 6
auuucuuacuaggaaag

SEQ ID NO: 3985933 - RNA, 13 nt, Human herpesvirus 6
auuucuuguugag

SEQ ID NO: 3985934 - RNA, 16 nt, Human herpesvirus 6
auuuuaauuuugaaau

SEQ ID NO: 3985935 - RNA, 18 nt, Human herpesvirus 6
auuuuauaauacacuauu

SEQ ID NO: 3985936 - RNA, 18 nt, Human herpesvirus 6
auuuucaaauuuauuugu

SEQ ID NO: 3985937 - RNA, 15 nt, Human herpesvirus 6
auuuuuuauuuccac

SEQ ID NO: 3985938 - RNA, 23 nt, Human herpesvirus 6
auuuuuuuuuuauuuacaaaaaa

SEQ ID NO: 3985939 - RNA, 19 nt, Human herpesvirus 6
caaaacauaucgagccaaa

SEQ ID NO: 3985940 - RNA, 18 nt, Human herpesvirus 6
caaaagacacaaucuucg

SEQ ID NO: 3985941 - RNA, 21 nt, Human herpesvirus 6
caaaauugacuacagcugcag

SEQ ID NO: 3985942 - RNA, 14 nt, Human herpesvirus 6
caaaauugacuuac

SEQ ID NO: 3985943 - RNA, 11 nt, Human herpesvirus 6
uuucuuuggag

SEQ ID NO: 3985944 - RNA, 18 nt, Human herpesvirus 6
uuugaauaacaaacuaua

SEQ ID NO: 3985945 - RNA, 22 nt, Human herpesvirus 6
uuuguacacuuuaucgauguag

SEQ ID NO: 3985946 - RNA, 17 nt, Human herpesvirus 6
uuuguagcaaucuuaaa

SEQ ID NO: 3985947 - RNA, 19 nt, Human herpesvirus 6
uuuguguucagucuaugca

SEQ ID NO: 3985948 - RNA, 22 nt, Human herpesvirus 6
uuuuaagagugcaacaaaaagc

SEQ ID NO: 3985949 - RNA, 15 nt, Human herpesvirus 6
uuuuacaauacacag

SEQ ID NO: 3985950 - RNA, 17 nt, Human herpesvirus 6
uuuuaguuuuuagagaa

SEQ ID NO: 3985951 - RNA, 22 nt, Human herpesvirus 6
uuuuauuuccacguacuauuuu

SEQ ID NO: 3985952 - RNA, 12 nt, Human herpesvirus 6
uuuugaaaaggu

SEQ ID NO: 3985953 - RNA, 16 nt, Human herpesvirus 6
uuuugaagguaucaaa

SEQ ID NO: 3985954 - RNA, 22 nt, Human herpesvirus 6
uuuugugauuaacaaauuacaa

SEQ ID NO: 3985955 - RNA, 16 nt, Human herpesvirus 6
uuuuuaaucaugauug

SEQ ID NO: 3985956 - RNA, 19 nt, Human herpesvirus 6
uuuuuaaugcaaguuugaa

SEQ ID NO: 3985957 - RNA, 24 nt, Human herpesvirus 6
uuuuucucgagcuagagugacauc

SEQ ID NO: 3985958 - RNA, 21 nt, Human herpesvirus 6
uuuuucucguuccccaugucu

SEQ ID NO: 3985959 - RNA, 17 nt, Human herpesvirus 6
uuuuucuucaggugucu

SEQ ID NO: 3985960 - RNA, 17 nt, Human herpesvirus 6
uuuuugucggauuuaaa

SEQ ID NO: 3985961 - RNA, 15 nt, Human herpesvirus 6
uauuuacggacaaac

SEQ ID NO: 3985962 - RNA, 14 nt, Human herpesvirus 6
uauuuccugcccag

SEQ ID NO: 3985963 - RNA, 17 nt, Human herpesvirus 6
uauuuccugcccaggca

SEQ ID NO: 3985964 - RNA, 19 nt, Human herpesvirus 6
uauuuuuuuuuuauuuaca

SEQ ID NO: 3985965 - RNA, 17 nt, Human herpesvirus 6
ucaaagaaacaguaaau

SEQ ID NO: 3985966 - RNA, 17 nt, Human herpesvirus 6
ucaaaugaauuuauuuu

SEQ ID NO: 3985967 - RNA, 15 nt, Human herpesvirus 6
ucaaaugauuuuaca

SEQ ID NO: 3985968 - RNA, 21 nt, Human herpesvirus 6
ucaauaucaccuuacaaauaa

SEQ ID NO: 3985969 - RNA, 20 nt, Human herpesvirus 6
ucaaugcguuggagcaagcg

SEQ ID NO: 3985970 - RNA, 22 nt, Human herpesvirus 6
ucacaagcuguccaucuucaga

SEQ ID NO: 3985971 - RNA, 20 nt, Human herpesvirus 6
ucaccgauaaaaacucacac

SEQ ID NO: 3985972 - RNA, 16 nt, Human herpesvirus 6
ucacguauaccauucc

SEQ ID NO: 3985973 - RNA, 19 nt, Human herpesvirus 6
ucagaagagaugaaagaca

SEQ ID NO: 3985974 - RNA, 21 nt, Human herpesvirus 6
ucagaagagaugaaagacaga

SEQ ID NO: 3985975 - RNA, 13 nt, Human herpesvirus 6
ucagacauccaga

SEQ ID NO: 3985976 - RNA, 19 nt, Human herpesvirus 6
ucagauacugaucguuuuu

SEQ ID NO: 3985977 - RNA, 22 nt, Human herpesvirus 6
ucagauugcggacauggugaaa

SEQ ID NO: 3985978 - RNA, 18 nt, Human herpesvirus 6
ucagccugagaacgggca

SEQ ID NO: 3985979 - RNA, 20 nt, Human herpesvirus 6
ucauaaagauaaagaucagu

SEQ ID NO: 3985980 - RNA, 22 nt, Human herpesvirus 6
ucauaaucugcguuccucucuc

SEQ ID NO: 3985981 - RNA, 12 nt, Human herpesvirus 6
ucauaugucucg

SEQ ID NO: 3985982 - RNA, 15 nt, Human herpesvirus 6
ucaucacaaaguuua

SEQ ID NO: 3985983 - RNA, 15 nt, Human herpesvirus 6
ucaugauauuccaga

SEQ ID NO: 3985984 - RNA, 17 nt, Human herpesvirus 6
ucauuguuuuugcaugu

SEQ ID NO: 3985985 - RNA, 20 nt, Human herpesvirus 6
ucauuuguuuuuuaaagcac

SEQ ID NO: 3985986 - RNA, 15 nt, Human herpesvirus 6
uccaaccccucccau

SEQ ID NO: 3985987 - RNA, 17 nt, Human herpesvirus 6
uccagguagaguugcgu

SEQ ID NO: 3985988 - RNA, 14 nt, Human herpesvirus 6
uccaguauugaaga

SEQ ID NO: 3985989 - RNA, 17 nt, Human herpesvirus 6
uccaguauugaagaaaa

SEQ ID NO: 3985990 - RNA, 14 nt, Human herpesvirus 6
uccaucuucagaca

SEQ ID NO: 3985991 - RNA, 17 nt, Human herpesvirus 6
ucccccggaguacacgu

SEQ ID NO: 3985992 - RNA, 15 nt, Human herpesvirus 6
ucccggcccagagac

SEQ ID NO: 3985993 - RNA, 15 nt, Human herpesvirus 6
uccgacacgccccca

SEQ ID NO: 3985994 - RNA, 22 nt, Human herpesvirus 6
uccgcaucgggggaacuacaua

SEQ ID NO: 3985995 - RNA, 14 nt, Human herpesvirus 6
uccgcccuccccga

SEQ ID NO: 3985996 - RNA, 17 nt, Human herpesvirus 6
uccgccuuuucuuauau

SEQ ID NO: 3985997 - RNA, 16 nt, Human herpesvirus 6
uccgcgauacccagcg

SEQ ID NO: 3985998 - RNA, 14 nt, Human herpesvirus 6
uccggaguugcagu

SEQ ID NO: 3985999 - RNA, 16 nt, Human herpesvirus 6
uccgugacacacagaa

SEQ ID NO: 3986000 - RNA, 21 nt, Human herpesvirus 6
uccucaaacuuuuagagacuu

SEQ ID NO: 3986001 - RNA, 14 nt, Human herpesvirus 6
uccugagaguaaau

SEQ ID NO: 3986002 - RNA, 12 nt, Human herpesvirus 6
uccugcacaggc

SEQ ID NO: 3986003 - RNA, 13 nt, Human herpesvirus 6
uccugcacaggcg

SEQ ID NO: 3986004 - RNA, 18 nt, Human herpesvirus 6
uccuuaauucuaaauacg

SEQ ID NO: 3986005 - RNA, 15 nt, Human herpesvirus 6
ucgaaacgaaagcug

SEQ ID NO: 3986006 - RNA, 17 nt, Human herpesvirus 6
ucgaaacgaaagcugau

SEQ ID NO: 3986007 - RNA, 16 nt, Human herpesvirus 6
ucgaccauguguauau

SEQ ID NO: 3986008 - RNA, 19 nt, Human herpesvirus 6
ucgauuuaaccuuuucacu

SEQ ID NO: 3986009 - RNA, 22 nt, Human herpesvirus 6
ucgcccccauacacacccagca

SEQ ID NO: 3986010 - RNA, 22 nt, Human herpesvirus 6
ucgcgguccaacacagcaugca

SEQ ID NO: 3986011 - RNA, 20 nt, Human herpesvirus 6
ucgcuaaguguugacugauc

SEQ ID NO: 3986012 - RNA, 16 nt, Human herpesvirus 6
ucgggaacauagagaa

SEQ ID NO: 3986013 - RNA, 16 nt, Human herpesvirus 6
ucgguuaaaacaguaa

SEQ ID NO: 3986014 - RNA, 22 nt, Human herpesvirus 6
ucguacacgcauuugcaauugu

SEQ ID NO: 3986015 - RNA, 15 nt, Human herpesvirus 6
ucuaacaucucguaa

SEQ ID NO: 3986016 - RNA, 10 nt, Human herpesvirus 6
ucuacaaaaa

SEQ ID NO: 3986017 - RNA, 21 nt, Human herpesvirus 6
ucuacguaugaaaguccucaa

SEQ ID NO: 3986018 - RNA, 22 nt, Human herpesvirus 6
ucuacguaugaaaguccucaaa

SEQ ID NO: 3986019 - RNA, 14 nt, Human herpesvirus 6
ucuccauccucgaa

SEQ ID NO: 3986020 - RNA, 15 nt, Human herpesvirus 6
ucuccauucuucgaa

SEQ ID NO: 3986021 - RNA, 20 nt, Human herpesvirus 6
ucucgugguacaauaaaaac

SEQ ID NO: 3986022 - RNA, 22 nt, Human herpesvirus 6
ucucucaguaauuuguguaauu

SEQ ID NO: 3986023 - RNA, 14 nt, Human herpesvirus 6
ucucucgaugaaag

SEQ ID NO: 3986024 - RNA, 16 nt, Human herpesvirus 6
ucucugacuauuucaa

SEQ ID NO: 3986025 - RNA, 22 nt, Human herpesvirus 6
ucucuguguguguugugcgcua

SEQ ID NO: 3986026 - RNA, 16 nt, Human herpesvirus 6
ucugaagcaaaagucu

SEQ ID NO: 3986027 - RNA, 16 nt, Human herpesvirus 6
ucugaauuuaaugcaa

SEQ ID NO: 3986028 - RNA, 16 nt, Human herpesvirus 6
ucugacauggaagaca

SEQ ID NO: 3986029 - RNA, 21 nt, Human herpesvirus 6
ucugagguuuccgucucgccu

SEQ ID NO: 3986030 - RNA, 20 nt, Human herpesvirus 6
ucugcauaguguagaaaaca

SEQ ID NO: 3986031 - RNA, 22 nt, Human herpesvirus 6
ucugcauuuauaucaaacuuuu

SEQ ID NO: 3986032 - RNA, 21 nt, Human herpesvirus 6
ucugcuauuuuuuuuaauguu

SEQ ID NO: 3986033 - RNA, 16 nt, Human herpesvirus 6
ucuggugaauguuucu

SEQ ID NO: 3986034 - RNA, 19 nt, Human herpesvirus 6
ucuguauuuuucuuugcag

SEQ ID NO: 3986035 - RNA, 14 nt, Human herpesvirus 6
ucuuacaauguuuu

SEQ ID NO: 3986036 - RNA, 16 nt, Human herpesvirus 6
ucuucaagcaaagaca

SEQ ID NO: 3986037 - RNA, 18 nt, Human herpesvirus 6
ucuucguacguacuacag

SEQ ID NO: 3986038 - RNA, 16 nt, Human herpesvirus 6
ucuugguuguguauau

SEQ ID NO: 3986039 - RNA, 18 nt, Human herpesvirus 6
ucuuuauaaacuuaaaac

SEQ ID NO: 3986040 - RNA, 13 nt, Human herpesvirus 6
ugaaagcagucag

SEQ ID NO: 3986041 - RNA, 14 nt, Human herpesvirus 6
ugaaauaaaguuua

SEQ ID NO: 3986042 - RNA, 13 nt, Human herpesvirus 6
ugaagaugacagc

SEQ ID NO: 3986043 - RNA, 23 nt, Human herpesvirus 6
ugaauggaguaaauuaaaguuua

SEQ ID NO: 3986044 - RNA, 18 nt, Human herpesvirus 6
ugaauucucauuugaaag

SEQ ID NO: 3986045 - RNA, 18 nt, Human herpesvirus 6
ugacaacaaaggagugag

SEQ ID NO: 3986046 - RNA, 16 nt, Human herpesvirus 6
ugacacacagaauaca

SEQ ID NO: 3986047 - RNA, 21 nt, Human herpesvirus 6
ugacacgggucgggggucugc

SEQ ID NO: 3986048 - RNA, 14 nt, Human herpesvirus 6
ugacaguucgagcc

SEQ ID NO: 3986049 - RNA, 22 nt, Human herpesvirus 6
ugacggcgacaaccgccgccgc

SEQ ID NO: 3986050 - RNA, 22 nt, Human herpesvirus 6
ugacucuucucuaaaaacuaaa

SEQ ID NO: 3986051 - RNA, 23 nt, Human herpesvirus 6
ugauaccgaaaucuccugagaag

SEQ ID NO: 3986052 - RNA, 15 nt, Human herpesvirus 6
ugaucuuuacaaaag

SEQ ID NO: 3986053 - RNA, 17 nt, Human herpesvirus 6
ugauggcagguaaccaa

SEQ ID NO: 3986054 - RNA, 20 nt, Human herpesvirus 6
ugauguggacguucugucug

SEQ ID NO: 3986055 - RNA, 11 nt, Human herpesvirus 6
ugauuaacaaa

SEQ ID NO: 3986056 - RNA, 20 nt, Human herpesvirus 6
ugauuaacaaauuacaauca

SEQ ID NO: 3986057 - RNA, 17 nt, Human herpesvirus 6
ugauuauauauuugcau

SEQ ID NO: 3986058 - RNA, 15 nt, Human herpesvirus 6
ugauuauucugucuu

SEQ ID NO: 3986059 - RNA, 17 nt, Human herpesvirus 6
ugauugucuuuucugga

SEQ ID NO: 3986060 - RNA, 18 nt, Human herpesvirus 6
ugauugugacaaggaaug

SEQ ID NO: 3986061 - RNA, 21 nt, Human herpesvirus 6
ugcaagccaugacaagaaagg

SEQ ID NO: 3986062 - RNA, 10 nt, Human herpesvirus 6
ugcacaggcg

SEQ ID NO: 3986063 - RNA, 20 nt, Human herpesvirus 6
ugcauacauaaauuauuuuu

SEQ ID NO: 3986064 - RNA, 21 nt, Human herpesvirus 6
ugcauuauacgugucggugau

SEQ ID NO: 3986065 - RNA, 13 nt, Human herpesvirus 6
ugccaaaggaaac

SEQ ID NO: 3986066 - RNA, 16 nt, Human herpesvirus 6
ugccaccgucugggac

SEQ ID NO: 3986067 - RNA, 19 nt, Human herpesvirus 6
ugccauaauuucuguuuug

SEQ ID NO: 3986068 - RNA, 19 nt, Human herpesvirus 6
ugcccacaccaucuucagc

SEQ ID NO: 3986069 - RNA, 14 nt, Human herpesvirus 6
ugcuccggggaggg

SEQ ID NO: 3986070 - RNA, 18 nt, Human herpesvirus 6
ugcuccguuuccuccucg

SEQ ID NO: 3986071 - RNA, 13 nt, Human herpesvirus 6
ugcucgcauuucu

SEQ ID NO: 3986072 - RNA, 13 nt, Human herpesvirus 6
ugcuguuuucacc

SEQ ID NO: 3986073 - RNA, 23 nt, Human herpesvirus 6
uggaaaacgacacagaacacauc

SEQ ID NO: 3986074 - RNA, 23 nt, Human herpesvirus 6
uggagagaacugucuugcagcug

SEQ ID NO: 3986075 - RNA, 15 nt, Human herpesvirus 6
uggagggaauuguau

SEQ ID NO: 3986076 - RNA, 15 nt, Human herpesvirus 6
uggauaaaacggcgu

SEQ ID NO: 3986077 - RNA, 17 nt, Human herpesvirus 6
uggauggauaaaauuga

SEQ ID NO: 3986078 - RNA, 19 nt, Human herpesvirus 6
uggauggauaaaauugaug

SEQ ID NO: 3986079 - RNA, 16 nt, Human herpesvirus 6
uggaugugcacuuucu

SEQ ID NO: 3986080 - RNA, 18 nt, Human herpesvirus 6
uggcacggugccaaagga

SEQ ID NO: 3986081 - RNA, 13 nt, Human herpesvirus 6
uggcagguaacca

SEQ ID NO: 3986082 - RNA, 20 nt, Human herpesvirus 6
uggcggaaacgacggaacga

SEQ ID NO: 3986083 - RNA, 22 nt, Human herpesvirus 6
ugggacccacgguggccuggca

SEQ ID NO: 3986084 - RNA, 14 nt, Human herpesvirus 6
ugggggucuuuccu

SEQ ID NO: 3986085 - RNA, 13 nt, Human herpesvirus 6
uggggucuuuccu

SEQ ID NO: 3986086 - RNA, 15 nt, Human herpesvirus 6
uggguacaaugaaaa

SEQ ID NO: 3986087 - RNA, 14 nt, Human herpesvirus 6
uggugguaauuuag

SEQ ID NO: 3986088 - RNA, 18 nt, Human herpesvirus 6
uguaauaguauugucuga

SEQ ID NO: 3986089 - RNA, 19 nt, Human herpesvirus 6
uguacaauauaauuucuua

SEQ ID NO: 3986090 - RNA, 23 nt, Human herpesvirus 6
uguauauugaauuguauauauag

SEQ ID NO: 3986091 - RNA, 12 nt, Human herpesvirus 6
uguauuauguaa

SEQ ID NO: 3986092 - RNA, 13 nt, Human herpesvirus 6
ugucaaguuucac

SEQ ID NO: 3986093 - RNA, 23 nt, Human herpesvirus 6
ugucagauacugaucguuuuuua

SEQ ID NO: 3986094 - RNA, 16 nt, Human herpesvirus 6
ugucaucaugugugcc

SEQ ID NO: 3986095 - RNA, 14 nt, Human herpesvirus 6
uguccaucuucaga

SEQ ID NO: 3986096 - RNA, 16 nt, Human herpesvirus 6
ugucggccgugaugca

SEQ ID NO: 3986097 - RNA, 12 nt, Human herpesvirus 6
ugucuuagugua

SEQ ID NO: 3986098 - RNA, 18 nt, Human herpesvirus 6
ugugauucaguaucuguu

SEQ ID NO: 3986099 - RNA, 13 nt, Human herpesvirus 6
uguguauuguaaa

SEQ ID NO: 3986100 - RNA, 14 nt, Human herpesvirus 6
uguguuauaaggaa

SEQ ID NO: 3986101 - RNA, 13 nt, Human herpesvirus 6
uguguucaagaac

SEQ ID NO: 3986102 - RNA, 19 nt, Human herpesvirus 6
uguugaguaauugaacauu

SEQ ID NO: 3986103 - RNA, 14 nt, Human herpesvirus 6
uguuuccugcccag

SEQ ID NO: 3986104 - RNA, 20 nt, Human herpesvirus 6
uguuugggagaacugaggac

SEQ ID NO: 3986105 - RNA, 19 nt, Human herpesvirus 6
uuaaaagaauuuuuguagc

SEQ ID NO: 3986106 - RNA, 12 nt, Human herpesvirus 6
uuaaaagucagu

SEQ ID NO: 3986107 - RNA, 15 nt, Human herpesvirus 6
uuaaaauagaagucu

SEQ ID NO: 3986108 - RNA, 15 nt, Human herpesvirus 6
uuaaacaacacagca

SEQ ID NO: 3986109 - RNA, 15 nt, Human herpesvirus 6
uuaaauccuguuuug

SEQ ID NO: 3986110 - RNA, 20 nt, Human herpesvirus 6
uuaacuaagauugugcaguu

SEQ ID NO: 3986111 - RNA, 22 nt, Human herpesvirus 6
uuaacuagguagcguacaaguc

SEQ ID NO: 3986112 - RNA, 20 nt, Human herpesvirus 6
uuaagcaacugauuaagauu

SEQ ID NO: 3986113 - RNA, 17 nt, Human herpesvirus 6
uuaaguccguuuggaga

SEQ ID NO: 3986114 - RNA, 16 nt, Human herpesvirus 6
uuaauacaaaauuuga

SEQ ID NO: 3986115 - RNA, 15 nt, Human herpesvirus 6
uuaauccauauuugg

SEQ ID NO: 3986116 - RNA, 19 nt, Human herpesvirus 6
uuaaugaaugugcuuugga

SEQ ID NO: 3986117 - RNA, 16 nt, Human herpesvirus 6
uuaauucuuaaagcgu

SEQ ID NO: 3986118 - RNA, 15 nt, Human herpesvirus 6
uuacaauacacagaa

SEQ ID NO: 3986119 - RNA, 20 nt, Human herpesvirus 6
uuacacaccuuaaacaugua

SEQ ID NO: 3986120 - RNA, 13 nt, Human herpesvirus 6
uuacagauacaua

SEQ ID NO: 3986121 - RNA, 12 nt, Human herpesvirus 6
uuacauaacaua

SEQ ID NO: 3986122 - RNA, 15 nt, Human herpesvirus 6
uuacauauacauuug

SEQ ID NO: 3986123 - RNA, 19 nt, Human herpesvirus 6
uuaccuaucguccuuaaua

SEQ ID NO: 3986124 - RNA, 15 nt, Human herpesvirus 6
uuagaacaauuauca

SEQ ID NO: 3986125 - RNA, 19 nt, Human herpesvirus 6
uuagacuuggugaugauga

SEQ ID NO: 3986126 - RNA, 16 nt, Human herpesvirus 6
uuauaagauuuacaga

SEQ ID NO: 3986127 - RNA, 16 nt, Human herpesvirus 6
uuauauucuucuguaa

SEQ ID NO: 3986128 - RNA, 15 nt, Human herpesvirus 6
uuauuaacaaugaaa

SEQ ID NO: 3986129 - RNA, 20 nt, Human herpesvirus 6
uuauucggaguuuucaagau

SEQ ID NO: 3986130 - RNA, 21 nt, Human herpesvirus 6
uucaaaaaucgaaaucguaua

SEQ ID NO: 3986131 - RNA, 22 nt, Human herpesvirus 6
uucaaaagaguuacuagcaguu

SEQ ID NO: 3986132 - RNA, 23 nt, Human herpesvirus 6
uucaacauccuauugagauucuc

SEQ ID NO: 3986133 - RNA, 23 nt, Human herpesvirus 6
uucaagauuguguuucugucuuu

SEQ ID NO: 3986134 - RNA, 19 nt, Human herpesvirus 6
uucacugaccguuguaaga

SEQ ID NO: 3986135 - RNA, 19 nt, Human herpesvirus 6
uucagaagagaugaaagac

SEQ ID NO: 3986136 - RNA, 22 nt, Human herpesvirus 6
uucagaccucauauaagaacca

SEQ ID NO: 3986137 - RNA, 22 nt, Human herpesvirus 6
uucagguucuucaaaaaaagaa

SEQ ID NO: 3986138 - RNA, 13 nt, Human herpesvirus 6
uucaguaucuguu

SEQ ID NO: 3986139 - RNA, 17 nt, Human herpesvirus 6
uucaguaucuguuuuua

SEQ ID NO: 3986140 - RNA, 21 nt, Human herpesvirus 6
uucauaaagauaaagaucagu

SEQ ID NO: 3986141 - RNA, 23 nt, Human herpesvirus 6
uucaucaaucacucccuguuuuu

SEQ ID NO: 3986142 - RNA, 17 nt, Human herpesvirus 6
uuccacguacuauuuuu

SEQ ID NO: 3986143 - RNA, 18 nt, Human herpesvirus 6
uuccccacaauaagaaaa

SEQ ID NO: 3986144 - RNA, 11 nt, Human herpesvirus 6
uucccucccac

SEQ ID NO: 3986145 - RNA, 12 nt, Human herpesvirus 6
uuccgaaaucaa

SEQ ID NO: 3986146 - RNA, 12 nt, Human herpesvirus 6
uuccugcacagg

SEQ ID NO: 3986147 - RNA, 20 nt, Human herpesvirus 6
uuccuuauaacacacagcua

SEQ ID NO: 3986148 - RNA, 19 nt, Human herpesvirus 6
uucgaauucuuaccaagaa

SEQ ID NO: 3986149 - RNA, 16 nt, Human herpesvirus 6
uucgauguuuucaggu

SEQ ID NO: 3986150 - RNA, 17 nt, Human herpesvirus 6
uucgcaaaaacguuuuu

SEQ ID NO: 3986151 - RNA, 13 nt, Human herpesvirus 6
uucgcuucuuaua

SEQ ID NO: 3986152 - RNA, 15 nt, Human herpesvirus 6
uucuauguacuuauu

SEQ ID NO: 3986153 - RNA, 12 nt, Human herpesvirus 6
uucuaugucuag

SEQ ID NO: 3986154 - RNA, 18 nt, Human herpesvirus 6
uucuccuaccauguugcu

SEQ ID NO: 3986155 - RNA, 23 nt, Human herpesvirus 6
uucucggaaaauuaaaagucagu

SEQ ID NO: 3986156 - RNA, 13 nt, Human herpesvirus 6
uucugaccagcaa

SEQ ID NO: 3986157 - RNA, 16 nt, Human herpesvirus 6
uucuguaauuuugaaa

SEQ ID NO: 3986158 - RNA, 23 nt, Human herpesvirus 6
uucuuaacucaucgacuucuguc

SEQ ID NO: 3986159 - RNA, 13 nt, Human herpesvirus 6
uucuucugugacu

SEQ ID NO: 3986160 - RNA, 21 nt, Human herpesvirus 6
uucuuguugaguuucagcaga

SEQ ID NO: 3986161 - RNA, 12 nt, Human herpesvirus 6
aaaaaaacacag

SEQ ID NO: 3986162 - RNA, 16 nt, Human herpesvirus 6
aaaaacguuuuuguua

SEQ ID NO: 3986163 - RNA, 13 nt, Human herpesvirus 6
aaaaacucacaca

SEQ ID NO: 3986164 - RNA, 15 nt, Human herpesvirus 6
aaaaaguauccuaaa

SEQ ID NO: 3986165 - RNA, 13 nt, Human herpesvirus 6
aaaaaucagaauc

SEQ ID NO: 3986166 - RNA, 19 nt, Human herpesvirus 6
aaaacacagacggauucaa

SEQ ID NO: 3986167 - RNA, 20 nt, Human herpesvirus 6
aaaacuccccucauuuucaa

SEQ ID NO: 3986168 - RNA, 15 nt, Human herpesvirus 6
aaaauaaguacauag

SEQ ID NO: 3986169 - RNA, 23 nt, Human herpesvirus 6
aaaaucaucucgugcaaaagcug

SEQ ID NO: 3986170 - RNA, 12 nt, Human herpesvirus 6
aaaaucucaaac

SEQ ID NO: 3986171 - RNA, 17 nt, Human herpesvirus 6
aaaauuuuauaaugagu

SEQ ID NO: 3986172 - RNA, 23 nt, Human herpesvirus 6
aaacaccucuaaaacaagacaga

SEQ ID NO: 3986173 - RNA, 19 nt, Human herpesvirus 6
aaacagacuuuacuucuac

SEQ ID NO: 3986174 - RNA, 20 nt, Human herpesvirus 6
aaaccaaagcauacucaacc

SEQ ID NO: 3986175 - RNA, 13 nt, Human herpesvirus 6
aaacggccaaccu

SEQ ID NO: 3986176 - RNA, 12 nt, Human herpesvirus 6
aaagaacaugug

SEQ ID NO: 3986177 - RNA, 15 nt, Human herpesvirus 6
aaagaagauuuuccu

SEQ ID NO: 3986178 - RNA, 16 nt, Human herpesvirus 6
aaagaucgcuuuugaa

SEQ ID NO: 3986179 - RNA, 23 nt, Human herpesvirus 6
aaagauuagauuaggggagagac

SEQ ID NO: 3986180 - RNA, 14 nt, Human herpesvirus 6
aaagcagaucgagu

SEQ ID NO: 3986181 - RNA, 20 nt, Human herpesvirus 6
aaagcaucucaaaaaacaua

SEQ ID NO: 3986182 - RNA, 13 nt, Human herpesvirus 6
aaagcgccugccu

SEQ ID NO: 3986183 - RNA, 18 nt, Human herpesvirus 6
aaagcugacuauucaggc

SEQ ID NO: 3986184 - RNA, 12 nt, Human herpesvirus 6
aaaggauguuug

SEQ ID NO: 3986185 - RNA, 13 nt, Human herpesvirus 6
aaaguuuaaagau

SEQ ID NO: 3986186 - RNA, 15 nt, Human herpesvirus 6
aaauaacucagauuc

SEQ ID NO: 3986187 - RNA, 22 nt, Human herpesvirus 6
aaauaauuuuauuaacuguaaa

SEQ ID NO: 3986188 - RNA, 24 nt, Human herpesvirus 6
aaaucaaacucaccgcauauauca

SEQ ID NO: 3986189 - RNA, 13 nt, Human herpesvirus 6
aaaugaauguguu

SEQ ID NO: 3986190 - RNA, 13 nt, Human herpesvirus 6
aaaugcacuguuu

SEQ ID NO: 3986191 - RNA, 21 nt, Human herpesvirus 6
aacaacuuuuuagcuuuuuaa

SEQ ID NO: 3986192 - RNA, 11 nt, Human herpesvirus 6
aacaaguaaau

SEQ ID NO: 3986193 - RNA, 22 nt, Human herpesvirus 6
aacaauauagaagacgcaaaga

SEQ ID NO: 3986194 - RNA, 14 nt, Human herpesvirus 6
aacacagcacauaa

SEQ ID NO: 3986195 - RNA, 15 nt, Human herpesvirus 6
aacagauaguguuuu

SEQ ID NO: 3986196 - RNA, 19 nt, Human herpesvirus 6
aacagauaguguuuucuga

SEQ ID NO: 3986197 - RNA, 17 nt, Human herpesvirus 6
aacagucugacauggaa

SEQ ID NO: 3986198 - RNA, 14 nt, Human herpesvirus 6
aacaucugcuaacg

SEQ ID NO: 3986199 - RNA, 20 nt, Human herpesvirus 6
aaccgguacgcuuuuacuga

SEQ ID NO: 3986200 - RNA, 15 nt, Human herpesvirus 6
aaccuugacagauau

SEQ ID NO: 3986201 - RNA, 22 nt, Human herpesvirus 6
aacgagaacucuaaaaucucgu

SEQ ID NO: 3986202 - RNA, 22 nt, Human herpesvirus 6
aacgagaacucuaacaucucgu

SEQ ID NO: 3986203 - RNA, 15 nt, Human herpesvirus 6
aacgauaugucucug

SEQ ID NO: 3986204 - RNA, 17 nt, Human herpesvirus 6
aacgcaagucacgggca

SEQ ID NO: 3986205 - RNA, 18 nt, Human herpesvirus 6
aacgcagacuaauccaua

SEQ ID NO: 3986206 - RNA, 19 nt, Human herpesvirus 6
aacgcgucaacaaacaauu

SEQ ID NO: 3986207 - RNA, 15 nt, Human herpesvirus 6
aacggagagcuuguu

SEQ ID NO: 3986208 - RNA, 18 nt, Human herpesvirus 6
aacuaaaagucagugggu

SEQ ID NO: 3986209 - RNA, 17 nt, Human herpesvirus 6
aacuaagauugugcagu

SEQ ID NO: 3986210 - RNA, 21 nt, Human herpesvirus 6
aacuacugagugcgaccuguc

SEQ ID NO: 3986211 - RNA, 23 nt, Human herpesvirus 6
aacucauguugccucuggacacg

SEQ ID NO: 3986212 - RNA, 12 nt, Human herpesvirus 6
aacucuaccugg

SEQ ID NO: 3986213 - RNA, 14 nt, Human herpesvirus 6
aacugaauuugcau

SEQ ID NO: 3986214 - RNA, 19 nt, Human herpesvirus 6
aacugccaauuaccgguaa

SEQ ID NO: 3986215 - RNA, 15 nt, Human herpesvirus 6
aacugcuggcugaga

SEQ ID NO: 3986216 - RNA, 16 nt, Human herpesvirus 6
aacugugucuguucaa

SEQ ID NO: 3986217 - RNA, 13 nt, Human herpesvirus 6
aacuuuuaaaaca

SEQ ID NO: 3986218 - RNA, 21 nt, Human herpesvirus 6
aagaaaaagcagcagaugcuu

SEQ ID NO: 3986219 - RNA, 16 nt, Human herpesvirus 6
aagaaacauuauaccu

SEQ ID NO: 3986220 - RNA, 23 nt, Human herpesvirus 6
uagggauacguauauuguguacc

SEQ ID NO: 3986221 - RNA, 18 nt, Human herpesvirus 6
uaggugauugggagcuca

SEQ ID NO: 3986222 - RNA, 21 nt, Human herpesvirus 6
uauaaaaaaagcaaauacuau

SEQ ID NO: 3986223 - RNA, 12 nt, Human herpesvirus 6
uauaaaaacuaa

SEQ ID NO: 3986224 - RNA, 13 nt, Human herpesvirus 6
uauaaauacugaa

SEQ ID NO: 3986225 - RNA, 20 nt, Human herpesvirus 6
uauaaauccgauagccauac

SEQ ID NO: 3986226 - RNA, 19 nt, Human herpesvirus 6
uauaagaacuggugucugu

SEQ ID NO: 3986227 - RNA, 17 nt, Human herpesvirus 6
uauauucgaauguugaa

SEQ ID NO: 3986228 - RNA, 16 nt, Human herpesvirus 6
uauauuggaauuggga

SEQ ID NO: 3986229 - RNA, 18 nt, Human herpesvirus 6
uauauugggggaaaauac

SEQ ID NO: 3986230 - RNA, 14 nt, Human herpesvirus 6
uaucacucauacac

SEQ ID NO: 3986231 - RNA, 23 nt, Human herpesvirus 6
uaucagcacccuaugcaagcuca

SEQ ID NO: 3986232 - RNA, 23 nt, Human herpesvirus 6
uaucgcaagcaaaacacagacgg

SEQ ID NO: 3986233 - RNA, 21 nt, Human herpesvirus 6
uaucucaaauuuuccaaacau

SEQ ID NO: 3986234 - RNA, 17 nt, Human herpesvirus 6
uaucuuuuucuguguuu

SEQ ID NO: 3986235 - RNA, 20 nt, Human herpesvirus 6
uaugaacaggugcuucuuuu

SEQ ID NO: 3986236 - RNA, 20 nt, Human herpesvirus 6
uaugcuaagcagaacggcgg

SEQ ID NO: 3986237 - RNA, 18 nt, Human herpesvirus 6
uaugugcgcguguuagaa

SEQ ID NO: 3986238 - RNA, 16 nt, Human herpesvirus 6
uauucagaggugcuga

SEQ ID NO: 3986239 - RNA, 16 nt, Human herpesvirus 6
uauucucggucuugcu

SEQ ID NO: 3986240 - RNA, 23 nt, Human herpesvirus 6
uauugccgcuucuauauaucaua

SEQ ID NO: 3986241 - RNA, 20 nt, Human herpesvirus 6
uauuguuaacauguacaaac

SEQ ID NO: 3986242 - RNA, 18 nt, Human herpesvirus 6
uauuuucgguguguauuu

SEQ ID NO: 3986243 - RNA, 18 nt, Human herpesvirus 6
ucaaacaccucacaaucu

SEQ ID NO: 3986244 - RNA, 16 nt, Human herpesvirus 6
ucaaaccgcagagcaa

SEQ ID NO: 3986245 - RNA, 20 nt, Human herpesvirus 6
ucacacccauggcgagaaac

SEQ ID NO: 3986246 - RNA, 16 nt, Human herpesvirus 6
ucacauguucuuuauu

SEQ ID NO: 3986247 - RNA, 19 nt, Human herpesvirus 6
ucacguuuugggaaaucug

SEQ ID NO: 3986248 - RNA, 23 nt, Human herpesvirus 6
ucacuccaauccaacgaauacuu

SEQ ID NO: 3986249 - RNA, 18 nt, Human herpesvirus 6
ucagaaauaaaauuucga

SEQ ID NO: 3986250 - RNA, 14 nt, Human herpesvirus 6
ucagaauccaccaa

SEQ ID NO: 3986251 - RNA, 15 nt, Human herpesvirus 6
ucagaccucauauaa

SEQ ID NO: 3986252 - RNA, 15 nt, Human herpesvirus 6
ucagagugaauuccu

SEQ ID NO: 3986253 - RNA, 15 nt, Human herpesvirus 6
ucagauuuggagaaa

SEQ ID NO: 3986254 - RNA, 18 nt, Human herpesvirus 6
ucaucaaauccucuacgu

SEQ ID NO: 3986255 - RNA, 12 nt, Human herpesvirus 6
ucaucaguuucc

SEQ ID NO: 3986256 - RNA, 17 nt, Human herpesvirus 6
ucauuagcauacagaug

SEQ ID NO: 3986257 - RNA, 16 nt, Human herpesvirus 6
uccaauccaauauaac

SEQ ID NO: 3986258 - RNA, 11 nt, Human herpesvirus 6
uccaauccuau

SEQ ID NO: 3986259 - RNA, 13 nt, Human herpesvirus 6
uccaccccucuuc

SEQ ID NO: 3986260 - RNA, 20 nt, Human herpesvirus 6
uccagaggcguggaaagacg

SEQ ID NO: 3986261 - RNA, 20 nt, Human herpesvirus 6
uccaggucuuauauuucaga

SEQ ID NO: 3986262 - RNA, 19 nt, Human herpesvirus 6
uccagugagaacguauaaa

SEQ ID NO: 3986263 - RNA, 23 nt, Human herpesvirus 6
uccccucgguccaaccccuccca

SEQ ID NO: 3986264 - RNA, 17 nt, Human herpesvirus 6
uccgcauaucgccccca

SEQ ID NO: 3986265 - RNA, 18 nt, Human herpesvirus 6
uccgccuguuccacgcgc

SEQ ID NO: 3986266 - RNA, 15 nt, Human herpesvirus 6
uccggccccagagac

SEQ ID NO: 3986267 - RNA, 19 nt, Human herpesvirus 6
uccggcugagcggagugga

SEQ ID NO: 3986268 - RNA, 12 nt, Human herpesvirus 6
uccgucauacaa

SEQ ID NO: 3986269 - RNA, 19 nt, Human herpesvirus 6
uccguuuuucucugcaaaa

SEQ ID NO: 3986270 - RNA, 13 nt, Human herpesvirus 6
uccuauugguuug

SEQ ID NO: 3986271 - RNA, 18 nt, Human herpesvirus 6
uccuccccuguccccucg

SEQ ID NO: 3986272 - RNA, 17 nt, Human herpesvirus 6
uccugggagcucucccu

SEQ ID NO: 3986273 - RNA, 23 nt, Human herpesvirus 6
uccuguuuucccaccuaauaaac

SEQ ID NO: 3986274 - RNA, 23 nt, Human herpesvirus 6
uccuucaugauauuccagacaau

SEQ ID NO: 3986275 - RNA, 19 nt, Human herpesvirus 6
ucgaaaguucaucuuucaa

SEQ ID NO: 3986276 - RNA, 14 nt, Human herpesvirus 6
ucgcgauagucaug

SEQ ID NO: 3986277 - RNA, 16 nt, Human herpesvirus 6
ucgcgauagucaugca

SEQ ID NO: 3986278 - RNA, 22 nt, Human herpesvirus 6
ucgcgcgcgacgugccaccguc

SEQ ID NO: 3986279 - RNA, 22 nt, Human herpesvirus 6
ucgcgcgcgcgggcccuccucg

SEQ ID NO: 3986280 - RNA, 14 nt, Human herpesvirus 6
ucgcggaguggagu

SEQ ID NO: 3986281 - RNA, 14 nt, Human herpesvirus 6
ucgcugacucgccu

SEQ ID NO: 3986282 - RNA, 15 nt, Human herpesvirus 6
ucggccgugaugcac

SEQ ID NO: 3986283 - RNA, 15 nt, Human herpesvirus 6
ucggcugacaacaaa

SEQ ID NO: 3986284 - RNA, 23 nt, Human herpesvirus 6
ucgggaacauagagaaacgagag

SEQ ID NO: 3986285 - RNA, 14 nt, Human herpesvirus 6
ucgggagaggacca

SEQ ID NO: 3986286 - RNA, 18 nt, Human herpesvirus 6
ucguauaaauuuaacuaa

SEQ ID NO: 3986287 - RNA, 11 nt, Human herpesvirus 6
ucgucuccugg

SEQ ID NO: 3986288 - RNA, 15 nt, Human herpesvirus 6
ucuaaaaggcucugu

SEQ ID NO: 3986289 - RNA, 20 nt, Human herpesvirus 6
ucuaaaauuguaauuuugaa

SEQ ID NO: 3986290 - RNA, 16 nt, Human herpesvirus 6
ucuaaauuggucucuu

SEQ ID NO: 3986291 - RNA, 21 nt, Human herpesvirus 6
ucuaccgagagauuuacuguu

SEQ ID NO: 3986292 - RNA, 21 nt, Human herpesvirus 6
ucuacugcaguccagaagucc

SEQ ID NO: 3986293 - RNA, 16 nt, Human herpesvirus 6
ucucgaaaaaacaacg

SEQ ID NO: 3986294 - RNA, 23 nt, Human herpesvirus 6
ucucggcgccggugguaccuguc

SEQ ID NO: 3986295 - RNA, 17 nt, Human herpesvirus 6
ucuucgauccaauaaga

SEQ ID NO: 3986296 - RNA, 23 nt, Human herpesvirus 6
ucuugaaaaaccuuauacagaug

SEQ ID NO: 3986297 - RNA, 20 nt, Human herpesvirus 6
ucuugggacuaggaauacgu

SEQ ID NO: 3986298 - RNA, 23 nt, Human herpesvirus 6
ucuuuauagagcaacucaucaaa

SEQ ID NO: 3986299 - RNA, 15 nt, Human herpesvirus 6
ucuuuauuaaauguu

SEQ ID NO: 3986300 - RNA, 16 nt, Human herpesvirus 6
ugaaaauaucauuaaa

SEQ ID NO: 3986301 - RNA, 17 nt, Human herpesvirus 6
ugaaacuccccagagaa

SEQ ID NO: 3986302 - RNA, 19 nt, Human herpesvirus 6
ugaaagacagaggaaauaa

SEQ ID NO: 3986303 - RNA, 17 nt, Human herpesvirus 6
ugaacgcacuggacauc

SEQ ID NO: 3986304 - RNA, 16 nt, Human herpesvirus 6
ugaacuacugagugcg

SEQ ID NO: 3986305 - RNA, 21 nt, Human herpesvirus 6
ugaacuggcgcgcauguugca

SEQ ID NO: 3986306 - RNA, 18 nt, Human herpesvirus 6
ugaagaaccugaaaucug

SEQ ID NO: 3986307 - RNA, 20 nt, Human herpesvirus 6
ugaauacgaggaggggagac

SEQ ID NO: 3986308 - RNA, 22 nt, Human herpesvirus 6
ugaaugcauaccgccuccgcag

SEQ ID NO: 3986309 - RNA, 15 nt, Human herpesvirus 6
ugaauguguucacag

SEQ ID NO: 3986310 - RNA, 18 nt, Human herpesvirus 6
ugacgccuugauguuucc

SEQ ID NO: 3986311 - RNA, 19 nt, Human herpesvirus 6
ugacgccuugauguuuccu

SEQ ID NO: 3986312 - RNA, 20 nt, Human herpesvirus 6
ugacggcgacaaccgccgcc

SEQ ID NO: 3986313 - RNA, 16 nt, Human herpesvirus 6
ugacguauccucagaa

SEQ ID NO: 3986314 - RNA, 20 nt, Human herpesvirus 6
ugagaucgcauuagucacag

SEQ ID NO: 3986315 - RNA, 15 nt, Human herpesvirus 6
ugagguacaaaacau

SEQ ID NO: 3986316 - RNA, 21 nt, Human herpesvirus 6
ugaguaauugaacauuguaaa

SEQ ID NO: 3986317 - RNA, 20 nt, Human herpesvirus 6
ugauagcgucuuugcauauu

SEQ ID NO: 3986318 - RNA, 19 nt, Human herpesvirus 6
ugaucagcauucacucuuc

SEQ ID NO: 3986319 - RNA, 24 nt, Human herpesvirus 6
ugauccugacugguauccaauuaa

SEQ ID NO: 3986320 - RNA, 17 nt, Human herpesvirus 6
ugauguauggagauguu

SEQ ID NO: 3986321 - RNA, 21 nt, Human herpesvirus 6
ugcaaaacuguuaaaagagaa

SEQ ID NO: 3986322 - RNA, 15 nt, Human herpesvirus 6
ugcaaguuugaauuu

SEQ ID NO: 3986323 - RNA, 21 nt, Human herpesvirus 6
ugcaauuuaaaagaauuuuug

SEQ ID NO: 3986324 - RNA, 13 nt, Human herpesvirus 6
ugcaccuguuacu

SEQ ID NO: 3986325 - RNA, 22 nt, Human herpesvirus 6
ugcagaacaacagcauguaaua

SEQ ID NO: 3986326 - RNA, 22 nt, Human herpesvirus 6
ugcauaugcagacugcuucuua

SEQ ID NO: 3986327 - RNA, 15 nt, Human herpesvirus 6
ugccaaaggaaacca

SEQ ID NO: 3986328 - RNA, 18 nt, Human herpesvirus 6
ugccaaaggaaaccaccg

SEQ ID NO: 3986329 - RNA, 17 nt, Human herpesvirus 6
ugccaccgucugggacc

SEQ ID NO: 3986330 - RNA, 15 nt, Human herpesvirus 6
ugccgagccugugga

SEQ ID NO: 3986331 - RNA, 14 nt, Human herpesvirus 6
ugccgauuaaugug

SEQ ID NO: 3986332 - RNA, 12 nt, Human herpesvirus 6
ugccguaaaucu

SEQ ID NO: 3986333 - RNA, 22 nt, Human herpesvirus 6
ugcuaggacuucguucuugaca

SEQ ID NO: 3986334 - RNA, 16 nt, Human herpesvirus 6
uccucgugcucugccu

SEQ ID NO: 3986335 - RNA, 15 nt, Human herpesvirus 6
uccugaucacagagc

SEQ ID NO: 3986336 - RNA, 11 nt, Human herpesvirus 6
uccugcccagg

SEQ ID NO: 3986337 - RNA, 12 nt, Human herpesvirus 6
uccugcccaggc

SEQ ID NO: 3986338 - RNA, 14 nt, Human herpesvirus 6
uccugcguguuaau

SEQ ID NO: 3986339 - RNA, 20 nt, Human herpesvirus 6
uccugggcauuaguguauaa

SEQ ID NO: 3986340 - RNA, 20 nt, Human herpesvirus 6
ucgagccaaagaaacagaua

SEQ ID NO: 3986341 - RNA, 17 nt, Human herpesvirus 6
ucgaguaauuguggauu

SEQ ID NO: 3986342 - RNA, 16 nt, Human herpesvirus 6
ucgccaagaaaaagaa

SEQ ID NO: 3986343 - RNA, 18 nt, Human herpesvirus 6
ucgcccgauccgccccga

SEQ ID NO: 3986344 - RNA, 23 nt, Human herpesvirus 6
ucgccuggccucccauguaugca

SEQ ID NO: 3986345 - RNA, 22 nt, Human herpesvirus 6
ucgcugcuaucgucuauaacaa

SEQ ID NO: 3986346 - RNA, 20 nt, Human herpesvirus 6
ucggaaaauauuuccugccc

SEQ ID NO: 3986347 - RNA, 21 nt, Human herpesvirus 6
ucggcgcugauuccuguaagg

SEQ ID NO: 3986348 - RNA, 23 nt, Human herpesvirus 6
ucggcucuuugcugacuguacgc

SEQ ID NO: 3986349 - RNA, 19 nt, Human herpesvirus 6
ucggcugacaacaaaggag

SEQ ID NO: 3986350 - RNA, 17 nt, Human herpesvirus 6
ucgggagaggaccaaga

SEQ ID NO: 3986351 - RNA, 13 nt, Human herpesvirus 6
ucguaauggcauu

SEQ ID NO: 3986352 - RNA, 15 nt, Human herpesvirus 6
ucuaaaaucucguaa

SEQ ID NO: 3986353 - RNA, 14 nt, Human herpesvirus 6
ucuaaacacagaug

SEQ ID NO: 3986354 - RNA, 18 nt, Human herpesvirus 6
ucuaacaucucguaacgc

SEQ ID NO: 3986355 - RNA, 20 nt, Human herpesvirus 6
ucuaacucgcgagacaaauc

SEQ ID NO: 3986356 - RNA, 19 nt, Human herpesvirus 6
ucuagaauaucugcuaagu

SEQ ID NO: 3986357 - RNA, 15 nt, Human herpesvirus 6
ucuaugagacuguuu

SEQ ID NO: 3986358 - RNA, 21 nt, Human herpesvirus 6
ucucaagcacaaaaccaggaa

SEQ ID NO: 3986359 - RNA, 14 nt, Human herpesvirus 6
ucucagcuggcuga

SEQ ID NO: 3986360 - RNA, 20 nt, Human herpesvirus 6
ucuccaaaagcgccugccua

SEQ ID NO: 3986361 - RNA, 16 nt, Human herpesvirus 6
ucuccucauggagaau

SEQ ID NO: 3986362 - RNA, 16 nt, Human herpesvirus 6
ucuccugagaagcugg

SEQ ID NO: 3986363 - RNA, 22 nt, Human herpesvirus 6
ucucggaaaacuaaaagucagu

SEQ ID NO: 3986364 - RNA, 16 nt, Human herpesvirus 6
ucucggaaaauuaaag

SEQ ID NO: 3986365 - RNA, 16 nt, Human herpesvirus 6
ucucuguucugccacg

SEQ ID NO: 3986366 - RNA, 14 nt, Human herpesvirus 6
ucugaaaauaaagu

SEQ ID NO: 3986367 - RNA, 11 nt, Human herpesvirus 6
ucugaaagaca

SEQ ID NO: 3986368 - RNA, 14 nt, Human herpesvirus 6
ucugacgaaguuuu

SEQ ID NO: 3986369 - RNA, 18 nt, Human herpesvirus 6
ucugauauggcaaauuuu

SEQ ID NO: 3986370 - RNA, 18 nt, Human herpesvirus 6
ucugauucgacaaaucau

SEQ ID NO: 3986371 - RNA, 21 nt, Human herpesvirus 6
ucuggaugguugugugaguuu

SEQ ID NO: 3986372 - RNA, 14 nt, Human herpesvirus 6
ucuggcacaggcau

SEQ ID NO: 3986373 - RNA, 22 nt, Human herpesvirus 6
ucugggacccacgguggccugg

SEQ ID NO: 3986374 - RNA, 22 nt, Human herpesvirus 6
ucuuauuaauuuccugaucaca

SEQ ID NO: 3986375 - RNA, 16 nt, Human herpesvirus 6
ucuucaauaaaaacuc

SEQ ID NO: 3986376 - RNA, 21 nt, Human herpesvirus 6
ucuuccguacuguaaguaagc

SEQ ID NO: 3986377 - RNA, 19 nt, Human herpesvirus 6
ucuuuugucguuauaaaau

SEQ ID NO: 3986378 - RNA, 13 nt, Human herpesvirus 6
ucuuuuuaacuag

SEQ ID NO: 3986379 - RNA, 20 nt, Human herpesvirus 6
ugaaaaaaaaugaaggggaa

SEQ ID NO: 3986380 - RNA, 15 nt, Human herpesvirus 6
ugaacuacugagugc

SEQ ID NO: 3986381 - RNA, 13 nt, Human herpesvirus 6
ugaacuguuucca

SEQ ID NO: 3986382 - RNA, 16 nt, Human herpesvirus 6
ugaacuuuguaaagaa

SEQ ID NO: 3986383 - RNA, 21 nt, Human herpesvirus 6
ugaacuuuuuucggauuuuga

SEQ ID NO: 3986384 - RNA, 21 nt, Human herpesvirus 6
ugaagaucacgcccauauguu

SEQ ID NO: 3986385 - RNA, 14 nt, Human herpesvirus 6
ugaaguaaaacuau

SEQ ID NO: 3986386 - RNA, 12 nt, Human herpesvirus 6
ugaaugugcuuu

SEQ ID NO: 3986387 - RNA, 15 nt, Human herpesvirus 6
ugacuauuaaacuaa

SEQ ID NO: 3986388 - RNA, 23 nt, Human herpesvirus 6
ugacuguguguugaauguuacag

SEQ ID NO: 3986389 - RNA, 13 nt, Human herpesvirus 6
ugagcucuccugg

SEQ ID NO: 3986390 - RNA, 17 nt, Human herpesvirus 6
ugagguguuuccugccc

SEQ ID NO: 3986391 - RNA, 12 nt, Human herpesvirus 6
ugaguaauugaa

SEQ ID NO: 3986392 - RNA, 17 nt, Human herpesvirus 6
ugaguuuaucgugcaau

SEQ ID NO: 3986393 - RNA, 16 nt, Human herpesvirus 6
ugauacuauaaacaau

SEQ ID NO: 3986394 - RNA, 18 nt, Human herpesvirus 6
ugaucgacauuuguauuu

SEQ ID NO: 3986395 - RNA, 20 nt, Human herpesvirus 6
ugauggguuuggccaugccg

SEQ ID NO: 3986396 - RNA, 15 nt, Human herpesvirus 6
ugauuccuucaaugu

SEQ ID NO: 3986397 - RNA, 18 nt, Human herpesvirus 6
ugauuuuguuuucuacgu

SEQ ID NO: 3986398 - RNA, 14 nt, Human herpesvirus 6
ugcaaacccgacaa

SEQ ID NO: 3986399 - RNA, 18 nt, Human herpesvirus 6
ugcacuccguuaaucuaa

SEQ ID NO: 3986400 - RNA, 16 nt, Human herpesvirus 6
ugcagaacaucucaga

SEQ ID NO: 3986401 - RNA, 19 nt, Human herpesvirus 6
ugcagacgcugaaaucauu

SEQ ID NO: 3986402 - RNA, 17 nt, Human herpesvirus 6
ugcagacuucacuuugg

SEQ ID NO: 3986403 - RNA, 24 nt, Human herpesvirus 6
ugcagacuucacuuugggcgaugg

SEQ ID NO: 3986404 - RNA, 18 nt, Human herpesvirus 6
ugcaguuuaaggauaaga

SEQ ID NO: 3986405 - RNA, 11 nt, Human herpesvirus 6
ugcauacauaa

SEQ ID NO: 3986406 - RNA, 14 nt, Human herpesvirus 6
ugcauaugucuguu

SEQ ID NO: 3986407 - RNA, 18 nt, Human herpesvirus 6
ugcauuaacccuggguga

SEQ ID NO: 3986408 - RNA, 15 nt, Human herpesvirus 6
ugcauuuuguauuua

SEQ ID NO: 3986409 - RNA, 19 nt, Human herpesvirus 6
ugccaaaggaaaccaccgg

SEQ ID NO: 3986410 - RNA, 11 nt, Human herpesvirus 6
ugcgaccuggc

SEQ ID NO: 3986411 - RNA, 14 nt, Human herpesvirus 6
ugcuugucucacaa

SEQ ID NO: 3986412 - RNA, 16 nt, Human herpesvirus 6
uggaaaacuaugugca

SEQ ID NO: 3986413 - RNA, 23 nt, Human herpesvirus 6
uggaagcgagcgggcuaauguau

SEQ ID NO: 3986414 - RNA, 16 nt, Human herpesvirus 6
uggaccgaggggacag

SEQ ID NO: 3986415 - RNA, 22 nt, Human herpesvirus 6
uggacggcggggggacgggcgg

SEQ ID NO: 3986416 - RNA, 19 nt, Human herpesvirus 6
uggagcagcuuccacgcga

SEQ ID NO: 3986417 - RNA, 20 nt, Human herpesvirus 6
uggaugcugaugaauuuaug

SEQ ID NO: 3986418 - RNA, 17 nt, Human herpesvirus 6
uggcaaacguaugcagu

SEQ ID NO: 3986419 - RNA, 18 nt, Human herpesvirus 6
uggcagaggggaagggaa

SEQ ID NO: 3986420 - RNA, 14 nt, Human herpesvirus 6
uggcagucugcucg

SEQ ID NO: 3986421 - RNA, 17 nt, Human herpesvirus 6
uggcccuacuacagugg

SEQ ID NO: 3986422 - RNA, 13 nt, Human herpesvirus 6
uggcugugcuauc

SEQ ID NO: 3986423 - RNA, 23 nt, Human herpesvirus 6
ugggaucuucugcuaauucauag

SEQ ID NO: 3986424 - RNA, 20 nt, Human herpesvirus 6
ugggauguccauuucuucga

SEQ ID NO: 3986425 - RNA, 17 nt, Human herpesvirus 6
uggggucuuuccugcac

SEQ ID NO: 3986426 - RNA, 18 nt, Human herpesvirus 6
ugguagcuauuaugugaa

SEQ ID NO: 3986427 - RNA, 14 nt, Human herpesvirus 6
ugguuaugacaaag

SEQ ID NO: 3986428 - RNA, 15 nt, Human herpesvirus 6
ugguuuacagcacuu

SEQ ID NO: 3986429 - RNA, 19 nt, Human herpesvirus 6
uguaaauagguaaacuguu

SEQ ID NO: 3986430 - RNA, 18 nt, Human herpesvirus 6
uguaagauuaaaugugaa

SEQ ID NO: 3986431 - RNA, 12 nt, Human herpesvirus 6
uguaauaagaaa

SEQ ID NO: 3986432 - RNA, 13 nt, Human herpesvirus 6
uguaauaagaaaa

SEQ ID NO: 3986433 - RNA, 14 nt, Human herpesvirus 6
uguaauaauugaug

SEQ ID NO: 3986434 - RNA, 17 nt, Human herpesvirus 6
uguaauacaucaacaaa

SEQ ID NO: 3986435 - RNA, 15 nt, Human herpesvirus 6
uguaccuagcagcaa

SEQ ID NO: 3986436 - RNA, 19 nt, Human herpesvirus 6
uguaccuagcagcaaauaa

SEQ ID NO: 3986437 - RNA, 17 nt, Human herpesvirus 6
uguacgaugaacuacug

SEQ ID NO: 3986438 - RNA, 20 nt, Human herpesvirus 6
uguaguuuaguaugggugag

SEQ ID NO: 3986439 - RNA, 15 nt, Human herpesvirus 6
uguaucugugaacaa

SEQ ID NO: 3986440 - RNA, 17 nt, Human herpesvirus 6
uguauugaacuuuguaa

SEQ ID NO: 3986441 - RNA, 19 nt, Human herpesvirus 6
ugucggucagacagugagu

SEQ ID NO: 3986442 - RNA, 24 nt, Human herpesvirus 6
ugucgugguggucuuguuaucuua

SEQ ID NO: 3986443 - RNA, 17 nt, Human herpesvirus 6
ugucguuguaguuuuua

SEQ ID NO: 3986444 - RNA, 21 nt, Human herpesvirus 6
ugucugcaguggucaugaucu

SEQ ID NO: 3986445 - RNA, 20 nt, Human herpesvirus 6
ugugauuccuucggggacag

SEQ ID NO: 3986446 - RNA, 22 nt, Human herpesvirus 6
ugugauucugcauuuauaucaa

SEQ ID NO: 3986447 - RNA, 17 nt, Human herpesvirus 6
ugugcaugaaaauauca

SEQ ID NO: 3986448 - RNA, 15 nt, Human herpesvirus 6
ugugcgauuuacugg

SEQ ID NO: 3986449 - RNA, 10 nt, Human herpesvirus 6
uguggcucuc

SEQ ID NO: 3986450 - RNA, 14 nt, Human herpesvirus 6
uguguauuauguaa

SEQ ID NO: 3986451 - RNA, 14 nt, Human herpesvirus 6
uguguuucugucuu

SEQ ID NO: 3986452 - RNA, 18 nt, Human herpesvirus 6
uguugaguaauugaacau

SEQ ID NO: 3986453 - RNA, 13 nt, Human herpesvirus 6
uguuuccugccca

SEQ ID NO: 3986454 - RNA, 21 nt, Human herpesvirus 6
uguuucgccaagaaaaagaaa

SEQ ID NO: 3986455 - RNA, 20 nt, Human herpesvirus 6
uguuugaggcguugugcuga

SEQ ID NO: 3986456 - RNA, 15 nt, Human herpesvirus 6
uguuugcaucaguga

SEQ ID NO: 3986457 - RNA, 19 nt, Human herpesvirus 6
uguuuucgguuuucuuaca

SEQ ID NO: 3986458 - RNA, 16 nt, Human herpesvirus 6
uuaaaccucuguagau

SEQ ID NO: 3986459 - RNA, 15 nt, Human herpesvirus 6
uuaaacuaugcaaac

SEQ ID NO: 3986460 - RNA, 12 nt, Human herpesvirus 6
uuaaauauuaau

SEQ ID NO: 3986461 - RNA, 15 nt, Human herpesvirus 6
uuaacauccaaaaua

SEQ ID NO: 3986462 - RNA, 18 nt, Human herpesvirus 6
uuaacgcagcaacaaucc

SEQ ID NO: 3986463 - RNA, 17 nt, Human herpesvirus 6
uuaauaaaggauguuug

SEQ ID NO: 3986464 - RNA, 12 nt, Human herpesvirus 6
uuaauaagaaag

SEQ ID NO: 3986465 - RNA, 12 nt, Human herpesvirus 6
uuaaugcauuca

SEQ ID NO: 3986466 - RNA, 19 nt, Human herpesvirus 6
uuaaugucacugucgaaua

SEQ ID NO: 3986467 - RNA, 19 nt, Human herpesvirus 6
uuacaacccccgauucaga

SEQ ID NO: 3986468 - RNA, 19 nt, Human herpesvirus 6
uuacacuuucuuguaguau

SEQ ID NO: 3986469 - RNA, 23 nt, Human herpesvirus 6
uuacaucaacuauuuaacaucca

SEQ ID NO: 3986470 - RNA, 19 nt, Human herpesvirus 6
uuaccauauauuggcaugu

SEQ ID NO: 3986471 - RNA, 14 nt, Human herpesvirus 6
uuaccuauagucaa

SEQ ID NO: 3986472 - RNA, 20 nt, Human herpesvirus 6
uuacucaccugcgucaaugc

SEQ ID NO: 3986473 - RNA, 16 nt, Human herpesvirus 6
uuagaaauuacauaag

SEQ ID NO: 3986474 - RNA, 13 nt, Human herpesvirus 6
uuagaauguuugg

SEQ ID NO: 3986475 - RNA, 17 nt, Human herpesvirus 6
uuagagaaaagugcaag

SEQ ID NO: 3986476 - RNA, 14 nt, Human herpesvirus 6
uuauaaaaccgauc

SEQ ID NO: 3986477 - RNA, 12 nt, Human herpesvirus 6
uuauaauacacu

SEQ ID NO: 3986478 - RNA, 15 nt, Human herpesvirus 6
uuauacuguuguaaa

SEQ ID NO: 3986479 - RNA, 13 nt, Human herpesvirus 6
uuauuaacuguaa

SEQ ID NO: 3986480 - RNA, 21 nt, Human herpesvirus 6
uuauuagggauacguauauug

SEQ ID NO: 3986481 - RNA, 18 nt, Human herpesvirus 6
uucaacauuccaacuuuc

SEQ ID NO: 3986482 - RNA, 23 nt, Human herpesvirus 6
uucacugaccguuguaagaagaa

SEQ ID NO: 3986483 - RNA, 14 nt, Human herpesvirus 6
uucagucucagcaa

SEQ ID NO: 3986484 - RNA, 20 nt, Human herpesvirus 6
uuccaagacauguacaucaa

SEQ ID NO: 3986485 - RNA, 19 nt, Human herpesvirus 6
uuccacgcauagacaaacc

SEQ ID NO: 3986486 - RNA, 20 nt, Human herpesvirus 6
uuccaggcggcaugaauucc

SEQ ID NO: 3986487 - RNA, 16 nt, Human herpesvirus 6
uuccccagcuguguuu

SEQ ID NO: 3986488 - RNA, 22 nt, Human herpesvirus 6
uucccgccaaggcuaugugucu

SEQ ID NO: 3986489 - RNA, 20 nt, Human herpesvirus 6
uuccgauacagcaccaucaa

SEQ ID NO: 3986490 - RNA, 21 nt, Human herpesvirus 6
uuccucgcgguauaaugcaug

SEQ ID NO: 3986491 - RNA, 13 nt, Human herpesvirus 6
uuccugcccaggc

SEQ ID NO: 3986492 - RNA, 14 nt, Human herpesvirus 6
uuccugcccaggcg

SEQ ID NO: 3986493 - RNA, 17 nt, Human herpesvirus 6
uucgacuucaaacaccu

SEQ ID NO: 3986494 - RNA, 18 nt, Human herpesvirus 6
uucgauccaauaagaaac

SEQ ID NO: 3986495 - RNA, 20 nt, Human herpesvirus 6
uucgggacaaaaccgaggca

SEQ ID NO: 3986496 - RNA, 17 nt, Human herpesvirus 6
uucgucgaguuguauua

SEQ ID NO: 3986497 - RNA, 16 nt, Human herpesvirus 6
uucuauguaaacuucu

SEQ ID NO: 3986498 - RNA, 15 nt, Human herpesvirus 6
uucuauguuauguaa

SEQ ID NO: 3986499 - RNA, 15 nt, Human herpesvirus 6
uucucuaaaaacuaa

SEQ ID NO: 3986500 - RNA, 20 nt, Human herpesvirus 6
uucucugcaaaacaaaggua

SEQ ID NO: 3986501 - RNA, 23 nt, Human herpesvirus 6
uucuggcacaggcauagcagcaa

SEQ ID NO: 3986502 - RNA, 22 nt, Human herpesvirus 6
uucuuacaacaggcuugugaaa

SEQ ID NO: 3986503 - RNA, 18 nt, Human herpesvirus 6
uucuuacacaaauugacc

SEQ ID NO: 3986504 - RNA, 14 nt, Human herpesvirus 6
uucuuaucaaaucg

SEQ ID NO: 3986505 - RNA, 17 nt, Human herpesvirus 6
uucuuaucaaaucgagu

SEQ ID NO: 3986506 - RNA, 20 nt, Human herpesvirus 6
uucuuauuuaccuuccugag

SEQ ID NO: 3986507 - RNA, 17 nt, Human herpesvirus 6
uucuucaaaaaaagaag

SEQ ID NO: 3986508 - RNA, 20 nt, Human herpesvirus 6
uucuucgaguuuuuuuugaa

SEQ ID NO: 3986509 - RNA, 15 nt, Human herpesvirus 6
uugaaaucacaccaa

SEQ ID NO: 3986510 - RNA, 20 nt, Human herpesvirus 6
uugaauaacaaacuauauug

SEQ ID NO: 3986511 - RNA, 18 nt, Human herpesvirus 6
uugaauguuuaaaguuuu

SEQ ID NO: 3986512 - RNA, 19 nt, Human herpesvirus 6
uugauaaugauauaguuuu

SEQ ID NO: 3986513 - RNA, 16 nt, Human herpesvirus 6
uugaugccaaagcuuu

SEQ ID NO: 3986514 - RNA, 21 nt, Human herpesvirus 6
uugauguuuccugaauuaaaa

SEQ ID NO: 3986515 - RNA, 15 nt, Human herpesvirus 6
uugauuuacaaggca

SEQ ID NO: 3986516 - RNA, 19 nt, Human herpesvirus 6
uugcaauuuccugucaugu

SEQ ID NO: 3986517 - RNA, 19 nt, Human herpesvirus 6
uugcagacgcugaaaucau

SEQ ID NO: 3986518 - RNA, 13 nt, Human herpesvirus 6
uugcgauucuaau

SEQ ID NO: 3986519 - RNA, 19 nt, Human herpesvirus 6
uuggccuucgguacaguga

SEQ ID NO: 3986520 - RNA, 14 nt, Human herpesvirus 6
uugggacauguaua

SEQ ID NO: 3986521 - RNA, 19 nt, Human herpesvirus 6
uuguaaauagguaaacugu

SEQ ID NO: 3986522 - RNA, 20 nt, Human herpesvirus 6
uuguaagaagaaaaaaacac

SEQ ID NO: 3986523 - RNA, 17 nt, Human herpesvirus 6
uuguaaucaaucaaggu

SEQ ID NO: 3986524 - RNA, 22 nt, Human herpesvirus 6
uuguaguauaucuagauaaacg

SEQ ID NO: 3986525 - RNA, 16 nt, Human herpesvirus 6
uuguugaguuucagca

SEQ ID NO: 3986526 - RNA, 22 nt, Human herpesvirus 6
uuuaaccauucguuuuauugaa

SEQ ID NO: 3986527 - RNA, 18 nt, Human herpesvirus 6
uuuaaugagaggacaguc

SEQ ID NO: 3986528 - RNA, 22 nt, Human herpesvirus 6
uuuaauuacggaacaaggccaa

SEQ ID NO: 3986529 - RNA, 16 nt, Human herpesvirus 6
uuuacaauguucaauu

SEQ ID NO: 3986530 - RNA, 18 nt, Human herpesvirus 6
uuuacauagaaauuacaa

SEQ ID NO: 3986531 - RNA, 21 nt, Human herpesvirus 6
uuuaccaccagucaggaaaaa

SEQ ID NO: 3986532 - RNA, 20 nt, Human herpesvirus 6
uuuaguaugggugagugcau

SEQ ID NO: 3986533 - RNA, 21 nt, Human herpesvirus 6
uuuaguaugggugagugcauu

SEQ ID NO: 3986534 - RNA, 14 nt, Human herpesvirus 6
uuuaucgauguaga

SEQ ID NO: 3986535 - RNA, 16 nt, Human herpesvirus 6
uuucaaaauugaguuu

SEQ ID NO: 3986536 - RNA, 20 nt, Human herpesvirus 6
uuucacgugaaauaaaguuu

SEQ ID NO: 3986537 - RNA, 23 nt, Human herpesvirus 6
uuucacgugcacgagaucuguuc

SEQ ID NO: 3986538 - RNA, 14 nt, Human herpesvirus 6
uuuccugcccaggc

SEQ ID NO: 3986539 - RNA, 17 nt, Human herpesvirus 6
uuucgacaauccuaauu

SEQ ID NO: 3986540 - RNA, 16 nt, Human herpesvirus 6
uuucuaaaaucaaaaa

SEQ ID NO: 3986541 - RNA, 12 nt, Human herpesvirus 6
uuugaacuuuuu

SEQ ID NO: 3986542 - RNA, 13 nt, Human herpesvirus 6
uuuguacacuuua

SEQ ID NO: 3986543 - RNA, 14 nt, Human herpesvirus 6
uuuguguuuguaaa

SEQ ID NO: 3986544 - RNA, 20 nt, Human herpesvirus 6
uuuguuucagcguauucaga

SEQ ID NO: 3986545 - RNA, 19 nt, Human herpesvirus 6
uuuguuuucuacguagaua

SEQ ID NO: 3986546 - RNA, 15 nt, Human herpesvirus 6
uuuuagaaacauuug

SEQ ID NO: 3986547 - RNA, 20 nt, Human herpesvirus 6
uuuuaucaugcccgaaugug

SEQ ID NO: 3986548 - RNA, 22 nt, Human herpesvirus 6
uuuuccgaaaggugaaaugaau

SEQ ID NO: 3986549 - RNA, 14 nt, Human herpesvirus 6
uuuugaaaaaacag

SEQ ID NO: 3986550 - RNA, 16 nt, Human herpesvirus 6
uuuugggauacauaau

SEQ ID NO: 3986551 - RNA, 23 nt, Human herpesvirus 6
uuuuguauuauguaauacaucaa

SEQ ID NO: 3986552 - RNA, 20 nt, Human herpesvirus 6
uuuuuaaaaaaaaauaaaac

SEQ ID NO: 3986553 - RNA, 13 nt, Human herpesvirus 6
uuuuuaacuaggu

SEQ ID NO: 3986554 - RNA, 13 nt, Human herpesvirus 6
uuuuuaauuaaaa

SEQ ID NO: 3986555 - RNA, 20 nt, Human herpesvirus 6
uuuuuauuuuauaauacacu

SEQ ID NO: 3986556 - RNA, 17 nt, Human herpesvirus 6
uuuuugucagguuugaa

SEQ ID NO: 3986557 - RNA, 16 nt, Human herpesvirus 6
agaauuuuuguagcaa

SEQ ID NO: 3986558 - RNA, 20 nt, Human herpesvirus 6
agacauugcuuucucuuuuu

SEQ ID NO: 3986559 - RNA, 17 nt, Human herpesvirus 6
agaccguagcaaaauuc

SEQ ID NO: 3986560 - RNA, 14 nt, Human herpesvirus 6
agacgccacgggca

SEQ ID NO: 3986561 - RNA, 17 nt, Human herpesvirus 6
agacgggccuccgccac

SEQ ID NO: 3986562 - RNA, 17 nt, Human herpesvirus 6
agacuacagacucccca

SEQ ID NO: 3986563 - RNA, 22 nt, Human herpesvirus 6
agacuccuacaauacgguuugu

SEQ ID NO: 3986564 - RNA, 20 nt, Human herpesvirus 6
agacugguugaguuuccugc

SEQ ID NO: 3986565 - RNA, 20 nt, Human herpesvirus 6
agagaacugucuugcagcug

SEQ ID NO: 3986566 - RNA, 22 nt, Human herpesvirus 6
agagacgugauacuauaaacaa

SEQ ID NO: 3986567 - RNA, 13 nt, Human herpesvirus 6
agagacugguuga

SEQ ID NO: 3986568 - RNA, 14 nt, Human herpesvirus 6
agagauguuucccg

SEQ ID NO: 3986569 - RNA, 18 nt, Human herpesvirus 6
agaggaagauagcagaau

SEQ ID NO: 3986570 - RNA, 14 nt, Human herpesvirus 6
agauaagagaguuu

SEQ ID NO: 3986571 - RNA, 15 nt, Human herpesvirus 6
agauacauagauuuu

SEQ ID NO: 3986572 - RNA, 22 nt, Human herpesvirus 6
agauauauacuuucaaguguuu

SEQ ID NO: 3986573 - RNA, 12 nt, Human herpesvirus 6
agaucagugggu

SEQ ID NO: 3986574 - RNA, 21 nt, Human herpesvirus 6
agauccgucucucagcuggcu

SEQ ID NO: 3986575 - RNA, 21 nt, Human herpesvirus 6
agaucgcuuuugaaauugaaa

SEQ ID NO: 3986576 - RNA, 17 nt, Human herpesvirus 6
agaucuggugaauguuu

SEQ ID NO: 3986577 - RNA, 18 nt, Human herpesvirus 6
agaucuguucgaaaaagu

SEQ ID NO: 3986578 - RNA, 15 nt, Human herpesvirus 6
agaucuuuauggagg

SEQ ID NO: 3986579 - RNA, 21 nt, Human herpesvirus 6
agaugaauugugcguguaauu

SEQ ID NO: 3986580 - RNA, 19 nt, Human herpesvirus 6
agauguguauuauguaaau

SEQ ID NO: 3986581 - RNA, 13 nt, Human herpesvirus 6
aucaugcugugag

SEQ ID NO: 3986582 - RNA, 20 nt, Human herpesvirus 6
auccacgaacguagacaguc

SEQ ID NO: 3986583 - RNA, 12 nt, Human herpesvirus 6
aucccuaauaaa

SEQ ID NO: 3986584 - RNA, 15 nt, Human herpesvirus 6
auccgcuccgcgccc

SEQ ID NO: 3986585 - RNA, 20 nt, Human herpesvirus 6
auccuaaauaccaauuccuu

SEQ ID NO: 3986586 - RNA, 17 nt, Human herpesvirus 6
aucgagaaucuuccuuu

SEQ ID NO: 3986587 - RNA, 22 nt, Human herpesvirus 6
aucgauucuguaauuuugaaau

SEQ ID NO: 3986588 - RNA, 15 nt, Human herpesvirus 6
aucgcuuaaagaaaa

SEQ ID NO: 3986589 - RNA, 22 nt, Human herpesvirus 6
aucgggcccggggacggacagg

SEQ ID NO: 3986590 - RNA, 15 nt, Human herpesvirus 6
aucguccccuuggcu

SEQ ID NO: 3986591 - RNA, 12 nt, Human herpesvirus 6
aucuauaugcau

SEQ ID NO: 3986592 - RNA, 14 nt, Human herpesvirus 6
aucucuaugagacu

SEQ ID NO: 3986593 - RNA, 21 nt, Human herpesvirus 6
aucucuauugguuaaaaggaa

SEQ ID NO: 3986594 - RNA, 12 nt, Human herpesvirus 6
aucuguccagcu

SEQ ID NO: 3986595 - RNA, 22 nt, Human herpesvirus 6
aucuuaccguaaacaaauucuu

SEQ ID NO: 3986596 - RNA, 16 nt, Human herpesvirus 6
aucuuccacugaagca

SEQ ID NO: 3986597 - RNA, 16 nt, Human herpesvirus 6
aucuucccuuuuacaa

SEQ ID NO: 3986598 - RNA, 16 nt, Human herpesvirus 6
aucuuccguacuguaa

SEQ ID NO: 3986599 - RNA, 19 nt, Human herpesvirus 6
aucuucggauucgcaagcu

SEQ ID NO: 3986600 - RNA, 13 nt, Human herpesvirus 6
aucuucuuugugc

SEQ ID NO: 3986601 - RNA, 16 nt, Human herpesvirus 6
augaaacucuuugaac

SEQ ID NO: 3986602 - RNA, 15 nt, Human herpesvirus 6
augaacuacugagug

SEQ ID NO: 3986603 - RNA, 15 nt, Human herpesvirus 6
augaagauuugacau

SEQ ID NO: 3986604 - RNA, 12 nt, Human herpesvirus 6
augaauguguuc

SEQ ID NO: 3986605 - RNA, 14 nt, Human herpesvirus 6
augacaucugcaaa

SEQ ID NO: 3986606 - RNA, 20 nt, Human herpesvirus 6
augagggguaugucugugca

SEQ ID NO: 3986607 - RNA, 20 nt, Human herpesvirus 6
augauagggaauauguuguu

SEQ ID NO: 3986608 - RNA, 22 nt, Human herpesvirus 6
augcauucacaaggaaugugca

SEQ ID NO: 3986609 - RNA, 16 nt, Human herpesvirus 6
augccauaaagaacac

SEQ ID NO: 3986610 - RNA, 15 nt, Human herpesvirus 6
augcgaaucugccga

SEQ ID NO: 3986611 - RNA, 15 nt, Human herpesvirus 6
augcgagcaaaaaau

SEQ ID NO: 3986612 - RNA, 15 nt, Human herpesvirus 6
augcguugcauuuug

SEQ ID NO: 3986613 - RNA, 16 nt, Human herpesvirus 6
auggaggaauggaaaa

SEQ ID NO: 3986614 - RNA, 22 nt, Human herpesvirus 6
auggcgaugaccgcuaaauuga

SEQ ID NO: 3986615 - RNA, 19 nt, Human herpesvirus 6
augucguucuuaacucauc

SEQ ID NO: 3986616 - RNA, 10 nt, Human herpesvirus 6
augucucgcg

SEQ ID NO: 3986617 - RNA, 13 nt, Human herpesvirus 6
augugauugucuu

SEQ ID NO: 3986618 - RNA, 23 nt, Human herpesvirus 6
auguguauuauguaaauaugcuu

SEQ ID NO: 3986619 - RNA, 22 nt, Human herpesvirus 6
auguguuuuucuuuuacaggaa

SEQ ID NO: 3986620 - RNA, 23 nt, Human herpesvirus 6
auguguuuuucuuuuacaggaag

SEQ ID NO: 3986621 - RNA, 18 nt, Human herpesvirus 6
auguucuuuauuaaaugu

SEQ ID NO: 3986622 - RNA, 22 nt, Human herpesvirus 6
auguuggcgccaaaaaaauaca

SEQ ID NO: 3986623 - RNA, 16 nt, Human herpesvirus 6
auguuuuccuuuauga

SEQ ID NO: 3986624 - RNA, 15 nt, Human herpesvirus 6
auuaacaaauuacaa

SEQ ID NO: 3986625 - RNA, 16 nt, Human herpesvirus 6
auuaacaaauuacaau

SEQ ID NO: 3986626 - RNA, 18 nt, Human herpesvirus 6
auuaaucguuacaaaauu

SEQ ID NO: 3986627 - RNA, 13 nt, Human herpesvirus 6
auuaauuaagugc

SEQ ID NO: 3986628 - RNA, 20 nt, Human herpesvirus 6
auuacucaacauuaaaaaaa

SEQ ID NO: 3986629 - RNA, 18 nt, Human herpesvirus 6
auuagauaagagaguuuc

SEQ ID NO: 3986630 - RNA, 18 nt, Human herpesvirus 6
auuagucuuaaucaacug

SEQ ID NO: 3986631 - RNA, 12 nt, Human herpesvirus 6
auuauguaaaua

SEQ ID NO: 3986632 - RNA, 22 nt, Human herpesvirus 6
auuaugugacucggaacauaau

SEQ ID NO: 3986633 - RNA, 15 nt, Human herpesvirus 6
auucacauaagacuu

SEQ ID NO: 3986634 - RNA, 16 nt, Human herpesvirus 6
auucacauuaccucug

SEQ ID NO: 3986635 - RNA, 13 nt, Human herpesvirus 6
auuccuucaaugu

SEQ ID NO: 3986636 - RNA, 15 nt, Human herpesvirus 6
auugacuacagcugc

SEQ ID NO: 3986637 - RNA, 21 nt, Human herpesvirus 6
auugacuacagcugcaggggu

SEQ ID NO: 3986638 - RNA, 22 nt, Human herpesvirus 6
auuguauauauagcuguaaaua

SEQ ID NO: 3986639 - RNA, 20 nt, Human herpesvirus 6
auuucagguucuucaaaaaa

SEQ ID NO: 3986640 - RNA, 19 nt, Human herpesvirus 6
auuucgguuucgucgcaaa

SEQ ID NO: 3986641 - RNA, 16 nt, Human herpesvirus 6
auuucuaaacacagau

SEQ ID NO: 3986642 - RNA, 16 nt, Human herpesvirus 6
auuucuacaaaaauac

SEQ ID NO: 3986643 - RNA, 23 nt, Human herpesvirus 6
auuucuagcgaucauaaaacugc

SEQ ID NO: 3986644 - RNA, 23 nt, Human herpesvirus 6
auuucuguuacugcgagcccgua

SEQ ID NO: 3986645 - RNA, 20 nt, Human herpesvirus 6
auuucuuccuuucucugcgc

SEQ ID NO: 3986646 - RNA, 18 nt, Human herpesvirus 6
auuugacaauaaacauga

SEQ ID NO: 3986647 - RNA, 14 nt, Human herpesvirus 6
auuugcugaugcga

SEQ ID NO: 3986648 - RNA, 16 nt, Human herpesvirus 6
auuuuaccuuuggaaa

SEQ ID NO: 3986649 - RNA, 16 nt, Human herpesvirus 6
auuuuauaacgacaaa

SEQ ID NO: 3986650 - RNA, 17 nt, Human herpesvirus 6
auuuuauuggcaaccug

SEQ ID NO: 3986651 - RNA, 19 nt, Human herpesvirus 6
auuuucggugcacauggaa

SEQ ID NO: 3986652 - RNA, 13 nt, Human herpesvirus 6
auuuucuuaguaa

SEQ ID NO: 3986653 - RNA, 18 nt, Human herpesvirus 6
auuuugaugccaaagcuu

SEQ ID NO: 3986654 - RNA, 15 nt, Human herpesvirus 6
auuuugggacaagau

SEQ ID NO: 3986655 - RNA, 22 nt, Human herpesvirus 6
auuuuuauguugugaucaagug

SEQ ID NO: 3986656 - RNA, 14 nt, Human herpesvirus 6
caaaaauacugcag

SEQ ID NO: 3986657 - RNA, 18 nt, Human herpesvirus 6
caaaacauaucgagccaa

SEQ ID NO: 3986658 - RNA, 22 nt, Human herpesvirus 6
caaaauuugaaauaucagaaau

SEQ ID NO: 3986659 - RNA, 21 nt, Human herpesvirus 6
caaacuacggaaaaucucaaa

SEQ ID NO: 3986660 - RNA, 19 nt, Human herpesvirus 6
caaaggaaaccaccggcua

SEQ ID NO: 3986661 - RNA, 19 nt, Human herpesvirus 6
caaaguucaguaacauuua

SEQ ID NO: 3986662 - RNA, 20 nt, Human herpesvirus 6
caaauguaacuuuuuguauu

SEQ ID NO: 3986663 - RNA, 16 nt, Human herpesvirus 6
caaauuacaaucaugu

SEQ ID NO: 3986664 - RNA, 16 nt, Human herpesvirus 6
caacaacaauaacaac

SEQ ID NO: 3986665 - RNA, 20 nt, Human herpesvirus 6
caacacuuuuaccaugcgcc

SEQ ID NO: 3986666 - RNA, 20 nt, Human herpesvirus 6
caacaggcuugugaaagacc

SEQ ID NO: 3986667 - RNA, 23 nt, Human herpesvirus 6
caagaaaucauuuugaaaugucg

SEQ ID NO: 3986668 - RNA, 13 nt, Human herpesvirus 6
caagaacagagag

SEQ ID NO: 3986669 - RNA, 21 nt, Human herpesvirus 6
caagaaugccgugaauugugu

SEQ ID NO: 3986670 - RNA, 22 nt, Human herpesvirus 6
caagauuguguuucugucuuua

SEQ ID NO: 3986671 - RNA, 20 nt, Human herpesvirus 6
caagccaugacaagaaaggu

SEQ ID NO: 3986672 - RNA, 14 nt, Human herpesvirus 6
caagcuaacaagaa

SEQ ID NO: 3986673 - RNA, 19 nt, Human herpesvirus 6
caaggaaugugcagagugc

SEQ ID NO: 3986674 - RNA, 16 nt, Human herpesvirus 6
caaguuugugugccuu

SEQ ID NO: 3986675 - RNA, 14 nt, Human herpesvirus 6
caauauaaaagauu

SEQ ID NO: 3986676 - RNA, 20 nt, Human herpesvirus 6
caaucaaucuucuggguggg

SEQ ID NO: 3986677 - RNA, 21 nt, Human herpesvirus 6
caaucaugugcaugaaaauau

SEQ ID NO: 3986678 - RNA, 19 nt, Human herpesvirus 6
caauuccuuaauucuaaau

SEQ ID NO: 3986679 - RNA, 19 nt, Human herpesvirus 6
caauuuguguuuauuugcc

SEQ ID NO: 3986680 - RNA, 13 nt, Human herpesvirus 6
cacaaaaacaggg

SEQ ID NO: 3986681 - RNA, 13 nt, Human herpesvirus 6
cacauaacugcau

SEQ ID NO: 3986682 - RNA, 18 nt, Human herpesvirus 6
cacauaugccgaggcuua

SEQ ID NO: 3986683 - RNA, 15 nt, Human herpesvirus 6
cacaucuauguguau

SEQ ID NO: 3986684 - RNA, 12 nt, Human herpesvirus 6
caccagccggua

SEQ ID NO: 3986685 - RNA, 23 nt, Human herpesvirus 6
cacccuacaaucuguccagcuug

SEQ ID NO: 3986686 - RNA, 20 nt, Human herpesvirus 6
caccgcugacaaccuccgca

SEQ ID NO: 3986687 - RNA, 20 nt, Human herpesvirus 6
caccggaugucgacuccucc

SEQ ID NO: 3986688 - RNA, 15 nt, Human herpesvirus 6
caccucuaaaacaag

SEQ ID NO: 3986689 - RNA, 13 nt, Human herpesvirus 6
caccuuuaucgac

SEQ ID NO: 3986690 - RNA, 16 nt, Human herpesvirus 6
cacgaagacgaagagg

SEQ ID NO: 3986691 - RNA, 20 nt, Human herpesvirus 6
cacgacgugcugcaaggccg

SEQ ID NO: 3986692 - RNA, 22 nt, Human herpesvirus 6
cacgauguuaacauaaaacaac

SEQ ID NO: 3986693 - RNA, 20 nt, Human herpesvirus 6
cacuugaaccaagucaacaa

SEQ ID NO: 3986694 - RNA, 15 nt, Human herpesvirus 6
cagaaaagcaaacau

SEQ ID NO: 3986695 - RNA, 14 nt, Human herpesvirus 6
cagaacaacagcau

SEQ ID NO: 3986696 - RNA, 16 nt, Human herpesvirus 6
cgcccccauacacacc

SEQ ID NO: 3986697 - RNA, 14 nt, Human herpesvirus 6
cgcccgauccgccc

SEQ ID NO: 3986698 - RNA, 16 nt, Human herpesvirus 6
cgcgaccgaccccugc

SEQ ID NO: 3986699 - RNA, 13 nt, Human herpesvirus 6
cgcgagacagcgg

SEQ ID NO: 3986700 - RNA, 14 nt, Human herpesvirus 6
cgcgcgccggugcg

SEQ ID NO: 3986701 - RNA, 18 nt, Human herpesvirus 6
cgcggaguggaguccagu

SEQ ID NO: 3986702 - RNA, 19 nt, Human herpesvirus 6
cgcgguuuggggucuuucc

SEQ ID NO: 3986703 - RNA, 19 nt, Human herpesvirus 6
cgcuccgcgccccucgccc

SEQ ID NO: 3986704 - RNA, 14 nt, Human herpesvirus 6
cgcuccuccccugu

SEQ ID NO: 3986705 - RNA, 15 nt, Human herpesvirus 6
cgcuccuccccuguc

SEQ ID NO: 3986706 - RNA, 13 nt, Human herpesvirus 6
cgcuguccgccug

SEQ ID NO: 3986707 - RNA, 14 nt, Human herpesvirus 6
cggaaaacuaaaag

SEQ ID NO: 3986708 - RNA, 20 nt, Human herpesvirus 6
cggaaucaccggaugucgac

SEQ ID NO: 3986709 - RNA, 18 nt, Human herpesvirus 6
cggagaaaguugauagac

SEQ ID NO: 3986710 - RNA, 20 nt, Human herpesvirus 6
cggaggcgacgaaagaggac

SEQ ID NO: 3986711 - RNA, 17 nt, Human herpesvirus 6
cggauccaacucgacua

SEQ ID NO: 3986712 - RNA, 19 nt, Human herpesvirus 6
cggauucaaagaaaguuuc

SEQ ID NO: 3986713 - RNA, 17 nt, Human herpesvirus 6
cggccauuuaacggaac

SEQ ID NO: 3986714 - RNA, 15 nt, Human herpesvirus 6
cggcggauggagccc

SEQ ID NO: 3986715 - RNA, 13 nt, Human herpesvirus 6
cggcggggggacg

SEQ ID NO: 3986716 - RNA, 16 nt, Human herpesvirus 6
cggucagacagugagu

SEQ ID NO: 3986717 - RNA, 21 nt, Human herpesvirus 6
cgguccaaggauuaugaucau

SEQ ID NO: 3986718 - RNA, 20 nt, Human herpesvirus 6
cgguugagguguuuccugcc

SEQ ID NO: 3986719 - RNA, 16 nt, Human herpesvirus 6
cguaagaaaaaaaacg

SEQ ID NO: 3986720 - RNA, 18 nt, Human herpesvirus 6
cguagacaguaaaaugug

SEQ ID NO: 3986721 - RNA, 16 nt, Human herpesvirus 6
cgucaucgguggcaga

SEQ ID NO: 3986722 - RNA, 18 nt, Human herpesvirus 6
cguccgaguuagcagaag

SEQ ID NO: 3986723 - RNA, 20 nt, Human herpesvirus 6
cgucucucagcuggcugaca

SEQ ID NO: 3986724 - RNA, 13 nt, Human herpesvirus 6
cgucugggaccca

SEQ ID NO: 3986725 - RNA, 17 nt, Human herpesvirus 6
cgugcuucuggcacagg

SEQ ID NO: 3986726 - RNA, 21 nt, Human herpesvirus 6
cguggggcacacauguauuua

SEQ ID NO: 3986727 - RNA, 20 nt, Human herpesvirus 6
cguuacccggaagcuucaag

SEQ ID NO: 3986728 - RNA, 22 nt, Human herpesvirus 6
cguuccucucucggcugacaac

SEQ ID NO: 3986729 - RNA, 17 nt, Human herpesvirus 6
cuaaauuauuuuuaaug

SEQ ID NO: 3986730 - RNA, 14 nt, Human herpesvirus 6
cuaaauuggucucu

SEQ ID NO: 3986731 - RNA, 23 nt, Human herpesvirus 6
cuaacaucugcuaacgcggcaac

SEQ ID NO: 3986732 - RNA, 21 nt, Human herpesvirus 6
cuaacgcggcaaccgcaguuc

SEQ ID NO: 3986733 - RNA, 21 nt, Human herpesvirus 6
cuaacggggcaaccgcaguuc

SEQ ID NO: 3986734 - RNA, 14 nt, Human herpesvirus 6
cuaauaugaacaau

SEQ ID NO: 3986735 - RNA, 14 nt, Human herpesvirus 6
cuaaugauaaauug

SEQ ID NO: 3986736 - RNA, 16 nt, Human herpesvirus 6
cuacaacagaaaaugc

SEQ ID NO: 3986737 - RNA, 13 nt, Human herpesvirus 6
cuacggaaaaucu

SEQ ID NO: 3986738 - RNA, 16 nt, Human herpesvirus 6
cuacugcacuuucgau

SEQ ID NO: 3986739 - RNA, 20 nt, Human herpesvirus 6
cuaggacuucguucuugaca

SEQ ID NO: 3986740 - RNA, 18 nt, Human herpesvirus 6
cuaguguuucgcagagga

SEQ ID NO: 3986741 - RNA, 14 nt, Human herpesvirus 6
cuauggcuuccgga

SEQ ID NO: 3986742 - RNA, 17 nt, Human herpesvirus 6
cuaugugucuccgccuu

SEQ ID NO: 3986743 - RNA, 16 nt, Human herpesvirus 6
cuauguuauguaaaga

SEQ ID NO: 3986744 - RNA, 19 nt, Human herpesvirus 6
cucaacacucucaguguaa

SEQ ID NO: 3986745 - RNA, 14 nt, Human herpesvirus 6
cucacaagcugucc

SEQ ID NO: 3986746 - RNA, 18 nt, Human herpesvirus 6
cuccucaacacucucagu

SEQ ID NO: 3986747 - RNA, 19 nt, Human herpesvirus 6
cuccugggagcucucccuc

SEQ ID NO: 3986748 - RNA, 20 nt, Human herpesvirus 6
cuccugggagcucucccucg

SEQ ID NO: 3986749 - RNA, 20 nt, Human herpesvirus 6
cucgccgaacuagaaaaaca

SEQ ID NO: 3986750 - RNA, 22 nt, Human herpesvirus 6
cucgcucacaauauuucacaua

SEQ ID NO: 3986751 - RNA, 22 nt, Human herpesvirus 6
cucgcuuaccguucaucauucc

SEQ ID NO: 3986752 - RNA, 20 nt, Human herpesvirus 6
cucgguccaaccccucccau

SEQ ID NO: 3986753 - RNA, 16 nt, Human herpesvirus 6
cucguaacgcggcaac

SEQ ID NO: 3986754 - RNA, 15 nt, Human herpesvirus 6
cucgugcucugccuc

SEQ ID NO: 3986755 - RNA, 16 nt, Human herpesvirus 6
cucuauauccugucgc

SEQ ID NO: 3986756 - RNA, 17 nt, Human herpesvirus 6
cucuauugguuaaaagg

SEQ ID NO: 3986757 - RNA, 21 nt, Human herpesvirus 6
cucugaaauuugagaaaguug

SEQ ID NO: 3986758 - RNA, 16 nt, Human herpesvirus 6
cucuuuuuaauuccaa

SEQ ID NO: 3986759 - RNA, 17 nt, Human herpesvirus 6
cugaaacuccccagaga

SEQ ID NO: 3986760 - RNA, 20 nt, Human herpesvirus 6
cugaagaugagcagcuuugg

SEQ ID NO: 3986761 - RNA, 16 nt, Human herpesvirus 6
cugacaaauacgagag

SEQ ID NO: 3986762 - RNA, 23 nt, Human herpesvirus 6
cugacugguauccaauuaacaca

SEQ ID NO: 3986763 - RNA, 16 nt, Human herpesvirus 6
cugacuguaccauugu

SEQ ID NO: 3986764 - RNA, 18 nt, Human herpesvirus 6
cugagaguaaauauuucu

SEQ ID NO: 3986765 - RNA, 17 nt, Human herpesvirus 6
cugagaucauaaauaaa

SEQ ID NO: 3986766 - RNA, 17 nt, Human herpesvirus 6
cugaucacagagaaaaa

SEQ ID NO: 3986767 - RNA, 12 nt, Human herpesvirus 6
cugauggaaacc

SEQ ID NO: 3986768 - RNA, 13 nt, Human herpesvirus 6
cugcacuuucgau

SEQ ID NO: 3986769 - RNA, 15 nt, Human herpesvirus 6
cugccaucccuuccu

SEQ ID NO: 3986770 - RNA, 15 nt, Human herpesvirus 6
cugcggucgccgccu

SEQ ID NO: 3986771 - RNA, 16 nt, Human herpesvirus 6
cuggaaaacgacacag

SEQ ID NO: 3986772 - RNA, 19 nt, Human herpesvirus 6
cuggaucggacggugaugg

SEQ ID NO: 3986773 - RNA, 19 nt, Human herpesvirus 6
cuggcgcgcauguugcagu

SEQ ID NO: 3986774 - RNA, 18 nt, Human herpesvirus 6
cuggcggacaccgagggc

SEQ ID NO: 3986775 - RNA, 21 nt, Human herpesvirus 6
cuggcggacaccgagggcgga

SEQ ID NO: 3986776 - RNA, 19 nt, Human herpesvirus 6
cugggacccacgguggccu

SEQ ID NO: 3986777 - RNA, 13 nt, Human herpesvirus 6
cuguaaacugguc

SEQ ID NO: 3986778 - RNA, 20 nt, Human herpesvirus 6
cugucgaguaauuguggauu

SEQ ID NO: 3986779 - RNA, 16 nt, Human herpesvirus 6
cugugaauccagacua

SEQ ID NO: 3986780 - RNA, 21 nt, Human herpesvirus 6
cuguuauaacacaacaaguaa

SEQ ID NO: 3986781 - RNA, 21 nt, Human herpesvirus 6
cuguucgauguacaguuucuc

SEQ ID NO: 3986782 - RNA, 19 nt, Human herpesvirus 6
cuuaaaaaaacacaguauu

SEQ ID NO: 3986783 - RNA, 23 nt, Human herpesvirus 6
cuuacacaaauugaccagccaga

SEQ ID NO: 3986784 - RNA, 15 nt, Human herpesvirus 6
cuuaccauauauugg

SEQ ID NO: 3986785 - RNA, 16 nt, Human herpesvirus 6
cuuagacgaaaauugu

SEQ ID NO: 3986786 - RNA, 18 nt, Human herpesvirus 6
cuuagacuuggugaugau

SEQ ID NO: 3986787 - RNA, 20 nt, Human herpesvirus 6
cuuauuaacgcagcaacaau

SEQ ID NO: 3986788 - RNA, 22 nt, Human herpesvirus 6
cuucauacccgaaguucucuca

SEQ ID NO: 3986789 - RNA, 18 nt, Human herpesvirus 6
cuuccaguauugaagaaa

SEQ ID NO: 3986790 - RNA, 23 nt, Human herpesvirus 6
cuucccuuuuacaauacacagaa

SEQ ID NO: 3986791 - RNA, 14 nt, Human herpesvirus 6
cuucgacuucaaac

SEQ ID NO: 3986792 - RNA, 22 nt, Human herpesvirus 6
cuucugccugaaaaugaagaga

SEQ ID NO: 3986793 - RNA, 13 nt, Human herpesvirus 6
cuugcgaccuggc

SEQ ID NO: 3986794 - RNA, 13 nt, Human herpesvirus 6
cuugcgauacaug

SEQ ID NO: 3986795 - RNA, 20 nt, Human herpesvirus 6
cuugggugugcauugugaca

SEQ ID NO: 3986796 - RNA, 12 nt, Human herpesvirus 6
cuuuaaagcagc

SEQ ID NO: 3986797 - RNA, 21 nt, Human herpesvirus 6
cuuuccgagcggugugcaguu

SEQ ID NO: 3986798 - RNA, 10 nt, Human herpesvirus 6
cuuuccugcc

SEQ ID NO: 3986799 - RNA, 14 nt, Human herpesvirus 6
cuuuccugcccaag

SEQ ID NO: 3986800 - RNA, 13 nt, Human herpesvirus 6
cuuugacauuuau

SEQ ID NO: 3986801 - RNA, 14 nt, Human herpesvirus 6
cuuuucguacggcg

SEQ ID NO: 3986802 - RNA, 20 nt, Human herpesvirus 6
cuuuuguuguuuuuuggaau

SEQ ID NO: 3986803 - RNA, 15 nt, Human herpesvirus 6
cuuuuuaaucaugau

SEQ ID NO: 3986804 - RNA, 19 nt, Human herpesvirus 6
gaaaaaacaacgacuauca

SEQ ID NO: 3986805 - RNA, 11 nt, Human herpesvirus 6
gaaaacaaugc

SEQ ID NO: 3986806 - RNA, 13 nt, Human herpesvirus 6
gaaaacccagcgg

SEQ ID NO: 3986807 - RNA, 20 nt, Human herpesvirus 6
gaaaauugaugauguucuuc

SEQ ID NO: 3986808 - RNA, 21 nt, Human herpesvirus 6
gaaacaguucguagaacggaa

SEQ ID NO: 3986809 - RNA, 20 nt, Human herpesvirus 6
gaaacggcgcggagcccaag

SEQ ID NO: 3986810 - RNA, 22 nt, Human herpesvirus 6
gaaacggcgcggagcccaagaa

SEQ ID NO: 3986811 - RNA, 18 nt, Human herpesvirus 6
acgagagaguccauuucu

SEQ ID NO: 3986812 - RNA, 19 nt, Human herpesvirus 6
acgccguguuucgccaaga

SEQ ID NO: 3986813 - RNA, 22 nt, Human herpesvirus 6
acgccuccacaugacaccucaa

SEQ ID NO: 3986814 - RNA, 14 nt, Human herpesvirus 6
acggaccgagagcc

SEQ ID NO: 3986815 - RNA, 16 nt, Human herpesvirus 6
acggauucgaucgaga

SEQ ID NO: 3986816 - RNA, 19 nt, Human herpesvirus 6
acggcaacgcuccuccccu

SEQ ID NO: 3986817 - RNA, 22 nt, Human herpesvirus 6
acggccuuucuguuuuaauuaa

SEQ ID NO: 3986818 - RNA, 23 nt, Human herpesvirus 6
acgggcgucaucgguggcagagg

SEQ ID NO: 3986819 - RNA, 15 nt, Human herpesvirus 6
acguagcgaaccagg

SEQ ID NO: 3986820 - RNA, 20 nt, Human herpesvirus 6
acguaucccuaauaaauguc

SEQ ID NO: 3986821 - RNA, 14 nt, Human herpesvirus 6
acguauccucagaa

SEQ ID NO: 3986822 - RNA, 20 nt, Human herpesvirus 6
acgucgaaacgaaagcugau

SEQ ID NO: 3986823 - RNA, 11 nt, Human herpesvirus 6
acgucuucaaa

SEQ ID NO: 3986824 - RNA, 23 nt, Human herpesvirus 6
acgugccaccgucugggacccac

SEQ ID NO: 3986825 - RNA, 13 nt, Human herpesvirus 6
acguuaauguuua

SEQ ID NO: 3986826 - RNA, 18 nt, Human herpesvirus 6
acguugguaucaguggau

SEQ ID NO: 3986827 - RNA, 17 nt, Human herpesvirus 6
acuaagauugugcaguu

SEQ ID NO: 3986828 - RNA, 12 nt, Human herpesvirus 6
acuaauguggau

SEQ ID NO: 3986829 - RNA, 11 nt, Human herpesvirus 6
acuauacuuuu

SEQ ID NO: 3986830 - RNA, 20 nt, Human herpesvirus 6
acuaucguuuauaaaaauag

SEQ ID NO: 3986831 - RNA, 17 nt, Human herpesvirus 6
acuauugacauaggaau

SEQ ID NO: 3986832 - RNA, 19 nt, Human herpesvirus 6
acuauuuuagucacacauu

SEQ ID NO: 3986833 - RNA, 14 nt, Human herpesvirus 6
acucaauuuugaaa

SEQ ID NO: 3986834 - RNA, 16 nt, Human herpesvirus 6
acucauacacaggauu

SEQ ID NO: 3986835 - RNA, 15 nt, Human herpesvirus 6
acucgugugucuuug

SEQ ID NO: 3986836 - RNA, 17 nt, Human herpesvirus 6
acucguuuuccuucccu

SEQ ID NO: 3986837 - RNA, 14 nt, Human herpesvirus 6
acucuaaaagcugc

SEQ ID NO: 3986838 - RNA, 14 nt, Human herpesvirus 6
acucucucaguaau

SEQ ID NO: 3986839 - RNA, 16 nt, Human herpesvirus 6
acugaccguuguaaga

SEQ ID NO: 3986840 - RNA, 13 nt, Human herpesvirus 6
acugauggcaggu

SEQ ID NO: 3986841 - RNA, 15 nt, Human herpesvirus 6
acugauuaguuuuca

SEQ ID NO: 3986842 - RNA, 23 nt, Human herpesvirus 6
acuggccauauuaggcugcagcc

SEQ ID NO: 3986843 - RNA, 20 nt, Human herpesvirus 6
acuucacgaucuacacaccg

SEQ ID NO: 3986844 - RNA, 18 nt, Human herpesvirus 6
acuuucuucgccuguaaa

SEQ ID NO: 3986845 - RNA, 22 nt, Human herpesvirus 6
acuuuuugccgaagauagcucu

SEQ ID NO: 3986846 - RNA, 15 nt, Human herpesvirus 6
agaaaaaaacuguga

SEQ ID NO: 3986847 - RNA, 14 nt, Human herpesvirus 6
agaaaaaacgauau

SEQ ID NO: 3986848 - RNA, 16 nt, Human herpesvirus 6
agaaaauaaaaaaaag

SEQ ID NO: 3986849 - RNA, 17 nt, Human herpesvirus 6
agaaacguuaauguuua

SEQ ID NO: 3986850 - RNA, 20 nt, Human herpesvirus 6
agaaagagauaaaaagagag

SEQ ID NO: 3986851 - RNA, 20 nt, Human herpesvirus 6
agaaaguucuaugucuagau

SEQ ID NO: 3986852 - RNA, 21 nt, Human herpesvirus 6
agaaauuacauaagcaaaugu

SEQ ID NO: 3986853 - RNA, 14 nt, Human herpesvirus 6
agaacaacagcaug

SEQ ID NO: 3986854 - RNA, 22 nt, Human herpesvirus 6
agaacguggccguuacaguuuc

SEQ ID NO: 3986855 - RNA, 19 nt, Human herpesvirus 6
agaacucuaaaagcugcua

SEQ ID NO: 3986856 - RNA, 18 nt, Human herpesvirus 6
agaauaauuauggacaac

SEQ ID NO: 3986857 - RNA, 21 nt, Human herpesvirus 6
agaauucuucugugacuauau

SEQ ID NO: 3986858 - RNA, 17 nt, Human herpesvirus 6
agacaaaccagcaaguu

SEQ ID NO: 3986859 - RNA, 14 nt, Human herpesvirus 6
agacacacaaaaaa

SEQ ID NO: 3986860 - RNA, 22 nt, Human herpesvirus 6
agacaucacauuauaagacacu

SEQ ID NO: 3986861 - RNA, 22 nt, Human herpesvirus 6
agaccaauuuaugucauuucau

SEQ ID NO: 3986862 - RNA, 20 nt, Human herpesvirus 6
agacuggaaaacuaugugca

SEQ ID NO: 3986863 - RNA, 12 nt, Human herpesvirus 6
agagaaggaaaa

SEQ ID NO: 3986864 - RNA, 17 nt, Human herpesvirus 6
agagacguuguuugacc

SEQ ID NO: 3986865 - RNA, 19 nt, Human herpesvirus 6
agagcgagucuugugugaa

SEQ ID NO: 3986866 - RNA, 17 nt, Human herpesvirus 6
agagcgcaucuuuaaca

SEQ ID NO: 3986867 - RNA, 12 nt, Human herpesvirus 6
agaggaaagaau

SEQ ID NO: 3986868 - RNA, 13 nt, Human herpesvirus 6
agaggaauuggcg

SEQ ID NO: 3986869 - RNA, 23 nt, Human herpesvirus 6
agaucauaaauaaaugaauagau

SEQ ID NO: 3986870 - RNA, 23 nt, Human herpesvirus 6
agaucuauuucucguucuccguu

SEQ ID NO: 3986871 - RNA, 13 nt, Human herpesvirus 6
agaugccuguagg

SEQ ID NO: 3986872 - RNA, 16 nt, Human herpesvirus 6
agauuacggcaacaua

SEQ ID NO: 3986873 - RNA, 20 nt, Human herpesvirus 6
agauuuggcauuaaaggacu

SEQ ID NO: 3986874 - RNA, 18 nt, Human herpesvirus 6
agcaaguugcuaccgcug

SEQ ID NO: 3986875 - RNA, 17 nt, Human herpesvirus 6
agcaauaggcaccuauc

SEQ ID NO: 3986876 - RNA, 14 nt, Human herpesvirus 6
agcagcucugcaau

SEQ ID NO: 3986877 - RNA, 16 nt, Human herpesvirus 6
agcauauuuuggcaaa

SEQ ID NO: 3986878 - RNA, 16 nt, Human herpesvirus 6
agccaaugauucuuaa

SEQ ID NO: 3986879 - RNA, 23 nt, Human herpesvirus 6
agccucgacguccaccuggaaaa

SEQ ID NO: 3986880 - RNA, 20 nt, Human herpesvirus 6
agcgaucauaaaacugccaa

SEQ ID NO: 3986881 - RNA, 20 nt, Human herpesvirus 6
agcgcgucguucgcuucuua

SEQ ID NO: 3986882 - RNA, 17 nt, Human herpesvirus 6
agcgugugauucaguau

SEQ ID NO: 3986883 - RNA, 20 nt, Human herpesvirus 6
agcguuggaaagcuuuaugg

SEQ ID NO: 3986884 - RNA, 14 nt, Human herpesvirus 6
agcuagagugacau

SEQ ID NO: 3986885 - RNA, 18 nt, Human herpesvirus 6
aggaacaaaacuuucauc

SEQ ID NO: 3986886 - RNA, 14 nt, Human herpesvirus 6
aggaacgauaugcu

SEQ ID NO: 3986887 - RNA, 11 nt, Human herpesvirus 6
aggaauugcuu

SEQ ID NO: 3986888 - RNA, 15 nt, Human herpesvirus 6
aggaggaggaagaga

SEQ ID NO: 3986889 - RNA, 16 nt, Human herpesvirus 6
aggcaaacgagaacuc

SEQ ID NO: 3986890 - RNA, 13 nt, Human herpesvirus 6
agggacccacagg

SEQ ID NO: 3986891 - RNA, 16 nt, Human herpesvirus 6
agggacccacaggcgg

SEQ ID NO: 3986892 - RNA, 23 nt, Human herpesvirus 6
agggcagggggggucucuguucu

SEQ ID NO: 3986893 - RNA, 17 nt, Human herpesvirus 6
aggggagagacauccau

SEQ ID NO: 3986894 - RNA, 23 nt, Human herpesvirus 6
aggggcgcgagacagcggacagc

SEQ ID NO: 3986895 - RNA, 19 nt, Human herpesvirus 6
agggugcuuugcuucagug

SEQ ID NO: 3986896 - RNA, 22 nt, Human herpesvirus 6
agguacaaaacauggacaacuu

SEQ ID NO: 3986897 - RNA, 15 nt, Human herpesvirus 6
agguccgacacgccc

SEQ ID NO: 3986898 - RNA, 12 nt, Human herpesvirus 6
aggugaaaugaa

SEQ ID NO: 3986899 - RNA, 23 nt, Human herpesvirus 6
aggugacucuucucuaaaaacua

SEQ ID NO: 3986900 - RNA, 13 nt, Human herpesvirus 6
agguguuaaacga

SEQ ID NO: 3986901 - RNA, 12 nt, Human herpesvirus 6
agguuaucggaa

SEQ ID NO: 3986902 - RNA, 18 nt, Human herpesvirus 6
aguaauauaggauuuccc

SEQ ID NO: 3986903 - RNA, 20 nt, Human herpesvirus 6
aguagcacaaaccaaaauga

SEQ ID NO: 3986904 - RNA, 14 nt, Human herpesvirus 6
aguaucgagauuuu

SEQ ID NO: 3986905 - RNA, 22 nt, Human herpesvirus 6
agucaggaaaaaguuaagaaaa

SEQ ID NO: 3986906 - RNA, 23 nt, Human herpesvirus 6
agucaguaaugauauaaaagaaa

SEQ ID NO: 3986907 - RNA, 18 nt, Human herpesvirus 6
agucccaucuauacaccc

SEQ ID NO: 3986908 - RNA, 22 nt, Human herpesvirus 6
agucugucgcuuauuucguuug

SEQ ID NO: 3986909 - RNA, 19 nt, Human herpesvirus 6
agugauuauggugccucag

SEQ ID NO: 3986910 - RNA, 22 nt, Human herpesvirus 6
agugccguugagugccucagag

SEQ ID NO: 3986911 - RNA, 19 nt, Human herpesvirus 6
agugcgagacuggaaaacu

SEQ ID NO: 3986912 - RNA, 16 nt, Human herpesvirus 6
aguggucguuggauua

SEQ ID NO: 3986913 - RNA, 22 nt, Human herpesvirus 6
aguguaaaguucucgaauuguu

SEQ ID NO: 3986914 - RNA, 23 nt, Human herpesvirus 6
aguuaggauuacacuuucuugua

SEQ ID NO: 3986915 - RNA, 23 nt, Human herpesvirus 6
aguucagaagagaugaaagacag

SEQ ID NO: 3986916 - RNA, 20 nt, Human herpesvirus 6
aguuccaaaacuucuauaug

SEQ ID NO: 3986917 - RNA, 17 nt, Human herpesvirus 6
aguuuaccuauuuacaa

SEQ ID NO: 3986918 - RNA, 19 nt, Human herpesvirus 6
aguuucaccauguccagga

SEQ ID NO: 3986919 - RNA, 17 nt, Human herpesvirus 6
aguuuguguuuguaaau

SEQ ID NO: 3986920 - RNA, 18 nt, Human herpesvirus 6
aguuuuuccgauacagca

SEQ ID NO: 3986921 - RNA, 14 nt, Human herpesvirus 6
aguuuuugugcggc

SEQ ID NO: 3986922 - RNA, 13 nt, Human herpesvirus 6
auaaaaacucaca

SEQ ID NO: 3986923 - RNA, 16 nt, Human herpesvirus 6
auaaaauaucccgcgu

SEQ ID NO: 3986924 - RNA, 17 nt, Human herpesvirus 6
auaaacugugucuguuc

SEQ ID NO: 3986925 - RNA, 18 nt, Human herpesvirus 6
cccacgguggccuggcac

SEQ ID NO: 3986926 - RNA, 19 nt, Human herpesvirus 6
cccacuccuacuauccgcc

SEQ ID NO: 3986927 - RNA, 18 nt, Human herpesvirus 6
cccagauuuguguucaag

SEQ ID NO: 3986928 - RNA, 18 nt, Human herpesvirus 6
cccugccgagccugugga

SEQ ID NO: 3986929 - RNA, 17 nt, Human herpesvirus 6
cccugccuauacaggca

SEQ ID NO: 3986930 - RNA, 13 nt, Human herpesvirus 6
ccgagccugugga

SEQ ID NO: 3986931 - RNA, 15 nt, Human herpesvirus 6
ccgaucucucucaga

SEQ ID NO: 3986932 - RNA, 13 nt, Human herpesvirus 6
ccgccaccaccgc

SEQ ID NO: 3986933 - RNA, 21 nt, Human herpesvirus 6
ccgccgugcuucuggcacagg

SEQ ID NO: 3986934 - RNA, 20 nt, Human herpesvirus 6
ccgcgguuggggucuuuccu

SEQ ID NO: 3986935 - RNA, 23 nt, Human herpesvirus 6
ccgcgguuggggucuuuccugca

SEQ ID NO: 3986936 - RNA, 22 nt, Human herpesvirus 6
ccgcgguuugggggucuuuccu

SEQ ID NO: 3986937 - RNA, 21 nt, Human herpesvirus 6
ccgcgguuuggggucuuuccu

SEQ ID NO: 3986938 - RNA, 19 nt, Human herpesvirus 6
ccggcugagcggaguggag

SEQ ID NO: 3986939 - RNA, 22 nt, Human herpesvirus 6
ccgucgauaauaauucagucug

SEQ ID NO: 3986940 - RNA, 19 nt, Human herpesvirus 6
ccgucuccguuccaaccuc

SEQ ID NO: 3986941 - RNA, 14 nt, Human herpesvirus 6
ccguuacaguuucc

SEQ ID NO: 3986942 - RNA, 14 nt, Human herpesvirus 6
ccguuucaaauagu

SEQ ID NO: 3986943 - RNA, 15 nt, Human herpesvirus 6
ccucgugcucugccu

SEQ ID NO: 3986944 - RNA, 15 nt, Human herpesvirus 6
ccucuaaacccagac

SEQ ID NO: 3986945 - RNA, 12 nt, Human herpesvirus 6
ccugcacaggcg

SEQ ID NO: 3986946 - RNA, 17 nt, Human herpesvirus 6
ccuggcacggugccaaa

SEQ ID NO: 3986947 - RNA, 16 nt, Human herpesvirus 6
ccugggagcucucccu

SEQ ID NO: 3986948 - RNA, 22 nt, Human herpesvirus 6
ccuguccgugacacacagaaua

SEQ ID NO: 3986949 - RNA, 14 nt, Human herpesvirus 6
ccuucacuuuuuca

SEQ ID NO: 3986950 - RNA, 21 nt, Human herpesvirus 6
ccuugaauuauuuauauugga

SEQ ID NO: 3986951 - RNA, 16 nt, Human herpesvirus 6
ccuuguguaucuguga

SEQ ID NO: 3986952 - RNA, 11 nt, Human herpesvirus 6
ccuuguuuucu

SEQ ID NO: 3986953 - RNA, 12 nt, Human herpesvirus 6
cgaauauguuuu

SEQ ID NO: 3986954 - RNA, 15 nt, Human herpesvirus 6
cgaaucucaagcaca

SEQ ID NO: 3986955 - RNA, 15 nt, Human herpesvirus 6
cgacacgcuggagca

SEQ ID NO: 3986956 - RNA, 14 nt, Human herpesvirus 6
cgagaacucuaaaa

SEQ ID NO: 3986957 - RNA, 20 nt, Human herpesvirus 6
cgagacagcggacagcgggg

SEQ ID NO: 3986958 - RNA, 12 nt, Human herpesvirus 6
cgauacccagcg

SEQ ID NO: 3986959 - RNA, 18 nt, Human herpesvirus 6
cgaucuuauauuaaagau

SEQ ID NO: 3986960 - RNA, 15 nt, Human herpesvirus 6
cgauucagaccucau

SEQ ID NO: 3986961 - RNA, 17 nt, Human herpesvirus 6
cgauucuaauaaaagac

SEQ ID NO: 3986962 - RNA, 15 nt, Human herpesvirus 6
cgcaaaccaccccaa

SEQ ID NO: 3986963 - RNA, 21 nt, Human herpesvirus 6
cgcauuagucacagccuugau

SEQ ID NO: 3986964 - RNA, 16 nt, Human herpesvirus 6
cgccacugcgaggcca

SEQ ID NO: 3986965 - RNA, 19 nt, Human herpesvirus 6
cgccggaucguaaggcagu

SEQ ID NO: 3986966 - RNA, 11 nt, Human herpesvirus 6
cgccgugugug

SEQ ID NO: 3986967 - RNA, 19 nt, Human herpesvirus 6
cgcgacagggugagucaca

SEQ ID NO: 3986968 - RNA, 16 nt, Human herpesvirus 6
cgcgcauguugcaguu

SEQ ID NO: 3986969 - RNA, 16 nt, Human herpesvirus 6
cgcggccguucucucu

SEQ ID NO: 3986970 - RNA, 17 nt, Human herpesvirus 6
cgcgguaacgccacagc

SEQ ID NO: 3986971 - RNA, 17 nt, Human herpesvirus 6
cgcggucauaaacagac

SEQ ID NO: 3986972 - RNA, 18 nt, Human herpesvirus 6
cgcuaaggugagccagau

SEQ ID NO: 3986973 - RNA, 17 nt, Human herpesvirus 6
cgcuaucgcccugcucc

SEQ ID NO: 3986974 - RNA, 16 nt, Human herpesvirus 6
cgcuccuccccugucc

SEQ ID NO: 3986975 - RNA, 18 nt, Human herpesvirus 6
cgcugcggucgccgccuc

SEQ ID NO: 3986976 - RNA, 21 nt, Human herpesvirus 6
cggaaaaauuuuauaaugagu

SEQ ID NO: 3986977 - RNA, 15 nt, Human herpesvirus 6
cggacaaugcagaac

SEQ ID NO: 3986978 - RNA, 13 nt, Human herpesvirus 6
cggagaacgggca

SEQ ID NO: 3986979 - RNA, 17 nt, Human herpesvirus 6
cggagauuaaaacauca

SEQ ID NO: 3986980 - RNA, 18 nt, Human herpesvirus 6
cggagguaacggagcccg

SEQ ID NO: 3986981 - RNA, 13 nt, Human herpesvirus 6
cggaguugcagug

SEQ ID NO: 3986982 - RNA, 13 nt, Human herpesvirus 6
cggauggagcccg

SEQ ID NO: 3986983 - RNA, 16 nt, Human herpesvirus 6
cggccuggaguacaag

SEQ ID NO: 3986984 - RNA, 16 nt, Human herpesvirus 6
cggcggauggagcccg

SEQ ID NO: 3986985 - RNA, 19 nt, Human herpesvirus 6
cggcggggggacgggcgga

SEQ ID NO: 3986986 - RNA, 23 nt, Human herpesvirus 6
cgggacaaaaccgaggcagagca

SEQ ID NO: 3986987 - RNA, 14 nt, Human herpesvirus 6
cgggaccuggcgga

SEQ ID NO: 3986988 - RNA, 12 nt, Human herpesvirus 6
cgggcaggaauc

SEQ ID NO: 3986989 - RNA, 17 nt, Human herpesvirus 6
cgggccuccgccacugc

SEQ ID NO: 3986990 - RNA, 12 nt, Human herpesvirus 6
cgggcggggcgg

SEQ ID NO: 3986991 - RNA, 19 nt, Human herpesvirus 6
cggggaggaggaggaggaa

SEQ ID NO: 3986992 - RNA, 20 nt, Human herpesvirus 6
cggggaggaggaggaggaag

SEQ ID NO: 3986993 - RNA, 17 nt, Human herpesvirus 6
cggguaagcagcagaac

SEQ ID NO: 3986994 - RNA, 18 nt, Human herpesvirus 6
cgguccggcugagcggag

SEQ ID NO: 3986995 - RNA, 23 nt, Human herpesvirus 6
cggugccaaaggaaaccaccggc

SEQ ID NO: 3986996 - RNA, 22 nt, Human herpesvirus 6
cgguuugucucgcaaacagcuu

SEQ ID NO: 3986997 - RNA, 14 nt, Human herpesvirus 6
cguaaaucugcguc

SEQ ID NO: 3986998 - RNA, 22 nt, Human herpesvirus 6
cguaacgcggcaaccgcaguuc

SEQ ID NO: 3986999 - RNA, 21 nt, Human herpesvirus 6
cgucauaccgaucccagcuca

SEQ ID NO: 3987000 - RNA, 17 nt, Human herpesvirus 6
cguccauacaguugugu

SEQ ID NO: 3987001 - RNA, 17 nt, Human herpesvirus 6
cguccucgugcucugcc

SEQ ID NO: 3987002 - RNA, 20 nt, Human herpesvirus 6
cgucuccgucuccucgcaau

SEQ ID NO: 3987003 - RNA, 16 nt, Human herpesvirus 6
cgucuccucauggaga

SEQ ID NO: 3987004 - RNA, 19 nt, Human herpesvirus 6
cgucuccugggagcucucc

SEQ ID NO: 3987005 - RNA, 13 nt, Human herpesvirus 6
cgugauguuuucc

SEQ ID NO: 3987006 - RNA, 20 nt, Human herpesvirus 6
cgugccuguuuuggugaaca

SEQ ID NO: 3987007 - RNA, 18 nt, Human herpesvirus 6
cgugcugcaaggccgacu

SEQ ID NO: 3987008 - RNA, 17 nt, Human herpesvirus 6
cgugugcgauuuacugg

SEQ ID NO: 3987009 - RNA, 18 nt, Human herpesvirus 6
cguuaguuuuuuguuuca

SEQ ID NO: 3987010 - RNA, 17 nt, Human herpesvirus 6
cguuuuccaugugaauc

SEQ ID NO: 3987011 - RNA, 12 nt, Human herpesvirus 6
cuaaaagucagu

SEQ ID NO: 3987012 - RNA, 22 nt, Human herpesvirus 6
cuaaaaucaaaaaaauuuugau

SEQ ID NO: 3987013 - RNA, 17 nt, Human herpesvirus 6
cuaaaauuguaauuuug

SEQ ID NO: 3987014 - RNA, 13 nt, Human herpesvirus 6
cuaaauacauuca

SEQ ID NO: 3987015 - RNA, 19 nt, Human herpesvirus 6
cuaaauauaucaaagaugu

SEQ ID NO: 3987016 - RNA, 17 nt, Human herpesvirus 6
cuaaauuucuacaaaaa

SEQ ID NO: 3987017 - RNA, 12 nt, Human herpesvirus 6
cuaauaaauguc

SEQ ID NO: 3987018 - RNA, 20 nt, Human herpesvirus 6
cuacaauacgguuugucucg

SEQ ID NO: 3987019 - RNA, 18 nt, Human herpesvirus 6
cuacguccuuauacacga

SEQ ID NO: 3987020 - RNA, 13 nt, Human herpesvirus 6
cuacguucgccuc

SEQ ID NO: 3987021 - RNA, 11 nt, Human herpesvirus 6
cuagaggugcc

SEQ ID NO: 3987022 - RNA, 15 nt, Human herpesvirus 6
cuaggacguacagaa

SEQ ID NO: 3987023 - RNA, 23 nt, Human herpesvirus 6
cuaguagccuaggccuucaccug

SEQ ID NO: 3987024 - RNA, 17 nt, Human herpesvirus 6
cuaugucgauguggaua

SEQ ID NO: 3987025 - RNA, 19 nt, Human herpesvirus 6
cuauuauaagcaaacaugu

SEQ ID NO: 3987026 - RNA, 17 nt, Human herpesvirus 6
cuauugagauucuccgu

SEQ ID NO: 3987027 - RNA, 20 nt, Human herpesvirus 6
cucaaacuuuuagagacuuu

SEQ ID NO: 3987028 - RNA, 16 nt, Human herpesvirus 6
cucaaagaaaagaugu

SEQ ID NO: 3987029 - RNA, 20 nt, Human herpesvirus 6
cucaacauuaaaaaaaauag

SEQ ID NO: 3987030 - RNA, 18 nt, Human herpesvirus 6
cucccaucccccuccccg

SEQ ID NO: 3987031 - RNA, 22 nt, Human herpesvirus 6
cuccuacuauccgcccuccccg

SEQ ID NO: 3987032 - RNA, 21 nt, Human herpesvirus 6
cucgauuuugugaaugagaca

SEQ ID NO: 3987033 - RNA, 11 nt, Human herpesvirus 6
cucggaaaauu

SEQ ID NO: 3987034 - RNA, 23 nt, Human herpesvirus 6
cucggauauauacuuacuugagu

SEQ ID NO: 3987035 - RNA, 18 nt, Human herpesvirus 6
cucuaccuggaaacaacg

SEQ ID NO: 3987036 - RNA, 22 nt, Human herpesvirus 6
cucucucggcugacaacaaagg

SEQ ID NO: 3987037 - RNA, 12 nt, Human herpesvirus 6
cucugaaacacu

SEQ ID NO: 3987038 - RNA, 16 nt, Human herpesvirus 6
cucugcaaaacaaagg

SEQ ID NO: 3987039 - RNA, 13 nt, Human herpesvirus 6
cucuguucugcca

SEQ ID NO: 3987040 - RNA, 13 nt, Human herpesvirus 6
gaucauuauauca

SEQ ID NO: 3987041 - RNA, 22 nt, Human herpesvirus 6
gauccuguaauaguauugucug

SEQ ID NO: 3987042 - RNA, 14 nt, Human herpesvirus 6
gaucuucugcuaau

SEQ ID NO: 3987043 - RNA, 18 nt, Human herpesvirus 6
gaugaauuaccuguuuua

SEQ ID NO: 3987044 - RNA, 18 nt, Human herpesvirus 6
gaugauuauucugucuug

SEQ ID NO: 3987045 - RNA, 23 nt, Human herpesvirus 6
gauguaaauugauuagcaaucau

SEQ ID NO: 3987046 - RNA, 19 nt, Human herpesvirus 6
gauguagauaguuuugcgu

SEQ ID NO: 3987047 - RNA, 16 nt, Human herpesvirus 6
gauguauggagauguu

SEQ ID NO: 3987048 - RNA, 18 nt, Human herpesvirus 6
gauuauauauuugcauac

SEQ ID NO: 3987049 - RNA, 14 nt, Human herpesvirus 6
gauucuaauaaaag

SEQ ID NO: 3987050 - RNA, 21 nt, Human herpesvirus 6
gauucuuaauucuuaaagcgu

SEQ ID NO: 3987051 - RNA, 21 nt, Human herpesvirus 6
gauuucagguaauauuccgaa

SEQ ID NO: 3987052 - RNA, 15 nt, Human herpesvirus 6
gcaacaauccauguu

SEQ ID NO: 3987053 - RNA, 21 nt, Human herpesvirus 6
gcaacuacuuuuucaaguaag

SEQ ID NO: 3987054 - RNA, 20 nt, Human herpesvirus 6
gcaauuucuuuugagggaau

SEQ ID NO: 3987055 - RNA, 13 nt, Human herpesvirus 6
gcaccgcuguggc

SEQ ID NO: 3987056 - RNA, 15 nt, Human herpesvirus 6
gcacggugccaaagg

SEQ ID NO: 3987057 - RNA, 15 nt, Human herpesvirus 6
gcacuccgugucgcu

SEQ ID NO: 3987058 - RNA, 21 nt, Human herpesvirus 6
gcacuuccgcgauacccagcg

SEQ ID NO: 3987059 - RNA, 20 nt, Human herpesvirus 6
gcagacuaauccauaugaaa

SEQ ID NO: 3987060 - RNA, 23 nt, Human herpesvirus 6
gcagaggggaagggaauaacaga

SEQ ID NO: 3987061 - RNA, 13 nt, Human herpesvirus 6
gcagaucaucaaa

SEQ ID NO: 3987062 - RNA, 14 nt, Human herpesvirus 6
gcagcaaauaaaua

SEQ ID NO: 3987063 - RNA, 12 nt, Human herpesvirus 6
gcagguauaaga

SEQ ID NO: 3987064 - RNA, 15 nt, Human herpesvirus 6
gcauaauccuuuucu

SEQ ID NO: 3987065 - RNA, 12 nt, Human herpesvirus 6
gccaaaggaaac

SEQ ID NO: 3987066 - RNA, 17 nt, Human herpesvirus 6
gccaaaggaaaccaccg

SEQ ID NO: 3987067 - RNA, 16 nt, Human herpesvirus 6
gccaauagauggugcu

SEQ ID NO: 3987068 - RNA, 16 nt, Human herpesvirus 6
gccaccgucugggacc

SEQ ID NO: 3987069 - RNA, 20 nt, Human herpesvirus 6
gccaccgucugggacccacg

SEQ ID NO: 3987070 - RNA, 22 nt, Human herpesvirus 6
gccaccgucugggacccacggu

SEQ ID NO: 3987071 - RNA, 19 nt, Human herpesvirus 6
gccaugaaacaggaacagu

SEQ ID NO: 3987072 - RNA, 15 nt, Human herpesvirus 6
gccgccguuacuguc

SEQ ID NO: 3987073 - RNA, 16 nt, Human herpesvirus 6
gccgcugcagaaaaac

SEQ ID NO: 3987074 - RNA, 18 nt, Human herpesvirus 6
gccgcuucggacccgagg

SEQ ID NO: 3987075 - RNA, 19 nt, Human herpesvirus 6
gccgucacacucuuaacua

SEQ ID NO: 3987076 - RNA, 20 nt, Human herpesvirus 6
gccuccccgggugcuccgcc

SEQ ID NO: 3987077 - RNA, 20 nt, Human herpesvirus 6
gccuccgccacugcgaggcc

SEQ ID NO: 3987078 - RNA, 15 nt, Human herpesvirus 6
gccuguuccacgcgc

SEQ ID NO: 3987079 - RNA, 24 nt, Human herpesvirus 6
gccuguuccacgcgcgugucggcu

SEQ ID NO: 3987080 - RNA, 14 nt, Human herpesvirus 6
gcgaacgaaaacuc

SEQ ID NO: 3987081 - RNA, 16 nt, Human herpesvirus 6
gcgaccgaccccugcc

SEQ ID NO: 3987082 - RNA, 22 nt, Human herpesvirus 6
gcgacgugccaccgucugggac

SEQ ID NO: 3987083 - RNA, 15 nt, Human herpesvirus 6
gcgagccgcggggag

SEQ ID NO: 3987084 - RNA, 16 nt, Human herpesvirus 6
gcgaggugacggaggc

SEQ ID NO: 3987085 - RNA, 18 nt, Human herpesvirus 6
gcgauucuaauaaaagac

SEQ ID NO: 3987086 - RNA, 13 nt, Human herpesvirus 6
gcgauuuaaacaa

SEQ ID NO: 3987087 - RNA, 21 nt, Human herpesvirus 6
gcgccuuguguaucugugaac

SEQ ID NO: 3987088 - RNA, 15 nt, Human herpesvirus 6
gcgcgacgugccacc

SEQ ID NO: 3987089 - RNA, 17 nt, Human herpesvirus 6
gcgcggagcacgcacga

SEQ ID NO: 3987090 - RNA, 18 nt, Human herpesvirus 6
gcggagcggaggggcgcg

SEQ ID NO: 3987091 - RNA, 23 nt, Human herpesvirus 6
gcggcaaccgcaguuccuguucu

SEQ ID NO: 3987092 - RNA, 14 nt, Human herpesvirus 6
gcgggaugccauaa

SEQ ID NO: 3987093 - RNA, 16 nt, Human herpesvirus 6
gcgguauaaugcauga

SEQ ID NO: 3987094 - RNA, 18 nt, Human herpesvirus 6
gcuagacuauacuuuucu

SEQ ID NO: 3987095 - RNA, 17 nt, Human herpesvirus 6
gcuagauaauuaugcau

SEQ ID NO: 3987096 - RNA, 15 nt, Human herpesvirus 6
gcuaggcagaucauc

SEQ ID NO: 3987097 - RNA, 16 nt, Human herpesvirus 6
gcuauggcuuccggaa

SEQ ID NO: 3987098 - RNA, 18 nt, Human herpesvirus 6
gcucuacacccucucucg

SEQ ID NO: 3987099 - RNA, 20 nt, Human herpesvirus 6
gcugcgcugauccugacugg

SEQ ID NO: 3987100 - RNA, 15 nt, Human herpesvirus 6
gcugcggucgccgcc

SEQ ID NO: 3987101 - RNA, 18 nt, Human herpesvirus 6
gcuuccggaauaguucuu

SEQ ID NO: 3987102 - RNA, 19 nt, Human herpesvirus 6
ggaaaauauuuccugccca

SEQ ID NO: 3987103 - RNA, 19 nt, Human herpesvirus 6
ggaaccuccaguuuggauu

SEQ ID NO: 3987104 - RNA, 21 nt, Human herpesvirus 6
ggaagaacaggcggaagaaca

SEQ ID NO: 3987105 - RNA, 18 nt, Human herpesvirus 6
ggaagaggaagggauggc

SEQ ID NO: 3987106 - RNA, 19 nt, Human herpesvirus 6
ggaagauacacugcaagaa

SEQ ID NO: 3987107 - RNA, 12 nt, Human herpesvirus 6
ggaauuucuucc

SEQ ID NO: 3987108 - RNA, 23 nt, Human herpesvirus 6
ggacagggggaucgacgggcagg

SEQ ID NO: 3987109 - RNA, 18 nt, Human herpesvirus 6
ggacccacgguggccugg

SEQ ID NO: 3987110 - RNA, 22 nt, Human herpesvirus 6
ggacccgagguccgacacgccc

SEQ ID NO: 3987111 - RNA, 18 nt, Human herpesvirus 6
ggacggcggggggacggg

SEQ ID NO: 3987112 - RNA, 20 nt, Human herpesvirus 6
ggacgggaagaacaggcgga

SEQ ID NO: 3987113 - RNA, 17 nt, Human herpesvirus 6
ggagacggguuggaaau

SEQ ID NO: 3987114 - RNA, 12 nt, Human herpesvirus 6
ggagauuucagg

SEQ ID NO: 3987115 - RNA, 19 nt, Human herpesvirus 6
ggagcagcuuccacgcgac

SEQ ID NO: 3987116 - RNA, 14 nt, Human herpesvirus 6
ggaggaggaagaga

SEQ ID NO: 3987117 - RNA, 17 nt, Human herpesvirus 6
ggaggaggaggaagaga

SEQ ID NO: 3987118 - RNA, 17 nt, Human herpesvirus 6
ggagguaacggagcccg

SEQ ID NO: 3987119 - RNA, 23 nt, Human herpesvirus 6
ggagugccguugagugccucaga

SEQ ID NO: 3987120 - RNA, 14 nt, Human herpesvirus 6
ggauaagcagaaga

SEQ ID NO: 3987121 - RNA, 19 nt, Human herpesvirus 6
ggauagagagauagauaug

SEQ ID NO: 3987122 - RNA, 17 nt, Human herpesvirus 6
ggaugcugaugaauuua

SEQ ID NO: 3987123 - RNA, 22 nt, Human herpesvirus 6
ggcaaccugaaacuccccagag

SEQ ID NO: 3987124 - RNA, 23 nt, Human herpesvirus 6
ggcaacuccccauucaacauccu

SEQ ID NO: 3987125 - RNA, 17 nt, Human herpesvirus 6
ggcagaucuaucacagg

SEQ ID NO: 3987126 - RNA, 19 nt, Human herpesvirus 6
ggcagaucuaucacaggcg

SEQ ID NO: 3987127 - RNA, 22 nt, Human herpesvirus 6
ggcagguaaccaaaaaaacgua

SEQ ID NO: 3987128 - RNA, 20 nt, Human herpesvirus 6
ggcauagcagcaauaggcac

SEQ ID NO: 3987129 - RNA, 18 nt, Human herpesvirus 6
ggcccagagacgguguuu

SEQ ID NO: 3987130 - RNA, 19 nt, Human herpesvirus 6
ggcccggggacggacaggg

SEQ ID NO: 3987131 - RNA, 19 nt, Human herpesvirus 6
ggccuccgccacugcgagg

SEQ ID NO: 3987132 - RNA, 18 nt, Human herpesvirus 6
ggcgaaaagugcugugcu

SEQ ID NO: 3987133 - RNA, 17 nt, Human herpesvirus 6
ggcggacggggacgaca

SEQ ID NO: 3987134 - RNA, 11 nt, Human herpesvirus 6
ggcgggcagau

SEQ ID NO: 3987135 - RNA, 19 nt, Human herpesvirus 6
ggcgucaucgguggcagag

SEQ ID NO: 3987136 - RNA, 22 nt, Human herpesvirus 6
ggcgucaucgguggcagagggg

SEQ ID NO: 3987137 - RNA, 19 nt, Human herpesvirus 6
ggcuacgacacgcuggagc

SEQ ID NO: 3987138 - RNA, 13 nt, Human herpesvirus 6
ggcucgaaucuaa

SEQ ID NO: 3987139 - RNA, 18 nt, Human herpesvirus 6
gggaggaggaggaggaag

SEQ ID NO: 3987140 - RNA, 13 nt, Human herpesvirus 6
gggagggacccac

SEQ ID NO: 3987141 - RNA, 20 nt, Human herpesvirus 6
gggagugaagagauguuucc

SEQ ID NO: 3987142 - RNA, 15 nt, Human herpesvirus 6
gggcggaaguugguu

SEQ ID NO: 3987143 - RNA, 18 nt, Human herpesvirus 6
gggcucgcucugaaauuu

SEQ ID NO: 3987144 - RNA, 20 nt, Human herpesvirus 6
ggggaucgggcccggggacg

SEQ ID NO: 3987145 - RNA, 16 nt, Human herpesvirus 6
ggggcggacggggacg

SEQ ID NO: 3987146 - RNA, 23 nt, Human herpesvirus 6
gggguguguaugcguggggugcg

SEQ ID NO: 3987147 - RNA, 23 nt, Human herpesvirus 6
gggucguacacgcauuugcaauu

SEQ ID NO: 3987148 - RNA, 16 nt, Human herpesvirus 6
gggugucggacgacgg

SEQ ID NO: 3987149 - RNA, 20 nt, Human herpesvirus 6
gguaccgcgguuggggucuu

SEQ ID NO: 3987150 - RNA, 15 nt, Human herpesvirus 6
gguauuuuagauaua

SEQ ID NO: 3987151 - RNA, 17 nt, Human herpesvirus 6
gguccaaccccucccau

SEQ ID NO: 3987152 - RNA, 23 nt, Human herpesvirus 6
ggucgcguucuaacccaugaaaa

SEQ ID NO: 3987153 - RNA, 15 nt, Human herpesvirus 6
ggugaauguuucuga

SEQ ID NO: 3987154 - RNA, 12 nt, Human herpesvirus 6
aaaaaaaugaua

SEQ ID NO: 3987155 - RNA, 13 nt, Human herpesvirus 6
aaaaaaauuccca

SEQ ID NO: 3987156 - RNA, 16 nt, Human herpesvirus 6
aaaaaauagcagcaau

SEQ ID NO: 3987157 - RNA, 16 nt, Human herpesvirus 6
aaaaaaucagaaucca

SEQ ID NO: 3987158 - RNA, 18 nt, Human herpesvirus 6
aaaaauuuugaugccaaa

SEQ ID NO: 3987159 - RNA, 19 nt, Human herpesvirus 6
aaaacagacgaaucacauc

SEQ ID NO: 3987160 - RNA, 21 nt, Human herpesvirus 6
aaaacauaucgagccaaagaa

SEQ ID NO: 3987161 - RNA, 16 nt, Human herpesvirus 6
aaaacgacacagaaca

SEQ ID NO: 3987162 - RNA, 16 nt, Human herpesvirus 6
aaaacgacaucgcgcg

SEQ ID NO: 3987163 - RNA, 14 nt, Human herpesvirus 6
aaaacuaugugcau

SEQ ID NO: 3987164 - RNA, 16 nt, Human herpesvirus 6
aaaacucuaaaagcug

SEQ ID NO: 3987165 - RNA, 21 nt, Human herpesvirus 6
aaaaucauuaccaguagcaca

SEQ ID NO: 3987166 - RNA, 15 nt, Human herpesvirus 6
aaaaucuauugaaga

SEQ ID NO: 3987167 - RNA, 16 nt, Human herpesvirus 6
aaaauuaaaggucagu

SEQ ID NO: 3987168 - RNA, 12 nt, Human herpesvirus 6
aaaauuugaaau

SEQ ID NO: 3987169 - RNA, 14 nt, Human herpesvirus 6
aaaauuugcuaacg

SEQ ID NO: 3987170 - RNA, 17 nt, Human herpesvirus 6
aaacaaauggaaacugg

SEQ ID NO: 3987171 - RNA, 14 nt, Human herpesvirus 6
aaacacagaugguu

SEQ ID NO: 3987172 - RNA, 20 nt, Human herpesvirus 6
aaacaccucuaaaacaagac

SEQ ID NO: 3987173 - RNA, 15 nt, Human herpesvirus 6
aaacauaaaauguuu

SEQ ID NO: 3987174 - RNA, 20 nt, Human herpesvirus 6
aaacauguauauaaauuggu

SEQ ID NO: 3987175 - RNA, 15 nt, Human herpesvirus 6
aaaccauagguguuu

SEQ ID NO: 3987176 - RNA, 15 nt, Human herpesvirus 6
aaaccaucgcaaugc

SEQ ID NO: 3987177 - RNA, 13 nt, Human herpesvirus 6
aaaccucuguaga

SEQ ID NO: 3987178 - RNA, 15 nt, Human herpesvirus 6
aaacuaugcaaacga

SEQ ID NO: 3987179 - RNA, 18 nt, Human herpesvirus 6
aaacuuuuaaaacaggaa

SEQ ID NO: 3987180 - RNA, 19 nt, Human herpesvirus 6
aaagaguugacguuccaaa

SEQ ID NO: 3987181 - RNA, 16 nt, Human herpesvirus 6
aaagauguuugaagau

SEQ ID NO: 3987182 - RNA, 13 nt, Human herpesvirus 6
aaagcugcuaacg

SEQ ID NO: 3987183 - RNA, 14 nt, Human herpesvirus 6
aaagcugcuaacgc

SEQ ID NO: 3987184 - RNA, 13 nt, Human herpesvirus 6
aaagucagugggu

SEQ ID NO: 3987185 - RNA, 16 nt, Human herpesvirus 6
aaagucaguggguacc

SEQ ID NO: 3987186 - RNA, 19 nt, Human herpesvirus 6
aaagucguuuuggagaaau

SEQ ID NO: 3987187 - RNA, 14 nt, Human herpesvirus 6
caucucaaaaaaca

SEQ ID NO: 3987188 - RNA, 19 nt, Human herpesvirus 6
caucugcaaaaaacaaaug

SEQ ID NO: 3987189 - RNA, 14 nt, Human herpesvirus 6
caugagagagcaaa

SEQ ID NO: 3987190 - RNA, 22 nt, Human herpesvirus 6
caugcaacacaacaaacauccu

SEQ ID NO: 3987191 - RNA, 17 nt, Human herpesvirus 6
caugcauuuuguauuua

SEQ ID NO: 3987192 - RNA, 16 nt, Human herpesvirus 6
caugucggccucugcc

SEQ ID NO: 3987193 - RNA, 21 nt, Human herpesvirus 6
cauuguaaauagguaaacugu

SEQ ID NO: 3987194 - RNA, 23 nt, Human herpesvirus 6
cauuguucuaaagauuuuuauuc

SEQ ID NO: 3987195 - RNA, 20 nt, Human herpesvirus 6
cauuucaagagaacaugauu

SEQ ID NO: 3987196 - RNA, 15 nt, Human herpesvirus 6
cauuuccaugcauau

SEQ ID NO: 3987197 - RNA, 23 nt, Human herpesvirus 6
cauuugcugaugcgauguggagc

SEQ ID NO: 3987198 - RNA, 11 nt, Human herpesvirus 6
ccaaaggaaac

SEQ ID NO: 3987199 - RNA, 17 nt, Human herpesvirus 6
ccaaaugccucgugaga

SEQ ID NO: 3987200 - RNA, 17 nt, Human herpesvirus 6
ccaacgcgacaggguga

SEQ ID NO: 3987201 - RNA, 13 nt, Human herpesvirus 6
ccacaugaaauca

SEQ ID NO: 3987202 - RNA, 13 nt, Human herpesvirus 6
ccaccaacacacc

SEQ ID NO: 3987203 - RNA, 21 nt, Human herpesvirus 6
ccagcauaacuggaaucauga

SEQ ID NO: 3987204 - RNA, 16 nt, Human herpesvirus 6
ccagcuuucuuagaga

SEQ ID NO: 3987205 - RNA, 15 nt, Human herpesvirus 6
ccaggcgaacgagaa

SEQ ID NO: 3987206 - RNA, 21 nt, Human herpesvirus 6
ccagugcuuuaaucacaauga

SEQ ID NO: 3987207 - RNA, 14 nt, Human herpesvirus 6
ccaucuucagacau

SEQ ID NO: 3987208 - RNA, 15 nt, Human herpesvirus 6
ccaugugcggagaaa

SEQ ID NO: 3987209 - RNA, 23 nt, Human herpesvirus 6
cccacgaaaaauaaaauccacga

SEQ ID NO: 3987210 - RNA, 15 nt, Human herpesvirus 6
cccacgguggccugg

SEQ ID NO: 3987211 - RNA, 21 nt, Human herpesvirus 6
cccacgguggccuggcacggu

SEQ ID NO: 3987212 - RNA, 17 nt, Human herpesvirus 6
cccagcguggaauuugu

SEQ ID NO: 3987213 - RNA, 14 nt, Human herpesvirus 6
cccagcucaccacc

SEQ ID NO: 3987214 - RNA, 20 nt, Human herpesvirus 6
cccaggcaaacgagaacucu

SEQ ID NO: 3987215 - RNA, 20 nt, Human herpesvirus 6
cccaggcgaacgagaacucu

SEQ ID NO: 3987216 - RNA, 22 nt, Human herpesvirus 6
cccauccaccuucccucccacc

SEQ ID NO: 3987217 - RNA, 21 nt, Human herpesvirus 6
cccaucccccuccccggagca

SEQ ID NO: 3987218 - RNA, 15 nt, Human herpesvirus 6
cccaucgucuccucc

SEQ ID NO: 3987219 - RNA, 18 nt, Human herpesvirus 6
ccccucgcccgauccgcc

SEQ ID NO: 3987220 - RNA, 16 nt, Human herpesvirus 6
ccccugccgagccugu

SEQ ID NO: 3987221 - RNA, 20 nt, Human herpesvirus 6
cccgcucggucucgcacuuc

SEQ ID NO: 3987222 - RNA, 15 nt, Human herpesvirus 6
cccuaugcaagcuca

SEQ ID NO: 3987223 - RNA, 18 nt, Human herpesvirus 6
ccgaacuagaaaaacaac

SEQ ID NO: 3987224 - RNA, 15 nt, Human herpesvirus 6
ccgaauguucucaga

SEQ ID NO: 3987225 - RNA, 13 nt, Human herpesvirus 6
ccgagggcggacg

SEQ ID NO: 3987226 - RNA, 19 nt, Human herpesvirus 6
ccgaggggacaggggagga

SEQ ID NO: 3987227 - RNA, 13 nt, Human herpesvirus 6
ccgauucagaccu

SEQ ID NO: 3987228 - RNA, 23 nt, Human herpesvirus 6
ccgcagaggcggcgaccgcagcg

SEQ ID NO: 3987229 - RNA, 23 nt, Human herpesvirus 6
ccgcaguuccuguuuuucucaua

SEQ ID NO: 3987230 - RNA, 19 nt, Human herpesvirus 6
ccgcugcggucgccgccuc

SEQ ID NO: 3987231 - RNA, 15 nt, Human herpesvirus 6
ccggccggagugccg

SEQ ID NO: 3987232 - RNA, 20 nt, Human herpesvirus 6
ccggggacggacagggggau

SEQ ID NO: 3987233 - RNA, 15 nt, Human herpesvirus 6
ccgguaacgcugucg

SEQ ID NO: 3987234 - RNA, 13 nt, Human herpesvirus 6
ccgugacacacag

SEQ ID NO: 3987235 - RNA, 16 nt, Human herpesvirus 6
ccguucaucauuccag

SEQ ID NO: 3987236 - RNA, 15 nt, Human herpesvirus 6
ccguucucucuccuc

SEQ ID NO: 3987237 - RNA, 15 nt, Human herpesvirus 6
ccuaaauaccauuuu

SEQ ID NO: 3987238 - RNA, 14 nt, Human herpesvirus 6
ccuacaagggcagg

SEQ ID NO: 3987239 - RNA, 14 nt, Human herpesvirus 6
ccuaccauguugcu

SEQ ID NO: 3987240 - RNA, 17 nt, Human herpesvirus 6
ccuauagucaauguugu

SEQ ID NO: 3987241 - RNA, 14 nt, Human herpesvirus 6
ccucaauuaauaca

SEQ ID NO: 3987242 - RNA, 23 nt, Human herpesvirus 6
ccucacuacugaaaccaaagcau

SEQ ID NO: 3987243 - RNA, 16 nt, Human herpesvirus 6
ccucaugaguguuuaa

SEQ ID NO: 3987244 - RNA, 16 nt, Human herpesvirus 6
ccucauuguuucacuu

SEQ ID NO: 3987245 - RNA, 17 nt, Human herpesvirus 6
ccucgcccgauccgccc

SEQ ID NO: 3987246 - RNA, 15 nt, Human herpesvirus 6
ccucguuguuucaua

SEQ ID NO: 3987247 - RNA, 17 nt, Human herpesvirus 6
ccucugcaauagcagaa

SEQ ID NO: 3987248 - RNA, 14 nt, Human herpesvirus 6
ccugccuacacugc

SEQ ID NO: 3987249 - RNA, 14 nt, Human herpesvirus 6
ccugggaaaagggu

SEQ ID NO: 3987250 - RNA, 23 nt, Human herpesvirus 6
ccuucaccugucucugcuuuaug

SEQ ID NO: 3987251 - RNA, 17 nt, Human herpesvirus 6
ccuuguguaucugugaa

SEQ ID NO: 3987252 - RNA, 20 nt, Human herpesvirus 6
cgaaaacucuaaaagcugcu

SEQ ID NO: 3987253 - RNA, 18 nt, Human herpesvirus 6
cgaaaggugaaaugaaug

SEQ ID NO: 3987254 - RNA, 19 nt, Human herpesvirus 6
cgaaucucaagcacaaaac

SEQ ID NO: 3987255 - RNA, 15 nt, Human herpesvirus 6
cgaaugguuaaaagu

SEQ ID NO: 3987256 - RNA, 15 nt, Human herpesvirus 6
cgacaaccgccgccg

SEQ ID NO: 3987257 - RNA, 22 nt, Human herpesvirus 6
cgacacgugggggguuccuccg

SEQ ID NO: 3987258 - RNA, 23 nt, Human herpesvirus 6
cgacccacuccuacuauccgccc

SEQ ID NO: 3987259 - RNA, 15 nt, Human herpesvirus 6
cgacgauuguccugg

SEQ ID NO: 3987260 - RNA, 16 nt, Human herpesvirus 6
cgacuaccacaucacc

SEQ ID NO: 3987261 - RNA, 23 nt, Human herpesvirus 6
cgacuaucaaaauaaaaauuuua

SEQ ID NO: 3987262 - RNA, 14 nt, Human herpesvirus 6
cgagcggugugcag

SEQ ID NO: 3987263 - RNA, 13 nt, Human herpesvirus 6
cgagucgaagaga

SEQ ID NO: 3987264 - RNA, 19 nt, Human herpesvirus 6
cgaguucgccuugucauca

SEQ ID NO: 3987265 - RNA, 20 nt, Human herpesvirus 6
cgauacccagcgggcuccgu

SEQ ID NO: 3987266 - RNA, 16 nt, Human herpesvirus 6
cgauuaguuuguguag

SEQ ID NO: 3987267 - RNA, 15 nt, Human herpesvirus 6
cgcaaauucucucua

SEQ ID NO: 3987268 - RNA, 20 nt, Human herpesvirus 6
cgcaagucacgggcagcugc

SEQ ID NO: 3987269 - RNA, 15 nt, Human herpesvirus 6
cgcacaucgauaaac

SEQ ID NO: 3987270 - RNA, 16 nt, Human herpesvirus 6
cgcaguuccuguuuuu

SEQ ID NO: 3987271 - RNA, 18 nt, Human herpesvirus 6
cgccaaaaaaauacagua

SEQ ID NO: 3987272 - RNA, 21 nt, Human herpesvirus 6
cgccaagaaaaagaaauuaau

SEQ ID NO: 3987273 - RNA, 20 nt, Human herpesvirus 6
cgccgccguuacugucgcug

SEQ ID NO: 3987274 - RNA, 20 nt, Human herpesvirus 6
cgccggagguaacggagccc

SEQ ID NO: 3987275 - RNA, 17 nt, Human herpesvirus 6
cgccguccuauucagag

SEQ ID NO: 3987276 - RNA, 20 nt, Human herpesvirus 6
cgccuguuccacgcgcgugu

SEQ ID NO: 3987277 - RNA, 22 nt, Human herpesvirus 6
cgcgauuuaaacaacacagcac

SEQ ID NO: 3987278 - RNA, 18 nt, Human herpesvirus 6
cgcgguuggggucuuucc

SEQ ID NO: 3987279 - RNA, 23 nt, Human herpesvirus 6
cgcgguuggggucuuuccugcac

SEQ ID NO: 3987280 - RNA, 12 nt, Human herpesvirus 6
cgcuuuuacuga

SEQ ID NO: 3987281 - RNA, 16 nt, Human herpesvirus 6
cggaaaacuaaaaguc

SEQ ID NO: 3987282 - RNA, 17 nt, Human herpesvirus 6
cggaacaaggccaaacc

SEQ ID NO: 3987283 - RNA, 19 nt, Human herpesvirus 6
cggaauuuugagauuuaca

SEQ ID NO: 3987284 - RNA, 16 nt, Human herpesvirus 6
cggacaccgagggcgg

SEQ ID NO: 3987285 - RNA, 17 nt, Human herpesvirus 6
cggacgacgggcggggc

SEQ ID NO: 3987286 - RNA, 12 nt, Human herpesvirus 6
cggaguugcagu

SEQ ID NO: 3987287 - RNA, 14 nt, Human herpesvirus 6
cggcaacgcuccuc

SEQ ID NO: 3987288 - RNA, 20 nt, Human herpesvirus 6
cgggcagguuaucggaagca

SEQ ID NO: 3987289 - RNA, 21 nt, Human herpesvirus 6
cgggcccggggacggacaggg

SEQ ID NO: 3987290 - RNA, 13 nt, Human herpesvirus 6
cgggcuugcgaug

SEQ ID NO: 3987291 - RNA, 15 nt, Human herpesvirus 6
cggggacggacaggg

SEQ ID NO: 3987292 - RNA, 19 nt, Human herpesvirus 6
cggggagagaauugccgau

SEQ ID NO: 3987293 - RNA, 17 nt, Human herpesvirus 6
cggggcggacggggacg

SEQ ID NO: 3987294 - RNA, 18 nt, Human herpesvirus 6
cggggggacgggcggagc

SEQ ID NO: 3987295 - RNA, 21 nt, Human herpesvirus 6
cggguaaacgcgcgccggugc

SEQ ID NO: 3987296 - RNA, 17 nt, Human herpesvirus 6
cgguccaaccccuccca

SEQ ID NO: 3987297 - RNA, 18 nt, Human herpesvirus 6
cgguccacacgccagucc

SEQ ID NO: 3987298 - RNA, 19 nt, Human herpesvirus 6
cgguccacacgccaguccg

SEQ ID NO: 3987299 - RNA, 21 nt, Human herpesvirus 6
cgguuaaagaaucugcagauu

SEQ ID NO: 3987300 - RNA, 17 nt, Human herpesvirus 6
cguagacaguaaaaugu

SEQ ID NO: 3987301 - RNA, 14 nt, Human herpesvirus 6
cguagacagucaca

SEQ ID NO: 3987302 - RNA, 11 nt, Human herpesvirus 6
cguauauugug

SEQ ID NO: 3987303 - RNA, 16 nt, Human herpesvirus 6
cguaucuuaaaguugg

SEQ ID NO: 3987304 - RNA, 17 nt, Human herpesvirus 6
cgucaugcaaaacagac

SEQ ID NO: 3987305 - RNA, 23 nt, Human herpesvirus 6
cgucugggacccacgguggccug

SEQ ID NO: 3987306 - RNA, 17 nt, Human herpesvirus 6
cgugccgggaccccgac

SEQ ID NO: 3987307 - RNA, 22 nt, Human herpesvirus 6
cgugguuuuuuuuuucuuacac

SEQ ID NO: 3987308 - RNA, 17 nt, Human herpesvirus 6
cguuuagaaugacagag

SEQ ID NO: 3987309 - RNA, 22 nt, Human herpesvirus 6
cuaaaacgacuauacgaaauaa

SEQ ID NO: 3987310 - RNA, 14 nt, Human herpesvirus 6
cuaaaagcugcuaa

SEQ ID NO: 3987311 - RNA, 12 nt, Human herpesvirus 6
cuaaaaggcucu

SEQ ID NO: 3987312 - RNA, 17 nt, Human herpesvirus 6
cuaaaagucagugggua

SEQ ID NO: 3987313 - RNA, 16 nt, Human herpesvirus 6
cuaagauugugcaguu

SEQ ID NO: 3987314 - RNA, 21 nt, Human herpesvirus 6
cuaagucuuugggaacaugua

SEQ ID NO: 3987315 - RNA, 17 nt, Human herpesvirus 6
cuaauaugaacaaugac

SEQ ID NO: 3987316 - RNA, 15 nt, Human herpesvirus 6
cuagcuuuucauaug

SEQ ID NO: 3987317 - RNA, 16 nt, Human herpesvirus 6
cuauccgcccuccccg

SEQ ID NO: 3987318 - RNA, 12 nt, Human herpesvirus 6
cuaugcagcgcc

SEQ ID NO: 3987319 - RNA, 20 nt, Human herpesvirus 6
cuaugcgcuuuuauuucugg

SEQ ID NO: 3987320 - RNA, 14 nt, Human herpesvirus 6
cuauguaaacuucu

SEQ ID NO: 3987321 - RNA, 20 nt, Human herpesvirus 6
cuauuaaacuaacauagcga

SEQ ID NO: 3987322 - RNA, 14 nt, Human herpesvirus 6
cuauuaugugaaug

SEQ ID NO: 3987323 - RNA, 22 nt, Human herpesvirus 6
cuauuuacaauguucaauuacu

SEQ ID NO: 3987324 - RNA, 18 nt, Human herpesvirus 6
cuauuuguuuaaugcauu

SEQ ID NO: 3987325 - RNA, 19 nt, Human herpesvirus 6
cucacacccauggcgagaa

SEQ ID NO: 3987326 - RNA, 22 nt, Human herpesvirus 6
cucaguaauuuguguaauuuaa

SEQ ID NO: 3987327 - RNA, 19 nt, Human herpesvirus 6
cucauguugccucuggaca

SEQ ID NO: 3987328 - RNA, 23 nt, Human herpesvirus 6
cuccccgagcacgguccacacgc

SEQ ID NO: 3987329 - RNA, 15 nt, Human herpesvirus 6
cucccggcccagaga

SEQ ID NO: 3987330 - RNA, 14 nt, Human herpesvirus 6
cucgaagccucgac

SEQ ID NO: 3987331 - RNA, 22 nt, Human herpesvirus 6
cucgacuccagugcuuuaauca

SEQ ID NO: 3987332 - RNA, 14 nt, Human herpesvirus 6
cucggaaaauuaaa

SEQ ID NO: 3987333 - RNA, 18 nt, Human herpesvirus 6
cucggauucaaagaaagu

SEQ ID NO: 3987334 - RNA, 18 nt, Human herpesvirus 6
cucguucuaccaugugcg

SEQ ID NO: 3987335 - RNA, 19 nt, Human herpesvirus 6
cucuauuccccauuccuag

SEQ ID NO: 3987336 - RNA, 14 nt, Human herpesvirus 6
cucugcaaaacaaa

SEQ ID NO: 3987337 - RNA, 14 nt, Human herpesvirus 6
cucugcggacggag

SEQ ID NO: 3987338 - RNA, 23 nt, Human herpesvirus 6
cugaauggaguaaauuaaaguuu

SEQ ID NO: 3987339 - RNA, 15 nt, Human herpesvirus 6
cugacaaccuccgca

SEQ ID NO: 3987340 - RNA, 19 nt, Human herpesvirus 6
cugaccguuguaagaagaa

SEQ ID NO: 3987341 - RNA, 22 nt, Human herpesvirus 6
cugauuccuucaauguucuuca

SEQ ID NO: 3987342 - RNA, 14 nt, Human herpesvirus 6
cugcaaaaaacaaa

SEQ ID NO: 3987343 - RNA, 12 nt, Human herpesvirus 6
cugcaaaacaaa

SEQ ID NO: 3987344 - RNA, 22 nt, Human herpesvirus 6
cugcacaggcgaacgaaaacuc

SEQ ID NO: 3987345 - RNA, 22 nt, Human herpesvirus 6
cugccauuauugauagcauuau

SEQ ID NO: 3987346 - RNA, 22 nt, Human herpesvirus 6
cugcccaggcgaacgagaacuc

SEQ ID NO: 3987347 - RNA, 20 nt, Human herpesvirus 6
cuggcccgaggauuaucgau

SEQ ID NO: 3987348 - RNA, 18 nt, Human herpesvirus 6
cugguaaauuuuaucgaa

SEQ ID NO: 3987349 - RNA, 17 nt, Human herpesvirus 6
cuggugaauguuucuga

SEQ ID NO: 3987350 - RNA, 16 nt, Human herpesvirus 6
cuguaccauugucaac

SEQ ID NO: 3987351 - RNA, 20 nt, Human herpesvirus 6
cuguccccucgguccaaccc

SEQ ID NO: 3987352 - RNA, 22 nt, Human herpesvirus 6
cuguggcgcgaccgaccccugc

SEQ ID NO: 3987353 - RNA, 22 nt, Human herpesvirus 6
cugugucuguucaacgucuuca

SEQ ID NO: 3987354 - RNA, 14 nt, Human herpesvirus 6
cuguugaauuccag

SEQ ID NO: 3987355 - RNA, 15 nt, Human herpesvirus 6
cuguuugaaacugag

SEQ ID NO: 3987356 - RNA, 16 nt, Human herpesvirus 6
cuguuuuucucauaaa

SEQ ID NO: 3987357 - RNA, 16 nt, Human herpesvirus 6
cuguuuuucucggaaa

SEQ ID NO: 3987358 - RNA, 23 nt, Human herpesvirus 6
cuuaaucaacugguuuaguuugg

SEQ ID NO: 3987359 - RNA, 14 nt, Human herpesvirus 6
cuuacagagcuuuu

SEQ ID NO: 3987360 - RNA, 15 nt, Human herpesvirus 6
cuuagcauauuuugg

SEQ ID NO: 3987361 - RNA, 22 nt, Human herpesvirus 6
cuuauacacgaacuaaauaaga

SEQ ID NO: 3987362 - RNA, 20 nt, Human herpesvirus 6
cuuauugaggaaaugcagca

SEQ ID NO: 3987363 - RNA, 22 nt, Human herpesvirus 6
cuucacuuugggcgauggaugu

SEQ ID NO: 3987364 - RNA, 13 nt, Human herpesvirus 6
cuucaggugucuc

SEQ ID NO: 3987365 - RNA, 12 nt, Human herpesvirus 6
cuucccucuucc

SEQ ID NO: 3987366 - RNA, 19 nt, Human herpesvirus 6
cuucgaauacuuucaugau

SEQ ID NO: 3987367 - RNA, 18 nt, Human herpesvirus 6
cuucgauccaauaagaaa

SEQ ID NO: 3987368 - RNA, 18 nt, Human herpesvirus 6
cuucugccugaaaaugaa

SEQ ID NO: 3987369 - RNA, 12 nt, Human herpesvirus 6
cuugacagagau

SEQ ID NO: 3987370 - RNA, 17 nt, Human herpesvirus 6
cuugacguauccucaga

SEQ ID NO: 3987371 - RNA, 23 nt, Human herpesvirus 6
cuugauaaucugaucgaaauacu

SEQ ID NO: 3987372 - RNA, 23 nt, Human herpesvirus 6
cuuggacaccgguaaccucgcuc

SEQ ID NO: 3987373 - RNA, 17 nt, Human herpesvirus 6
cuuguguucuaucacau

SEQ ID NO: 3987374 - RNA, 17 nt, Human herpesvirus 6
cuuuauagagcaacuca

SEQ ID NO: 3987375 - RNA, 16 nt, Human herpesvirus 6
cuuuccugcacaggcg

SEQ ID NO: 3987376 - RNA, 22 nt, Human herpesvirus 6
cuuucuacgguaggcagggaaa

SEQ ID NO: 3987377 - RNA, 12 nt, Human herpesvirus 6
cuuuuuguauua

SEQ ID NO: 3987378 - RNA, 22 nt, Human herpesvirus 6
cuuuuuuaaaccucuguagauc

SEQ ID NO: 3987379 - RNA, 21 nt, Human herpesvirus 6
gaaaaaaaauugccuuguaaa

SEQ ID NO: 3987380 - RNA, 14 nt, Human herpesvirus 6
gaaaacuaaaaguc

SEQ ID NO: 3987381 - RNA, 17 nt, Human herpesvirus 6
gaaaagaucaagcaagu

SEQ ID NO: 3987382 - RNA, 14 nt, Human herpesvirus 6
gaaaagggugacac

SEQ ID NO: 3987383 - RNA, 22 nt, Human herpesvirus 6
gaaaauauuuccaugacuguga

SEQ ID NO: 3987384 - RNA, 19 nt, Human herpesvirus 6
gaaaauauuuccugcccag

SEQ ID NO: 3987385 - RNA, 17 nt, Human herpesvirus 6
gaaacaaccacaaacau

SEQ ID NO: 3987386 - RNA, 12 nt, Human herpesvirus 6
gaaacaagaaag

SEQ ID NO: 3987387 - RNA, 15 nt, Human herpesvirus 6
gaaacuccccagaga

SEQ ID NO: 3987388 - RNA, 14 nt, Human herpesvirus 6
gaaagaaaaauauu

SEQ ID NO: 3987389 - RNA, 16 nt, Human herpesvirus 6
gaaaguucaucuuuca

SEQ ID NO: 3987390 - RNA, 16 nt, Human herpesvirus 6
gaaauaucagaaauaa

SEQ ID NO: 3987391 - RNA, 16 nt, Human herpesvirus 6
gaaaugaucaauacau

SEQ ID NO: 3987392 - RNA, 18 nt, Human herpesvirus 6
gaaaugaugaguaauaca

SEQ ID NO: 3987393 - RNA, 20 nt, Human herpesvirus 6
gaacaaaaugaggggaacac

SEQ ID NO: 3987394 - RNA, 17 nt, Human herpesvirus 6
gaacaaaguaauaugau

SEQ ID NO: 3987395 - RNA, 16 nt, Human herpesvirus 6
gaacaggcggaagaac

SEQ ID NO: 3987396 - RNA, 21 nt, Human herpesvirus 6
gaacaggcggaagaacacgaa

SEQ ID NO: 3987397 - RNA, 15 nt, Human herpesvirus 6
gaacaucucagaucu

SEQ ID NO: 3987398 - RNA, 14 nt, Human herpesvirus 6
gaacccuagacaca

SEQ ID NO: 3987399 - RNA, 18 nt, Human herpesvirus 6
gaagaauuuauguucagc

SEQ ID NO: 3987400 - RNA, 20 nt, Human herpesvirus 6
gaagacauuaauacugguuu

SEQ ID NO: 3987401 - RNA, 17 nt, Human herpesvirus 6
gaagaccuauauguguu

SEQ ID NO: 3987402 - RNA, 21 nt, Human herpesvirus 6
gaagaucuuuauggagggaau

SEQ ID NO: 3987403 - RNA, 18 nt, Human herpesvirus 6
gaagauuuguaaggacaa

SEQ ID NO: 3987404 - RNA, 17 nt, Human herpesvirus 6
gaagucuugcuuggaaa

SEQ ID NO: 3987405 - RNA, 19 nt, Human herpesvirus 6
gaauaacgguguugaguuu

SEQ ID NO: 3987406 - RNA, 14 nt, Human herpesvirus 6
gaauauugaaacgg

SEQ ID NO: 3987407 - RNA, 20 nt, Human herpesvirus 6
gaaucaugagagccuucagu

SEQ ID NO: 3987408 - RNA, 15 nt, Human herpesvirus 6
gaaucauggugucuu

SEQ ID NO: 3987409 - RNA, 15 nt, Human herpesvirus 6
gaaugagauguucua

SEQ ID NO: 3987410 - RNA, 23 nt, Human herpesvirus 6
gaaugcuauucguuuuuuuucuu

SEQ ID NO: 3987411 - RNA, 15 nt, Human herpesvirus 6
gaauuguauauauag

SEQ ID NO: 3987412 - RNA, 17 nt, Human herpesvirus 6
gacaaaaccuaaauaca

SEQ ID NO: 3987413 - RNA, 18 nt, Human herpesvirus 6
gacaaaucaucacuacgu

SEQ ID NO: 3987414 - RNA, 20 nt, Human herpesvirus 6
gacaguccauuucuaaagau

SEQ ID NO: 3987415 - RNA, 18 nt, Human herpesvirus 6
gacauccagaaaagcaaa

SEQ ID NO: 3987416 - RNA, 16 nt, Human herpesvirus 6
gacaugcauuuuguau

SEQ ID NO: 3987417 - RNA, 12 nt, Human herpesvirus 6
gaccagccagau

SEQ ID NO: 3987418 - RNA, 13 nt, Human herpesvirus 6
gaccaggacaauc

SEQ ID NO: 3987419 - RNA, 15 nt, Human herpesvirus 6
gacccacgguggccu

SEQ ID NO: 3987420 - RNA, 20 nt, Human herpesvirus 6
gacccacgguggccuggcac

SEQ ID NO: 3987421 - RNA, 17 nt, Human herpesvirus 6
gaccccugccgagccug

SEQ ID NO: 3987422 - RNA, 13 nt, Human herpesvirus 6
gacccggccggag

SEQ ID NO: 3987423 - RNA, 15 nt, Human herpesvirus 6
gacgcaaagagacca

SEQ ID NO: 3987424 - RNA, 18 nt, Human herpesvirus 6
gacgcaccuccuuuguau

SEQ ID NO: 3987425 - RNA, 20 nt, Human herpesvirus 6
aagaaaguuucguacuggag

SEQ ID NO: 3987426 - RNA, 15 nt, Human herpesvirus 6
aagaauuuuuguagc

SEQ ID NO: 3987427 - RNA, 22 nt, Human herpesvirus 6
aagacguuugcuguuuucacca

SEQ ID NO: 3987428 - RNA, 17 nt, Human herpesvirus 6
aagaugagcagcuuugg

SEQ ID NO: 3987429 - RNA, 22 nt, Human herpesvirus 6
aagcgccugccuacacugcgaa

SEQ ID NO: 3987430 - RNA, 23 nt, Human herpesvirus 6
aaggacuaucugagacaguccau

SEQ ID NO: 3987431 - RNA, 16 nt, Human herpesvirus 6
aagguaucaaagaaca

SEQ ID NO: 3987432 - RNA, 16 nt, Human herpesvirus 6
aaggugaaaugaaugu

SEQ ID NO: 3987433 - RNA, 15 nt, Human herpesvirus 6
aaguaagcaccuuag

SEQ ID NO: 3987434 - RNA, 19 nt, Human herpesvirus 6
aaguagccaaugauucuua

SEQ ID NO: 3987435 - RNA, 16 nt, Human herpesvirus 6
aaguauccuaaauacc

SEQ ID NO: 3987436 - RNA, 23 nt, Human herpesvirus 6
aaguauguacaauauaauuucuu

SEQ ID NO: 3987437 - RNA, 18 nt, Human herpesvirus 6
aagucacgggcagcugca

SEQ ID NO: 3987438 - RNA, 17 nt, Human herpesvirus 6
aagucagagauuauuca

SEQ ID NO: 3987439 - RNA, 12 nt, Human herpesvirus 6
aagucagugggu

SEQ ID NO: 3987440 - RNA, 17 nt, Human herpesvirus 6
aagucuaaggugacucu

SEQ ID NO: 3987441 - RNA, 19 nt, Human herpesvirus 6
aaguuuacauagaaauuac

SEQ ID NO: 3987442 - RNA, 15 nt, Human herpesvirus 6
aauaaaucgcuuaaa

SEQ ID NO: 3987443 - RNA, 22 nt, Human herpesvirus 6
aauaacucagauucgcaagacu

SEQ ID NO: 3987444 - RNA, 15 nt, Human herpesvirus 6
aauaauuauccucuc

SEQ ID NO: 3987445 - RNA, 18 nt, Human herpesvirus 6
aauauaacaguaggagau

SEQ ID NO: 3987446 - RNA, 21 nt, Human herpesvirus 6
aauaucaccuuacaaauaaua

SEQ ID NO: 3987447 - RNA, 17 nt, Human herpesvirus 6
aauauguuuucaaaaau

SEQ ID NO: 3987448 - RNA, 16 nt, Human herpesvirus 6
aauauuuccugcccag

SEQ ID NO: 3987449 - RNA, 23 nt, Human herpesvirus 6
aaucagccugcucagagcugcgc

SEQ ID NO: 3987450 - RNA, 19 nt, Human herpesvirus 6
aaucauuagcauacagaug

SEQ ID NO: 3987451 - RNA, 17 nt, Human herpesvirus 6
aaucgauuacaaaacaa

SEQ ID NO: 3987452 - RNA, 23 nt, Human herpesvirus 6
aaucucaagcacaaaaccaggaa

SEQ ID NO: 3987453 - RNA, 21 nt, Human herpesvirus 6
aaucugaucgaaauacuucuc

SEQ ID NO: 3987454 - RNA, 16 nt, Human herpesvirus 6
aaugagauagaaguua

SEQ ID NO: 3987455 - RNA, 16 nt, Human herpesvirus 6
aaugagauguucuaaa

SEQ ID NO: 3987456 - RNA, 22 nt, Human herpesvirus 6
aaugccucuccuauaaauacug

SEQ ID NO: 3987457 - RNA, 10 nt, Human herpesvirus 6
aaugcugcug

SEQ ID NO: 3987458 - RNA, 21 nt, Human herpesvirus 6
aauguaacuuuuuguauuaug

SEQ ID NO: 3987459 - RNA, 14 nt, Human herpesvirus 6
aauguaauaauuga

SEQ ID NO: 3987460 - RNA, 20 nt, Human herpesvirus 6
aauguuuuucauaaauggua

SEQ ID NO: 3987461 - RNA, 20 nt, Human herpesvirus 6
aauuacgcuguccgccuguu

SEQ ID NO: 3987462 - RNA, 17 nt, Human herpesvirus 6
aauucgucgaguuguau

SEQ ID NO: 3987463 - RNA, 13 nt, Human herpesvirus 6
aauucuaaauacg

SEQ ID NO: 3987464 - RNA, 21 nt, Human herpesvirus 6
aauuguggauuuucagacaua

SEQ ID NO: 3987465 - RNA, 14 nt, Human herpesvirus 6
aauuucuuuugagg

SEQ ID NO: 3987466 - RNA, 19 nt, Human herpesvirus 6
aauuugaaauaucagaaau

SEQ ID NO: 3987467 - RNA, 20 nt, Human herpesvirus 6
aauuugaaauaucagaaaua

SEQ ID NO: 3987468 - RNA, 18 nt, Human herpesvirus 6
aauuuguaaaaaaacauu

SEQ ID NO: 3987469 - RNA, 17 nt, Human herpesvirus 6
aauuuuauuaacuguaa

SEQ ID NO: 3987470 - RNA, 13 nt, Human herpesvirus 6
acaaaacaaucua

SEQ ID NO: 3987471 - RNA, 16 nt, Human herpesvirus 6
acaaaacaaucuaucu

SEQ ID NO: 3987472 - RNA, 17 nt, Human herpesvirus 6
acaaacugucacuuucc

SEQ ID NO: 3987473 - RNA, 13 nt, Human herpesvirus 6
acaaagcuuuacu

SEQ ID NO: 3987474 - RNA, 21 nt, Human herpesvirus 6
acaaauucuuacauuuuguac

SEQ ID NO: 3987475 - RNA, 23 nt, Human herpesvirus 6
acaagggcagggggggucucugu

SEQ ID NO: 3987476 - RNA, 15 nt, Human herpesvirus 6
acaaugacugggaga

SEQ ID NO: 3987477 - RNA, 23 nt, Human herpesvirus 6
acacaccugccuagaauucuccc

SEQ ID NO: 3987478 - RNA, 16 nt, Human herpesvirus 6
acaccaucuucagcuc

SEQ ID NO: 3987479 - RNA, 18 nt, Human herpesvirus 6
acacgcgcaguggacggc

SEQ ID NO: 3987480 - RNA, 15 nt, Human herpesvirus 6
acacguguuaaauaa

SEQ ID NO: 3987481 - RNA, 21 nt, Human herpesvirus 6
acacugcaagguuucgaaugg

SEQ ID NO: 3987482 - RNA, 17 nt, Human herpesvirus 6
acacuugccaugcuagc

SEQ ID NO: 3987483 - RNA, 19 nt, Human herpesvirus 6
acacuuuaucgauguagau

SEQ ID NO: 3987484 - RNA, 19 nt, Human herpesvirus 6
acagaauucuucugugacu

SEQ ID NO: 3987485 - RNA, 15 nt, Human herpesvirus 6
acagacgaaucacau

SEQ ID NO: 3987486 - RNA, 15 nt, Human herpesvirus 6
acaggggaggagcgu

SEQ ID NO: 3987487 - RNA, 20 nt, Human herpesvirus 6
acagucguaguauccuuaac

SEQ ID NO: 3987488 - RNA, 14 nt, Human herpesvirus 6
acagucuuuaaaug

SEQ ID NO: 3987489 - RNA, 19 nt, Human herpesvirus 6
acagugauuagaauguuug

SEQ ID NO: 3987490 - RNA, 20 nt, Human herpesvirus 6
acaguuauacuggcaaagca

SEQ ID NO: 3987491 - RNA, 16 nt, Human herpesvirus 6
acaguuuccgcugccg

SEQ ID NO: 3987492 - RNA, 15 nt, Human herpesvirus 6
acauccuaacaagac

SEQ ID NO: 3987493 - RNA, 20 nt, Human herpesvirus 6
acaucgucuccuacauucuc

SEQ ID NO: 3987494 - RNA, 13 nt, Human herpesvirus 6
acaugcaauuuuu

SEQ ID NO: 3987495 - RNA, 21 nt, Human herpesvirus 6
acauguucuuuauuaaauguu

SEQ ID NO: 3987496 - RNA, 14 nt, Human herpesvirus 6
acauuaaacacuaa

SEQ ID NO: 3987497 - RNA, 21 nt, Human herpesvirus 6
acauugauuccaccuuuaucg

SEQ ID NO: 3987498 - RNA, 17 nt, Human herpesvirus 6
acauuuauaaaaggagu

SEQ ID NO: 3987499 - RNA, 18 nt, Human herpesvirus 6
acauuuauaauuaaaaua

SEQ ID NO: 3987500 - RNA, 14 nt, Human herpesvirus 6
acauuuauguuucu

SEQ ID NO: 3987501 - RNA, 21 nt, Human herpesvirus 6
acauuuauguuucuuauuagc

SEQ ID NO: 3987502 - RNA, 17 nt, Human herpesvirus 6
acauuuugguuucccuc

SEQ ID NO: 3987503 - RNA, 16 nt, Human herpesvirus 6
accaacacaccugccu

SEQ ID NO: 3987504 - RNA, 19 nt, Human herpesvirus 6
accaccaacacaccugccu

SEQ ID NO: 3987505 - RNA, 18 nt, Human herpesvirus 6
accaucaauaaaaaucua

SEQ ID NO: 3987506 - RNA, 20 nt, Human herpesvirus 6
acccaucuccucaacacucu

SEQ ID NO: 3987507 - RNA, 22 nt, Human herpesvirus 6
acccauuuccggaguugcagug

SEQ ID NO: 3987508 - RNA, 21 nt, Human herpesvirus 6
accccucccaucccccucccc

SEQ ID NO: 3987509 - RNA, 22 nt, Human herpesvirus 6
acccuacaaucuguccagcuug

SEQ ID NO: 3987510 - RNA, 22 nt, Human herpesvirus 6
accgaccccugccgagccugug

SEQ ID NO: 3987511 - RNA, 22 nt, Human herpesvirus 6
accgagagauuuacuguuucuu

SEQ ID NO: 3987512 - RNA, 20 nt, Human herpesvirus 6
accgagagccggaaaacaau

SEQ ID NO: 3987513 - RNA, 15 nt, Human herpesvirus 6
accgcaguuucuguu

SEQ ID NO: 3987514 - RNA, 20 nt, Human herpesvirus 6
accgcaguuucuguuuuucu

SEQ ID NO: 3987515 - RNA, 16 nt, Human herpesvirus 6
accgccguucugcuua

SEQ ID NO: 3987516 - RNA, 19 nt, Human herpesvirus 6
accgucuacugcacuuucg

SEQ ID NO: 3987517 - RNA, 18 nt, Human herpesvirus 6
accgucucugaagcaaaa

SEQ ID NO: 3987518 - RNA, 14 nt, Human herpesvirus 6
accuaauaaacugu

SEQ ID NO: 3987519 - RNA, 16 nt, Human herpesvirus 6
accucugaaacacugu

SEQ ID NO: 3987520 - RNA, 11 nt, Human herpesvirus 6
acgaaaaauuu

SEQ ID NO: 3987521 - RNA, 20 nt, Human herpesvirus 6
acgaauacuucucuuuauag

SEQ ID NO: 3987522 - RNA, 23 nt, Human herpesvirus 6
acgaugugugggaaugcugagcu

SEQ ID NO: 3987523 - RNA, 24 nt, Human herpesvirus 6
acgauuucugacucucucaguaau

SEQ ID NO: 3987524 - RNA, 21 nt, Human herpesvirus 6
acgcaacgcggagugaacuca

SEQ ID NO: 3987525 - RNA, 13 nt, Human herpesvirus 6
acgcauagacaaa

SEQ ID NO: 3987526 - RNA, 18 nt, Human herpesvirus 6
acgcccccaccucgcgca

SEQ ID NO: 3987527 - RNA, 22 nt, Human herpesvirus 6
acggaaaagaugagcgucagag

SEQ ID NO: 3987528 - RNA, 19 nt, Human herpesvirus 6
acggccaaccucuuccuag

SEQ ID NO: 3987529 - RNA, 20 nt, Human herpesvirus 6
acggcgacaaccgccgccgc

SEQ ID NO: 3987530 - RNA, 17 nt, Human herpesvirus 6
acggcgcggagcccaag

SEQ ID NO: 3987531 - RNA, 12 nt, Human herpesvirus 6
acgggaaaagau

SEQ ID NO: 3987532 - RNA, 17 nt, Human herpesvirus 6
acggugccaaaggaaac

SEQ ID NO: 3987533 - RNA, 13 nt, Human herpesvirus 6
acgguggccuggc

SEQ ID NO: 3987534 - RNA, 14 nt, Human herpesvirus 6
acgguuuauaugca

SEQ ID NO: 3987535 - RNA, 23 nt, Human herpesvirus 6
acguauauuguguaccuuguaau

SEQ ID NO: 3987536 - RNA, 17 nt, Human herpesvirus 6
acgucgacgaaauaauu

SEQ ID NO: 3987537 - RNA, 13 nt, Human herpesvirus 6
acgucugcgucgc

SEQ ID NO: 3987538 - RNA, 18 nt, Human herpesvirus 6
acgucugcgucgcccccc

SEQ ID NO: 3987539 - RNA, 21 nt, Human herpesvirus 6
acgucugcgucgcccccccgc

SEQ ID NO: 3987540 - RNA, 19 nt, Human herpesvirus 6
acgugauuccucaaaugaa

SEQ ID NO: 3987541 - RNA, 16 nt, Human herpesvirus 6
acgugcuugucucaca

SEQ ID NO: 3987542 - RNA, 19 nt, Human herpesvirus 6
acgugguuuuuuuuuucuu

SEQ ID NO: 3987543 - RNA, 23 nt, Human herpesvirus 6
acguuauaucuaaagucagagau

SEQ ID NO: 3987544 - RNA, 19 nt, Human herpesvirus 6
acuaaaaaaaaaaacacaa

SEQ ID NO: 3987545 - RNA, 13 nt, Human herpesvirus 6
acuacagcuaaga

SEQ ID NO: 3987546 - RNA, 18 nt, Human herpesvirus 6
acuacugaaaccaaagca

SEQ ID NO: 3987547 - RNA, 22 nt, Human herpesvirus 6
acucaacgcguaucgauuuaac

SEQ ID NO: 3987548 - RNA, 15 nt, Human herpesvirus 6
acucaauuuugaaau

SEQ ID NO: 3987549 - RNA, 17 nt, Human herpesvirus 6
acucauuuuaacauuuu

SEQ ID NO: 3987550 - RNA, 15 nt, Human herpesvirus 6
acucgacuaaaagac

SEQ ID NO: 3987551 - RNA, 21 nt, Human herpesvirus 6
acucuccacccaucuccucaa

SEQ ID NO: 3987552 - RNA, 22 nt, Human herpesvirus 6
acucuucggcauaaacagagac

SEQ ID NO: 3987553 - RNA, 21 nt, Human herpesvirus 6
acugaccguuguaagaagaaa

SEQ ID NO: 3987554 - RNA, 11 nt, Human herpesvirus 6
acugauggcag

SEQ ID NO: 3987555 - RNA, 15 nt, Human herpesvirus 6
acugcuaguuuuuuu

SEQ ID NO: 3987556 - RNA, 16 nt, Human herpesvirus 6
acuggagcuagagaaa

SEQ ID NO: 3987557 - RNA, 21 nt, Human herpesvirus 6
acuggcgcgcauguugcaguu

SEQ ID NO: 3987558 - RNA, 17 nt, Human herpesvirus 6
acugguuuacagcacuu

SEQ ID NO: 3987559 - RNA, 19 nt, Human herpesvirus 6
acuuauauauauaucagaa

SEQ ID NO: 3987560 - RNA, 17 nt, Human herpesvirus 6
acuuauuuuuuuuucug

SEQ ID NO: 3987561 - RNA, 19 nt, Human herpesvirus 6
acuuccgcgauacccagcg

SEQ ID NO: 3987562 - RNA, 21 nt, Human herpesvirus 6
acuuuaucgauguagauaaau

SEQ ID NO: 3987563 - RNA, 19 nt, Human herpesvirus 6
acuuucuaagacgagaugu

SEQ ID NO: 3987564 - RNA, 19 nt, Human herpesvirus 6
acuuuuugccgucacacuc

SEQ ID NO: 3987565 - RNA, 22 nt, Human herpesvirus 6
agaaaaauaaaggucagugggu

SEQ ID NO: 3987566 - RNA, 14 nt, Human herpesvirus 6
agaaaagaaacaau

SEQ ID NO: 3987567 - RNA, 12 nt, Human herpesvirus 6
agaaaugaccug

SEQ ID NO: 3987568 - RNA, 19 nt, Human herpesvirus 6
agaaaugcacuguuugaaa

SEQ ID NO: 3987569 - RNA, 14 nt, Human herpesvirus 6
agaaccaccagaga

SEQ ID NO: 3987570 - RNA, 17 nt, Human herpesvirus 6
agaagaaaagaaaaagc

SEQ ID NO: 3987571 - RNA, 20 nt, Human herpesvirus 6
agaagaucugcgugaacgug

SEQ ID NO: 3987572 - RNA, 22 nt, Human herpesvirus 6
agaagcgguagaguggaguugu

SEQ ID NO: 3987573 - RNA, 20 nt, Human herpesvirus 6
agaaguuuacauagaaauua

SEQ ID NO: 3987574 - RNA, 15 nt, Human herpesvirus 6
agaauuaagaugucu

SEQ ID NO: 3987575 - RNA, 16 nt, Human herpesvirus 6
agacacgucaacgugu

SEQ ID NO: 3987576 - RNA, 20 nt, Human herpesvirus 6
agacucgccgaugaaacugu

SEQ ID NO: 3987577 - RNA, 10 nt, Human herpesvirus 6
agagaggaag

SEQ ID NO: 3987578 - RNA, 14 nt, Human herpesvirus 6
agagaugaaagaca

SEQ ID NO: 3987579 - RNA, 14 nt, Human herpesvirus 6
agaggagaaaugau

SEQ ID NO: 3987580 - RNA, 22 nt, Human herpesvirus 6
agaguuggauuuuuuuaauugg

SEQ ID NO: 3987581 - RNA, 17 nt, Human herpesvirus 6
agauaaaaagagaggaa

SEQ ID NO: 3987582 - RNA, 20 nt, Human herpesvirus 6
agaucuggugaauguuucug

SEQ ID NO: 3987583 - RNA, 22 nt, Human herpesvirus 6
agaugaaaccuagauguaaauu

SEQ ID NO: 3987584 - RNA, 15 nt, Human herpesvirus 6
agaugacaucugcaa

SEQ ID NO: 3987585 - RNA, 15 nt, Human herpesvirus 6
agauguuucccguau

SEQ ID NO: 3987586 - RNA, 11 nt, Human herpesvirus 6
agauuaaaugu

SEQ ID NO: 3987587 - RNA, 11 nt, Human herpesvirus 6
agauuuacaga

SEQ ID NO: 3987588 - RNA, 22 nt, Human herpesvirus 6
agauuuauuagccgugauguuu

SEQ ID NO: 3987589 - RNA, 15 nt, Human herpesvirus 6
agauuucagguucuu

SEQ ID NO: 3987590 - RNA, 22 nt, Human herpesvirus 6
agcaaguugcuaccgcugggcc

SEQ ID NO: 3987591 - RNA, 20 nt, Human herpesvirus 6
uugagagcuaauaugaacaa

SEQ ID NO: 3987592 - RNA, 12 nt, Human herpesvirus 6
uugauagacggc

SEQ ID NO: 3987593 - RNA, 17 nt, Human herpesvirus 6
uugaugaaauugugacu

SEQ ID NO: 3987594 - RNA, 19 nt, Human herpesvirus 6
uugauuauauauuugcaua

SEQ ID NO: 3987595 - RNA, 17 nt, Human herpesvirus 6
uugcaauaaaaaaugga

SEQ ID NO: 3987596 - RNA, 15 nt, Human herpesvirus 6
uugcaguguguuuuu

SEQ ID NO: 3987597 - RNA, 17 nt, Human herpesvirus 6
uugcuaguuguaugacu

SEQ ID NO: 3987598 - RNA, 18 nt, Human herpesvirus 6
uugcuauagauuagaaau

SEQ ID NO: 3987599 - RNA, 20 nt, Human herpesvirus 6
uuggaugccugcauaugcag

SEQ ID NO: 3987600 - RNA, 19 nt, Human herpesvirus 6
uugguaucaguggauagga

SEQ ID NO: 3987601 - RNA, 20 nt, Human herpesvirus 6
uugguuaaaaggaauagcag

SEQ ID NO: 3987602 - RNA, 15 nt, Human herpesvirus 6
uugguucggagaggu

SEQ ID NO: 3987603 - RNA, 23 nt, Human herpesvirus 6
uugucagguuugaaacacugcaa

SEQ ID NO: 3987604 - RNA, 17 nt, Human herpesvirus 6
uugucagucaacgcaau

SEQ ID NO: 3987605 - RNA, 15 nt, Human herpesvirus 6
uuuacgguuucaggc

SEQ ID NO: 3987606 - RNA, 13 nt, Human herpesvirus 6
uuuacugugauuu

SEQ ID NO: 3987607 - RNA, 13 nt, Human herpesvirus 6
uuuauaaacuuaa

SEQ ID NO: 3987608 - RNA, 16 nt, Human herpesvirus 6
uuucaagauggaccuc

SEQ ID NO: 3987609 - RNA, 22 nt, Human herpesvirus 6
uuucaugauucuuugucuaauu

SEQ ID NO: 3987610 - RNA, 19 nt, Human herpesvirus 6
uuuccagguagaguugcgu

SEQ ID NO: 3987611 - RNA, 18 nt, Human herpesvirus 6
uuuccgaaaucaaugagu

SEQ ID NO: 3987612 - RNA, 11 nt, Human herpesvirus 6
uuuccugccca

SEQ ID NO: 3987613 - RNA, 23 nt, Human herpesvirus 6
uuuccugcccaggcgaacgagaa

SEQ ID NO: 3987614 - RNA, 17 nt, Human herpesvirus 6
uuucgccaagaaaaaga

SEQ ID NO: 3987615 - RNA, 21 nt, Human herpesvirus 6
uuucguauguuuggauaauaa

SEQ ID NO: 3987616 - RNA, 14 nt, Human herpesvirus 6
uuucuuacacaaau

SEQ ID NO: 3987617 - RNA, 21 nt, Human herpesvirus 6
agcagaacggcgguaacgugg

SEQ ID NO: 3987618 - RNA, 16 nt, Human herpesvirus 6
agcagcagaguccggc

SEQ ID NO: 3987619 - RNA, 14 nt, Human herpesvirus 6
agcagucaguaaug

SEQ ID NO: 3987620 - RNA, 12 nt, Human herpesvirus 6
agcaucucaaaa

SEQ ID NO: 3987621 - RNA, 18 nt, Human herpesvirus 6
agccacugcggaguuuua

SEQ ID NO: 3987622 - RNA, 16 nt, Human herpesvirus 6
agcccccagcugaaau

SEQ ID NO: 3987623 - RNA, 15 nt, Human herpesvirus 6
agcccuuacuugaaa

SEQ ID NO: 3987624 - RNA, 17 nt, Human herpesvirus 6
agcgaagugaagaauuu

SEQ ID NO: 3987625 - RNA, 14 nt, Human herpesvirus 6
agcucucccuuaaa

SEQ ID NO: 3987626 - RNA, 19 nt, Human herpesvirus 6
agcuuagcgauuaguuugu

SEQ ID NO: 3987627 - RNA, 16 nt, Human herpesvirus 6
agcuuguuaggacacu

SEQ ID NO: 3987628 - RNA, 21 nt, Human herpesvirus 6
agcuuugccacauacaggugg

SEQ ID NO: 3987629 - RNA, 23 nt, Human herpesvirus 6
aggaaaacucgcaccucugaaac

SEQ ID NO: 3987630 - RNA, 15 nt, Human herpesvirus 6
aggaaaccaccggcu

SEQ ID NO: 3987631 - RNA, 21 nt, Human herpesvirus 6
aggaaaguguguucuuacaau

SEQ ID NO: 3987632 - RNA, 20 nt, Human herpesvirus 6
aggaaauaaaaacaccucua

SEQ ID NO: 3987633 - RNA, 19 nt, Human herpesvirus 6
aggaacaacuauacgguga

SEQ ID NO: 3987634 - RNA, 20 nt, Human herpesvirus 6
aggaagaaacggacacgcgc

SEQ ID NO: 3987635 - RNA, 17 nt, Human herpesvirus 6
aggacgggaagaacagg

SEQ ID NO: 3987636 - RNA, 23 nt, Human herpesvirus 6
aggacuaucugagacaguccauu

SEQ ID NO: 3987637 - RNA, 19 nt, Human herpesvirus 6
aggaucguccccuuggcuc

SEQ ID NO: 3987638 - RNA, 15 nt, Human herpesvirus 6
aggcaugugauuguc

SEQ ID NO: 3987639 - RNA, 16 nt, Human herpesvirus 6
aggccuacggcgccac

SEQ ID NO: 3987640 - RNA, 22 nt, Human herpesvirus 6
aggcuaugugucuccgccuuuu

SEQ ID NO: 3987641 - RNA, 14 nt, Human herpesvirus 6
aggcugccaugaaa

SEQ ID NO: 3987642 - RNA, 16 nt, Human herpesvirus 6
agggcggacggacggc

SEQ ID NO: 3987643 - RNA, 16 nt, Human herpesvirus 6
aggggcgcgagacagc

SEQ ID NO: 3987644 - RNA, 14 nt, Human herpesvirus 6
agggucaaaaaacu

SEQ ID NO: 3987645 - RNA, 14 nt, Human herpesvirus 6
agguaacggagccc

SEQ ID NO: 3987646 - RNA, 13 nt, Human herpesvirus 6
aggucagugggua

SEQ ID NO: 3987647 - RNA, 14 nt, Human herpesvirus 6
agguguuuccugcc

SEQ ID NO: 3987648 - RNA, 18 nt, Human herpesvirus 6
aguaguugcuaaguguga

SEQ ID NO: 3987649 - RNA, 12 nt, Human herpesvirus 6
aguaugcuuugg

SEQ ID NO: 3987650 - RNA, 13 nt, Human herpesvirus 6
aguauuaacuagu

SEQ ID NO: 3987651 - RNA, 16 nt, Human herpesvirus 6
agucaaauugauuaug

SEQ ID NO: 3987652 - RNA, 19 nt, Human herpesvirus 6
agucaccuguauagauuua

SEQ ID NO: 3987653 - RNA, 14 nt, Human herpesvirus 6
agucauuaacgaga

SEQ ID NO: 3987654 - RNA, 19 nt, Human herpesvirus 6
agucccaucuauacacccu

SEQ ID NO: 3987655 - RNA, 15 nt, Human herpesvirus 6
agucgacaaauuaua

SEQ ID NO: 3987656 - RNA, 22 nt, Human herpesvirus 6
agucgcacacacaagaacagag

SEQ ID NO: 3987657 - RNA, 19 nt, Human herpesvirus 6
agucucacgcgaucuaaua

SEQ ID NO: 3987658 - RNA, 17 nt, Human herpesvirus 6
agucugcuaaaaaucau

SEQ ID NO: 3987659 - RNA, 13 nt, Human herpesvirus 6
agugaaauucaaa

SEQ ID NO: 3987660 - RNA, 16 nt, Human herpesvirus 6
agugauuauggugccu

SEQ ID NO: 3987661 - RNA, 22 nt, Human herpesvirus 6
aguuaccgugaugugggugugg

SEQ ID NO: 3987662 - RNA, 22 nt, Human herpesvirus 6
aguuauacuggcaaagcaaaga

SEQ ID NO: 3987663 - RNA, 15 nt, Human herpesvirus 6
aguuuacauagaaau

SEQ ID NO: 3987664 - RNA, 20 nt, Human herpesvirus 6
aguuucaccauguccaggaa

SEQ ID NO: 3987665 - RNA, 19 nt, Human herpesvirus 6
aguuucuguuuuucucgga

SEQ ID NO: 3987666 - RNA, 15 nt, Human herpesvirus 6
aguuugugugccuuu

SEQ ID NO: 3987667 - RNA, 13 nt, Human herpesvirus 6
aguuuucuaaaag

SEQ ID NO: 3987668 - RNA, 20 nt, Human herpesvirus 6
aguuuuuauugaagacugaa

SEQ ID NO: 3987669 - RNA, 13 nt, Human herpesvirus 6
auaaaaaaaagac

SEQ ID NO: 3987670 - RNA, 14 nt, Human herpesvirus 6
auaaaaaauauuaa

SEQ ID NO: 3987671 - RNA, 19 nt, Human herpesvirus 6
auaaacauuucauugaaua

SEQ ID NO: 3987672 - RNA, 15 nt, Human herpesvirus 6
auaaaguaagcaccu

SEQ ID NO: 3987673 - RNA, 16 nt, Human herpesvirus 6
auaaccucacuacuga

SEQ ID NO: 3987674 - RNA, 22 nt, Human herpesvirus 6
auaacgauagcagcucugcaau

SEQ ID NO: 3987675 - RNA, 18 nt, Human herpesvirus 6
gacgcacucggaagaaaa

SEQ ID NO: 3987676 - RNA, 12 nt, Human herpesvirus 6
gacgggcaggaa

SEQ ID NO: 3987677 - RNA, 16 nt, Human herpesvirus 6
gacgugccaccgucug

SEQ ID NO: 3987678 - RNA, 19 nt, Human herpesvirus 6
gacucagguuuagaugcuu

SEQ ID NO: 3987679 - RNA, 15 nt, Human herpesvirus 6
gacuuggagagaacu

SEQ ID NO: 3987680 - RNA, 20 nt, Human herpesvirus 6
gagaauaagaucuacagagu

SEQ ID NO: 3987681 - RNA, 15 nt, Human herpesvirus 6
gagacagcggacagc

SEQ ID NO: 3987682 - RNA, 23 nt, Human herpesvirus 6
gagaccaauuuaugucauuucau

SEQ ID NO: 3987683 - RNA, 13 nt, Human herpesvirus 6
gagacgaaagcag

SEQ ID NO: 3987684 - RNA, 23 nt, Human herpesvirus 6
gagacgcacccuacaaucugucc

SEQ ID NO: 3987685 - RNA, 21 nt, Human herpesvirus 6
gagacuuagcuagaugugucu

SEQ ID NO: 3987686 - RNA, 21 nt, Human herpesvirus 6
gagaggaagaaacggacacgc

SEQ ID NO: 3987687 - RNA, 17 nt, Human herpesvirus 6
gagaggcucuaugaaga

SEQ ID NO: 3987688 - RNA, 16 nt, Human herpesvirus 6
gagauaucauaaucug

SEQ ID NO: 3987689 - RNA, 21 nt, Human herpesvirus 6
gagaucuggugaauguuucug

SEQ ID NO: 3987690 - RNA, 14 nt, Human herpesvirus 6
gagaugacggaaua

SEQ ID NO: 3987691 - RNA, 21 nt, Human herpesvirus 6
gagcacgcacgacaacacgcc

SEQ ID NO: 3987692 - RNA, 15 nt, Human herpesvirus 6
gagcggugugcaguu

SEQ ID NO: 3987693 - RNA, 16 nt, Human herpesvirus 6
gaggacgggaagaaca

SEQ ID NO: 3987694 - RNA, 16 nt, Human herpesvirus 6
gaggacggugagaaga

SEQ ID NO: 3987695 - RNA, 21 nt, Human herpesvirus 6
gaggccaucuaucgcgcaccg

SEQ ID NO: 3987696 - RNA, 15 nt, Human herpesvirus 6
gagguguuuccugcc

SEQ ID NO: 3987697 - RNA, 20 nt, Human herpesvirus 6
gaguccggcgcacgcacacg

SEQ ID NO: 3987698 - RNA, 17 nt, Human herpesvirus 6
gauaaagaucagugggu

SEQ ID NO: 3987699 - RNA, 13 nt, Human herpesvirus 6
gauaacuuuuguu

SEQ ID NO: 3987700 - RNA, 17 nt, Human herpesvirus 6
gauacaucguuuguuga

SEQ ID NO: 3987701 - RNA, 15 nt, Human herpesvirus 6
gauagaggaauugcu

SEQ ID NO: 3987702 - RNA, 16 nt, Human herpesvirus 6
gauagguagaauuacu

SEQ ID NO: 3987703 - RNA, 13 nt, Human herpesvirus 6
gauauaaauaugg

SEQ ID NO: 3987704 - RNA, 18 nt, Human herpesvirus 6
gaucaacggccuggagua

SEQ ID NO: 3987705 - RNA, 16 nt, Human herpesvirus 6
gaucacaacauaaaaa

SEQ ID NO: 3987706 - RNA, 12 nt, Human herpesvirus 6
gaucagugggua

SEQ ID NO: 3987707 - RNA, 20 nt, Human herpesvirus 6
gaucaucgggaacauagaga

SEQ ID NO: 3987708 - RNA, 22 nt, Human herpesvirus 6
gauccgucucucagcuggcuga

SEQ ID NO: 3987709 - RNA, 21 nt, Human herpesvirus 6
gaucuaaauuucuacaaaaau

SEQ ID NO: 3987710 - RNA, 17 nt, Human herpesvirus 6
gaugauuauucugucuu

SEQ ID NO: 3987711 - RNA, 19 nt, Human herpesvirus 6
gaugcaaucgaugugacaa

SEQ ID NO: 3987712 - RNA, 16 nt, Human herpesvirus 6
gaugccugcauaugca

SEQ ID NO: 3987713 - RNA, 18 nt, Human herpesvirus 6
gauggaguauuuguuuua

SEQ ID NO: 3987714 - RNA, 15 nt, Human herpesvirus 6
gauguagguuucgau

SEQ ID NO: 3987715 - RNA, 15 nt, Human herpesvirus 6
gauguucuaaaggau

SEQ ID NO: 3987716 - RNA, 14 nt, Human herpesvirus 6
gauguuuccugaau

SEQ ID NO: 3987717 - RNA, 20 nt, Human herpesvirus 6
gauucgaucgagaaucuucc

SEQ ID NO: 3987718 - RNA, 14 nt, Human herpesvirus 6
gauucuuuaaagau

SEQ ID NO: 3987719 - RNA, 19 nt, Human herpesvirus 6
gauuucacuuaagccagcu

SEQ ID NO: 3987720 - RNA, 21 nt, Human herpesvirus 6
gcaaaccauaaaaaaucuugu

SEQ ID NO: 3987721 - RNA, 21 nt, Human herpesvirus 6
gcaaaucucacugucgaaauu

SEQ ID NO: 3987722 - RNA, 24 nt, Human herpesvirus 6
gcaacaaaaagcuuuaaagcagcu

SEQ ID NO: 3987723 - RNA, 17 nt, Human herpesvirus 6
gcaacucaucaaauccu

SEQ ID NO: 3987724 - RNA, 16 nt, Human herpesvirus 6
gcaagacgccacgggc

SEQ ID NO: 3987725 - RNA, 16 nt, Human herpesvirus 6
gcaagucacgggcagc

SEQ ID NO: 3987726 - RNA, 22 nt, Human herpesvirus 6
gcaaucgaugugacaaaucugu

SEQ ID NO: 3987727 - RNA, 16 nt, Human herpesvirus 6
gcacaucuauguguau

SEQ ID NO: 3987728 - RNA, 17 nt, Human herpesvirus 6
gcagaacaacagcaugu

SEQ ID NO: 3987729 - RNA, 17 nt, Human herpesvirus 6
gcagaauagagagaaag

SEQ ID NO: 3987730 - RNA, 16 nt, Human herpesvirus 6
gcagaucuaucacagg

SEQ ID NO: 3987731 - RNA, 16 nt, Human herpesvirus 6
gcagauuuuuaaaagu

SEQ ID NO: 3987732 - RNA, 23 nt, Human herpesvirus 6
gcagucaguaaugauauaaaaga

SEQ ID NO: 3987733 - RNA, 19 nt, Human herpesvirus 6
gcauugacuauuaaacuaa

SEQ ID NO: 3987734 - RNA, 21 nt, Human herpesvirus 6
gccaaacuuguugcaagcagc

SEQ ID NO: 3987735 - RNA, 20 nt, Human herpesvirus 6
gccaaaggaaaccaccggcu

SEQ ID NO: 3987736 - RNA, 14 nt, Human herpesvirus 6
gccacgacgugcug

SEQ ID NO: 3987737 - RNA, 21 nt, Human herpesvirus 6
gccacgacgugcugcaaggcc

SEQ ID NO: 3987738 - RNA, 16 nt, Human herpesvirus 6
gccagcgcaagauucu

SEQ ID NO: 3987739 - RNA, 15 nt, Human herpesvirus 6
gcccggggacggaca

SEQ ID NO: 3987740 - RNA, 21 nt, Human herpesvirus 6
gcccuaucuccgauaacgaaa

SEQ ID NO: 3987741 - RNA, 13 nt, Human herpesvirus 6
gccgacagcaagu

SEQ ID NO: 3987742 - RNA, 23 nt, Human herpesvirus 6
gccgccguccuauucagaggugc

SEQ ID NO: 3987743 - RNA, 18 nt, Human herpesvirus 6
gccggaucguaaggcagu

SEQ ID NO: 3987744 - RNA, 19 nt, Human herpesvirus 6
gccgguagagaguggggac

SEQ ID NO: 3987745 - RNA, 13 nt, Human herpesvirus 6
gccgucaaagaca

SEQ ID NO: 3987746 - RNA, 22 nt, Human herpesvirus 6
gccuaauuacgcuguccgccug

SEQ ID NO: 3987747 - RNA, 19 nt, Human herpesvirus 6
gccuugucaucaugugugc

SEQ ID NO: 3987748 - RNA, 23 nt, Human herpesvirus 6
gcgaccgaccccugccgagccug

SEQ ID NO: 3987749 - RNA, 14 nt, Human herpesvirus 6
gcgacuauuugaaa

SEQ ID NO: 3987750 - RNA, 20 nt, Human herpesvirus 6
gcgagucuugugugaaagua

SEQ ID NO: 3987751 - RNA, 13 nt, Human herpesvirus 6
gcgcgcgugugug

SEQ ID NO: 3987752 - RNA, 21 nt, Human herpesvirus 6
gcggaaauaaaaaauauuaau

SEQ ID NO: 3987753 - RNA, 11 nt, Human herpesvirus 6
gcggacggacg

SEQ ID NO: 3987754 - RNA, 16 nt, Human herpesvirus 6
gcggagcccaagaaga

SEQ ID NO: 3987755 - RNA, 22 nt, Human herpesvirus 6
gcggcaaccgcaguuccuguuu

SEQ ID NO: 3987756 - RNA, 12 nt, Human herpesvirus 6
gcgggaccuggc

SEQ ID NO: 3987757 - RNA, 15 nt, Human herpesvirus 6
gcggugcagaacauc

SEQ ID NO: 3987758 - RNA, 19 nt, Human herpesvirus 6
gcguuccgacucgauuuga

SEQ ID NO: 3987759 - RNA, 13 nt, Human herpesvirus 6
gcuaccgcugggc

SEQ ID NO: 3987760 - RNA, 18 nt, Human herpesvirus 6
gcucugaaauuugagaaa

SEQ ID NO: 3987761 - RNA, 21 nt, Human herpesvirus 6
gcugugacgaagauggaugug

SEQ ID NO: 3987762 - RNA, 20 nt, Human herpesvirus 6
gcuuaccguucaucauucca

SEQ ID NO: 3987763 - RNA, 18 nt, Human herpesvirus 6
gcuucaacuaaauauguu

SEQ ID NO: 3987764 - RNA, 12 nt, Human herpesvirus 6
gcuuuaaagcag

SEQ ID NO: 3987765 - RNA, 22 nt, Human herpesvirus 6
ggaaaauuaaaagucagugggu

SEQ ID NO: 3987766 - RNA, 20 nt, Human herpesvirus 6
ggaaagaagauuuuccuagu

SEQ ID NO: 3987767 - RNA, 15 nt, Human herpesvirus 6
ggaacgauuugcagu

SEQ ID NO: 3987768 - RNA, 16 nt, Human herpesvirus 6
ggaagagaggaagaaa

SEQ ID NO: 3987769 - RNA, 12 nt, Human herpesvirus 6
ggaaugugucag

SEQ ID NO: 3987770 - RNA, 17 nt, Human herpesvirus 6
ggaccgaggggacaggg

SEQ ID NO: 3987771 - RNA, 18 nt, Human herpesvirus 6
ggacgacgggcggggcgg

SEQ ID NO: 3987772 - RNA, 13 nt, Human herpesvirus 6
ggacgggcggagc

SEQ ID NO: 3987773 - RNA, 15 nt, Human herpesvirus 6
ggacguucugucugc

SEQ ID NO: 3987774 - RNA, 14 nt, Human herpesvirus 6
ggacucauagauuu

SEQ ID NO: 3987775 - RNA, 14 nt, Human herpesvirus 6
ggagacuccccgcu

SEQ ID NO: 3987776 - RNA, 19 nt, Human herpesvirus 6
ggagagacgcaccacggcu

SEQ ID NO: 3987777 - RNA, 13 nt, Human herpesvirus 6
ggagaggccggag

SEQ ID NO: 3987778 - RNA, 19 nt, Human herpesvirus 6
ggaggccuucaugagccag

SEQ ID NO: 3987779 - RNA, 13 nt, Human herpesvirus 6
ggagggacccaca

SEQ ID NO: 3987780 - RNA, 23 nt, Human herpesvirus 6
ggauaagcagaagaguuuuuuaa

SEQ ID NO: 3987781 - RNA, 15 nt, Human herpesvirus 6
ggauaucucaaauuu

SEQ ID NO: 3987782 - RNA, 20 nt, Human herpesvirus 6
ggaucgacgggcaggaauca

SEQ ID NO: 3987783 - RNA, 19 nt, Human herpesvirus 6
ggaugcaaucgaugugaca

SEQ ID NO: 3987784 - RNA, 17 nt, Human herpesvirus 6
ggauggcuagugugccu

SEQ ID NO: 3987785 - RNA, 22 nt, Human herpesvirus 6
ggauuucccuuguaaucaauca

SEQ ID NO: 3987786 - RNA, 16 nt, Human herpesvirus 6
ggcagaggggaaggga

SEQ ID NO: 3987787 - RNA, 21 nt, Human herpesvirus 6
ggccacguccucgugcucugc

SEQ ID NO: 3987788 - RNA, 16 nt, Human herpesvirus 6
ggccucccauguaugc

SEQ ID NO: 3987789 - RNA, 13 nt, Human herpesvirus 6
ggccuggcacggu

SEQ ID NO: 3987790 - RNA, 20 nt, Human herpesvirus 6
ggcgaugaucucggcgccgg

SEQ ID NO: 3987791 - RNA, 16 nt, Human herpesvirus 6
ggcgcugauuccugua

SEQ ID NO: 3987792 - RNA, 19 nt, Human herpesvirus 6
ggcggagccacuugcaaug

SEQ ID NO: 3987793 - RNA, 22 nt, Human herpesvirus 6
ggcuauuuuuccgaaaggugaa

SEQ ID NO: 3987794 - RNA, 19 nt, Human herpesvirus 6
ggcucgugauccuacaagg

SEQ ID NO: 3987795 - RNA, 19 nt, Human herpesvirus 6
ggcucuguuuucccaggua

SEQ ID NO: 3987796 - RNA, 18 nt, Human herpesvirus 6
ggcucuuugcugacugua

SEQ ID NO: 3987797 - RNA, 13 nt, Human herpesvirus 6
gggccuccgccac

SEQ ID NO: 3987798 - RNA, 17 nt, Human herpesvirus 6
gggcuggaaagagaacg

SEQ ID NO: 3987799 - RNA, 23 nt, Human herpesvirus 6
ggggacagugauuagaauguuug

SEQ ID NO: 3987800 - RNA, 16 nt, Human herpesvirus 6
gggucuuuccugcaca

SEQ ID NO: 3987801 - RNA, 17 nt, Human herpesvirus 6
gggucuuuccugcacag

SEQ ID NO: 3987802 - RNA, 21 nt, Human herpesvirus 6
gggucuuuccugcacaggcga

SEQ ID NO: 3987803 - RNA, 23 nt, Human herpesvirus 6
gguaaaauggcugugcuaucuga

SEQ ID NO: 3987804 - RNA, 13 nt, Human herpesvirus 6
gguaacgcugucg

SEQ ID NO: 3987805 - RNA, 22 nt, Human herpesvirus 6
gguaccgcgguuugggggucuu

SEQ ID NO: 3987806 - RNA, 20 nt, Human herpesvirus 6
gguauaucucggacucauag

SEQ ID NO: 3987807 - RNA, 11 nt, Human herpesvirus 6
ggucagugggu

SEQ ID NO: 3987808 - RNA, 19 nt, Human herpesvirus 6
ggucugcaaaaaugucugc

SEQ ID NO: 3987809 - RNA, 15 nt, Human herpesvirus 6
ggugagucacauaga

SEQ ID NO: 3987810 - RNA, 21 nt, Human herpesvirus 6
gguggccuggcacggugccaa

SEQ ID NO: 3987811 - RNA, 17 nt, Human herpesvirus 6
guaaaucaucaacguaa

SEQ ID NO: 3987812 - RNA, 23 nt, Human herpesvirus 6
guaaaugaauguguucacagagc

SEQ ID NO: 3987813 - RNA, 22 nt, Human herpesvirus 6
guaacgccacagccuguucuug

SEQ ID NO: 3987814 - RNA, 19 nt, Human herpesvirus 6
guaacggcaggcuuuuuaa

SEQ ID NO: 3987815 - RNA, 20 nt, Human herpesvirus 6
guaagauacgaaccucauga

SEQ ID NO: 3987816 - RNA, 17 nt, Human herpesvirus 6
guaauauagacauugcu

SEQ ID NO: 3987817 - RNA, 15 nt, Human herpesvirus 6
guaauuuugaaauug

SEQ ID NO: 3987818 - RNA, 16 nt, Human herpesvirus 6
guacguugguaucagu

SEQ ID NO: 3987819 - RNA, 16 nt, Human herpesvirus 6
guauaagucuaaugca

SEQ ID NO: 3987820 - RNA, 18 nt, Human herpesvirus 6
guauacagcuaaacgccg

SEQ ID NO: 3987821 - RNA, 14 nt, Human herpesvirus 6
guaugcaucaucaa

SEQ ID NO: 3987822 - RNA, 14 nt, Human herpesvirus 6
guauggagauguua

SEQ ID NO: 3987823 - RNA, 16 nt, Human herpesvirus 6
guauuauguaauacau

SEQ ID NO: 3987824 - RNA, 15 nt, Human herpesvirus 6
guauuuuuuaagagu

SEQ ID NO: 3987825 - RNA, 17 nt, Human herpesvirus 6
gucaaauugauuaugau

SEQ ID NO: 3987826 - RNA, 19 nt, Human herpesvirus 6
gucaguggguaccgcgguu

SEQ ID NO: 3987827 - RNA, 18 nt, Human herpesvirus 6
guccgugacacacagaau

SEQ ID NO: 3987828 - RNA, 17 nt, Human herpesvirus 6
guccucuuugaauuuua

SEQ ID NO: 3987829 - RNA, 15 nt, Human herpesvirus 6
gucuccauccucgaa

SEQ ID NO: 3987830 - RNA, 16 nt, Human herpesvirus 6
gucucuguucugccac

SEQ ID NO: 3987831 - RNA, 23 nt, Human herpesvirus 6
gucugggacccacgguggccugg

SEQ ID NO: 3987832 - RNA, 18 nt, Human herpesvirus 6
gucuucuugggcuccgcg

SEQ ID NO: 3987833 - RNA, 12 nt, Human herpesvirus 6
gucuuuccugca

SEQ ID NO: 3987834 - RNA, 18 nt, Human herpesvirus 6
gugaaagaccguagcaaa

SEQ ID NO: 3987835 - RNA, 13 nt, Human herpesvirus 6
gugaauauaucaa

SEQ ID NO: 3987836 - RNA, 20 nt, Human herpesvirus 6
gugauccuacaagggcaggg

SEQ ID NO: 3987837 - RNA, 20 nt, Human herpesvirus 6
gugaucugauucgacaaauc

SEQ ID NO: 3987838 - RNA, 21 nt, Human herpesvirus 6
gugaucuuuacaaaagacaca

SEQ ID NO: 3987839 - RNA, 21 nt, Human herpesvirus 6
gugauuccucaaaugaauuua

SEQ ID NO: 3987840 - RNA, 16 nt, Human herpesvirus 6
gugauugugacaagga

SEQ ID NO: 3987841 - RNA, 18 nt, Human herpesvirus 6
gugauuucacgugaaaua

SEQ ID NO: 3987842 - RNA, 19 nt, Human herpesvirus 6
gugcgaucgagcaacagcg

SEQ ID NO: 3987843 - RNA, 15 nt, Human herpesvirus 6
gugcugagacucuac

SEQ ID NO: 3987844 - RNA, 19 nt, Human herpesvirus 6
gugcuucuggcacaggcau

SEQ ID NO: 3987845 - RNA, 15 nt, Human herpesvirus 6
gugcuuuuaaaauua

SEQ ID NO: 3987846 - RNA, 19 nt, Human herpesvirus 6
guggaaaaaagucaccugu

SEQ ID NO: 3987847 - RNA, 21 nt, Human herpesvirus 6
guggugguuuugggcgcaauc

SEQ ID NO: 3987848 - RNA, 12 nt, Human herpesvirus 6
guguacaaugac

SEQ ID NO: 3987849 - RNA, 15 nt, Human herpesvirus 6
guguguguaauuuuu

SEQ ID NO: 3987850 - RNA, 11 nt, Human herpesvirus 6
guguuuccaau

SEQ ID NO: 3987851 - RNA, 13 nt, Human herpesvirus 6
guguuuucaucag

SEQ ID NO: 3987852 - RNA, 17 nt, Human herpesvirus 6
guuaaaaaaacggccaa

SEQ ID NO: 3987853 - RNA, 21 nt, Human herpesvirus 6
guuaauucaaaugcaguaaau

SEQ ID NO: 3987854 - RNA, 21 nt, Human herpesvirus 6
guuacaaguuucaauauauga

SEQ ID NO: 3987855 - RNA, 23 nt, Human herpesvirus 6
guuagaaauuuuaccuuuggaaa

SEQ ID NO: 3987856 - RNA, 14 nt, Human herpesvirus 6
guuauauuggauug

SEQ ID NO: 3987857 - RNA, 21 nt, Human herpesvirus 6
guuccuccgcgggaccuggcg

SEQ ID NO: 3987858 - RNA, 14 nt, Human herpesvirus 6
guucguaaugugca

SEQ ID NO: 3987859 - RNA, 13 nt, Human herpesvirus 6
guucguuaaaaac

SEQ ID NO: 3987860 - RNA, 17 nt, Human herpesvirus 6
guugagguguuuccugc

SEQ ID NO: 3987861 - RNA, 14 nt, Human herpesvirus 6
guugauuacgucaa

SEQ ID NO: 3987862 - RNA, 14 nt, Human herpesvirus 6
guugugauuggauc

SEQ ID NO: 3987863 - RNA, 12 nt, Human herpesvirus 6
guuguucuugga

SEQ ID NO: 3987864 - RNA, 16 nt, Human herpesvirus 6
guuuaaacuaugcaaa

SEQ ID NO: 3987865 - RNA, 21 nt, Human herpesvirus 6
guuuaagaagggcuuuaaaac

SEQ ID NO: 3987866 - RNA, 18 nt, Human herpesvirus 6
guuucauuucaucuuguu

SEQ ID NO: 3987867 - RNA, 14 nt, Human herpesvirus 6
guuuccugcccagg

SEQ ID NO: 3987868 - RNA, 13 nt, Human herpesvirus 6
guuucguacugga

SEQ ID NO: 3987869 - RNA, 23 nt, Human herpesvirus 6
guuugcaaaacuguuaaaagaga

SEQ ID NO: 3987870 - RNA, 20 nt, Human herpesvirus 6
guuuuaagagcagacaagga

SEQ ID NO: 3987871 - RNA, 13 nt, Human herpesvirus 6
guuuuucauaaau

SEQ ID NO: 3987872 - RNA, 20 nt, Human herpesvirus 6
guuuuuuggaauauauaaau

SEQ ID NO: 3987873 - RNA, 19 nt, Human herpesvirus 6
uaaaaaaugaaugugcuga

SEQ ID NO: 3987874 - RNA, 17 nt, Human herpesvirus 6
uaaaaacucacacaacc

SEQ ID NO: 3987875 - RNA, 11 nt, Human herpesvirus 6
uaaaaagagag

SEQ ID NO: 3987876 - RNA, 20 nt, Human herpesvirus 6
uaaaagaauuuuuguagcaa

SEQ ID NO: 3987877 - RNA, 20 nt, Human herpesvirus 6
uaaaauuugcuaacggggca

SEQ ID NO: 3987878 - RNA, 17 nt, Human herpesvirus 6
uaaacaauuauguguca

SEQ ID NO: 3987879 - RNA, 21 nt, Human herpesvirus 6
uaaagacgggccuccgccacu

SEQ ID NO: 3987880 - RNA, 14 nt, Human herpesvirus 6
uaaaguuuugugau

SEQ ID NO: 3987881 - RNA, 15 nt, Human herpesvirus 6
uaaaugguagcuauu

SEQ ID NO: 3987882 - RNA, 15 nt, Human herpesvirus 6
uaaauuauuuuguga

SEQ ID NO: 3987883 - RNA, 20 nt, Human herpesvirus 6
uaaauuauuuugugauuaac

SEQ ID NO: 3987884 - RNA, 16 nt, Human herpesvirus 6
uaacaacaaccacagc

SEQ ID NO: 3987885 - RNA, 15 nt, Human herpesvirus 6
uaacacgugugacac

SEQ ID NO: 3987886 - RNA, 19 nt, Human herpesvirus 6
uaacaggauucccuucaga

SEQ ID NO: 3987887 - RNA, 20 nt, Human herpesvirus 6
uaacaucugcuaacgcggca

SEQ ID NO: 3987888 - RNA, 14 nt, Human herpesvirus 6
uaaccggaaaagag

SEQ ID NO: 3987889 - RNA, 12 nt, Human herpesvirus 6
uaacggagcccg

SEQ ID NO: 3987890 - RNA, 15 nt, Human herpesvirus 6
uaacugguucagaau

SEQ ID NO: 3987891 - RNA, 13 nt, Human herpesvirus 6
uaacuuuuuguau

SEQ ID NO: 3987892 - RNA, 13 nt, Human herpesvirus 6
uaagauuaaaugu

SEQ ID NO: 3987893 - RNA, 15 nt, Human herpesvirus 6
uaagauugugcaguu

SEQ ID NO: 3987894 - RNA, 21 nt, Human herpesvirus 6
uaagcaaauguaacuuuuugu

SEQ ID NO: 3987895 - RNA, 23 nt, Human herpesvirus 6
uaagcaaauguaacuuuuuguau

SEQ ID NO: 3987896 - RNA, 16 nt, Human herpesvirus 6
uaagcgugacuuauau

SEQ ID NO: 3987897 - RNA, 18 nt, Human herpesvirus 6
uaaggaagauucagagug

SEQ ID NO: 3987898 - RNA, 21 nt, Human herpesvirus 6
uaaggaagauucagagugaau

SEQ ID NO: 3987899 - RNA, 13 nt, Human herpesvirus 6
uaaggucaaauau

SEQ ID NO: 3987900 - RNA, 22 nt, Human herpesvirus 6
uaauaaaggauguuugugacuc

SEQ ID NO: 3987901 - RNA, 13 nt, Human herpesvirus 6
uaauagccaaaca

SEQ ID NO: 3987902 - RNA, 17 nt, Human herpesvirus 6
uaauagccaaacaaggg

SEQ ID NO: 3987903 - RNA, 13 nt, Human herpesvirus 6
uaauaugaacaau

SEQ ID NO: 3987904 - RNA, 20 nt, Human herpesvirus 6
uaaugaguuuuucgcaauuu

SEQ ID NO: 3987905 - RNA, 15 nt, Human herpesvirus 6
uaaugauauaaaaga

SEQ ID NO: 3987906 - RNA, 15 nt, Human herpesvirus 6
uaaugcaaguuugaa

SEQ ID NO: 3987907 - RNA, 21 nt, Human herpesvirus 6
uaaugcgguucgacagagaua

SEQ ID NO: 3987908 - RNA, 20 nt, Human herpesvirus 6
uaauggcgcauaacggaaaa

SEQ ID NO: 3987909 - RNA, 15 nt, Human herpesvirus 6
gucacacguguuaaa

SEQ ID NO: 3987910 - RNA, 16 nt, Human herpesvirus 6
gucaucgguggcagag

SEQ ID NO: 3987911 - RNA, 15 nt, Human herpesvirus 6
gucauuucaucuauu

SEQ ID NO: 3987912 - RNA, 13 nt, Human herpesvirus 6
gucgcucuuucua

SEQ ID NO: 3987913 - RNA, 23 nt, Human herpesvirus 6
gucgggaaauaaaaaauauuaau

SEQ ID NO: 3987914 - RNA, 17 nt, Human herpesvirus 6
gucguuggauuaaauca

SEQ ID NO: 3987915 - RNA, 21 nt, Human herpesvirus 6
gucuaauuucgacaauccuaa

SEQ ID NO: 3987916 - RNA, 14 nt, Human herpesvirus 6
gucuagaugcaaau

SEQ ID NO: 3987917 - RNA, 18 nt, Human herpesvirus 6
gucuccugggagcucucc

SEQ ID NO: 3987918 - RNA, 14 nt, Human herpesvirus 6
gucucucagcuggc

SEQ ID NO: 3987919 - RNA, 19 nt, Human herpesvirus 6
gucugaucccuuagaagcu

SEQ ID NO: 3987920 - RNA, 14 nt, Human herpesvirus 6
gucugcaaaaaugu

SEQ ID NO: 3987921 - RNA, 13 nt, Human herpesvirus 6
gucugggacccac

SEQ ID NO: 3987922 - RNA, 13 nt, Human herpesvirus 6
gucugugauuuua

SEQ ID NO: 3987923 - RNA, 20 nt, Human herpesvirus 6
gucuucaauaaaaacucaau

SEQ ID NO: 3987924 - RNA, 22 nt, Human herpesvirus 6
gucuuuaccauuugacuccaac

SEQ ID NO: 3987925 - RNA, 16 nt, Human herpesvirus 6
gucuuuagaacagcuu

SEQ ID NO: 3987926 - RNA, 16 nt, Human herpesvirus 6
gucuuuccugcacagg

SEQ ID NO: 3987927 - RNA, 20 nt, Human herpesvirus 6
gugaacgcaagucacgggca

SEQ ID NO: 3987928 - RNA, 14 nt, Human herpesvirus 6
gugacucuucucua

SEQ ID NO: 3987929 - RNA, 18 nt, Human herpesvirus 6
gugacuuauauauauauc

SEQ ID NO: 3987930 - RNA, 14 nt, Human herpesvirus 6
gugagaagaucugc

SEQ ID NO: 3987931 - RNA, 21 nt, Human herpesvirus 6
gugaucugauucgacaaauca

SEQ ID NO: 3987932 - RNA, 15 nt, Human herpesvirus 6
gugauuccaguuaau

SEQ ID NO: 3987933 - RNA, 22 nt, Human herpesvirus 6
gugccucagaggugaguaggag

SEQ ID NO: 3987934 - RNA, 17 nt, Human herpesvirus 6
gugcuugucucacaagc

SEQ ID NO: 3987935 - RNA, 17 nt, Human herpesvirus 6
gugcuuuuaaaauuaug

SEQ ID NO: 3987936 - RNA, 14 nt, Human herpesvirus 6
guggacgugccggg

SEQ ID NO: 3987937 - RNA, 17 nt, Human herpesvirus 6
guggcagaggggaaggg

SEQ ID NO: 3987938 - RNA, 12 nt, Human herpesvirus 6
guggccuggcac

SEQ ID NO: 3987939 - RNA, 22 nt, Human herpesvirus 6
gugggaggcauuacauuaugaa

SEQ ID NO: 3987940 - RNA, 23 nt, Human herpesvirus 6
gugggggguuccuccgcgggacc

SEQ ID NO: 3987941 - RNA, 18 nt, Human herpesvirus 6
gugguuguuguuauuguu

SEQ ID NO: 3987942 - RNA, 13 nt, Human herpesvirus 6
guguuauucggag

SEQ ID NO: 3987943 - RNA, 12 nt, Human herpesvirus 6
guguuuguaaau

SEQ ID NO: 3987944 - RNA, 19 nt, Human herpesvirus 6
guuacauucguauacuucc

SEQ ID NO: 3987945 - RNA, 22 nt, Human herpesvirus 6
guuaggacaauuagauaaacaa

SEQ ID NO: 3987946 - RNA, 19 nt, Human herpesvirus 6
guuaggacacuuucaaaau

SEQ ID NO: 3987947 - RNA, 17 nt, Human herpesvirus 6
guuaugaaugagauguu

SEQ ID NO: 3987948 - RNA, 22 nt, Human herpesvirus 6
guuauugccgcuucuauauauc

SEQ ID NO: 3987949 - RNA, 20 nt, Human herpesvirus 6
guucagucuaugcagcgcca

SEQ ID NO: 3987950 - RNA, 14 nt, Human herpesvirus 6
guucaucauuccag

SEQ ID NO: 3987951 - RNA, 16 nt, Human herpesvirus 6
guucgaugauuauucu

SEQ ID NO: 3987952 - RNA, 20 nt, Human herpesvirus 6
guucggagauaucauaaucu

SEQ ID NO: 3987953 - RNA, 21 nt, Human herpesvirus 6
guucugccacgacgugcugca

SEQ ID NO: 3987954 - RNA, 19 nt, Human herpesvirus 6
guugagaaugauuuuaagu

SEQ ID NO: 3987955 - RNA, 21 nt, Human herpesvirus 6
guuguugaucguguuguggac

SEQ ID NO: 3987956 - RNA, 16 nt, Human herpesvirus 6
guuuaaagauguguua

SEQ ID NO: 3987957 - RNA, 17 nt, Human herpesvirus 6
guuuaauaguuugccau

SEQ ID NO: 3987958 - RNA, 14 nt, Human herpesvirus 6
guuuaauaguuuua

SEQ ID NO: 3987959 - RNA, 22 nt, Human herpesvirus 6
guuuacccgggcgaguagacuc

SEQ ID NO: 3987960 - RNA, 17 nt, Human herpesvirus 6
guuuaccuauuuacaau

SEQ ID NO: 3987961 - RNA, 18 nt, Human herpesvirus 6
guuucgccaagaaaaaga

SEQ ID NO: 3987962 - RNA, 23 nt, Human herpesvirus 6
guuugggauguccauuucuucga

SEQ ID NO: 3987963 - RNA, 20 nt, Human herpesvirus 6
guuugggggucuuuccugca

SEQ ID NO: 3987964 - RNA, 19 nt, Human herpesvirus 6
guuuggggucuuuccugca

SEQ ID NO: 3987965 - RNA, 14 nt, Human herpesvirus 6
guuuuguggcucuc

SEQ ID NO: 3987966 - RNA, 23 nt, Human herpesvirus 6
guuuuuuaauccauauuuggaag

SEQ ID NO: 3987967 - RNA, 17 nt, Human herpesvirus 6
uaaaaaccgacuuauau

SEQ ID NO: 3987968 - RNA, 11 nt, Human herpesvirus 6
uaaaauuaaag

SEQ ID NO: 3987969 - RNA, 14 nt, Human herpesvirus 6
uaaaauuguaauuu

SEQ ID NO: 3987970 - RNA, 21 nt, Human herpesvirus 6
uaaagaaacagauuuccgccu

SEQ ID NO: 3987971 - RNA, 16 nt, Human herpesvirus 6
uaaaggucagugggug

SEQ ID NO: 3987972 - RNA, 12 nt, Human herpesvirus 6
uaaaguuuucau

SEQ ID NO: 3987973 - RNA, 14 nt, Human herpesvirus 6
uaaaugugaacauu

SEQ ID NO: 3987974 - RNA, 13 nt, Human herpesvirus 6
uaaauuguuuuac

SEQ ID NO: 3987975 - RNA, 15 nt, Human herpesvirus 6
uaacgaacaaaucuc

SEQ ID NO: 3987976 - RNA, 18 nt, Human herpesvirus 6
uaacguggauaaaacggc

SEQ ID NO: 3987977 - RNA, 13 nt, Human herpesvirus 6
uaacucuuuuugu

SEQ ID NO: 3987978 - RNA, 13 nt, Human herpesvirus 6
uaacuuuacauua

SEQ ID NO: 3987979 - RNA, 13 nt, Human herpesvirus 6
uaagcgugacuua

SEQ ID NO: 3987980 - RNA, 16 nt, Human herpesvirus 6
uaauaaagugucacuc

SEQ ID NO: 3987981 - RNA, 17 nt, Human herpesvirus 6
uaauaaguccugugcuc

SEQ ID NO: 3987982 - RNA, 14 nt, Human herpesvirus 6
uaauauacgaaaua

SEQ ID NO: 3987983 - RNA, 21 nt, Human herpesvirus 6
uaaucgauuacaaaacaaucu

SEQ ID NO: 3987984 - RNA, 20 nt, Human herpesvirus 6
uaauuaccuauagucaaugu

SEQ ID NO: 3987985 - RNA, 19 nt, Human herpesvirus 6
uaauuccagcuuucuuaga

SEQ ID NO: 3987986 - RNA, 16 nt, Human herpesvirus 6
uacaagguacacaaua

SEQ ID NO: 3987987 - RNA, 19 nt, Human herpesvirus 6
uacaauagucauuaacgag

SEQ ID NO: 3987988 - RNA, 19 nt, Human herpesvirus 6
uacagaaccagauaucucu

SEQ ID NO: 3987989 - RNA, 13 nt, Human herpesvirus 6
uacauauagucaa

SEQ ID NO: 3987990 - RNA, 17 nt, Human herpesvirus 6
uacauauagucaauguu

SEQ ID NO: 3987991 - RNA, 24 nt, Human herpesvirus 6
uacaucaucgccuuuuacuuacau

SEQ ID NO: 3987992 - RNA, 13 nt, Human herpesvirus 6
uacccggaagcuu

SEQ ID NO: 3987993 - RNA, 11 nt, Human herpesvirus 6
uaccgcugggc

SEQ ID NO: 3987994 - RNA, 12 nt, Human herpesvirus 6
uaccuauaguca

SEQ ID NO: 3987995 - RNA, 15 nt, Human herpesvirus 6
uacgaauucaauguc

SEQ ID NO: 3987996 - RNA, 15 nt, Human herpesvirus 6
uacuacagugacuuu

SEQ ID NO: 3987997 - RNA, 19 nt, Human herpesvirus 6
uacugaaaccaaagcauac

SEQ ID NO: 3987998 - RNA, 21 nt, Human herpesvirus 6
uagcagaaguuuacauagaaa

SEQ ID NO: 3987999 - RNA, 23 nt, Human herpesvirus 6
uagcagaauagagagaaagagau

SEQ ID NO: 3988000 - RNA, 16 nt, Human herpesvirus 6
uagcuauuaugugaau

SEQ ID NO: 3988001 - RNA, 14 nt, Human herpesvirus 6
uagggaugguggau

SEQ ID NO: 3988002 - RNA, 22 nt, Human herpesvirus 6
uagguaucacccccccuucauc

SEQ ID NO: 3988003 - RNA, 14 nt, Human herpesvirus 6
uaguuuuugcuuac

SEQ ID NO: 3988004 - RNA, 22 nt, Human herpesvirus 6
uauacgaaaauaaaaaaaacaa

SEQ ID NO: 3988005 - RNA, 13 nt, Human herpesvirus 6
uauauauuugcau

SEQ ID NO: 3988006 - RNA, 15 nt, Human herpesvirus 6
uauaucaaacuuuuu

SEQ ID NO: 3988007 - RNA, 18 nt, Human herpesvirus 6
uauaucuucguaauggga

SEQ ID NO: 3988008 - RNA, 21 nt, Human herpesvirus 6
uauaugaggcgcuugaaacca

SEQ ID NO: 3988009 - RNA, 13 nt, Human herpesvirus 6
uauauuaaauugu

SEQ ID NO: 3988010 - RNA, 15 nt, Human herpesvirus 6
uaucaugagagagca

SEQ ID NO: 3988011 - RNA, 15 nt, Human herpesvirus 6
uaucauuaaauuguu

SEQ ID NO: 3988012 - RNA, 23 nt, Human herpesvirus 6
uaucccccguacaagcuuaauaa

SEQ ID NO: 3988013 - RNA, 16 nt, Human herpesvirus 6
uaucgauucuguaauu

SEQ ID NO: 3988014 - RNA, 12 nt, Human herpesvirus 6
uaucugaagacg

SEQ ID NO: 3988015 - RNA, 19 nt, Human herpesvirus 6
uaucuugaaaucuacugua

SEQ ID NO: 3988016 - RNA, 23 nt, Human herpesvirus 6
uaugaauucguuacaaucucugu

SEQ ID NO: 3988017 - RNA, 21 nt, Human herpesvirus 6
uaugcuuauacuguuguaaaa

SEQ ID NO: 3988018 - RNA, 12 nt, Human herpesvirus 6
uaugugcauucc

SEQ ID NO: 3988019 - RNA, 18 nt, Human herpesvirus 6
uauuaacacguacauaau

SEQ ID NO: 3988020 - RNA, 18 nt, Human herpesvirus 6
uauucaagcgaagugaag

SEQ ID NO: 3988021 - RNA, 21 nt, Human herpesvirus 6
uauuccaaacuacggaaaauc

SEQ ID NO: 3988022 - RNA, 14 nt, Human herpesvirus 6
uauugucgaagaac

SEQ ID NO: 3988023 - RNA, 16 nt, Human herpesvirus 6
uauuuaacauccaaaa

SEQ ID NO: 3988024 - RNA, 19 nt, Human herpesvirus 6
cguuauucguaagugggua

SEQ ID NO: 3988025 - RNA, 14 nt, Human herpesvirus 6
cguuuuccauguga

SEQ ID NO: 3988026 - RNA, 13 nt, Human herpesvirus 6
cuaaacuuuacau

SEQ ID NO: 3988027 - RNA, 17 nt, Human herpesvirus 6
cuaagauugugcaguua

SEQ ID NO: 3988028 - RNA, 21 nt, Human herpesvirus 6
cuaauaaaugucaaagaaaca

SEQ ID NO: 3988029 - RNA, 16 nt, Human herpesvirus 6
cuaauaauuacaauac

SEQ ID NO: 3988030 - RNA, 14 nt, Human herpesvirus 6
cuaaugcaaagaug

SEQ ID NO: 3988031 - RNA, 23 nt, Human herpesvirus 6
cuacauuaacagacgaggacgga

SEQ ID NO: 3988032 - RNA, 20 nt, Human herpesvirus 6
cuaccaugugcggagaaagu

SEQ ID NO: 3988033 - RNA, 18 nt, Human herpesvirus 6
cuacggcaacgcuccucc

SEQ ID NO: 3988034 - RNA, 13 nt, Human herpesvirus 6
cuacuauccgccc

SEQ ID NO: 3988035 - RNA, 17 nt, Human herpesvirus 6
cuacugaaaccaaagca

SEQ ID NO: 3988036 - RNA, 15 nt, Human herpesvirus 6
cuaggccuucaccug

SEQ ID NO: 3988037 - RNA, 14 nt, Human herpesvirus 6
cuaguuuucacacg

SEQ ID NO: 3988038 - RNA, 21 nt, Human herpesvirus 6
cuauaaaaaauuucaaacugg

SEQ ID NO: 3988039 - RNA, 18 nt, Human herpesvirus 6
cuauaaacaauuguauuc

SEQ ID NO: 3988040 - RNA, 14 nt, Human herpesvirus 6
cuauagucaauguu

SEQ ID NO: 3988041 - RNA, 20 nt, Human herpesvirus 6
cuaucauuuuuuugauuuac

SEQ ID NO: 3988042 - RNA, 12 nt, Human herpesvirus 6
cuauccaugaaa

SEQ ID NO: 3988043 - RNA, 13 nt, Human herpesvirus 6
cuauccgcccucc

SEQ ID NO: 3988044 - RNA, 16 nt, Human herpesvirus 6
cuaugaguucucugau

SEQ ID NO: 3988045 - RNA, 18 nt, Human herpesvirus 6
cuauuacuauauauugga

SEQ ID NO: 3988046 - RNA, 13 nt, Human herpesvirus 6
cuauuauauugua

SEQ ID NO: 3988047 - RNA, 16 nt, Human herpesvirus 6
cuauuuaaaauggacu

SEQ ID NO: 3988048 - RNA, 14 nt, Human herpesvirus 6
cucaaaaaacauau

SEQ ID NO: 3988049 - RNA, 15 nt, Human herpesvirus 6
cucacuacugaaacc

SEQ ID NO: 3988050 - RNA, 14 nt, Human herpesvirus 6
cucauaaaauuaaa

SEQ ID NO: 3988051 - RNA, 11 nt, Human herpesvirus 6
cuccaauaaaa

SEQ ID NO: 3988052 - RNA, 14 nt, Human herpesvirus 6
cuccacaugacacc

SEQ ID NO: 3988053 - RNA, 20 nt, Human herpesvirus 6
cuccccgggugcuccgccac

SEQ ID NO: 3988054 - RNA, 14 nt, Human herpesvirus 6
cuccgcgccccucg

SEQ ID NO: 3988055 - RNA, 15 nt, Human herpesvirus 6
cuccguuuccuccuc

SEQ ID NO: 3988056 - RNA, 18 nt, Human herpesvirus 6
cuccuacuauccgcccuc

SEQ ID NO: 3988057 - RNA, 15 nt, Human herpesvirus 6
cuccuauaaauacug

SEQ ID NO: 3988058 - RNA, 12 nt, Human herpesvirus 6
cuccucaacacu

SEQ ID NO: 3988059 - RNA, 15 nt, Human herpesvirus 6
cuccugagaagcugg

SEQ ID NO: 3988060 - RNA, 14 nt, Human herpesvirus 6
cucgaaaaaacaac

SEQ ID NO: 3988061 - RNA, 11 nt, Human herpesvirus 6
cucggaaaaua

SEQ ID NO: 3988062 - RNA, 14 nt, Human herpesvirus 6
cucggaacauaauu

SEQ ID NO: 3988063 - RNA, 19 nt, Human herpesvirus 6
cucgggaacgaccgcggcc

SEQ ID NO: 3988064 - RNA, 14 nt, Human herpesvirus 6
cucuaaaagcugcu

SEQ ID NO: 3988065 - RNA, 22 nt, Human herpesvirus 6
cucuaaccguuguucuuggaga

SEQ ID NO: 3988066 - RNA, 14 nt, Human herpesvirus 6
cugaacuguuucca

SEQ ID NO: 3988067 - RNA, 18 nt, Human herpesvirus 6
cugaagaugagcagcuuu

SEQ ID NO: 3988068 - RNA, 13 nt, Human herpesvirus 6
cugacacaaucag

SEQ ID NO: 3988069 - RNA, 13 nt, Human herpesvirus 6
cugagaacgggca

SEQ ID NO: 3988070 - RNA, 16 nt, Human herpesvirus 6
cugagaccuugucaau

SEQ ID NO: 3988071 - RNA, 16 nt, Human herpesvirus 6
cugagugcgaccuguc

SEQ ID NO: 3988072 - RNA, 20 nt, Human herpesvirus 6
cugaucacagagaaaaaaca

SEQ ID NO: 3988073 - RNA, 18 nt, Human herpesvirus 6
cugauggcagguaaccaa

SEQ ID NO: 3988074 - RNA, 17 nt, Human herpesvirus 6
cugauuccuucaauguu

SEQ ID NO: 3988075 - RNA, 13 nt, Human herpesvirus 6
cugcaaaaggugg

SEQ ID NO: 3988076 - RNA, 22 nt, Human herpesvirus 6
cugcacaggcgaacgagaacuc

SEQ ID NO: 3988077 - RNA, 15 nt, Human herpesvirus 6
cugccauaucacaca

SEQ ID NO: 3988078 - RNA, 22 nt, Human herpesvirus 6
cugcccaggcaaacgagaacuc

SEQ ID NO: 3988079 - RNA, 13 nt, Human herpesvirus 6
cugcgaggccauc

SEQ ID NO: 3988080 - RNA, 21 nt, Human herpesvirus 6
cugcuaaaagcuauguaugaa

SEQ ID NO: 3988081 - RNA, 20 nt, Human herpesvirus 6
cugcuaguuuuuuuucuuua

SEQ ID NO: 3988082 - RNA, 16 nt, Human herpesvirus 6
cugcuggaugcugaug

SEQ ID NO: 3988083 - RNA, 16 nt, Human herpesvirus 6
cugcuggcugagauuc

SEQ ID NO: 3988084 - RNA, 17 nt, Human herpesvirus 6
cuggagcagucugcugg

SEQ ID NO: 3988085 - RNA, 14 nt, Human herpesvirus 6
cuggaugcugauga

SEQ ID NO: 3988086 - RNA, 16 nt, Human herpesvirus 6
cugggacccacggugg

SEQ ID NO: 3988087 - RNA, 18 nt, Human herpesvirus 6
cugggacccacgguggcc

SEQ ID NO: 3988088 - RNA, 13 nt, Human herpesvirus 6
cugguuuacagca

SEQ ID NO: 3988089 - RNA, 18 nt, Human herpesvirus 6
cuguagaaacguuaaugu

SEQ ID NO: 3988090 - RNA, 14 nt, Human herpesvirus 6
cugucgaauauguu

SEQ ID NO: 3988091 - RNA, 19 nt, Human herpesvirus 6
cugucuauuaucuggccuc

SEQ ID NO: 3988092 - RNA, 14 nt, Human herpesvirus 6
cugugcucuuuaua

SEQ ID NO: 3988093 - RNA, 15 nt, Human herpesvirus 6
cuguguguuauaagg

SEQ ID NO: 3988094 - RNA, 17 nt, Human herpesvirus 6
cuguguuacaaacaugc

SEQ ID NO: 3988095 - RNA, 12 nt, Human herpesvirus 6
cuguuuuaaccg

SEQ ID NO: 3988096 - RNA, 14 nt, Human herpesvirus 6
cuguuuuucucgga

SEQ ID NO: 3988097 - RNA, 20 nt, Human herpesvirus 6
cuuacaauguuuuugacaaa

SEQ ID NO: 3988098 - RNA, 16 nt, Human herpesvirus 6
cuuacauuuuguacaa

SEQ ID NO: 3988099 - RNA, 12 nt, Human herpesvirus 6
cuuaccaagaaa

SEQ ID NO: 3988100 - RNA, 13 nt, Human herpesvirus 6
cuuauauaggcac

SEQ ID NO: 3988101 - RNA, 14 nt, Human herpesvirus 6
cuuauauaggcacc

SEQ ID NO: 3988102 - RNA, 21 nt, Human herpesvirus 6
cuucaacauaucacuuguauu

SEQ ID NO: 3988103 - RNA, 17 nt, Human herpesvirus 6
cuucaauaaaaacucaa

SEQ ID NO: 3988104 - RNA, 18 nt, Human herpesvirus 6
cuugaucaaauaucugaa

SEQ ID NO: 3988105 - RNA, 15 nt, Human herpesvirus 6
cuugauguuuccuga

SEQ ID NO: 3988106 - RNA, 20 nt, Human herpesvirus 6
cuuguccuuuuuuacuaguu

SEQ ID NO: 3988107 - RNA, 20 nt, Human herpesvirus 6
cuugucgggcuuugugaaau

SEQ ID NO: 3988108 - RNA, 19 nt, Human herpesvirus 6
cuugucuuacacucuccac

SEQ ID NO: 3988109 - RNA, 16 nt, Human herpesvirus 6
cuuguguaucugugaa

SEQ ID NO: 3988110 - RNA, 14 nt, Human herpesvirus 6
cuuuaaagcagcua

SEQ ID NO: 3988111 - RNA, 23 nt, Human herpesvirus 6
cuuuauauuuucgguguguauuu

SEQ ID NO: 3988112 - RNA, 21 nt, Human herpesvirus 6
cuuuauguacccuaagugaaa

SEQ ID NO: 3988113 - RNA, 14 nt, Human herpesvirus 6
cuuuauuaaauguu

SEQ ID NO: 3988114 - RNA, 15 nt, Human herpesvirus 6
cuuucaguauuaacu

SEQ ID NO: 3988115 - RNA, 10 nt, Human herpesvirus 6
cuuuccugca

SEQ ID NO: 3988116 - RNA, 18 nt, Human herpesvirus 6
cuuuccugcacaggcgaa

SEQ ID NO: 3988117 - RNA, 22 nt, Human herpesvirus 6
cuuucuguuuuaauuaaaaaaa

SEQ ID NO: 3988118 - RNA, 22 nt, Human herpesvirus 6
cuuugaaggacuaucugagaca

SEQ ID NO: 3988119 - RNA, 22 nt, Human herpesvirus 6
cuuugggaccuucaggaacaaa

SEQ ID NO: 3988120 - RNA, 20 nt, Human herpesvirus 6
cuuuuacaauacacagaaaa

SEQ ID NO: 3988121 - RNA, 19 nt, Human herpesvirus 6
cuuuuggaugcagcguugg

SEQ ID NO: 3988122 - RNA, 21 nt, Human herpesvirus 6
gaaaaaaacacaaaucuggau

SEQ ID NO: 3988123 - RNA, 13 nt, Human herpesvirus 6
gaaaaaaaucaga

SEQ ID NO: 3988124 - RNA, 15 nt, Human herpesvirus 6
gaaaaauucaaucag

SEQ ID NO: 3988125 - RNA, 15 nt, Human herpesvirus 6
gaaaauauuuccugc

SEQ ID NO: 3988126 - RNA, 20 nt, Human herpesvirus 6
gaaaaucucaaacgccgugu

SEQ ID NO: 3988127 - RNA, 20 nt, Human herpesvirus 6
gaaacacugaguucuguggc

SEQ ID NO: 3988128 - RNA, 19 nt, Human herpesvirus 6
gaaaccaccggcuaacccu

SEQ ID NO: 3988129 - RNA, 20 nt, Human herpesvirus 6
gaaagaguguuuggauaaug

SEQ ID NO: 3988130 - RNA, 15 nt, Human herpesvirus 6
gaaaucguauacguu

SEQ ID NO: 3988131 - RNA, 14 nt, Human herpesvirus 6
gaacaaaaugaggg

SEQ ID NO: 3988132 - RNA, 17 nt, Human herpesvirus 6
gaacuagaaaaacaacg

SEQ ID NO: 3988133 - RNA, 17 nt, Human herpesvirus 6
gaagaaggcuaucacuu

SEQ ID NO: 3988134 - RNA, 13 nt, Human herpesvirus 6
gaagaggaagaag

SEQ ID NO: 3988135 - RNA, 18 nt, Human herpesvirus 6
gaagaguuuuuuaagagu

SEQ ID NO: 3988136 - RNA, 15 nt, Human herpesvirus 6
gaagauaauaaaaca

SEQ ID NO: 3988137 - RNA, 16 nt, Human herpesvirus 6
gaagauaauaaaacaa

SEQ ID NO: 3988138 - RNA, 14 nt, Human herpesvirus 6
gaagauauggauga

SEQ ID NO: 3988139 - RNA, 13 nt, Human herpesvirus 6
gaagaucuaaauu

SEQ ID NO: 3988140 - RNA, 20 nt, Human herpesvirus 6
gaauacgaggaggggagacg

SEQ ID NO: 3988141 - RNA, 21 nt, Human herpesvirus 6
gaaucuacugagaucauaaau

SEQ ID NO: 3988142 - RNA, 12 nt, Human herpesvirus 6
gaaugagauguu

SEQ ID NO: 3988143 - RNA, 20 nt, Human herpesvirus 6
gaaugucgguaaacuuacca

SEQ ID NO: 3988144 - RNA, 23 nt, Human herpesvirus 6
gaauuuguggaacaauagacgaa

SEQ ID NO: 3988145 - RNA, 22 nt, Human herpesvirus 6
gacaaaccucucgccgaccugu

SEQ ID NO: 3988146 - RNA, 17 nt, Human herpesvirus 6
gacaaguaagauugcag

SEQ ID NO: 3988147 - RNA, 23 nt, Human herpesvirus 6
gacaaucgucggaucaacagaug

SEQ ID NO: 3988148 - RNA, 13 nt, Human herpesvirus 6
gacacacaaaaaa

SEQ ID NO: 3988149 - RNA, 19 nt, Human herpesvirus 6
gacaucgcgcgcgacgugc

SEQ ID NO: 3988150 - RNA, 20 nt, Human herpesvirus 6
gacccgagguccgacacgcc

SEQ ID NO: 3988151 - RNA, 16 nt, Human herpesvirus 6
gaccucauauaagaac

SEQ ID NO: 3988152 - RNA, 18 nt, Human herpesvirus 6
gaccugaucacagagaaa

SEQ ID NO: 3988153 - RNA, 22 nt, Human herpesvirus 6
gacgggcgucaucgguggcaga

SEQ ID NO: 3988154 - RNA, 17 nt, Human herpesvirus 6
gacgucauguguggaca

SEQ ID NO: 3988155 - RNA, 20 nt, Human herpesvirus 6
gacgugccaccgucugggac

SEQ ID NO: 3988156 - RNA, 18 nt, Human herpesvirus 6
gacguuagcucgggguga

SEQ ID NO: 3988157 - RNA, 17 nt, Human herpesvirus 6
gacuauauuaucuuuca

SEQ ID NO: 3988158 - RNA, 14 nt, Human herpesvirus 6
gacuauuucaaaag

SEQ ID NO: 3988159 - RNA, 20 nt, Human herpesvirus 6
gacucaaucccuuucaguuc

SEQ ID NO: 3988160 - RNA, 15 nt, Human herpesvirus 6
gacucauagauuuca

SEQ ID NO: 3988161 - RNA, 16 nt, Human herpesvirus 6
gagagacgcaccacgg

SEQ ID NO: 3988162 - RNA, 16 nt, Human herpesvirus 6
gagcauucacauaaga

SEQ ID NO: 3988163 - RNA, 17 nt, Human herpesvirus 6
gagcuuguuaggacacu

SEQ ID NO: 3988164 - RNA, 17 nt, Human herpesvirus 6
gagggggagggacccac

SEQ ID NO: 3988165 - RNA, 16 nt, Human herpesvirus 6
gagguuuuuguugguu

SEQ ID NO: 3988166 - RNA, 23 nt, Human herpesvirus 6
gagugguuuuuuggauaagcaga

SEQ ID NO: 3988167 - RNA, 21 nt, Human herpesvirus 6
gaguugggacuuggaaacgug

SEQ ID NO: 3988168 - RNA, 19 nt, Human herpesvirus 6
gaguuuuuaucggugaugu

SEQ ID NO: 3988169 - RNA, 19 nt, Human herpesvirus 6
gauaaaaaacucaacugcu

SEQ ID NO: 3988170 - RNA, 21 nt, Human herpesvirus 6
gauaaccguugcgauuuccuu

SEQ ID NO: 3988171 - RNA, 20 nt, Human herpesvirus 6
gaucaucuccaauaaaauau

SEQ ID NO: 3988172 - RNA, 20 nt, Human herpesvirus 6
gaucuuuacaaaagacacaa

SEQ ID NO: 3988173 - RNA, 12 nt, Human herpesvirus 6
gaugaaauugug

SEQ ID NO: 3988174 - RNA, 20 nt, Human herpesvirus 6
gaugaauuaccuguuuuaga

SEQ ID NO: 3988175 - RNA, 22 nt, Human herpesvirus 6
gaugacagcgauacaauaacaa

SEQ ID NO: 3988176 - RNA, 23 nt, Human herpesvirus 6
gauggccgguuacaauagucauu

SEQ ID NO: 3988177 - RNA, 13 nt, Human herpesvirus 6
gauguuugaagau

SEQ ID NO: 3988178 - RNA, 17 nt, Human herpesvirus 6
gauuaauguguuuuucu

SEQ ID NO: 3988179 - RNA, 14 nt, Human herpesvirus 6
gauuacaaaacaau

SEQ ID NO: 3988180 - RNA, 17 nt, Human herpesvirus 6
cauauagucaauguugu

SEQ ID NO: 3988181 - RNA, 14 nt, Human herpesvirus 6
cauaugaaaagcug

SEQ ID NO: 3988182 - RNA, 14 nt, Human herpesvirus 6
caucaaauccucua

SEQ ID NO: 3988183 - RNA, 14 nt, Human herpesvirus 6
caucaaaucggaca

SEQ ID NO: 3988184 - RNA, 22 nt, Human herpesvirus 6
cauccaaauacacuuucauagg

SEQ ID NO: 3988185 - RNA, 14 nt, Human herpesvirus 6
cauccaccuucccu

SEQ ID NO: 3988186 - RNA, 16 nt, Human herpesvirus 6
caucccuuaaaaaaac

SEQ ID NO: 3988187 - RNA, 24 nt, Human herpesvirus 6
caucgcgcgcgacgugccaccguc

SEQ ID NO: 3988188 - RNA, 17 nt, Human herpesvirus 6
caucucgugcaaaagcu

SEQ ID NO: 3988189 - RNA, 13 nt, Human herpesvirus 6
caucugcaaaaaa

SEQ ID NO: 3988190 - RNA, 16 nt, Human herpesvirus 6
caucugccauaucaca

SEQ ID NO: 3988191 - RNA, 13 nt, Human herpesvirus 6
caugaaaucacgu

SEQ ID NO: 3988192 - RNA, 20 nt, Human herpesvirus 6
caugagggacucggaaaagg

SEQ ID NO: 3988193 - RNA, 14 nt, Human herpesvirus 6
cauggugaaagacu

SEQ ID NO: 3988194 - RNA, 16 nt, Human herpesvirus 6
cauguauuuauucacu

SEQ ID NO: 3988195 - RNA, 17 nt, Human herpesvirus 6
caugucuugccucuccg

SEQ ID NO: 3988196 - RNA, 21 nt, Human herpesvirus 6
cauuaaauuguuuuacaaauu

SEQ ID NO: 3988197 - RNA, 16 nt, Human herpesvirus 6
cauucagucucagcaa

SEQ ID NO: 3988198 - RNA, 14 nt, Human herpesvirus 6
cauuguguggggug

SEQ ID NO: 3988199 - RNA, 23 nt, Human herpesvirus 6
cauuuccggagauuaaaacauca

SEQ ID NO: 3988200 - RNA, 15 nt, Human herpesvirus 6
cauuuugaaaaaaca

SEQ ID NO: 3988201 - RNA, 15 nt, Human herpesvirus 6
ccaaagaaacagaua

SEQ ID NO: 3988202 - RNA, 21 nt, Human herpesvirus 6
ccaaauguauugaacuuugua

SEQ ID NO: 3988203 - RNA, 13 nt, Human herpesvirus 6
ccaagaaaaagaa

SEQ ID NO: 3988204 - RNA, 12 nt, Human herpesvirus 6
ccaauauugugg

SEQ ID NO: 3988205 - RNA, 14 nt, Human herpesvirus 6
ccaaucacaacaaa

SEQ ID NO: 3988206 - RNA, 19 nt, Human herpesvirus 6
ccaaugauucuuaauucuu

SEQ ID NO: 3988207 - RNA, 12 nt, Human herpesvirus 6
ccacauguguau

SEQ ID NO: 3988208 - RNA, 13 nt, Human herpesvirus 6
ccaccaaaacgac

SEQ ID NO: 3988209 - RNA, 16 nt, Human herpesvirus 6
ccaccaacacaccugc

SEQ ID NO: 3988210 - RNA, 18 nt, Human herpesvirus 6
ccaccagaaaaguauagu

SEQ ID NO: 3988211 - RNA, 20 nt, Human herpesvirus 6
ccacgcgacagauccgucuc

SEQ ID NO: 3988212 - RNA, 14 nt, Human herpesvirus 6
ccagauaaccucac

SEQ ID NO: 3988213 - RNA, 20 nt, Human herpesvirus 6
ccagauacauaaacaccccg

SEQ ID NO: 3988214 - RNA, 17 nt, Human herpesvirus 6
ccagauacuacacaaac

SEQ ID NO: 3988215 - RNA, 23 nt, Human herpesvirus 6
ccagcgggcuccgucgccgcuuc

SEQ ID NO: 3988216 - RNA, 19 nt, Human herpesvirus 6
ccaggucuuauauuucaga

SEQ ID NO: 3988217 - RNA, 15 nt, Human herpesvirus 6
ccaguagacaagaaa

SEQ ID NO: 3988218 - RNA, 13 nt, Human herpesvirus 6
ccaucuguucaau

SEQ ID NO: 3988219 - RNA, 18 nt, Human herpesvirus 6
ccauguguauauugaauu

SEQ ID NO: 3988220 - RNA, 16 nt, Human herpesvirus 6
cccagcugaaauagac

SEQ ID NO: 3988221 - RNA, 13 nt, Human herpesvirus 6
ccccgcagcuccu

SEQ ID NO: 3988222 - RNA, 15 nt, Human herpesvirus 6
ccccggaguacacgu

SEQ ID NO: 3988223 - RNA, 19 nt, Human herpesvirus 6
ggcgggcagaucuaucaca

SEQ ID NO: 3988224 - RNA, 18 nt, Human herpesvirus 6
ggcgucaucgguggcaga

SEQ ID NO: 3988225 - RNA, 12 nt, Human herpesvirus 6
ggcuaacccuaa

SEQ ID NO: 3988226 - RNA, 18 nt, Human herpesvirus 6
ggcuaacccuaacccuaa

SEQ ID NO: 3988227 - RNA, 20 nt, Human herpesvirus 6
ggcuacgacacgcuggagca

SEQ ID NO: 3988228 - RNA, 18 nt, Human herpesvirus 6
gggacccacgguggccug

SEQ ID NO: 3988229 - RNA, 21 nt, Human herpesvirus 6
gggacccacgguggccuggca

SEQ ID NO: 3988230 - RNA, 19 nt, Human herpesvirus 6
gggcgcgagacagcggaca

SEQ ID NO: 3988231 - RNA, 23 nt, Human herpesvirus 6
gggcgucaucgguggcagagggg

SEQ ID NO: 3988232 - RNA, 18 nt, Human herpesvirus 6
ggggaucgacgggcagga

SEQ ID NO: 3988233 - RNA, 19 nt, Human herpesvirus 6
ggggucucuguucugccac

SEQ ID NO: 3988234 - RNA, 20 nt, Human herpesvirus 6
ggggucuuuccugcacaggc

SEQ ID NO: 3988235 - RNA, 16 nt, Human herpesvirus 6
gggucuuuccugccca

SEQ ID NO: 3988236 - RNA, 18 nt, Human herpesvirus 6
gggugaguuuuaucacuu

SEQ ID NO: 3988237 - RNA, 23 nt, Human herpesvirus 6
gggugucggacgacgggcggggc

SEQ ID NO: 3988238 - RNA, 16 nt, Human herpesvirus 6
ggguuggaaaucaguu

SEQ ID NO: 3988239 - RNA, 20 nt, Human herpesvirus 6
gguaauuuaguguuuaaugu

SEQ ID NO: 3988240 - RNA, 21 nt, Human herpesvirus 6
gguaccgcgguuuggggucuu

SEQ ID NO: 3988241 - RNA, 17 nt, Human herpesvirus 6
gguagagaguggggaca

SEQ ID NO: 3988242 - RNA, 23 nt, Human herpesvirus 6
gguccaacacagcaugcauuugg

SEQ ID NO: 3988243 - RNA, 14 nt, Human herpesvirus 6
ggugaguuugauuu

SEQ ID NO: 3988244 - RNA, 15 nt, Human herpesvirus 6
ggugccaaaggaaac

SEQ ID NO: 3988245 - RNA, 17 nt, Human herpesvirus 6
ggugccaaaggaaacca

SEQ ID NO: 3988246 - RNA, 22 nt, Human herpesvirus 6
gguuucuugauuagagacgcac

SEQ ID NO: 3988247 - RNA, 13 nt, Human herpesvirus 6
gguuugucucgca

SEQ ID NO: 3988248 - RNA, 16 nt, Human herpesvirus 6
guaaaaucacccgagg

SEQ ID NO: 3988249 - RNA, 19 nt, Human herpesvirus 6
guaaauauuucuaaacaca

SEQ ID NO: 3988250 - RNA, 21 nt, Human herpesvirus 6
guaacaacuaccgccauauua

SEQ ID NO: 3988251 - RNA, 12 nt, Human herpesvirus 6
guaauacaucaa

SEQ ID NO: 3988252 - RNA, 22 nt, Human herpesvirus 6
guaauuucuauguaaacuucug

SEQ ID NO: 3988253 - RNA, 13 nt, Human herpesvirus 6
guaccuguacaag

SEQ ID NO: 3988254 - RNA, 20 nt, Human herpesvirus 6
guacuaugauuuauagaauu

SEQ ID NO: 3988255 - RNA, 17 nt, Human herpesvirus 6
guaugaaaguccucaaa

SEQ ID NO: 3988256 - RNA, 14 nt, Human herpesvirus 6
guauugaagaaaau

SEQ ID NO: 3988257 - RNA, 18 nt, Human herpesvirus 6
guauuggugcaucaguga

SEQ ID NO: 3988258 - RNA, 23 nt, Human herpesvirus 6
gucaaauguucgaugauuauucu

SEQ ID NO: 3988259 - RNA, 17 nt, Human herpesvirus 6
auucuaaaauuguaauu

SEQ ID NO: 3988260 - RNA, 15 nt, Human herpesvirus 6
auucuaauaaaagac

SEQ ID NO: 3988261 - RNA, 22 nt, Human herpesvirus 6
auucuucgaauaaaaaguuugu

SEQ ID NO: 3988262 - RNA, 15 nt, Human herpesvirus 6
auucuucuguaaaua

SEQ ID NO: 3988263 - RNA, 16 nt, Human herpesvirus 6
auugaaagaguguuug

SEQ ID NO: 3988264 - RNA, 15 nt, Human herpesvirus 6
auugaauuguauaua

SEQ ID NO: 3988265 - RNA, 13 nt, Human herpesvirus 6
auugcgauucuaa

SEQ ID NO: 3988266 - RNA, 14 nt, Human herpesvirus 6
auugguuugcauaa

SEQ ID NO: 3988267 - RNA, 14 nt, Human herpesvirus 6
auuguaaacgauau

SEQ ID NO: 3988268 - RNA, 23 nt, Human herpesvirus 6
auuguaauuauuagguaaacuga

SEQ ID NO: 3988269 - RNA, 21 nt, Human herpesvirus 6
auuguauauauagcuguaaau

SEQ ID NO: 3988270 - RNA, 16 nt, Human herpesvirus 6
auuguuaacauguaca

SEQ ID NO: 3988271 - RNA, 15 nt, Human herpesvirus 6
auuuaacaacaucuu

SEQ ID NO: 3988272 - RNA, 22 nt, Human herpesvirus 6
auuuaacaacaucuuaaaagac

SEQ ID NO: 3988273 - RNA, 17 nt, Human herpesvirus 6
auuuacaaaacaaauau

SEQ ID NO: 3988274 - RNA, 22 nt, Human herpesvirus 6
auuuaccuuccugagaguaaau

SEQ ID NO: 3988275 - RNA, 18 nt, Human herpesvirus 6
auuucaaacugguguaaa

SEQ ID NO: 3988276 - RNA, 19 nt, Human herpesvirus 6
auuucaaacugguguaaau

SEQ ID NO: 3988277 - RNA, 23 nt, Human herpesvirus 6
auuucauuuguuuuuuaaagcac

SEQ ID NO: 3988278 - RNA, 13 nt, Human herpesvirus 6
auuuccugcccag

SEQ ID NO: 3988279 - RNA, 15 nt, Human herpesvirus 6
auuucuauguaaacu

SEQ ID NO: 3988280 - RNA, 22 nt, Human herpesvirus 6
auuugagagcuaauaugaacaa

SEQ ID NO: 3988281 - RNA, 13 nt, Human herpesvirus 6
auuugcccugagc

SEQ ID NO: 3988282 - RNA, 22 nt, Human herpesvirus 6
auuuggaagcgaaucgcuuaaa

SEQ ID NO: 3988283 - RNA, 17 nt, Human herpesvirus 6
auuuuaauuuugaaaua

SEQ ID NO: 3988284 - RNA, 21 nt, Human herpesvirus 6
auuuuuuggaagaaauugcaa

SEQ ID NO: 3988285 - RNA, 15 nt, Human herpesvirus 6
auuuuuuuaauaaau

SEQ ID NO: 3988286 - RNA, 16 nt, Human herpesvirus 6
caaaaaaaugauagac

SEQ ID NO: 3988287 - RNA, 21 nt, Human herpesvirus 6
caaaaaaccuuuaacuuuuug

SEQ ID NO: 3988288 - RNA, 21 nt, Human herpesvirus 6
caaaaaugcacaauuuagccu

SEQ ID NO: 3988289 - RNA, 21 nt, Human herpesvirus 6
caaaacuacaaagugaaagag

SEQ ID NO: 3988290 - RNA, 15 nt, Human herpesvirus 6
caaaagcgccugccu

SEQ ID NO: 3988291 - RNA, 16 nt, Human herpesvirus 6
caaacauguauccucg

SEQ ID NO: 3988292 - RNA, 21 nt, Human herpesvirus 6
caaagaacaaaaucuucuuug

SEQ ID NO: 3988293 - RNA, 18 nt, Human herpesvirus 6
caaagacauucaacauuc

SEQ ID NO: 3988294 - RNA, 23 nt, Human herpesvirus 6
caaagacgauugcuuuaguagug

SEQ ID NO: 3988295 - RNA, 23 nt, Human herpesvirus 6
caaaucuucccuuuuacaauaca

SEQ ID NO: 3988296 - RNA, 16 nt, Human herpesvirus 6
caaauguaacuuuuug

SEQ ID NO: 3988297 - RNA, 18 nt, Human herpesvirus 6
caacaucuuaaaagacca

SEQ ID NO: 3988298 - RNA, 15 nt, Human herpesvirus 6
caacauuuauguuuc

SEQ ID NO: 3988299 - RNA, 19 nt, Human herpesvirus 6
caaccugaaacuccccaga

SEQ ID NO: 3988300 - RNA, 14 nt, Human herpesvirus 6
caacgcaucacaca

SEQ ID NO: 3988301 - RNA, 23 nt, Human herpesvirus 6
caacgcugucuuuuuucccuaac

SEQ ID NO: 3988302 - RNA, 20 nt, Human herpesvirus 6
caacugguuuugagaaagcc

SEQ ID NO: 3988303 - RNA, 20 nt, Human herpesvirus 6
caaguguuuggugugacauu

SEQ ID NO: 3988304 - RNA, 23 nt, Human herpesvirus 6
caauaaaaaccgacuuauaucga

SEQ ID NO: 3988305 - RNA, 14 nt, Human herpesvirus 6
caauaauugcauuc

SEQ ID NO: 3988306 - RNA, 13 nt, Human herpesvirus 6
caauacacagaaa

SEQ ID NO: 3988307 - RNA, 18 nt, Human herpesvirus 6
caauaucaccuuacaaau

SEQ ID NO: 3988308 - RNA, 15 nt, Human herpesvirus 6
caaucacauaguuuc

SEQ ID NO: 3988309 - RNA, 18 nt, Human herpesvirus 6
caaucgcaaaaacauguu

SEQ ID NO: 3988310 - RNA, 13 nt, Human herpesvirus 6
caaucuuaaauau

SEQ ID NO: 3988311 - RNA, 18 nt, Human herpesvirus 6
caaugcagaacaacagca

SEQ ID NO: 3988312 - RNA, 16 nt, Human herpesvirus 6
caauguaauaauugau

SEQ ID NO: 3988313 - RNA, 19 nt, Human herpesvirus 6
caauuguaguuuguguccu

SEQ ID NO: 3988314 - RNA, 18 nt, Human herpesvirus 6
caauuuaggucuuuaucc

SEQ ID NO: 3988315 - RNA, 23 nt, Human herpesvirus 6
cacagcaugaacucucacggcca

SEQ ID NO: 3988316 - RNA, 13 nt, Human herpesvirus 6
cacaggcggggau

SEQ ID NO: 3988317 - RNA, 11 nt, Human herpesvirus 6
cacccaucucc

SEQ ID NO: 3988318 - RNA, 19 nt, Human herpesvirus 6
caccgagauccccaagagg

SEQ ID NO: 3988319 - RNA, 16 nt, Human herpesvirus 6
caccuacggccagaga

SEQ ID NO: 3988320 - RNA, 15 nt, Human herpesvirus 6
caccucgcgcaccgc

SEQ ID NO: 3988321 - RNA, 16 nt, Human herpesvirus 6
caccucuaaaacaaga

SEQ ID NO: 3988322 - RNA, 19 nt, Human herpesvirus 6
caccuggguuucgaagaau

SEQ ID NO: 3988323 - RNA, 21 nt, Human herpesvirus 6
cacgacaaaacaaucagccug

SEQ ID NO: 3988324 - RNA, 14 nt, Human herpesvirus 6
cacgacaacacgcc

SEQ ID NO: 3988325 - RNA, 15 nt, Human herpesvirus 6
cacgaucuacacacc

SEQ ID NO: 3988326 - RNA, 19 nt, Human herpesvirus 6
cacggggauuuaguacagu

SEQ ID NO: 3988327 - RNA, 14 nt, Human herpesvirus 6
cacguacuauuuuu

SEQ ID NO: 3988328 - RNA, 17 nt, Human herpesvirus 6
cacgugaaauaaaguuu

SEQ ID NO: 3988329 - RNA, 20 nt, Human herpesvirus 6
cacguuaccgaagauuacuu

SEQ ID NO: 3988330 - RNA, 21 nt, Human herpesvirus 6
cacuccgacucgccgcugcag

SEQ ID NO: 3988331 - RNA, 20 nt, Human herpesvirus 6
cacucggauucaaagaaagu

SEQ ID NO: 3988332 - RNA, 15 nt, Human herpesvirus 6
cacuguaccuuuagu

SEQ ID NO: 3988333 - RNA, 14 nt, Human herpesvirus 6
cacuguuugaaacu

SEQ ID NO: 3988334 - RNA, 16 nt, Human herpesvirus 6
cacuuagacacggccg

SEQ ID NO: 3988335 - RNA, 17 nt, Human herpesvirus 6
cacuuguauuaaaguuc

SEQ ID NO: 3988336 - RNA, 14 nt, Human herpesvirus 6
cagaaaaaaaucag

SEQ ID NO: 3988337 - RNA, 16 nt, Human herpesvirus 6
cagaagaacagcuaau

SEQ ID NO: 3988338 - RNA, 22 nt, Human herpesvirus 6
cagaauuuguaaaaaaacauuc

SEQ ID NO: 3988339 - RNA, 13 nt, Human herpesvirus 6
cagacagaggaag

SEQ ID NO: 3988340 - RNA, 15 nt, Human herpesvirus 6
cagaccacaccccug

SEQ ID NO: 3988341 - RNA, 17 nt, Human herpesvirus 6
cagaggaagauagcaga

SEQ ID NO: 3988342 - RNA, 14 nt, Human herpesvirus 6
cagauaaccucacu

SEQ ID NO: 3988343 - RNA, 22 nt, Human herpesvirus 6
cagauggugcgaucgagcaaca

SEQ ID NO: 3988344 - RNA, 13 nt, Human herpesvirus 6
cagcggaagugaa

SEQ ID NO: 3988345 - RNA, 21 nt, Human herpesvirus 6
cagcucaaacaaauggaaacu

SEQ ID NO: 3988346 - RNA, 19 nt, Human herpesvirus 6
cagcuuccguaucacacuu

SEQ ID NO: 3988347 - RNA, 18 nt, Human herpesvirus 6
caggaacagucugacaug

SEQ ID NO: 3988348 - RNA, 18 nt, Human herpesvirus 6
caggauuauaaaaacaca

SEQ ID NO: 3988349 - RNA, 22 nt, Human herpesvirus 6
caggcgaacgaaaacucuaaaa

SEQ ID NO: 3988350 - RNA, 21 nt, Human herpesvirus 6
cagggggaucgacgggcagga

SEQ ID NO: 3988351 - RNA, 19 nt, Human herpesvirus 6
cagggggggucucuguucu

SEQ ID NO: 3988352 - RNA, 20 nt, Human herpesvirus 6
cagggucaaaaaacucagcc

SEQ ID NO: 3988353 - RNA, 14 nt, Human herpesvirus 6
cagguggagcugug

SEQ ID NO: 3988354 - RNA, 13 nt, Human herpesvirus 6
cagguuugaaaca

SEQ ID NO: 3988355 - RNA, 19 nt, Human herpesvirus 6
cagucaaauugauuaugau

SEQ ID NO: 3988356 - RNA, 14 nt, Human herpesvirus 6
cagucaggaaaaag

SEQ ID NO: 3988357 - RNA, 20 nt, Human herpesvirus 6
caguuauuacauuuuuggau

SEQ ID NO: 3988358 - RNA, 17 nt, Human herpesvirus 6
caguucguagaacggaa

SEQ ID NO: 3988359 - RNA, 19 nt, Human herpesvirus 6
caguuuaccuauuuacaau

SEQ ID NO: 3988360 - RNA, 14 nt, Human herpesvirus 6
cauaaacaccccga

SEQ ID NO: 3988361 - RNA, 13 nt, Human herpesvirus 6
cauaaacagacag

SEQ ID NO: 3988362 - RNA, 15 nt, Human herpesvirus 6
cauaagcaaauguaa

SEQ ID NO: 3988363 - RNA, 21 nt, Human herpesvirus 6
cauacauuccuuaagaaugaa

SEQ ID NO: 3988364 - RNA, 18 nt, Human herpesvirus 6
cauaguugggaucuucug

SEQ ID NO: 3988365 - RNA, 13 nt, Human herpesvirus 6
cauauaugaugcu

SEQ ID NO: 3988366 - RNA, 18 nt, Human herpesvirus 6
cauauauuggcaugugaa

SEQ ID NO: 3988367 - RNA, 15 nt, Human herpesvirus 6
cauaugcagacugcu

SEQ ID NO: 3988368 - RNA, 15 nt, Human herpesvirus 6
cauaugucuguuaua

SEQ ID NO: 3988369 - RNA, 17 nt, Human herpesvirus 6
cauauuaggcugcagcc

SEQ ID NO: 3988370 - RNA, 18 nt, Human herpesvirus 6
cauauuauauuuaaauga

SEQ ID NO: 3988371 - RNA, 20 nt, Human herpesvirus 6
caucaauuccggccuaggac

SEQ ID NO: 3988372 - RNA, 19 nt, Human herpesvirus 6
caucagcccccagcugaaa

SEQ ID NO: 3988373 - RNA, 18 nt, Human herpesvirus 6
caucccccuccccggagc

SEQ ID NO: 3988374 - RNA, 20 nt, Human herpesvirus 6
uaauuuaguguuuaauguaa

SEQ ID NO: 3988375 - RNA, 14 nt, Human herpesvirus 6
uacaaagugaaaga

SEQ ID NO: 3988376 - RNA, 17 nt, Human herpesvirus 6
uacaaagugaaagagac

SEQ ID NO: 3988377 - RNA, 17 nt, Human herpesvirus 6
uacaagaaaagaaacaa

SEQ ID NO: 3988378 - RNA, 15 nt, Human herpesvirus 6
uacaauacacagaaa

SEQ ID NO: 3988379 - RNA, 18 nt, Human herpesvirus 6
uacaaugaaaaaaaaauc

SEQ ID NO: 3988380 - RNA, 13 nt, Human herpesvirus 6
uacacacccagca

SEQ ID NO: 3988381 - RNA, 12 nt, Human herpesvirus 6
uacacgaacuaa

SEQ ID NO: 3988382 - RNA, 18 nt, Human herpesvirus 6
uacagauacauagauuuu

SEQ ID NO: 3988383 - RNA, 15 nt, Human herpesvirus 6
uacauaagcaaaugu

SEQ ID NO: 3988384 - RNA, 16 nt, Human herpesvirus 6
uacauauagucaaugu

SEQ ID NO: 3988385 - RNA, 17 nt, Human herpesvirus 6
uaccacacgcuuacaca

SEQ ID NO: 3988386 - RNA, 21 nt, Human herpesvirus 6
uaccuaauaauuacaauacaa

SEQ ID NO: 3988387 - RNA, 13 nt, Human herpesvirus 6
uaccuauagucaa

SEQ ID NO: 3988388 - RNA, 21 nt, Human herpesvirus 6
uaccuguaaacuggucugcuu

SEQ ID NO: 3988389 - RNA, 12 nt, Human herpesvirus 6
uaccuguacaag

SEQ ID NO: 3988390 - RNA, 14 nt, Human herpesvirus 6
uacggaaaaaguau

SEQ ID NO: 3988391 - RNA, 18 nt, Human herpesvirus 6
uacggcacgcucguuuuu

SEQ ID NO: 3988392 - RNA, 11 nt, Human herpesvirus 6
uacuaggaaag

SEQ ID NO: 3988393 - RNA, 16 nt, Human herpesvirus 6
uacuauaaacaauugu

SEQ ID NO: 3988394 - RNA, 14 nt, Human herpesvirus 6
uacuauuuguuuaa

SEQ ID NO: 3988395 - RNA, 16 nt, Human herpesvirus 6
uacugagcaaagaaau

SEQ ID NO: 3988396 - RNA, 17 nt, Human herpesvirus 6
uagacauuuugugauuc

SEQ ID NO: 3988397 - RNA, 13 nt, Human herpesvirus 6
uagagauuuugga

SEQ ID NO: 3988398 - RNA, 14 nt, Human herpesvirus 6
uagagcaacucauc

SEQ ID NO: 3988399 - RNA, 18 nt, Human herpesvirus 6
uagaucaauauaucgucu

SEQ ID NO: 3988400 - RNA, 22 nt, Human herpesvirus 6
uagaugaaaccuagauguaaau

SEQ ID NO: 3988401 - RNA, 17 nt, Human herpesvirus 6
uagauggaaaauugcaa

SEQ ID NO: 3988402 - RNA, 17 nt, Human herpesvirus 6
uagauuuuaauuuugaa

SEQ ID NO: 3988403 - RNA, 19 nt, Human herpesvirus 6
uagauuuuauaacgacaaa

SEQ ID NO: 3988404 - RNA, 21 nt, Human herpesvirus 6
uagccauuuuuuucuuacacg

SEQ ID NO: 3988405 - RNA, 14 nt, Human herpesvirus 6
uagcgauaauuaag

SEQ ID NO: 3988406 - RNA, 14 nt, Human herpesvirus 6
uaggauuagaacaa

SEQ ID NO: 3988407 - RNA, 15 nt, Human herpesvirus 6
uaggauuagaacaau

SEQ ID NO: 3988408 - RNA, 20 nt, Human herpesvirus 6
uagguauuagaugaauuugu

SEQ ID NO: 3988409 - RNA, 18 nt, Human herpesvirus 6
uaggugggucagugcuua

SEQ ID NO: 3988410 - RNA, 20 nt, Human herpesvirus 6
uaguacaguaugucuccaaa

SEQ ID NO: 3988411 - RNA, 17 nt, Human herpesvirus 6
uaguuuucacacguuau

SEQ ID NO: 3988412 - RNA, 16 nt, Human herpesvirus 6
uaguuuuuuuucuuua

SEQ ID NO: 3988413 - RNA, 14 nt, Human herpesvirus 6
uauaaaaaacugca

SEQ ID NO: 3988414 - RNA, 19 nt, Human herpesvirus 6
uauaaacaauuguauucuu

SEQ ID NO: 3988415 - RNA, 14 nt, Human herpesvirus 6
uauaaauguagcau

SEQ ID NO: 3988416 - RNA, 19 nt, Human herpesvirus 6
uauaauguguuggucauuu

SEQ ID NO: 3988417 - RNA, 16 nt, Human herpesvirus 6
uauaauuaaaauagaa

SEQ ID NO: 3988418 - RNA, 17 nt, Human herpesvirus 6
uauacacgaacuaaaua

SEQ ID NO: 3988419 - RNA, 23 nt, Human herpesvirus 6
uauacgaaauaaucgauuacaaa

SEQ ID NO: 3988420 - RNA, 15 nt, Human herpesvirus 6
uauacggaaaagaug

SEQ ID NO: 3988421 - RNA, 14 nt, Human herpesvirus 6
uauaucuaaaguca

SEQ ID NO: 3988422 - RNA, 19 nt, Human herpesvirus 6
uauaucucggacucauaga

SEQ ID NO: 3988423 - RNA, 19 nt, Human herpesvirus 6
uauauuggauuggauggau

SEQ ID NO: 3988424 - RNA, 16 nt, Human herpesvirus 6
uaucacggaugguuug

SEQ ID NO: 3988425 - RNA, 15 nt, Human herpesvirus 6
uauccgcccuccccg

SEQ ID NO: 3988426 - RNA, 17 nt, Human herpesvirus 6
uaugaucauaugaggau

SEQ ID NO: 3988427 - RNA, 15 nt, Human herpesvirus 6
uaugauuuauagaau

SEQ ID NO: 3988428 - RNA, 17 nt, Human herpesvirus 6
uaugcuuauacuguugu

SEQ ID NO: 3988429 - RNA, 16 nt, Human herpesvirus 6
uauguaauacaucaac

SEQ ID NO: 3988430 - RNA, 15 nt, Human herpesvirus 6
uauguaugaacaggu

SEQ ID NO: 3988431 - RNA, 15 nt, Human herpesvirus 6
uauguuuucaaaaau

SEQ ID NO: 3988432 - RNA, 18 nt, Human herpesvirus 6
uauucacggcuaauauga

SEQ ID NO: 3988433 - RNA, 22 nt, Human herpesvirus 6
uauuccccauuccuagaggugc

SEQ ID NO: 3988434 - RNA, 18 nt, Human herpesvirus 6
uauuguguaccuuguaau

SEQ ID NO: 3988435 - RNA, 22 nt, Human herpesvirus 6
uauuuacugagcaaagaaauga

SEQ ID NO: 3988436 - RNA, 17 nt, Human herpesvirus 6
uauuuaugaaaauugcu

SEQ ID NO: 3988437 - RNA, 13 nt, Human herpesvirus 6
uauuuccugccca

SEQ ID NO: 3988438 - RNA, 17 nt, Human herpesvirus 6
uauuucguauguuugga

SEQ ID NO: 3988439 - RNA, 20 nt, Human herpesvirus 6
uauuucugguuguguuaauc

SEQ ID NO: 3988440 - RNA, 14 nt, Human herpesvirus 6
ucaaaaaaauuccc

SEQ ID NO: 3988441 - RNA, 16 nt, Human herpesvirus 6
ucaaacugguguaaau

SEQ ID NO: 3988442 - RNA, 23 nt, Human herpesvirus 6
ucaacauuaaaaaaaauagcaga

SEQ ID NO: 3988443 - RNA, 17 nt, Human herpesvirus 6
ucaagguggagguuucu

SEQ ID NO: 3988444 - RNA, 19 nt, Human herpesvirus 6
ucaaugaaaaaaaaugaag

SEQ ID NO: 3988445 - RNA, 19 nt, Human herpesvirus 6
ucacaguuuuuuuuuucau

SEQ ID NO: 3988446 - RNA, 15 nt, Human herpesvirus 6
ucacauauaugaugc

SEQ ID NO: 3988447 - RNA, 23 nt, Human herpesvirus 6
ucacauguucuuuauuaaauguu

SEQ ID NO: 3988448 - RNA, 12 nt, Human herpesvirus 6
ucacggauggag

SEQ ID NO: 3988449 - RNA, 14 nt, Human herpesvirus 6
ucacucagauuuca

SEQ ID NO: 3988450 - RNA, 12 nt, Human herpesvirus 6
ucacugucuauu

SEQ ID NO: 3988451 - RNA, 13 nt, Human herpesvirus 6
ucagagaaacgga

SEQ ID NO: 3988452 - RNA, 22 nt, Human herpesvirus 6
ucagcgacucccggcccagaga

SEQ ID NO: 3988453 - RNA, 22 nt, Human herpesvirus 6
ucagucuucaauaaaaacucaa

SEQ ID NO: 3988454 - RNA, 18 nt, Human herpesvirus 6
ucaugagccagcgcaaga

SEQ ID NO: 3988455 - RNA, 23 nt, Human herpesvirus 6
ucaugaucucacgucacaguuuu

SEQ ID NO: 3988456 - RNA, 22 nt, Human herpesvirus 6
uccaacggccuuucuguuuuaa

SEQ ID NO: 3988457 - RNA, 17 nt, Human herpesvirus 6
uccaccuucccucccac

SEQ ID NO: 3988458 - RNA, 14 nt, Human herpesvirus 6
uccagacaauaauc

SEQ ID NO: 3988459 - RNA, 18 nt, Human herpesvirus 6
uccauaaguuaauuccag

SEQ ID NO: 3988460 - RNA, 13 nt, Human herpesvirus 6
uccauccucgaau

SEQ ID NO: 3988461 - RNA, 15 nt, Human herpesvirus 6
uccaugcgaguagau

SEQ ID NO: 3988462 - RNA, 16 nt, Human herpesvirus 6
uccaugucuucuuggg

SEQ ID NO: 3988463 - RNA, 13 nt, Human herpesvirus 6
uccccacaauaag

SEQ ID NO: 3988464 - RNA, 15 nt, Human herpesvirus 6
uccccagagaaaauu

SEQ ID NO: 3988465 - RNA, 22 nt, Human herpesvirus 6
uccccuuggcucgugauccuac

SEQ ID NO: 3988466 - RNA, 14 nt, Human herpesvirus 6
ucccuaauaaaugu

SEQ ID NO: 3988467 - RNA, 21 nt, Human herpesvirus 6
uccgccccgauaaaaacaagu

SEQ ID NO: 3988468 - RNA, 15 nt, Human herpesvirus 6
uccgcgggaccuggc

SEQ ID NO: 3988469 - RNA, 21 nt, Human herpesvirus 6
acauuauaaauuauuuuguga

SEQ ID NO: 3988470 - RNA, 14 nt, Human herpesvirus 6
acauuguagaaaga

SEQ ID NO: 3988471 - RNA, 19 nt, Human herpesvirus 6
acauuuugguuucccucag

SEQ ID NO: 3988472 - RNA, 19 nt, Human herpesvirus 6
accaccagucaggaaaaag

SEQ ID NO: 3988473 - RNA, 21 nt, Human herpesvirus 6
accaccggcuaacccuaaccc

SEQ ID NO: 3988474 - RNA, 21 nt, Human herpesvirus 6
accagcauguuuucuccucaa

SEQ ID NO: 3988475 - RNA, 21 nt, Human herpesvirus 6
aaaucgcgucguucguuguau

SEQ ID NO: 3988476 - RNA, 12 nt, Human herpesvirus 6
aaaucuggcaac

SEQ ID NO: 3988477 - RNA, 18 nt, Human herpesvirus 6
aaaugaugaguaauacau

SEQ ID NO: 3988478 - RNA, 11 nt, Human herpesvirus 6
aaauggcucag

SEQ ID NO: 3988479 - RNA, 19 nt, Human herpesvirus 6
aaaugucaaagaaacagua

SEQ ID NO: 3988480 - RNA, 19 nt, Human herpesvirus 6
aaauuacaagguacacaau

SEQ ID NO: 3988481 - RNA, 16 nt, Human herpesvirus 6
aaauuguuuuacaaau

SEQ ID NO: 3988482 - RNA, 15 nt, Human herpesvirus 6
aacaaauggaaacug

SEQ ID NO: 3988483 - RNA, 13 nt, Human herpesvirus 6
aacaacaauaaca

SEQ ID NO: 3988484 - RNA, 22 nt, Human herpesvirus 6
aacaacaucuuaaaagaccacu

SEQ ID NO: 3988485 - RNA, 15 nt, Human herpesvirus 6
aacaaccacaaacau

SEQ ID NO: 3988486 - RNA, 15 nt, Human herpesvirus 6
aacaauccauguuca

SEQ ID NO: 3988487 - RNA, 17 nt, Human herpesvirus 6
aacacacaucauauccu

SEQ ID NO: 3988488 - RNA, 22 nt, Human herpesvirus 6
aacaccaauaaaauuuuuugca

SEQ ID NO: 3988489 - RNA, 18 nt, Human herpesvirus 6
aacacgaagacgaagagg

SEQ ID NO: 3988490 - RNA, 14 nt, Human herpesvirus 6
aacacgcuguugcu

SEQ ID NO: 3988491 - RNA, 22 nt, Human herpesvirus 6
aacaggauucccuucagacauc

SEQ ID NO: 3988492 - RNA, 17 nt, Human herpesvirus 6
aacaguuauacuggcaa

SEQ ID NO: 3988493 - RNA, 15 nt, Human herpesvirus 6
aacaucugcuaacgc

SEQ ID NO: 3988494 - RNA, 16 nt, Human herpesvirus 6
aaccaaguguuuuaug

SEQ ID NO: 3988495 - RNA, 17 nt, Human herpesvirus 6
aacccuaacccuaaccc

SEQ ID NO: 3988496 - RNA, 23 nt, Human herpesvirus 6
aaccgcaguuccuguuuuucuca

SEQ ID NO: 3988497 - RNA, 22 nt, Human herpesvirus 6
aaccgccgugcuucuggcacag

SEQ ID NO: 3988498 - RNA, 18 nt, Human herpesvirus 6
aaccucauuaugaauaac

SEQ ID NO: 3988499 - RNA, 15 nt, Human herpesvirus 6
aaccuuauacagaug

SEQ ID NO: 3988500 - RNA, 17 nt, Human herpesvirus 6
aaccuuuaacuuuuugc

SEQ ID NO: 3988501 - RNA, 23 nt, Human herpesvirus 6
aacgacuaccacaucaccgauaa

SEQ ID NO: 3988502 - RNA, 14 nt, Human herpesvirus 6
aacgauaugucucu

SEQ ID NO: 3988503 - RNA, 21 nt, Human herpesvirus 6
aacggcgguaacguggauaaa

SEQ ID NO: 3988504 - RNA, 15 nt, Human herpesvirus 6
aacggcuucaagaau

SEQ ID NO: 3988505 - RNA, 23 nt, Human herpesvirus 6
aacugguguaaauacccuggggu

SEQ ID NO: 3988506 - RNA, 16 nt, Human herpesvirus 6
aacuuacuaaugugga

SEQ ID NO: 3988507 - RNA, 12 nt, Human herpesvirus 6
aacuuuuaacuu

SEQ ID NO: 3988508 - RNA, 14 nt, Human herpesvirus 6
aagaauuauuuauc

SEQ ID NO: 3988509 - RNA, 18 nt, Human herpesvirus 6
aagacucagcgacucccg

SEQ ID NO: 3988510 - RNA, 22 nt, Human herpesvirus 6
aagauccaaucacaacaaaaau

SEQ ID NO: 3988511 - RNA, 12 nt, Human herpesvirus 6
aagauuaaaugu

SEQ ID NO: 3988512 - RNA, 21 nt, Human herpesvirus 6
aagauuguguuucugucuuua

SEQ ID NO: 3988513 - RNA, 22 nt, Human herpesvirus 6
aagcaaaaacagauuaaauaua

SEQ ID NO: 3988514 - RNA, 15 nt, Human herpesvirus 6
aagcaaguuccauuu

SEQ ID NO: 3988515 - RNA, 14 nt, Human herpesvirus 6
aagcacaaaaccag

SEQ ID NO: 3988516 - RNA, 13 nt, Human herpesvirus 6
aagcgccugccua

SEQ ID NO: 3988517 - RNA, 18 nt, Human herpesvirus 6
aaggaaagacaugcauuu

SEQ ID NO: 3988518 - RNA, 15 nt, Human herpesvirus 6
aaggacuaucugaga

SEQ ID NO: 3988519 - RNA, 24 nt, Human herpesvirus 6
aagggcuuuucaagaucugccauc

SEQ ID NO: 3988520 - RNA, 13 nt, Human herpesvirus 6
aaggucagugggu

SEQ ID NO: 3988521 - RNA, 19 nt, Human herpesvirus 6
aagguguuaaacgaaaacu

SEQ ID NO: 3988522 - RNA, 12 nt, Human herpesvirus 6
aaguauguacaa

SEQ ID NO: 3988523 - RNA, 19 nt, Human herpesvirus 6
aaguuggggucucaugacu

SEQ ID NO: 3988524 - RNA, 13 nt, Human herpesvirus 6
aaguuucacauau

SEQ ID NO: 3988525 - RNA, 14 nt, Human herpesvirus 6
aauaaaaaauucuu

SEQ ID NO: 3988526 - RNA, 19 nt, Human herpesvirus 6
aauaaacuuuuuuggcucg

SEQ ID NO: 3988527 - RNA, 13 nt, Human herpesvirus 6
aauaaaggucagu

SEQ ID NO: 3988528 - RNA, 19 nt, Human herpesvirus 6
aauaaugcccagaugugga

SEQ ID NO: 3988529 - RNA, 16 nt, Human herpesvirus 6
aauaauggcaugcauu

SEQ ID NO: 3988530 - RNA, 14 nt, Human herpesvirus 6
aauauaucuugaaa

SEQ ID NO: 3988531 - RNA, 18 nt, Human herpesvirus 6
aauauauuuauugaaaga

SEQ ID NO: 3988532 - RNA, 13 nt, Human herpesvirus 6
aauauuuccugcc

SEQ ID NO: 3988533 - RNA, 14 nt, Human herpesvirus 6
aauauuuccugccc

SEQ ID NO: 3988534 - RNA, 15 nt, Human herpesvirus 6
aauauuuugaaaagg

SEQ ID NO: 3988535 - RNA, 16 nt, Human herpesvirus 6
aaucaaaaaaaugaua

SEQ ID NO: 3988536 - RNA, 12 nt, Human herpesvirus 6
aaucacaaauau

SEQ ID NO: 3988537 - RNA, 12 nt, Human herpesvirus 6
aaucaugagagc

SEQ ID NO: 3988538 - RNA, 16 nt, Human herpesvirus 6
aaucauggugucuuug

SEQ ID NO: 3988539 - RNA, 20 nt, Human herpesvirus 6
aaucauuagcauacagaugu

SEQ ID NO: 3988540 - RNA, 20 nt, Human herpesvirus 6
aaucucgccgaacuagaaaa

SEQ ID NO: 3988541 - RNA, 23 nt, Human herpesvirus 6
aaucuuauucaaaaauguugcau

SEQ ID NO: 3988542 - RNA, 23 nt, Human herpesvirus 6
aauggaguaaauuaaaguuuacu

SEQ ID NO: 3988543 - RNA, 19 nt, Human herpesvirus 6
aauguaaacacgaaauugc

SEQ ID NO: 3988544 - RNA, 23 nt, Human herpesvirus 6
aauguaacugguucagaauuugu

SEQ ID NO: 3988545 - RNA, 17 nt, Human herpesvirus 6
aauguccgcaaguaaaa

SEQ ID NO: 3988546 - RNA, 16 nt, Human herpesvirus 6
aauguguucacagagc

SEQ ID NO: 3988547 - RNA, 19 nt, Human herpesvirus 6
aauguugaaguauguacaa

SEQ ID NO: 3988548 - RNA, 12 nt, Human herpesvirus 6
aauuaauacaaa

SEQ ID NO: 3988549 - RNA, 18 nt, Human herpesvirus 6
aauuacaagguacacaau

SEQ ID NO: 3988550 - RNA, 15 nt, Human herpesvirus 6
aauuacauuaaaaca

SEQ ID NO: 3988551 - RNA, 14 nt, Human herpesvirus 6
aauuauagcgauaa

SEQ ID NO: 3988552 - RNA, 22 nt, Human herpesvirus 6
aauuaucacaguugauaaacau

SEQ ID NO: 3988553 - RNA, 15 nt, Human herpesvirus 6
aauucuuaccaagaa

SEQ ID NO: 3988554 - RNA, 14 nt, Human herpesvirus 6
aauuguauucuuga

SEQ ID NO: 3988555 - RNA, 16 nt, Human herpesvirus 6
aauuucuacaaaaaua

SEQ ID NO: 3988556 - RNA, 13 nt, Human herpesvirus 6
aauuuuaaaaaga

SEQ ID NO: 3988557 - RNA, 15 nt, Human herpesvirus 6
aauuuuccaaacauu

SEQ ID NO: 3988558 - RNA, 16 nt, Human herpesvirus 6
aauuuuuuauuucuga

SEQ ID NO: 3988559 - RNA, 21 nt, Human herpesvirus 6
acaaauaaaaaauucuugaau

SEQ ID NO: 3988560 - RNA, 15 nt, Human herpesvirus 6
acaaauuuuuaacua

SEQ ID NO: 3988561 - RNA, 15 nt, Human herpesvirus 6
acaacaaguaaauuc

SEQ ID NO: 3988562 - RNA, 23 nt, Human herpesvirus 6
acaaccuccgcauaucgccccca

SEQ ID NO: 3988563 - RNA, 15 nt, Human herpesvirus 6
acaacgcuccauaac

SEQ ID NO: 3988564 - RNA, 18 nt, Human herpesvirus 6
acaacgguguggagacac

SEQ ID NO: 3988565 - RNA, 16 nt, Human herpesvirus 6
acaagguucgucgaga

SEQ ID NO: 3988566 - RNA, 14 nt, Human herpesvirus 6
acaauauuucacau

SEQ ID NO: 3988567 - RNA, 22 nt, Human herpesvirus 6
acaaucagccugcucagagcug

SEQ ID NO: 3988568 - RNA, 21 nt, Human herpesvirus 6
acaaugcagaacaacagcaug

SEQ ID NO: 3988569 - RNA, 13 nt, Human herpesvirus 6
acaccucaggguc

SEQ ID NO: 3988570 - RNA, 21 nt, Human herpesvirus 6
acagacuccccaccgagaucc

SEQ ID NO: 3988571 - RNA, 17 nt, Human herpesvirus 6
acagauuaaauauaccu

SEQ ID NO: 3988572 - RNA, 22 nt, Human herpesvirus 6
acagcacuuugcgcccauaccu

SEQ ID NO: 3988573 - RNA, 16 nt, Human herpesvirus 6
acagcagcagcauuaa

SEQ ID NO: 3988574 - RNA, 14 nt, Human herpesvirus 6
acaguaaaaugugu

SEQ ID NO: 3988575 - RNA, 22 nt, Human herpesvirus 6
acagucacacacagggugcuua

SEQ ID NO: 3988576 - RNA, 16 nt, Human herpesvirus 6
acagugauuagaaugu

SEQ ID NO: 3988577 - RNA, 16 nt, Human herpesvirus 6
acauaguggcuaugaa

SEQ ID NO: 3988578 - RNA, 20 nt, Human herpesvirus 6
acauauaaauccgauagcca

SEQ ID NO: 3988579 - RNA, 23 nt, Human herpesvirus 6
acaucaacuauuuaacauccaaa

SEQ ID NO: 3988580 - RNA, 19 nt, Human herpesvirus 6
acauccagaaaagcaaaca

SEQ ID NO: 3988581 - RNA, 15 nt, Human herpesvirus 6
acauggugaaagacu

SEQ ID NO: 3988582 - RNA, 13 nt, Human herpesvirus 6
acauguuaacaau

SEQ ID NO: 3988583 - RNA, 20 nt, Human herpesvirus 6
acauguucuuuauuaaaugu

SEQ ID NO: 3988584 - RNA, 17 nt, Human herpesvirus 6
guuuuuuucguauaaau

SEQ ID NO: 3988585 - RNA, 15 nt, Human herpesvirus 6
uaaaaacucacacaa

SEQ ID NO: 3988586 - RNA, 20 nt, Human herpesvirus 6
uaaaaagaaugggauuguga

SEQ ID NO: 3988587 - RNA, 23 nt, Human herpesvirus 6
uaaaagacguuugcuguuuucac

SEQ ID NO: 3988588 - RNA, 17 nt, Human herpesvirus 6
uaaaauguguagugguc

SEQ ID NO: 3988589 - RNA, 19 nt, Human herpesvirus 6
uaaaauuaugccacaccca

SEQ ID NO: 3988590 - RNA, 18 nt, Human herpesvirus 6
uaaaauuucgauguggag

SEQ ID NO: 3988591 - RNA, 17 nt, Human herpesvirus 6
uaaacaugauuguaaua

SEQ ID NO: 3988592 - RNA, 12 nt, Human herpesvirus 6
uaaagcagcuag

SEQ ID NO: 3988593 - RNA, 16 nt, Human herpesvirus 6
uaaaggucagugggua

SEQ ID NO: 3988594 - RNA, 19 nt, Human herpesvirus 6
uaaaguuuugugauccugu

SEQ ID NO: 3988595 - RNA, 15 nt, Human herpesvirus 6
uaaauacauucacau

SEQ ID NO: 3988596 - RNA, 17 nt, Human herpesvirus 6
uaaauauaucaaagaug

SEQ ID NO: 3988597 - RNA, 22 nt, Human herpesvirus 6
uaaauauguugaaucuuauuca

SEQ ID NO: 3988598 - RNA, 16 nt, Human herpesvirus 6
uaaaucugagguuucc

SEQ ID NO: 3988599 - RNA, 20 nt, Human herpesvirus 6
uaaaugaauguguucacaga

SEQ ID NO: 3988600 - RNA, 12 nt, Human herpesvirus 6
uaacaacaacaa

SEQ ID NO: 3988601 - RNA, 18 nt, Human herpesvirus 6
uaaccagauguguacaac

SEQ ID NO: 3988602 - RNA, 15 nt, Human herpesvirus 6
uaacccuaacccuaa

SEQ ID NO: 3988603 - RNA, 18 nt, Human herpesvirus 6
uaacccuaacccuaaccc

SEQ ID NO: 3988604 - RNA, 18 nt, Human herpesvirus 6
uaacgacuucgacuucaa

SEQ ID NO: 3988605 - RNA, 22 nt, Human herpesvirus 6
uaacgcaacucuaccuggaaac

SEQ ID NO: 3988606 - RNA, 17 nt, Human herpesvirus 6
uaacgcggcaaccgcag

SEQ ID NO: 3988607 - RNA, 19 nt, Human herpesvirus 6
uaacucuuuuuguugcuau

SEQ ID NO: 3988608 - RNA, 19 nt, Human herpesvirus 6
uaacuguaaaaagugcuuu

SEQ ID NO: 3988609 - RNA, 14 nt, Human herpesvirus 6
uaacuuauguuucu

SEQ ID NO: 3988610 - RNA, 20 nt, Human herpesvirus 6
uaacuuuuuguauuauguaa

SEQ ID NO: 3988611 - RNA, 15 nt, Human herpesvirus 6
uaagagugcaacaaa

SEQ ID NO: 3988612 - RNA, 17 nt, Human herpesvirus 6
uaagauaggcaaaccau

SEQ ID NO: 3988613 - RNA, 19 nt, Human herpesvirus 6
uaaguggguacaaugaaaa

SEQ ID NO: 3988614 - RNA, 16 nt, Human herpesvirus 6
uaaucaucccaauaaa

SEQ ID NO: 3988615 - RNA, 23 nt, Human herpesvirus 6
uaaucgcgguccaacacagcaug

SEQ ID NO: 3988616 - RNA, 18 nt, Human herpesvirus 6
uaaucguuacaaaauuga

SEQ ID NO: 3988617 - RNA, 20 nt, Human herpesvirus 6
uaauuacauauagucaaugu

SEQ ID NO: 3988618 - RNA, 19 nt, Human herpesvirus 6
uaauuaugcauuucuuggu

SEQ ID NO: 3988619 - RNA, 13 nt, Human herpesvirus 6
uaauucuuaaagc

SEQ ID NO: 3988620 - RNA, 13 nt, Human herpesvirus 6
uacaacaauaaaa

SEQ ID NO: 3988621 - RNA, 16 nt, Human herpesvirus 6
uacaacugaaacuuca

SEQ ID NO: 3988622 - RNA, 22 nt, Human herpesvirus 6
uacaagaaaagaaacaaugcuu

SEQ ID NO: 3988623 - RNA, 15 nt, Human herpesvirus 6
uacaaucaugugcau

SEQ ID NO: 3988624 - RNA, 17 nt, Human herpesvirus 6
uacacgaaaaacauuuc

SEQ ID NO: 3988625 - RNA, 14 nt, Human herpesvirus 6
uacacuuuaucgau

SEQ ID NO: 3988626 - RNA, 20 nt, Human herpesvirus 6
uacauguuuguugugaucuu

SEQ ID NO: 3988627 - RNA, 18 nt, Human herpesvirus 6
uacauuuauaauuaaaau

SEQ ID NO: 3988628 - RNA, 15 nt, Human herpesvirus 6
uacauuuucaaauuu

SEQ ID NO: 3988629 - RNA, 23 nt, Human herpesvirus 6
uaccacaucaccgauaaaaacuc

SEQ ID NO: 3988630 - RNA, 22 nt, Human herpesvirus 6
uaccacggggauuuaguacagu

SEQ ID NO: 3988631 - RNA, 19 nt, Human herpesvirus 6
uaccgcgguuggggucuuu

SEQ ID NO: 3988632 - RNA, 20 nt, Human herpesvirus 6
uaccgcgguuuggggucuuu

SEQ ID NO: 3988633 - RNA, 19 nt, Human herpesvirus 6
uaccgugucuuuaaugggu

SEQ ID NO: 3988634 - RNA, 16 nt, Human herpesvirus 6
uaccuauuuacaaugu

SEQ ID NO: 3988635 - RNA, 16 nt, Human herpesvirus 6
uacgaaauaaucgauu

SEQ ID NO: 3988636 - RNA, 16 nt, Human herpesvirus 6
uacgaacagaaauuuc

SEQ ID NO: 3988637 - RNA, 17 nt, Human herpesvirus 6
uacgacgaaaacuuuua

SEQ ID NO: 3988638 - RNA, 16 nt, Human herpesvirus 6
uacgccaguguggaua

SEQ ID NO: 3988639 - RNA, 23 nt, Human herpesvirus 6
uacggggaagaucuaugggagug

SEQ ID NO: 3988640 - RNA, 18 nt, Human herpesvirus 6
uacguuuuguguuaaaau

SEQ ID NO: 3988641 - RNA, 13 nt, Human herpesvirus 6
uacuaauguggau

SEQ ID NO: 3988642 - RNA, 13 nt, Human herpesvirus 6
uacuacacaaacg

SEQ ID NO: 3988643 - RNA, 11 nt, Human herpesvirus 6
uacuacaguga

SEQ ID NO: 3988644 - RNA, 16 nt, Human herpesvirus 6
uacuaguuuucacacg

SEQ ID NO: 3988645 - RNA, 23 nt, Human herpesvirus 6
uacuauauaugcaagccaugaca

SEQ ID NO: 3988646 - RNA, 14 nt, Human herpesvirus 6
uacuuucaugauuc

SEQ ID NO: 3988647 - RNA, 16 nt, Human herpesvirus 6
uagaaauuacaaggua

SEQ ID NO: 3988648 - RNA, 23 nt, Human herpesvirus 6
uagacacgcuaaaaacagacgaa

SEQ ID NO: 3988649 - RNA, 16 nt, Human herpesvirus 6
uagauggaaaauugca

SEQ ID NO: 3988650 - RNA, 14 nt, Human herpesvirus 6
uagcauacgacaaa

SEQ ID NO: 3988651 - RNA, 23 nt, Human herpesvirus 6
uagcgaaugaauuuacuguuuua

SEQ ID NO: 3988652 - RNA, 20 nt, Human herpesvirus 6
uagcguucauucccaguguc

SEQ ID NO: 3988653 - RNA, 15 nt, Human herpesvirus 6
uaggaaguaaauaca

SEQ ID NO: 3988654 - RNA, 19 nt, Human herpesvirus 6
uaggauuacacuuucuugu

SEQ ID NO: 3988655 - RNA, 15 nt, Human herpesvirus 6
uauaaaaaacuaaaa

SEQ ID NO: 3988656 - RNA, 20 nt, Human herpesvirus 6
uauaucaaacuuuuuuugaa

SEQ ID NO: 3988657 - RNA, 20 nt, Human herpesvirus 6
uauauucguggauaacgucg

SEQ ID NO: 3988658 - RNA, 19 nt, Human herpesvirus 6
uauauuuuuaccgaaccau

SEQ ID NO: 3988659 - RNA, 18 nt, Human herpesvirus 6
uaucaaacuuuuuuugaa

SEQ ID NO: 3988660 - RNA, 13 nt, Human herpesvirus 6
uaucaccuuacaa

SEQ ID NO: 3988661 - RNA, 15 nt, Human herpesvirus 6
uaucauagacaaacc

SEQ ID NO: 3988662 - RNA, 18 nt, Human herpesvirus 6
uaucccuaauaaauguca

SEQ ID NO: 3988663 - RNA, 21 nt, Human herpesvirus 6
uaucgccccugucugugauuu

SEQ ID NO: 3988664 - RNA, 15 nt, Human herpesvirus 6
uaugaaugagauguu

SEQ ID NO: 3988665 - RNA, 21 nt, Human herpesvirus 6
uaugacgggcagguuaucgga

SEQ ID NO: 3988666 - RNA, 18 nt, Human herpesvirus 6
uaugacuguguguugaau

SEQ ID NO: 3988667 - RNA, 22 nt, Human herpesvirus 6
uauggaaacacuuucuucgccu

SEQ ID NO: 3988668 - RNA, 18 nt, Human herpesvirus 6
uauuaacgcagcaacaau

SEQ ID NO: 3988669 - RNA, 20 nt, Human herpesvirus 6
uauuguguaacucuuuuugu

SEQ ID NO: 3988670 - RNA, 20 nt, Human herpesvirus 6
uauuguguguacaaugacug

SEQ ID NO: 3988671 - RNA, 22 nt, Human herpesvirus 6
uauuuuaagcgugacuuauaua

SEQ ID NO: 3988672 - RNA, 15 nt, Human herpesvirus 6
uauuuuuuauuucca

SEQ ID NO: 3988673 - RNA, 12 nt, Human herpesvirus 6
ucaaagaaaguu

SEQ ID NO: 3988674 - RNA, 14 nt, Human herpesvirus 6
ucaaauauggcaga

SEQ ID NO: 3988675 - RNA, 12 nt, Human herpesvirus 6
ucaaauccucua

SEQ ID NO: 3988676 - RNA, 19 nt, Human herpesvirus 6
ucaagacuacucuggcuga

SEQ ID NO: 3988677 - RNA, 14 nt, Human herpesvirus 6
ucaagcacaaaacc

SEQ ID NO: 3988678 - RNA, 19 nt, Human herpesvirus 6
ucaaugcggguacuauaga

SEQ ID NO: 3988679 - RNA, 14 nt, Human herpesvirus 6
ucaauugucacuuu

SEQ ID NO: 3988680 - RNA, 21 nt, Human herpesvirus 6
ucacaaaguuuaaguuuucac

SEQ ID NO: 3988681 - RNA, 16 nt, Human herpesvirus 6
ucacaaggaaugugca

SEQ ID NO: 3988682 - RNA, 17 nt, Human herpesvirus 6
ucacaauauuucacaua

SEQ ID NO: 3988683 - RNA, 18 nt, Human herpesvirus 6
ucaccgauaaaaacucac

SEQ ID NO: 3988684 - RNA, 17 nt, Human herpesvirus 6
ucacgaucuacacaccg

SEQ ID NO: 3988685 - RNA, 15 nt, Human herpesvirus 6
ucacucagauuucag

SEQ ID NO: 3988686 - RNA, 18 nt, Human herpesvirus 6
ucacugucgaaauucacc

SEQ ID NO: 3988687 - RNA, 20 nt, Human herpesvirus 6
ucacugucgaaauucaccag

SEQ ID NO: 3988688 - RNA, 16 nt, Human herpesvirus 6
ucagguuuagaugcuu

SEQ ID NO: 3988689 - RNA, 23 nt, Human herpesvirus 6
ucagucaauuuuacuaaaaaagc

SEQ ID NO: 3988690 - RNA, 22 nt, Human herpesvirus 6
ucauaaagauaaagaucagugg

SEQ ID NO: 3988691 - RNA, 22 nt, Human herpesvirus 6
ucauaaccucaucgcgacuaaa

SEQ ID NO: 3988692 - RNA, 13 nt, Human herpesvirus 6
ucaugucggccuc

SEQ ID NO: 3988693 - RNA, 19 nt, Human herpesvirus 6
ucauuuuuuugauuuacaa

SEQ ID NO: 3988694 - RNA, 20 nt, Human herpesvirus 6
uccaauccaauauaacuuua

SEQ ID NO: 3988695 - RNA, 22 nt, Human herpesvirus 6
uccacucggauucaaagaaagu

SEQ ID NO: 3988696 - RNA, 18 nt, Human herpesvirus 6
uccaugcaacacaacaaa

SEQ ID NO: 3988697 - RNA, 14 nt, Human herpesvirus 6
uccccacaauaaga

SEQ ID NO: 3988698 - RNA, 17 nt, Human herpesvirus 6
ugugaaaguauuuuacu

SEQ ID NO: 3988699 - RNA, 17 nt, Human herpesvirus 6
ugugacaaaucuguaag

SEQ ID NO: 3988700 - RNA, 12 nt, Human herpesvirus 6
ugugauaugcaa

SEQ ID NO: 3988701 - RNA, 19 nt, Human herpesvirus 6
ugugccguuuaugcgaauc

SEQ ID NO: 3988702 - RNA, 15 nt, Human herpesvirus 6
ugugcuaucugauuu

SEQ ID NO: 3988703 - RNA, 13 nt, Human herpesvirus 6
uguggaaaaacug

SEQ ID NO: 3988704 - RNA, 15 nt, Human herpesvirus 6
uguguauuauguaaa

SEQ ID NO: 3988705 - RNA, 19 nt, Human herpesvirus 6
uguuaacauaaaacaacaa

SEQ ID NO: 3988706 - RNA, 17 nt, Human herpesvirus 6
uguuaaccaguagacaa

SEQ ID NO: 3988707 - RNA, 16 nt, Human herpesvirus 6
uguuagaucacguuca

SEQ ID NO: 3988708 - RNA, 18 nt, Human herpesvirus 6
uguuauaacacaacaagu

SEQ ID NO: 3988709 - RNA, 13 nt, Human herpesvirus 6
uguuguguuugag

SEQ ID NO: 3988710 - RNA, 20 nt, Human herpesvirus 6
uguuucuaacagaggguuua

SEQ ID NO: 3988711 - RNA, 18 nt, Human herpesvirus 6
uguuuuauguauuaauuu

SEQ ID NO: 3988712 - RNA, 21 nt, Human herpesvirus 6
uguuuuauguuaacaucguga

SEQ ID NO: 3988713 - RNA, 18 nt, Human herpesvirus 6
uuaaaacaauggaaaagg

SEQ ID NO: 3988714 - RNA, 16 nt, Human herpesvirus 6
uuaaagaaucugcaga

SEQ ID NO: 3988715 - RNA, 23 nt, Human herpesvirus 6
uuaaagaguuuucucacacccau

SEQ ID NO: 3988716 - RNA, 23 nt, Human herpesvirus 6
uuaaagcagcuagagaaauugga

SEQ ID NO: 3988717 - RNA, 11 nt, Human herpesvirus 6
uuaaggcauug

SEQ ID NO: 3988718 - RNA, 13 nt, Human herpesvirus 6
uuaauccacugca

SEQ ID NO: 3988719 - RNA, 20 nt, Human herpesvirus 6
uuaauuccaagacauguaca

SEQ ID NO: 3988720 - RNA, 23 nt, Human herpesvirus 6
uuaauuuaucgcagcaucauguu

SEQ ID NO: 3988721 - RNA, 15 nt, Human herpesvirus 6
uuacaagguacacaa

SEQ ID NO: 3988722 - RNA, 17 nt, Human herpesvirus 6
uuacaagguacacaaua

SEQ ID NO: 3988723 - RNA, 23 nt, Human herpesvirus 6
uuacaauguucaauuacucaaca

SEQ ID NO: 3988724 - RNA, 17 nt, Human herpesvirus 6
uuacugacgguuagguu

SEQ ID NO: 3988725 - RNA, 18 nt, Human herpesvirus 6
uuacuguuuuaaccgaua

SEQ ID NO: 3988726 - RNA, 19 nt, Human herpesvirus 6
uuagccuuuauucuguuuu

SEQ ID NO: 3988727 - RNA, 21 nt, Human herpesvirus 6
uuaguaugggugagugcauua

SEQ ID NO: 3988728 - RNA, 11 nt, Human herpesvirus 6
uuagucaguuu

SEQ ID NO: 3988729 - RNA, 21 nt, Human herpesvirus 6
uuagucuauccaugaaacucu

SEQ ID NO: 3988730 - RNA, 22 nt, Human herpesvirus 6
uuauaacaagcacugaauuaga

SEQ ID NO: 3988731 - RNA, 17 nt, Human herpesvirus 6
uuauacgaaaauaaaaa

SEQ ID NO: 3988732 - RNA, 13 nt, Human herpesvirus 6
uuaugauuucgga

SEQ ID NO: 3988733 - RNA, 17 nt, Human herpesvirus 6
uuaugcgacugcaagag

SEQ ID NO: 3988734 - RNA, 13 nt, Human herpesvirus 6
uuauuaaauguua

SEQ ID NO: 3988735 - RNA, 21 nt, Human herpesvirus 6
uuauucggaguuuucaagaug

SEQ ID NO: 3988736 - RNA, 15 nt, Human herpesvirus 6
uucaacgucuucaaa

SEQ ID NO: 3988737 - RNA, 15 nt, Human herpesvirus 6
uucaaugcguuucuu

SEQ ID NO: 3988738 - RNA, 16 nt, Human herpesvirus 6
uucaaugcguuucuuc

SEQ ID NO: 3988739 - RNA, 23 nt, Human herpesvirus 6
uucacaguccccacccucuuuuu

SEQ ID NO: 3988740 - RNA, 12 nt, Human herpesvirus 6
uucagaggugcu

SEQ ID NO: 3988741 - RNA, 12 nt, Human herpesvirus 6
uucagagugaau

SEQ ID NO: 3988742 - RNA, 15 nt, Human herpesvirus 6
uucagagugaauucc

SEQ ID NO: 3988743 - RNA, 19 nt, Human herpesvirus 6
uucagccugagaacgggca

SEQ ID NO: 3988744 - RNA, 16 nt, Human herpesvirus 6
uucaggaugaagaaaa

SEQ ID NO: 3988745 - RNA, 22 nt, Human herpesvirus 6
uucaggcggaauguuuguuuuu

SEQ ID NO: 3988746 - RNA, 17 nt, Human herpesvirus 6
uucauaugaaaagcugg

SEQ ID NO: 3988747 - RNA, 19 nt, Human herpesvirus 6
uucaugcgcuucuguuuug

SEQ ID NO: 3988748 - RNA, 13 nt, Human herpesvirus 6
uucauuucaucuu

SEQ ID NO: 3988749 - RNA, 24 nt, Human herpesvirus 6
uuccacgaguggaucgaaugcuag

SEQ ID NO: 3988750 - RNA, 23 nt, Human herpesvirus 6
uuccaguuaauaagauguugcaa

SEQ ID NO: 3988751 - RNA, 20 nt, Human herpesvirus 6
uucgacaacggaccaggaca

SEQ ID NO: 3988752 - RNA, 12 nt, Human herpesvirus 6
uucgacagacga

SEQ ID NO: 3988753 - RNA, 18 nt, Human herpesvirus 6
uucggagugcguccguuu

SEQ ID NO: 3988754 - RNA, 23 nt, Human herpesvirus 6
uucggcagaugcgcuauuguacc

SEQ ID NO: 3988755 - RNA, 14 nt, Human herpesvirus 6
uucggccgacagca

SEQ ID NO: 3988756 - RNA, 22 nt, Human herpesvirus 6
uucuaccguagaccguuucuua

SEQ ID NO: 3988757 - RNA, 19 nt, Human herpesvirus 6
uucuuacaauguuuuugac

SEQ ID NO: 3988758 - RNA, 16 nt, Human herpesvirus 6
uucuuuauuaaauguu

SEQ ID NO: 3988759 - RNA, 20 nt, Human herpesvirus 6
uucuuuggagaugauuccaa

SEQ ID NO: 3988760 - RNA, 15 nt, Human herpesvirus 6
uucuuuuuaacuagg

SEQ ID NO: 3988761 - RNA, 17 nt, Human herpesvirus 6
uugaaaaaccuuauaca

SEQ ID NO: 3988762 - RNA, 22 nt, Human herpesvirus 6
uugaaaagguguuguguuugag

SEQ ID NO: 3988763 - RNA, 20 nt, Human herpesvirus 6
uugacauaggaauucuuauu

SEQ ID NO: 3988764 - RNA, 20 nt, Human herpesvirus 6
uugaucaaauaucugaaaca

SEQ ID NO: 3988765 - RNA, 19 nt, Human herpesvirus 6
uugcagaucuaauucacau

SEQ ID NO: 3988766 - RNA, 20 nt, Human herpesvirus 6
uugcauauuauuaacaauga

SEQ ID NO: 3988767 - RNA, 24 nt, Human herpesvirus 6
uugcauuuuggguugaguaugcuu

SEQ ID NO: 3988768 - RNA, 18 nt, Human herpesvirus 6
uugccgggaugagcuuua

SEQ ID NO: 3988769 - RNA, 15 nt, Human herpesvirus 6
uugccgucacacucu

SEQ ID NO: 3988770 - RNA, 14 nt, Human herpesvirus 6
uugccuuguaaauc

SEQ ID NO: 3988771 - RNA, 13 nt, Human herpesvirus 6
uuggaauauauaa

SEQ ID NO: 3988772 - RNA, 13 nt, Human herpesvirus 6
uugguuguguaua

SEQ ID NO: 3988773 - RNA, 16 nt, Human herpesvirus 6
uuguacaaacuuuuug

SEQ ID NO: 3988774 - RNA, 22 nt, Human herpesvirus 6
uugucauuacgaagcuucgcaa

SEQ ID NO: 3988775 - RNA, 16 nt, Human herpesvirus 6
uuguccaacacuuuua

SEQ ID NO: 3988776 - RNA, 22 nt, Human herpesvirus 6
uugucugauauggcaaauuuua

SEQ ID NO: 3988777 - RNA, 16 nt, Human herpesvirus 6
uugugauucugcauuu

SEQ ID NO: 3988778 - RNA, 16 nt, Human herpesvirus 6
uugugcgucagcuuug

SEQ ID NO: 3988779 - RNA, 19 nt, Human herpesvirus 6
uuguguuaaucggaauguc

SEQ ID NO: 3988780 - RNA, 16 nt, Human herpesvirus 6
uuguguuguuguauau

SEQ ID NO: 3988781 - RNA, 15 nt, Human herpesvirus 6
uuguguuucugucuu

SEQ ID NO: 3988782 - RNA, 20 nt, Human herpesvirus 6
uuguugcuauagauuagaaa

SEQ ID NO: 3988783 - RNA, 23 nt, Human herpesvirus 6
uuguugucucuuuauaaacuuaa

SEQ ID NO: 3988784 - RNA, 23 nt, Human herpesvirus 6
uuuaaaauggauuagugaaaaga

SEQ ID NO: 3988785 - RNA, 18 nt, Human herpesvirus 6
uuuaaaugaagauaaaag

SEQ ID NO: 3988786 - RNA, 15 nt, Human herpesvirus 6
uuuaauaaggaaaaa

SEQ ID NO: 3988787 - RNA, 16 nt, Human herpesvirus 6
uuuaauaguuugccau

SEQ ID NO: 3988788 - RNA, 17 nt, Human herpesvirus 6
uuuaccuuuggaaaaua

SEQ ID NO: 3988789 - RNA, 17 nt, Human herpesvirus 6
uuuagaaacauuugcug

SEQ ID NO: 3988790 - RNA, 22 nt, Human herpesvirus 6
uuuagccuauuaagcagccgcg

SEQ ID NO: 3988791 - RNA, 12 nt, Human herpesvirus 6
uuuauaaugagu

SEQ ID NO: 3988792 - RNA, 22 nt, Human herpesvirus 6
uuuaucccccguacaagcuuaa

SEQ ID NO: 3988793 - RNA, 19 nt, Human herpesvirus 6
uuuauuuucguauaaaaug

SEQ ID NO: 3988794 - RNA, 22 nt, Human herpesvirus 6
uuucaguauuaacuaguugcuu

SEQ ID NO: 3988795 - RNA, 23 nt, Human herpesvirus 6
uuuccuacccaggcgaacgagaa

SEQ ID NO: 3988796 - RNA, 15 nt, Human herpesvirus 6
uuuccugcacaggcg

SEQ ID NO: 3988797 - RNA, 16 nt, Human herpesvirus 6
uuuccugcacaggcga

SEQ ID NO: 3988798 - RNA, 23 nt, Human herpesvirus 6
uuuccugcccaggcaaacgagaa

SEQ ID NO: 3988799 - RNA, 13 nt, Human herpesvirus 6
uuucgcaauuugg

SEQ ID NO: 3988800 - RNA, 18 nt, Human herpesvirus 6
uuucguuuacgaauucaa

SEQ ID NO: 3988801 - RNA, 21 nt, Human herpesvirus 6
uuucuaacagaggguuuagaa

SEQ ID NO: 3988802 - RNA, 21 nt, Human herpesvirus 6
uuucuaugaguauauaaaaaa

SEQ ID NO: 3988803 - RNA, 16 nt, Human herpesvirus 6
uuucuuaaggugcuuu

SEQ ID NO: 3988804 - RNA, 13 nt, Human herpesvirus 6
uuugaaacggcgc

SEQ ID NO: 3988805 - RNA, 15 nt, Human herpesvirus 6
uuugauuuuguacag

SEQ ID NO: 3988806 - RNA, 20 nt, Human herpesvirus 6
uuuguguuaaaauaaaguuc

SEQ ID NO: 3988807 - RNA, 13 nt, Human herpesvirus 6
uuuguugguuaaa

SEQ ID NO: 3988808 - RNA, 19 nt, Human herpesvirus 6
uuuuggaauauauaaauag

SEQ ID NO: 3988809 - RNA, 17 nt, Human herpesvirus 6
uuuugggaaaucuggca

SEQ ID NO: 3988810 - RNA, 13 nt, Human herpesvirus 6
uuuuucauaaaug

SEQ ID NO: 3988811 - RNA, 17 nt, Human herpesvirus 6
gcgcgcauguugcaguu

SEQ ID NO: 3988812 - RNA, 21 nt, Human herpesvirus 6
gcggaauguuuguuuuuguca

SEQ ID NO: 3988813 - RNA, 17 nt, Human herpesvirus 6
gcggacgguuuauuuuu

SEQ ID NO: 3988814 - RNA, 13 nt, Human herpesvirus 6
gcggauggagccc

SEQ ID NO: 3988815 - RNA, 17 nt, Human herpesvirus 6
gcggcaaccgcaguucc

SEQ ID NO: 3988816 - RNA, 23 nt, Human herpesvirus 6
gcgucgcccccccgcagcuccuu

SEQ ID NO: 3988817 - RNA, 22 nt, Human herpesvirus 6
gcuaaaucaaaugauuuuacaa

SEQ ID NO: 3988818 - RNA, 13 nt, Human herpesvirus 6
gcuaagcucguuc

SEQ ID NO: 3988819 - RNA, 18 nt, Human herpesvirus 6
gcuacgacacgcuggagc

SEQ ID NO: 3988820 - RNA, 17 nt, Human herpesvirus 6
gcuauuuuuuuuaaugu

SEQ ID NO: 3988821 - RNA, 21 nt, Human herpesvirus 6
gcuccguguuacugauggcag

SEQ ID NO: 3988822 - RNA, 17 nt, Human herpesvirus 6
gcucgcucugaaauuug

SEQ ID NO: 3988823 - RNA, 18 nt, Human herpesvirus 6
gcugaugcgauguggagc

SEQ ID NO: 3988824 - RNA, 18 nt, Human herpesvirus 6
gcugcagucucgggagag

SEQ ID NO: 3988825 - RNA, 12 nt, Human herpesvirus 6
gcuggaaagaga

SEQ ID NO: 3988826 - RNA, 12 nt, Human herpesvirus 6
gcuggagcagcu

SEQ ID NO: 3988827 - RNA, 23 nt, Human herpesvirus 6
gcuuucaaaaccgucaaccgcca

SEQ ID NO: 3988828 - RNA, 14 nt, Human herpesvirus 6
ggaaaccaccggcu

SEQ ID NO: 3988829 - RNA, 19 nt, Human herpesvirus 6
ggaacaaaacuuucauccu

SEQ ID NO: 3988830 - RNA, 19 nt, Human herpesvirus 6
ggaagaagauacgagaaca

SEQ ID NO: 3988831 - RNA, 21 nt, Human herpesvirus 6
ggaauaacagaugagggggag

SEQ ID NO: 3988832 - RNA, 17 nt, Human herpesvirus 6
ggaaugcugagcugcag

SEQ ID NO: 3988833 - RNA, 15 nt, Human herpesvirus 6
ggaauuuugagauuu

SEQ ID NO: 3988834 - RNA, 20 nt, Human herpesvirus 6
ggacacgcgcaguggacggc

SEQ ID NO: 3988835 - RNA, 15 nt, Human herpesvirus 6
ggacgacacgugggg

SEQ ID NO: 3988836 - RNA, 18 nt, Human herpesvirus 6
ggagaauaggaaaagaua

SEQ ID NO: 3988837 - RNA, 22 nt, Human herpesvirus 6
ggagaugauuccaagugguggu

SEQ ID NO: 3988838 - RNA, 20 nt, Human herpesvirus 6
ggagcccgcucggucucgca

SEQ ID NO: 3988839 - RNA, 21 nt, Human herpesvirus 6
ggagcggaggggcgcgagaca

SEQ ID NO: 3988840 - RNA, 23 nt, Human herpesvirus 6
ggagggaugucggucagacagug

SEQ ID NO: 3988841 - RNA, 14 nt, Human herpesvirus 6
ggaggugagacauc

SEQ ID NO: 3988842 - RNA, 16 nt, Human herpesvirus 6
ggagucggcgugugug

SEQ ID NO: 3988843 - RNA, 12 nt, Human herpesvirus 6
ggaguugcagug

SEQ ID NO: 3988844 - RNA, 17 nt, Human herpesvirus 6
ggauaauuuauggaaau

SEQ ID NO: 3988845 - RNA, 13 nt, Human herpesvirus 6
ggaucaacagaug

SEQ ID NO: 3988846 - RNA, 18 nt, Human herpesvirus 6
ggaugccugcauaugcag

SEQ ID NO: 3988847 - RNA, 18 nt, Human herpesvirus 6
ggauucccuucagacauc

SEQ ID NO: 3988848 - RNA, 18 nt, Human herpesvirus 6
ggcaaccgcaguuccugu

SEQ ID NO: 3988849 - RNA, 14 nt, Human herpesvirus 6
ggcaacgcuccucc

SEQ ID NO: 3988850 - RNA, 22 nt, Human herpesvirus 6
ggccacguccucgugcucugcc

SEQ ID NO: 3988851 - RNA, 13 nt, Human herpesvirus 6
ggccccagagacg

SEQ ID NO: 3988852 - RNA, 20 nt, Human herpesvirus 6
ggccuggcacggugccaaag

SEQ ID NO: 3988853 - RNA, 17 nt, Human herpesvirus 6
ggcgacaaccgccgccg

SEQ ID NO: 3988854 - RNA, 16 nt, Human herpesvirus 6
ggcggacaccgagggc

SEQ ID NO: 3988855 - RNA, 22 nt, Human herpesvirus 6
ggcggcgaguaacggaaaacga

SEQ ID NO: 3988856 - RNA, 20 nt, Human herpesvirus 6
ggcgucaucgguggcagagg

SEQ ID NO: 3988857 - RNA, 20 nt, Human herpesvirus 6
gggaagaaaauccagcaaug

SEQ ID NO: 3988858 - RNA, 16 nt, Human herpesvirus 6
gggaccuucaggaaca

SEQ ID NO: 3988859 - RNA, 14 nt, Human herpesvirus 6
gggacgggcggagc

SEQ ID NO: 3988860 - RNA, 21 nt, Human herpesvirus 6
gggauuaauaaaggauguuug

SEQ ID NO: 3988861 - RNA, 19 nt, Human herpesvirus 6
gggcaaccgcaguuccugu

SEQ ID NO: 3988862 - RNA, 13 nt, Human herpesvirus 6
gggcacaaaacag

SEQ ID NO: 3988863 - RNA, 17 nt, Human herpesvirus 6
gggccuccgccacugcg

SEQ ID NO: 3988864 - RNA, 20 nt, Human herpesvirus 6
gggcgcgagacagcggacag

SEQ ID NO: 3988865 - RNA, 20 nt, Human herpesvirus 6
gggcuccgcgccguuucaaa

SEQ ID NO: 3988866 - RNA, 16 nt, Human herpesvirus 6
ggggagggacccacag

SEQ ID NO: 3988867 - RNA, 22 nt, Human herpesvirus 6
ggggaucgggcccggggacgga

SEQ ID NO: 3988868 - RNA, 21 nt, Human herpesvirus 6
gggggaucgacgggcaggaau

SEQ ID NO: 3988869 - RNA, 15 nt, Human herpesvirus 6
gggucuuuccugcac

SEQ ID NO: 3988870 - RNA, 20 nt, Human herpesvirus 6
ggguuggaccgaggggacag

SEQ ID NO: 3988871 - RNA, 23 nt, Human herpesvirus 6
ggguuggaccgaggggacagggg

SEQ ID NO: 3988872 - RNA, 20 nt, Human herpesvirus 6
ggucacguauaccauuccca

SEQ ID NO: 3988873 - RNA, 17 nt, Human herpesvirus 6
ggucuuuccugcacagg

SEQ ID NO: 3988874 - RNA, 15 nt, Human herpesvirus 6
ggucuuuccugccca

SEQ ID NO: 3988875 - RNA, 12 nt, Human herpesvirus 6
ggugaaaugaau

SEQ ID NO: 3988876 - RNA, 15 nt, Human herpesvirus 6
gguuagagcugggga

SEQ ID NO: 3988877 - RNA, 18 nt, Human herpesvirus 6
gguuugggggucuuuccu

SEQ ID NO: 3988878 - RNA, 17 nt, Human herpesvirus 6
gguuuggggucuuuccu

SEQ ID NO: 3988879 - RNA, 15 nt, Human herpesvirus 6
guaaaaaaacauucu

SEQ ID NO: 3988880 - RNA, 17 nt, Human herpesvirus 6
guaaacacgaaauugcu

SEQ ID NO: 3988881 - RNA, 20 nt, Human herpesvirus 6
guaaacuggucugcuugcaa

SEQ ID NO: 3988882 - RNA, 12 nt, Human herpesvirus 6
guaaacuucugc

SEQ ID NO: 3988883 - RNA, 20 nt, Human herpesvirus 6
guaauuucagucaauuuuac

SEQ ID NO: 3988884 - RNA, 16 nt, Human herpesvirus 6
guauaaauuuaacuaa

SEQ ID NO: 3988885 - RNA, 17 nt, Human herpesvirus 6
guauaaugcaugauggu

SEQ ID NO: 3988886 - RNA, 16 nt, Human herpesvirus 6
guauucagaguacuuu

SEQ ID NO: 3988887 - RNA, 11 nt, Human herpesvirus 6
guauuguaaaa

SEQ ID NO: 3988888 - RNA, 13 nt, Human herpesvirus 6
gucagguuugaaa

SEQ ID NO: 3988889 - RNA, 13 nt, Human herpesvirus 6
guccacacgccag

SEQ ID NO: 3988890 - RNA, 18 nt, Human herpesvirus 6
guccgacacgcccccacc

SEQ ID NO: 3988891 - RNA, 13 nt, Human herpesvirus 6
gucgaaauucacc

SEQ ID NO: 3988892 - RNA, 19 nt, Human herpesvirus 6
gucggacgacgggcggggc

SEQ ID NO: 3988893 - RNA, 22 nt, Human herpesvirus 6
gucggacgacgggcggggcgga

SEQ ID NO: 3988894 - RNA, 14 nt, Human herpesvirus 6
gucggcgugucugu

SEQ ID NO: 3988895 - RNA, 22 nt, Human herpesvirus 6
gucuauaacgagucgaagagag

SEQ ID NO: 3988896 - RNA, 20 nt, Human herpesvirus 6
gucuccgccuuuucuuauau

SEQ ID NO: 3988897 - RNA, 21 nt, Human herpesvirus 6
gucucuucuugcgaccuggcu

SEQ ID NO: 3988898 - RNA, 17 nt, Human herpesvirus 6
gucuucaagcaaagaca

SEQ ID NO: 3988899 - RNA, 15 nt, Human herpesvirus 6
gucuuuccugcacag

SEQ ID NO: 3988900 - RNA, 18 nt, Human herpesvirus 6
gucuuuccugcacaggcg

SEQ ID NO: 3988901 - RNA, 11 nt, Human herpesvirus 6
gugaagaucac

SEQ ID NO: 3988902 - RNA, 14 nt, Human herpesvirus 6
gugacaucuuuuau

SEQ ID NO: 3988903 - RNA, 21 nt, Human herpesvirus 6
gugacuacguuuuguguuaaa

SEQ ID NO: 3988904 - RNA, 16 nt, Human herpesvirus 6
gugccaccgucuggga

SEQ ID NO: 3988905 - RNA, 12 nt, Human herpesvirus 6
gugccuuuguau

SEQ ID NO: 3988906 - RNA, 12 nt, Human herpesvirus 6
guggacaaugau

SEQ ID NO: 3988907 - RNA, 19 nt, Human herpesvirus 6
guggauuaugaguaugaaa

SEQ ID NO: 3988908 - RNA, 14 nt, Human herpesvirus 6
gugucaaguuucac

SEQ ID NO: 3988909 - RNA, 16 nt, Human herpesvirus 6
guguuuuugaugugcc

SEQ ID NO: 3988910 - RNA, 15 nt, Human herpesvirus 6
guuaaaacaguaaau

SEQ ID NO: 3988911 - RNA, 16 nt, Human herpesvirus 6
guuaaauaacucagau

SEQ ID NO: 3988912 - RNA, 13 nt, Human herpesvirus 6
guuaaugcugcug

SEQ ID NO: 3988913 - RNA, 15 nt, Human herpesvirus 6
guuaaugcugcugcu

SEQ ID NO: 3988914 - RNA, 11 nt, Human herpesvirus 6
guuaauguuua

SEQ ID NO: 3988915 - RNA, 12 nt, Human herpesvirus 6
guuaauucucau

SEQ ID NO: 3988916 - RNA, 14 nt, Human herpesvirus 6
guuagcuuugcgau

SEQ ID NO: 3988917 - RNA, 10 nt, Human herpesvirus 6
guuaguaaau

SEQ ID NO: 3988918 - RNA, 21 nt, Human herpesvirus 6
guuauaacacaacaaguaaau

SEQ ID NO: 3988919 - RNA, 13 nt, Human herpesvirus 6
guuaucacgaugu

SEQ ID NO: 3988920 - RNA, 13 nt, Human herpesvirus 6
guucaguaacauu

SEQ ID NO: 3988921 - RNA, 14 nt, Human herpesvirus 6
guuccacgcgcgug

SEQ ID NO: 3988922 - RNA, 23 nt, Human herpesvirus 6
guuccccaugucuugccucuccg

SEQ ID NO: 3988923 - RNA, 15 nt, Human herpesvirus 6
guuuaacgcucauga

SEQ ID NO: 3988924 - RNA, 13 nt, Human herpesvirus 6
guuuagaaaugca

SEQ ID NO: 3988925 - RNA, 15 nt, Human herpesvirus 6
guuuauugucaaaua

SEQ ID NO: 3988926 - RNA, 22 nt, Human herpesvirus 6
guuuuagagaaaagugcaaggg

SEQ ID NO: 3988927 - RNA, 17 nt, Human herpesvirus 6
uccccgggugcuccgcc

SEQ ID NO: 3988928 - RNA, 15 nt, Human herpesvirus 6
uccggaguugcagug

SEQ ID NO: 3988929 - RNA, 14 nt, Human herpesvirus 6
uccguaucacacuu

SEQ ID NO: 3988930 - RNA, 14 nt, Human herpesvirus 6
uccguuuccuccuc

SEQ ID NO: 3988931 - RNA, 13 nt, Human herpesvirus 6
uccuagcauuucc

SEQ ID NO: 3988932 - RNA, 16 nt, Human herpesvirus 6
uccuauugguuugcau

SEQ ID NO: 3988933 - RNA, 22 nt, Human herpesvirus 6
uccugagaguaaauauuucuaa

SEQ ID NO: 3988934 - RNA, 22 nt, Human herpesvirus 6
ucgaaauucaccagauucacug

SEQ ID NO: 3988935 - RNA, 18 nt, Human herpesvirus 6
ucgaauaauuauccucuc

SEQ ID NO: 3988936 - RNA, 22 nt, Human herpesvirus 6
ucgaccuaaaaaaguguaacau

SEQ ID NO: 3988937 - RNA, 18 nt, Human herpesvirus 6
ucgacgaaauaauugaua

SEQ ID NO: 3988938 - RNA, 20 nt, Human herpesvirus 6
ucgauuugcugguaaauuuu

SEQ ID NO: 3988939 - RNA, 15 nt, Human herpesvirus 6
ucgcacacacaagaa

SEQ ID NO: 3988940 - RNA, 20 nt, Human herpesvirus 6
ucgcacacacaagaacagag

SEQ ID NO: 3988941 - RNA, 21 nt, Human herpesvirus 6
ucgcccugcuccguuuccucc

SEQ ID NO: 3988942 - RNA, 15 nt, Human herpesvirus 6
ucgcuggacuuagug

SEQ ID NO: 3988943 - RNA, 22 nt, Human herpesvirus 6
ucggaaaacuaaaagucagugg

SEQ ID NO: 3988944 - RNA, 22 nt, Human herpesvirus 6
ucggaaaauuaaaagucagugg

SEQ ID NO: 3988945 - RNA, 18 nt, Human herpesvirus 6
ucggacagcaaggaacaa

SEQ ID NO: 3988946 - RNA, 15 nt, Human herpesvirus 6
ucgggcuuugugaaa

SEQ ID NO: 3988947 - RNA, 17 nt, Human herpesvirus 6
ucggucaccuacauucg

SEQ ID NO: 3988948 - RNA, 17 nt, Human herpesvirus 6
ucgugauaacaaugcau

SEQ ID NO: 3988949 - RNA, 20 nt, Human herpesvirus 6
ucgugccaguucacacggac

SEQ ID NO: 3988950 - RNA, 20 nt, Human herpesvirus 6
ucguuauauuuuuuauuuuu

SEQ ID NO: 3988951 - RNA, 16 nt, Human herpesvirus 6
ucuaaaacaagacaga

SEQ ID NO: 3988952 - RNA, 18 nt, Human herpesvirus 6
ucuaaaaucucguaacgc

SEQ ID NO: 3988953 - RNA, 15 nt, Human herpesvirus 6
ucuaaccauuuugaa

SEQ ID NO: 3988954 - RNA, 14 nt, Human herpesvirus 6
ucuaaugguugaaa

SEQ ID NO: 3988955 - RNA, 22 nt, Human herpesvirus 6
ucuagcuauagcuaauguaaua

SEQ ID NO: 3988956 - RNA, 13 nt, Human herpesvirus 6
ucuauauccuguc

SEQ ID NO: 3988957 - RNA, 22 nt, Human herpesvirus 6
ucuauccaugaaacucuuugaa

SEQ ID NO: 3988958 - RNA, 13 nt, Human herpesvirus 6
ucuauggaucuga

SEQ ID NO: 3988959 - RNA, 16 nt, Human herpesvirus 6
ucuccuauaaauacug

SEQ ID NO: 3988960 - RNA, 22 nt, Human herpesvirus 6
ucuccucguggucauugguguu

SEQ ID NO: 3988961 - RNA, 22 nt, Human herpesvirus 6
ucucggaaaauuaaaagucagu

SEQ ID NO: 3988962 - RNA, 17 nt, Human herpesvirus 6
ucucgugguacaauaaa

SEQ ID NO: 3988963 - RNA, 11 nt, Human herpesvirus 6
ucucugcaaaa

SEQ ID NO: 3988964 - RNA, 21 nt, Human herpesvirus 6
ucucugcgccaaccuucuaau

SEQ ID NO: 3988965 - RNA, 15 nt, Human herpesvirus 6
ucucuucgaaauuuu

SEQ ID NO: 3988966 - RNA, 16 nt, Human herpesvirus 6
ucucuuuuuaauucca

SEQ ID NO: 3988967 - RNA, 15 nt, Human herpesvirus 6
ucugcauuuauauca

SEQ ID NO: 3988968 - RNA, 15 nt, Human herpesvirus 6
ucugucugcagcuua

SEQ ID NO: 3988969 - RNA, 14 nt, Human herpesvirus 6
ucuuauauuucaga

SEQ ID NO: 3988970 - RNA, 23 nt, Human herpesvirus 6
ucuuccaguauugaagaaaauug

SEQ ID NO: 3988971 - RNA, 16 nt, Human herpesvirus 6
ucuuguugaguuucag

SEQ ID NO: 3988972 - RNA, 13 nt, Human herpesvirus 6
ucuuuccugccca

SEQ ID NO: 3988973 - RNA, 20 nt, Human herpesvirus 6
ugaaaauaucauuaaauugu

SEQ ID NO: 3988974 - RNA, 20 nt, Human herpesvirus 6
ugaaagacuuaaaauuuaug

SEQ ID NO: 3988975 - RNA, 21 nt, Human herpesvirus 6
ugaaagagacucuauggugag

SEQ ID NO: 3988976 - RNA, 14 nt, Human herpesvirus 6
ugaaauaucagaaa

SEQ ID NO: 3988977 - RNA, 21 nt, Human herpesvirus 6
ugaaccaagucaacaacguca

SEQ ID NO: 3988978 - RNA, 23 nt, Human herpesvirus 6
ugaaccgcguauguuuuaucgag

SEQ ID NO: 3988979 - RNA, 15 nt, Human herpesvirus 6
ugaauguuacagaua

SEQ ID NO: 3988980 - RNA, 15 nt, Human herpesvirus 6
ugacaauaaacauga

SEQ ID NO: 3988981 - RNA, 14 nt, Human herpesvirus 6
ugacaucugcaaaa

SEQ ID NO: 3988982 - RNA, 14 nt, Human herpesvirus 6
ugacauucaaaguc

SEQ ID NO: 3988983 - RNA, 20 nt, Human herpesvirus 6
ugaccggagaaaaucaugca

SEQ ID NO: 3988984 - RNA, 20 nt, Human herpesvirus 6
ugacgccuugauguuuccug

SEQ ID NO: 3988985 - RNA, 22 nt, Human herpesvirus 6
ugacggaggcgacgaaagagga

SEQ ID NO: 3988986 - RNA, 20 nt, Human herpesvirus 6
ugacuguaccauugucaaca

SEQ ID NO: 3988987 - RNA, 20 nt, Human herpesvirus 6
ugacuguccgcaugagcgac

SEQ ID NO: 3988988 - RNA, 20 nt, Human herpesvirus 6
ugagagaaugcaacauccug

SEQ ID NO: 3988989 - RNA, 17 nt, Human herpesvirus 6
ugagauguucuaaagga

SEQ ID NO: 3988990 - RNA, 22 nt, Human herpesvirus 6
ugagauucacuccgcguaaaga

SEQ ID NO: 3988991 - RNA, 14 nt, Human herpesvirus 6
ugaguaggagaggc

SEQ ID NO: 3988992 - RNA, 21 nt, Human herpesvirus 6
ugaucugauucgacaaaucau

SEQ ID NO: 3988993 - RNA, 17 nt, Human herpesvirus 6
ugauuaugccaaaugua

SEQ ID NO: 3988994 - RNA, 16 nt, Human herpesvirus 6
ugauuauucugucuug

SEQ ID NO: 3988995 - RNA, 19 nt, Human herpesvirus 6
ugauugucuuuucuggaaa

SEQ ID NO: 3988996 - RNA, 13 nt, Human herpesvirus 6
ugcaaccaauaaa

SEQ ID NO: 3988997 - RNA, 17 nt, Human herpesvirus 6
ugcaauucgguucagcc

SEQ ID NO: 3988998 - RNA, 20 nt, Human herpesvirus 6
ugcaauuguuugugaugggu

SEQ ID NO: 3988999 - RNA, 13 nt, Human herpesvirus 6
ugcacuguuugaa

SEQ ID NO: 3989000 - RNA, 17 nt, Human herpesvirus 6
ugcagacgcugaaauca

SEQ ID NO: 3989001 - RNA, 18 nt, Human herpesvirus 6
ugcagacugcuucuuaga

SEQ ID NO: 3989002 - RNA, 17 nt, Human herpesvirus 6
ugcagaucuaauucaca

SEQ ID NO: 3989003 - RNA, 15 nt, Human herpesvirus 6
ugcaugguccacaga

SEQ ID NO: 3989004 - RNA, 15 nt, Human herpesvirus 6
ugcauuaacccuggg

SEQ ID NO: 3989005 - RNA, 19 nt, Human herpesvirus 6
ugcauugugacagaauucu

SEQ ID NO: 3989006 - RNA, 14 nt, Human herpesvirus 6
ugcauugugugggg

SEQ ID NO: 3989007 - RNA, 18 nt, Human herpesvirus 6
ugccaccgucugggaccc

SEQ ID NO: 3989008 - RNA, 13 nt, Human herpesvirus 6
ugccauaauuucu

SEQ ID NO: 3989009 - RNA, 15 nt, Human herpesvirus 6
ugcccagauguggaa

SEQ ID NO: 3989010 - RNA, 17 nt, Human herpesvirus 6
ugccuuguuuucuuaug

SEQ ID NO: 3989011 - RNA, 18 nt, Human herpesvirus 6
ugcgucgcccccccgcag

SEQ ID NO: 3989012 - RNA, 12 nt, Human herpesvirus 6
ugcguuaucgac

SEQ ID NO: 3989013 - RNA, 21 nt, Human herpesvirus 6
ugcuaagggugccguuauucc

SEQ ID NO: 3989014 - RNA, 19 nt, Human herpesvirus 6
ugcuacccacaugaaauca

SEQ ID NO: 3989015 - RNA, 16 nt, Human herpesvirus 6
ugcucgccguauaagu

SEQ ID NO: 3989016 - RNA, 19 nt, Human herpesvirus 6
ugcuucucucgaugaaagu

SEQ ID NO: 3989017 - RNA, 18 nt, Human herpesvirus 6
uggaaacacuuucuucgc

SEQ ID NO: 3989018 - RNA, 12 nt, Human herpesvirus 6
uggauguuuucg

SEQ ID NO: 3989019 - RNA, 12 nt, Human herpesvirus 6
uggcagagggga

SEQ ID NO: 3989020 - RNA, 21 nt, Human herpesvirus 6
uggccauauuaggcugcagcc

SEQ ID NO: 3989021 - RNA, 18 nt, Human herpesvirus 6
uggccuucgguacaguga

SEQ ID NO: 3989022 - RNA, 15 nt, Human herpesvirus 6
ugggaaucaugugua

SEQ ID NO: 3989023 - RNA, 18 nt, Human herpesvirus 6
ugggggucuuuccugcac

SEQ ID NO: 3989024 - RNA, 23 nt, Human herpesvirus 6
ugggggucuuuccugcacaggcg

SEQ ID NO: 3989025 - RNA, 22 nt, Human herpesvirus 6
uggggucuuuccugcacaggcg

SEQ ID NO: 3989026 - RNA, 17 nt, Human herpesvirus 6
uggggucuuuccugccc

SEQ ID NO: 3989027 - RNA, 17 nt, Human herpesvirus 6
uggucaugaucugcuug

SEQ ID NO: 3989028 - RNA, 15 nt, Human herpesvirus 6
uggucauuucauuug

SEQ ID NO: 3989029 - RNA, 17 nt, Human herpesvirus 6
uguaaauaaacaccagc

SEQ ID NO: 3989030 - RNA, 17 nt, Human herpesvirus 6
uguaagauuaaauguga

SEQ ID NO: 3989031 - RNA, 15 nt, Human herpesvirus 6
uguaauaaaguguca

SEQ ID NO: 3989032 - RNA, 21 nt, Human herpesvirus 6
uguacuuccgcauacuuuugu

SEQ ID NO: 3989033 - RNA, 22 nt, Human herpesvirus 6
uguaguuuaguaugggugagug

SEQ ID NO: 3989034 - RNA, 15 nt, Human herpesvirus 6
uguaguuuuuaaauc

SEQ ID NO: 3989035 - RNA, 22 nt, Human herpesvirus 6
uguaucggcaguguaaaguucu

SEQ ID NO: 3989036 - RNA, 22 nt, Human herpesvirus 6
uguauuguagcagcuggcgaaa

SEQ ID NO: 3989037 - RNA, 19 nt, Human herpesvirus 6
ugucacugucgaauauguu

SEQ ID NO: 3989038 - RNA, 18 nt, Human herpesvirus 6
uguccucuuugaauuuua

SEQ ID NO: 3989039 - RNA, 18 nt, Human herpesvirus 6
ugucgaagucuucuuggg

SEQ ID NO: 3989040 - RNA, 12 nt, Human herpesvirus 6
ugucggccucug

SEQ ID NO: 3989041 - RNA, 11 nt, Human herpesvirus 6
aaaaaaaaugu

SEQ ID NO: 3989042 - RNA, 13 nt, Human herpesvirus 6
aaaaaacaacuuu

SEQ ID NO: 3989043 - RNA, 21 nt, Human herpesvirus 6
aaaaacaccucuaaaacaaga

SEQ ID NO: 3989044 - RNA, 23 nt, Human herpesvirus 6
aaaaaguuuucuaaaaggcucug

SEQ ID NO: 3989045 - RNA, 23 nt, Human herpesvirus 6
aaaaauaaguacauagaauuucu

SEQ ID NO: 3989046 - RNA, 12 nt, Human herpesvirus 6
aaaaaucaacau

SEQ ID NO: 3989047 - RNA, 16 nt, Human herpesvirus 6
aaaacagcuccgcauc

SEQ ID NO: 3989048 - RNA, 17 nt, Human herpesvirus 6
aaaacguuuuuguuauu

SEQ ID NO: 3989049 - RNA, 20 nt, Human herpesvirus 6
aaaacuaauucggaacauug

SEQ ID NO: 3989050 - RNA, 14 nt, Human herpesvirus 6
aaaagcgccugccu

SEQ ID NO: 3989051 - RNA, 17 nt, Human herpesvirus 6
aaaagcuggaaaacuau

SEQ ID NO: 3989052 - RNA, 15 nt, Human herpesvirus 6
aaaagggaagauuug

SEQ ID NO: 3989053 - RNA, 13 nt, Human herpesvirus 6
aaaagggagauga

SEQ ID NO: 3989054 - RNA, 16 nt, Human herpesvirus 6
aaaaucuauugaagau

SEQ ID NO: 3989055 - RNA, 18 nt, Human herpesvirus 6
aaaaucuucuuugugcgu

SEQ ID NO: 3989056 - RNA, 15 nt, Human herpesvirus 6
aaaauuugcuaacgg

SEQ ID NO: 3989057 - RNA, 22 nt, Human herpesvirus 6
aaacaagauccaaucacaacaa

SEQ ID NO: 3989058 - RNA, 14 nt, Human herpesvirus 6
aaacaaucaaaugg

SEQ ID NO: 3989059 - RNA, 22 nt, Human herpesvirus 6
aaacacacaauuaguccauuac

SEQ ID NO: 3989060 - RNA, 21 nt, Human herpesvirus 6
aaacaguaauuuuagggaugg

SEQ ID NO: 3989061 - RNA, 12 nt, Human herpesvirus 6
aaacauguuguu

SEQ ID NO: 3989062 - RNA, 17 nt, Human herpesvirus 6
aaaccaccggcuaaccc

SEQ ID NO: 3989063 - RNA, 17 nt, Human herpesvirus 6
aaaccuagauguaaauu

SEQ ID NO: 3989064 - RNA, 19 nt, Human herpesvirus 6
aaacuaucggagagacgca

SEQ ID NO: 3989065 - RNA, 17 nt, Human herpesvirus 6
aaacucaauuuugaaau

SEQ ID NO: 3989066 - RNA, 23 nt, Human herpesvirus 6
aaagaaucgguaaacuucagacc

SEQ ID NO: 3989067 - RNA, 22 nt, Human herpesvirus 6
aaagacaucacauuauaagaca

SEQ ID NO: 3989068 - RNA, 19 nt, Human herpesvirus 6
aaagagaauacuacaguga

SEQ ID NO: 3989069 - RNA, 17 nt, Human herpesvirus 6
aaagaucaguggguacc

SEQ ID NO: 3989070 - RNA, 14 nt, Human herpesvirus 6
aaagcacauaaggc

SEQ ID NO: 3989071 - RNA, 16 nt, Human herpesvirus 6
aaagcagcagaugcuu

SEQ ID NO: 3989072 - RNA, 16 nt, Human herpesvirus 6
aaagggaagauuugua

SEQ ID NO: 3989073 - RNA, 18 nt, Human herpesvirus 6
aaaguuucggaaaaugua

SEQ ID NO: 3989074 - RNA, 18 nt, Human herpesvirus 6
aaauaaaaaauauuaauu

SEQ ID NO: 3989075 - RNA, 11 nt, Human herpesvirus 6
aaauaaaguuu

SEQ ID NO: 3989076 - RNA, 15 nt, Human herpesvirus 6
aaauagcagaaguuu

SEQ ID NO: 3989077 - RNA, 16 nt, Human herpesvirus 6
aaauauggcagagcug

SEQ ID NO: 3989078 - RNA, 21 nt, Human herpesvirus 6
aaauauguugaaucuuauuca

SEQ ID NO: 3989079 - RNA, 23 nt, Human herpesvirus 6
aaauauuuccaugacugugaggu

SEQ ID NO: 3989080 - RNA, 21 nt, Human herpesvirus 6
aaaucuauccgcuaaaacgac

SEQ ID NO: 3989081 - RNA, 15 nt, Human herpesvirus 6
aaaucucucgguaga

SEQ ID NO: 3989082 - RNA, 21 nt, Human herpesvirus 6
aaaucuggaucaucaagcauc

SEQ ID NO: 3989083 - RNA, 16 nt, Human herpesvirus 6
aaauggauuugguauu

SEQ ID NO: 3989084 - RNA, 10 nt, Human herpesvirus 6
aaaugugucu

SEQ ID NO: 3989085 - RNA, 12 nt, Human herpesvirus 6
aaauuacauaag

SEQ ID NO: 3989086 - RNA, 19 nt, Human herpesvirus 6
aacaaaaagcuuuaaagca

SEQ ID NO: 3989087 - RNA, 17 nt, Human herpesvirus 6
aacaacaucuuaaaaga

SEQ ID NO: 3989088 - RNA, 23 nt, Human herpesvirus 6
aacaaugaaaauucaguuuuuau

SEQ ID NO: 3989089 - RNA, 23 nt, Human herpesvirus 6
aacacgugggucagauaguugau

SEQ ID NO: 3989090 - RNA, 13 nt, Human herpesvirus 6
aacagacuuuacu

SEQ ID NO: 3989091 - RNA, 23 nt, Human herpesvirus 6
aacauaaaacaacaacaauaaca

SEQ ID NO: 3989092 - RNA, 22 nt, Human herpesvirus 6
aacauaucgagccaaagaaaca

SEQ ID NO: 3989093 - RNA, 22 nt, Human herpesvirus 6
aacauccuauugagauucuccg

SEQ ID NO: 3989094 - RNA, 13 nt, Human herpesvirus 6
aacaugaacauug

SEQ ID NO: 3989095 - RNA, 19 nt, Human herpesvirus 6
aacaugcguuguguuacac

SEQ ID NO: 3989096 - RNA, 19 nt, Human herpesvirus 6
aacauuuaauaaagaacau

SEQ ID NO: 3989097 - RNA, 18 nt, Human herpesvirus 6
aacccuaaaauuugcuaa

SEQ ID NO: 3989098 - RNA, 16 nt, Human herpesvirus 6
aaccuguuuccagaau

SEQ ID NO: 3989099 - RNA, 16 nt, Human herpesvirus 6
aacgaacaaaucucca

SEQ ID NO: 3989100 - RNA, 18 nt, Human herpesvirus 6
aacgcgguaacgccacag

SEQ ID NO: 3989101 - RNA, 14 nt, Human herpesvirus 6
aacgucgaaacgaa

SEQ ID NO: 3989102 - RNA, 22 nt, Human herpesvirus 6
aacuaauucggaacauuguucu

SEQ ID NO: 3989103 - RNA, 16 nt, Human herpesvirus 6
aacuacgguagaagcu

SEQ ID NO: 3989104 - RNA, 15 nt, Human herpesvirus 6
aacuagaaaaacaac

SEQ ID NO: 3989105 - RNA, 18 nt, Human herpesvirus 6
aacucuaaaagcugcuaa

SEQ ID NO: 3989106 - RNA, 16 nt, Human herpesvirus 6
aacugcuuaacuugca

SEQ ID NO: 3989107 - RNA, 20 nt, Human herpesvirus 6
aacuuuuugccgaagauagc

SEQ ID NO: 3989108 - RNA, 14 nt, Human herpesvirus 6
aagaauucaaaaac

SEQ ID NO: 3989109 - RNA, 15 nt, Human herpesvirus 6
aagacggaaccauga

SEQ ID NO: 3989110 - RNA, 23 nt, Human herpesvirus 6
aagagugauucaagguggagguu

SEQ ID NO: 3989111 - RNA, 15 nt, Human herpesvirus 6
aagaucuacagagua

SEQ ID NO: 3989112 - RNA, 14 nt, Human herpesvirus 6
aagauguagcugga

SEQ ID NO: 3989113 - RNA, 15 nt, Human herpesvirus 6
aagauguugcaauaa

SEQ ID NO: 3989114 - RNA, 11 nt, Human herpesvirus 6
aagcaaacaug

SEQ ID NO: 3989115 - RNA, 20 nt, Human herpesvirus 6
aagcacugaauuagaauaau

SEQ ID NO: 3989116 - RNA, 14 nt, Human herpesvirus 6
aagcaucugcugcu

SEQ ID NO: 3989117 - RNA, 20 nt, Human herpesvirus 6
aagccucgacguccaccugg

SEQ ID NO: 3989118 - RNA, 23 nt, Human herpesvirus 6
aagcuauguaugaacaggugcuu

SEQ ID NO: 3989119 - RNA, 17 nt, Human herpesvirus 6
aaggacuacaucccucu

SEQ ID NO: 3989120 - RNA, 17 nt, Human herpesvirus 6
aaguaauauagacauug

SEQ ID NO: 3989121 - RNA, 17 nt, Human herpesvirus 6
aagucacgggcagcugc

SEQ ID NO: 3989122 - RNA, 16 nt, Human herpesvirus 6
aagucgacaaauuaua

SEQ ID NO: 3989123 - RNA, 16 nt, Human herpesvirus 6
aauaaaaaguuugugc

SEQ ID NO: 3989124 - RNA, 23 nt, Human herpesvirus 6
aauaaaauuuacaguguuuccaa

SEQ ID NO: 3989125 - RNA, 23 nt, Human herpesvirus 6
aauaaggaaaaauaucgaaauaa

SEQ ID NO: 3989126 - RNA, 13 nt, Human herpesvirus 6
aauaauugcauuc

SEQ ID NO: 3989127 - RNA, 20 nt, Human herpesvirus 6
aauacauuuccaugcauauc

SEQ ID NO: 3989128 - RNA, 23 nt, Human herpesvirus 6
aauauucaagcgaagugaagaau

SEQ ID NO: 3989129 - RNA, 14 nt, Human herpesvirus 6
aaucaucaacguaa

SEQ ID NO: 3989130 - RNA, 21 nt, Human herpesvirus 6
aaucggacaaugcagaacaac

SEQ ID NO: 3989131 - RNA, 16 nt, Human herpesvirus 6
aaucuauugaagauaa

SEQ ID NO: 3989132 - RNA, 18 nt, Human herpesvirus 6
aaucugaauuuaaugcaa

SEQ ID NO: 3989133 - RNA, 14 nt, Human herpesvirus 6
aaucugagugaucu

SEQ ID NO: 3989134 - RNA, 23 nt, Human herpesvirus 6
aaucugcguuccucucucggcug

SEQ ID NO: 3989135 - RNA, 19 nt, Human herpesvirus 6
aaucuguaagauuaaaugu

SEQ ID NO: 3989136 - RNA, 20 nt, Human herpesvirus 6
aaucuguaagauuaaaugug

SEQ ID NO: 3989137 - RNA, 18 nt, Human herpesvirus 6
aaugacugggagaauaag

SEQ ID NO: 3989138 - RNA, 16 nt, Human herpesvirus 6
aaugcaauuuaaaaga

SEQ ID NO: 3989139 - RNA, 15 nt, Human herpesvirus 6
aaugcacuguuugaa

SEQ ID NO: 3989140 - RNA, 14 nt, Human herpesvirus 6
aauggaagaaggcu

SEQ ID NO: 3989141 - RNA, 24 nt, Human herpesvirus 6
aauguugaguaauugaacauugua

SEQ ID NO: 3989142 - RNA, 10 nt, Human herpesvirus 6
aauuaaaggu

SEQ ID NO: 3989143 - RNA, 19 nt, Human herpesvirus 6
aauuacucaacauuaaaaa

SEQ ID NO: 3989144 - RNA, 22 nt, Human herpesvirus 6
aauucaaaaaccgccaagagau

SEQ ID NO: 3989145 - RNA, 17 nt, Human herpesvirus 6
aauucaaaauaaauacu

SEQ ID NO: 3989146 - RNA, 22 nt, Human herpesvirus 6
aauucgauggguuagugaaaaa

SEQ ID NO: 3989147 - RNA, 16 nt, Human herpesvirus 6
aauucuaaaauuguaa

SEQ ID NO: 3989148 - RNA, 23 nt, Human herpesvirus 6
aauucucuggaugcuuuuagaug

SEQ ID NO: 3989149 - RNA, 21 nt, Human herpesvirus 6
aauuuuaucuucgccuuguau

SEQ ID NO: 3989150 - RNA, 23 nt, Human herpesvirus 6
aauuuuauuaacuguaaaaagug

SEQ ID NO: 3989151 - RNA, 15 nt, Human herpesvirus 6
acaaaccaaaaugac

SEQ ID NO: 3989152 - RNA, 20 nt, Human herpesvirus 6
acaaacgccuccacaugaca

SEQ ID NO: 3989153 - RNA, 14 nt, Human herpesvirus 6
acaaauaaaagcau

SEQ ID NO: 3989154 - RNA, 13 nt, Human herpesvirus 6
acaacaacaauaa

SEQ ID NO: 3989155 - RNA, 23 nt, Human herpesvirus 6
acaagcacugaauuagaauaauu

SEQ ID NO: 3989156 - RNA, 14 nt, Human herpesvirus 6
acaaguuucaauau

SEQ ID NO: 3989157 - RNA, 22 nt, Human herpesvirus 6
acaaucgucggaucaacagaug

SEQ ID NO: 3989158 - RNA, 17 nt, Human herpesvirus 6
acacaaaccaucaauuu

SEQ ID NO: 3989159 - RNA, 14 nt, Human herpesvirus 6
acacaauauacgua

SEQ ID NO: 3989160 - RNA, 12 nt, Human herpesvirus 6
acacacccagca

SEQ ID NO: 3989161 - RNA, 23 nt, Human herpesvirus 6
acacagaugguuuuaagagcaga

SEQ ID NO: 3989162 - RNA, 12 nt, Human herpesvirus 6
acacaggacacg

SEQ ID NO: 3989163 - RNA, 18 nt, Human herpesvirus 6
acaccucacaaucuaaua

SEQ ID NO: 3989164 - RNA, 15 nt, Human herpesvirus 6
acacgcuggagcagc

SEQ ID NO: 3989165 - RNA, 16 nt, Human herpesvirus 6
acagaccgucaaaucu

SEQ ID NO: 3989166 - RNA, 21 nt, Human herpesvirus 6
acagagaaggguaugaaacuu

SEQ ID NO: 3989167 - RNA, 18 nt, Human herpesvirus 6
acagagcgcaucuuuaac

SEQ ID NO: 3989168 - RNA, 20 nt, Human herpesvirus 6
acagagcgcaucuuuaacau

SEQ ID NO: 3989169 - RNA, 18 nt, Human herpesvirus 6
acaggaggcuauggcuuc

SEQ ID NO: 3989170 - RNA, 18 nt, Human herpesvirus 6
acaguuuaccuauuuaca

SEQ ID NO: 3989171 - RNA, 18 nt, Human herpesvirus 6
acauaagcaaauguaacu

SEQ ID NO: 3989172 - RNA, 17 nt, Human herpesvirus 6
acauaguggcuaugaag

SEQ ID NO: 3989173 - RNA, 22 nt, Human herpesvirus 6
acauaguggcuaugaagccuuc

SEQ ID NO: 3989174 - RNA, 21 nt, Human herpesvirus 6
acaucgagauucuuuaaagau

SEQ ID NO: 3989175 - RNA, 22 nt, Human herpesvirus 6
acaucgcgcgcgacgugccacc

SEQ ID NO: 3989176 - RNA, 15 nt, Human herpesvirus 6
acaugaacauugaaa

SEQ ID NO: 3989177 - RNA, 22 nt, Human herpesvirus 6
accaagaaucguuaaaugagau

SEQ ID NO: 3989178 - RNA, 16 nt, Human herpesvirus 6
accaccaacacaccug

SEQ ID NO: 3989179 - RNA, 22 nt, Human herpesvirus 6
accaucagcccccagcugaaau

SEQ ID NO: 3989180 - RNA, 17 nt, Human herpesvirus 6
accauuguauauguguu

SEQ ID NO: 3989181 - RNA, 15 nt, Human herpesvirus 6
acccacgguggccug

SEQ ID NO: 3989182 - RNA, 18 nt, Human herpesvirus 6
acccacgguggccuggca

SEQ ID NO: 3989183 - RNA, 13 nt, Human herpesvirus 6
acccuaacccuaa

SEQ ID NO: 3989184 - RNA, 19 nt, Human herpesvirus 6
acccuaccauccuucggcc

SEQ ID NO: 3989185 - RNA, 14 nt, Human herpesvirus 6
accgauucagaaag

SEQ ID NO: 3989186 - RNA, 20 nt, Human herpesvirus 6
accgcaguuccuguuuuucu

SEQ ID NO: 3989187 - RNA, 23 nt, Human herpesvirus 6
accgcaguuccuguuuuucucgg

SEQ ID NO: 3989188 - RNA, 17 nt, Human herpesvirus 6
accgcaguuucuguuuu

SEQ ID NO: 3989189 - RNA, 14 nt, Human herpesvirus 6
accgucucugaagc

SEQ ID NO: 3989190 - RNA, 20 nt, Human herpesvirus 6
accuaacgcgggauauuuua

SEQ ID NO: 3989191 - RNA, 21 nt, Human herpesvirus 6
accuagcagcaaauaaauaca

SEQ ID NO: 3989192 - RNA, 14 nt, Human herpesvirus 6
accucuaaaacaag

SEQ ID NO: 3989193 - RNA, 17 nt, Human herpesvirus 6
accuggaaaaacugacu

SEQ ID NO: 3989194 - RNA, 14 nt, Human herpesvirus 6
accuucccucccac

SEQ ID NO: 3989195 - RNA, 16 nt, Human herpesvirus 6
acgaaaacucuaaaag

SEQ ID NO: 3989196 - RNA, 15 nt, Human herpesvirus 6
acgagaaccugcagg

SEQ ID NO: 3989197 - RNA, 18 nt, Human herpesvirus 6
acgaucgcgaagccuguc

SEQ ID NO: 3989198 - RNA, 17 nt, Human herpesvirus 6
acgaucuacacaccguc

SEQ ID NO: 3989199 - RNA, 20 nt, Human herpesvirus 6
acgcacgacaacacgccaga

SEQ ID NO: 3989200 - RNA, 13 nt, Human herpesvirus 6
acgcacuggacau

SEQ ID NO: 3989201 - RNA, 13 nt, Human herpesvirus 6
acgcauuugcaau

SEQ ID NO: 3989202 - RNA, 15 nt, Human herpesvirus 6
acgcggcaaccgcag

SEQ ID NO: 3989203 - RNA, 13 nt, Human herpesvirus 6
acgcugaaaucau

SEQ ID NO: 3989204 - RNA, 14 nt, Human herpesvirus 6
acggacacgcgcag

SEQ ID NO: 3989205 - RNA, 19 nt, Human herpesvirus 6
acggguaagcagcagaaca

SEQ ID NO: 3989206 - RNA, 13 nt, Human herpesvirus 6
acguauaccuaga

SEQ ID NO: 3989207 - RNA, 15 nt, Human herpesvirus 6
acgugcuugucucac

SEQ ID NO: 3989208 - RNA, 16 nt, Human herpesvirus 6
acguggcagucugcuc

SEQ ID NO: 3989209 - RNA, 13 nt, Human herpesvirus 6
acguuuagaauga

SEQ ID NO: 3989210 - RNA, 15 nt, Human herpesvirus 6
acguuugccaaagcu

SEQ ID NO: 3989211 - RNA, 20 nt, Human herpesvirus 6
acuaaaaaaaaaaacacaaa

SEQ ID NO: 3989212 - RNA, 22 nt, Human herpesvirus 6
acuacguuuuguguuaaaauaa

SEQ ID NO: 3989213 - RNA, 14 nt, Human herpesvirus 6
acuaguuuucacac

SEQ ID NO: 3989214 - RNA, 16 nt, Human herpesvirus 6
acucaacccaaaaugc

SEQ ID NO: 3989215 - RNA, 18 nt, Human herpesvirus 6
acucaacugcuaguuuuu

SEQ ID NO: 3989216 - RNA, 19 nt, Human herpesvirus 6
acucgaccccuuuauaaga

SEQ ID NO: 3989217 - RNA, 15 nt, Human herpesvirus 6
acucgacuucuuuca

SEQ ID NO: 3989218 - RNA, 21 nt, Human herpesvirus 6
acucgugugucuuugugaaga

SEQ ID NO: 3989219 - RNA, 13 nt, Human herpesvirus 6
acugaauagguuu

SEQ ID NO: 3989220 - RNA, 11 nt, Human herpesvirus 6
acugaauuugc

SEQ ID NO: 3989221 - RNA, 22 nt, Human herpesvirus 6
acugcauacguuugccaaagcu

SEQ ID NO: 3989222 - RNA, 22 nt, Human herpesvirus 6
acugccgguaacgcugucguua

SEQ ID NO: 3989223 - RNA, 21 nt, Human herpesvirus 6
acugguguaaauacccugggg

SEQ ID NO: 3989224 - RNA, 14 nt, Human herpesvirus 6
acugugauaugcaa

SEQ ID NO: 3989225 - RNA, 15 nt, Human herpesvirus 6
acugugucuguucaa

SEQ ID NO: 3989226 - RNA, 15 nt, Human herpesvirus 6
acuguguguugaaug

SEQ ID NO: 3989227 - RNA, 14 nt, Human herpesvirus 6
acuucaaacaccuc

SEQ ID NO: 3989228 - RNA, 15 nt, Human herpesvirus 6
acuuccgauaaagau

SEQ ID NO: 3989229 - RNA, 23 nt, Human herpesvirus 6
acuuucguuuacgaauucaaugu

SEQ ID NO: 3989230 - RNA, 20 nt, Human herpesvirus 6
acuuugguucggagagguuu

SEQ ID NO: 3989231 - RNA, 20 nt, Human herpesvirus 6
acuuuguccuuacaaaucuu

SEQ ID NO: 3989232 - RNA, 18 nt, Human herpesvirus 6
acuuuugcuuagucugua

SEQ ID NO: 3989233 - RNA, 14 nt, Human herpesvirus 6
agaaaaguuuauuu

SEQ ID NO: 3989234 - RNA, 16 nt, Human herpesvirus 6
agaaaauccagcaaug

SEQ ID NO: 3989235 - RNA, 12 nt, Human herpesvirus 6
agaaaauugcag

SEQ ID NO: 3989236 - RNA, 14 nt, Human herpesvirus 6
agaacaaaaugagg

SEQ ID NO: 3989237 - RNA, 22 nt, Human herpesvirus 6
agaacaugugacacgauuucug

SEQ ID NO: 3989238 - RNA, 20 nt, Human herpesvirus 6
agaagaaaagaaaaagcagc

SEQ ID NO: 3989239 - RNA, 13 nt, Human herpesvirus 6
agaagaucuaaau

SEQ ID NO: 3989240 - RNA, 21 nt, Human herpesvirus 6
agaaucaaugaaaaaaaauga

SEQ ID NO: 3989241 - RNA, 20 nt, Human herpesvirus 6
agaaugcaacauccugcgug

SEQ ID NO: 3989242 - RNA, 13 nt, Human herpesvirus 6
agauuguuauuag

SEQ ID NO: 3989243 - RNA, 21 nt, Human herpesvirus 6
agauuuauugcgauucuaaua

SEQ ID NO: 3989244 - RNA, 19 nt, Human herpesvirus 6
agcaaguugcuaccgcugg

SEQ ID NO: 3989245 - RNA, 15 nt, Human herpesvirus 6
agcagaagaacagcu

SEQ ID NO: 3989246 - RNA, 19 nt, Human herpesvirus 6
agcagaaguuuacauagaa

SEQ ID NO: 3989247 - RNA, 11 nt, Human herpesvirus 6
agcagaugcuu

SEQ ID NO: 3989248 - RNA, 22 nt, Human herpesvirus 6
agcagcagaguccggcgcacgc

SEQ ID NO: 3989249 - RNA, 14 nt, Human herpesvirus 6
agcagcuagagaaa

SEQ ID NO: 3989250 - RNA, 21 nt, Human herpesvirus 6
agcauacagauguguauuaug

SEQ ID NO: 3989251 - RNA, 15 nt, Human herpesvirus 6
agcaucugcugcuuu

SEQ ID NO: 3989252 - RNA, 18 nt, Human herpesvirus 6
agcccuaauguuaaauaa

SEQ ID NO: 3989253 - RNA, 14 nt, Human herpesvirus 6
agccuaagaaauuu

SEQ ID NO: 3989254 - RNA, 22 nt, Human herpesvirus 6
agccucgacguccaccuggaaa

SEQ ID NO: 3989255 - RNA, 15 nt, Human herpesvirus 6
agccuuuauucuguu

SEQ ID NO: 3989256 - RNA, 21 nt, Human herpesvirus 6
agcgacucccggcccagagac

SEQ ID NO: 3989257 - RNA, 18 nt, Human herpesvirus 6
agcggaagugaaagcagu

SEQ ID NO: 3989258 - RNA, 19 nt, Human herpesvirus 6
agcgguagaguggaguugu

SEQ ID NO: 3989259 - RNA, 15 nt, Human herpesvirus 6
agcuaaaacuugaaa

SEQ ID NO: 3989260 - RNA, 20 nt, Human herpesvirus 6
agcuacgccaaaacuacaaa

SEQ ID NO: 3989261 - RNA, 22 nt, Human herpesvirus 6
agcucaagaggguuuuuuacaa

SEQ ID NO: 3989262 - RNA, 14 nt, Human herpesvirus 6
agcucuccugggca

SEQ ID NO: 3989263 - RNA, 16 nt, Human herpesvirus 6
agcugcgcugauccug

SEQ ID NO: 3989264 - RNA, 12 nt, Human herpesvirus 6
agcuggcugaca

SEQ ID NO: 3989265 - RNA, 15 nt, Human herpesvirus 6
agcuggggaguugcu

SEQ ID NO: 3989266 - RNA, 13 nt, Human herpesvirus 6
agcuuagggccaa

SEQ ID NO: 3989267 - RNA, 14 nt, Human herpesvirus 6
aggauaagaugauu

SEQ ID NO: 3989268 - RNA, 18 nt, Human herpesvirus 6
aggcaguaaagccgauga

SEQ ID NO: 3989269 - RNA, 16 nt, Human herpesvirus 6
aggcgaacgagaacuc

SEQ ID NO: 3989270 - RNA, 14 nt, Human herpesvirus 6
aggcuuaaugaaug

SEQ ID NO: 3989271 - RNA, 20 nt, Human herpesvirus 6
agggauggcagaucuugaaa

SEQ ID NO: 3989272 - RNA, 22 nt, Human herpesvirus 6
aggggaacacgccggggaccga

SEQ ID NO: 3989273 - RNA, 18 nt, Human herpesvirus 6
aggggagagacauccauu

SEQ ID NO: 3989274 - RNA, 22 nt, Human herpesvirus 6
aggggagagacauccauugagu

SEQ ID NO: 3989275 - RNA, 18 nt, Human herpesvirus 6
agguccgacacgccccca

SEQ ID NO: 3989276 - RNA, 19 nt, Human herpesvirus 6
aggugucucaaccuucauu

SEQ ID NO: 3989277 - RNA, 16 nt, Human herpesvirus 6
agguguuuccugccca

SEQ ID NO: 3989278 - RNA, 15 nt, Human herpesvirus 6
aguaaauauuucuaa

SEQ ID NO: 3989279 - RNA, 18 nt, Human herpesvirus 6
aguacauagaauuucuaa

SEQ ID NO: 3989280 - RNA, 13 nt, Human herpesvirus 6
agucacacacagg

SEQ ID NO: 3989281 - RNA, 19 nt, Human herpesvirus 6
aguccgcugggaauugcau

SEQ ID NO: 3989282 - RNA, 16 nt, Human herpesvirus 6
agugaaagcagucagu

SEQ ID NO: 3989283 - RNA, 17 nt, Human herpesvirus 6
aguguguucuuacaaug

SEQ ID NO: 3989284 - RNA, 19 nt, Human herpesvirus 6
aguuagaaauuuuaccuuu

SEQ ID NO: 3989285 - RNA, 20 nt, Human herpesvirus 6
aguuauauucuucuguaaau

SEQ ID NO: 3989286 - RNA, 13 nt, Human herpesvirus 6
aguuaugugcugu

SEQ ID NO: 3989287 - RNA, 15 nt, Human herpesvirus 6
aguucaacgcugucu

SEQ ID NO: 3989288 - RNA, 19 nt, Human herpesvirus 6
aguuccuguuuuucucgga

SEQ ID NO: 3989289 - RNA, 17 nt, Human herpesvirus 6
aguucuaugucuagaug

SEQ ID NO: 3989290 - RNA, 12 nt, Human herpesvirus 6
aguugguuuaaa

SEQ ID NO: 3989291 - RNA, 22 nt, Human herpesvirus 6
aguuucggcaacugaauuugca

SEQ ID NO: 3989292 - RNA, 23 nt, Human herpesvirus 6
aguuuuuccgauacagcaccauc

SEQ ID NO: 3989293 - RNA, 14 nt, Human herpesvirus 6
auaaaagaaucauu

SEQ ID NO: 3989294 - RNA, 18 nt, Human herpesvirus 6
auaaaaucuauugaagau

SEQ ID NO: 3989295 - RNA, 17 nt, Human herpesvirus 6
auaaaucgcuuaaagcg

SEQ ID NO: 3989296 - RNA, 18 nt, Human herpesvirus 6
auaaauugaugaaauugu

SEQ ID NO: 3989297 - RNA, 23 nt, Human herpesvirus 6
auaacaacaaccacagcagcagc

SEQ ID NO: 3989298 - RNA, 17 nt, Human herpesvirus 6
auaacgaugcuuuuauu

SEQ ID NO: 3989299 - RNA, 13 nt, Human herpesvirus 6
auaacugcauacg

SEQ ID NO: 3989300 - RNA, 14 nt, Human herpesvirus 6
auaaguacauagaa

SEQ ID NO: 3989301 - RNA, 13 nt, Human herpesvirus 6
auaauauuuccau

SEQ ID NO: 3989302 - RNA, 19 nt, Human herpesvirus 6
auaaucgauuacaaaacaa

SEQ ID NO: 3989303 - RNA, 17 nt, Human herpesvirus 6
auaauucagucugcuaa

SEQ ID NO: 3989304 - RNA, 13 nt, Human herpesvirus 6
auaauuuauggaa

SEQ ID NO: 3989305 - RNA, 14 nt, Human herpesvirus 6
auacagauguguau

SEQ ID NO: 3989306 - RNA, 19 nt, Human herpesvirus 6
auacauuuccaugcauauc

SEQ ID NO: 3989307 - RNA, 23 nt, Human herpesvirus 6
auacggcagcggaagugaaagca

SEQ ID NO: 3989308 - RNA, 16 nt, Human herpesvirus 6
auagauuagaaauuac

SEQ ID NO: 3989309 - RNA, 18 nt, Human herpesvirus 6
auagcucucccuuaaaga

SEQ ID NO: 3989310 - RNA, 15 nt, Human herpesvirus 6
auauaaaagcuaaau

SEQ ID NO: 3989311 - RNA, 23 nt, Human herpesvirus 6
auauaacgauauauaaaaaacug

SEQ ID NO: 3989312 - RNA, 20 nt, Human herpesvirus 6
auauaacgcuucuaacaaua

SEQ ID NO: 3989313 - RNA, 15 nt, Human herpesvirus 6
auauauauaucagaa

SEQ ID NO: 3989314 - RNA, 15 nt, Human herpesvirus 6
auaucgagccaaaga

SEQ ID NO: 3989315 - RNA, 17 nt, Human herpesvirus 6
auaucgagccaaagaaa

SEQ ID NO: 3989316 - RNA, 20 nt, Human herpesvirus 6
auaucugaaacacugaguuc

SEQ ID NO: 3989317 - RNA, 15 nt, Human herpesvirus 6
auaugcaaacugacu

SEQ ID NO: 3989318 - RNA, 14 nt, Human herpesvirus 6
auauuguguaacuc

SEQ ID NO: 3989319 - RNA, 12 nt, Human herpesvirus 6
auauuuccugcc

SEQ ID NO: 3989320 - RNA, 16 nt, Human herpesvirus 6
auauuuccugcccagg

SEQ ID NO: 3989321 - RNA, 21 nt, Human herpesvirus 6
aucaaauaucugaaacacuga

SEQ ID NO: 3989322 - RNA, 19 nt, Human herpesvirus 6
aucaaaucggacaaugcag

SEQ ID NO: 3989323 - RNA, 18 nt, Human herpesvirus 6
aucaacugacuuauaagu

SEQ ID NO: 3989324 - RNA, 12 nt, Human herpesvirus 6
aucacaaaauuu

SEQ ID NO: 3989325 - RNA, 18 nt, Human herpesvirus 6
aucacauuauaagacacu

SEQ ID NO: 3989326 - RNA, 18 nt, Human herpesvirus 6
aucaccuuacaaauaaua

SEQ ID NO: 3989327 - RNA, 18 nt, Human herpesvirus 6
aucagauuuggagaaaau

SEQ ID NO: 3989328 - RNA, 21 nt, Human herpesvirus 6
aucauauccugaaaauaaaca

SEQ ID NO: 3989329 - RNA, 15 nt, Human herpesvirus 6
cagaaguuuacauag

SEQ ID NO: 3989330 - RNA, 14 nt, Human herpesvirus 6
cagaccacaccccu

SEQ ID NO: 3989331 - RNA, 17 nt, Human herpesvirus 6
cagagacgacucgcgga

SEQ ID NO: 3989332 - RNA, 21 nt, Human herpesvirus 6
cagagagaggagcauucacau

SEQ ID NO: 3989333 - RNA, 12 nt, Human herpesvirus 6
cagaggaaauaa

SEQ ID NO: 3989334 - RNA, 23 nt, Human herpesvirus 6
cagaggaagauagcagaauagag

SEQ ID NO: 3989335 - RNA, 14 nt, Human herpesvirus 6
cagaggguuuagaa

SEQ ID NO: 3989336 - RNA, 16 nt, Human herpesvirus 6
cagcaauguaauaauu

SEQ ID NO: 3989337 - RNA, 16 nt, Human herpesvirus 6
cagcaucaccuggguu

SEQ ID NO: 3989338 - RNA, 18 nt, Human herpesvirus 6
cagccgguagagaguggg

SEQ ID NO: 3989339 - RNA, 11 nt, Human herpesvirus 6
cagcuggcuga

SEQ ID NO: 3989340 - RNA, 20 nt, Human herpesvirus 6
caggaucguccccuuggcuc

SEQ ID NO: 3989341 - RNA, 22 nt, Human herpesvirus 6
caggcaaccgccgugcuucugg

SEQ ID NO: 3989342 - RNA, 15 nt, Human herpesvirus 6
caggcgaacgaaaac

SEQ ID NO: 3989343 - RNA, 20 nt, Human herpesvirus 6
caggggaggagcguugccgu

SEQ ID NO: 3989344 - RNA, 15 nt, Human herpesvirus 6
cagguauaagaacug

SEQ ID NO: 3989345 - RNA, 18 nt, Human herpesvirus 6
caguaaaucuucauuaaa

SEQ ID NO: 3989346 - RNA, 20 nt, Human herpesvirus 6
caguaugucuccaaacagag

SEQ ID NO: 3989347 - RNA, 15 nt, Human herpesvirus 6
caguauuaauguuuu

SEQ ID NO: 3989348 - RNA, 14 nt, Human herpesvirus 6
cagucaguaaugau

SEQ ID NO: 3989349 - RNA, 22 nt, Human herpesvirus 6
cagucuacacacacgccgguua

SEQ ID NO: 3989350 - RNA, 16 nt, Human herpesvirus 6
cagugauauggaaaca

SEQ ID NO: 3989351 - RNA, 18 nt, Human herpesvirus 6
caguuucucgaaaaaaca

SEQ ID NO: 3989352 - RNA, 15 nt, Human herpesvirus 6
cauaacggaaaaaug

SEQ ID NO: 3989353 - RNA, 15 nt, Human herpesvirus 6
cauacacacccagca

SEQ ID NO: 3989354 - RNA, 22 nt, Human herpesvirus 6
cauacauuccuuaagaaugaaa

SEQ ID NO: 3989355 - RNA, 20 nt, Human herpesvirus 6
cauaggaauucuuauuuacc

SEQ ID NO: 3989356 - RNA, 13 nt, Human herpesvirus 6
cauaggugauuuc

SEQ ID NO: 3989357 - RNA, 18 nt, Human herpesvirus 6
caucaccgauaaaaacuc

SEQ ID NO: 3989358 - RNA, 17 nt, Human herpesvirus 6
caucagaauccagaaac

SEQ ID NO: 3989359 - RNA, 19 nt, Human herpesvirus 6
caucaugcugugagagaau

SEQ ID NO: 3989360 - RNA, 19 nt, Human herpesvirus 6
caucccuuaaaaaaacaca

SEQ ID NO: 3989361 - RNA, 20 nt, Human herpesvirus 6
caucgcgcgcgacgugccac

SEQ ID NO: 3989362 - RNA, 22 nt, Human herpesvirus 6
caucgcgcgcgacgugccaccg

SEQ ID NO: 3989363 - RNA, 22 nt, Human herpesvirus 6
caucucgugcaaaagcugacua

SEQ ID NO: 3989364 - RNA, 15 nt, Human herpesvirus 6
caucugcaaaaaaca

SEQ ID NO: 3989365 - RNA, 17 nt, Human herpesvirus 6
caucugcaaaaaacaaa

SEQ ID NO: 3989366 - RNA, 21 nt, Human herpesvirus 6
caugauuaucauagacaaacc

SEQ ID NO: 3989367 - RNA, 13 nt, Human herpesvirus 6
caugcaaaacaga

SEQ ID NO: 3989368 - RNA, 14 nt, Human herpesvirus 6
caugucggccucug

SEQ ID NO: 3989369 - RNA, 23 nt, Human herpesvirus 6
cauguguauauugaauuguauau

SEQ ID NO: 3989370 - RNA, 21 nt, Human herpesvirus 6
cauguucggagauaucauaau

SEQ ID NO: 3989371 - RNA, 17 nt, Human herpesvirus 6
cauucgguacucuuuuc

SEQ ID NO: 3989372 - RNA, 22 nt, Human herpesvirus 6
cauuuauuucguauguuuggau

SEQ ID NO: 3989373 - RNA, 11 nt, Human herpesvirus 6
ccaacacaccu

SEQ ID NO: 3989374 - RNA, 15 nt, Human herpesvirus 6
ccaacacaccugccu

SEQ ID NO: 3989375 - RNA, 12 nt, Human herpesvirus 6
ccaagugguggu

SEQ ID NO: 3989376 - RNA, 13 nt, Human herpesvirus 6
ccaauaaaauauc

SEQ ID NO: 3989377 - RNA, 16 nt, Human herpesvirus 6
ccacauguguauugga

SEQ ID NO: 3989378 - RNA, 14 nt, Human herpesvirus 6
ccacccccgcucga

SEQ ID NO: 3989379 - RNA, 17 nt, Human herpesvirus 6
ccaccgucugggaccca

SEQ ID NO: 3989380 - RNA, 16 nt, Human herpesvirus 6
ccacggaagaagagaa

SEQ ID NO: 3989381 - RNA, 21 nt, Human herpesvirus 6
ccacgugcuugucucacaagc

SEQ ID NO: 3989382 - RNA, 18 nt, Human herpesvirus 6
ccagauacauaaacaccc

SEQ ID NO: 3989383 - RNA, 17 nt, Human herpesvirus 6
ccauggaaaacaaagaa

SEQ ID NO: 3989384 - RNA, 12 nt, Human herpesvirus 6
ccauuauugugu

SEQ ID NO: 3989385 - RNA, 16 nt, Human herpesvirus 6
cccacaggcggggauc

SEQ ID NO: 3989386 - RNA, 16 nt, Human herpesvirus 6
cccagcgggcuccguc

SEQ ID NO: 3989387 - RNA, 15 nt, Human herpesvirus 6
cccaggcgaacgaga

SEQ ID NO: 3989388 - RNA, 19 nt, Human herpesvirus 6
cccauaccuguaaacuggu

SEQ ID NO: 3989389 - RNA, 14 nt, Human herpesvirus 6
cccauccaccuucc

SEQ ID NO: 3989390 - RNA, 14 nt, Human herpesvirus 6
cccauggcgagaaa

SEQ ID NO: 3989391 - RNA, 15 nt, Human herpesvirus 6
cccaugucuugccuc

SEQ ID NO: 3989392 - RNA, 23 nt, Human herpesvirus 6
ccccauacgauauaaaauuuaau

SEQ ID NO: 3989393 - RNA, 16 nt, Human herpesvirus 6
cccccggaguacacgu

SEQ ID NO: 3989394 - RNA, 19 nt, Human herpesvirus 6
ccccugccgagccugugga

SEQ ID NO: 3989395 - RNA, 14 nt, Human herpesvirus 6
cccggaguacacgu

SEQ ID NO: 3989396 - RNA, 19 nt, Human herpesvirus 6
cccucguccaaaucagacg

SEQ ID NO: 3989397 - RNA, 12 nt, Human herpesvirus 6
cccuguccccuc

SEQ ID NO: 3989398 - RNA, 21 nt, Human herpesvirus 6
ccgagcggcggauggagcccg

SEQ ID NO: 3989399 - RNA, 22 nt, Human herpesvirus 6
ccgaggggcggauccgcuccgc

SEQ ID NO: 3989400 - RNA, 14 nt, Human herpesvirus 6
ccgcaguuccuguu

SEQ ID NO: 3989401 - RNA, 15 nt, Human herpesvirus 6
ccgccggcccaucca

SEQ ID NO: 3989402 - RNA, 14 nt, Human herpesvirus 6
ccgcgggaccuggc

SEQ ID NO: 3989403 - RNA, 15 nt, Human herpesvirus 6
ccgcugacaaccucc

SEQ ID NO: 3989404 - RNA, 19 nt, Human herpesvirus 6
ccggagguaacggagcccg

SEQ ID NO: 3989405 - RNA, 14 nt, Human herpesvirus 6
ccggaguugcagug

SEQ ID NO: 3989406 - RNA, 16 nt, Human herpesvirus 6
ccggcuaacccuaacc

SEQ ID NO: 3989407 - RNA, 20 nt, Human herpesvirus 6
ccgguguuuagccuuuauuc

SEQ ID NO: 3989408 - RNA, 17 nt, Human herpesvirus 6
ccgguuacggaaaagau

SEQ ID NO: 3989409 - RNA, 20 nt, Human herpesvirus 6
ccgugcuucuggcacaggca

SEQ ID NO: 3989410 - RNA, 17 nt, Human herpesvirus 6
ccuaaauacauucacau

SEQ ID NO: 3989411 - RNA, 13 nt, Human herpesvirus 6
ccuaauaaauguc

SEQ ID NO: 3989412 - RNA, 23 nt, Human herpesvirus 6
ccuagacccugccuauacaggca

SEQ ID NO: 3989413 - RNA, 21 nt, Human herpesvirus 6
ccucaaacuuuuagagacuuu

SEQ ID NO: 3989414 - RNA, 21 nt, Human herpesvirus 6
ccucgcgcaccgccuccgcca

SEQ ID NO: 3989415 - RNA, 17 nt, Human herpesvirus 6
ccucgugcucugccucg

SEQ ID NO: 3989416 - RNA, 16 nt, Human herpesvirus 6
ccugaaacuccccaga

SEQ ID NO: 3989417 - RNA, 16 nt, Human herpesvirus 6
ccugaucacagagcag

SEQ ID NO: 3989418 - RNA, 10 nt, Human herpesvirus 6
ccugcccagg

SEQ ID NO: 3989419 - RNA, 21 nt, Human herpesvirus 6
ccuggcggacaccgagggcgg

SEQ ID NO: 3989420 - RNA, 15 nt, Human herpesvirus 6
ccuuacggggagcuu

SEQ ID NO: 3989421 - RNA, 13 nt, Human herpesvirus 6
ccuucggccgaca

SEQ ID NO: 3989422 - RNA, 14 nt, Human herpesvirus 6
ccuuuaaccauguu

SEQ ID NO: 3989423 - RNA, 23 nt, Human herpesvirus 6
ccuuucucugcgccaaccuucua

SEQ ID NO: 3989424 - RNA, 21 nt, Human herpesvirus 6
cgaaaacucuaaaagcugcua

SEQ ID NO: 3989425 - RNA, 14 nt, Human herpesvirus 6
cgaaaaucgccagg

SEQ ID NO: 3989426 - RNA, 22 nt, Human herpesvirus 6
cgaaaccaucgucauaaccuca

SEQ ID NO: 3989427 - RNA, 16 nt, Human herpesvirus 6
cgaaggagauuucagg

SEQ ID NO: 3989428 - RNA, 14 nt, Human herpesvirus 6
cgaagugcuucucu

SEQ ID NO: 3989429 - RNA, 18 nt, Human herpesvirus 6
cgacaagaaaauaaaaaa

SEQ ID NO: 3989430 - RNA, 14 nt, Human herpesvirus 6
cgacagaugugugu

SEQ ID NO: 3989431 - RNA, 11 nt, Human herpesvirus 6
cgacccacucc

SEQ ID NO: 3989432 - RNA, 20 nt, Human herpesvirus 6
cgagcggcggauggagcccg

SEQ ID NO: 3989433 - RNA, 21 nt, Human herpesvirus 6
cgaggggcggauccgcuccgc

SEQ ID NO: 3989434 - RNA, 21 nt, Human herpesvirus 6
cgaguuagcagaagaacagcu

SEQ ID NO: 3989435 - RNA, 20 nt, Human herpesvirus 6
cgaucucucucagaucgaga

SEQ ID NO: 3989436 - RNA, 22 nt, Human herpesvirus 6
cgaugacggcgauacguuucug

SEQ ID NO: 3989437 - RNA, 18 nt, Human herpesvirus 6
cgaugucggaaucuacug

SEQ ID NO: 3989438 - RNA, 21 nt, Human herpesvirus 6
cgauguggagcggaaacauga

SEQ ID NO: 3989439 - RNA, 11 nt, Human herpesvirus 6
cgauguuuuca

SEQ ID NO: 3989440 - RNA, 14 nt, Human herpesvirus 6
cgcauguugcaguu

SEQ ID NO: 3989441 - RNA, 14 nt, Human herpesvirus 6
cgccaguguggaua

SEQ ID NO: 3989442 - RNA, 13 nt, Human herpesvirus 6
cgccauaauggaa

SEQ ID NO: 3989443 - RNA, 12 nt, Human herpesvirus 6
cgcccccaccuc

SEQ ID NO: 3989444 - RNA, 16 nt, Human herpesvirus 6
gaaacuccccagagaa

SEQ ID NO: 3989445 - RNA, 13 nt, Human herpesvirus 6
gaaacucuuauaa

SEQ ID NO: 3989446 - RNA, 21 nt, Human herpesvirus 6
gaaacucuuauaacaagcacu

SEQ ID NO: 3989447 - RNA, 14 nt, Human herpesvirus 6
gaaagacagaggaa

SEQ ID NO: 3989448 - RNA, 16 nt, Human herpesvirus 6
gaaagaggacgggaag

SEQ ID NO: 3989449 - RNA, 15 nt, Human herpesvirus 6
gaaagccggugaccg

SEQ ID NO: 3989450 - RNA, 22 nt, Human herpesvirus 6
gaaauuacaagguacacaauau

SEQ ID NO: 3989451 - RNA, 20 nt, Human herpesvirus 6
gaaauuugagaaaguuguac

SEQ ID NO: 3989452 - RNA, 16 nt, Human herpesvirus 6
gaaauuuuugacugau

SEQ ID NO: 3989453 - RNA, 21 nt, Human herpesvirus 6
gaacauacaaaggaggugcgu

SEQ ID NO: 3989454 - RNA, 14 nt, Human herpesvirus 6
gaacucucacggcc

SEQ ID NO: 3989455 - RNA, 19 nt, Human herpesvirus 6
gaacuggugucugucuauu

SEQ ID NO: 3989456 - RNA, 16 nt, Human herpesvirus 6
gaagaaccugaaaucu

SEQ ID NO: 3989457 - RNA, 14 nt, Human herpesvirus 6
gaagacuuuaaagu

SEQ ID NO: 3989458 - RNA, 17 nt, Human herpesvirus 6
gaagcgguagaguggag

SEQ ID NO: 3989459 - RNA, 17 nt, Human herpesvirus 6
gaagucuucuugggcuc

SEQ ID NO: 3989460 - RNA, 14 nt, Human herpesvirus 6
gaagugaaagcagu

SEQ ID NO: 3989461 - RNA, 17 nt, Human herpesvirus 6
gaaguuagaaauuuuac

SEQ ID NO: 3989462 - RNA, 14 nt, Human herpesvirus 6
gaauaacagaugag

SEQ ID NO: 3989463 - RNA, 13 nt, Human herpesvirus 6
gaauagagauuuu

SEQ ID NO: 3989464 - RNA, 22 nt, Human herpesvirus 6
gaaucaaugaaaaaaaaugaag

SEQ ID NO: 3989465 - RNA, 22 nt, Human herpesvirus 6
gaaucagaucacucagauuuca

SEQ ID NO: 3989466 - RNA, 13 nt, Human herpesvirus 6
gaaugagauguuc

SEQ ID NO: 3989467 - RNA, 22 nt, Human herpesvirus 6
gaauuucgucuccugggagcuc

SEQ ID NO: 3989468 - RNA, 20 nt, Human herpesvirus 6
gaauuuguccguauacagcu

SEQ ID NO: 3989469 - RNA, 18 nt, Human herpesvirus 6
gacaaagaaccggcgugu

SEQ ID NO: 3989470 - RNA, 15 nt, Human herpesvirus 6
gacaaccuccgcaua

SEQ ID NO: 3989471 - RNA, 21 nt, Human herpesvirus 6
gacaauucaaaacgacaucgc

SEQ ID NO: 3989472 - RNA, 22 nt, Human herpesvirus 6
gacaccucaauuaauacaaaau

SEQ ID NO: 3989473 - RNA, 15 nt, Human herpesvirus 6
gacacgcuggagcag

SEQ ID NO: 3989474 - RNA, 19 nt, Human herpesvirus 6
gacaguauuuacugagcaa

SEQ ID NO: 3989475 - RNA, 20 nt, Human herpesvirus 6
gacaucgaccgccggaggua

SEQ ID NO: 3989476 - RNA, 17 nt, Human herpesvirus 6
gaccaauuuaugucauu

SEQ ID NO: 3989477 - RNA, 15 nt, Human herpesvirus 6
gacgacgggcggggc

SEQ ID NO: 3989478 - RNA, 22 nt, Human herpesvirus 6
gacggccuccggccccagagac

SEQ ID NO: 3989479 - RNA, 17 nt, Human herpesvirus 6
gacgggcggggcggacg

SEQ ID NO: 3989480 - RNA, 16 nt, Human herpesvirus 6
gacgucgacgaaauaa

SEQ ID NO: 3989481 - RNA, 19 nt, Human herpesvirus 6
gacgugccaccgucuggga

SEQ ID NO: 3989482 - RNA, 22 nt, Human herpesvirus 6
gacgugccaccgucugggaccc

SEQ ID NO: 3989483 - RNA, 23 nt, Human herpesvirus 6
gacuacagacuccccaccgagau

SEQ ID NO: 3989484 - RNA, 13 nt, Human herpesvirus 6
gacuacagcugca

SEQ ID NO: 3989485 - RNA, 19 nt, Human herpesvirus 6
gacuacucuggcugaaaga

SEQ ID NO: 3989486 - RNA, 19 nt, Human herpesvirus 6
gacuauacgaaauaaucga

SEQ ID NO: 3989487 - RNA, 16 nt, Human herpesvirus 6
gacucgccgaugaaac

SEQ ID NO: 3989488 - RNA, 22 nt, Human herpesvirus 6
gacucuaaauacggaccgagag

SEQ ID NO: 3989489 - RNA, 21 nt, Human herpesvirus 6
gacuggaaaacuaugugcauu

SEQ ID NO: 3989490 - RNA, 22 nt, Human herpesvirus 6
gacuguuuauuuucucgacauc

SEQ ID NO: 3989491 - RNA, 23 nt, Human herpesvirus 6
gacuuacagagcuuuuaaagaau

SEQ ID NO: 3989492 - RNA, 16 nt, Human herpesvirus 6
gacuuuuuaacaaaau

SEQ ID NO: 3989493 - RNA, 23 nt, Human herpesvirus 6
gagacaccagccgguagagagug

SEQ ID NO: 3989494 - RNA, 17 nt, Human herpesvirus 6
gagaccuacacuuuucc

SEQ ID NO: 3989495 - RNA, 15 nt, Human herpesvirus 6
gagacgaaacauagu

SEQ ID NO: 3989496 - RNA, 19 nt, Human herpesvirus 6
gagacgacucgcggagugg

SEQ ID NO: 3989497 - RNA, 23 nt, Human herpesvirus 6
gagagagcgugcacacaaacagu

SEQ ID NO: 3989498 - RNA, 14 nt, Human herpesvirus 6
gagaguggggacaa

SEQ ID NO: 3989499 - RNA, 13 nt, Human herpesvirus 6
gagcacacacgcc

SEQ ID NO: 3989500 - RNA, 23 nt, Human herpesvirus 6
gagcacgcacgacaacacgccag

SEQ ID NO: 3989501 - RNA, 18 nt, Human herpesvirus 6
gagcacgguccacacgcc

SEQ ID NO: 3989502 - RNA, 22 nt, Human herpesvirus 6
gagcgugccguaaaucugcguc

SEQ ID NO: 3989503 - RNA, 17 nt, Human herpesvirus 6
gagcuaauaugaacaau

SEQ ID NO: 3989504 - RNA, 16 nt, Human herpesvirus 6
gaggaaaugcagcagu

SEQ ID NO: 3989505 - RNA, 16 nt, Human herpesvirus 6
gaguuuccgggcaugg

SEQ ID NO: 3989506 - RNA, 19 nt, Human herpesvirus 6
gaucaguggguaccgcggu

SEQ ID NO: 3989507 - RNA, 23 nt, Human herpesvirus 6
gaucuaaauuucuacaaaaauac

SEQ ID NO: 3989508 - RNA, 20 nt, Human herpesvirus 6
gaucugauucgacaaaucau

SEQ ID NO: 3989509 - RNA, 14 nt, Human herpesvirus 6
gaucuugaucaaau

SEQ ID NO: 3989510 - RNA, 19 nt, Human herpesvirus 6
gaugaagcgguuagagcug

SEQ ID NO: 3989511 - RNA, 15 nt, Human herpesvirus 6
gauguuuuccuuuau

SEQ ID NO: 3989512 - RNA, 18 nt, Human herpesvirus 6
gauuagaaauuacauaag

SEQ ID NO: 3989513 - RNA, 19 nt, Human herpesvirus 6
gauuaugccgucuuauucc

SEQ ID NO: 3989514 - RNA, 19 nt, Human herpesvirus 6
gauugcaacauuuuccucu

SEQ ID NO: 3989515 - RNA, 23 nt, Human herpesvirus 6
gauuucacuuaagccagcuuucg

SEQ ID NO: 3989516 - RNA, 15 nt, Human herpesvirus 6
gauuuuuauucugcu

SEQ ID NO: 3989517 - RNA, 21 nt, Human herpesvirus 6
gcaaucaaucuucuggguggg

SEQ ID NO: 3989518 - RNA, 19 nt, Human herpesvirus 6
gcaaucauuagcauacaga

SEQ ID NO: 3989519 - RNA, 16 nt, Human herpesvirus 6
gcaauuuccugucaug

SEQ ID NO: 3989520 - RNA, 15 nt, Human herpesvirus 6
gcacacauguauuua

SEQ ID NO: 3989521 - RNA, 13 nt, Human herpesvirus 6
gcacaggcgaacg

SEQ ID NO: 3989522 - RNA, 14 nt, Human herpesvirus 6
gcacauaacugcau

SEQ ID NO: 3989523 - RNA, 16 nt, Human herpesvirus 6
gcaccucugaaacacu

SEQ ID NO: 3989524 - RNA, 19 nt, Human herpesvirus 6
gcacgcacgacaacacgcc

SEQ ID NO: 3989525 - RNA, 16 nt, Human herpesvirus 6
gcacuguuugaaacug

SEQ ID NO: 3989526 - RNA, 21 nt, Human herpesvirus 6
gcagaguccggcgcacgcaca

SEQ ID NO: 3989527 - RNA, 21 nt, Human herpesvirus 6
gcagcaucauguucggagaua

SEQ ID NO: 3989528 - RNA, 15 nt, Human herpesvirus 6
gcagcuuccacgcga

SEQ ID NO: 3989529 - RNA, 13 nt, Human herpesvirus 6
gcaggaaucaugu

SEQ ID NO: 3989530 - RNA, 17 nt, Human herpesvirus 6
gcaggauaauuuaugga

SEQ ID NO: 3989531 - RNA, 21 nt, Human herpesvirus 6
gcagggggggucucuguucug

SEQ ID NO: 3989532 - RNA, 14 nt, Human herpesvirus 6
gcaguggacggcgg

SEQ ID NO: 3989533 - RNA, 19 nt, Human herpesvirus 6
gcauacguuugccaaagcu

SEQ ID NO: 3989534 - RNA, 13 nt, Human herpesvirus 6
gcauucgguacuc

SEQ ID NO: 3989535 - RNA, 10 nt, Human herpesvirus 6
gccaaaauau

SEQ ID NO: 3989536 - RNA, 16 nt, Human herpesvirus 6
gccaaaggaaaccacc

SEQ ID NO: 3989537 - RNA, 18 nt, Human herpesvirus 6
gccaaaggaaaccaccgg

SEQ ID NO: 3989538 - RNA, 11 nt, Human herpesvirus 6
gccaaauguau

SEQ ID NO: 3989539 - RNA, 21 nt, Human herpesvirus 6
gccaucuaucgcgcaccgcug

SEQ ID NO: 3989540 - RNA, 20 nt, Human herpesvirus 6
gcccgccggcccauccaccu

SEQ ID NO: 3989541 - RNA, 11 nt, Human herpesvirus 6
gcccugcuccg

SEQ ID NO: 3989542 - RNA, 14 nt, Human herpesvirus 6
gccgagccugugga

SEQ ID NO: 3989543 - RNA, 15 nt, Human herpesvirus 6
gccgaugaaacuguc

SEQ ID NO: 3989544 - RNA, 23 nt, Human herpesvirus 6
gccgcugcagaaaaacggcagcu

SEQ ID NO: 3989545 - RNA, 16 nt, Human herpesvirus 6
gccgcugcggucgccg

SEQ ID NO: 3989546 - RNA, 14 nt, Human herpesvirus 6
gccugaaaaugaag

SEQ ID NO: 3989547 - RNA, 13 nt, Human herpesvirus 6
gccugcucagagc

SEQ ID NO: 3989548 - RNA, 15 nt, Human herpesvirus 6
gccugcucagagcug

SEQ ID NO: 3989549 - RNA, 19 nt, Human herpesvirus 6
gccuggcacggugccaaag

SEQ ID NO: 3989550 - RNA, 15 nt, Human herpesvirus 6
gccuguuuuagucua

SEQ ID NO: 3989551 - RNA, 17 nt, Human herpesvirus 6
gcgaaugcucaaccuaa

SEQ ID NO: 3989552 - RNA, 17 nt, Human herpesvirus 6
gcgaauuuguuaagcaa

SEQ ID NO: 3989553 - RNA, 13 nt, Human herpesvirus 6
gcgacaaccgccg

SEQ ID NO: 3989554 - RNA, 19 nt, Human herpesvirus 6
gcgaucauaaaacugccaa

SEQ ID NO: 3989555 - RNA, 20 nt, Human herpesvirus 6
gcgaucgcugacucgccuuu

SEQ ID NO: 3989556 - RNA, 22 nt, Human herpesvirus 6
gcgcaauucuucucuacaucga

SEQ ID NO: 3989557 - RNA, 17 nt, Human herpesvirus 6
gcgcgaggugacggagg

SEQ ID NO: 3989558 - RNA, 13 nt, Human herpesvirus 6
aaaaaaacacuag

SEQ ID NO: 3989559 - RNA, 13 nt, Human herpesvirus 6
aaaaaaucuaucc

SEQ ID NO: 3989560 - RNA, 21 nt, Human herpesvirus 6
aaaaacacuagccuacuauga

SEQ ID NO: 3989561 - RNA, 20 nt, Human herpesvirus 6
aaaaacaucguaauggcauu

SEQ ID NO: 3989562 - RNA, 11 nt, Human herpesvirus 6
aaaaacauuuc

SEQ ID NO: 3989563 - RNA, 15 nt, Human herpesvirus 6
aaaaacugacugaca

SEQ ID NO: 3989564 - RNA, 20 nt, Human herpesvirus 6
aaaaagagaggaaagaauua

SEQ ID NO: 3989565 - RNA, 23 nt, Human herpesvirus 6
aaaaaguuagcggggagucucca

SEQ ID NO: 3989566 - RNA, 15 nt, Human herpesvirus 6
aaaaauugacaauga

SEQ ID NO: 3989567 - RNA, 22 nt, Human herpesvirus 6
aaaacacaaaccaucaauuuua

SEQ ID NO: 3989568 - RNA, 15 nt, Human herpesvirus 6
aaaacaguauaacgg

SEQ ID NO: 3989569 - RNA, 22 nt, Human herpesvirus 6
aaaacaguuuaccuauuuacaa

SEQ ID NO: 3989570 - RNA, 19 nt, Human herpesvirus 6
aaaacauaccgacguaaua

SEQ ID NO: 3989571 - RNA, 18 nt, Human herpesvirus 6
aaaaccuuauacagaugu

SEQ ID NO: 3989572 - RNA, 16 nt, Human herpesvirus 6
aaaacucgcaccucug

SEQ ID NO: 3989573 - RNA, 22 nt, Human herpesvirus 6
aaaacugcauggugagcaaaau

SEQ ID NO: 3989574 - RNA, 16 nt, Human herpesvirus 6
aaaauagauggcuuug

SEQ ID NO: 3989575 - RNA, 17 nt, Human herpesvirus 6
aaaaugcguuugucauu

SEQ ID NO: 3989576 - RNA, 12 nt, Human herpesvirus 6
aaaauuaaaagu

SEQ ID NO: 3989577 - RNA, 14 nt, Human herpesvirus 6
aaacaaauggaaac

SEQ ID NO: 3989578 - RNA, 13 nt, Human herpesvirus 6
aaacacagauggu

SEQ ID NO: 3989579 - RNA, 22 nt, Human herpesvirus 6
aaacaccgguaagcaucugcug

SEQ ID NO: 3989580 - RNA, 14 nt, Human herpesvirus 6
aaacagagacuggu

SEQ ID NO: 3989581 - RNA, 13 nt, Human herpesvirus 6
aaacaguaaauuc

SEQ ID NO: 3989582 - RNA, 14 nt, Human herpesvirus 6
aaacauguuguucu

SEQ ID NO: 3989583 - RNA, 16 nt, Human herpesvirus 6
aaaccuuauacagaug

SEQ ID NO: 3989584 - RNA, 13 nt, Human herpesvirus 6
aaacucaccgcau

SEQ ID NO: 3989585 - RNA, 18 nt, Human herpesvirus 6
aaacucuaaaagcugcua

SEQ ID NO: 3989586 - RNA, 19 nt, Human herpesvirus 6
aaacuggucugcuugcaaa

SEQ ID NO: 3989587 - RNA, 15 nt, Human herpesvirus 6
aaagaaucaaugaaa

SEQ ID NO: 3989588 - RNA, 12 nt, Human herpesvirus 6
aaagcaaacaug

SEQ ID NO: 3989589 - RNA, 19 nt, Human herpesvirus 6
aaagcauuuuuguugugau

SEQ ID NO: 3989590 - RNA, 18 nt, Human herpesvirus 6
aaaguuaagaaaacauga

SEQ ID NO: 3989591 - RNA, 21 nt, Human herpesvirus 6
aaauaaaaacaccucuaaaac

SEQ ID NO: 3989592 - RNA, 18 nt, Human herpesvirus 6
aaauaaaguuaaauugau

SEQ ID NO: 3989593 - RNA, 15 nt, Human herpesvirus 6
aaauagcagcaauca

SEQ ID NO: 3989594 - RNA, 21 nt, Human herpesvirus 6
aaauauuaaucguuacaaaau

SEQ ID NO: 3989595 - RNA, 23 nt, Human herpesvirus 6
aaauccuccuagggaauuuaauc

SEQ ID NO: 3989596 - RNA, 19 nt, Human herpesvirus 6
aaaucgguuaaagaaucug

SEQ ID NO: 3989597 - RNA, 18 nt, Human herpesvirus 6
aaaucuacuguacaaaau

SEQ ID NO: 3989598 - RNA, 21 nt, Human herpesvirus 6
aaauuuugaugccaaagcuuu

SEQ ID NO: 3989599 - RNA, 23 nt, Human herpesvirus 6
aacaaagguaccacggggauuua

SEQ ID NO: 3989600 - RNA, 20 nt, Human herpesvirus 6
aacaagauccaaucacaaca

SEQ ID NO: 3989601 - RNA, 21 nt, Human herpesvirus 6
aacagggagugauugaugaaa

SEQ ID NO: 3989602 - RNA, 15 nt, Human herpesvirus 6
aacaguauaacggaa

SEQ ID NO: 3989603 - RNA, 23 nt, Human herpesvirus 6
aacaguuuaccuauuuacaaugu

SEQ ID NO: 3989604 - RNA, 15 nt, Human herpesvirus 6
aacauagaaaaauga

SEQ ID NO: 3989605 - RNA, 17 nt, Human herpesvirus 6
aacaucaguaacaccgu

SEQ ID NO: 3989606 - RNA, 14 nt, Human herpesvirus 6
aacaucccggaaau

SEQ ID NO: 3989607 - RNA, 21 nt, Human herpesvirus 6
aacaugagggacucggaaaag

SEQ ID NO: 3989608 - RNA, 22 nt, Human herpesvirus 6
aacaugagggacucggaaaagg

SEQ ID NO: 3989609 - RNA, 12 nt, Human herpesvirus 6
aacauuguaaau

SEQ ID NO: 3989610 - RNA, 14 nt, Human herpesvirus 6
aaccaccggcuaac

SEQ ID NO: 3989611 - RNA, 22 nt, Human herpesvirus 6
aaccaccggcuaacccuaaccc

SEQ ID NO: 3989612 - RNA, 15 nt, Human herpesvirus 6
aaccaugucuugcaa

SEQ ID NO: 3989613 - RNA, 12 nt, Human herpesvirus 6
aaccuaaauaca

SEQ ID NO: 3989614 - RNA, 12 nt, Human herpesvirus 6
aacgaaaaagaa

SEQ ID NO: 3989615 - RNA, 21 nt, Human herpesvirus 6
aacgagaacgcucuugccgaa

SEQ ID NO: 3989616 - RNA, 19 nt, Human herpesvirus 6
aacgcgucgguaaacaauu

SEQ ID NO: 3989617 - RNA, 13 nt, Human herpesvirus 6
aacgcuccucccc

SEQ ID NO: 3989618 - RNA, 17 nt, Human herpesvirus 6
aacuauauugcugcuag

SEQ ID NO: 3989619 - RNA, 15 nt, Human herpesvirus 6
aacuaucggagagac

SEQ ID NO: 3989620 - RNA, 22 nt, Human herpesvirus 6
aacucacacaaccauccagaua

SEQ ID NO: 3989621 - RNA, 21 nt, Human herpesvirus 6
aacuuuuuucggauuuugaau

SEQ ID NO: 3989622 - RNA, 21 nt, Human herpesvirus 6
aagaacacgaagacgaagagg

SEQ ID NO: 3989623 - RNA, 17 nt, Human herpesvirus 6
aagaaugggauugugau

SEQ ID NO: 3989624 - RNA, 17 nt, Human herpesvirus 6
aagacagaccacacccc

SEQ ID NO: 3989625 - RNA, 18 nt, Human herpesvirus 6
aagacgaaaaauuuuacg

SEQ ID NO: 3989626 - RNA, 21 nt, Human herpesvirus 6
aagagugggaugcauuauacu

SEQ ID NO: 3989627 - RNA, 13 nt, Human herpesvirus 6
aagaucagugggu

SEQ ID NO: 3989628 - RNA, 16 nt, Human herpesvirus 6
aagauuacggcaacau

SEQ ID NO: 3989629 - RNA, 15 nt, Human herpesvirus 6
aagcagucaguaaug

SEQ ID NO: 3989630 - RNA, 20 nt, Human herpesvirus 6
aagcgucaacggcuucaaga

SEQ ID NO: 3989631 - RNA, 14 nt, Human herpesvirus 6
aagcucauuuucuc

SEQ ID NO: 3989632 - RNA, 14 nt, Human herpesvirus 6
aagcuggaaaacua

SEQ ID NO: 3989633 - RNA, 19 nt, Human herpesvirus 6
aagcuuuaaagcagcuaga

SEQ ID NO: 3989634 - RNA, 17 nt, Human herpesvirus 6
aaggauuaugaucauau

SEQ ID NO: 3989635 - RNA, 20 nt, Human herpesvirus 6
aaguaauauagacauugcuu

SEQ ID NO: 3989636 - RNA, 20 nt, Human herpesvirus 6
aagugggccucguuguuuca

SEQ ID NO: 3989637 - RNA, 16 nt, Human herpesvirus 6
aaguucuacaaaaagu

SEQ ID NO: 3989638 - RNA, 16 nt, Human herpesvirus 6
aaguuuacauagaaau

SEQ ID NO: 3989639 - RNA, 15 nt, Human herpesvirus 6
aaguuucagagguuu

SEQ ID NO: 3989640 - RNA, 21 nt, Human herpesvirus 6
aauaaauacuagcuaaaacuu

SEQ ID NO: 3989641 - RNA, 12 nt, Human herpesvirus 6
aauaacagauga

SEQ ID NO: 3989642 - RNA, 12 nt, Human herpesvirus 6
aauaagauguug

SEQ ID NO: 3989643 - RNA, 13 nt, Human herpesvirus 6
aauaauaaaaagu

SEQ ID NO: 3989644 - RNA, 17 nt, Human herpesvirus 6
aauaaucgauuacaaaa

SEQ ID NO: 3989645 - RNA, 20 nt, Human herpesvirus 6
aauaaucgauuacaaaacaa

SEQ ID NO: 3989646 - RNA, 21 nt, Human herpesvirus 6
aauacuucucuuuauagagca

SEQ ID NO: 3989647 - RNA, 12 nt, Human herpesvirus 6
aauauagacuuu

SEQ ID NO: 3989648 - RNA, 15 nt, Human herpesvirus 6
aauaugauggacaaa

SEQ ID NO: 3989649 - RNA, 23 nt, Human herpesvirus 6
aauauuuccauaaguuaauucca

SEQ ID NO: 3989650 - RNA, 20 nt, Human herpesvirus 6
aaucaaaaaaauuuugaugc

SEQ ID NO: 3989651 - RNA, 14 nt, Human herpesvirus 6
aaucauuguuugaa

SEQ ID NO: 3989652 - RNA, 18 nt, Human herpesvirus 6
aaucauuguuugaauaac

SEQ ID NO: 3989653 - RNA, 20 nt, Human herpesvirus 6
aauccagaaacuugcuccug

SEQ ID NO: 3989654 - RNA, 21 nt, Human herpesvirus 6
aaucugagcucuccugggcau

SEQ ID NO: 3989655 - RNA, 16 nt, Human herpesvirus 6
aaucuguccagcuugc

SEQ ID NO: 3989656 - RNA, 17 nt, Human herpesvirus 6
aaugaauuuauuuucaa

SEQ ID NO: 3989657 - RNA, 18 nt, Human herpesvirus 6
aaugagcccgguuuaaga

SEQ ID NO: 3989658 - RNA, 14 nt, Human herpesvirus 6
aauguguuuuucuu

SEQ ID NO: 3989659 - RNA, 12 nt, Human herpesvirus 6
aauguugcaugg

SEQ ID NO: 3989660 - RNA, 15 nt, Human herpesvirus 6
aauguuuuguggcuc

SEQ ID NO: 3989661 - RNA, 18 nt, Human herpesvirus 6
aauguuuuugacaaauaa

SEQ ID NO: 3989662 - RNA, 19 nt, Human herpesvirus 6
aauuacauaagcaaaugua

SEQ ID NO: 3989663 - RNA, 21 nt, Human herpesvirus 6
aauuauccuauugguuugcau

SEQ ID NO: 3989664 - RNA, 14 nt, Human herpesvirus 6
aauuauuuugugau

SEQ ID NO: 3989665 - RNA, 18 nt, Human herpesvirus 6
aauucaaaauaaauacua

SEQ ID NO: 3989666 - RNA, 17 nt, Human herpesvirus 6
aauucauuguacgauaa

SEQ ID NO: 3989667 - RNA, 19 nt, Human herpesvirus 6
aauuccuuaauucuaaaua

SEQ ID NO: 3989668 - RNA, 14 nt, Human herpesvirus 6
aauucuuauuuacc

SEQ ID NO: 3989669 - RNA, 17 nt, Human herpesvirus 6
aauuguauucuugaaaa

SEQ ID NO: 3989670 - RNA, 19 nt, Human herpesvirus 6
aauuuaauaagaaagcagu

SEQ ID NO: 3989671 - RNA, 21 nt, Human herpesvirus 6
aauuucuaaccauuuugaaaa

SEQ ID NO: 3989672 - RNA, 12 nt, Human herpesvirus 6
aauuuuaaaugc

SEQ ID NO: 3989673 - RNA, 18 nt, Human herpesvirus 6
acaaaagacaaaacucau

SEQ ID NO: 3989674 - RNA, 18 nt, Human herpesvirus 6
acaaaaucuucuuugugc

SEQ ID NO: 3989675 - RNA, 17 nt, Human herpesvirus 6
acaaagaaucaaugaaa

SEQ ID NO: 3989676 - RNA, 15 nt, Human herpesvirus 6
acaaauaaaaaauuc

SEQ ID NO: 3989677 - RNA, 15 nt, Human herpesvirus 6
acaaauuuuaaaugc

SEQ ID NO: 3989678 - RNA, 16 nt, Human herpesvirus 6
acaaccgccgccgccg

SEQ ID NO: 3989679 - RNA, 16 nt, Human herpesvirus 6
acaauauuucacauau

SEQ ID NO: 3989680 - RNA, 14 nt, Human herpesvirus 6
acaaucaaaugggu

SEQ ID NO: 3989681 - RNA, 14 nt, Human herpesvirus 6
acaaucaugugcau

SEQ ID NO: 3989682 - RNA, 21 nt, Human herpesvirus 6
acaaugcaugucgaacagcuu

SEQ ID NO: 3989683 - RNA, 15 nt, Human herpesvirus 6
acacaaaaaauugac

SEQ ID NO: 3989684 - RNA, 11 nt, Human herpesvirus 6
acacacccagc

SEQ ID NO: 3989685 - RNA, 21 nt, Human herpesvirus 6
acaccacucuguuuuuuugca

SEQ ID NO: 3989686 - RNA, 21 nt, Human herpesvirus 6
acaccgauucagaaaguucua

SEQ ID NO: 3989687 - RNA, 22 nt, Human herpesvirus 6
acacgacaaaacaaucagccug

SEQ ID NO: 3989688 - RNA, 21 nt, Human herpesvirus 6
acacgcuggagcagcuuccac

SEQ ID NO: 3989689 - RNA, 19 nt, Human herpesvirus 6
acagaaaaaaaaauaagua

SEQ ID NO: 3989690 - RNA, 16 nt, Human herpesvirus 6
acagaagacgacauac

SEQ ID NO: 3989691 - RNA, 13 nt, Human herpesvirus 6
acagacagaggaa

SEQ ID NO: 3989692 - RNA, 11 nt, Human herpesvirus 6
acagauugcau

SEQ ID NO: 3989693 - RNA, 16 nt, Human herpesvirus 6
acagcaccaucaauaa

SEQ ID NO: 3989694 - RNA, 12 nt, Human herpesvirus 6
acagcggacagc

SEQ ID NO: 3989695 - RNA, 21 nt, Human herpesvirus 6
acaguaugucuccaaacagag

SEQ ID NO: 3989696 - RNA, 22 nt, Human herpesvirus 6
acaguuuaccuauuuacaaugu

SEQ ID NO: 3989697 - RNA, 16 nt, Human herpesvirus 6
acauaucgagccaaag

SEQ ID NO: 3989698 - RNA, 18 nt, Human herpesvirus 6
acaucaccgauaaaaacu

SEQ ID NO: 3989699 - RNA, 23 nt, Human herpesvirus 6
acauccagaaaagcaaacaugca

SEQ ID NO: 3989700 - RNA, 21 nt, Human herpesvirus 6
acauccugcguguuaaugaau

SEQ ID NO: 3989701 - RNA, 13 nt, Human herpesvirus 6
acaucgauccaaa

SEQ ID NO: 3989702 - RNA, 20 nt, Human herpesvirus 6
acauguuguucuugucuuuu

SEQ ID NO: 3989703 - RNA, 18 nt, Human herpesvirus 6
acauucguauacuuccuc

SEQ ID NO: 3989704 - RNA, 22 nt, Human herpesvirus 6
acauuguaaauagguaaacugu

SEQ ID NO: 3989705 - RNA, 20 nt, Human herpesvirus 6
acauuuaauaaagaacaugu

SEQ ID NO: 3989706 - RNA, 17 nt, Human herpesvirus 6
acauuuuguacaaacuu

SEQ ID NO: 3989707 - RNA, 19 nt, Human herpesvirus 6
accaauuccuuaauucuaa

SEQ ID NO: 3989708 - RNA, 15 nt, Human herpesvirus 6
acccaugaaaaucau

SEQ ID NO: 3989709 - RNA, 15 nt, Human herpesvirus 6
acccccgauucagac

SEQ ID NO: 3989710 - RNA, 22 nt, Human herpesvirus 6
accccguugauuggaugaucgc

SEQ ID NO: 3989711 - RNA, 14 nt, Human herpesvirus 6
acccgcguccucca

SEQ ID NO: 3989712 - RNA, 18 nt, Human herpesvirus 6
acccuacaaucuguccag

SEQ ID NO: 3989713 - RNA, 19 nt, Human herpesvirus 6
acccugccuauacaggcaa

SEQ ID NO: 3989714 - RNA, 16 nt, Human herpesvirus 6
accgauuuuucagugu

SEQ ID NO: 3989715 - RNA, 16 nt, Human herpesvirus 6
accgcagcagcuagau

SEQ ID NO: 3989716 - RNA, 23 nt, Human herpesvirus 6
accgcaguuucuguuuuucucgg

SEQ ID NO: 3989717 - RNA, 15 nt, Human herpesvirus 6
accggaaaagagaag

SEQ ID NO: 3989718 - RNA, 16 nt, Human herpesvirus 6
accuaaauacauucac

SEQ ID NO: 3989719 - RNA, 17 nt, Human herpesvirus 6
accuauuagguguccuu

SEQ ID NO: 3989720 - RNA, 18 nt, Human herpesvirus 6
accucaaaaaugcacaau

SEQ ID NO: 3989721 - RNA, 20 nt, Human herpesvirus 6
accuguuuuagaaacauuug

SEQ ID NO: 3989722 - RNA, 16 nt, Human herpesvirus 6
accuugucaauaaaca

SEQ ID NO: 3989723 - RNA, 11 nt, Human herpesvirus 6
acgaaaaccau

SEQ ID NO: 3989724 - RNA, 18 nt, Human herpesvirus 6
acgaaagcaguuuuacau

SEQ ID NO: 3989725 - RNA, 17 nt, Human herpesvirus 6
acgacuucgacuucaaa

SEQ ID NO: 3989726 - RNA, 16 nt, Human herpesvirus 6
acgagaacucuaaaag

SEQ ID NO: 3989727 - RNA, 23 nt, Human herpesvirus 6
auaaaugguagcuauuaugugaa

SEQ ID NO: 3989728 - RNA, 20 nt, Human herpesvirus 6
auaacuuuacauuaaacacu

SEQ ID NO: 3989729 - RNA, 13 nt, Human herpesvirus 6
auaagacacugau

SEQ ID NO: 3989730 - RNA, 22 nt, Human herpesvirus 6
auaaucuuauagcucaguguuu

SEQ ID NO: 3989731 - RNA, 20 nt, Human herpesvirus 6
auaaugauauaguuuuugcu

SEQ ID NO: 3989732 - RNA, 21 nt, Human herpesvirus 6
auaauuuuauuaacuguaaaa

SEQ ID NO: 3989733 - RNA, 16 nt, Human herpesvirus 6
auacaaaauuugaaau

SEQ ID NO: 3989734 - RNA, 14 nt, Human herpesvirus 6
auacacacccagca

SEQ ID NO: 3989735 - RNA, 15 nt, Human herpesvirus 6
auacaucguuuguug

SEQ ID NO: 3989736 - RNA, 18 nt, Human herpesvirus 6
auaccaacgugagggaaa

SEQ ID NO: 3989737 - RNA, 20 nt, Human herpesvirus 6
auacucaacccaaaaugcaa

SEQ ID NO: 3989738 - RNA, 17 nt, Human herpesvirus 6
auacuggcaaagcaaag

SEQ ID NO: 3989739 - RNA, 15 nt, Human herpesvirus 6
auacuuuugucucug

SEQ ID NO: 3989740 - RNA, 14 nt, Human herpesvirus 6
auagaggaauugcu

SEQ ID NO: 3989741 - RNA, 18 nt, Human herpesvirus 6
auaguguuuucugauugu

SEQ ID NO: 3989742 - RNA, 21 nt, Human herpesvirus 6
auauaacgauauauaaaaaac

SEQ ID NO: 3989743 - RNA, 19 nt, Human herpesvirus 6
auaucaaacuuuuuuugaa

SEQ ID NO: 3989744 - RNA, 13 nt, Human herpesvirus 6
auaucauuaaauu

SEQ ID NO: 3989745 - RNA, 15 nt, Human herpesvirus 6
auaucuugaaaucua

SEQ ID NO: 3989746 - RNA, 12 nt, Human herpesvirus 6
auaugaugcugu

SEQ ID NO: 3989747 - RNA, 14 nt, Human herpesvirus 6
auauuccagacaau

SEQ ID NO: 3989748 - RNA, 16 nt, Human herpesvirus 6
auauucuucuguaaau

SEQ ID NO: 3989749 - RNA, 23 nt, Human herpesvirus 6
auauuuaacaacaucuuaaaaga

SEQ ID NO: 3989750 - RNA, 15 nt, Human herpesvirus 6
aucaaaaaaaugaua

SEQ ID NO: 3989751 - RNA, 16 nt, Human herpesvirus 6
aucaacuauuuaacau

SEQ ID NO: 3989752 - RNA, 20 nt, Human herpesvirus 6
aucaagacuacucuggcuga

SEQ ID NO: 3989753 - RNA, 22 nt, Human herpesvirus 6
aucagugaaggcugccaugaaa

SEQ ID NO: 3989754 - RNA, 14 nt, Human herpesvirus 6
aucauauccugaaa

SEQ ID NO: 3989755 - RNA, 16 nt, Human herpesvirus 6
auccaccaaugacacc

SEQ ID NO: 3989756 - RNA, 13 nt, Human herpesvirus 6
aucccccuccccg

SEQ ID NO: 3989757 - RNA, 14 nt, Human herpesvirus 6
auccgcccuccccg

SEQ ID NO: 3989758 - RNA, 19 nt, Human herpesvirus 6
auccgcccuccccgagcac

SEQ ID NO: 3989759 - RNA, 14 nt, Human herpesvirus 6
auccucucuggaaa

SEQ ID NO: 3989760 - RNA, 15 nt, Human herpesvirus 6
aucgagaaaaggaca

SEQ ID NO: 3989761 - RNA, 14 nt, Human herpesvirus 6
aucgcccugcuccg

SEQ ID NO: 3989762 - RNA, 17 nt, Human herpesvirus 6
aucggacaaugcagaac

SEQ ID NO: 3989763 - RNA, 19 nt, Human herpesvirus 6
aucggagagacgcaccacg

SEQ ID NO: 3989764 - RNA, 14 nt, Human herpesvirus 6
aucgguggcagagg

SEQ ID NO: 3989765 - RNA, 19 nt, Human herpesvirus 6
aucguagguaauuuuuauu

SEQ ID NO: 3989766 - RNA, 12 nt, Human herpesvirus 6
aucuaauucaca

SEQ ID NO: 3989767 - RNA, 15 nt, Human herpesvirus 6
aucuaauucacauau

SEQ ID NO: 3989768 - RNA, 14 nt, Human herpesvirus 6
aucuauuauaagca

SEQ ID NO: 3989769 - RNA, 20 nt, Human herpesvirus 6
aucuccucaacacucucagu

SEQ ID NO: 3989770 - RNA, 17 nt, Human herpesvirus 6
aucuuccuuauaacaca

SEQ ID NO: 3989771 - RNA, 22 nt, Human herpesvirus 6
augaaaauaucauuaaauuguu

SEQ ID NO: 3989772 - RNA, 16 nt, Human herpesvirus 6
augaagaaguuaacua

SEQ ID NO: 3989773 - RNA, 16 nt, Human herpesvirus 6
augaauguaacugguu

SEQ ID NO: 3989774 - RNA, 16 nt, Human herpesvirus 6
augaaugugcugaugu

SEQ ID NO: 3989775 - RNA, 14 nt, Human herpesvirus 6
augacaagaaaggu

SEQ ID NO: 3989776 - RNA, 18 nt, Human herpesvirus 6
augacaccgauucagaaa

SEQ ID NO: 3989777 - RNA, 20 nt, Human herpesvirus 6
augaucaacggccuggagua

SEQ ID NO: 3989778 - RNA, 17 nt, Human herpesvirus 6
augaucagcauucacuc

SEQ ID NO: 3989779 - RNA, 14 nt, Human herpesvirus 6
augcaaaucucacu

SEQ ID NO: 3989780 - RNA, 15 nt, Human herpesvirus 6
augcaacgcaucaca

SEQ ID NO: 3989781 - RNA, 23 nt, Human herpesvirus 6
augcaagccaugacaagaaaggu

SEQ ID NO: 3989782 - RNA, 22 nt, Human herpesvirus 6
augcaguaaaugaauguguuca

SEQ ID NO: 3989783 - RNA, 14 nt, Human herpesvirus 6
augcgacugcaaga

SEQ ID NO: 3989784 - RNA, 18 nt, Human herpesvirus 6
augcgaguagauucuccg

SEQ ID NO: 3989785 - RNA, 17 nt, Human herpesvirus 6
augcggacucugacgaa

SEQ ID NO: 3989786 - RNA, 20 nt, Human herpesvirus 6
augcuuuuuaaaaaaacacu

SEQ ID NO: 3989787 - RNA, 20 nt, Human herpesvirus 6
auggacaacgguguggagac

SEQ ID NO: 3989788 - RNA, 16 nt, Human herpesvirus 6
auggauaaacgugucu

SEQ ID NO: 3989789 - RNA, 17 nt, Human herpesvirus 6
auggcagaucuugaaaa

SEQ ID NO: 3989790 - RNA, 17 nt, Human herpesvirus 6
auggugaguaccuguac

SEQ ID NO: 3989791 - RNA, 12 nt, Human herpesvirus 6
auguaaagaaau

SEQ ID NO: 3989792 - RNA, 21 nt, Human herpesvirus 6
auguaauaauugaugggaugc

SEQ ID NO: 3989793 - RNA, 17 nt, Human herpesvirus 6
auguagcauacgacaaa

SEQ ID NO: 3989794 - RNA, 16 nt, Human herpesvirus 6
augucggccucugccg

SEQ ID NO: 3989795 - RNA, 16 nt, Human herpesvirus 6
auguggagaagaucua

SEQ ID NO: 3989796 - RNA, 17 nt, Human herpesvirus 6
auguguauuauguaaau

SEQ ID NO: 3989797 - RNA, 13 nt, Human herpesvirus 6
augugucggccgu

SEQ ID NO: 3989798 - RNA, 15 nt, Human herpesvirus 6
auguguucacagagc

SEQ ID NO: 3989799 - RNA, 14 nt, Human herpesvirus 6
auguuauguaaaga

SEQ ID NO: 3989800 - RNA, 17 nt, Human herpesvirus 6
auguuuaaguaaaacaa

SEQ ID NO: 3989801 - RNA, 18 nt, Human herpesvirus 6
auguuucauccaaauaca

SEQ ID NO: 3989802 - RNA, 23 nt, Human herpesvirus 6
auuaaaguuuucauaaaaacgac

SEQ ID NO: 3989803 - RNA, 22 nt, Human herpesvirus 6
auuaaaugugaacauuauaaau

SEQ ID NO: 3989804 - RNA, 22 nt, Human herpesvirus 6
auuaauuaccuauagucaaugu

SEQ ID NO: 3989805 - RNA, 20 nt, Human herpesvirus 6
auuacacuuucuuguaguau

SEQ ID NO: 3989806 - RNA, 20 nt, Human herpesvirus 6
auuaccgguaaagaacccau

SEQ ID NO: 3989807 - RNA, 19 nt, Human herpesvirus 6
auuagaauaauuauggaca

SEQ ID NO: 3989808 - RNA, 16 nt, Human herpesvirus 6
auuaggggacagagcc

SEQ ID NO: 3989809 - RNA, 13 nt, Human herpesvirus 6
auuaucauagaca

SEQ ID NO: 3989810 - RNA, 15 nt, Human herpesvirus 6
auuaucauagacaaa

SEQ ID NO: 3989811 - RNA, 17 nt, Human herpesvirus 6
auuauguaauacaucaa

SEQ ID NO: 3989812 - RNA, 15 nt, Human herpesvirus 6
auuauuaacaaugaa

SEQ ID NO: 3989813 - RNA, 22 nt, Human herpesvirus 6
auuauuaaggccgucaaagaca

SEQ ID NO: 3989814 - RNA, 18 nt, Human herpesvirus 6
auucaaaacgacaucgcg

SEQ ID NO: 3989815 - RNA, 21 nt, Human herpesvirus 6
auuccaagacauguacaucaa

SEQ ID NO: 3989816 - RNA, 13 nt, Human herpesvirus 6
auucuauguacuu

SEQ ID NO: 3989817 - RNA, 20 nt, Human herpesvirus 6
auucugcauuuauaucaaac

SEQ ID NO: 3989818 - RNA, 13 nt, Human herpesvirus 6
auugaagaaaauu

SEQ ID NO: 3989819 - RNA, 14 nt, Human herpesvirus 6
auugcauucugggc

SEQ ID NO: 3989820 - RNA, 15 nt, Human herpesvirus 6
auugcucuauugugu

SEQ ID NO: 3989821 - RNA, 22 nt, Human herpesvirus 6
auuggcgucuaguaccuguagc

SEQ ID NO: 3989822 - RNA, 18 nt, Human herpesvirus 6
auuguaaauagguaaacu

SEQ ID NO: 3989823 - RNA, 16 nt, Human herpesvirus 6
auuguaauuuugaauu

SEQ ID NO: 3989824 - RNA, 16 nt, Human herpesvirus 6
auuguauauauagcug

SEQ ID NO: 3989825 - RNA, 12 nt, Human herpesvirus 6
auuuaaacaaca

SEQ ID NO: 3989826 - RNA, 13 nt, Human herpesvirus 6
auuucuaaacaca

SEQ ID NO: 3989827 - RNA, 16 nt, Human herpesvirus 6
auuucuauguaaacuu

SEQ ID NO: 3989828 - RNA, 21 nt, Human herpesvirus 6
auuucuuaccuuuuaagagug

SEQ ID NO: 3989829 - RNA, 19 nt, Human herpesvirus 6
auuugcucgcacgaaauga

SEQ ID NO: 3989830 - RNA, 20 nt, Human herpesvirus 6
auuuguaaaaaaacauucua

SEQ ID NO: 3989831 - RNA, 21 nt, Human herpesvirus 6
auuuuauaacgacaaaagaca

SEQ ID NO: 3989832 - RNA, 14 nt, Human herpesvirus 6
auuuuguacaguag

SEQ ID NO: 3989833 - RNA, 12 nt, Human herpesvirus 6
auuuuuuaagag

SEQ ID NO: 3989834 - RNA, 14 nt, Human herpesvirus 6
auuuuuuauuucca

SEQ ID NO: 3989835 - RNA, 21 nt, Human herpesvirus 6
caaaaagcuuuaaagcagcua

SEQ ID NO: 3989836 - RNA, 20 nt, Human herpesvirus 6
caaaacaccgguaagcaucu

SEQ ID NO: 3989837 - RNA, 14 nt, Human herpesvirus 6
caaaaccgaggcag

SEQ ID NO: 3989838 - RNA, 19 nt, Human herpesvirus 6
caaaagauuacggcaacau

SEQ ID NO: 3989839 - RNA, 20 nt, Human herpesvirus 6
caaaaugguuaugacaaagg

SEQ ID NO: 3989840 - RNA, 21 nt, Human herpesvirus 6
caaaauugggaaucaugugua

SEQ ID NO: 3989841 - RNA, 15 nt, Human herpesvirus 6
caaagaaaagaugua

SEQ ID NO: 3989842 - RNA, 13 nt, Human herpesvirus 6
caaagaaacagua

SEQ ID NO: 3989843 - RNA, 15 nt, Human herpesvirus 6
caaagaaacaguaaa

SEQ ID NO: 3989844 - RNA, 13 nt, Human herpesvirus 6
caaagagaccaau

SEQ ID NO: 3989845 - RNA, 17 nt, Human herpesvirus 6
caaauccugacuacgau

SEQ ID NO: 3989846 - RNA, 21 nt, Human herpesvirus 6
caaaucuguaagauuaaaugu

SEQ ID NO: 3989847 - RNA, 22 nt, Human herpesvirus 6
caaaugauuuuacaaagaccua

SEQ ID NO: 3989848 - RNA, 15 nt, Human herpesvirus 6
caaauugauuaugau

SEQ ID NO: 3989849 - RNA, 14 nt, Human herpesvirus 6
caacaaccacagca

SEQ ID NO: 3989850 - RNA, 15 nt, Human herpesvirus 6
caacacaccugccua

SEQ ID NO: 3989851 - RNA, 18 nt, Human herpesvirus 6
caaccugaaacuccccag

SEQ ID NO: 3989852 - RNA, 16 nt, Human herpesvirus 6
caagacgccacgggca

SEQ ID NO: 3989853 - RNA, 16 nt, Human herpesvirus 6
caagauacugguuuac

SEQ ID NO: 3989854 - RNA, 19 nt, Human herpesvirus 6
caagcacaaaaccaggaau

SEQ ID NO: 3989855 - RNA, 23 nt, Human herpesvirus 6
caaguuugaauuuauacugugug

SEQ ID NO: 3989856 - RNA, 12 nt, Human herpesvirus 6
caauaagaaaca

SEQ ID NO: 3989857 - RNA, 20 nt, Human herpesvirus 6
caaucauguuuauugucaaa

SEQ ID NO: 3989858 - RNA, 17 nt, Human herpesvirus 6
caauuacucaacauuaa

SEQ ID NO: 3989859 - RNA, 19 nt, Human herpesvirus 6
caauucauuguacgauaau

SEQ ID NO: 3989860 - RNA, 15 nt, Human herpesvirus 6
cacaagcguacacua

SEQ ID NO: 3989861 - RNA, 20 nt, Human herpesvirus 6
cacaauaagaaaacgagaga

SEQ ID NO: 3989862 - RNA, 12 nt, Human herpesvirus 6
cacaaucagaaa

SEQ ID NO: 3989863 - RNA, 16 nt, Human herpesvirus 6
cacacaauuaguccau

SEQ ID NO: 3989864 - RNA, 22 nt, Human herpesvirus 6
cacacccauggcgagaaacgcc

SEQ ID NO: 3989865 - RNA, 22 nt, Human herpesvirus 6
cacaggauuauaaaaacacacc

SEQ ID NO: 3989866 - RNA, 15 nt, Human herpesvirus 6
cacauaagacuuaua

SEQ ID NO: 3989867 - RNA, 13 nt, Human herpesvirus 6
cacaugaaaucac

SEQ ID NO: 3989868 - RNA, 19 nt, Human herpesvirus 6
caccaccgcugacaaccuc

SEQ ID NO: 3989869 - RNA, 14 nt, Human herpesvirus 6
caccaucuguugau

SEQ ID NO: 3989870 - RNA, 15 nt, Human herpesvirus 6
cacccauuuccggag

SEQ ID NO: 3989871 - RNA, 23 nt, Human herpesvirus 6
cacccauuuccggaguugcagug

SEQ ID NO: 3989872 - RNA, 15 nt, Human herpesvirus 6
caccgaaguacccau

SEQ ID NO: 3989873 - RNA, 19 nt, Human herpesvirus 6
caccgucugggacccacgg

SEQ ID NO: 3989874 - RNA, 22 nt, Human herpesvirus 6
caccgucugggacccacggugg

SEQ ID NO: 3989875 - RNA, 21 nt, Human herpesvirus 6
cacgcuuggaguuuuuuaugc

SEQ ID NO: 3989876 - RNA, 17 nt, Human herpesvirus 6
cacguuuugggaaaucu

SEQ ID NO: 3989877 - RNA, 17 nt, Human herpesvirus 6
cacucggaagaaaagcu

SEQ ID NO: 3989878 - RNA, 23 nt, Human herpesvirus 6
cacugcauuucauuccccgacca

SEQ ID NO: 3989879 - RNA, 15 nt, Human herpesvirus 6
cacuuccucacgcaa

SEQ ID NO: 3989880 - RNA, 16 nt, Human herpesvirus 6
cacuuuuaaaauaccg

SEQ ID NO: 3989881 - RNA, 20 nt, Human herpesvirus 6
cagaagagaugaaagacaga

SEQ ID NO: 3989882 - RNA, 20 nt, Human herpesvirus 6
cagaaguuucggcaacugaa

SEQ ID NO: 3989883 - RNA, 17 nt, Human herpesvirus 6
cagaccucauauaagaa

SEQ ID NO: 3989884 - RNA, 16 nt, Human herpesvirus 6
cagagaaaaaacaaag

SEQ ID NO: 3989885 - RNA, 17 nt, Human herpesvirus 6
cagaucuaucacaggcg

SEQ ID NO: 3989886 - RNA, 22 nt, Human herpesvirus 6
cagaugguuuuaagagcagaca

SEQ ID NO: 3989887 - RNA, 16 nt, Human herpesvirus 6
cagcacauaacugcau

SEQ ID NO: 3989888 - RNA, 19 nt, Human herpesvirus 6
cagcggaagugaaagcagu

SEQ ID NO: 3989889 - RNA, 20 nt, Human herpesvirus 6
cagcggaagugaaagcaguc

SEQ ID NO: 3989890 - RNA, 17 nt, Human herpesvirus 6
cagcggacagcggggug

SEQ ID NO: 3989891 - RNA, 20 nt, Human herpesvirus 6
cagcggaccaauccaugcaa

SEQ ID NO: 3989892 - RNA, 16 nt, Human herpesvirus 6
cagcuuuauucccaug

SEQ ID NO: 3989893 - RNA, 18 nt, Human herpesvirus 6
caggaucguccccuuggc

SEQ ID NO: 3989894 - RNA, 14 nt, Human herpesvirus 6
caggcaaacgagaa

SEQ ID NO: 3989895 - RNA, 20 nt, Human herpesvirus 6
caggcgguauaacuuccgga

SEQ ID NO: 3989896 - RNA, 14 nt, Human herpesvirus 6
cagggaacuugaug

SEQ ID NO: 3989897 - RNA, 21 nt, Human herpesvirus 6
cagguaauauuccgaacgaga

SEQ ID NO: 3989898 - RNA, 15 nt, Human herpesvirus 6
cagguuucuccgcac

SEQ ID NO: 3989899 - RNA, 18 nt, Human herpesvirus 6
cagucacacacagggugc

SEQ ID NO: 3989900 - RNA, 15 nt, Human herpesvirus 6
cagucugcuggaugc

SEQ ID NO: 3989901 - RNA, 17 nt, Human herpesvirus 6
cagugaaggcugccaug

SEQ ID NO: 3989902 - RNA, 23 nt, Human herpesvirus 6
caguuauacuggcaaagcaaaga

SEQ ID NO: 3989903 - RNA, 19 nt, Human herpesvirus 6
caguucaacgcugucuuuu

SEQ ID NO: 3989904 - RNA, 18 nt, Human herpesvirus 6
caguucguagaacggaaa

SEQ ID NO: 3989905 - RNA, 17 nt, Human herpesvirus 6
caguugucuggcagcua

SEQ ID NO: 3989906 - RNA, 19 nt, Human herpesvirus 6
caguuuuuuuuuucauaug

SEQ ID NO: 3989907 - RNA, 12 nt, Human herpesvirus 6
cauaaaauguuu

SEQ ID NO: 3989908 - RNA, 20 nt, Human herpesvirus 6
cauaaacagagacugguuga

SEQ ID NO: 3989909 - RNA, 14 nt, Human herpesvirus 6
cauaacgauagcag

SEQ ID NO: 3989910 - RNA, 23 nt, Human herpesvirus 6
cauaaguuaauuccagcuuucuu

SEQ ID NO: 3989911 - RNA, 17 nt, Human herpesvirus 6
cauacauuuugggcagu

SEQ ID NO: 3989912 - RNA, 16 nt, Human herpesvirus 6
cauagagcauggcgca

SEQ ID NO: 3989913 - RNA, 14 nt, Human herpesvirus 6
cauagcagcaauag

SEQ ID NO: 3989914 - RNA, 16 nt, Human herpesvirus 6
cauauaauauuuccau

SEQ ID NO: 3989915 - RNA, 20 nt, Human herpesvirus 6
cauauuguguaacucuuuuu

SEQ ID NO: 3989916 - RNA, 16 nt, Human herpesvirus 6
caucagaauccagaaa

SEQ ID NO: 3989917 - RNA, 18 nt, Human herpesvirus 6
caucauauaauauuucca

SEQ ID NO: 3989918 - RNA, 21 nt, Human herpesvirus 6
cauccaccuucccucccaccc

SEQ ID NO: 3989919 - RNA, 22 nt, Human herpesvirus 6
caucccagauacauaaacaccc

SEQ ID NO: 3989920 - RNA, 17 nt, Human herpesvirus 6
caucccuuaaaaaaaca

SEQ ID NO: 3989921 - RNA, 15 nt, Human herpesvirus 6
cauccguuaguaaau

SEQ ID NO: 3989922 - RNA, 19 nt, Human herpesvirus 6
cauccuaacaagacagaag

SEQ ID NO: 3989923 - RNA, 20 nt, Human herpesvirus 6
caucgguggcagaggggaag

SEQ ID NO: 3989924 - RNA, 23 nt, Human herpesvirus 6
caucuaucgcgcaccgcuguggc

SEQ ID NO: 3989925 - RNA, 12 nt, Human herpesvirus 6
caugaacucuca

SEQ ID NO: 3989926 - RNA, 14 nt, Human herpesvirus 6
caugacaagaaagg

SEQ ID NO: 3989927 - RNA, 19 nt, Human herpesvirus 6
caugaucugcuugauauuu

SEQ ID NO: 3989928 - RNA, 14 nt, Human herpesvirus 6
caugauugcaucaa

SEQ ID NO: 3989929 - RNA, 20 nt, Human herpesvirus 6
caugauuguaauaaaguguc

SEQ ID NO: 3989930 - RNA, 18 nt, Human herpesvirus 6
caugcauuuuguauuuau

SEQ ID NO: 3989931 - RNA, 13 nt, Human herpesvirus 6
cauguugcaguuu

SEQ ID NO: 3989932 - RNA, 22 nt, Human herpesvirus 6
cauguuuucuccucaacuaaac

SEQ ID NO: 3989933 - RNA, 20 nt, Human herpesvirus 6
cauuaacagacgaggacgga

SEQ ID NO: 3989934 - RNA, 16 nt, Human herpesvirus 6
cauuaacccuggguga

SEQ ID NO: 3989935 - RNA, 14 nt, Human herpesvirus 6
cauuauugucugca

SEQ ID NO: 3989936 - RNA, 13 nt, Human herpesvirus 6
cauucacauuacc

SEQ ID NO: 3989937 - RNA, 12 nt, Human herpesvirus 6
cauugcuuucuc

SEQ ID NO: 3989938 - RNA, 14 nt, Human herpesvirus 6
cauuuauguuucuu

SEQ ID NO: 3989939 - RNA, 20 nt, Human herpesvirus 6
cauuuguuuuuuaaagcaca

SEQ ID NO: 3989940 - RNA, 18 nt, Human herpesvirus 6
ccaaaggaaaccaccggc

SEQ ID NO: 3989941 - RNA, 16 nt, Human herpesvirus 6
ccaaccucuuccuaga

SEQ ID NO: 3989942 - RNA, 21 nt, Human herpesvirus 6
ccaaugacaccgauucagaaa

SEQ ID NO: 3989943 - RNA, 20 nt, Human herpesvirus 6
ccaauuuguguuuauuugcc

SEQ ID NO: 3989944 - RNA, 21 nt, Human herpesvirus 6
ccacagaugucccggggggaa

SEQ ID NO: 3989945 - RNA, 13 nt, Human herpesvirus 6
ccacagcagcagc

SEQ ID NO: 3989946 - RNA, 19 nt, Human herpesvirus 6
ccacaugacaccucaauua

SEQ ID NO: 3989947 - RNA, 20 nt, Human herpesvirus 6
ccacggggauuuaguacagu

SEQ ID NO: 3989948 - RNA, 13 nt, Human herpesvirus 6
ccacgguggccug

SEQ ID NO: 3989949 - RNA, 13 nt, Human herpesvirus 6
ccagaaaaguaua

SEQ ID NO: 3989950 - RNA, 20 nt, Human herpesvirus 6
ccagcauguuuucuccucaa

SEQ ID NO: 3989951 - RNA, 15 nt, Human herpesvirus 6
ccaguauugaagaaa

SEQ ID NO: 3989952 - RNA, 15 nt, Human herpesvirus 6
ccauccaccuucccu

SEQ ID NO: 3989953 - RNA, 14 nt, Human herpesvirus 6
ccaucuauacaccc

SEQ ID NO: 3989954 - RNA, 24 nt, Human herpesvirus 6
ccaucuaucgcgcaccgcuguggc

SEQ ID NO: 3989955 - RNA, 14 nt, Human herpesvirus 6
cccaccuaauaaac

SEQ ID NO: 3989956 - RNA, 16 nt, Human herpesvirus 6
cccacgguggccuggc

SEQ ID NO: 3989957 - RNA, 18 nt, Human herpesvirus 6
cucuuaacuacuucuuuc

SEQ ID NO: 3989958 - RNA, 14 nt, Human herpesvirus 6
cugaaaccaaagca

SEQ ID NO: 3989959 - RNA, 20 nt, Human herpesvirus 6
cugaaagaaaaauauuuugu

SEQ ID NO: 3989960 - RNA, 20 nt, Human herpesvirus 6
cugaaauuugagaaaguugu

SEQ ID NO: 3989961 - RNA, 13 nt, Human herpesvirus 6
cugagacagucca

SEQ ID NO: 3989962 - RNA, 20 nt, Human herpesvirus 6
cugagaugacaucugcaaaa

SEQ ID NO: 3989963 - RNA, 14 nt, Human herpesvirus 6
cugagauucacucc

SEQ ID NO: 3989964 - RNA, 24 nt, Human herpesvirus 6
cugaguucuguggccgaagaagag

SEQ ID NO: 3989965 - RNA, 19 nt, Human herpesvirus 6
cugaucacagagcagagag

SEQ ID NO: 3989966 - RNA, 19 nt, Human herpesvirus 6
cugauuuuguuuucuacgu

SEQ ID NO: 3989967 - RNA, 17 nt, Human herpesvirus 6
cugcaugguccacagau

SEQ ID NO: 3989968 - RNA, 12 nt, Human herpesvirus 6
cugccaucccuu

SEQ ID NO: 3989969 - RNA, 16 nt, Human herpesvirus 6
cugccuauacaggcaa

SEQ ID NO: 3989970 - RNA, 18 nt, Human herpesvirus 6
cugccucgguuuuguccc

SEQ ID NO: 3989971 - RNA, 12 nt, Human herpesvirus 6
cugcgucaaugc

SEQ ID NO: 3989972 - RNA, 12 nt, Human herpesvirus 6
cuggaaaacuau

SEQ ID NO: 3989973 - RNA, 18 nt, Human herpesvirus 6
cuggcaucugcggcucug

SEQ ID NO: 3989974 - RNA, 18 nt, Human herpesvirus 6
cuggccgaguuuggacau

SEQ ID NO: 3989975 - RNA, 15 nt, Human herpesvirus 6
cugggacccacggug

SEQ ID NO: 3989976 - RNA, 20 nt, Human herpesvirus 6
cugggacccacgguggccug

SEQ ID NO: 3989977 - RNA, 19 nt, Human herpesvirus 6
cuggguuucgaagaauccu

SEQ ID NO: 3989978 - RNA, 21 nt, Human herpesvirus 6
cuguacaaaaucaaacucacc

SEQ ID NO: 3989979 - RNA, 16 nt, Human herpesvirus 6
cuguauuaaugucacu

SEQ ID NO: 3989980 - RNA, 21 nt, Human herpesvirus 6
cuguggacgugccgggacccc

SEQ ID NO: 3989981 - RNA, 14 nt, Human herpesvirus 6
cugugucuguucaa

SEQ ID NO: 3989982 - RNA, 16 nt, Human herpesvirus 6
cuguguuuauguuuca

SEQ ID NO: 3989983 - RNA, 16 nt, Human herpesvirus 6
cuguucuucucagaaa

SEQ ID NO: 3989984 - RNA, 21 nt, Human herpesvirus 6
cuuaaagcguuugcaaaacug

SEQ ID NO: 3989985 - RNA, 14 nt, Human herpesvirus 6
cuuacguugaugau

SEQ ID NO: 3989986 - RNA, 17 nt, Human herpesvirus 6
cuuauaacaagcacuga

SEQ ID NO: 3989987 - RNA, 16 nt, Human herpesvirus 6
cuuaucguucacugac

SEQ ID NO: 3989988 - RNA, 18 nt, Human herpesvirus 6
cuuauguuucuaacagag

SEQ ID NO: 3989989 - RNA, 15 nt, Human herpesvirus 6
cuucaauaaaaacuc

SEQ ID NO: 3989990 - RNA, 14 nt, Human herpesvirus 6
cuucgguacaguga

SEQ ID NO: 3989991 - RNA, 18 nt, Human herpesvirus 6
cuucugcuaauucauagu

SEQ ID NO: 3989992 - RNA, 13 nt, Human herpesvirus 6
cuugaauguuuaa

SEQ ID NO: 3989993 - RNA, 23 nt, Human herpesvirus 6
cuugaauguuuaaaguuuuguga

SEQ ID NO: 3989994 - RNA, 23 nt, Human herpesvirus 6
cuugaucacaacauaaaaauaca

SEQ ID NO: 3989995 - RNA, 16 nt, Human herpesvirus 6
cuuuaacuuauguuuc

SEQ ID NO: 3989996 - RNA, 18 nt, Human herpesvirus 6
cuuuaacuuauguuucua

SEQ ID NO: 3989997 - RNA, 15 nt, Human herpesvirus 6
cuuuaacuuuuugca

SEQ ID NO: 3989998 - RNA, 20 nt, Human herpesvirus 6
cuuuaauggguuuguuuucu

SEQ ID NO: 3989999 - RNA, 15 nt, Human herpesvirus 6
cuuuacagucuuuaa

SEQ ID NO: 3990000 - RNA, 18 nt, Human herpesvirus 6
cuuucuaagacgagaugu

SEQ ID NO: 3990001 - RNA, 19 nt, Human herpesvirus 6
cuuucucuuuuuaauucca

SEQ ID NO: 3990002 - RNA, 13 nt, Human herpesvirus 6
cuuugaaggacua

SEQ ID NO: 3990003 - RNA, 21 nt, Human herpesvirus 6
cuuugucacgagucgcuucua

SEQ ID NO: 3990004 - RNA, 20 nt, Human herpesvirus 6
cuuuuauuuugggauacaua

SEQ ID NO: 3990005 - RNA, 18 nt, Human herpesvirus 6
cuuuucauaugaaaagcu

SEQ ID NO: 3990006 - RNA, 18 nt, Human herpesvirus 6
cuuuuuucggauuuugaa

SEQ ID NO: 3990007 - RNA, 13 nt, Human herpesvirus 6
gaaaaaaaaucua

SEQ ID NO: 3990008 - RNA, 18 nt, Human herpesvirus 6
gaaaaagguggcaucaga

SEQ ID NO: 3990009 - RNA, 19 nt, Human herpesvirus 6
gaaaacccagcaugaugau

SEQ ID NO: 3990010 - RNA, 21 nt, Human herpesvirus 6
gaaaacuaaaagucagugggu

SEQ ID NO: 3990011 - RNA, 17 nt, Human herpesvirus 6
gaaaacucuaaaagcug

SEQ ID NO: 3990012 - RNA, 20 nt, Human herpesvirus 6
gaaaacucuaaaagcugcua

SEQ ID NO: 3990013 - RNA, 17 nt, Human herpesvirus 6
gaaaagguguuguguuu

SEQ ID NO: 3990014 - RNA, 17 nt, Human herpesvirus 6
gaaaauguuuuucauaa

SEQ ID NO: 3990015 - RNA, 14 nt, Human herpesvirus 6
gaaaauuaaaaguc

SEQ ID NO: 3990016 - RNA, 21 nt, Human herpesvirus 6
gaaacggacacgcgcagugga

SEQ ID NO: 3990017 - RNA, 19 nt, Human herpesvirus 6
gaaaguugauacgccagaa

SEQ ID NO: 3990018 - RNA, 17 nt, Human herpesvirus 6
gaaauaaaguuuaaaga

SEQ ID NO: 3990019 - RNA, 19 nt, Human herpesvirus 6
gaaaucuacuguacaaaau

SEQ ID NO: 3990020 - RNA, 22 nt, Human herpesvirus 6
gaacaugugacacgauuucuga

SEQ ID NO: 3990021 - RNA, 14 nt, Human herpesvirus 6
gaaccaccagagac

SEQ ID NO: 3990022 - RNA, 15 nt, Human herpesvirus 6
gaacucuaaaagcug

SEQ ID NO: 3990023 - RNA, 21 nt, Human herpesvirus 6
gaacuuuguccuuacaaaucu

SEQ ID NO: 3990024 - RNA, 16 nt, Human herpesvirus 6
gaagauacgagaacaa

SEQ ID NO: 3990025 - RNA, 18 nt, Human herpesvirus 6
gaagauacgagaacaaaa

SEQ ID NO: 3990026 - RNA, 18 nt, Human herpesvirus 6
gaagcgguuagagcuggg

SEQ ID NO: 3990027 - RNA, 23 nt, Human herpesvirus 6
gaaguugguuuaaaauaucuguu

SEQ ID NO: 3990028 - RNA, 20 nt, Human herpesvirus 6
gaauaacaaacuauauugcu

SEQ ID NO: 3990029 - RNA, 19 nt, Human herpesvirus 6
gaauucguuacaaucucug

SEQ ID NO: 3990030 - RNA, 14 nt, Human herpesvirus 6
gaauugguuugcuu

SEQ ID NO: 3990031 - RNA, 17 nt, Human herpesvirus 6
gaauuuauuuucaauau

SEQ ID NO: 3990032 - RNA, 18 nt, Human herpesvirus 6
gacacgcuaaaaacagac

SEQ ID NO: 3990033 - RNA, 22 nt, Human herpesvirus 6
gacagauccgucucucagcugg

SEQ ID NO: 3990034 - RNA, 19 nt, Human herpesvirus 6
gacagcaaguugcuaccgc

SEQ ID NO: 3990035 - RNA, 22 nt, Human herpesvirus 6
gacagggggaucgacgggcagg

SEQ ID NO: 3990036 - RNA, 21 nt, Human herpesvirus 6
gacaucgagauucuuuaaaga

SEQ ID NO: 3990037 - RNA, 23 nt, Human herpesvirus 6
gaccacaccccuguacgcgcaua

SEQ ID NO: 3990038 - RNA, 17 nt, Human herpesvirus 6
gacccacgguggccugg

SEQ ID NO: 3990039 - RNA, 22 nt, Human herpesvirus 6
gacccacuccuacuauccgccc

SEQ ID NO: 3990040 - RNA, 22 nt, Human herpesvirus 6
gaccccugccgagccuguggac

SEQ ID NO: 3990041 - RNA, 20 nt, Human herpesvirus 6
gaccuggccgaguuuggaca

SEQ ID NO: 3990042 - RNA, 15 nt, Human herpesvirus 6
gaccuggcggacacc

SEQ ID NO: 3990043 - RNA, 22 nt, Human herpesvirus 6
gacgaaagcaguuuuacaucau

SEQ ID NO: 3990044 - RNA, 13 nt, Human herpesvirus 6
gacgaagaggaag

SEQ ID NO: 3990045 - RNA, 17 nt, Human herpesvirus 6
gacgcagauuuacggca

SEQ ID NO: 3990046 - RNA, 17 nt, Human herpesvirus 6
gacgccuugauguuucc

SEQ ID NO: 3990047 - RNA, 14 nt, Human herpesvirus 6
gacgugcugcaagg

SEQ ID NO: 3990048 - RNA, 21 nt, Human herpesvirus 6
gacucauagauuucauacugu

SEQ ID NO: 3990049 - RNA, 17 nt, Human herpesvirus 6
gacucccggcccagaga

SEQ ID NO: 3990050 - RNA, 23 nt, Human herpesvirus 6
gacucuauggugaguaccuguac

SEQ ID NO: 3990051 - RNA, 15 nt, Human herpesvirus 6
gacuguguguugaau

SEQ ID NO: 3990052 - RNA, 17 nt, Human herpesvirus 6
gagaacucuaaaagcug

SEQ ID NO: 3990053 - RNA, 20 nt, Human herpesvirus 6
gagaacucuaaaagcugcua

SEQ ID NO: 3990054 - RNA, 20 nt, Human herpesvirus 6
gagaauaggaaaagauaggc

SEQ ID NO: 3990055 - RNA, 20 nt, Human herpesvirus 6
gagacagcggacagcggggu

SEQ ID NO: 3990056 - RNA, 18 nt, Human herpesvirus 6
gagagacgcaccacggcu

SEQ ID NO: 3990057 - RNA, 22 nt, Human herpesvirus 6
gagauaaaaagagaggaaagaa

SEQ ID NO: 3990058 - RNA, 23 nt, Human herpesvirus 6
gagauacguguuuuugaugugcc

SEQ ID NO: 3990059 - RNA, 20 nt, Human herpesvirus 6
gagaucuggugaauguuucu

SEQ ID NO: 3990060 - RNA, 23 nt, Human herpesvirus 6
gagauucuuuaacuuauguuucu

SEQ ID NO: 3990061 - RNA, 11 nt, Human herpesvirus 6
gagauuucagg

SEQ ID NO: 3990062 - RNA, 20 nt, Human herpesvirus 6
gagccuguggacgugccggg

SEQ ID NO: 3990063 - RNA, 18 nt, Human herpesvirus 6
gagcgggcuaauguaugc

SEQ ID NO: 3990064 - RNA, 22 nt, Human herpesvirus 6
gaggcgacgaaagaggacggga

SEQ ID NO: 3990065 - RNA, 14 nt, Human herpesvirus 6
gaggggaacacgcc

SEQ ID NO: 3990066 - RNA, 18 nt, Human herpesvirus 6
gaguaacggaaaacgagu

SEQ ID NO: 3990067 - RNA, 20 nt, Human herpesvirus 6
gagucuggcaucugcggcuc

SEQ ID NO: 3990068 - RNA, 19 nt, Human herpesvirus 6
gauagcagaauagagagaa

SEQ ID NO: 3990069 - RNA, 14 nt, Human herpesvirus 6
gauauuaacacagu

SEQ ID NO: 3990070 - RNA, 11 nt, Human herpesvirus 6
gaucagugggu

SEQ ID NO: 3990071 - RNA, 17 nt, Human herpesvirus 6
ugcuuuacaucgaauuu

SEQ ID NO: 3990072 - RNA, 19 nt, Human herpesvirus 6
uggaaaacuaugugcauuc

SEQ ID NO: 3990073 - RNA, 19 nt, Human herpesvirus 6
uggaaaucaguucuccggg

SEQ ID NO: 3990074 - RNA, 17 nt, Human herpesvirus 6
uggaagaaccaaagaca

SEQ ID NO: 3990075 - RNA, 17 nt, Human herpesvirus 6
uggacacgguaccuguu

SEQ ID NO: 3990076 - RNA, 19 nt, Human herpesvirus 6
uggaggccuucaugagcca

SEQ ID NO: 3990077 - RNA, 14 nt, Human herpesvirus 6
uggaucgaaugcua

SEQ ID NO: 3990078 - RNA, 21 nt, Human herpesvirus 6
uggaugaucgccacaugugua

SEQ ID NO: 3990079 - RNA, 16 nt, Human herpesvirus 6
uggcacggugccaaag

SEQ ID NO: 3990080 - RNA, 20 nt, Human herpesvirus 6
uggccguuacaguuuccgcu

SEQ ID NO: 3990081 - RNA, 18 nt, Human herpesvirus 6
uggcgcgcauguugcagu

SEQ ID NO: 3990082 - RNA, 19 nt, Human herpesvirus 6
uggcgcgcauguugcaguu

SEQ ID NO: 3990083 - RNA, 15 nt, Human herpesvirus 6
ugggggguuccuccg

SEQ ID NO: 3990084 - RNA, 18 nt, Human herpesvirus 6
ugggugaguuuuaucacu

SEQ ID NO: 3990085 - RNA, 15 nt, Human herpesvirus 6
uggugcgaucgagca

SEQ ID NO: 3990086 - RNA, 12 nt, Human herpesvirus 6
ugguuugcuucg

SEQ ID NO: 3990087 - RNA, 22 nt, Human herpesvirus 6
uguaaagaaguaucgagauuuu

SEQ ID NO: 3990088 - RNA, 15 nt, Human herpesvirus 6
uguaaauacccuggg

SEQ ID NO: 3990089 - RNA, 20 nt, Human herpesvirus 6
uguaaauaugcuuauacugu

SEQ ID NO: 3990090 - RNA, 18 nt, Human herpesvirus 6
uguaaaucaaaaaaauga

SEQ ID NO: 3990091 - RNA, 17 nt, Human herpesvirus 6
uguaagaagaaaaaaac

SEQ ID NO: 3990092 - RNA, 19 nt, Human herpesvirus 6
uguaauacaucaacaaaca

SEQ ID NO: 3990093 - RNA, 17 nt, Human herpesvirus 6
uguacaauauaauuucu

SEQ ID NO: 3990094 - RNA, 22 nt, Human herpesvirus 6
uguagggugcuuugcuucagug

SEQ ID NO: 3990095 - RNA, 20 nt, Human herpesvirus 6
uguaguuuuuaaauccuguu

SEQ ID NO: 3990096 - RNA, 15 nt, Human herpesvirus 6
uguauauguaaauaa

SEQ ID NO: 3990097 - RNA, 15 nt, Human herpesvirus 6
uguaucguuugagau

SEQ ID NO: 3990098 - RNA, 16 nt, Human herpesvirus 6
uguccuuacaaaucuu

SEQ ID NO: 3990099 - RNA, 22 nt, Human herpesvirus 6
ugucggaggguuuuuucaucau

SEQ ID NO: 3990100 - RNA, 23 nt, Human herpesvirus 6
ugucgugcgccuuguguaucugu

SEQ ID NO: 3990101 - RNA, 22 nt, Human herpesvirus 6
ugucuauuuuuaaaccuguugu

SEQ ID NO: 3990102 - RNA, 19 nt, Human herpesvirus 6
ugucucacaagcuguccau

SEQ ID NO: 3990103 - RNA, 18 nt, Human herpesvirus 6
ugugacgaagauggaugu

SEQ ID NO: 3990104 - RNA, 19 nt, Human herpesvirus 6
ugugacuacguuuuguguu

SEQ ID NO: 3990105 - RNA, 20 nt, Human herpesvirus 6
ugugaugcguugcauuuugg

SEQ ID NO: 3990106 - RNA, 22 nt, Human herpesvirus 6
uguguauauugaauuguauaua

SEQ ID NO: 3990107 - RNA, 13 nt, Human herpesvirus 6
ugugucaugauua

SEQ ID NO: 3990108 - RNA, 17 nt, Human herpesvirus 6
uguguguuauaaggaag

SEQ ID NO: 3990109 - RNA, 17 nt, Human herpesvirus 6
uguguuagcuuugcgau

SEQ ID NO: 3990110 - RNA, 13 nt, Human herpesvirus 6
uguuagaauguau

SEQ ID NO: 3990111 - RNA, 16 nt, Human herpesvirus 6
uguucaacgucuucaa

SEQ ID NO: 3990112 - RNA, 19 nt, Human herpesvirus 6
uguucagucuaugcagcgc

SEQ ID NO: 3990113 - RNA, 16 nt, Human herpesvirus 6
uguucuagugcguauu

SEQ ID NO: 3990114 - RNA, 14 nt, Human herpesvirus 6
uguuguguuuacau

SEQ ID NO: 3990115 - RNA, 14 nt, Human herpesvirus 6
uguuguuuuuugga

SEQ ID NO: 3990116 - RNA, 13 nt, Human herpesvirus 6
uguuuccagaaua

SEQ ID NO: 3990117 - RNA, 18 nt, Human herpesvirus 6
uguuuccagagcauacau

SEQ ID NO: 3990118 - RNA, 12 nt, Human herpesvirus 6
uguuucugauuu

SEQ ID NO: 3990119 - RNA, 18 nt, Human herpesvirus 6
uguuucugauuuguucua

SEQ ID NO: 3990120 - RNA, 13 nt, Human herpesvirus 6
uguuuuguaugaa

SEQ ID NO: 3990121 - RNA, 15 nt, Human herpesvirus 6
uguuuuugcauguga

SEQ ID NO: 3990122 - RNA, 13 nt, Human herpesvirus 6
uguuuuuucaaaa

SEQ ID NO: 3990123 - RNA, 16 nt, Human herpesvirus 6
uuaaagauguguuaaa

SEQ ID NO: 3990124 - RNA, 17 nt, Human herpesvirus 6
uuaaauguuacugaacu

SEQ ID NO: 3990125 - RNA, 16 nt, Human herpesvirus 6
uuaacagugucuguuu

SEQ ID NO: 3990126 - RNA, 17 nt, Human herpesvirus 6
uuaacagugucuguuuu

SEQ ID NO: 3990127 - RNA, 22 nt, Human herpesvirus 6
uuaacaucgugauaacaaugca

SEQ ID NO: 3990128 - RNA, 19 nt, Human herpesvirus 6
uuaacgcgucaacaaacaa

SEQ ID NO: 3990129 - RNA, 13 nt, Human herpesvirus 6
uuaaucggaaugu

SEQ ID NO: 3990130 - RNA, 16 nt, Human herpesvirus 6
uuaaugagaggacagu

SEQ ID NO: 3990131 - RNA, 22 nt, Human herpesvirus 6
uuaaugcauucacaaggaaugu

SEQ ID NO: 3990132 - RNA, 17 nt, Human herpesvirus 6
uuaauguugaguaauug

SEQ ID NO: 3990133 - RNA, 14 nt, Human herpesvirus 6
uuacauauagucaa

SEQ ID NO: 3990134 - RNA, 12 nt, Human herpesvirus 6
uuacuaguuuuc

SEQ ID NO: 3990135 - RNA, 15 nt, Human herpesvirus 6
uuacuuaaacggaau

SEQ ID NO: 3990136 - RNA, 22 nt, Human herpesvirus 6
uuacuugaaaaaguaguugcua

SEQ ID NO: 3990137 - RNA, 17 nt, Human herpesvirus 6
uuauagcucaguguuug

SEQ ID NO: 3990138 - RNA, 20 nt, Human herpesvirus 6
uuaucgcaacacacagugaa

SEQ ID NO: 3990139 - RNA, 22 nt, Human herpesvirus 6
uuaucgcccgguaaauuacuag

SEQ ID NO: 3990140 - RNA, 23 nt, Human herpesvirus 6
uuauggacaacgguguggagaca

SEQ ID NO: 3990141 - RNA, 15 nt, Human herpesvirus 6
uuauuaaauguuacu

SEQ ID NO: 3990142 - RNA, 16 nt, Human herpesvirus 6
uucaaaauaaauacua

SEQ ID NO: 3990143 - RNA, 18 nt, Human herpesvirus 6
uucaaccuguuuccagaa

SEQ ID NO: 3990144 - RNA, 14 nt, Human herpesvirus 6
uucaacgucuucaa

SEQ ID NO: 3990145 - RNA, 20 nt, Human herpesvirus 6
uucaagguggagguuucuuu

SEQ ID NO: 3990146 - RNA, 16 nt, Human herpesvirus 6
uucaauaaaaacucaa

SEQ ID NO: 3990147 - RNA, 23 nt, Human herpesvirus 6
uucaauccggaguuaaguaaacu

SEQ ID NO: 3990148 - RNA, 15 nt, Human herpesvirus 6
uucaguaucuguuuu

SEQ ID NO: 3990149 - RNA, 15 nt, Human herpesvirus 6
uucaugauauuccag

SEQ ID NO: 3990150 - RNA, 15 nt, Human herpesvirus 6
uucauuuguuuuuua

SEQ ID NO: 3990151 - RNA, 22 nt, Human herpesvirus 6
uuccauugucgccucgaaacaa

SEQ ID NO: 3990152 - RNA, 19 nt, Human herpesvirus 6
uucccaccuaauaaacugu

SEQ ID NO: 3990153 - RNA, 21 nt, Human herpesvirus 6
uucccgugcuccguaagaaau

SEQ ID NO: 3990154 - RNA, 14 nt, Human herpesvirus 6
uucccuuuuacaau

SEQ ID NO: 3990155 - RNA, 16 nt, Human herpesvirus 6
uuccgauaguagauuu

SEQ ID NO: 3990156 - RNA, 17 nt, Human herpesvirus 6
uuccuuaauucuaaaua

SEQ ID NO: 3990157 - RNA, 15 nt, Human herpesvirus 6
uucgcagaggacagu

SEQ ID NO: 3990158 - RNA, 19 nt, Human herpesvirus 6
uucuaagacgagauguuuc

SEQ ID NO: 3990159 - RNA, 14 nt, Human herpesvirus 6
uucuacaaaaauac

SEQ ID NO: 3990160 - RNA, 21 nt, Human herpesvirus 6
uucuaccguagaccguuucuu

SEQ ID NO: 3990161 - RNA, 23 nt, Human herpesvirus 6
uucucggaaaacuaaaagucagu

SEQ ID NO: 3990162 - RNA, 21 nt, Human herpesvirus 6
uucucugacuauuucaaaaga

SEQ ID NO: 3990163 - RNA, 17 nt, Human herpesvirus 6
uucucugcaaaacaaag

SEQ ID NO: 3990164 - RNA, 20 nt, Human herpesvirus 6
uucucuuuuuuuuaaugcaa

SEQ ID NO: 3990165 - RNA, 17 nt, Human herpesvirus 6
uucuguuuugagagcua

SEQ ID NO: 3990166 - RNA, 13 nt, Human herpesvirus 6
uucuucuguaaau

SEQ ID NO: 3990167 - RNA, 22 nt, Human herpesvirus 6
uugaauaauaagccuaagaaau

SEQ ID NO: 3990168 - RNA, 17 nt, Human herpesvirus 6
uugacgguuuauaugca

SEQ ID NO: 3990169 - RNA, 13 nt, Human herpesvirus 6
uugauaguacuua

SEQ ID NO: 3990170 - RNA, 15 nt, Human herpesvirus 6
uugauguauggagau

SEQ ID NO: 3990171 - RNA, 14 nt, Human herpesvirus 6
uugcaaccaauaaa

SEQ ID NO: 3990172 - RNA, 16 nt, Human herpesvirus 6
uugcaagcagcggcga

SEQ ID NO: 3990173 - RNA, 14 nt, Human herpesvirus 6
uugcagaucuaauu

SEQ ID NO: 3990174 - RNA, 14 nt, Human herpesvirus 6
uugcaguucucgga

SEQ ID NO: 3990175 - RNA, 17 nt, Human herpesvirus 6
uuggauucaggcuuuaa

SEQ ID NO: 3990176 - RNA, 22 nt, Human herpesvirus 6
uuggcgccaaaaaaauacagua

SEQ ID NO: 3990177 - RNA, 19 nt, Human herpesvirus 6
uugggaccuucaggaacaa

SEQ ID NO: 3990178 - RNA, 15 nt, Human herpesvirus 6
uugggauguccauuu

SEQ ID NO: 3990179 - RNA, 21 nt, Human herpesvirus 6
uuguaaauagguaaacuguuu

SEQ ID NO: 3990180 - RNA, 23 nt, Human herpesvirus 6
uuguaaauagguaaacuguuuuu

SEQ ID NO: 3990181 - RNA, 18 nt, Human herpesvirus 6
uuguaauuucuauguaaa

SEQ ID NO: 3990182 - RNA, 14 nt, Human herpesvirus 6
uuguacaaacuuuu

SEQ ID NO: 3990183 - RNA, 21 nt, Human herpesvirus 6
uuguacaggaggcuauggcuu

SEQ ID NO: 3990184 - RNA, 21 nt, Human herpesvirus 6
uuguauauuuuuuuuuauuuu

SEQ ID NO: 3990185 - RNA, 15 nt, Human herpesvirus 6
uugugcgaauugugu

SEQ ID NO: 3990186 - RNA, 14 nt, Human herpesvirus 6B
acgccuauucuaau

SEQ ID NO: 3990187 - RNA, 18 nt, Human herpesvirus 6B
acgccuauucuaauuaua

SEQ ID NO: 3990188 - RNA, 21 nt, Human herpesvirus 6B
acgcgacacggugagucgcau

SEQ ID NO: 3990189 - RNA, 12 nt, Human herpesvirus 6B
acgcgccacagc

SEQ ID NO: 3990190 - RNA, 16 nt, Human herpesvirus 6B
acgcgccgacucucuc

SEQ ID NO: 3990191 - RNA, 15 nt, Human herpesvirus 6B
acgcggcaaccgcag

SEQ ID NO: 3990192 - RNA, 17 nt, Human herpesvirus 6B
acgcguguuuuggaauu

SEQ ID NO: 3990193 - RNA, 15 nt, Human herpesvirus 6B
acgcuugcuguaaag

SEQ ID NO: 3990194 - RNA, 20 nt, Human herpesvirus 6B
acgcuugcuguaaaguauug

SEQ ID NO: 3990195 - RNA, 16 nt, Human herpesvirus 6B
acggauucgaucgaga

SEQ ID NO: 3990196 - RNA, 16 nt, Human herpesvirus 6B
acggcagcggggaagg

SEQ ID NO: 3990197 - RNA, 15 nt, Human herpesvirus 6B
acggcgucacacagc

SEQ ID NO: 3990198 - RNA, 21 nt, Human herpesvirus 6B
acgucauguacggacagguuu

SEQ ID NO: 3990199 - RNA, 22 nt, Human herpesvirus 6B
acgucuccaucucuagaaucuu

SEQ ID NO: 3990200 - RNA, 14 nt, Human herpesvirus 6B
acgugaauuucaua

SEQ ID NO: 3990201 - RNA, 20 nt, Human herpesvirus 6B
acgugacuguaucaaauuua

SEQ ID NO: 3990202 - RNA, 19 nt, Human herpesvirus 6B
acguggccgucuccugcaa

SEQ ID NO: 3990203 - RNA, 19 nt, Human herpesvirus 6B
acgugggguaaaaauguua

SEQ ID NO: 3990204 - RNA, 14 nt, Human herpesvirus 6B
acuaaauuuuaugc

SEQ ID NO: 3990205 - RNA, 17 nt, Human herpesvirus 6B
acuaaugcgauuucacc

SEQ ID NO: 3990206 - RNA, 12 nt, Human herpesvirus 6B
acuaauguggau

SEQ ID NO: 3990207 - RNA, 12 nt, Human herpesvirus 6B
acuaccgaugcu

SEQ ID NO: 3990208 - RNA, 14 nt, Human herpesvirus 6B
acuaugagauuggu

SEQ ID NO: 3990209 - RNA, 12 nt, Human herpesvirus 6B
acuauguggaaa

SEQ ID NO: 3990210 - RNA, 18 nt, Human herpesvirus 6B
acucaagaauuacugcug

SEQ ID NO: 3990211 - RNA, 23 nt, Human herpesvirus 6B
acuccguauaugcuuuacuucug

SEQ ID NO: 3990212 - RNA, 14 nt, Human herpesvirus 6B
acucgauuugauaa

SEQ ID NO: 3990213 - RNA, 23 nt, Human herpesvirus 6B
acucucuacguuuacaucaacua

SEQ ID NO: 3990214 - RNA, 18 nt, Human herpesvirus 6B
acugaucgguauuugcga

SEQ ID NO: 3990215 - RNA, 19 nt, Human herpesvirus 6B
acugcacagaaucgagauc

SEQ ID NO: 3990216 - RNA, 22 nt, Human herpesvirus 6B
acugcuccagucauaggcacuu

SEQ ID NO: 3990217 - RNA, 16 nt, Human herpesvirus 6B
acugcugcgaucuuug

SEQ ID NO: 3990218 - RNA, 23 nt, Human herpesvirus 6B
acuggagcuagagaaaauuauag

SEQ ID NO: 3990219 - RNA, 20 nt, Human herpesvirus 6B
acuguaaaaaaaauucucug

SEQ ID NO: 3990220 - RNA, 18 nt, Human herpesvirus 6B
acuguauggcaaaaccaa

SEQ ID NO: 3990221 - RNA, 15 nt, Human herpesvirus 6B
acugugaaaagugcu

SEQ ID NO: 3990222 - RNA, 11 nt, Human herpesvirus 6B
acuucuaaaau

SEQ ID NO: 3990223 - RNA, 14 nt, Human herpesvirus 6B
acuuuaccucugcu

SEQ ID NO: 3990224 - RNA, 13 nt, Human herpesvirus 6B
acuuuuucaauug

SEQ ID NO: 3990225 - RNA, 16 nt, Human herpesvirus 6B
acuuuuuucuaaaacc

SEQ ID NO: 3990226 - RNA, 14 nt, Human herpesvirus 6B
agaaaaagaacugu

SEQ ID NO: 3990227 - RNA, 21 nt, Human herpesvirus 6B
agaaagcguguucaaaaaugu

SEQ ID NO: 3990228 - RNA, 13 nt, Human herpesvirus 6B
agaaaggcggaga

SEQ ID NO: 3990229 - RNA, 19 nt, Human herpesvirus 6B
agaaauguugccuuuguaa

SEQ ID NO: 3990230 - RNA, 11 nt, Human herpesvirus 6B
agaaauguuuu

SEQ ID NO: 3990231 - RNA, 19 nt, Human herpesvirus 6B
agaaauuuaauugcaauuu

SEQ ID NO: 3990232 - RNA, 17 nt, Human herpesvirus 6B
agaaauuuuuuagaaca

SEQ ID NO: 3990233 - RNA, 21 nt, Human herpesvirus 6B
agaacagaggaagaaaggagu

SEQ ID NO: 3990234 - RNA, 18 nt, Human herpesvirus 6B
agaacagcgcauaaauaa

SEQ ID NO: 3990235 - RNA, 17 nt, Human herpesvirus 6B
agaagaucuaaugaaug

SEQ ID NO: 3990236 - RNA, 22 nt, Human herpesvirus 6B
agaagccaccaauagugggaga

SEQ ID NO: 3990237 - RNA, 13 nt, Human herpesvirus 6B
agaaguuacaaga

SEQ ID NO: 3990238 - RNA, 16 nt, Human herpesvirus 6B
agaauacgcuguguuu

SEQ ID NO: 3990239 - RNA, 15 nt, Human herpesvirus 6B
agaaucuuaaaggau

SEQ ID NO: 3990240 - RNA, 19 nt, Human herpesvirus 6B
agaaugaauuugagaagau

SEQ ID NO: 3990241 - RNA, 14 nt, Human herpesvirus 6B
agaauuccaaggcu

SEQ ID NO: 3990242 - RNA, 17 nt, Human herpesvirus 6B
agacaaaaacaugugcu

SEQ ID NO: 3990243 - RNA, 22 nt, Human herpesvirus 6B
agacaagggugugaaacuauga

SEQ ID NO: 3990244 - RNA, 12 nt, Human herpesvirus 6B
agacagaaauuu

SEQ ID NO: 3990245 - RNA, 21 nt, Human herpesvirus 6B
agacagaguucgguccaagga

SEQ ID NO: 3990246 - RNA, 21 nt, Human herpesvirus 6B
agacaguuuacuaaaaaagau

SEQ ID NO: 3990247 - RNA, 19 nt, Human herpesvirus 6B
agaccgcuauggcagaaag

SEQ ID NO: 3990248 - RNA, 15 nt, Human herpesvirus 6B
agacgccuauucuaa

SEQ ID NO: 3990249 - RNA, 18 nt, Human herpesvirus 6B
agacuaaacuuaacuuau

SEQ ID NO: 3990250 - RNA, 17 nt, Human herpesvirus 6B
agacugcugcuguggag

SEQ ID NO: 3990251 - RNA, 19 nt, Human herpesvirus 6B
agacuuugcugauucuguu

SEQ ID NO: 3990252 - RNA, 20 nt, Human herpesvirus 6B
agagacuuugcugauucugu

SEQ ID NO: 3990253 - RNA, 22 nt, Human herpesvirus 6B
agagcugaugauuugaaauguu

SEQ ID NO: 3990254 - RNA, 22 nt, Human herpesvirus 6B
agagggagaaacggacacgcgc

SEQ ID NO: 3990255 - RNA, 20 nt, Human herpesvirus 6B
agaggguuccuccgcgggac

SEQ ID NO: 3990256 - RNA, 21 nt, Human herpesvirus 6B
agagguuuuaccuguugguua

SEQ ID NO: 3990257 - RNA, 14 nt, Human herpesvirus 6B
agaguacggaagug

SEQ ID NO: 3990258 - RNA, 22 nt, Human herpesvirus 6B
agaguacuuucguuuacgaauu

SEQ ID NO: 3990259 - RNA, 20 nt, Human herpesvirus 6B
agaguggcgauaauguuauc

SEQ ID NO: 3990260 - RNA, 14 nt, Human herpesvirus 6B
agaguuucauccug

SEQ ID NO: 3990261 - RNA, 12 nt, Human herpesvirus 6B
agauacagguuu

SEQ ID NO: 3990262 - RNA, 20 nt, Human herpesvirus 6B
agauauauugguagacagga

SEQ ID NO: 3990263 - RNA, 23 nt, Human herpesvirus 6B
agauaucugaaacacuaagugcc

SEQ ID NO: 3990264 - RNA, 18 nt, Human herpesvirus 6B
agaucacaacaaacaugu

SEQ ID NO: 3990265 - RNA, 12 nt, Human herpesvirus 6B
agaucaucgcca

SEQ ID NO: 3990266 - RNA, 13 nt, Human herpesvirus 6B
agaucauggugau

SEQ ID NO: 3990267 - RNA, 15 nt, Human herpesvirus 6B
agaucuggauaaaga

SEQ ID NO: 3990268 - RNA, 17 nt, Human herpesvirus 6B
agaucuggauaaagaua

SEQ ID NO: 3990269 - RNA, 15 nt, Human herpesvirus 6B
agaucuugaaaagcc

SEQ ID NO: 3990270 - RNA, 12 nt, Human herpesvirus 6B
agaugcaaaaua

SEQ ID NO: 3990271 - RNA, 14 nt, Human herpesvirus 6B
agauggcaaaacaa

SEQ ID NO: 3990272 - RNA, 18 nt, Human herpesvirus 6B
agauguguuaaagaaugc

SEQ ID NO: 3990273 - RNA, 20 nt, Human herpesvirus 6B
agauucauaauaggcaauuu

SEQ ID NO: 3990274 - RNA, 19 nt, Human herpesvirus 6B
agauuccgucaucuagaga

SEQ ID NO: 3990275 - RNA, 23 nt, Human herpesvirus 6B
agauuccgucaucuagagaauau

SEQ ID NO: 3990276 - RNA, 11 nt, Human herpesvirus 6B
agauuuacaga

SEQ ID NO: 3990277 - RNA, 21 nt, Human herpesvirus 6B
agcaaauuuaguuaauucucg

SEQ ID NO: 3990278 - RNA, 14 nt, Human herpesvirus 6B
agcaagaaaaagag

SEQ ID NO: 3990279 - RNA, 16 nt, Human herpesvirus 6B
agcaggagaaaaauuu

SEQ ID NO: 3990280 - RNA, 21 nt, Human herpesvirus 6B
agcauccacccugauucucuu

SEQ ID NO: 3990281 - RNA, 19 nt, Human herpesvirus 6B
agccccugcuugaaagagu

SEQ ID NO: 3990282 - RNA, 18 nt, Human herpesvirus 6B
agcccugagagcaggagc

SEQ ID NO: 3990283 - RNA, 15 nt, Human herpesvirus 6B
agccgacuauggaug

SEQ ID NO: 3990284 - RNA, 15 nt, Human herpesvirus 6B
agccggagcccugag

SEQ ID NO: 3990285 - RNA, 18 nt, Human herpesvirus 6B
agccgggagauuccucug

SEQ ID NO: 3990286 - RNA, 23 nt, Human herpesvirus 6B
agccguuucguucccucucaaac

SEQ ID NO: 3990287 - RNA, 19 nt, Human herpesvirus 6B
agcgcaucugccgaaagcu

SEQ ID NO: 3990288 - RNA, 17 nt, Human herpesvirus 6B
agcuagacgugucuuca

SEQ ID NO: 3990289 - RNA, 15 nt, Human herpesvirus 6B
agcuaucggacaggc

SEQ ID NO: 3990290 - RNA, 15 nt, Human herpesvirus 6B
agcucuacacagagu

SEQ ID NO: 3990291 - RNA, 20 nt, Human herpesvirus 6B
agcucuguucucucccacuc

SEQ ID NO: 3990292 - RNA, 14 nt, Human herpesvirus 6B
agcugacaucugca

SEQ ID NO: 3990293 - RNA, 14 nt, Human herpesvirus 6B
agcugaugauuuga

SEQ ID NO: 3990294 - RNA, 18 nt, Human herpesvirus 6B
agcugcuaacggagcaac

SEQ ID NO: 3990295 - RNA, 23 nt, Human herpesvirus 6B
agcugcuaacggagcaaccgcag

SEQ ID NO: 3990296 - RNA, 21 nt, Human herpesvirus 6B
agcuuguuaugacaaaaccau

SEQ ID NO: 3990297 - RNA, 16 nt, Human herpesvirus 6B
agcuuucauaagcucu

SEQ ID NO: 3990298 - RNA, 16 nt, Human herpesvirus 6B
aggaaauaccaaagaa

SEQ ID NO: 3990299 - RNA, 12 nt, Human herpesvirus 6B
aggaagaggagg

SEQ ID NO: 3990300 - RNA, 19 nt, Human herpesvirus 6B
aggagaaaaauuugauaua

SEQ ID NO: 3990301 - RNA, 13 nt, Human herpesvirus 6B
aggagaagaacag

SEQ ID NO: 3990302 - RNA, 9 nt, Human herpesvirus 6B
aggagaggg

SEQ ID NO: 3990303 - RNA, 17 nt, Human herpesvirus 6B
aggaggaggagagggag

SEQ ID NO: 3990304 - RNA, 15 nt, Human herpesvirus 6B
aggcgaacuaagaaa

SEQ ID NO: 3990305 - RNA, 19 nt, Human herpesvirus 6B
aggcgaagauacuuucaau

SEQ ID NO: 3990306 - RNA, 17 nt, Human herpesvirus 6B
aggcgagauuuggugga

SEQ ID NO: 3990307 - RNA, 20 nt, Human herpesvirus 6B
aggcgcagcagcagcuccaa

SEQ ID NO: 3990308 - RNA, 22 nt, Human herpesvirus 6B
aggcguagaccuuugcgcaggc

SEQ ID NO: 3990309 - RNA, 19 nt, Human herpesvirus 6B
aggcuuuauggagauuuga

SEQ ID NO: 3990310 - RNA, 18 nt, Human herpesvirus 6B
agggaagccagccgcccu

SEQ ID NO: 3990311 - RNA, 19 nt, Human herpesvirus 6B
agggaauaacagaugagga

SEQ ID NO: 3990312 - RNA, 21 nt, Human herpesvirus 6B
agggacccacacgcggggauc

SEQ ID NO: 3990313 - RNA, 22 nt, Human herpesvirus 6B
agggauucguaguuuaugaaau

SEQ ID NO: 3990314 - RNA, 15 nt, Human herpesvirus 6B
agggcagagagccgc

SEQ ID NO: 3990315 - RNA, 13 nt, Human herpesvirus 6B
agggcgggcggac

SEQ ID NO: 3990316 - RNA, 18 nt, Human herpesvirus 6B
aggggcuaccgucuugga

SEQ ID NO: 3990317 - RNA, 19 nt, Human herpesvirus 6B
aggguuccuccgcgggacc

SEQ ID NO: 3990318 - RNA, 23 nt, Human herpesvirus 6B
agguaucugccccccuucaucca

SEQ ID NO: 3990319 - RNA, 14 nt, Human herpesvirus 6B
aggucaaaaaacuc

SEQ ID NO: 3990320 - RNA, 15 nt, Human herpesvirus 6B
agguccgacacgccc

SEQ ID NO: 3990321 - RNA, 15 nt, Human herpesvirus 6B
aggugauuugaacag

SEQ ID NO: 3990322 - RNA, 18 nt, Human herpesvirus 6B
aggugauuugaacagaga

SEQ ID NO: 3990323 - RNA, 20 nt, Human herpesvirus 6B
aggugauuuuuauuguaaac

SEQ ID NO: 3990324 - RNA, 17 nt, Human herpesvirus 6B
agguuacaaaggggcua

SEQ ID NO: 3990325 - RNA, 16 nt, Human herpesvirus 6B
agguucagacugcugc

SEQ ID NO: 3990326 - RNA, 15 nt, Human herpesvirus 6B
agguuuuuucacccc

SEQ ID NO: 3990327 - RNA, 21 nt, Human herpesvirus 6B
aguaacggaaaaauuuuacaa

SEQ ID NO: 3990328 - RNA, 14 nt, Human herpesvirus 6B
aguaccgaauaaaa

SEQ ID NO: 3990329 - RNA, 19 nt, Human herpesvirus 6B
aguaccucuaugauacuuu

SEQ ID NO: 3990330 - RNA, 18 nt, Human herpesvirus 6B
aguaucagcuaaaaauau

SEQ ID NO: 3990331 - RNA, 16 nt, Human herpesvirus 6B
aguauguuuuguacaa

SEQ ID NO: 3990332 - RNA, 17 nt, Human herpesvirus 6B
aguauucgugugugaaa

SEQ ID NO: 3990333 - RNA, 21 nt, Human herpesvirus 6B
aguccaucgaguaucgugucu

SEQ ID NO: 3990334 - RNA, 19 nt, Human herpesvirus 6B
agucuagacaugauauucu

SEQ ID NO: 3990335 - RNA, 13 nt, Human herpesvirus 6B
agucucaaaaauu

SEQ ID NO: 3990336 - RNA, 14 nt, Human herpesvirus 6B
agucucaaaaauua

SEQ ID NO: 3990337 - RNA, 15 nt, Human herpesvirus 6B
agucuccacagggca

SEQ ID NO: 3990338 - RNA, 19 nt, Human herpesvirus 6B
agugacaguaacggcggcg

SEQ ID NO: 3990339 - RNA, 17 nt, Human herpesvirus 6B
agugcguaaucgcaaga

SEQ ID NO: 3990340 - RNA, 18 nt, Human herpesvirus 6B
aguggaaguguaaauguc

SEQ ID NO: 3990341 - RNA, 17 nt, Human herpesvirus 6B
aguggcgauaauguuau

SEQ ID NO: 3990342 - RNA, 20 nt, Human herpesvirus 6B
aguggcgcgcguuuuuggug

SEQ ID NO: 3990343 - RNA, 22 nt, Human herpesvirus 6B
aguggcgcgcguuuuuggugaa

SEQ ID NO: 3990344 - RNA, 17 nt, Human herpesvirus 6B
agugggagagcggaaga

SEQ ID NO: 3990345 - RNA, 16 nt, Human herpesvirus 6B
agugugcguuauuuuc

SEQ ID NO: 3990346 - RNA, 19 nt, Human herpesvirus 6B
aguucaaaauuuuucugua

SEQ ID NO: 3990347 - RNA, 14 nt, Human herpesvirus 6B
aguucuucaaaaaa

SEQ ID NO: 3990348 - RNA, 16 nt, Human herpesvirus 6B
aguugguucgaacaaa

SEQ ID NO: 3990349 - RNA, 15 nt, Human herpesvirus 6B
aguuucagaugauca

SEQ ID NO: 3990350 - RNA, 14 nt, Human herpesvirus 6B
aguuucuuuggaaa

SEQ ID NO: 3990351 - RNA, 15 nt, Human herpesvirus 6B
aguuuucaugugaaa

SEQ ID NO: 3990352 - RNA, 18 nt, Human herpesvirus 6B
aguuuugugauccuguaa

SEQ ID NO: 3990353 - RNA, 14 nt, Human herpesvirus 6B
auaaacaugauugu

SEQ ID NO: 3990354 - RNA, 20 nt, Human herpesvirus 6B
auaaacaugauuguaauaaa

SEQ ID NO: 3990355 - RNA, 17 nt, Human herpesvirus 6B
auaaaguuaaagaucag

SEQ ID NO: 3990356 - RNA, 15 nt, Human herpesvirus 6B
auaaaucgccauaau

SEQ ID NO: 3990357 - RNA, 14 nt, Human herpesvirus 6B
auaaauguagcaca

SEQ ID NO: 3990358 - RNA, 13 nt, Human herpesvirus 6B
auaaauuccucuc

SEQ ID NO: 3990359 - RNA, 18 nt, Human herpesvirus 6B
auaacucuuggauugcag

SEQ ID NO: 3990360 - RNA, 13 nt, Human herpesvirus 6B
auaagaguguaaa

SEQ ID NO: 3990361 - RNA, 15 nt, Human herpesvirus 6B
auaagauuuacagac

SEQ ID NO: 3990362 - RNA, 14 nt, Human herpesvirus 6B
auaagcagccgaau

SEQ ID NO: 3990363 - RNA, 16 nt, Human herpesvirus 6B
auaaugugaacuaaau

SEQ ID NO: 3990364 - RNA, 19 nt, Human herpesvirus 6B
auacaaaauuguauugagc

SEQ ID NO: 3990365 - RNA, 20 nt, Human herpesvirus 6B
auacacacgcgcggagcacg

SEQ ID NO: 3990366 - RNA, 14 nt, Human herpesvirus 6B
auacagguuugcuc

SEQ ID NO: 3990367 - RNA, 22 nt, Human herpesvirus 6B
auacauccagaaaagcaaacau

SEQ ID NO: 3990368 - RNA, 17 nt, Human herpesvirus 6B
auaccauuuuauacgaa

SEQ ID NO: 3990369 - RNA, 15 nt, Human herpesvirus 6B
auaccgugacagcaa

SEQ ID NO: 3990370 - RNA, 18 nt, Human herpesvirus 6B
auaccuaguacaaagaua

SEQ ID NO: 3990371 - RNA, 21 nt, Human herpesvirus 6B
auacuuccucgcgguauaaug

SEQ ID NO: 3990372 - RNA, 12 nt, Human herpesvirus 6B
auacuugaagag

SEQ ID NO: 3990373 - RNA, 14 nt, Human herpesvirus 6B
auagagcauccugu

SEQ ID NO: 3990374 - RNA, 14 nt, Human herpesvirus 6B
auagaggaauugcu

SEQ ID NO: 3990375 - RNA, 22 nt, Human herpesvirus 6B
auagaucuucggcgcugauucc

SEQ ID NO: 3990376 - RNA, 16 nt, Human herpesvirus 6B
auaggcucggcagggg

SEQ ID NO: 3990377 - RNA, 17 nt, Human herpesvirus 6B
auagguaaacuguucuu

SEQ ID NO: 3990378 - RNA, 18 nt, Human herpesvirus 6B
auagguuauuuacaaaag

SEQ ID NO: 3990379 - RNA, 22 nt, Human herpesvirus 6B
auauaaaaccaaaaaaaaagug

SEQ ID NO: 3990380 - RNA, 13 nt, Human herpesvirus 6B
auauauaugaauu

SEQ ID NO: 3990381 - RNA, 23 nt, Human herpesvirus 6B
auaucgagaguacggaagugccu

SEQ ID NO: 3990382 - RNA, 16 nt, Human herpesvirus 6B
auaucgauucuguaau

SEQ ID NO: 3990383 - RNA, 19 nt, Human herpesvirus 6B
auauuauaaggucauuuua

SEQ ID NO: 3990384 - RNA, 12 nt, Human herpesvirus 6B
auauucaguuuu

SEQ ID NO: 3990385 - RNA, 22 nt, Human herpesvirus 6B
auauuccucaagauaugggaaa

SEQ ID NO: 3990386 - RNA, 18 nt, Human herpesvirus 6B
auauuucuaucuggaaau

SEQ ID NO: 3990387 - RNA, 13 nt, Human herpesvirus 6B
auauuuuuacugc

SEQ ID NO: 3990388 - RNA, 17 nt, Human herpesvirus 6B
aucaaacuuuuuuugaa

SEQ ID NO: 3990389 - RNA, 16 nt, Human herpesvirus 6B
aucaacacaccugccu

SEQ ID NO: 3990390 - RNA, 14 nt, Human herpesvirus 6B
aucaacuauacuua

SEQ ID NO: 3990391 - RNA, 15 nt, Human herpesvirus 6B
aucaagacuacucug

SEQ ID NO: 3990392 - RNA, 22 nt, Human herpesvirus 6B
aucaccaucaacacaccugccu

SEQ ID NO: 3990393 - RNA, 14 nt, Human herpesvirus 6B
aucauauauugaaa

SEQ ID NO: 3990394 - RNA, 23 nt, Human herpesvirus 6B
aucaugauaaauuguuuccgaau

SEQ ID NO: 3990395 - RNA, 21 nt, Human herpesvirus 6B
auccaaugaugaaacuccuuc

SEQ ID NO: 3990396 - RNA, 13 nt, Human herpesvirus 6B
auccccagaagga

SEQ ID NO: 3990397 - RNA, 18 nt, Human herpesvirus 6B
auccuguuuucccaccua

SEQ ID NO: 3990398 - RNA, 11 nt, Human herpesvirus 6B
aucggaagagg

SEQ ID NO: 3990399 - RNA, 15 nt, Human herpesvirus 6B
aucggcccuugguga

SEQ ID NO: 3990400 - RNA, 18 nt, Human herpesvirus 6B
aucgugcuuguuuuggug

SEQ ID NO: 3990401 - RNA, 20 nt, Human herpesvirus 6B
aucucaagaaacaaguacua

SEQ ID NO: 3990402 - RNA, 22 nt, Human herpesvirus 6B
aucucgaaauauaaaaccaaaa

SEQ ID NO: 3990403 - RNA, 17 nt, Human herpesvirus 6B
aucucgaugccaaagcu

SEQ ID NO: 3990404 - RNA, 20 nt, Human herpesvirus 6B
aucugcuuuguuuucuuaug

SEQ ID NO: 3990405 - RNA, 23 nt, Human herpesvirus 6B
aucuggugagaaagacuucuugc

SEQ ID NO: 3990406 - RNA, 18 nt, Human herpesvirus 6B
aucuucaucccuguucag

SEQ ID NO: 3990407 - RNA, 18 nt, Human herpesvirus 6B
aucuuccuguacagaauu

SEQ ID NO: 3990408 - RNA, 22 nt, Human herpesvirus 6B
aucuuccuuuucaguauagaca

SEQ ID NO: 3990409 - RNA, 22 nt, Human herpesvirus 6B
aucuucgaaucaaauucaaacu

SEQ ID NO: 3990410 - RNA, 22 nt, Human herpesvirus 6B
augaaaauaucauuaaauuguu

SEQ ID NO: 3990411 - RNA, 14 nt, Human herpesvirus 6B
augaaauuuucaau

SEQ ID NO: 3990412 - RNA, 17 nt, Human herpesvirus 6B
uugacgguuuauaugca

SEQ ID NO: 3990413 - RNA, 17 nt, Human herpesvirus 6B
uugacgucugggaucau

SEQ ID NO: 3990414 - RNA, 22 nt, Human herpesvirus 6B
uugaggaaaugcagcaguuuuu

SEQ ID NO: 3990415 - RNA, 15 nt, Human herpesvirus 6B
uugauagcauuauua

SEQ ID NO: 3990416 - RNA, 14 nt, Human herpesvirus 6B
uugaugcuguugcu

SEQ ID NO: 3990417 - RNA, 13 nt, Human herpesvirus 6B
uugauuuguaaaa

SEQ ID NO: 3990418 - RNA, 19 nt, Human herpesvirus 6B
uugcaauuuggcugcguug

SEQ ID NO: 3990419 - RNA, 20 nt, Human herpesvirus 6B
uugcaguggcgcgcguuuuu

SEQ ID NO: 3990420 - RNA, 15 nt, Human herpesvirus 6B
uugcauuaaggaaaa

SEQ ID NO: 3990421 - RNA, 16 nt, Human herpesvirus 6B
uugcgaucuauauaaa

SEQ ID NO: 3990422 - RNA, 20 nt, Human herpesvirus 6B
uugcgucuaaaaauauggaa

SEQ ID NO: 3990423 - RNA, 11 nt, Human herpesvirus 6B
uugcugucaca

SEQ ID NO: 3990424 - RNA, 19 nt, Human herpesvirus 6B
uuggaugccuacauaugcc

SEQ ID NO: 3990425 - RNA, 19 nt, Human herpesvirus 6B
uugggaccuucaggaacaa

SEQ ID NO: 3990426 - RNA, 13 nt, Human herpesvirus 6B
uuggugugcauua

SEQ ID NO: 3990427 - RNA, 15 nt, Human herpesvirus 6B
uugucagauuuccca

SEQ ID NO: 3990428 - RNA, 13 nt, Human herpesvirus 6B
uugucauuucccu

SEQ ID NO: 3990429 - RNA, 21 nt, Human herpesvirus 6B
uuguggcuauuugacaauaaa

SEQ ID NO: 3990430 - RNA, 19 nt, Human herpesvirus 6B
uuguuaucuuauguauaua

SEQ ID NO: 3990431 - RNA, 23 nt, Human herpesvirus 6B
uuguucagagcugaugauuugaa

SEQ ID NO: 3990432 - RNA, 18 nt, Human herpesvirus 6B
uuuaaacuccggaaaaga

SEQ ID NO: 3990433 - RNA, 18 nt, Human herpesvirus 6B
uuuacaaucaucugguaa

SEQ ID NO: 3990434 - RNA, 20 nt, Human herpesvirus 6B
uuuagaugucgggccacauu

SEQ ID NO: 3990435 - RNA, 14 nt, Human herpesvirus 6B
uuuaggacaugugg

SEQ ID NO: 3990436 - RNA, 14 nt, Human herpesvirus 6B
uuuauauuaaugau

SEQ ID NO: 3990437 - RNA, 13 nt, Human herpesvirus 6B
uuuauccggccaa

SEQ ID NO: 3990438 - RNA, 22 nt, Human herpesvirus 6B
uuuauguaaacauagaaucucc

SEQ ID NO: 3990439 - RNA, 19 nt, Human herpesvirus 6B
uuuauguugugaucaagug

SEQ ID NO: 3990440 - RNA, 19 nt, Human herpesvirus 6B
uuuauuuucguauaaaaug

SEQ ID NO: 3990441 - RNA, 18 nt, Human herpesvirus 6B
uuucaccccccucuugca

SEQ ID NO: 3990442 - RNA, 23 nt, Human herpesvirus 6B
uuuccccccgccgccuucucugu

SEQ ID NO: 3990443 - RNA, 13 nt, Human herpesvirus 6B
uuuccuugacagu

SEQ ID NO: 3990444 - RNA, 17 nt, Human herpesvirus 6B
uuucuguuuuucucaua

SEQ ID NO: 3990445 - RNA, 16 nt, Human herpesvirus 6B
uuugaggcaacuuuuu

SEQ ID NO: 3990446 - RNA, 19 nt, Human herpesvirus 6B
uuugauccauuuucugaaa

SEQ ID NO: 3990447 - RNA, 15 nt, Human herpesvirus 6B
uuugcgucagaguuu

SEQ ID NO: 3990448 - RNA, 17 nt, Human herpesvirus 6B
uuugcguuauuugugca

SEQ ID NO: 3990449 - RNA, 23 nt, Human herpesvirus 6B
uuuguuccagauguagguuucaa

SEQ ID NO: 3990450 - RNA, 20 nt, Human herpesvirus 6B
uuuguuucagcguauucaga

SEQ ID NO: 3990451 - RNA, 18 nt, Human herpesvirus 6B
uuuuauuuuguggcuauu

SEQ ID NO: 3990452 - RNA, 11 nt, Human herpesvirus 6B
uuuucaagaau

SEQ ID NO: 3990453 - RNA, 19 nt, Human herpesvirus 6B
uuuucaccccccucuugca

SEQ ID NO: 3990454 - RNA, 13 nt, Human herpesvirus 6B
uuuucuauuaaaa

SEQ ID NO: 3990455 - RNA, 15 nt, Human herpesvirus 6B
uuuucugcaaaacaa

SEQ ID NO: 3990456 - RNA, 18 nt, Human herpesvirus 6B
uuuucugcucaacaaugu

SEQ ID NO: 3990457 - RNA, 13 nt, Human herpesvirus 6B
uuuugaaaucacu

SEQ ID NO: 3990458 - RNA, 18 nt, Human herpesvirus 6B
uuuugcgucgucugugca

SEQ ID NO: 3990459 - RNA, 19 nt, Human herpesvirus 6B
uuuuuaaauaauaguaaac

SEQ ID NO: 3990460 - RNA, 20 nt, Human herpesvirus 6B
uuuuucacagaauguauaua

SEQ ID NO: 3990461 - RNA, 11 nt, Human herpesvirus 6B
uuuuucacccc

SEQ ID NO: 3990462 - RNA, 19 nt, Human herpesvirus 6B
uuuuugaugacuuauaaua

SEQ ID NO: 3990463 - RNA, 15 nt, Human herpesvirus 6B
uuuuuugaaaucacu

SEQ ID NO: 3990464 - RNA, 13 nt, Human herpesvirus 6B
uuuuuuuuucaua

SEQ ID NO: 3990465 - RNA, 22 nt, Human herpesvirus 6B
ccgucgcgcucgccgucgucgc

SEQ ID NO: 3990466 - RNA, 17 nt, Human herpesvirus 6B
ccgucgucgcucucccu

SEQ ID NO: 3990467 - RNA, 16 nt, Human herpesvirus 6B
ccgucucagugucacu

SEQ ID NO: 3990468 - RNA, 13 nt, Human herpesvirus 6B
ccgucuccugcaa

SEQ ID NO: 3990469 - RNA, 13 nt, Human herpesvirus 6B
ccgugacacacag

SEQ ID NO: 3990470 - RNA, 18 nt, Human herpesvirus 6B
ccguguuggcggauuaca

SEQ ID NO: 3990471 - RNA, 15 nt, Human herpesvirus 6B
ccuaagcuggacaga

SEQ ID NO: 3990472 - RNA, 23 nt, Human herpesvirus 6B
ccuagguuuucgaaacgggagaa

SEQ ID NO: 3990473 - RNA, 13 nt, Human herpesvirus 6B
ccuauucaaaagu

SEQ ID NO: 3990474 - RNA, 19 nt, Human herpesvirus 6B
ccucaacuaaaucaugucu

SEQ ID NO: 3990475 - RNA, 19 nt, Human herpesvirus 6B
ccucccauagaggcgcgcg

SEQ ID NO: 3990476 - RNA, 14 nt, Human herpesvirus 6B
ccucccuccauccc

SEQ ID NO: 3990477 - RNA, 12 nt, Human herpesvirus 6B
ccucgcucuccu

SEQ ID NO: 3990478 - RNA, 15 nt, Human herpesvirus 6B
ccucgucuguugcug

SEQ ID NO: 3990479 - RNA, 15 nt, Human herpesvirus 6B
ccucucuccgccucc

SEQ ID NO: 3990480 - RNA, 17 nt, Human herpesvirus 6B
ccucugcggcucucugc

SEQ ID NO: 3990481 - RNA, 14 nt, Human herpesvirus 6B
ccucuugcaguggc

SEQ ID NO: 3990482 - RNA, 19 nt, Human herpesvirus 6B
ccugaaaccccacaaagcc

SEQ ID NO: 3990483 - RNA, 14 nt, Human herpesvirus 6B
ccugagaccgagag

SEQ ID NO: 3990484 - RNA, 13 nt, Human herpesvirus 6B
ccugaucacagag

SEQ ID NO: 3990485 - RNA, 14 nt, Human herpesvirus 6B
ccugauggauuaca

SEQ ID NO: 3990486 - RNA, 20 nt, Human herpesvirus 6B
ccugcaauuugaauucugcu

SEQ ID NO: 3990487 - RNA, 14 nt, Human herpesvirus 6B
ccugccuacacugc

SEQ ID NO: 3990488 - RNA, 15 nt, Human herpesvirus 6B
ccuggaagaaggaaa

SEQ ID NO: 3990489 - RNA, 18 nt, Human herpesvirus 6B
ccuggcgggcaccgaggg

SEQ ID NO: 3990490 - RNA, 22 nt, Human herpesvirus 6B
ccuguccgugacacacagaaua

SEQ ID NO: 3990491 - RNA, 19 nt, Human herpesvirus 6B
ccuuuggccuugauuguga

SEQ ID NO: 3990492 - RNA, 18 nt, Human herpesvirus 6B
cgaauuauguauguguua

SEQ ID NO: 3990493 - RNA, 21 nt, Human herpesvirus 6B
cgaauuauguauguguuaaua

SEQ ID NO: 3990494 - RNA, 16 nt, Human herpesvirus 6B
cgacagcgggugcuca

SEQ ID NO: 3990495 - RNA, 16 nt, Human herpesvirus 6B
cgacgcccauagaaga

SEQ ID NO: 3990496 - RNA, 20 nt, Human herpesvirus 6B
cgacucuuuccgaugugucu

SEQ ID NO: 3990497 - RNA, 16 nt, Human herpesvirus 6B
cgagccggacaggagg

SEQ ID NO: 3990498 - RNA, 20 nt, Human herpesvirus 6B
cgagccggacaggaggugcg

SEQ ID NO: 3990499 - RNA, 17 nt, Human herpesvirus 6B
cgaggaauguguuucua

SEQ ID NO: 3990500 - RNA, 17 nt, Human herpesvirus 6B
cgaggaguuaaaacuaa

SEQ ID NO: 3990501 - RNA, 11 nt, Human herpesvirus 6B
cgauaucucac

SEQ ID NO: 3990502 - RNA, 18 nt, Human herpesvirus 6B
cgauccgucaggaccagc

SEQ ID NO: 3990503 - RNA, 21 nt, Human herpesvirus 6B
cgaugcgaagggaguaaggag

SEQ ID NO: 3990504 - RNA, 14 nt, Human herpesvirus 6B
cgaugcgccacagg

SEQ ID NO: 3990505 - RNA, 13 nt, Human herpesvirus 6B
cgaugcuggccug

SEQ ID NO: 3990506 - RNA, 14 nt, Human herpesvirus 6B
cgauguacaguuuc

SEQ ID NO: 3990507 - RNA, 14 nt, Human herpesvirus 6B
cgauguuuccaggu

SEQ ID NO: 3990508 - RNA, 18 nt, Human herpesvirus 6B
cgauugcugcuucuguaa

SEQ ID NO: 3990509 - RNA, 23 nt, Human herpesvirus 6B
cgcaaagagagaccaauuuagau

SEQ ID NO: 3990510 - RNA, 17 nt, Human herpesvirus 6B
cgcaaagggaagccagc

SEQ ID NO: 3990511 - RNA, 20 nt, Human herpesvirus 6B
cgcagaaucaagaaacacuu

SEQ ID NO: 3990512 - RNA, 14 nt, Human herpesvirus 6B
cgcagcuccuuccg

SEQ ID NO: 3990513 - RNA, 22 nt, Human herpesvirus 6B
cgcagggaaagagcacgaagaa

SEQ ID NO: 3990514 - RNA, 16 nt, Human herpesvirus 6B
cgcaguuucuguuuuu

SEQ ID NO: 3990515 - RNA, 19 nt, Human herpesvirus 6B
cgcauguaugguugcgaaa

SEQ ID NO: 3990516 - RNA, 13 nt, Human herpesvirus 6B
cgccauaauggaa

SEQ ID NO: 3990517 - RNA, 19 nt, Human herpesvirus 6B
cgccauaauggaagaaggc

SEQ ID NO: 3990518 - RNA, 21 nt, Human herpesvirus 6B
cgcccgccucucuccgccucc

SEQ ID NO: 3990519 - RNA, 18 nt, Human herpesvirus 6B
cgccgccucgccgcuccc

SEQ ID NO: 3990520 - RNA, 21 nt, Human herpesvirus 6B
cgccuccgccaccaccgcuga

SEQ ID NO: 3990521 - RNA, 11 nt, Human herpesvirus 6B
cgccucucccg

SEQ ID NO: 3990522 - RNA, 14 nt, Human herpesvirus 6B
cgcgccgucagcgg

SEQ ID NO: 3990523 - RNA, 22 nt, Human herpesvirus 6B
cgcgcugggacuccgagccgga

SEQ ID NO: 3990524 - RNA, 19 nt, Human herpesvirus 6B
cgcggaccacucgggccgg

SEQ ID NO: 3990525 - RNA, 22 nt, Human herpesvirus 6B
cgcuaagagauuuacuguuucu

SEQ ID NO: 3990526 - RNA, 15 nt, Human herpesvirus 6B
cgcugggcuccucac

SEQ ID NO: 3990527 - RNA, 17 nt, Human herpesvirus 6B
cgcuggucgccguggcc

SEQ ID NO: 3990528 - RNA, 20 nt, Human herpesvirus 6B
cggaaaaauuauagacuugc

SEQ ID NO: 3990529 - RNA, 22 nt, Human herpesvirus 6B
cggaagacguuucuauggauau

SEQ ID NO: 3990530 - RNA, 15 nt, Human herpesvirus 6B
cggaagugcaugcga

SEQ ID NO: 3990531 - RNA, 12 nt, Human herpesvirus 6B
cggaauuuacug

SEQ ID NO: 3990532 - RNA, 18 nt, Human herpesvirus 6B
cggagcccugagagcagg

SEQ ID NO: 3990533 - RNA, 19 nt, Human herpesvirus 6B
cggagcccugagagcagga

SEQ ID NO: 3990534 - RNA, 21 nt, Human herpesvirus 6B
cggagcccugagagcaggagc

SEQ ID NO: 3990535 - RNA, 14 nt, Human herpesvirus 6B
cggcacgcgccguc

SEQ ID NO: 3990536 - RNA, 23 nt, Human herpesvirus 6B
cggcgaagggacacgagaagaac

SEQ ID NO: 3990537 - RNA, 22 nt, Human herpesvirus 6B
cggcgacacgcgcggaccacuc

SEQ ID NO: 3990538 - RNA, 15 nt, Human herpesvirus 6B
cggcgaggggacgga

SEQ ID NO: 3990539 - RNA, 17 nt, Human herpesvirus 6B
cggcgcugggcuccuca

SEQ ID NO: 3990540 - RNA, 15 nt, Human herpesvirus 6B
cggcgguuaacuguu

SEQ ID NO: 3990541 - RNA, 21 nt, Human herpesvirus 6B
cgggaccuggcgggcaccgag

SEQ ID NO: 3990542 - RNA, 15 nt, Human herpesvirus 6B
cgggaucacgcaggc

SEQ ID NO: 3990543 - RNA, 13 nt, Human herpesvirus 6B
cgggcgacgagag

SEQ ID NO: 3990544 - RNA, 17 nt, Human herpesvirus 6B
cgggcgcggggcgcacc

SEQ ID NO: 3990545 - RNA, 19 nt, Human herpesvirus 6B
cggggagagaauugccgau

SEQ ID NO: 3990546 - RNA, 18 nt, Human herpesvirus 6B
cggggcgcaccggcgaca

SEQ ID NO: 3990547 - RNA, 16 nt, Human herpesvirus 6B
cggguaaauaugugaa

SEQ ID NO: 3990548 - RNA, 10 nt, Human herpesvirus 6B
cgguaaaaug

SEQ ID NO: 3990549 - RNA, 18 nt, Human herpesvirus 6B
cgguguccucguccgucc

SEQ ID NO: 3990550 - RNA, 15 nt, Human herpesvirus 6B
cgguuugugugggua

SEQ ID NO: 3990551 - RNA, 20 nt, Human herpesvirus 6B
cguauacgaacaauauggcc

SEQ ID NO: 3990552 - RNA, 13 nt, Human herpesvirus 6B
cguauuauugugu

SEQ ID NO: 3990553 - RNA, 13 nt, Human herpesvirus 6B
cgucacacagcau

SEQ ID NO: 3990554 - RNA, 14 nt, Human herpesvirus 6B
cgucacacagcaug

SEQ ID NO: 3990555 - RNA, 17 nt, Human herpesvirus 6B
cgucauaauuuuccagc

SEQ ID NO: 3990556 - RNA, 17 nt, Human herpesvirus 6B
cguccauccaguugugu

SEQ ID NO: 3990557 - RNA, 14 nt, Human herpesvirus 6B
cgucccucucaccc

SEQ ID NO: 3990558 - RNA, 23 nt, Human herpesvirus 6B
cgucuacaucaaaauccaaagua

SEQ ID NO: 3990559 - RNA, 19 nt, Human herpesvirus 6B
cgucuccgauccgucagga

SEQ ID NO: 3990560 - RNA, 17 nt, Human herpesvirus 6B
cgugacacggaaaacca

SEQ ID NO: 3990561 - RNA, 21 nt, Human herpesvirus 6B
cgugaugagagacaucuguuu

SEQ ID NO: 3990562 - RNA, 23 nt, Human herpesvirus 6B
cguggcagaacagagacccuccu

SEQ ID NO: 3990563 - RNA, 16 nt, Human herpesvirus 6B
cguggcagaagaagag

SEQ ID NO: 3990564 - RNA, 19 nt, Human herpesvirus 6B
cgugguggccgucugucug

SEQ ID NO: 3990565 - RNA, 12 nt, Human herpesvirus 6B
cguggugugcac

SEQ ID NO: 3990566 - RNA, 19 nt, Human herpesvirus 6B
cguguucaaaaaugugguc

SEQ ID NO: 3990567 - RNA, 15 nt, Human herpesvirus 6B
cguuccgaauccugu

SEQ ID NO: 3990568 - RNA, 14 nt, Human herpesvirus 6B
cguugugacagaau

SEQ ID NO: 3990569 - RNA, 17 nt, Human herpesvirus 6B
cguuuuccaacuuaaua

SEQ ID NO: 3990570 - RNA, 22 nt, Human herpesvirus 6B
cguuuucugcucaacaauguuc

SEQ ID NO: 3990571 - RNA, 22 nt, Human herpesvirus 6B
cuaaaaauauugguauugauuu

SEQ ID NO: 3990572 - RNA, 14 nt, Human herpesvirus 6B
cuaaaagcugcuaa

SEQ ID NO: 3990573 - RNA, 14 nt, Human herpesvirus 6B
cuaaaaucugcuaa

SEQ ID NO: 3990574 - RNA, 15 nt, Human herpesvirus 6B
cuaauuauaaaugua

SEQ ID NO: 3990575 - RNA, 18 nt, Human herpesvirus 6B
cuacccaccuguccuuuc

SEQ ID NO: 3990576 - RNA, 14 nt, Human herpesvirus 6B
cuacguuagcuucc

SEQ ID NO: 3990577 - RNA, 19 nt, Human herpesvirus 6B
cuagaaugccagguccagu

SEQ ID NO: 3990578 - RNA, 17 nt, Human herpesvirus 6B
cuauguuaacauuguga

SEQ ID NO: 3990579 - RNA, 18 nt, Human herpesvirus 6B
uaaauguauaaaagagaa

SEQ ID NO: 3990580 - RNA, 18 nt, Human herpesvirus 6B
uaacaauguuaugcaguu

SEQ ID NO: 3990581 - RNA, 18 nt, Human herpesvirus 6B
uaacauccaaaauacacu

SEQ ID NO: 3990582 - RNA, 20 nt, Human herpesvirus 6B
uaacauugugagaacagcgc

SEQ ID NO: 3990583 - RNA, 23 nt, Human herpesvirus 6B
uaacggaacccuagacacacaga

SEQ ID NO: 3990584 - RNA, 14 nt, Human herpesvirus 6B
uaagaauuuccagg

SEQ ID NO: 3990585 - RNA, 17 nt, Human herpesvirus 6B
uaagccuauugacauga

SEQ ID NO: 3990586 - RNA, 17 nt, Human herpesvirus 6B
uaaggcucgguaguaua

SEQ ID NO: 3990587 - RNA, 14 nt, Human herpesvirus 6B
uaagguuguuuucg

SEQ ID NO: 3990588 - RNA, 23 nt, Human herpesvirus 6B
uaagugugcguuauuuucuguau

SEQ ID NO: 3990589 - RNA, 18 nt, Human herpesvirus 6B
uaauaguuaaaaaauuga

SEQ ID NO: 3990590 - RNA, 15 nt, Human herpesvirus 6B
uaauauaaauucuua

SEQ ID NO: 3990591 - RNA, 16 nt, Human herpesvirus 6B
uaauauuugcaagcag

SEQ ID NO: 3990592 - RNA, 22 nt, Human herpesvirus 6B
uaauauuugcaagcagaccagu

SEQ ID NO: 3990593 - RNA, 14 nt, Human herpesvirus 6B
uaauguaaauguua

SEQ ID NO: 3990594 - RNA, 18 nt, Human herpesvirus 6B
uaauugguauaagaaaga

SEQ ID NO: 3990595 - RNA, 12 nt, Human herpesvirus 6B
uaauuuuccagc

SEQ ID NO: 3990596 - RNA, 16 nt, Human herpesvirus 6B
uaauuuuuuguuucug

SEQ ID NO: 3990597 - RNA, 14 nt, Human herpesvirus 6B
uacagacuccucac

SEQ ID NO: 3990598 - RNA, 22 nt, Human herpesvirus 6B
uacagacuccucaccgaaaucc

SEQ ID NO: 3990599 - RNA, 19 nt, Human herpesvirus 6B
uacagcaaaaauuucaugc

SEQ ID NO: 3990600 - RNA, 20 nt, Human herpesvirus 6B
uacagcuaagauuaacaacu

SEQ ID NO: 3990601 - RNA, 16 nt, Human herpesvirus 6B
uacgaacagaaauuuc

SEQ ID NO: 3990602 - RNA, 17 nt, Human herpesvirus 6B
uacgagaccuguuugag

SEQ ID NO: 3990603 - RNA, 17 nt, Human herpesvirus 6B
uacgcauugacggguau

SEQ ID NO: 3990604 - RNA, 17 nt, Human herpesvirus 6B
uacgcuggaaacuaaac

SEQ ID NO: 3990605 - RNA, 13 nt, Human herpesvirus 6B
uacggcaggagca

SEQ ID NO: 3990606 - RNA, 13 nt, Human herpesvirus 6B
uacguauaaaagu

SEQ ID NO: 3990607 - RNA, 18 nt, Human herpesvirus 6B
uacguggccgucuccugc

SEQ ID NO: 3990608 - RNA, 23 nt, Human herpesvirus 6B
uacguggccgucuccugcaauuu

SEQ ID NO: 3990609 - RNA, 13 nt, Human herpesvirus 6B
uacguuagcuucc

SEQ ID NO: 3990610 - RNA, 15 nt, Human herpesvirus 6B
uacuaaaggacuggc

SEQ ID NO: 3990611 - RNA, 19 nt, Human herpesvirus 6B
uacuacguguaauguuucc

SEQ ID NO: 3990612 - RNA, 21 nt, Human herpesvirus 6B
uacugacaccacauaacaaaa

SEQ ID NO: 3990613 - RNA, 22 nt, Human herpesvirus 6B
uacuguaaacaaauucuuacaa

SEQ ID NO: 3990614 - RNA, 10 nt, Human herpesvirus 6B
uacuuccugu

SEQ ID NO: 3990615 - RNA, 21 nt, Human herpesvirus 6B
uacuuuuuucaauaaugcuca

SEQ ID NO: 3990616 - RNA, 17 nt, Human herpesvirus 6B
uagaacauaagggacag

SEQ ID NO: 3990617 - RNA, 20 nt, Human herpesvirus 6B
uagacgaaaauuguaacuuc

SEQ ID NO: 3990618 - RNA, 22 nt, Human herpesvirus 6B
uagacgugucuucauucuucga

SEQ ID NO: 3990619 - RNA, 12 nt, Human herpesvirus 6B
uagagaacagau

SEQ ID NO: 3990620 - RNA, 12 nt, Human herpesvirus 6B
uagagacuuugc

SEQ ID NO: 3990621 - RNA, 17 nt, Human herpesvirus 6B
uagagcauccuguuuuc

SEQ ID NO: 3990622 - RNA, 18 nt, Human herpesvirus 6B
uagcaauuuuaaauauua

SEQ ID NO: 3990623 - RNA, 23 nt, Human herpesvirus 6B
uagcauucugccgaaaagaaaga

SEQ ID NO: 3990624 - RNA, 14 nt, Human herpesvirus 6B
uagcgguuucuagg

SEQ ID NO: 3990625 - RNA, 23 nt, Human herpesvirus 6B
uagcuugcgauuccgaagauugc

SEQ ID NO: 3990626 - RNA, 22 nt, Human herpesvirus 6B
uauaacagacauaugcaaucug

SEQ ID NO: 3990627 - RNA, 21 nt, Human herpesvirus 6B
uauaagucuaaugcaaagaug

SEQ ID NO: 3990628 - RNA, 12 nt, Human herpesvirus 6B
uauaaugugaac

SEQ ID NO: 3990629 - RNA, 22 nt, Human herpesvirus 6B
uauauucaguuuuuuguuucug

SEQ ID NO: 3990630 - RNA, 21 nt, Human herpesvirus 6B
uauauugcucaaaauuggcau

SEQ ID NO: 3990631 - RNA, 15 nt, Human herpesvirus 6B
uaucauuaaauuguu

SEQ ID NO: 3990632 - RNA, 14 nt, Human herpesvirus 6B
uauccagaagacug

SEQ ID NO: 3990633 - RNA, 15 nt, Human herpesvirus 6B
uaucgacggcagcgg

SEQ ID NO: 3990634 - RNA, 22 nt, Human herpesvirus 6B
uaugaaaguguauuuggaugaa

SEQ ID NO: 3990635 - RNA, 21 nt, Human herpesvirus 6B
uaugagaauguucuucugaaa

SEQ ID NO: 3990636 - RNA, 15 nt, Human herpesvirus 6B
uaugauuuucaauau

SEQ ID NO: 3990637 - RNA, 16 nt, Human herpesvirus 6B
uaugauuuucaauauc

SEQ ID NO: 3990638 - RNA, 14 nt, Human herpesvirus 6B
uaugcgaauuaaaa

SEQ ID NO: 3990639 - RNA, 16 nt, Human herpesvirus 6B
uaugcggccagucucg

SEQ ID NO: 3990640 - RNA, 18 nt, Human herpesvirus 6B
uauggagaaaaacuuuua

SEQ ID NO: 3990641 - RNA, 20 nt, Human herpesvirus 6B
uauggugaugaauugaacau

SEQ ID NO: 3990642 - RNA, 19 nt, Human herpesvirus 6B
uauguauaauauaaauucu

SEQ ID NO: 3990643 - RNA, 14 nt, Human herpesvirus 6B
uauguuuuguacaa

SEQ ID NO: 3990644 - RNA, 16 nt, Human herpesvirus 6B
uauuaacaauuuugau

SEQ ID NO: 3990645 - RNA, 19 nt, Human herpesvirus 6B
uauucacaagaagaugcuu

SEQ ID NO: 3990646 - RNA, 14 nt, Human herpesvirus 6B
uauucauaacagau

SEQ ID NO: 3990647 - RNA, 14 nt, Human herpesvirus 6B
uauugugacaaggu

SEQ ID NO: 3990648 - RNA, 17 nt, Human herpesvirus 6B
uauuuaacauccaaaau

SEQ ID NO: 3990649 - RNA, 14 nt, Human herpesvirus 6B
uauuuuaaaugaca

SEQ ID NO: 3990650 - RNA, 16 nt, Human herpesvirus 6B
uauuuucguauaaaau

SEQ ID NO: 3990651 - RNA, 13 nt, Human herpesvirus 6B
ucaaauguagcaa

SEQ ID NO: 3990652 - RNA, 23 nt, Human herpesvirus 6B
ucaaauuuaccggugcaacgcau

SEQ ID NO: 3990653 - RNA, 22 nt, Human herpesvirus 6B
ucaagcucgaguucgagaagau

SEQ ID NO: 3990654 - RNA, 21 nt, Human herpesvirus 6B
ucaagcuucacgugauuugua

SEQ ID NO: 3990655 - RNA, 22 nt, Human herpesvirus 6B
ucacaagaagaugcuuuaaaaa

SEQ ID NO: 3990656 - RNA, 22 nt, Human herpesvirus 6B
ucacaauaauuacucccauaga

SEQ ID NO: 3990657 - RNA, 11 nt, Human herpesvirus 6B
ucacacagcau

SEQ ID NO: 3990658 - RNA, 15 nt, Human herpesvirus 6B
ucaccccccucuugc

SEQ ID NO: 3990659 - RNA, 19 nt, Human herpesvirus 6B
ucacuggacagggguaaau

SEQ ID NO: 3990660 - RNA, 12 nt, Human herpesvirus 6B
ucagauguggaa

SEQ ID NO: 3990661 - RNA, 22 nt, Human herpesvirus 6B
ucagcaagagagauacagguuu

SEQ ID NO: 3990662 - RNA, 21 nt, Human herpesvirus 6B
ucaggcauuaaacugaggcag

SEQ ID NO: 3990663 - RNA, 20 nt, Human herpesvirus 6B
ucaguguuugccaaccaaau

SEQ ID NO: 3990664 - RNA, 19 nt, Human herpesvirus 6B
ucauccugaccgacuuuga

SEQ ID NO: 3990665 - RNA, 13 nt, Human herpesvirus 6B
ucaugaauuuaug

SEQ ID NO: 3990666 - RNA, 21 nt, Human herpesvirus 6B
ucauuaccaguagcacgaacc

SEQ ID NO: 3990667 - RNA, 17 nt, Human herpesvirus 6B
ucauucgcguggcggcg

SEQ ID NO: 3990668 - RNA, 21 nt, Human herpesvirus 6B
ucauuuaugcagcucgggaaa

SEQ ID NO: 3990669 - RNA, 19 nt, Human herpesvirus 6B
uccaaagucguugaauucu

SEQ ID NO: 3990670 - RNA, 15 nt, Human herpesvirus 6B
uccaaugaugaaacu

SEQ ID NO: 3990671 - RNA, 14 nt, Human herpesvirus 6B
uccacucaugccgc

SEQ ID NO: 3990672 - RNA, 21 nt, Human herpesvirus 6B
uccagcagcggucugcaccuc

SEQ ID NO: 3990673 - RNA, 14 nt, Human herpesvirus 6B
uccagguuuuucau

SEQ ID NO: 3990674 - RNA, 16 nt, Human herpesvirus 6B
uccaucccccuccccg

SEQ ID NO: 3990675 - RNA, 15 nt, Human herpesvirus 6B
uccauugcucuuucc

SEQ ID NO: 3990676 - RNA, 17 nt, Human herpesvirus 6B
uccauuuucugaaaucu

SEQ ID NO: 3990677 - RNA, 15 nt, Human herpesvirus 6B
uccccccucccucca

SEQ ID NO: 3990678 - RNA, 13 nt, Human herpesvirus 6B
ucccgcagcuccu

SEQ ID NO: 3990679 - RNA, 23 nt, Human herpesvirus 6B
ucccggggggggggggcccgggc

SEQ ID NO: 3990680 - RNA, 16 nt, Human herpesvirus 6B
uccgaaaacuagauga

SEQ ID NO: 3990681 - RNA, 14 nt, Human herpesvirus 6B
uccgaccagcacca

SEQ ID NO: 3990682 - RNA, 23 nt, Human herpesvirus 6B
uccgcaaguuuucagcaagagag

SEQ ID NO: 3990683 - RNA, 21 nt, Human herpesvirus 6B
uccgcgaugcgccacagggag

SEQ ID NO: 3990684 - RNA, 15 nt, Human herpesvirus 6B
uccgcggcgcugggc

SEQ ID NO: 3990685 - RNA, 23 nt, Human herpesvirus 6B
uccgcuauggccuauugcauggc

SEQ ID NO: 3990686 - RNA, 21 nt, Human herpesvirus 6B
uccggccaauucauuguacga

SEQ ID NO: 3990687 - RNA, 22 nt, Human herpesvirus 6B
uccuauacaugcggagaaguau

SEQ ID NO: 3990688 - RNA, 14 nt, Human herpesvirus 6B
uccucacccugaag

SEQ ID NO: 3990689 - RNA, 17 nt, Human herpesvirus 6B
uccucccacgcccccuc

SEQ ID NO: 3990690 - RNA, 18 nt, Human herpesvirus 6B
uccuccgcaaguuuucag

SEQ ID NO: 3990691 - RNA, 18 nt, Human herpesvirus 6B
uccucgucauaauuuucc

SEQ ID NO: 3990692 - RNA, 17 nt, Human herpesvirus 6B
cagcggucgagaaagau

SEQ ID NO: 3990693 - RNA, 13 nt, Human herpesvirus 6B
cagcuggacagaa

SEQ ID NO: 3990694 - RNA, 22 nt, Human herpesvirus 6B
caggaacgaggauuuuuucugc

SEQ ID NO: 3990695 - RNA, 12 nt, Human herpesvirus 6B
caggagaagaac

SEQ ID NO: 3990696 - RNA, 16 nt, Human herpesvirus 6B
caggagaagaacagag

SEQ ID NO: 3990697 - RNA, 20 nt, Human herpesvirus 6B
caggagcaggcuccccaggc

SEQ ID NO: 3990698 - RNA, 15 nt, Human herpesvirus 6B
caggauuuguaaaaa

SEQ ID NO: 3990699 - RNA, 19 nt, Human herpesvirus 6B
caggccgaguuggccaagc

SEQ ID NO: 3990700 - RNA, 13 nt, Human herpesvirus 6B
caggcgcagcagc

SEQ ID NO: 3990701 - RNA, 17 nt, Human herpesvirus 6B
caggcgcgucggcggga

SEQ ID NO: 3990702 - RNA, 19 nt, Human herpesvirus 6B
caggcuccccaggcgcagc

SEQ ID NO: 3990703 - RNA, 22 nt, Human herpesvirus 6B
caggcuccccaggcgcagcagc

SEQ ID NO: 3990704 - RNA, 15 nt, Human herpesvirus 6B
cagggaaagagcacg

SEQ ID NO: 3990705 - RNA, 16 nt, Human herpesvirus 6B
cagggcauagaaagcg

SEQ ID NO: 3990706 - RNA, 23 nt, Human herpesvirus 6B
cagggcauagaaagcggccaggc

SEQ ID NO: 3990707 - RNA, 16 nt, Human herpesvirus 6B
cagggcgggcacggag

SEQ ID NO: 3990708 - RNA, 20 nt, Human herpesvirus 6B
caggguguaugcggccaguc

SEQ ID NO: 3990709 - RNA, 19 nt, Human herpesvirus 6B
caggguguggccggcacgc

SEQ ID NO: 3990710 - RNA, 21 nt, Human herpesvirus 6B
cagucgcggcggccccgcguc

SEQ ID NO: 3990711 - RNA, 16 nt, Human herpesvirus 6B
caguugcauggugaug

SEQ ID NO: 3990712 - RNA, 16 nt, Human herpesvirus 6B
cauaaacuauuguuua

SEQ ID NO: 3990713 - RNA, 20 nt, Human herpesvirus 6B
cauaagcucuacacagagug

SEQ ID NO: 3990714 - RNA, 15 nt, Human herpesvirus 6B
cauaagggacagcag

SEQ ID NO: 3990715 - RNA, 23 nt, Human herpesvirus 6B
cauaauugugauaguuauuuugu

SEQ ID NO: 3990716 - RNA, 17 nt, Human herpesvirus 6B
cauaccgggacagcacc

SEQ ID NO: 3990717 - RNA, 14 nt, Human herpesvirus 6B
cauagagcauccug

SEQ ID NO: 3990718 - RNA, 15 nt, Human herpesvirus 6B
cauauacccucgccc

SEQ ID NO: 3990719 - RNA, 15 nt, Human herpesvirus 6B
cauaucaaacaacug

SEQ ID NO: 3990720 - RNA, 15 nt, Human herpesvirus 6B
cauaugcaaucugug

SEQ ID NO: 3990721 - RNA, 21 nt, Human herpesvirus 6B
cauauuuaaaccagucuucua

SEQ ID NO: 3990722 - RNA, 17 nt, Human herpesvirus 6B
caucaacacaccugccu

SEQ ID NO: 3990723 - RNA, 15 nt, Human herpesvirus 6B
caucacguauggauc

SEQ ID NO: 3990724 - RNA, 18 nt, Human herpesvirus 6B
caucaucucucuuucaga

SEQ ID NO: 3990725 - RNA, 19 nt, Human herpesvirus 6B
caucgcgguguccucgucc

SEQ ID NO: 3990726 - RNA, 14 nt, Human herpesvirus 6B
caucuaugaugcug

SEQ ID NO: 3990727 - RNA, 14 nt, Human herpesvirus 6B
caucugcaaaaaca

SEQ ID NO: 3990728 - RNA, 15 nt, Human herpesvirus 6B
caucuuaaauuucua

SEQ ID NO: 3990729 - RNA, 22 nt, Human herpesvirus 6B
caucuugccguuuugaucuuug

SEQ ID NO: 3990730 - RNA, 19 nt, Human herpesvirus 6B
caugacugugaggugauuu

SEQ ID NO: 3990731 - RNA, 13 nt, Human herpesvirus 6B
caugcaaaacaga

SEQ ID NO: 3990732 - RNA, 23 nt, Human herpesvirus 6B
cauguguggcgcauguaugguug

SEQ ID NO: 3990733 - RNA, 17 nt, Human herpesvirus 6B
cauguucgccucucccg

SEQ ID NO: 3990734 - RNA, 14 nt, Human herpesvirus 6B
cauguucuauuuua

SEQ ID NO: 3990735 - RNA, 22 nt, Human herpesvirus 6B
cauguuuuuacuugauaaacug

SEQ ID NO: 3990736 - RNA, 19 nt, Human herpesvirus 6B
cauugagccggcugauaag

SEQ ID NO: 3990737 - RNA, 22 nt, Human herpesvirus 6B
cauuuuuuaauccauauuugga

SEQ ID NO: 3990738 - RNA, 16 nt, Human herpesvirus 6B
ccaaagcuuucuguac

SEQ ID NO: 3990739 - RNA, 12 nt, Human herpesvirus 6B
ccaacugagaga

SEQ ID NO: 3990740 - RNA, 20 nt, Human herpesvirus 6B
ccaaggcaacggcacgagag

SEQ ID NO: 3990741 - RNA, 15 nt, Human herpesvirus 6B
ccacagcggcagcgg

SEQ ID NO: 3990742 - RNA, 17 nt, Human herpesvirus 6B
ccaccuggcgcaccgcc

SEQ ID NO: 3990743 - RNA, 23 nt, Human herpesvirus 6B
ccacuccaacacggggugagaga

SEQ ID NO: 3990744 - RNA, 20 nt, Human herpesvirus 6B
ccacugcggaguuuuauggc

SEQ ID NO: 3990745 - RNA, 10 nt, Human herpesvirus 6B
ccacugugau

SEQ ID NO: 3990746 - RNA, 14 nt, Human herpesvirus 6B
ccagccgcccuccc

SEQ ID NO: 3990747 - RNA, 18 nt, Human herpesvirus 6B
ccagcucuguucucuccc

SEQ ID NO: 3990748 - RNA, 14 nt, Human herpesvirus 6B
ccaggaaaaugugu

SEQ ID NO: 3990749 - RNA, 22 nt, Human herpesvirus 6B
ccaggcaccauguucgccucuc

SEQ ID NO: 3990750 - RNA, 14 nt, Human herpesvirus 6B
ccaggcgcagcagc

SEQ ID NO: 3990751 - RNA, 17 nt, Human herpesvirus 6B
ccaguugaacuaugcau

SEQ ID NO: 3990752 - RNA, 13 nt, Human herpesvirus 6B
ccaugacugugag

SEQ ID NO: 3990753 - RNA, 14 nt, Human herpesvirus 6B
cccaaacucuugca

SEQ ID NO: 3990754 - RNA, 15 nt, Human herpesvirus 6B
cccagaguuaaugca

SEQ ID NO: 3990755 - RNA, 17 nt, Human herpesvirus 6B
cccaggcgcagcagcag

SEQ ID NO: 3990756 - RNA, 22 nt, Human herpesvirus 6B
ccccacucgaaucgcgcaggcg

SEQ ID NO: 3990757 - RNA, 12 nt, Human herpesvirus 6B
ccccccucuugc

SEQ ID NO: 3990758 - RNA, 13 nt, Human herpesvirus 6B
cccccucuugcag

SEQ ID NO: 3990759 - RNA, 17 nt, Human herpesvirus 6B
ccccggcuuucucgccg

SEQ ID NO: 3990760 - RNA, 22 nt, Human herpesvirus 6B
cccgcacaguucguccagcagc

SEQ ID NO: 3990761 - RNA, 13 nt, Human herpesvirus 6B
cccgccucucucc

SEQ ID NO: 3990762 - RNA, 22 nt, Human herpesvirus 6B
cccggcuuucucgccgccucgc

SEQ ID NO: 3990763 - RNA, 11 nt, Human herpesvirus 6B
cccggggaggc

SEQ ID NO: 3990764 - RNA, 15 nt, Human herpesvirus 6B
cccuccauguugcaa

SEQ ID NO: 3990765 - RNA, 12 nt, Human herpesvirus 6B
cccuccccgcac

SEQ ID NO: 3990766 - RNA, 23 nt, Human herpesvirus 6B
ccgaacgguauuuuuagaugucg

SEQ ID NO: 3990767 - RNA, 17 nt, Human herpesvirus 6B
ccgacuuauuaucucac

SEQ ID NO: 3990768 - RNA, 18 nt, Human herpesvirus 6B
ccgaucugugcgccuuua

SEQ ID NO: 3990769 - RNA, 13 nt, Human herpesvirus 6B
ccgcagaagacuu

SEQ ID NO: 3990770 - RNA, 23 nt, Human herpesvirus 6B
ccgcaguuccuguuuuucucaua

SEQ ID NO: 3990771 - RNA, 23 nt, Human herpesvirus 6B
ccgcaguuucuguuuuucucaua

SEQ ID NO: 3990772 - RNA, 17 nt, Human herpesvirus 6B
ccgcaucgcaccgcaga

SEQ ID NO: 3990773 - RNA, 23 nt, Human herpesvirus 6B
ccgcaucgcaccgcagaucacgu

SEQ ID NO: 3990774 - RNA, 23 nt, Human herpesvirus 6B
ccgcaucgcguucgacaaagaac

SEQ ID NO: 3990775 - RNA, 22 nt, Human herpesvirus 6B
ccgcggcgcugggcuccucacc

SEQ ID NO: 3990776 - RNA, 14 nt, Human herpesvirus 6B
ccgcgggaccuggc

SEQ ID NO: 3990777 - RNA, 12 nt, Human herpesvirus 6B
ccgcgggccagc

SEQ ID NO: 3990778 - RNA, 15 nt, Human herpesvirus 6B
ccgcugacagucacc

SEQ ID NO: 3990779 - RNA, 23 nt, Human herpesvirus 6B
ccgcuuaaaucaaaaaaaugaua

SEQ ID NO: 3990780 - RNA, 13 nt, Human herpesvirus 6B
ccgggcgacgaga

SEQ ID NO: 3990781 - RNA, 18 nt, Human herpesvirus 6B
ccguccucgugcucuccg

SEQ ID NO: 3990782 - RNA, 16 nt, Human herpesvirus 6B
ccgucgucgcucuccc

SEQ ID NO: 3990783 - RNA, 20 nt, Human herpesvirus 6B
ccgucugucuguuccucaga

SEQ ID NO: 3990784 - RNA, 14 nt, Human herpesvirus 6B
ccguggcagaagaa

SEQ ID NO: 3990785 - RNA, 20 nt, Human herpesvirus 6B
ccguuauuguguucugcucu

SEQ ID NO: 3990786 - RNA, 15 nt, Human herpesvirus 6B
ccguucaacaagucc

SEQ ID NO: 3990787 - RNA, 17 nt, Human herpesvirus 6B
ccguucccuucucgucu

SEQ ID NO: 3990788 - RNA, 18 nt, Human herpesvirus 6B
ccuaaauaccauuuuaua

SEQ ID NO: 3990789 - RNA, 16 nt, Human herpesvirus 6B
ccuacggccagagaca

SEQ ID NO: 3990790 - RNA, 20 nt, Human herpesvirus 6B
ccuacgggaagguguuugau

SEQ ID NO: 3990791 - RNA, 20 nt, Human herpesvirus 6B
ccuauucuaauuauaaaugu

SEQ ID NO: 3990792 - RNA, 13 nt, Human herpesvirus 6B
ccucacccugaag

SEQ ID NO: 3990793 - RNA, 17 nt, Human herpesvirus 6B
ccucacccugaagggac

SEQ ID NO: 3990794 - RNA, 20 nt, Human herpesvirus 6B
ccucauagauuucauacugu

SEQ ID NO: 3990795 - RNA, 23 nt, Human herpesvirus 6B
ccuccgcgagacgguacagcgcg

SEQ ID NO: 3990796 - RNA, 15 nt, Human herpesvirus 6B
ccuccguccaggacc

SEQ ID NO: 3990797 - RNA, 19 nt, Human herpesvirus 6B
ccucgaugguagcaauaac

SEQ ID NO: 3990798 - RNA, 19 nt, Human herpesvirus 6B
ccucuugcaguggcgcgcg

SEQ ID NO: 3990799 - RNA, 16 nt, Human herpesvirus 6B
ccugacgguuagauuu

SEQ ID NO: 3990800 - RNA, 21 nt, Human herpesvirus 6B
ccugagaauuuucgaaaagau

SEQ ID NO: 3990801 - RNA, 22 nt, Human herpesvirus 6B
ccugagagcaggagcaggcucc

SEQ ID NO: 3990802 - RNA, 18 nt, Human herpesvirus 6B
ccugagucggcuguccaa

SEQ ID NO: 3990803 - RNA, 13 nt, Human herpesvirus 6B
ccugauccaugag

SEQ ID NO: 3990804 - RNA, 18 nt, Human herpesvirus 6B
ccugaugguuaaggaaaa

SEQ ID NO: 3990805 - RNA, 21 nt, Human herpesvirus 6B
ccugcaauuugaauucugcuc

SEQ ID NO: 3990806 - RNA, 22 nt, Human herpesvirus 6B
ccugccauagaguuucgagaaa

SEQ ID NO: 3990807 - RNA, 18 nt, Human herpesvirus 6B
ccugcuccguucccuucu

SEQ ID NO: 3990808 - RNA, 15 nt, Human herpesvirus 6B
ccugugcguccuccu

SEQ ID NO: 3990809 - RNA, 20 nt, Human herpesvirus 6B
ccuguucgauguacaguuuc

SEQ ID NO: 3990810 - RNA, 16 nt, Human herpesvirus 6B
ccuguuucuacugcug

SEQ ID NO: 3990811 - RNA, 15 nt, Human herpesvirus 6B
ccuuccgcuaccgcc

SEQ ID NO: 3990812 - RNA, 16 nt, Human herpesvirus 6B
ccuuguguauuuguga

SEQ ID NO: 3990813 - RNA, 14 nt, Human herpesvirus 6B
ccuuuaaccauguu

SEQ ID NO: 3990814 - RNA, 16 nt, Human herpesvirus 6B
ccuuuguaaaauguuu

SEQ ID NO: 3990815 - RNA, 15 nt, Human herpesvirus 6B
cgaaaaucauauauu

SEQ ID NO: 3990816 - RNA, 23 nt, Human herpesvirus 6B
cgaaacgugggguaaaaauguua

SEQ ID NO: 3990817 - RNA, 17 nt, Human herpesvirus 6B
cgaacgcguccuccgcg

SEQ ID NO: 3990818 - RNA, 18 nt, Human herpesvirus 6B
cgaagacauucaacauuc

SEQ ID NO: 3990819 - RNA, 15 nt, Human herpesvirus 6B
cgaagucaugaauuu

SEQ ID NO: 3990820 - RNA, 15 nt, Human herpesvirus 6B
cgaaucucaagcaca

SEQ ID NO: 3990821 - RNA, 12 nt, Human herpesvirus 6B
cgacaaagaaca

SEQ ID NO: 3990822 - RNA, 22 nt, Human herpesvirus 6B
cgacacggagugcgacaggaga

SEQ ID NO: 3990823 - RNA, 12 nt, Human herpesvirus 6B
cgaccagcacca

SEQ ID NO: 3990824 - RNA, 12 nt, Human herpesvirus 6B
cgaccucgcucu

SEQ ID NO: 3990825 - RNA, 14 nt, Human herpesvirus 6B
cgaccucgcucucc

SEQ ID NO: 3990826 - RNA, 15 nt, Human herpesvirus 6B
cgaccucgcucuccu

SEQ ID NO: 3990827 - RNA, 20 nt, Human herpesvirus 6B
cgacgcagauuuacgacacg

SEQ ID NO: 3990828 - RNA, 23 nt, Human herpesvirus 6B
cgacgcagauuuacgacacgcuc

SEQ ID NO: 3990829 - RNA, 19 nt, Human herpesvirus 6B
cgagaaacggagagcgaca

SEQ ID NO: 3990830 - RNA, 18 nt, Human herpesvirus 6B
cgagacgguacagcgcgu

SEQ ID NO: 3990831 - RNA, 21 nt, Human herpesvirus 6B
cgagacuggccgcauacaccc

SEQ ID NO: 3990832 - RNA, 22 nt, Human herpesvirus 6B
cgagaguccgaacgaacgccgu

SEQ ID NO: 3990833 - RNA, 16 nt, Human herpesvirus 6B
cgagauucuuuaaaga

SEQ ID NO: 3990834 - RNA, 15 nt, Human herpesvirus 6B
cgagccggacaggag

SEQ ID NO: 3990835 - RNA, 23 nt, Human herpesvirus 6B
cgaggguuuuuuccgaaaacuag

SEQ ID NO: 3990836 - RNA, 18 nt, Human herpesvirus 6B
cgaggucgccagauuggc

SEQ ID NO: 3990837 - RNA, 19 nt, Human herpesvirus 6B
cgauaccgaaucggaagag

SEQ ID NO: 3990838 - RNA, 15 nt, Human herpesvirus 6B
cgauagcuucagggc

SEQ ID NO: 3990839 - RNA, 21 nt, Human herpesvirus 6B
cgauauaaaaaaagagaaguu

SEQ ID NO: 3990840 - RNA, 18 nt, Human herpesvirus 6B
cgauccaguggcaauaau

SEQ ID NO: 3990841 - RNA, 20 nt, Human herpesvirus 6B
cgauuuggguuaucuuagaa

SEQ ID NO: 3990842 - RNA, 15 nt, Human herpesvirus 6B
cgcacguaacaccag

SEQ ID NO: 3990843 - RNA, 21 nt, Human herpesvirus 6B
cgcacucuccgaccagcacca

SEQ ID NO: 3990844 - RNA, 16 nt, Human herpesvirus 6B
cgcagcagcagcucca

SEQ ID NO: 3990845 - RNA, 20 nt, Human herpesvirus 6B
cgcaguuccuguuuuucuca

SEQ ID NO: 3990846 - RNA, 20 nt, Human herpesvirus 6B
cgcauuucucuacaugccac

SEQ ID NO: 3990847 - RNA, 14 nt, Human herpesvirus 6B
cgccauggguguca

SEQ ID NO: 3990848 - RNA, 14 nt, Human herpesvirus 6B
cgccgccuucucug

SEQ ID NO: 3990849 - RNA, 16 nt, Human herpesvirus 6B
cgccgguuuccaugag

SEQ ID NO: 3990850 - RNA, 21 nt, Human herpesvirus 6B
cgccgucgucgcucucccucu

SEQ ID NO: 3990851 - RNA, 13 nt, Human herpesvirus 6B
cgccgugucuuuc

SEQ ID NO: 3990852 - RNA, 18 nt, Human herpesvirus 6B
cgcgacgccuccgccggg

SEQ ID NO: 3990853 - RNA, 15 nt, Human herpesvirus 6B
cgcgccgucagcggc

SEQ ID NO: 3990854 - RNA, 21 nt, Human herpesvirus 6B
cgcggagcacgcacgagaaca

SEQ ID NO: 3990855 - RNA, 18 nt, Human herpesvirus 6B
cgcggggaucgggccugg

SEQ ID NO: 3990856 - RNA, 19 nt, Human herpesvirus 6B
cgcguggcggcgcgcgccg

SEQ ID NO: 3990857 - RNA, 12 nt, Human herpesvirus 6B
cgcucauuuuga

SEQ ID NO: 3990858 - RNA, 22 nt, Human herpesvirus 6B
cgcucgggggacggagaggaag

SEQ ID NO: 3990859 - RNA, 22 nt, Human herpesvirus 6B
cgcugggcuccucacccugaag

SEQ ID NO: 3990860 - RNA, 21 nt, Human herpesvirus 6B
cgcugucgucugagcagaggu

SEQ ID NO: 3990861 - RNA, 21 nt, Human herpesvirus 6B
cggaagugcaugcgacagaca

SEQ ID NO: 3990862 - RNA, 13 nt, Human herpesvirus 6B
cggacagagcgga

SEQ ID NO: 3990863 - RNA, 20 nt, Human herpesvirus 6B
cggacagagcggagaggcgc

SEQ ID NO: 3990864 - RNA, 18 nt, Human herpesvirus 6B
cggacuugcgagucuguc

SEQ ID NO: 3990865 - RNA, 13 nt, Human herpesvirus 6B
cggagcacccggg

SEQ ID NO: 3990866 - RNA, 17 nt, Human herpesvirus 6B
cggagcccugagagcag

SEQ ID NO: 3990867 - RNA, 20 nt, Human herpesvirus 6B
cggaucugccgcguggaagc

SEQ ID NO: 3990868 - RNA, 17 nt, Human herpesvirus 6B
cggcaacgcuccuccca

SEQ ID NO: 3990869 - RNA, 13 nt, Human herpesvirus 6B
cggcacgcgccgu

SEQ ID NO: 3990870 - RNA, 16 nt, Human herpesvirus 6B
cggcagcggggaaggg

SEQ ID NO: 3990871 - RNA, 17 nt, Human herpesvirus 6B
cggcgaauuuaugugaa

SEQ ID NO: 3990872 - RNA, 13 nt, Human herpesvirus 6B
cgggacagcaccc

SEQ ID NO: 3990873 - RNA, 22 nt, Human herpesvirus 6B
cgggcagacgugagacauuuga

SEQ ID NO: 3990874 - RNA, 14 nt, Human herpesvirus 6B
cgggcagggcgggc

SEQ ID NO: 3990875 - RNA, 19 nt, Human herpesvirus 6B
cgggcagggcgggcacgga

SEQ ID NO: 3990876 - RNA, 13 nt, Human herpesvirus 6B
cgggccacgagag

SEQ ID NO: 3990877 - RNA, 14 nt, Human herpesvirus 6B
cgggccagcccuga

SEQ ID NO: 3990878 - RNA, 21 nt, Human herpesvirus 6B
cgggccuggggacagacaggg

SEQ ID NO: 3990879 - RNA, 15 nt, Human herpesvirus 6B
cgggcgacgggcagg

SEQ ID NO: 3990880 - RNA, 20 nt, Human herpesvirus 6B
cgggcucgaagcgacgcaag

SEQ ID NO: 3990881 - RNA, 15 nt, Human herpesvirus 6B
cggggccucccuccg

SEQ ID NO: 3990882 - RNA, 12 nt, Human herpesvirus 6B
cggggcgcaccg

SEQ ID NO: 3990883 - RNA, 17 nt, Human herpesvirus 6B
cgguauuuuuagauguc

SEQ ID NO: 3990884 - RNA, 23 nt, Human herpesvirus 6B
cgguccccccucccuccaucccc

SEQ ID NO: 3990885 - RNA, 13 nt, Human herpesvirus 6B
cggucucuggaag

SEQ ID NO: 3990886 - RNA, 16 nt, Human herpesvirus 6B
cgguuaacuguuucuu

SEQ ID NO: 3990887 - RNA, 17 nt, Human herpesvirus 6B
cguacacggccacccgc

SEQ ID NO: 3990888 - RNA, 15 nt, Human herpesvirus 6B
cgucauuccagucca

SEQ ID NO: 3990889 - RNA, 20 nt, Human herpesvirus 6B
cguccgcgaugcgccacagg

SEQ ID NO: 3990890 - RNA, 14 nt, Human herpesvirus 6B
cguccucagagaaa

SEQ ID NO: 3990891 - RNA, 15 nt, Human herpesvirus 6B
cgucgcucucccucu

SEQ ID NO: 3990892 - RNA, 22 nt, Human herpesvirus 6B
cgucuccgauccgucaggacca

SEQ ID NO: 3990893 - RNA, 15 nt, Human herpesvirus 6B
cgugcacgcgccugu

SEQ ID NO: 3990894 - RNA, 15 nt, Human herpesvirus 6B
cguggccgucuccug

SEQ ID NO: 3990895 - RNA, 18 nt, Human herpesvirus 6B
cguggccgucuccugcaa

SEQ ID NO: 3990896 - RNA, 20 nt, Human herpesvirus 6B
cgugggggcagaacugagau

SEQ ID NO: 3990897 - RNA, 14 nt, Human herpesvirus 6B
cgugguugucuuug

SEQ ID NO: 3990898 - RNA, 18 nt, Human herpesvirus 6B
cguguuauuagacaccuc

SEQ ID NO: 3990899 - RNA, 18 nt, Human herpesvirus 6B
cguuagacaaaaacaugu

SEQ ID NO: 3990900 - RNA, 14 nt, Human herpesvirus 6B
cguugaugaaauaa

SEQ ID NO: 3990901 - RNA, 20 nt, Human herpesvirus 6B
cguuugucuaugcaaugucu

SEQ ID NO: 3990902 - RNA, 16 nt, Human herpesvirus 6B
cguuuucgauuuagag

SEQ ID NO: 3990903 - RNA, 16 nt, Human herpesvirus 6B
cguuuuuucugcaaaa

SEQ ID NO: 3990904 - RNA, 14 nt, Human herpesvirus 6B
cuaaaaccugcuaa

SEQ ID NO: 3990905 - RNA, 17 nt, Human herpesvirus 6B
cuaaaagauuguuuuca

SEQ ID NO: 3990906 - RNA, 19 nt, Human herpesvirus 6B
cuaaacugaagaauggaaa

SEQ ID NO: 3990907 - RNA, 21 nt, Human herpesvirus 6B
cuaacaauaauugcauuuugg

SEQ ID NO: 3990908 - RNA, 21 nt, Human herpesvirus 6B
cuaacggagcaaccgcaguuc

SEQ ID NO: 3990909 - RNA, 16 nt, Human herpesvirus 6B
cuaagcuggacagaaa

SEQ ID NO: 3990910 - RNA, 20 nt, Human herpesvirus 6B
cuaagugugcguuauuuucu

SEQ ID NO: 3990911 - RNA, 17 nt, Human herpesvirus 6B
cuaauaaaauauaacgc

SEQ ID NO: 3990912 - RNA, 16 nt, Human herpesvirus 6B
cuaauuauaaauguag

SEQ ID NO: 3990913 - RNA, 16 nt, Human herpesvirus 6B
cuacaaaguucucaga

SEQ ID NO: 3990914 - RNA, 13 nt, Human herpesvirus 6B
cuacaaucauuua

SEQ ID NO: 3990915 - RNA, 13 nt, Human herpesvirus 6B
cuacgcggcaagu

SEQ ID NO: 3990916 - RNA, 18 nt, Human herpesvirus 6B
cuagagguuuucuuuccc

SEQ ID NO: 3990917 - RNA, 16 nt, Human herpesvirus 6B
cuagcaaugauacauc

SEQ ID NO: 3990918 - RNA, 22 nt, Human herpesvirus 6B
gcagaugcuuaccgguguuuua

SEQ ID NO: 3990919 - RNA, 17 nt, Human herpesvirus 6B
gcagcagaggccggcac

SEQ ID NO: 3990920 - RNA, 14 nt, Human herpesvirus 6B
gcagcggggaaggg

SEQ ID NO: 3990921 - RNA, 18 nt, Human herpesvirus 6B
gcaggcgcgucggcggga

SEQ ID NO: 3990922 - RNA, 13 nt, Human herpesvirus 6B
gcagggaaagagc

SEQ ID NO: 3990923 - RNA, 15 nt, Human herpesvirus 6B
gcaugaacgguaguu

SEQ ID NO: 3990924 - RNA, 23 nt, Human herpesvirus 6B
gcaugacacaucgugaguuuuca

SEQ ID NO: 3990925 - RNA, 18 nt, Human herpesvirus 6B
gcauucauaauugugaua

SEQ ID NO: 3990926 - RNA, 17 nt, Human herpesvirus 6B
gccaccucuucuccgcc

SEQ ID NO: 3990927 - RNA, 16 nt, Human herpesvirus 6B
gccagcccugaagaag

SEQ ID NO: 3990928 - RNA, 19 nt, Human herpesvirus 6B
gccaguaucgcgagcacca

SEQ ID NO: 3990929 - RNA, 23 nt, Human herpesvirus 6B
gccccuccguccaggacccgagg

SEQ ID NO: 3990930 - RNA, 15 nt, Human herpesvirus 6B
gcccgggcgcggggc

SEQ ID NO: 3990931 - RNA, 15 nt, Human herpesvirus 6B
gcccucccgcagcuc

SEQ ID NO: 3990932 - RNA, 22 nt, Human herpesvirus 6B
gcccuccuggguacggcaaacu

SEQ ID NO: 3990933 - RNA, 15 nt, Human herpesvirus 6B
gcccugagagcagga

SEQ ID NO: 3990934 - RNA, 19 nt, Human herpesvirus 6B
gcccugagagcaggagcag

SEQ ID NO: 3990935 - RNA, 20 nt, Human herpesvirus 6B
gcccugcuccguucccuucu

SEQ ID NO: 3990936 - RNA, 21 nt, Human herpesvirus 6B
gccgauagcggccgggcgacg

SEQ ID NO: 3990937 - RNA, 20 nt, Human herpesvirus 6B
gccgcguggaagccgcugca

SEQ ID NO: 3990938 - RNA, 16 nt, Human herpesvirus 6B
gccgucaccugcacug

SEQ ID NO: 3990939 - RNA, 20 nt, Human herpesvirus 6B
gccgucgucgcucucccucu

SEQ ID NO: 3990940 - RNA, 24 nt, Human herpesvirus 6B
gccgucugucuguuccucagauuc

SEQ ID NO: 3990941 - RNA, 20 nt, Human herpesvirus 6B
gccgugagaaacgcaaaggg

SEQ ID NO: 3990942 - RNA, 19 nt, Human herpesvirus 6B
gccguugccuuggccgcgc

SEQ ID NO: 3990943 - RNA, 23 nt, Human herpesvirus 6B
gccuauucuaauuauaaauguag

SEQ ID NO: 3990944 - RNA, 22 nt, Human herpesvirus 6B
gccuccucuuuuccccccgccg

SEQ ID NO: 3990945 - RNA, 19 nt, Human herpesvirus 6B
gccugcagcgauauggaaa

SEQ ID NO: 3990946 - RNA, 14 nt, Human herpesvirus 6B
gccuggggacagac

SEQ ID NO: 3990947 - RNA, 18 nt, Human herpesvirus 6B
gccuuguguauuugugaa

SEQ ID NO: 3990948 - RNA, 20 nt, Human herpesvirus 6B
gcgagucugucaguggcuug

SEQ ID NO: 3990949 - RNA, 17 nt, Human herpesvirus 6B
gcgcaaaccaagguguu

SEQ ID NO: 3990950 - RNA, 16 nt, Human herpesvirus 6B
gcgccucccauagagg

SEQ ID NO: 3990951 - RNA, 14 nt, Human herpesvirus 6B
gcgcgacggagaug

SEQ ID NO: 3990952 - RNA, 15 nt, Human herpesvirus 6B
gcgcgacggagaugc

SEQ ID NO: 3990953 - RNA, 17 nt, Human herpesvirus 6B
gcgcggagcacgcacga

SEQ ID NO: 3990954 - RNA, 13 nt, Human herpesvirus 6B
gcggccaggccgc

SEQ ID NO: 3990955 - RNA, 16 nt, Human herpesvirus 6B
gcggcucauacccggc

SEQ ID NO: 3990956 - RNA, 21 nt, Human herpesvirus 6B
gcggggcgcaccggcgacacg

SEQ ID NO: 3990957 - RNA, 14 nt, Human herpesvirus 6B
gcgguucgacagag

SEQ ID NO: 3990958 - RNA, 16 nt, Human herpesvirus 6B
gcguguuauggggaag

SEQ ID NO: 3990959 - RNA, 23 nt, Human herpesvirus 6B
gcguuucucgccaugggugucag

SEQ ID NO: 3990960 - RNA, 13 nt, Human herpesvirus 6B
gcuauguaugaac

SEQ ID NO: 3990961 - RNA, 21 nt, Human herpesvirus 6B
gcuauuugacaauaaacauga

SEQ ID NO: 3990962 - RNA, 14 nt, Human herpesvirus 6B
gcucagauguggaa

SEQ ID NO: 3990963 - RNA, 13 nt, Human herpesvirus 6B
gcucauggaucag

SEQ ID NO: 3990964 - RNA, 17 nt, Human herpesvirus 6B
gcuccgagcgggauccc

SEQ ID NO: 3990965 - RNA, 13 nt, Human herpesvirus 6B
gcuccgcgcggcc

SEQ ID NO: 3990966 - RNA, 16 nt, Human herpesvirus 6B
gcucuccguuucucgg

SEQ ID NO: 3990967 - RNA, 13 nt, Human herpesvirus 6B
gcucuguucucuc

SEQ ID NO: 3990968 - RNA, 19 nt, Human herpesvirus 6B
gcugcguuccaugugucuc

SEQ ID NO: 3990969 - RNA, 12 nt, Human herpesvirus 6B
gcugcuggguac

SEQ ID NO: 3990970 - RNA, 12 nt, Human herpesvirus 6B
gcugcugggugu

SEQ ID NO: 3990971 - RNA, 22 nt, Human herpesvirus 6B
gcugggacuccgagccggacag

SEQ ID NO: 3990972 - RNA, 14 nt, Human herpesvirus 6B
gcugguuugcuuug

SEQ ID NO: 3990973 - RNA, 14 nt, Human herpesvirus 6B
gcugucacacucug

SEQ ID NO: 3990974 - RNA, 23 nt, Human herpesvirus 6B
gcugugcuuuguauguaucugaa

SEQ ID NO: 3990975 - RNA, 22 nt, Human herpesvirus 6B
gcuuaggauguaaaugcagaca

SEQ ID NO: 3990976 - RNA, 23 nt, Human herpesvirus 6B
gcuucacguccagcgcauccuua

SEQ ID NO: 3990977 - RNA, 13 nt, Human herpesvirus 6B
gcuuccggagaag

SEQ ID NO: 3990978 - RNA, 12 nt, Human herpesvirus 6B
gcuuuaaagcag

SEQ ID NO: 3990979 - RNA, 14 nt, Human herpesvirus 6B
gcuuugguggaaaa

SEQ ID NO: 3990980 - RNA, 14 nt, Human herpesvirus 6B
gcuuuuaguuucaa

SEQ ID NO: 3990981 - RNA, 21 nt, Human herpesvirus 6B
ggaacacgucguggcagaaca

SEQ ID NO: 3990982 - RNA, 15 nt, Human herpesvirus 6B
ggaacggugaagcgg

SEQ ID NO: 3990983 - RNA, 16 nt, Human herpesvirus 6B
ggaagaaaggaguuug

SEQ ID NO: 3990984 - RNA, 19 nt, Human herpesvirus 6B
ggaagaucaugacaaggau

SEQ ID NO: 3990985 - RNA, 17 nt, Human herpesvirus 6B
ggaagauucugcagaau

SEQ ID NO: 3990986 - RNA, 16 nt, Human herpesvirus 6B
ggaauauauagaagaa

SEQ ID NO: 3990987 - RNA, 16 nt, Human herpesvirus 6B
ggacacgcgcggugga

SEQ ID NO: 3990988 - RNA, 20 nt, Human herpesvirus 6B
ggaccaugcagcugcccgug

SEQ ID NO: 3990989 - RNA, 15 nt, Human herpesvirus 6B
ggacccuccacgccc

SEQ ID NO: 3990990 - RNA, 13 nt, Human herpesvirus 6B
ggacggacagagc

SEQ ID NO: 3990991 - RNA, 14 nt, Human herpesvirus 6B
ggacuaccgaugcu

SEQ ID NO: 3990992 - RNA, 20 nt, Human herpesvirus 6B
ggacuccgagccggacagga

SEQ ID NO: 3990993 - RNA, 19 nt, Human herpesvirus 6B
ggacucucgucgcccggcc

SEQ ID NO: 3990994 - RNA, 15 nt, Human herpesvirus 6B
ggagaacgggcaacu

SEQ ID NO: 3990995 - RNA, 23 nt, Human herpesvirus 6B
ggagaaguauuucgaucagauua

SEQ ID NO: 3990996 - RNA, 15 nt, Human herpesvirus 6B
ggagaggaagccgga

SEQ ID NO: 3990997 - RNA, 14 nt, Human herpesvirus 6B
ggagaggcgcggga

SEQ ID NO: 3990998 - RNA, 18 nt, Human herpesvirus 6B
ggagagugcggggagaua

SEQ ID NO: 3990999 - RNA, 11 nt, Human herpesvirus 6B
ggagcacgagc

SEQ ID NO: 3991000 - RNA, 19 nt, Human herpesvirus 6B
ggagcuaguuacggggaag

SEQ ID NO: 3991001 - RNA, 11 nt, Human herpesvirus 6B
ggaggagaggg

SEQ ID NO: 3991002 - RNA, 22 nt, Human herpesvirus 6B
ggagggacccacacgcggggau

SEQ ID NO: 3991003 - RNA, 22 nt, Human herpesvirus 6B
ggaggggaauacaccggagacc

SEQ ID NO: 3991004 - RNA, 15 nt, Human herpesvirus 6B
ggagucggucuguuc

SEQ ID NO: 3991005 - RNA, 15 nt, Human herpesvirus 6B
ggagucuggccucug

SEQ ID NO: 3991006 - RNA, 21 nt, Human herpesvirus 6B
ggaucugccgcguggaagccg

SEQ ID NO: 3991007 - RNA, 15 nt, Human herpesvirus 6B
ggauuacaagggaaa

SEQ ID NO: 3991008 - RNA, 16 nt, Human herpesvirus 6B
ggauucgaucgagaau

SEQ ID NO: 3991009 - RNA, 20 nt, Human herpesvirus 6B
ggcaacuccccauucaacau

SEQ ID NO: 3991010 - RNA, 17 nt, Human herpesvirus 6B
ggcauguguaagaaaac

SEQ ID NO: 3991011 - RNA, 14 nt, Human herpesvirus 6B
ggccgaaggauggu

SEQ ID NO: 3991012 - RNA, 20 nt, Human herpesvirus 6B
ggccggucggggaggggagg

SEQ ID NO: 3991013 - RNA, 21 nt, Human herpesvirus 6B
ggcgacacgcgcggaccacuc

SEQ ID NO: 3991014 - RNA, 18 nt, Human herpesvirus 6B
ggcgaccgugaugagaga

SEQ ID NO: 3991015 - RNA, 12 nt, Human herpesvirus 6B
ggcgcagaauua

SEQ ID NO: 3991016 - RNA, 19 nt, Human herpesvirus 6B
ggcgcagggaacggugaag

SEQ ID NO: 3991017 - RNA, 22 nt, Human herpesvirus 6B
ggcggaggcgucgcggugguga

SEQ ID NO: 3991018 - RNA, 13 nt, Human herpesvirus 6B
ggcgggcacggag

SEQ ID NO: 3991019 - RNA, 19 nt, Human herpesvirus 6B
ggcuccucacccugaaggg

SEQ ID NO: 3991020 - RNA, 22 nt, Human herpesvirus 6B
ggcugauauacgauggacagaa

SEQ ID NO: 3991021 - RNA, 21 nt, Human herpesvirus 6B
ggcuugcugucgcccgccucu

SEQ ID NO: 3991022 - RNA, 19 nt, Human herpesvirus 6B
gggaagccagccgcccucc

SEQ ID NO: 3991023 - RNA, 18 nt, Human herpesvirus 6B
gggaauuucauguuuacu

SEQ ID NO: 3991024 - RNA, 9 nt, Human herpesvirus 6B
gggaggaga

SEQ ID NO: 3991025 - RNA, 13 nt, Human herpesvirus 6B
gggaggagaggga

SEQ ID NO: 3991026 - RNA, 19 nt, Human herpesvirus 6B
gggccggucggggagggga

SEQ ID NO: 3991027 - RNA, 21 nt, Human herpesvirus 6B
gggccuggggacagacagggg

SEQ ID NO: 3991028 - RNA, 16 nt, Human herpesvirus 6B
gggcgucgucaacucc

SEQ ID NO: 3991029 - RNA, 22 nt, Human herpesvirus 6B
gggcuacuacguuaguaaggaa

SEQ ID NO: 3991030 - RNA, 23 nt, Human herpesvirus 6B
gggcuccucacccugaagggacc

SEQ ID NO: 3991031 - RNA, 13 nt, Human herpesvirus 6B
uaaggucaaauau

SEQ ID NO: 3991032 - RNA, 22 nt, Human herpesvirus 6B
uaagugugcguuauuuucugua

SEQ ID NO: 3991033 - RNA, 17 nt, Human herpesvirus 6B
uaauaaaccuaacagag

SEQ ID NO: 3991034 - RNA, 19 nt, Human herpesvirus 6B
uaauagaaaaaucaucaaa

SEQ ID NO: 3991035 - RNA, 17 nt, Human herpesvirus 6B
uaauaucgaauucagcu

SEQ ID NO: 3991036 - RNA, 16 nt, Human herpesvirus 6B
uaaucaucccaauaaa

SEQ ID NO: 3991037 - RNA, 14 nt, Human herpesvirus 6B
uaaugaaauuuaag

SEQ ID NO: 3991038 - RNA, 22 nt, Human herpesvirus 6B
uaauguaucaaaguguauacau

SEQ ID NO: 3991039 - RNA, 23 nt, Human herpesvirus 6B
uaauucaaauguagcaaaugaau

SEQ ID NO: 3991040 - RNA, 23 nt, Human herpesvirus 6B
uaauuucagcuuugaacaucuau

SEQ ID NO: 3991041 - RNA, 17 nt, Human herpesvirus 6B
uacaguuucucgaaaau

SEQ ID NO: 3991042 - RNA, 22 nt, Human herpesvirus 6B
uacauaugccgacuguuucuua

SEQ ID NO: 3991043 - RNA, 20 nt, Human herpesvirus 6B
uacaucaacuauuuaacauc

SEQ ID NO: 3991044 - RNA, 16 nt, Human herpesvirus 6B
uacaucguuuguugaa

SEQ ID NO: 3991045 - RNA, 20 nt, Human herpesvirus 6B
uacauucaaucuguauaaga

SEQ ID NO: 3991046 - RNA, 15 nt, Human herpesvirus 6B
uacauuguuucucua

SEQ ID NO: 3991047 - RNA, 16 nt, Human herpesvirus 6B
uacauuguuucucuaa

SEQ ID NO: 3991048 - RNA, 22 nt, Human herpesvirus 6B
uaccauuuuauacgaaaauaaa

SEQ ID NO: 3991049 - RNA, 14 nt, Human herpesvirus 6B
uacgaagacaagcc

SEQ ID NO: 3991050 - RNA, 18 nt, Human herpesvirus 6B
uacgauuuucuaauacua

SEQ ID NO: 3991051 - RNA, 18 nt, Human herpesvirus 6B
uacgggaagguguuugau

SEQ ID NO: 3991052 - RNA, 16 nt, Human herpesvirus 6B
uacuacgagaaaaggu

SEQ ID NO: 3991053 - RNA, 17 nt, Human herpesvirus 6B
uacucuggcugaaggaa

SEQ ID NO: 3991054 - RNA, 13 nt, Human herpesvirus 6B
uacuguaaacaaa

SEQ ID NO: 3991055 - RNA, 18 nt, Human herpesvirus 6B
uacuguguauuguguacc

SEQ ID NO: 3991056 - RNA, 22 nt, Human herpesvirus 6B
uacuucucuuuauagagcaauu

SEQ ID NO: 3991057 - RNA, 20 nt, Human herpesvirus 6B
uacuuuugggauuuuucaua

SEQ ID NO: 3991058 - RNA, 22 nt, Human herpesvirus 6B
uagaaaaauaagacuuagcuag

SEQ ID NO: 3991059 - RNA, 15 nt, Human herpesvirus 6B
uagaaauuuuuugca

SEQ ID NO: 3991060 - RNA, 15 nt, Human herpesvirus 6B
uagaagaagaaauac

SEQ ID NO: 3991061 - RNA, 20 nt, Human herpesvirus 6B
uagacaauuuaucgugcuug

SEQ ID NO: 3991062 - RNA, 18 nt, Human herpesvirus 6B
uagacuaaacuuaacuua

SEQ ID NO: 3991063 - RNA, 13 nt, Human herpesvirus 6B
uagagauuuugga

SEQ ID NO: 3991064 - RNA, 13 nt, Human herpesvirus 6B
uaggacugaagga

SEQ ID NO: 3991065 - RNA, 16 nt, Human herpesvirus 6B
uaggacugaaggagau

SEQ ID NO: 3991066 - RNA, 14 nt, Human herpesvirus 6B
uaggaucagacaga

SEQ ID NO: 3991067 - RNA, 14 nt, Human herpesvirus 6B
uaggguuaggguua

SEQ ID NO: 3991068 - RNA, 12 nt, Human herpesvirus 6B
uaguaaggaaga

SEQ ID NO: 3991069 - RNA, 17 nt, Human herpesvirus 6B
uauaaaugugagcaguu

SEQ ID NO: 3991070 - RNA, 16 nt, Human herpesvirus 6B
uauaguaagaggcuua

SEQ ID NO: 3991071 - RNA, 22 nt, Human herpesvirus 6B
uauaguuauucagauuucugua

SEQ ID NO: 3991072 - RNA, 16 nt, Human herpesvirus 6B
uauauagaagaagaaa

SEQ ID NO: 3991073 - RNA, 15 nt, Human herpesvirus 6B
uauaucaaacuuuuu

SEQ ID NO: 3991074 - RNA, 14 nt, Human herpesvirus 6B
uauaugaaaugucu

SEQ ID NO: 3991075 - RNA, 15 nt, Human herpesvirus 6B
uauauugcucaaaau

SEQ ID NO: 3991076 - RNA, 15 nt, Human herpesvirus 6B
uaucaaacaacuguu

SEQ ID NO: 3991077 - RNA, 22 nt, Human herpesvirus 6B
uaucaagcucgaguucgagaag

SEQ ID NO: 3991078 - RNA, 17 nt, Human herpesvirus 6B
uaucacuuuauuucuaa

SEQ ID NO: 3991079 - RNA, 23 nt, Human herpesvirus 6B
uaucccucguacaagcuuaauaa

SEQ ID NO: 3991080 - RNA, 16 nt, Human herpesvirus 6B
uaucguccucagagaa

SEQ ID NO: 3991081 - RNA, 20 nt, Human herpesvirus 6B
uaucucaacguauugggaag

SEQ ID NO: 3991082 - RNA, 19 nt, Human herpesvirus 6B
uaucucgaaaccaagacuu

SEQ ID NO: 3991083 - RNA, 23 nt, Human herpesvirus 6B
uaucugaaaucgcauuucucuac

SEQ ID NO: 3991084 - RNA, 23 nt, Human herpesvirus 6B
uaucuuacuguaaacaaauucuu

SEQ ID NO: 3991085 - RNA, 18 nt, Human herpesvirus 6B
uaugaauggggcuacuac

SEQ ID NO: 3991086 - RNA, 13 nt, Human herpesvirus 6B
uaugaaugugaga

SEQ ID NO: 3991087 - RNA, 9 nt, Human herpesvirus 6B
uaugagaau

SEQ ID NO: 3991088 - RNA, 16 nt, Human herpesvirus 6B
uaugagacuuacaguu

SEQ ID NO: 3991089 - RNA, 15 nt, Human herpesvirus 6B
uaugcaacugcauuu

SEQ ID NO: 3991090 - RNA, 19 nt, Human herpesvirus 6B
uauguaaagaaacaaaauu

SEQ ID NO: 3991091 - RNA, 15 nt, Human herpesvirus 6B
uaugucgauacaaua

SEQ ID NO: 3991092 - RNA, 16 nt, Human herpesvirus 6B
uaugucguuucauggg

SEQ ID NO: 3991093 - RNA, 16 nt, Human herpesvirus 6B
uauguggaaauuaaaa

SEQ ID NO: 3991094 - RNA, 20 nt, Human herpesvirus 6B
uauguuaacauugugagaac

SEQ ID NO: 3991095 - RNA, 22 nt, Human herpesvirus 6B
uauuaagaaugaauuugagaag

SEQ ID NO: 3991096 - RNA, 20 nt, Human herpesvirus 6B
uauuaauuuuuuguuucuga

SEQ ID NO: 3991097 - RNA, 16 nt, Human herpesvirus 6B
uauuagaucuucuuca

SEQ ID NO: 3991098 - RNA, 19 nt, Human herpesvirus 6B
uauucuaauuauaaaugua

SEQ ID NO: 3991099 - RNA, 12 nt, Human herpesvirus 6B
uauugcuacaaa

SEQ ID NO: 3991100 - RNA, 20 nt, Human herpesvirus 6B
uauuguguguacaacgacug

SEQ ID NO: 3991101 - RNA, 20 nt, Human herpesvirus 6B
uauuucugguuguguuaauc

SEQ ID NO: 3991102 - RNA, 21 nt, Human herpesvirus 6B
uauuucuuuuuaaaaucaaaa

SEQ ID NO: 3991103 - RNA, 14 nt, Human herpesvirus 6B
uauuugaaacugaa

SEQ ID NO: 3991104 - RNA, 14 nt, Human herpesvirus 6B
uauuuuauuuugug

SEQ ID NO: 3991105 - RNA, 15 nt, Human herpesvirus 6B
ucaaaaaaaaaugac

SEQ ID NO: 3991106 - RNA, 13 nt, Human herpesvirus 6B
ucaaaaucugcua

SEQ ID NO: 3991107 - RNA, 21 nt, Human herpesvirus 6B
ucaaacaacuguuguguuuga

SEQ ID NO: 3991108 - RNA, 14 nt, Human herpesvirus 6B
ucaaauauggcaga

SEQ ID NO: 3991109 - RNA, 14 nt, Human herpesvirus 6B
ucaaauguagcaaa

SEQ ID NO: 3991110 - RNA, 15 nt, Human herpesvirus 6B
ucaacuauuuaacau

SEQ ID NO: 3991111 - RNA, 14 nt, Human herpesvirus 6B
ucaaggaaacguug

SEQ ID NO: 3991112 - RNA, 20 nt, Human herpesvirus 6B
ucaagggcaagguucucagc

SEQ ID NO: 3991113 - RNA, 19 nt, Human herpesvirus 6B
ucaaguuagaaauguugcc

SEQ ID NO: 3991114 - RNA, 23 nt, Human herpesvirus 6B
ucaauguaugcgaggcuuuugau

SEQ ID NO: 3991115 - RNA, 20 nt, Human herpesvirus 6B
ucacaaccaaacaguuucag

SEQ ID NO: 3991116 - RNA, 19 nt, Human herpesvirus 6B
ucacacagcaugaacucuc

SEQ ID NO: 3991117 - RNA, 17 nt, Human herpesvirus 6B
ucaccaugaaagcacag

SEQ ID NO: 3991118 - RNA, 17 nt, Human herpesvirus 6B
ucaccgaaauccccaga

SEQ ID NO: 3991119 - RNA, 20 nt, Human herpesvirus 6B
ucacgcggaccgacgacaaa

SEQ ID NO: 3991120 - RNA, 15 nt, Human herpesvirus 6B
ucacguacuuaugau

SEQ ID NO: 3991121 - RNA, 20 nt, Human herpesvirus 6B
ucacuaacuucaagaauucu

SEQ ID NO: 3991122 - RNA, 21 nt, Human herpesvirus 6B
ucacucacauagagaagaauc

SEQ ID NO: 3991123 - RNA, 23 nt, Human herpesvirus 6B
ucacucgaggaaacgcgcuggga

SEQ ID NO: 3991124 - RNA, 19 nt, Human herpesvirus 6B
ucagcggguaccgcgguug

SEQ ID NO: 3991125 - RNA, 19 nt, Human herpesvirus 6B
ucagcuucuucuacuuuau

SEQ ID NO: 3991126 - RNA, 16 nt, Human herpesvirus 6B
ucaguaaacuuacgua

SEQ ID NO: 3991127 - RNA, 16 nt, Human herpesvirus 6B
ucagugucagcauugu

SEQ ID NO: 3991128 - RNA, 17 nt, Human herpesvirus 6B
ucauaggcacuuaccca

SEQ ID NO: 3991129 - RNA, 15 nt, Human herpesvirus 6B
ucauauauugaaauu

SEQ ID NO: 3991130 - RNA, 19 nt, Human herpesvirus 6B
ucaugauaaauuguuuccg

SEQ ID NO: 3991131 - RNA, 19 nt, Human herpesvirus 6B
ucaugccgccgaagaaaga

SEQ ID NO: 3991132 - RNA, 13 nt, Human herpesvirus 6B
ucaugucuuacag

SEQ ID NO: 3991133 - RNA, 12 nt, Human herpesvirus 6B
ucaugugaaauu

SEQ ID NO: 3991134 - RNA, 21 nt, Human herpesvirus 6B
ucauucgauuaaugccacagg

SEQ ID NO: 3991135 - RNA, 16 nt, Human herpesvirus 6B
ucauucgcguggcggc

SEQ ID NO: 3991136 - RNA, 20 nt, Human herpesvirus 6B
ucauuucgaucuaacuacau

SEQ ID NO: 3991137 - RNA, 14 nt, Human herpesvirus 6B
ucauuuuuacucau

SEQ ID NO: 3991138 - RNA, 16 nt, Human herpesvirus 6B
uccaaacuauguguua

SEQ ID NO: 3991139 - RNA, 20 nt, Human herpesvirus 6B
uccaaagucguugaauucuc

SEQ ID NO: 3991140 - RNA, 18 nt, Human herpesvirus 6B
uccaauaguagauuuuca

SEQ ID NO: 3991141 - RNA, 13 nt, Human herpesvirus 6B
uccaaucacgaaa

SEQ ID NO: 3991142 - RNA, 15 nt, Human herpesvirus 6B
uccaaugaauacuuc

SEQ ID NO: 3991143 - RNA, 12 nt, Human herpesvirus 6B
uccacagggcau

SEQ ID NO: 3991144 - RNA, 18 nt, Human herpesvirus 6B
aaaaagaacugucgcauc

SEQ ID NO: 3991145 - RNA, 20 nt, Human herpesvirus 6B
aaaaauauugguauugauuu

SEQ ID NO: 3991146 - RNA, 21 nt, Human herpesvirus 6B
aaaaccccacggagaaaucuu

SEQ ID NO: 3991147 - RNA, 14 nt, Human herpesvirus 6B
aaaaccugcuaacg

SEQ ID NO: 3991148 - RNA, 16 nt, Human herpesvirus 6B
aaaacgugagguguau

SEQ ID NO: 3991149 - RNA, 20 nt, Human herpesvirus 6B
aaaacuauacuaugauagaa

SEQ ID NO: 3991150 - RNA, 13 nt, Human herpesvirus 6B
aaaagccccugcu

SEQ ID NO: 3991151 - RNA, 20 nt, Human herpesvirus 6B
aaaaguuaguuuuggauggc

SEQ ID NO: 3991152 - RNA, 21 nt, Human herpesvirus 6B
aaaauaauccucuuagacacu

SEQ ID NO: 3991153 - RNA, 18 nt, Human herpesvirus 6B
aaaauacuauguggaaau

SEQ ID NO: 3991154 - RNA, 19 nt, Human herpesvirus 6B
aaaauauggaaacgaaugu

SEQ ID NO: 3991155 - RNA, 14 nt, Human herpesvirus 6B
aaaauauuggauuu

SEQ ID NO: 3991156 - RNA, 15 nt, Human herpesvirus 6B
aaaaucaucaaaugu

SEQ ID NO: 3991157 - RNA, 17 nt, Human herpesvirus 6B
aaaaucucgaugccaaa

SEQ ID NO: 3991158 - RNA, 14 nt, Human herpesvirus 6B
aaaaucugcuaacg

SEQ ID NO: 3991159 - RNA, 17 nt, Human herpesvirus 6B
aaaauuacuaaugugga

SEQ ID NO: 3991160 - RNA, 21 nt, Human herpesvirus 6B
aaaauugucuacaaucauuua

SEQ ID NO: 3991161 - RNA, 19 nt, Human herpesvirus 6B
aaacagauuuuacuucuac

SEQ ID NO: 3991162 - RNA, 13 nt, Human herpesvirus 6B
aaacauaaaaugu

SEQ ID NO: 3991163 - RNA, 14 nt, Human herpesvirus 6B
aaacaugauuguaa

SEQ ID NO: 3991164 - RNA, 19 nt, Human herpesvirus 6B
aaaccaggaauccuauuca

SEQ ID NO: 3991165 - RNA, 22 nt, Human herpesvirus 6B
aaacgacuaucuccuugaugau

SEQ ID NO: 3991166 - RNA, 13 nt, Human herpesvirus 6B
aaacggagacugc

SEQ ID NO: 3991167 - RNA, 23 nt, Human herpesvirus 6B
aaacggagacugcacagaaucga

SEQ ID NO: 3991168 - RNA, 19 nt, Human herpesvirus 6B
aaacugaagaauggaaaga

SEQ ID NO: 3991169 - RNA, 15 nt, Human herpesvirus 6B
aaagaaaaaacagag

SEQ ID NO: 3991170 - RNA, 19 nt, Human herpesvirus 6B
aaagauguguuaaagaaug

SEQ ID NO: 3991171 - RNA, 13 nt, Human herpesvirus 6B
aaagcugcuaacg

SEQ ID NO: 3991172 - RNA, 23 nt, Human herpesvirus 6B
aaaggaguuugcauuuggugauu

SEQ ID NO: 3991173 - RNA, 11 nt, Human herpesvirus 6B
aaagggaaguc

SEQ ID NO: 3991174 - RNA, 19 nt, Human herpesvirus 6B
aaagggaagucaaggaaac

SEQ ID NO: 3991175 - RNA, 22 nt, Human herpesvirus 6B
aaaggggauacuuuguuuucuu

SEQ ID NO: 3991176 - RNA, 16 nt, Human herpesvirus 6B
aaaguuuuggaaaaug

SEQ ID NO: 3991177 - RNA, 16 nt, Human herpesvirus 6B
aaauaucgucucuaac

SEQ ID NO: 3991178 - RNA, 22 nt, Human herpesvirus 6B
aaaucaaggaagagaaugaauc

SEQ ID NO: 3991179 - RNA, 15 nt, Human herpesvirus 6B
aaaucauauauugaa

SEQ ID NO: 3991180 - RNA, 22 nt, Human herpesvirus 6B
aaaugacaaugugaaguucgau

SEQ ID NO: 3991181 - RNA, 14 nt, Human herpesvirus 6B
aaaugaccagagau

SEQ ID NO: 3991182 - RNA, 13 nt, Human herpesvirus 6B
aaauggaguuaug

SEQ ID NO: 3991183 - RNA, 21 nt, Human herpesvirus 6B
aaaugucacucacauagagaa

SEQ ID NO: 3991184 - RNA, 17 nt, Human herpesvirus 6B
aaauuucaaaaagaaug

SEQ ID NO: 3991185 - RNA, 16 nt, Human herpesvirus 6B
aacaaagaacuuugug

SEQ ID NO: 3991186 - RNA, 19 nt, Human herpesvirus 6B
aacaaagagcuuuaaagca

SEQ ID NO: 3991187 - RNA, 18 nt, Human herpesvirus 6B
aacaaagucuuuggcuug

SEQ ID NO: 3991188 - RNA, 18 nt, Human herpesvirus 6B
aacacacacggagaauac

SEQ ID NO: 3991189 - RNA, 22 nt, Human herpesvirus 6B
aacacuuucuucgccuguaaag

SEQ ID NO: 3991190 - RNA, 13 nt, Human herpesvirus 6B
aacagaaaggcca

SEQ ID NO: 3991191 - RNA, 15 nt, Human herpesvirus 6B
aacagaguuuucaua

SEQ ID NO: 3991192 - RNA, 15 nt, Human herpesvirus 6B
aacaugauuguaaua

SEQ ID NO: 3991193 - RNA, 15 nt, Human herpesvirus 6B
aacauguauucuccu

SEQ ID NO: 3991194 - RNA, 17 nt, Human herpesvirus 6B
aaccaugcaucuugcaa

SEQ ID NO: 3991195 - RNA, 22 nt, Human herpesvirus 6B
aaccgaaaacacccugauggau

SEQ ID NO: 3991196 - RNA, 23 nt, Human herpesvirus 6B
aaccgcaguuccuguuuuucuca

SEQ ID NO: 3991197 - RNA, 21 nt, Human herpesvirus 6B
aaccgcaguuucuguuuuucu

SEQ ID NO: 3991198 - RNA, 14 nt, Human herpesvirus 6B
aacgacugggagaa

SEQ ID NO: 3991199 - RNA, 19 nt, Human herpesvirus 6B
aacgagaagacaguuuacu

SEQ ID NO: 3991200 - RNA, 21 nt, Human herpesvirus 6B
aacgagaauuccaaggcucug

SEQ ID NO: 3991201 - RNA, 20 nt, Human herpesvirus 6B
aacgauuuaugacagcaaug

SEQ ID NO: 3991202 - RNA, 22 nt, Human herpesvirus 6B
aacgcaaagggaagccagccgc

SEQ ID NO: 3991203 - RNA, 17 nt, Human herpesvirus 6B
aacgcuccucccacgcc

SEQ ID NO: 3991204 - RNA, 21 nt, Human herpesvirus 6B
aacgcuuuuuuauuauguuuu

SEQ ID NO: 3991205 - RNA, 12 nt, Human herpesvirus 6B
aacguacauaaa

SEQ ID NO: 3991206 - RNA, 19 nt, Human herpesvirus 6B
aacuaaugcggaacauugu

SEQ ID NO: 3991207 - RNA, 19 nt, Human herpesvirus 6B
aacuacgaagcugaaaauc

SEQ ID NO: 3991208 - RNA, 21 nt, Human herpesvirus 6B
aacuagcuccuaaauaccauu

SEQ ID NO: 3991209 - RNA, 16 nt, Human herpesvirus 6B
aacuauuaaaaaaccc

SEQ ID NO: 3991210 - RNA, 23 nt, Human herpesvirus 6B
aacucgggggcagucggaaaauc

SEQ ID NO: 3991211 - RNA, 18 nt, Human herpesvirus 6B
aacugaucgguauuugcg

SEQ ID NO: 3991212 - RNA, 22 nt, Human herpesvirus 6B
aagaaagcguguucaaaaaugu

SEQ ID NO: 3991213 - RNA, 20 nt, Human herpesvirus 6B
aagaacaugcagaagaacau

SEQ ID NO: 3991214 - RNA, 14 nt, Human herpesvirus 6B
aagacuuagcuaga

SEQ ID NO: 3991215 - RNA, 19 nt, Human herpesvirus 6B
aagacuuagcuagacgugu

SEQ ID NO: 3991216 - RNA, 20 nt, Human herpesvirus 6B
aagagcacgaagaagggcag

SEQ ID NO: 3991217 - RNA, 14 nt, Human herpesvirus 6B
aagagcgagaucua

SEQ ID NO: 3991218 - RNA, 16 nt, Human herpesvirus 6B
aagauccaauggauuu

SEQ ID NO: 3991219 - RNA, 15 nt, Human herpesvirus 6B
aagaucuacagagua

SEQ ID NO: 3991220 - RNA, 15 nt, Human herpesvirus 6B
aagauuuuuggauuu

SEQ ID NO: 3991221 - RNA, 18 nt, Human herpesvirus 6B
aagccagccgcccucccc

SEQ ID NO: 3991222 - RNA, 12 nt, Human herpesvirus 6B
aaggaagagaau

SEQ ID NO: 3991223 - RNA, 12 nt, Human herpesvirus 6B
aaggacuggcug

SEQ ID NO: 3991224 - RNA, 17 nt, Human herpesvirus 6B
aaggagaauuugcaguu

SEQ ID NO: 3991225 - RNA, 15 nt, Human herpesvirus 6B
aaggcuuaggaugua

SEQ ID NO: 3991226 - RNA, 20 nt, Human herpesvirus 6B
aaguaugggcacaaagugcu

SEQ ID NO: 3991227 - RNA, 19 nt, Human herpesvirus 6B
aagucaaaguccuggaaag

SEQ ID NO: 3991228 - RNA, 16 nt, Human herpesvirus 6B
aagucgccucacugua

SEQ ID NO: 3991229 - RNA, 18 nt, Human herpesvirus 6B
aauaacgguguugaguuu

SEQ ID NO: 3991230 - RNA, 16 nt, Human herpesvirus 6B
aauaaguggugaugaa

SEQ ID NO: 3991231 - RNA, 21 nt, Human herpesvirus 6B
aauaaucucuggcuucauuuc

SEQ ID NO: 3991232 - RNA, 19 nt, Human herpesvirus 6B
aauaaugcucagaugugga

SEQ ID NO: 3991233 - RNA, 21 nt, Human herpesvirus 6B
aauaauuacaaagccacagcu

SEQ ID NO: 3991234 - RNA, 21 nt, Human herpesvirus 6B
aauaauucguuugauauagaa

SEQ ID NO: 3991235 - RNA, 16 nt, Human herpesvirus 6B
aauaauuuuauugacu

SEQ ID NO: 3991236 - RNA, 20 nt, Human herpesvirus 6B
aauaauuuuauugacuguga

SEQ ID NO: 3991237 - RNA, 12 nt, Human herpesvirus 6B
aauacagcugca

SEQ ID NO: 3991238 - RNA, 19 nt, Human herpesvirus 6B
aauaccaaaaaauguuaaa

SEQ ID NO: 3991239 - RNA, 21 nt, Human herpesvirus 6B
aauaccaaaaaauguuaaaaa

SEQ ID NO: 3991240 - RNA, 16 nt, Human herpesvirus 6B
aauacgaagacaagcc

SEQ ID NO: 3991241 - RNA, 13 nt, Human herpesvirus 6B
aauacgucagcuc

SEQ ID NO: 3991242 - RNA, 18 nt, Human herpesvirus 6B
aauauauuuguugaaaga

SEQ ID NO: 3991243 - RNA, 15 nt, Human herpesvirus 6B
aauaugauggacaaa

SEQ ID NO: 3991244 - RNA, 22 nt, Human herpesvirus 6B
aauauggccugaccaacaugcc

SEQ ID NO: 3991245 - RNA, 13 nt, Human herpesvirus 6B
aauauuuugaaaa

SEQ ID NO: 3991246 - RNA, 16 nt, Human herpesvirus 6B
aaucaaauucaaacuu

SEQ ID NO: 3991247 - RNA, 13 nt, Human herpesvirus 6B
aaucacaaaauga

SEQ ID NO: 3991248 - RNA, 12 nt, Human herpesvirus 6B
aaucaugagagc

SEQ ID NO: 3991249 - RNA, 18 nt, Human herpesvirus 6B
aauccuucauagccggga

SEQ ID NO: 3991250 - RNA, 17 nt, Human herpesvirus 6B
aaucuugagguggaaau

SEQ ID NO: 3991251 - RNA, 21 nt, Human herpesvirus 6B
aaugacuuggccgaguuuaga

SEQ ID NO: 3991252 - RNA, 16 nt, Human herpesvirus 6B
aaugagauagaaguua

SEQ ID NO: 3991253 - RNA, 12 nt, Human herpesvirus 6B
aaugauuaguua

SEQ ID NO: 3991254 - RNA, 19 nt, Human herpesvirus 6B
aauggauuuuagauucgac

SEQ ID NO: 3991255 - RNA, 20 nt, Human herpesvirus 6B
aauguagcacacgacaaaua

SEQ ID NO: 3991256 - RNA, 16 nt, Human herpesvirus 6B
aauguauuguucgcug

SEQ ID NO: 3991257 - RNA, 14 nt, Human herpesvirus 6B
agacugcacagaau

SEQ ID NO: 3991258 - RNA, 12 nt, Human herpesvirus 6B
agacuugcuaac

SEQ ID NO: 3991259 - RNA, 12 nt, Human herpesvirus 6B
agagaaggaaaa

SEQ ID NO: 3991260 - RNA, 18 nt, Human herpesvirus 6B
agagacccuccuggcgcu

SEQ ID NO: 3991261 - RNA, 13 nt, Human herpesvirus 6B
agagacgaagucc

SEQ ID NO: 3991262 - RNA, 15 nt, Human herpesvirus 6B
agagcaggagcaggc

SEQ ID NO: 3991263 - RNA, 12 nt, Human herpesvirus 6B
agagcgacacgg

SEQ ID NO: 3991264 - RNA, 14 nt, Human herpesvirus 6B
agagcggaagacga

SEQ ID NO: 3991265 - RNA, 15 nt, Human herpesvirus 6B
agaggaagccggagc

SEQ ID NO: 3991266 - RNA, 13 nt, Human herpesvirus 6B
agaggcgcgggac

SEQ ID NO: 3991267 - RNA, 14 nt, Human herpesvirus 6B
agaggucuuugcuu

SEQ ID NO: 3991268 - RNA, 20 nt, Human herpesvirus 6B
agaguaccgaauaaaacaag

SEQ ID NO: 3991269 - RNA, 20 nt, Human herpesvirus 6B
agauaacggcgcagaauuac

SEQ ID NO: 3991270 - RNA, 23 nt, Human herpesvirus 6B
agauauauggaucaaucuccaaa

SEQ ID NO: 3991271 - RNA, 19 nt, Human herpesvirus 6B
agauaucguagagcaguuu

SEQ ID NO: 3991272 - RNA, 23 nt, Human herpesvirus 6B
agauaugucguuucaugggagaa

SEQ ID NO: 3991273 - RNA, 14 nt, Human herpesvirus 6B
agaucgagaucuuu

SEQ ID NO: 3991274 - RNA, 18 nt, Human herpesvirus 6B
agaucuguuuaaugagaa

SEQ ID NO: 3991275 - RNA, 15 nt, Human herpesvirus 6B
agaucuuuauggagg

SEQ ID NO: 3991276 - RNA, 20 nt, Human herpesvirus 6B
agaugcagucuccacagggc

SEQ ID NO: 3991277 - RNA, 15 nt, Human herpesvirus 6B
agaugcgggaguuga

SEQ ID NO: 3991278 - RNA, 13 nt, Human herpesvirus 6B
agauguguggugu

SEQ ID NO: 3991279 - RNA, 16 nt, Human herpesvirus 6B
agauuccucuguaaaa

SEQ ID NO: 3991280 - RNA, 12 nt, Human herpesvirus 6B
agauuucuguag

SEQ ID NO: 3991281 - RNA, 16 nt, Human herpesvirus 6B
agcaaaccagacagaa

SEQ ID NO: 3991282 - RNA, 16 nt, Human herpesvirus 6B
agcaauaacucuugga

SEQ ID NO: 3991283 - RNA, 18 nt, Human herpesvirus 6B
agcaauaacucuuggauu

SEQ ID NO: 3991284 - RNA, 15 nt, Human herpesvirus 6B
agcaaugucaaguua

SEQ ID NO: 3991285 - RNA, 21 nt, Human herpesvirus 6B
agcaauucuuuugcgaagaau

SEQ ID NO: 3991286 - RNA, 18 nt, Human herpesvirus 6B
agcaccccacaaaacuua

SEQ ID NO: 3991287 - RNA, 21 nt, Human herpesvirus 6B
agcagaacggcgguaacgugg

SEQ ID NO: 3991288 - RNA, 19 nt, Human herpesvirus 6B
agcagcgcccgaugccaac

SEQ ID NO: 3991289 - RNA, 18 nt, Human herpesvirus 6B
agcaggcuccccaggcgc

SEQ ID NO: 3991290 - RNA, 19 nt, Human herpesvirus 6B
agcauaauccuuuucugug

SEQ ID NO: 3991291 - RNA, 21 nt, Human herpesvirus 6B
agcaucgauaccagaaaaugu

SEQ ID NO: 3991292 - RNA, 12 nt, Human herpesvirus 6B
agccaaggggac

SEQ ID NO: 3991293 - RNA, 14 nt, Human herpesvirus 6B
agccacagcuuugc

SEQ ID NO: 3991294 - RNA, 14 nt, Human herpesvirus 6B
agccgcccuccccg

SEQ ID NO: 3991295 - RNA, 19 nt, Human herpesvirus 6B
agccuugauuuuugagauu

SEQ ID NO: 3991296 - RNA, 16 nt, Human herpesvirus 6B
agcgaagucaugaauu

SEQ ID NO: 3991297 - RNA, 21 nt, Human herpesvirus 6B
agcgcaucaacuacuucuguu

SEQ ID NO: 3991298 - RNA, 14 nt, Human herpesvirus 6B
agcgccaggacggg

SEQ ID NO: 3991299 - RNA, 22 nt, Human herpesvirus 6B
agcgggguugcuauagcagcgc

SEQ ID NO: 3991300 - RNA, 21 nt, Human herpesvirus 6B
agcucguuaguaauuuggauu

SEQ ID NO: 3991301 - RNA, 17 nt, Human herpesvirus 6B
agcucuuuguucugcug

SEQ ID NO: 3991302 - RNA, 14 nt, Human herpesvirus 6B
agcugcuaaaugug

SEQ ID NO: 3991303 - RNA, 15 nt, Human herpesvirus 6B
agcugcuaaauguga

SEQ ID NO: 3991304 - RNA, 12 nt, Human herpesvirus 6B
agcuggacagaa

SEQ ID NO: 3991305 - RNA, 22 nt, Human herpesvirus 6B
agcuuuaucccaaaauauaauu

SEQ ID NO: 3991306 - RNA, 18 nt, Human herpesvirus 6B
agcuuugagcaugacaca

SEQ ID NO: 3991307 - RNA, 12 nt, Human herpesvirus 6B
aggaaaaagccu

SEQ ID NO: 3991308 - RNA, 16 nt, Human herpesvirus 6B
aggaaacgcgcuggga

SEQ ID NO: 3991309 - RNA, 13 nt, Human herpesvirus 6B
aggaagaggagga

SEQ ID NO: 3991310 - RNA, 19 nt, Human herpesvirus 6B
aggaagccggagcccugag

SEQ ID NO: 3991311 - RNA, 16 nt, Human herpesvirus 6B
aggaauguaaugaauu

SEQ ID NO: 3991312 - RNA, 22 nt, Human herpesvirus 6B
aggagaagaacagaggaagaaa

SEQ ID NO: 3991313 - RNA, 14 nt, Human herpesvirus 6B
aggagaauuugcag

SEQ ID NO: 3991314 - RNA, 18 nt, Human herpesvirus 6B
aggagcacgagccaaggg

SEQ ID NO: 3991315 - RNA, 20 nt, Human herpesvirus 6B
aggagccaacauacacacga

SEQ ID NO: 3991316 - RNA, 15 nt, Human herpesvirus 6B
aggaggaagaggagg

SEQ ID NO: 3991317 - RNA, 11 nt, Human herpesvirus 6B
aggagggaccc

SEQ ID NO: 3991318 - RNA, 17 nt, Human herpesvirus 6B
aggauauugagacguuu

SEQ ID NO: 3991319 - RNA, 17 nt, Human herpesvirus 6B
aggcaauuuaaacagaa

SEQ ID NO: 3991320 - RNA, 23 nt, Human herpesvirus 6B
aggcacaauucuaacuaaaauua

SEQ ID NO: 3991321 - RNA, 14 nt, Human herpesvirus 6B
aggcacugauuuga

SEQ ID NO: 3991322 - RNA, 15 nt, Human herpesvirus 6B
aggcaucuucauccc

SEQ ID NO: 3991323 - RNA, 19 nt, Human herpesvirus 6B
aggcaugugauugucuuuu

SEQ ID NO: 3991324 - RNA, 15 nt, Human herpesvirus 6B
aggcuacuauaaaca

SEQ ID NO: 3991325 - RNA, 16 nt, Human herpesvirus 6B
agggaagucaaggaaa

SEQ ID NO: 3991326 - RNA, 17 nt, Human herpesvirus 6B
agggaagucaaggaaac

SEQ ID NO: 3991327 - RNA, 20 nt, Human herpesvirus 6B
agggaauaacagaugaggag

SEQ ID NO: 3991328 - RNA, 18 nt, Human herpesvirus 6B
agggacgcuugcuguaaa

SEQ ID NO: 3991329 - RNA, 15 nt, Human herpesvirus 6B
agggaggagagggag

SEQ ID NO: 3991330 - RNA, 14 nt, Human herpesvirus 6B
aggggacggacaga

SEQ ID NO: 3991331 - RNA, 17 nt, Human herpesvirus 6B
aggggacggacagagcg

SEQ ID NO: 3991332 - RNA, 14 nt, Human herpesvirus 6B
aggucaagcgccag

SEQ ID NO: 3991333 - RNA, 15 nt, Human herpesvirus 6B
agguggcugcauaua

SEQ ID NO: 3991334 - RNA, 16 nt, Human herpesvirus 6B
agguguuaaacgaaaa

SEQ ID NO: 3991335 - RNA, 22 nt, Human herpesvirus 6B
agguucuauucguucagaaugu

SEQ ID NO: 3991336 - RNA, 12 nt, Human herpesvirus 6B
aguaaaaaagcc

SEQ ID NO: 3991337 - RNA, 15 nt, Human herpesvirus 6B
aguaaauuaaaguuu

SEQ ID NO: 3991338 - RNA, 15 nt, Human herpesvirus 6B
aguacaaagauauuu

SEQ ID NO: 3991339 - RNA, 13 nt, Human herpesvirus 6B
aguacaauacuuu

SEQ ID NO: 3991340 - RNA, 19 nt, Human herpesvirus 6B
aguaugggcacaaagugcu

SEQ ID NO: 3991341 - RNA, 21 nt, Human herpesvirus 6B
aguauggugucugaaaaaugg

SEQ ID NO: 3991342 - RNA, 23 nt, Human herpesvirus 6B
aguauguauaauauaaauucuua

SEQ ID NO: 3991343 - RNA, 15 nt, Human herpesvirus 6B
aguauucuucuuccc

SEQ ID NO: 3991344 - RNA, 12 nt, Human herpesvirus 6B
aguauuuacuga

SEQ ID NO: 3991345 - RNA, 23 nt, Human herpesvirus 6B
aguauuuaugcuucauaauguau

SEQ ID NO: 3991346 - RNA, 18 nt, Human herpesvirus 6B
agucaacaugauuuccga

SEQ ID NO: 3991347 - RNA, 20 nt, Human herpesvirus 6B
aguccaaugaauacuucucu

SEQ ID NO: 3991348 - RNA, 14 nt, Human herpesvirus 6B
agucguggcggagc

SEQ ID NO: 3991349 - RNA, 13 nt, Human herpesvirus 6B
agucuaaugcaaa

SEQ ID NO: 3991350 - RNA, 14 nt, Human herpesvirus 6B
agucugucaguggc

SEQ ID NO: 3991351 - RNA, 12 nt, Human herpesvirus 6B
agugaaagcagu

SEQ ID NO: 3991352 - RNA, 16 nt, Human herpesvirus 6B
agugaguuuuggaaau

SEQ ID NO: 3991353 - RNA, 19 nt, Human herpesvirus 6B
agugauuauggugccucag

SEQ ID NO: 3991354 - RNA, 14 nt, Human herpesvirus 6B
agugcuucugcucu

SEQ ID NO: 3991355 - RNA, 12 nt, Human herpesvirus 6B
aguggcagggcu

SEQ ID NO: 3991356 - RNA, 22 nt, Human herpesvirus 6B
aguggguaccgcgguugaaguc

SEQ ID NO: 3991357 - RNA, 22 nt, Human herpesvirus 6B
aguguauacauucaaucuguau

SEQ ID NO: 3991358 - RNA, 15 nt, Human herpesvirus 6B
aguguggaauuuaaa

SEQ ID NO: 3991359 - RNA, 20 nt, Human herpesvirus 6B
aguguuacggggaccacugu

SEQ ID NO: 3991360 - RNA, 17 nt, Human herpesvirus 6B
aguuaacggagagucuu

SEQ ID NO: 3991361 - RNA, 22 nt, Human herpesvirus 6B
aguuaccgugaugugggugugg

SEQ ID NO: 3991362 - RNA, 23 nt, Human herpesvirus 6B
aguuagaugcuuaacuuacuuaa

SEQ ID NO: 3991363 - RNA, 16 nt, Human herpesvirus 6B
aguuagugcaccgaga

SEQ ID NO: 3991364 - RNA, 22 nt, Human herpesvirus 6B
aguuagugcaccgagaaauagu

SEQ ID NO: 3991365 - RNA, 21 nt, Human herpesvirus 6B
aguucacuaacaaaaaaaucg

SEQ ID NO: 3991366 - RNA, 18 nt, Human herpesvirus 6B
aguugggacuuggaaacg

SEQ ID NO: 3991367 - RNA, 16 nt, Human herpesvirus 6B
aguuguugcuuccgau

SEQ ID NO: 3991368 - RNA, 20 nt, Human herpesvirus 6B
auaaaauuuugcgucgucug

SEQ ID NO: 3991369 - RNA, 22 nt, Human herpesvirus 6B
auaaaccuaacagaguuuucau

SEQ ID NO: 3991370 - RNA, 15 nt, Human herpesvirus 6B
auaaaguggccauaa

SEQ ID NO: 3991371 - RNA, 21 nt, Human herpesvirus 6B
uccagaagacugcuccaguca

SEQ ID NO: 3991372 - RNA, 14 nt, Human herpesvirus 6B
uccauauuuggaag

SEQ ID NO: 3991373 - RNA, 15 nt, Human herpesvirus 6B
uccauauuuggaagc

SEQ ID NO: 3991374 - RNA, 19 nt, Human herpesvirus 6B
ucccccgaacgccuccacg

SEQ ID NO: 3991375 - RNA, 13 nt, Human herpesvirus 6B
uccccucauacau

SEQ ID NO: 3991376 - RNA, 14 nt, Human herpesvirus 6B
ucccucuucccucu

SEQ ID NO: 3991377 - RNA, 15 nt, Human herpesvirus 6B
uccgcaaguuuucag

SEQ ID NO: 3991378 - RNA, 18 nt, Human herpesvirus 6B
uccgcucuggcaugcguu

SEQ ID NO: 3991379 - RNA, 22 nt, Human herpesvirus 6B
uccgucaggaccagcucuguuc

SEQ ID NO: 3991380 - RNA, 13 nt, Human herpesvirus 6B
uccguccccgccg

SEQ ID NO: 3991381 - RNA, 15 nt, Human herpesvirus 6B
uccuaaauaccauuu

SEQ ID NO: 3991382 - RNA, 18 nt, Human herpesvirus 6B
uccucccacgcccccucg

SEQ ID NO: 3991383 - RNA, 23 nt, Human herpesvirus 6B
uccugugaugccuugauguuucc

SEQ ID NO: 3991384 - RNA, 21 nt, Human herpesvirus 6B
uccuuaaaugacacagaaucu

SEQ ID NO: 3991385 - RNA, 16 nt, Human herpesvirus 6B
uccuuuucaguauaga

SEQ ID NO: 3991386 - RNA, 17 nt, Human herpesvirus 6B
ucgaaauauaaaaccaa

SEQ ID NO: 3991387 - RNA, 18 nt, Human herpesvirus 6B
ucgaaaugcauagaaguu

SEQ ID NO: 3991388 - RNA, 15 nt, Human herpesvirus 6B
ucgacauagaguguu

SEQ ID NO: 3991389 - RNA, 14 nt, Human herpesvirus 6B
ucgaugaaaguuuu

SEQ ID NO: 3991390 - RNA, 14 nt, Human herpesvirus 6B
ucgaugccaaagcu

SEQ ID NO: 3991391 - RNA, 13 nt, Human herpesvirus 6B
ucgauguagaugu

SEQ ID NO: 3991392 - RNA, 12 nt, Human herpesvirus 6B
ucgauguuucca

SEQ ID NO: 3991393 - RNA, 16 nt, Human herpesvirus 6B
ucgauuuagagaauau

SEQ ID NO: 3991394 - RNA, 23 nt, Human herpesvirus 6B
ucgcauuucucuacaugccacag

SEQ ID NO: 3991395 - RNA, 15 nt, Human herpesvirus 6B
ucgcccguucccggg

SEQ ID NO: 3991396 - RNA, 15 nt, Human herpesvirus 6B
ucgcgauauucagag

SEQ ID NO: 3991397 - RNA, 15 nt, Human herpesvirus 6B
ucgcggcggccccgc

SEQ ID NO: 3991398 - RNA, 16 nt, Human herpesvirus 6B
ucgcguggcggcgcgc

SEQ ID NO: 3991399 - RNA, 21 nt, Human herpesvirus 6B
ucggauccaacucuacuaaaa

SEQ ID NO: 3991400 - RNA, 20 nt, Human herpesvirus 6B
ucggcgaauguacacaguca

SEQ ID NO: 3991401 - RNA, 17 nt, Human herpesvirus 6B
ucgggccuggggacaga

SEQ ID NO: 3991402 - RNA, 15 nt, Human herpesvirus 6B
ucgggcgacgggcag

SEQ ID NO: 3991403 - RNA, 15 nt, Human herpesvirus 6B
ucguuuugcaacuua

SEQ ID NO: 3991404 - RNA, 13 nt, Human herpesvirus 6B
ucuaaaucugaaa

SEQ ID NO: 3991405 - RNA, 18 nt, Human herpesvirus 6B
ucuaaugcaaagaugucg

SEQ ID NO: 3991406 - RNA, 21 nt, Human herpesvirus 6B
ucuauucguucagaauguucc

SEQ ID NO: 3991407 - RNA, 23 nt, Human herpesvirus 6B
ucucacggccauuuaacggaacc

SEQ ID NO: 3991408 - RNA, 17 nt, Human herpesvirus 6B
ucucauaauuugccuga

SEQ ID NO: 3991409 - RNA, 16 nt, Human herpesvirus 6B
ucuccaucucuagaau

SEQ ID NO: 3991410 - RNA, 23 nt, Human herpesvirus 6B
ucucccaugguuccgggauguag

SEQ ID NO: 3991411 - RNA, 13 nt, Human herpesvirus 6B
ucuccgucucagu

SEQ ID NO: 3991412 - RNA, 13 nt, Human herpesvirus 6B
ucuccugcaauuu

SEQ ID NO: 3991413 - RNA, 21 nt, Human herpesvirus 6B
ucucgaaaaugcugauuuuaa

SEQ ID NO: 3991414 - RNA, 16 nt, Human herpesvirus 6B
ucucgaugccaaagcu

SEQ ID NO: 3991415 - RNA, 20 nt, Human herpesvirus 6B
ucucgauugugauguacgug

SEQ ID NO: 3991416 - RNA, 21 nt, Human herpesvirus 6B
ucucgccgccucgccgcuccc

SEQ ID NO: 3991417 - RNA, 16 nt, Human herpesvirus 6B
ucugccgaaaagaaag

SEQ ID NO: 3991418 - RNA, 18 nt, Human herpesvirus 6B
ucugccgucaccugcacu

SEQ ID NO: 3991419 - RNA, 16 nt, Human herpesvirus 6B
ucugcguugcccuccc

SEQ ID NO: 3991420 - RNA, 13 nt, Human herpesvirus 6B
ucuggcugaagga

SEQ ID NO: 3991421 - RNA, 20 nt, Human herpesvirus 6B
ucuuaaucagauaucugaaa

SEQ ID NO: 3991422 - RNA, 13 nt, Human herpesvirus 6B
ucuuagaaauuuu

SEQ ID NO: 3991423 - RNA, 23 nt, Human herpesvirus 6B
ucuuaggaaacuuucaaaauuuu

SEQ ID NO: 3991424 - RNA, 21 nt, Human herpesvirus 6B
ucuucacaaccaaacaguuuc

SEQ ID NO: 3991425 - RNA, 14 nt, Human herpesvirus 6B
ucuucauccucgaa

SEQ ID NO: 3991426 - RNA, 12 nt, Human herpesvirus 6B
ucuucggacgcg

SEQ ID NO: 3991427 - RNA, 18 nt, Human herpesvirus 6B
ucuuuauaaacuuaaaag

SEQ ID NO: 3991428 - RNA, 12 nt, Human herpesvirus 6B
ugaaaaacagaa

SEQ ID NO: 3991429 - RNA, 20 nt, Human herpesvirus 6B
ugaaaauaucauuaaauugu

SEQ ID NO: 3991430 - RNA, 13 nt, Human herpesvirus 6B
ugaaacguuuucu

SEQ ID NO: 3991431 - RNA, 18 nt, Human herpesvirus 6B
ugaacaguauaaauucuu

SEQ ID NO: 3991432 - RNA, 16 nt, Human herpesvirus 6B
ugaagaaacgauuucu

SEQ ID NO: 3991433 - RNA, 14 nt, Human herpesvirus 6B
ugaagucuuuccug

SEQ ID NO: 3991434 - RNA, 12 nt, Human herpesvirus 6B
ugaauguuucug

SEQ ID NO: 3991435 - RNA, 16 nt, Human herpesvirus 6B
ugaauuagcagaagau

SEQ ID NO: 3991436 - RNA, 15 nt, Human herpesvirus 6B
ugaauuugagaagau

SEQ ID NO: 3991437 - RNA, 19 nt, Human herpesvirus 6B
ugaauuugcgucagaguuu

SEQ ID NO: 3991438 - RNA, 17 nt, Human herpesvirus 6B
ugacauuuaccagagau

SEQ ID NO: 3991439 - RNA, 14 nt, Human herpesvirus 6B
ugacgcaaacacag

SEQ ID NO: 3991440 - RNA, 19 nt, Human herpesvirus 6B
ugacggcgaugaaaaagau

SEQ ID NO: 3991441 - RNA, 20 nt, Human herpesvirus 6B
ugacgggggcacaucuguug

SEQ ID NO: 3991442 - RNA, 13 nt, Human herpesvirus 6B
ugacguuugcaua

SEQ ID NO: 3991443 - RNA, 15 nt, Human herpesvirus 6B
ugacuacugugucca

SEQ ID NO: 3991444 - RNA, 16 nt, Human herpesvirus 6B
ugacugaggaugugua

SEQ ID NO: 3991445 - RNA, 20 nt, Human herpesvirus 6B
ugacugauauuaacaauccg

SEQ ID NO: 3991446 - RNA, 20 nt, Human herpesvirus 6B
ugagaagauuugugugaacg

SEQ ID NO: 3991447 - RNA, 22 nt, Human herpesvirus 6B
ugagcagaagcugucuguguuu

SEQ ID NO: 3991448 - RNA, 17 nt, Human herpesvirus 6B
ugagggagaugaagagu

SEQ ID NO: 3991449 - RNA, 14 nt, Human herpesvirus 6B
ugaguuaacagaua

SEQ ID NO: 3991450 - RNA, 13 nt, Human herpesvirus 6B
ugaguuuuggaaa

SEQ ID NO: 3991451 - RNA, 19 nt, Human herpesvirus 6B
ugauacgaguaaaauugaa

SEQ ID NO: 3991452 - RNA, 18 nt, Human herpesvirus 6B
ugauauacgauggacaga

SEQ ID NO: 3991453 - RNA, 14 nt, Human herpesvirus 6B
ugauauagaacaau

SEQ ID NO: 3991454 - RNA, 15 nt, Human herpesvirus 6B
ugaugacucaagaau

SEQ ID NO: 3991455 - RNA, 21 nt, Human herpesvirus 6B
ugauuccguugugacagaauu

SEQ ID NO: 3991456 - RNA, 15 nt, Human herpesvirus 6B
ugauuccuucaaugu

SEQ ID NO: 3991457 - RNA, 15 nt, Human herpesvirus 6B
ugauuuucagaguuu

SEQ ID NO: 3991458 - RNA, 16 nt, Human herpesvirus 6B
ugauuuuccaaagauu

SEQ ID NO: 3991459 - RNA, 15 nt, Human herpesvirus 6B
ugcaaaaacaaauga

SEQ ID NO: 3991460 - RNA, 15 nt, Human herpesvirus 6B
ugcacaguugcaugg

SEQ ID NO: 3991461 - RNA, 17 nt, Human herpesvirus 6B
ugcacgaauaaggagag

SEQ ID NO: 3991462 - RNA, 11 nt, Human herpesvirus 6B
ugcagaagaac

SEQ ID NO: 3991463 - RNA, 20 nt, Human herpesvirus 6B
ugcaguuugugaauauucag

SEQ ID NO: 3991464 - RNA, 20 nt, Human herpesvirus 6B
ugcauacaugggaggccagg

SEQ ID NO: 3991465 - RNA, 12 nt, Human herpesvirus 6B
ugcaucuugcaa

SEQ ID NO: 3991466 - RNA, 11 nt, Human herpesvirus 6B
ugcccaagaac

SEQ ID NO: 3991467 - RNA, 19 nt, Human herpesvirus 6B
ugccgaaaauuugggugau

SEQ ID NO: 3991468 - RNA, 16 nt, Human herpesvirus 6B
ugccuucuguucacau

SEQ ID NO: 3991469 - RNA, 21 nt, Human herpesvirus 6B
ugcgaauuaaaacucuaaaac

SEQ ID NO: 3991470 - RNA, 15 nt, Human herpesvirus 6B
ugcgucagaguuuga

SEQ ID NO: 3991471 - RNA, 19 nt, Human herpesvirus 6B
ugcgucucuuuaaacagau

SEQ ID NO: 3991472 - RNA, 22 nt, Human herpesvirus 6B
ugcuacccggcgguuuugcgau

SEQ ID NO: 3991473 - RNA, 18 nt, Human herpesvirus 6B
ugcuaccggaacucacac

SEQ ID NO: 3991474 - RNA, 16 nt, Human herpesvirus 6B
ugcucauggaucaggu

SEQ ID NO: 3991475 - RNA, 18 nt, Human herpesvirus 6B
ugcuccguucccuucucg

SEQ ID NO: 3991476 - RNA, 14 nt, Human herpesvirus 6B
ugcuccuguuucua

SEQ ID NO: 3991477 - RNA, 15 nt, Human herpesvirus 6B
ugcucgggaucacgc

SEQ ID NO: 3991478 - RNA, 19 nt, Human herpesvirus 6B
ugcucuccgcgcugcuggg

SEQ ID NO: 3991479 - RNA, 18 nt, Human herpesvirus 6B
ugcuggguguauguuucu

SEQ ID NO: 3991480 - RNA, 14 nt, Human herpesvirus 6B
ugcuguaaaccagu

SEQ ID NO: 3991481 - RNA, 18 nt, Human herpesvirus 6B
ugcugucacacucugaac

SEQ ID NO: 3991482 - RNA, 22 nt, Human herpesvirus 6B
ugcugucgcccgccucucuccg

SEQ ID NO: 3991483 - RNA, 15 nt, Human herpesvirus 6B
ugcugugcuuuguau

SEQ ID NO: 3991484 - RNA, 14 nt, Human herpesvirus 6B
uggaaaacugcaga

SEQ ID NO: 3991485 - RNA, 22 nt, Human herpesvirus 6B
uugguuguuuuucuaaacugaa

SEQ ID NO: 3991486 - RNA, 13 nt, Human herpesvirus 6B
uuguacauguuaa

SEQ ID NO: 3991487 - RNA, 17 nt, Human herpesvirus 6B
uuguagcucaguguuug

SEQ ID NO: 3991488 - RNA, 23 nt, Human herpesvirus 6B
uugucgcugacgcaauacguaaa

SEQ ID NO: 3991489 - RNA, 19 nt, Human herpesvirus 6B
uugucgguaaauauugucu

SEQ ID NO: 3991490 - RNA, 20 nt, Human herpesvirus 6B
uugucuuuguccuauguuaa

SEQ ID NO: 3991491 - RNA, 20 nt, Human herpesvirus 6B
uugugaacaaguuauuuaaa

SEQ ID NO: 3991492 - RNA, 12 nt, Human herpesvirus 6B
uugugagaacag

SEQ ID NO: 3991493 - RNA, 21 nt, Human herpesvirus 6B
uuguguagaagacaucuuaaa

SEQ ID NO: 3991494 - RNA, 18 nt, Human herpesvirus 6B
uuguuaguguuaauucca

SEQ ID NO: 3991495 - RNA, 19 nt, Human herpesvirus 6B
uuguuucugaacuauuaaa

SEQ ID NO: 3991496 - RNA, 21 nt, Human herpesvirus 6B
uuguuuuuuucugcgacaaaa

SEQ ID NO: 3991497 - RNA, 14 nt, Human herpesvirus 6B
uuuaaaaacacacu

SEQ ID NO: 3991498 - RNA, 20 nt, Human herpesvirus 6B
uuuaaaaaugauaacuguuu

SEQ ID NO: 3991499 - RNA, 18 nt, Human herpesvirus 6B
uuuacguuaaaagggaag

SEQ ID NO: 3991500 - RNA, 14 nt, Human herpesvirus 6B
uuuacugcaugcua

SEQ ID NO: 3991501 - RNA, 13 nt, Human herpesvirus 6B
uuuauaaacuuaa

SEQ ID NO: 3991502 - RNA, 22 nt, Human herpesvirus 6B
uuuaucccucguacaagcuuaa

SEQ ID NO: 3991503 - RNA, 12 nt, Human herpesvirus 6B
uuuaugcuucau

SEQ ID NO: 3991504 - RNA, 22 nt, Human herpesvirus 6B
uuuauggagggaauugugucuu

SEQ ID NO: 3991505 - RNA, 16 nt, Human herpesvirus 6B
uuuauucuauauggcc

SEQ ID NO: 3991506 - RNA, 12 nt, Human herpesvirus 6B
uuuauugacugu

SEQ ID NO: 3991507 - RNA, 20 nt, Human herpesvirus 6B
uuucgacgaucgcgaagccu

SEQ ID NO: 3991508 - RNA, 18 nt, Human herpesvirus 6B
uuucgugguugucuuugu

SEQ ID NO: 3991509 - RNA, 18 nt, Human herpesvirus 6B
uuucguuuacgaauucaa

SEQ ID NO: 3991510 - RNA, 19 nt, Human herpesvirus 6B
uuucuccuuuuuugacguu

SEQ ID NO: 3991511 - RNA, 19 nt, Human herpesvirus 6B
uuugauaucgauucuguaa

SEQ ID NO: 3991512 - RNA, 18 nt, Human herpesvirus 6B
uuugauguugucuucugu

SEQ ID NO: 3991513 - RNA, 17 nt, Human herpesvirus 6B
uuugauuuucagaguuu

SEQ ID NO: 3991514 - RNA, 16 nt, Human herpesvirus 6B
uuugcagucgguauuu

SEQ ID NO: 3991515 - RNA, 14 nt, Human herpesvirus 6B
uuugcgucgucugu

SEQ ID NO: 3991516 - RNA, 11 nt, Human herpesvirus 6B
uuugcugucac

SEQ ID NO: 3991517 - RNA, 20 nt, Human herpesvirus 6B
uuuguauccgagcauuauga

SEQ ID NO: 3991518 - RNA, 18 nt, Human herpesvirus 6B
uuuguggcuauuugacaa

SEQ ID NO: 3991519 - RNA, 17 nt, Human herpesvirus 6B
uuuuaaacauucuuaaa

SEQ ID NO: 3991520 - RNA, 19 nt, Human herpesvirus 6B
uuuuauagccggugucauc

SEQ ID NO: 3991521 - RNA, 17 nt, Human herpesvirus 6B
uuuuauugacugugaaa

SEQ ID NO: 3991522 - RNA, 20 nt, Human herpesvirus 6B
uuuugacaccucauaucaaa

SEQ ID NO: 3991523 - RNA, 22 nt, Human herpesvirus 6B
uuuuuaaacagauuuugaggau

SEQ ID NO: 3991524 - RNA, 12 nt, Human herpesvirus 6B
uuuuucauauuu

SEQ ID NO: 3991525 - RNA, 17 nt, Human herpesvirus 6B
uuuuucuccugaucuca

SEQ ID NO: 3991526 - RNA, 16 nt, Human herpesvirus 6B
aaaaaauagcagcaau

SEQ ID NO: 3991527 - RNA, 14 nt, Human herpesvirus 6B
aauguucuucugaa

SEQ ID NO: 3991528 - RNA, 17 nt, Human herpesvirus 6B
aauguugucaaucgugu

SEQ ID NO: 3991529 - RNA, 23 nt, Human herpesvirus 6B
aauucucugcaugucuuuagaug

SEQ ID NO: 3991530 - RNA, 21 nt, Human herpesvirus 6B
aauuucaagucuguuacuaau

SEQ ID NO: 3991531 - RNA, 22 nt, Human herpesvirus 6B
aauuucagcggucgagaaagau

SEQ ID NO: 3991532 - RNA, 19 nt, Human herpesvirus 6B
aauuuccggucaacuucua

SEQ ID NO: 3991533 - RNA, 21 nt, Human herpesvirus 6B
aauuugaauucugcucguuug

SEQ ID NO: 3991534 - RNA, 16 nt, Human herpesvirus 6B
aauuuggcagaaucuu

SEQ ID NO: 3991535 - RNA, 22 nt, Human herpesvirus 6B
aauuuguaucucagaucuucga

SEQ ID NO: 3991536 - RNA, 14 nt, Human herpesvirus 6B
aauuuuauugacug

SEQ ID NO: 3991537 - RNA, 18 nt, Human herpesvirus 6B
aauuuuauugacugugaa

SEQ ID NO: 3991538 - RNA, 14 nt, Human herpesvirus 6B
aauuuugaaauugg

SEQ ID NO: 3991539 - RNA, 18 nt, Human herpesvirus 6B
aauuuuuuguuucugaaa

SEQ ID NO: 3991540 - RNA, 21 nt, Human herpesvirus 6B
aauuuuuuguuucugaaaaua

SEQ ID NO: 3991541 - RNA, 16 nt, Human herpesvirus 6B
acaaagugcuguaaac

SEQ ID NO: 3991542 - RNA, 18 nt, Human herpesvirus 6B
acaaauaauuuuauugac

SEQ ID NO: 3991543 - RNA, 15 nt, Human herpesvirus 6B
acaacgacugggaga

SEQ ID NO: 3991544 - RNA, 19 nt, Human herpesvirus 6B
acaagaaaacgagagaguu

SEQ ID NO: 3991545 - RNA, 21 nt, Human herpesvirus 6B
acaagcagccuaaauuuucuu

SEQ ID NO: 3991546 - RNA, 14 nt, Human herpesvirus 6B
acaauguuccgaaa

SEQ ID NO: 3991547 - RNA, 17 nt, Human herpesvirus 6B
acaccaaugaucacaca

SEQ ID NO: 3991548 - RNA, 18 nt, Human herpesvirus 6B
acaccagagaucagcaug

SEQ ID NO: 3991549 - RNA, 19 nt, Human herpesvirus 6B
acaccguuguugaacgaga

SEQ ID NO: 3991550 - RNA, 22 nt, Human herpesvirus 6B
acacgccauccacccauauacc

SEQ ID NO: 3991551 - RNA, 16 nt, Human herpesvirus 6B
acacucauuugcaauu

SEQ ID NO: 3991552 - RNA, 14 nt, Human herpesvirus 6B
acagaaaaaaauuu

SEQ ID NO: 3991553 - RNA, 16 nt, Human herpesvirus 6B
acagaaaaaacaccag

SEQ ID NO: 3991554 - RNA, 12 nt, Human herpesvirus 6B
acagaaauuuca

SEQ ID NO: 3991555 - RNA, 22 nt, Human herpesvirus 6B
acagcaguuuuuuggggaagcg

SEQ ID NO: 3991556 - RNA, 17 nt, Human herpesvirus 6B
acagggcauagaaagcg

SEQ ID NO: 3991557 - RNA, 17 nt, Human herpesvirus 6B
acagggguaaauuugua

SEQ ID NO: 3991558 - RNA, 21 nt, Human herpesvirus 6B
acaguauuuacugagcaaaga

SEQ ID NO: 3991559 - RNA, 14 nt, Human herpesvirus 6B
acauagaaaaauaa

SEQ ID NO: 3991560 - RNA, 18 nt, Human herpesvirus 6B
acauagaaaaauaagacu

SEQ ID NO: 3991561 - RNA, 14 nt, Human herpesvirus 6B
acauagaguguuug

SEQ ID NO: 3991562 - RNA, 23 nt, Human herpesvirus 6B
acauccagaaaagcaaacaugca

SEQ ID NO: 3991563 - RNA, 18 nt, Human herpesvirus 6B
acaucucauaauuugccu

SEQ ID NO: 3991564 - RNA, 13 nt, Human herpesvirus 6B
acauguuaacaau

SEQ ID NO: 3991565 - RNA, 16 nt, Human herpesvirus 6B
acauucguauacuucc

SEQ ID NO: 3991566 - RNA, 15 nt, Human herpesvirus 6B
acauugugagaacag

SEQ ID NO: 3991567 - RNA, 15 nt, Human herpesvirus 6B
accacucgggccggu

SEQ ID NO: 3991568 - RNA, 14 nt, Human herpesvirus 6B
accagcucuguucu

SEQ ID NO: 3991569 - RNA, 13 nt, Human herpesvirus 6B
acccauuuaucug

SEQ ID NO: 3991570 - RNA, 18 nt, Human herpesvirus 6B
accccccucuugcagugg

SEQ ID NO: 3991571 - RNA, 16 nt, Human herpesvirus 6B
acccgcguccuccauc

SEQ ID NO: 3991572 - RNA, 15 nt, Human herpesvirus 6B
accgacuuugaaauc

SEQ ID NO: 3991573 - RNA, 23 nt, Human herpesvirus 6B
accggagcuuauuuaugaaaauu

SEQ ID NO: 3991574 - RNA, 18 nt, Human herpesvirus 6B
accgguacgauuucuguu

SEQ ID NO: 3991575 - RNA, 18 nt, Human herpesvirus 6B
accgguuauaauauuaac

SEQ ID NO: 3991576 - RNA, 14 nt, Human herpesvirus 6B
accuaagcuggaca

SEQ ID NO: 3991577 - RNA, 13 nt, Human herpesvirus 6B
accucaucccuua

SEQ ID NO: 3991578 - RNA, 15 nt, Human herpesvirus 6B
acgaaaacuuuuugc

SEQ ID NO: 3991579 - RNA, 16 nt, Human herpesvirus 6B
acgacgaggaguuaaa

SEQ ID NO: 3991580 - RNA, 17 nt, Human herpesvirus 6B
acgacgcagauuuacga

SEQ ID NO: 3991581 - RNA, 15 nt, Human herpesvirus 6B
acgacuaucuccuug

SEQ ID NO: 3991582 - RNA, 20 nt, Human herpesvirus 6B
acgauggacagaaaaaacac

SEQ ID NO: 3991583 - RNA, 15 nt, Human herpesvirus 6B
acgcacgagaacacg

SEQ ID NO: 3991584 - RNA, 23 nt, Human herpesvirus 6B
acgccuccacggcaacgcuccuc

SEQ ID NO: 3991585 - RNA, 19 nt, Human herpesvirus 6B
acggaauauauagaagaag

SEQ ID NO: 3991586 - RNA, 16 nt, Human herpesvirus 6B
acggacagagcggaga

SEQ ID NO: 3991587 - RNA, 13 nt, Human herpesvirus 6B
acggagaggaagc

SEQ ID NO: 3991588 - RNA, 15 nt, Human herpesvirus 6B
acggagagucuucau

SEQ ID NO: 3991589 - RNA, 14 nt, Human herpesvirus 6B
acggagaguuuaua

SEQ ID NO: 3991590 - RNA, 16 nt, Human herpesvirus 6B
acggcaaacucaaaga

SEQ ID NO: 3991591 - RNA, 23 nt, Human herpesvirus 6B
acggccacccgcgucuccgaucc

SEQ ID NO: 3991592 - RNA, 16 nt, Human herpesvirus 6B
acggcgagacuuugug

SEQ ID NO: 3991593 - RNA, 20 nt, Human herpesvirus 6B
acggcucucuucaggagaag

SEQ ID NO: 3991594 - RNA, 15 nt, Human herpesvirus 6B
acgguaaagaugaga

SEQ ID NO: 3991595 - RNA, 13 nt, Human herpesvirus 6B
acgguggauuaug

SEQ ID NO: 3991596 - RNA, 20 nt, Human herpesvirus 6B
acgucccuucuccgucaccc

SEQ ID NO: 3991597 - RNA, 19 nt, Human herpesvirus 6B
acgucuccaucucuagaau

SEQ ID NO: 3991598 - RNA, 17 nt, Human herpesvirus 6B
acgucuccuucuaauau

SEQ ID NO: 3991599 - RNA, 18 nt, Human herpesvirus 6B
acguggccgucuccugca

SEQ ID NO: 3991600 - RNA, 15 nt, Human herpesvirus 6B
acguuaguaaggaag

SEQ ID NO: 3991601 - RNA, 22 nt, Human herpesvirus 6B
acuaaaauuacgucuuuuaugc

SEQ ID NO: 3991602 - RNA, 18 nt, Human herpesvirus 6B
acuaagugugcguuauuu

SEQ ID NO: 3991603 - RNA, 19 nt, Human herpesvirus 6B
acuaucaaaauaaaaauuu

SEQ ID NO: 3991604 - RNA, 16 nt, Human herpesvirus 6B
acucacauagagaaga

SEQ ID NO: 3991605 - RNA, 20 nt, Human herpesvirus 6B
acucaguagaaugaaugaaa

SEQ ID NO: 3991606 - RNA, 15 nt, Human herpesvirus 6B
acuccaaaaucuuua

SEQ ID NO: 3991607 - RNA, 18 nt, Human herpesvirus 6B
acucuauuauaaaaaugc

SEQ ID NO: 3991608 - RNA, 15 nt, Human herpesvirus 6B
acucugcuaaaauug

SEQ ID NO: 3991609 - RNA, 17 nt, Human herpesvirus 6B
acucuuggauugcagau

SEQ ID NO: 3991610 - RNA, 19 nt, Human herpesvirus 6B
acuggagcuagagaaaauu

SEQ ID NO: 3991611 - RNA, 19 nt, Human herpesvirus 6B
acugugaaaagugcuuuau

SEQ ID NO: 3991612 - RNA, 22 nt, Human herpesvirus 6B
acugugaggugauuugaacaga

SEQ ID NO: 3991613 - RNA, 12 nt, Human herpesvirus 6B
acuuagcuagac

SEQ ID NO: 3991614 - RNA, 23 nt, Human herpesvirus 6B
acuuaguugauaugaaugugaga

SEQ ID NO: 3991615 - RNA, 13 nt, Human herpesvirus 6B
acuucuaaaaugc

SEQ ID NO: 3991616 - RNA, 14 nt, Human herpesvirus 6B
acuucuucugcaga

SEQ ID NO: 3991617 - RNA, 21 nt, Human herpesvirus 6B
acuucuugcgauuuugugaaa

SEQ ID NO: 3991618 - RNA, 16 nt, Human herpesvirus 6B
acuuuauuugaaacug

SEQ ID NO: 3991619 - RNA, 13 nt, Human herpesvirus 6B
acuuuuugaagag

SEQ ID NO: 3991620 - RNA, 15 nt, Human herpesvirus 6B
acuuuuuucuaaaac

SEQ ID NO: 3991621 - RNA, 23 nt, Human herpesvirus 6B
agaacugucgcaucaauuacucg

SEQ ID NO: 3991622 - RNA, 22 nt, Human herpesvirus 6B
agaagaaacaaguugcggaagg

SEQ ID NO: 3991623 - RNA, 14 nt, Human herpesvirus 6B
agaagaagauauuu

SEQ ID NO: 3991624 - RNA, 15 nt, Human herpesvirus 6B
agaagauauuucccu

SEQ ID NO: 3991625 - RNA, 12 nt, Human herpesvirus 6B
agaagcugucug

SEQ ID NO: 3991626 - RNA, 19 nt, Human herpesvirus 6B
agaagggcagagagccgca

SEQ ID NO: 3991627 - RNA, 18 nt, Human herpesvirus 6B
agaaguauuucgaucaga

SEQ ID NO: 3991628 - RNA, 22 nt, Human herpesvirus 6B
agaaguuacuauuguauuuacu

SEQ ID NO: 3991629 - RNA, 22 nt, Human herpesvirus 6B
agaaucuaaaucgcgagacaga

SEQ ID NO: 3991630 - RNA, 16 nt, Human herpesvirus 6B
agaaucuccaaauggu

SEQ ID NO: 3991631 - RNA, 20 nt, Human herpesvirus 6B
agaaucuuccuuuucaguau

SEQ ID NO: 3991632 - RNA, 13 nt, Human herpesvirus 6B
agaaugacagaua

SEQ ID NO: 3991633 - RNA, 16 nt, Human herpesvirus 6B
agacaagggugugaaa

SEQ ID NO: 3991634 - RNA, 23 nt, Human herpesvirus 6B
agacaugauauucuuuaugugca

SEQ ID NO: 3991635 - RNA, 22 nt, Human herpesvirus 6B
agacauuugauguugucuucug

SEQ ID NO: 3991636 - RNA, 13 nt, Human herpesvirus 6B
agacauuuucuau

SEQ ID NO: 3991637 - RNA, 12 nt, Human herpesvirus 6B
agacgccucagg

SEQ ID NO: 3991638 - RNA, 14 nt, Human herpesvirus 6B
agacguuguuugac

SEQ ID NO: 3991639 - RNA, 14 nt, Human herpesvirus 6B
agacuaaauguucu

SEQ ID NO: 3991640 - RNA, 22 nt, Human herpesvirus 6B
auaacaugugacacaauuucug

SEQ ID NO: 3991641 - RNA, 21 nt, Human herpesvirus 6B
auaacgauaucguuuuugcuu

SEQ ID NO: 3991642 - RNA, 15 nt, Human herpesvirus 6B
auaacggcgcagaau

SEQ ID NO: 3991643 - RNA, 13 nt, Human herpesvirus 6B
auaacuaugaauu

SEQ ID NO: 3991644 - RNA, 11 nt, Human herpesvirus 6B
auaagaaugcu

SEQ ID NO: 3991645 - RNA, 13 nt, Human herpesvirus 6B
auaagacuuagcu

SEQ ID NO: 3991646 - RNA, 15 nt, Human herpesvirus 6B
auaagcagaagaguu

SEQ ID NO: 3991647 - RNA, 15 nt, Human herpesvirus 6B
auaagggacagcagu

SEQ ID NO: 3991648 - RNA, 16 nt, Human herpesvirus 6B
auaagucgugggaauu

SEQ ID NO: 3991649 - RNA, 18 nt, Human herpesvirus 6B
auaauaucauucugauaa

SEQ ID NO: 3991650 - RNA, 22 nt, Human herpesvirus 6B
auaaucuuguagcucaguguuu

SEQ ID NO: 3991651 - RNA, 16 nt, Human herpesvirus 6B
auaauuacagaugucu

SEQ ID NO: 3991652 - RNA, 16 nt, Human herpesvirus 6B
auaauuuuauugacug

SEQ ID NO: 3991653 - RNA, 20 nt, Human herpesvirus 6B
auaauuuuauugacugugaa

SEQ ID NO: 3991654 - RNA, 23 nt, Human herpesvirus 6B
auacggcggcggaagugaaagca

SEQ ID NO: 3991655 - RNA, 18 nt, Human herpesvirus 6B
auacgucagcucuucacu

SEQ ID NO: 3991656 - RNA, 18 nt, Human herpesvirus 6B
auacgugaauuucauaga

SEQ ID NO: 3991657 - RNA, 22 nt, Human herpesvirus 6B
auacuacguguaauguuuccuu

SEQ ID NO: 3991658 - RNA, 14 nt, Human herpesvirus 6B
auagacgacgcaga

SEQ ID NO: 3991659 - RNA, 13 nt, Human herpesvirus 6B
auagagccggccu

SEQ ID NO: 3991660 - RNA, 16 nt, Human herpesvirus 6B
auagauugcacgcugg

SEQ ID NO: 3991661 - RNA, 15 nt, Human herpesvirus 6B
auaggacagaggaau

SEQ ID NO: 3991662 - RNA, 16 nt, Human herpesvirus 6B
auaguaguugucguua

SEQ ID NO: 3991663 - RNA, 14 nt, Human herpesvirus 6B
auaguuauucagau

SEQ ID NO: 3991664 - RNA, 14 nt, Human herpesvirus 6B
auauaaaaaaagag

SEQ ID NO: 3991665 - RNA, 17 nt, Human herpesvirus 6B
auauaaagacuuacaga

SEQ ID NO: 3991666 - RNA, 16 nt, Human herpesvirus 6B
auaucuggauauguau

SEQ ID NO: 3991667 - RNA, 23 nt, Human herpesvirus 6B
auaugcuuuuuuuuguggauggu

SEQ ID NO: 3991668 - RNA, 23 nt, Human herpesvirus 6B
auauggaucaaucuccaaaacac

SEQ ID NO: 3991669 - RNA, 18 nt, Human herpesvirus 6B
auaugucagauuauaaug

SEQ ID NO: 3991670 - RNA, 23 nt, Human herpesvirus 6B
auaugucguuucaugggagaaau

SEQ ID NO: 3991671 - RNA, 16 nt, Human herpesvirus 6B
auauuauuaacaauga

SEQ ID NO: 3991672 - RNA, 22 nt, Human herpesvirus 6B
aucaauauagaggacgcaaaga

SEQ ID NO: 3991673 - RNA, 21 nt, Human herpesvirus 6B
aucacuuaguugauaugaaug

SEQ ID NO: 3991674 - RNA, 20 nt, Human herpesvirus 6B
aucacuuuauuucuaaggag

SEQ ID NO: 3991675 - RNA, 20 nt, Human herpesvirus 6B
aucaucgccauagugaaaga

SEQ ID NO: 3991676 - RNA, 11 nt, Human herpesvirus 6B
aucaugagaga

SEQ ID NO: 3991677 - RNA, 18 nt, Human herpesvirus 6B
aucauuucgauaucucac

SEQ ID NO: 3991678 - RNA, 11 nt, Human herpesvirus 6B
auccuuuguuu

SEQ ID NO: 3991679 - RNA, 17 nt, Human herpesvirus 6B
aucgacgaccaggcacc

SEQ ID NO: 3991680 - RNA, 17 nt, Human herpesvirus 6B
aucgagaaucuuccuuu

SEQ ID NO: 3991681 - RNA, 17 nt, Human herpesvirus 6B
aucgcgaagccuguccg

SEQ ID NO: 3991682 - RNA, 19 nt, Human herpesvirus 6B
aucgcgguguccucguccg

SEQ ID NO: 3991683 - RNA, 14 nt, Human herpesvirus 6B
aucggaagaggaag

SEQ ID NO: 3991684 - RNA, 19 nt, Human herpesvirus 6B
aucggaauguugguaaacu

SEQ ID NO: 3991685 - RNA, 12 nt, Human herpesvirus 6B
aucgggccuggg

SEQ ID NO: 3991686 - RNA, 18 nt, Human herpesvirus 6B
aucuacugguaauaaaca

SEQ ID NO: 3991687 - RNA, 14 nt, Human herpesvirus 6B
aucuaugaugcugu

SEQ ID NO: 3991688 - RNA, 15 nt, Human herpesvirus 6B
aucuauuaucauuua

SEQ ID NO: 3991689 - RNA, 14 nt, Human herpesvirus 6B
aucuccaaaagcgc

SEQ ID NO: 3991690 - RNA, 19 nt, Human herpesvirus 6B
aucuccggacagaaaauuu

SEQ ID NO: 3991691 - RNA, 17 nt, Human herpesvirus 6B
aucuuauuccaguggag

SEQ ID NO: 3991692 - RNA, 17 nt, Human herpesvirus 6B
aucuuugauaaaaccau

SEQ ID NO: 3991693 - RNA, 12 nt, Human herpesvirus 6B
augaaaacauuc

SEQ ID NO: 3991694 - RNA, 17 nt, Human herpesvirus 6B
augaaaacauucagaaa

SEQ ID NO: 3991695 - RNA, 17 nt, Human herpesvirus 6B
augaaacggaaaccgaa

SEQ ID NO: 3991696 - RNA, 22 nt, Human herpesvirus 6B
augaaaucgauguagauguuuu

SEQ ID NO: 3991697 - RNA, 22 nt, Human herpesvirus 6B
augaaaucucuuuuaacacaca

SEQ ID NO: 3991698 - RNA, 22 nt, Human herpesvirus 6B
augaagagguucagacugcugc

SEQ ID NO: 3991699 - RNA, 23 nt, Human herpesvirus 6B
augaaugugagagauuuuucaau

SEQ ID NO: 3991700 - RNA, 14 nt, Human herpesvirus 6B
augacuaucaaaau

SEQ ID NO: 3991701 - RNA, 13 nt, Human herpesvirus 6B
augacugugaggu

SEQ ID NO: 3991702 - RNA, 20 nt, Human herpesvirus 6B
augacugugaggugauuuga

SEQ ID NO: 3991703 - RNA, 14 nt, Human herpesvirus 6B
augacuuuucugau

SEQ ID NO: 3991704 - RNA, 11 nt, Human herpesvirus 6B
augagagagca

SEQ ID NO: 3991705 - RNA, 12 nt, Human herpesvirus 6B
augauaacuguu

SEQ ID NO: 3991706 - RNA, 21 nt, Human herpesvirus 6B
augauagaagaucuaaugaau

SEQ ID NO: 3991707 - RNA, 23 nt, Human herpesvirus 6B
augcaacgucgguucaauaacug

SEQ ID NO: 3991708 - RNA, 17 nt, Human herpesvirus 6B
augcaagucgcgaagug

SEQ ID NO: 3991709 - RNA, 16 nt, Human herpesvirus 6B
augcaaucugugggaa

SEQ ID NO: 3991710 - RNA, 18 nt, Human herpesvirus 6B
augcagaucgagaauaau

SEQ ID NO: 3991711 - RNA, 19 nt, Human herpesvirus 6B
augcagucuccacagggca

SEQ ID NO: 3991712 - RNA, 12 nt, Human herpesvirus 6B
augcauagaagu

SEQ ID NO: 3991713 - RNA, 18 nt, Human herpesvirus 6B
augcgccacagggaggug

SEQ ID NO: 3991714 - RNA, 23 nt, Human herpesvirus 6B
augcgguugucuuguuagacaag

SEQ ID NO: 3991715 - RNA, 12 nt, Human herpesvirus 6B
augcuaaagcac

SEQ ID NO: 3991716 - RNA, 16 nt, Human herpesvirus 6B
auggaagacagucaaa

SEQ ID NO: 3991717 - RNA, 17 nt, Human herpesvirus 6B
auggaucaaucuccaaa

SEQ ID NO: 3991718 - RNA, 22 nt, Human herpesvirus 6B
auggaucaaucuccaaaacacu

SEQ ID NO: 3991719 - RNA, 17 nt, Human herpesvirus 6B
auggauuacaagggaaa

SEQ ID NO: 3991720 - RNA, 18 nt, Human herpesvirus 6B
augggaaauguugucaau

SEQ ID NO: 3991721 - RNA, 13 nt, Human herpesvirus 6B
auggggcuacuac

SEQ ID NO: 3991722 - RNA, 22 nt, Human herpesvirus 6B
auggguacaaugccaacacugu

SEQ ID NO: 3991723 - RNA, 13 nt, Human herpesvirus 6B
augguauggaaaa

SEQ ID NO: 3991724 - RNA, 14 nt, Human herpesvirus 6B
augguuaaggaaaa

SEQ ID NO: 3991725 - RNA, 18 nt, Human herpesvirus 6B
augguucgauugcgcgau

SEQ ID NO: 3991726 - RNA, 20 nt, Human herpesvirus 6B
auguaaacacgaaacugcuu

SEQ ID NO: 3991727 - RNA, 19 nt, Human herpesvirus 6B
auguaaagaaacaaaauua

SEQ ID NO: 3991728 - RNA, 22 nt, Human herpesvirus 6B
auguacguggccgucuccugca

SEQ ID NO: 3991729 - RNA, 12 nt, Human herpesvirus 6B
auguagcacacg

SEQ ID NO: 3991730 - RNA, 19 nt, Human herpesvirus 6B
auguagcacacgacaaaua

SEQ ID NO: 3991731 - RNA, 14 nt, Human herpesvirus 6B
auguaguguggaau

SEQ ID NO: 3991732 - RNA, 13 nt, Human herpesvirus 6B
auguaucugaaaa

SEQ ID NO: 3991733 - RNA, 12 nt, Human herpesvirus 6B
augucaaaauuu

SEQ ID NO: 3991734 - RNA, 14 nt, Human herpesvirus 6B
augucgaaucucaa

SEQ ID NO: 3991735 - RNA, 15 nt, Human herpesvirus 6B
auguucgccucuccc

SEQ ID NO: 3991736 - RNA, 19 nt, Human herpesvirus 6B
auuaaacuaacaugacaaa

SEQ ID NO: 3991737 - RNA, 20 nt, Human herpesvirus 6B
auuaaagauugcaucgcugg

SEQ ID NO: 3991738 - RNA, 13 nt, Human herpesvirus 6B
auuaauuaucauu

SEQ ID NO: 3991739 - RNA, 20 nt, Human herpesvirus 6B
auuaccgguaaagaacccau

SEQ ID NO: 3991740 - RNA, 13 nt, Human herpesvirus 6B
auuagaucuucuu

SEQ ID NO: 3991741 - RNA, 18 nt, Human herpesvirus 6B
auuagcauucaaguccaa

SEQ ID NO: 3991742 - RNA, 12 nt, Human herpesvirus 6B
auuauaaaugua

SEQ ID NO: 3991743 - RNA, 14 nt, Human herpesvirus 6B
auuauaaugaugca

SEQ ID NO: 3991744 - RNA, 18 nt, Human herpesvirus 6B
auuauauguugauugcug

SEQ ID NO: 3991745 - RNA, 20 nt, Human herpesvirus 6B
auuauggaaguagaauacug

SEQ ID NO: 3991746 - RNA, 19 nt, Human herpesvirus 6B
auucaaguccaaugcucug

SEQ ID NO: 3991747 - RNA, 15 nt, Human herpesvirus 6B
auuccaauugcugcu

SEQ ID NO: 3991748 - RNA, 22 nt, Human herpesvirus 6B
auuccauguggccuuuuuguaa

SEQ ID NO: 3991749 - RNA, 20 nt, Human herpesvirus 6B
auuccguugugacagaauua

SEQ ID NO: 3991750 - RNA, 17 nt, Human herpesvirus 6B
auucgaucgagaaucuu

SEQ ID NO: 3991751 - RNA, 18 nt, Human herpesvirus 6B
auucugauuauuaucaca

SEQ ID NO: 3991752 - RNA, 13 nt, Human herpesvirus 6B
auucuuaaauuca

SEQ ID NO: 3991753 - RNA, 19 nt, Human herpesvirus 6B
auucuuguucgggccaagg

SEQ ID NO: 3991754 - RNA, 17 nt, Human herpesvirus 6B
uggaaaagaucaacaaa

SEQ ID NO: 3991755 - RNA, 19 nt, Human herpesvirus 6B
uggaaacacuuucuucgcc

SEQ ID NO: 3991756 - RNA, 19 nt, Human herpesvirus 6B
uggaaaucuauuaauuuug

SEQ ID NO: 3991757 - RNA, 16 nt, Human herpesvirus 6B
uggaagacgucgggaa

SEQ ID NO: 3991758 - RNA, 14 nt, Human herpesvirus 6B
uggacaccaauaaa

SEQ ID NO: 3991759 - RNA, 12 nt, Human herpesvirus 6B
uggacaggagca

SEQ ID NO: 3991760 - RNA, 15 nt, Human herpesvirus 6B
uggacggcgagggga

SEQ ID NO: 3991761 - RNA, 16 nt, Human herpesvirus 6B
uggagauugauuccag

SEQ ID NO: 3991762 - RNA, 17 nt, Human herpesvirus 6B
uggagucuggccucugc

SEQ ID NO: 3991763 - RNA, 23 nt, Human herpesvirus 6B
uggagucuggccucugcggcucu

SEQ ID NO: 3991764 - RNA, 23 nt, Human herpesvirus 6B
uggauauguauccagucuauucu

SEQ ID NO: 3991765 - RNA, 18 nt, Human herpesvirus 6B
uggauuacgcuaggaaaa

SEQ ID NO: 3991766 - RNA, 20 nt, Human herpesvirus 6B
uggcacugaaucagaaacug

SEQ ID NO: 3991767 - RNA, 21 nt, Human herpesvirus 6B
uggccaaucauaagaaacuca

SEQ ID NO: 3991768 - RNA, 20 nt, Human herpesvirus 6B
uggccgcuuucuuggcgccc

SEQ ID NO: 3991769 - RNA, 22 nt, Human herpesvirus 6B
uggccuauugcauggcauguga

SEQ ID NO: 3991770 - RNA, 12 nt, Human herpesvirus 6B
uggcugaaggaa

SEQ ID NO: 3991771 - RNA, 16 nt, Human herpesvirus 6B
ugggaaccugugaaca

SEQ ID NO: 3991772 - RNA, 13 nt, Human herpesvirus 6B
ugggacuccgagc

SEQ ID NO: 3991773 - RNA, 17 nt, Human herpesvirus 6B
ugggcaauuguuuucca

SEQ ID NO: 3991774 - RNA, 14 nt, Human herpesvirus 6B
uggggacagacagg

SEQ ID NO: 3991775 - RNA, 22 nt, Human herpesvirus 6B
ugggucuaacggcaucagauuu

SEQ ID NO: 3991776 - RNA, 16 nt, Human herpesvirus 6B
uggguuaucuuagaaa

SEQ ID NO: 3991777 - RNA, 16 nt, Human herpesvirus 6B
uggugaccgaauuaug

SEQ ID NO: 3991778 - RNA, 14 nt, Human herpesvirus 6B
ugguucuugagcag

SEQ ID NO: 3991779 - RNA, 16 nt, Human herpesvirus 6B
ugguuugcuuuggauc

SEQ ID NO: 3991780 - RNA, 19 nt, Human herpesvirus 6B
uguaaaaaaaauucucuga

SEQ ID NO: 3991781 - RNA, 13 nt, Human herpesvirus 6B
uguaaaaaaagau

SEQ ID NO: 3991782 - RNA, 15 nt, Human herpesvirus 6B
uguaaaauguuucca

SEQ ID NO: 3991783 - RNA, 16 nt, Human herpesvirus 6B
uguaauuguugaaauu

SEQ ID NO: 3991784 - RNA, 23 nt, Human herpesvirus 6B
uguacugguaauucaauuucuaa

SEQ ID NO: 3991785 - RNA, 17 nt, Human herpesvirus 6B
uguaucgauuuaaccuu

SEQ ID NO: 3991786 - RNA, 17 nt, Human herpesvirus 6B
uguauuaaaaugugaug

SEQ ID NO: 3991787 - RNA, 16 nt, Human herpesvirus 6B
uguauuguguaccuug

SEQ ID NO: 3991788 - RNA, 14 nt, Human herpesvirus 6B
ugucaggaauguaa

SEQ ID NO: 3991789 - RNA, 12 nt, Human herpesvirus 6B
ugucgaaucuca

SEQ ID NO: 3991790 - RNA, 22 nt, Human herpesvirus 6B
ugucgcagaaucaagaaacacu

SEQ ID NO: 3991791 - RNA, 17 nt, Human herpesvirus 6B
ugucgcaucaauuacuc

SEQ ID NO: 3991792 - RNA, 19 nt, Human herpesvirus 6B
ugucugagcauuguguauu

SEQ ID NO: 3991793 - RNA, 22 nt, Human herpesvirus 6B
ugugaaaagugcuuuauccggc

SEQ ID NO: 3991794 - RNA, 16 nt, Human herpesvirus 6B
ugugaaguucgauguu

SEQ ID NO: 3991795 - RNA, 14 nt, Human herpesvirus 6B
ugugcaaaucagga

SEQ ID NO: 3991796 - RNA, 13 nt, Human herpesvirus 6B
ugugcuuggaagu

SEQ ID NO: 3991797 - RNA, 13 nt, Human herpesvirus 6B
uguggaguuuucu

SEQ ID NO: 3991798 - RNA, 15 nt, Human herpesvirus 6B
uguguauuugugaac

SEQ ID NO: 3991799 - RNA, 13 nt, Human herpesvirus 6B
uguguuguuuccu

SEQ ID NO: 3991800 - RNA, 16 nt, Human herpesvirus 6B
uguuagauaaaaugaa

SEQ ID NO: 3991801 - RNA, 16 nt, Human herpesvirus 6B
uguucagcuucuucua

SEQ ID NO: 3991802 - RNA, 14 nt, Human herpesvirus 6B
uguucauagagcau

SEQ ID NO: 3991803 - RNA, 15 nt, Human herpesvirus 6B
uguucgccucucccg

SEQ ID NO: 3991804 - RNA, 13 nt, Human herpesvirus 6B
uguucguucucua

SEQ ID NO: 3991805 - RNA, 14 nt, Human herpesvirus 6B
uguucguugucuga

SEQ ID NO: 3991806 - RNA, 11 nt, Human herpesvirus 6B
uguuguagugg

SEQ ID NO: 3991807 - RNA, 13 nt, Human herpesvirus 6B
uguuguguuugaa

SEQ ID NO: 3991808 - RNA, 21 nt, Human herpesvirus 6B
uguuuucaaugguauucgaaa

SEQ ID NO: 3991809 - RNA, 15 nt, Human herpesvirus 6B
uguuuuuaguaauaa

SEQ ID NO: 3991810 - RNA, 14 nt, Human herpesvirus 6B
uuaaaauguguuaa

SEQ ID NO: 3991811 - RNA, 23 nt, Human herpesvirus 6B
uuaacaaugaaaauucaguuuuu

SEQ ID NO: 3991812 - RNA, 22 nt, Human herpesvirus 6B
uuaaggagcggacacgacaugu

SEQ ID NO: 3991813 - RNA, 17 nt, Human herpesvirus 6B
uuaauaaaggauguuug

SEQ ID NO: 3991814 - RNA, 13 nt, Human herpesvirus 6B
uuacgacacgcuc

SEQ ID NO: 3991815 - RNA, 20 nt, Human herpesvirus 6B
uuacgacacgcucguauuuu

SEQ ID NO: 3991816 - RNA, 13 nt, Human herpesvirus 6B
uuacucauacaga

SEQ ID NO: 3991817 - RNA, 15 nt, Human herpesvirus 6B
uuagagaaauuugug

SEQ ID NO: 3991818 - RNA, 22 nt, Human herpesvirus 6B
uuagaugucgggccacauuucg

SEQ ID NO: 3991819 - RNA, 12 nt, Human herpesvirus 6B
uuaggacaauug

SEQ ID NO: 3991820 - RNA, 14 nt, Human herpesvirus 6B
uuaggauguaaaug

SEQ ID NO: 3991821 - RNA, 23 nt, Human herpesvirus 6B
uuauaaaaaugcgcauaugacuc

SEQ ID NO: 3991822 - RNA, 23 nt, Human herpesvirus 6B
uuauaaaugugagcaguuuuuua

SEQ ID NO: 3991823 - RNA, 13 nt, Human herpesvirus 6B
uuauaaguguuac

SEQ ID NO: 3991824 - RNA, 18 nt, Human herpesvirus 6B
uuaucaaauuugcauuca

SEQ ID NO: 3991825 - RNA, 19 nt, Human herpesvirus 6B
uuauccccaaacucuugca

SEQ ID NO: 3991826 - RNA, 17 nt, Human herpesvirus 6B
uuaugaucggcauuugu

SEQ ID NO: 3991827 - RNA, 17 nt, Human herpesvirus 6B
uuaugcaagacguuuuu

SEQ ID NO: 3991828 - RNA, 23 nt, Human herpesvirus 6B
uuauggacaacgguguggagaca

SEQ ID NO: 3991829 - RNA, 21 nt, Human herpesvirus 6B
uuauguuaauuccaagaugca

SEQ ID NO: 3991830 - RNA, 11 nt, Human herpesvirus 6B
uuauguuugau

SEQ ID NO: 3991831 - RNA, 20 nt, Human herpesvirus 6B
uuauuagcauucaaguccaa

SEQ ID NO: 3991832 - RNA, 14 nt, Human herpesvirus 6B
uuauugacugugaa

SEQ ID NO: 3991833 - RNA, 14 nt, Human herpesvirus 6B
uuauuguguucugc

SEQ ID NO: 3991834 - RNA, 15 nt, Human herpesvirus 6B
uuauuucauuggaua

SEQ ID NO: 3991835 - RNA, 20 nt, Human herpesvirus 6B
uucacagcaguuaucucaaa

SEQ ID NO: 3991836 - RNA, 15 nt, Human herpesvirus 6B
uucacguuuacauaa

SEQ ID NO: 3991837 - RNA, 20 nt, Human herpesvirus 6B
uucacuaacaaaaaaaucgu

SEQ ID NO: 3991838 - RNA, 17 nt, Human herpesvirus 6B
uucagaaggcuguguuu

SEQ ID NO: 3991839 - RNA, 15 nt, Human herpesvirus 6B
uucagcuaaucacuu

SEQ ID NO: 3991840 - RNA, 19 nt, Human herpesvirus 6B
uucaggcggcaugaauucc

SEQ ID NO: 3991841 - RNA, 17 nt, Human herpesvirus 6B
uucauaagcucuacaca

SEQ ID NO: 3991842 - RNA, 13 nt, Human herpesvirus 6B
uuccaaagauucu

SEQ ID NO: 3991843 - RNA, 12 nt, Human herpesvirus 6B
uuccagauguag

SEQ ID NO: 3991844 - RNA, 15 nt, Human herpesvirus 6B
uuccagggugaagac

SEQ ID NO: 3991845 - RNA, 21 nt, Human herpesvirus 6B
uuccucgcgguauaaugcaug

SEQ ID NO: 3991846 - RNA, 20 nt, Human herpesvirus 6B
uuccuucaggcgcaaaccaa

SEQ ID NO: 3991847 - RNA, 18 nt, Human herpesvirus 6B
uucgacaaagaacauuug

SEQ ID NO: 3991848 - RNA, 13 nt, Human herpesvirus 6B
uucgagaaagagg

SEQ ID NO: 3991849 - RNA, 14 nt, Human herpesvirus 6B
uucgauuaugugag

SEQ ID NO: 3991850 - RNA, 20 nt, Human herpesvirus 6B
uucgggaugugcggagaaag

SEQ ID NO: 3991851 - RNA, 20 nt, Human herpesvirus 6B
uucguccggggugaaaucua

SEQ ID NO: 3991852 - RNA, 16 nt, Human herpesvirus 6B
uucuaaaaguuuauua

SEQ ID NO: 3991853 - RNA, 20 nt, Human herpesvirus 6B
uucuauauggcccucucacg

SEQ ID NO: 3991854 - RNA, 16 nt, Human herpesvirus 6B
uucucagcauuguuga

SEQ ID NO: 3991855 - RNA, 15 nt, Human herpesvirus 6B
uucuccacacuguuu

SEQ ID NO: 3991856 - RNA, 21 nt, Human herpesvirus 6B
uucuuaggaaacuuucaaaau

SEQ ID NO: 3991857 - RNA, 15 nt, Human herpesvirus 6B
uucuuugaacaguga

SEQ ID NO: 3991858 - RNA, 18 nt, Human herpesvirus 6B
uugaauacgacuuuggaa

SEQ ID NO: 3991859 - RNA, 13 nt, Human herpesvirus 6B
uugaauucugcuc

SEQ ID NO: 3991860 - RNA, 13 nt, Human herpesvirus 6B
uugagacguuuuu

SEQ ID NO: 3991861 - RNA, 19 nt, Human herpesvirus 6B
uugaguuuaucgugcaauu

SEQ ID NO: 3991862 - RNA, 15 nt, Human herpesvirus 6B
uugauguugguugau

SEQ ID NO: 3991863 - RNA, 20 nt, Human herpesvirus 6B
uugauguugucuucugugcu

SEQ ID NO: 3991864 - RNA, 20 nt, Human herpesvirus 6B
uugcacuauuuuaaaugaca

SEQ ID NO: 3991865 - RNA, 18 nt, Human herpesvirus 6B
uugcauucaguauuacga

SEQ ID NO: 3991866 - RNA, 19 nt, Human herpesvirus 6B
uugcuacaaaguucucaga

SEQ ID NO: 3991867 - RNA, 13 nt, Human herpesvirus 6B
uugcugucgcccg

SEQ ID NO: 3991868 - RNA, 14 nt, Human herpesvirus 6B
ccaugacugugagg

SEQ ID NO: 3991869 - RNA, 14 nt, Human herpesvirus 6B
ccaugcagcugccc

SEQ ID NO: 3991870 - RNA, 18 nt, Human herpesvirus 6B
ccaugcagcugcccguga

SEQ ID NO: 3991871 - RNA, 13 nt, Human herpesvirus 6B
ccaugcgaguaga

SEQ ID NO: 3991872 - RNA, 14 nt, Human herpesvirus 6B
ccauggcgacucaa

SEQ ID NO: 3991873 - RNA, 23 nt, Human herpesvirus 6B
ccauugaauacacguguggcagc

SEQ ID NO: 3991874 - RNA, 13 nt, Human herpesvirus 6B
cccacgcccccuc

SEQ ID NO: 3991875 - RNA, 14 nt, Human herpesvirus 6B
cccagaugcagucu

SEQ ID NO: 3991876 - RNA, 13 nt, Human herpesvirus 6B
cccaggcgcagca

SEQ ID NO: 3991877 - RNA, 16 nt, Human herpesvirus 6B
cccaggcgcagcagca

SEQ ID NO: 3991878 - RNA, 20 nt, Human herpesvirus 6B
cccaggcgcagcagcagcuc

SEQ ID NO: 3991879 - RNA, 24 nt, Human herpesvirus 6B
cccagucagauaaugaauuucaau

SEQ ID NO: 3991880 - RNA, 21 nt, Human herpesvirus 6B
cccccucuugcaguggcgcgc

SEQ ID NO: 3991881 - RNA, 17 nt, Human herpesvirus 6B
ccccucuugcaguggcg

SEQ ID NO: 3991882 - RNA, 14 nt, Human herpesvirus 6B
cccgcgucaggugc

SEQ ID NO: 3991883 - RNA, 22 nt, Human herpesvirus 6B
cccgcgucuccgauccgucagg

SEQ ID NO: 3991884 - RNA, 22 nt, Human herpesvirus 6B
cccgggcgcggggcgcaccggc

SEQ ID NO: 3991885 - RNA, 16 nt, Human herpesvirus 6B
cccggggagugggagg

SEQ ID NO: 3991886 - RNA, 16 nt, Human herpesvirus 6B
cccgguauggaucuca

SEQ ID NO: 3991887 - RNA, 18 nt, Human herpesvirus 6B
cccguccucgugcucucc

SEQ ID NO: 3991888 - RNA, 13 nt, Human herpesvirus 6B
cccucccgcagcu

SEQ ID NO: 3991889 - RNA, 13 nt, Human herpesvirus 6B
cccuccguccagg

SEQ ID NO: 3991890 - RNA, 14 nt, Human herpesvirus 6B
cccucgcccguucc

SEQ ID NO: 3991891 - RNA, 14 nt, Human herpesvirus 6B
cccucuugcagugg

SEQ ID NO: 3991892 - RNA, 14 nt, Human herpesvirus 6B
ccgaaccacaucuu

SEQ ID NO: 3991893 - RNA, 23 nt, Human herpesvirus 6B
ccgagagaauagagauaaaugua

SEQ ID NO: 3991894 - RNA, 21 nt, Human herpesvirus 6B
ccgcacaguucguccagcagc

SEQ ID NO: 3991895 - RNA, 15 nt, Human herpesvirus 6B
ccgcagaggcggcga

SEQ ID NO: 3991896 - RNA, 13 nt, Human herpesvirus 6B
ccgcagcuccuuc

SEQ ID NO: 3991897 - RNA, 21 nt, Human herpesvirus 6B
ccgccucucuccgccuccucu

SEQ ID NO: 3991898 - RNA, 19 nt, Human herpesvirus 6B
ccgccuucucugucgcugc

SEQ ID NO: 3991899 - RNA, 17 nt, Human herpesvirus 6B
ccgcgaugcgccacagg

SEQ ID NO: 3991900 - RNA, 23 nt, Human herpesvirus 6B
ccgcgguugaagucuuuccuguu

SEQ ID NO: 3991901 - RNA, 23 nt, Human herpesvirus 6B
ccgcugcagugugucggcuccga

SEQ ID NO: 3991902 - RNA, 19 nt, Human herpesvirus 6B
ccggagcccugagagcagg

SEQ ID NO: 3991903 - RNA, 19 nt, Human herpesvirus 6B
ccggcccguccaccguccc

SEQ ID NO: 3991904 - RNA, 23 nt, Human herpesvirus 6B
ccggcgacacgcgcggaccacuc

SEQ ID NO: 3991905 - RNA, 21 nt, Human herpesvirus 6B
ccgggcgcggggcgcaccggc

SEQ ID NO: 3991906 - RNA, 19 nt, Human herpesvirus 6B
ccggggagugggaggagcc

SEQ ID NO: 3991907 - RNA, 16 nt, Human herpesvirus 6B
ccguacgcgccacagc

SEQ ID NO: 3991908 - RNA, 12 nt, Human herpesvirus 6B
ccgugaaggaau

SEQ ID NO: 3991909 - RNA, 23 nt, Human herpesvirus 6B
ccuauguuaacauugugagaaca

SEQ ID NO: 3991910 - RNA, 18 nt, Human herpesvirus 6B
ccuccaucccccuccccg

SEQ ID NO: 3991911 - RNA, 17 nt, Human herpesvirus 6B
ccucccgcagcuccuuc

SEQ ID NO: 3991912 - RNA, 16 nt, Human herpesvirus 6B
ccuccggcacugccgc

SEQ ID NO: 3991913 - RNA, 21 nt, Human herpesvirus 6B
ccucgguccccccucccucca

SEQ ID NO: 3991914 - RNA, 15 nt, Human herpesvirus 6B
ccucgugcucuccgc

SEQ ID NO: 3991915 - RNA, 11 nt, Human herpesvirus 6B
ccugaaaagac

SEQ ID NO: 3991916 - RNA, 15 nt, Human herpesvirus 6B
ccugaaaccccacaa

SEQ ID NO: 3991917 - RNA, 18 nt, Human herpesvirus 6B
ccugauccaugagcaccc

SEQ ID NO: 3991918 - RNA, 20 nt, Human herpesvirus 6B
ccugaugguuaaggaaaaag

SEQ ID NO: 3991919 - RNA, 14 nt, Human herpesvirus 6B
ccuguuuucccacc

SEQ ID NO: 3991920 - RNA, 21 nt, Human herpesvirus 6B
cgaaaacacccugauggauua

SEQ ID NO: 3991921 - RNA, 20 nt, Human herpesvirus 6B
cgaaagcaguuuugcagcau

SEQ ID NO: 3991922 - RNA, 17 nt, Human herpesvirus 6B
cgaaauuauuuuuaaug

SEQ ID NO: 3991923 - RNA, 20 nt, Human herpesvirus 6B
cgaaguacacuucaugggca

SEQ ID NO: 3991924 - RNA, 15 nt, Human herpesvirus 6B
cgaauaagccuuugc

SEQ ID NO: 3991925 - RNA, 15 nt, Human herpesvirus 6B
cgaaucggaagagga

SEQ ID NO: 3991926 - RNA, 18 nt, Human herpesvirus 6B
cgacacgcgcggaccacu

SEQ ID NO: 3991927 - RNA, 16 nt, Human herpesvirus 6B
cuguaaaaaaaauucu

SEQ ID NO: 3991928 - RNA, 14 nt, Human herpesvirus 6B
cuguaaaagggcuc

SEQ ID NO: 3991929 - RNA, 18 nt, Human herpesvirus 6B
cuguaguuuuuuucugau

SEQ ID NO: 3991930 - RNA, 18 nt, Human herpesvirus 6B
cuguauaucuaugcuuuu

SEQ ID NO: 3991931 - RNA, 13 nt, Human herpesvirus 6B
cuguauuaauuuu

SEQ ID NO: 3991932 - RNA, 17 nt, Human herpesvirus 6B
cugucuccagcaagaaa

SEQ ID NO: 3991933 - RNA, 21 nt, Human herpesvirus 6B
cugugaggugauuugaacaga

SEQ ID NO: 3991934 - RNA, 20 nt, Human herpesvirus 6B
cugugauaaaucuaccugcc

SEQ ID NO: 3991935 - RNA, 18 nt, Human herpesvirus 6B
cugugaugggaaauguug

SEQ ID NO: 3991936 - RNA, 15 nt, Human herpesvirus 6B
cuguucacauuguga

SEQ ID NO: 3991937 - RNA, 21 nt, Human herpesvirus 6B
cuguucgauguacaguuucuc

SEQ ID NO: 3991938 - RNA, 12 nt, Human herpesvirus 6B
cuguuguggauu

SEQ ID NO: 3991939 - RNA, 17 nt, Human herpesvirus 6B
cuuaaaugacacagaau

SEQ ID NO: 3991940 - RNA, 15 nt, Human herpesvirus 6B
cuuaaucagauaucu

SEQ ID NO: 3991941 - RNA, 12 nt, Human herpesvirus 6B
cuuaccaagaaa

SEQ ID NO: 3991942 - RNA, 22 nt, Human herpesvirus 6B
cuuacccaucuaugcgugugaa

SEQ ID NO: 3991943 - RNA, 14 nt, Human herpesvirus 6B
cuuaccuuuuaaga

SEQ ID NO: 3991944 - RNA, 16 nt, Human herpesvirus 6B
cuuagaaccaaucugu

SEQ ID NO: 3991945 - RNA, 19 nt, Human herpesvirus 6B
cuuagacacuguaauuugg

SEQ ID NO: 3991946 - RNA, 23 nt, Human herpesvirus 6B
cuucaggagaagaacagaggaag

SEQ ID NO: 3991947 - RNA, 19 nt, Human herpesvirus 6B
cuucauccucgaagaauug

SEQ ID NO: 3991948 - RNA, 17 nt, Human herpesvirus 6B
cuuccgcggcgcugggc

SEQ ID NO: 3991949 - RNA, 23 nt, Human herpesvirus 6B
cuucuuggagucuggccucugcg

SEQ ID NO: 3991950 - RNA, 19 nt, Human herpesvirus 6B
cuugaucacuucuucugca

SEQ ID NO: 3991951 - RNA, 10 nt, Human herpesvirus 6B
cuugcagugg

SEQ ID NO: 3991952 - RNA, 12 nt, Human herpesvirus 6B
cuuggaaaaggu

SEQ ID NO: 3991953 - RNA, 20 nt, Human herpesvirus 6B
cuugguguaccagacaaaac

SEQ ID NO: 3991954 - RNA, 12 nt, Human herpesvirus 6B
cuuuaaaaauua

SEQ ID NO: 3991955 - RNA, 12 nt, Human herpesvirus 6B
cuuuaaagcagc

SEQ ID NO: 3991956 - RNA, 20 nt, Human herpesvirus 6B
cuuuacauaacauagaaaaa

SEQ ID NO: 3991957 - RNA, 20 nt, Human herpesvirus 6B
cuuuagauggaaaacugcag

SEQ ID NO: 3991958 - RNA, 19 nt, Human herpesvirus 6B
cuuuccauugcucuuucca

SEQ ID NO: 3991959 - RNA, 19 nt, Human herpesvirus 6B
cuuuccgcccuccguuuca

SEQ ID NO: 3991960 - RNA, 15 nt, Human herpesvirus 6B
cuuugaacagugaca

SEQ ID NO: 3991961 - RNA, 19 nt, Human herpesvirus 6B
cuuugacauuuaccagaga

SEQ ID NO: 3991962 - RNA, 14 nt, Human herpesvirus 6B
cuuuggaaaguuuu

SEQ ID NO: 3991963 - RNA, 24 nt, Human herpesvirus 6B
cuuuuauagauuguuacuuucaua

SEQ ID NO: 3991964 - RNA, 23 nt, Human herpesvirus 6B
cuuuucaguauagacauuuugug

SEQ ID NO: 3991965 - RNA, 23 nt, Human herpesvirus 6B
cuuuugcaaagcuuugcacggcg

SEQ ID NO: 3991966 - RNA, 17 nt, Human herpesvirus 6B
cuuuuugaugacuuaua

SEQ ID NO: 3991967 - RNA, 23 nt, Human herpesvirus 6B
gaaaacacccugauggauuacaa

SEQ ID NO: 3991968 - RNA, 20 nt, Human herpesvirus 6B
gaaaaggugaucguggacag

SEQ ID NO: 3991969 - RNA, 14 nt, Human herpesvirus 6B
gaaaagugcuuuau

SEQ ID NO: 3991970 - RNA, 22 nt, Human herpesvirus 6B
gaaaauaaaguugaauugauag

SEQ ID NO: 3991971 - RNA, 19 nt, Human herpesvirus 6B
gaaaauacgucagcucuuc

SEQ ID NO: 3991972 - RNA, 21 nt, Human herpesvirus 6B
gaaaauuguuuuugauaugau

SEQ ID NO: 3991973 - RNA, 16 nt, Human herpesvirus 6B
gaaacauaaacgcaaa

SEQ ID NO: 3991974 - RNA, 14 nt, Human herpesvirus 6B
gaaagaaccaguga

SEQ ID NO: 3991975 - RNA, 16 nt, Human herpesvirus 6B
gaaagaggggaauuug

SEQ ID NO: 3991976 - RNA, 13 nt, Human herpesvirus 6B
gaaagcacagaaa

SEQ ID NO: 3991977 - RNA, 15 nt, Human herpesvirus 6B
gaaagcgcgccacau

SEQ ID NO: 3991978 - RNA, 16 nt, Human herpesvirus 6B
gaaaggcggagacaca

SEQ ID NO: 3991979 - RNA, 16 nt, Human herpesvirus 6B
gaaauaccaaagaaau

SEQ ID NO: 3991980 - RNA, 17 nt, Human herpesvirus 6B
gaaauauccguuuaguu

SEQ ID NO: 3991981 - RNA, 16 nt, Human herpesvirus 6B
gaaaucuuuccugcua

SEQ ID NO: 3991982 - RNA, 19 nt, Human herpesvirus 6B
gaaauguugccuuuguaaa

SEQ ID NO: 3991983 - RNA, 17 nt, Human herpesvirus 6B
gaacaaaguaauaugau

SEQ ID NO: 3991984 - RNA, 19 nt, Human herpesvirus 6B
gaacagagacccuccuggc

SEQ ID NO: 3991985 - RNA, 14 nt, Human herpesvirus 6B
gagggaaugaugaa

SEQ ID NO: 3991986 - RNA, 16 nt, Human herpesvirus 6B
gagguagcaacuugcu

SEQ ID NO: 3991987 - RNA, 17 nt, Human herpesvirus 6B
gaggugauuugaacaga

SEQ ID NO: 3991988 - RNA, 20 nt, Human herpesvirus 6B
gaguaccgaauaaaacaagu

SEQ ID NO: 3991989 - RNA, 18 nt, Human herpesvirus 6B
gaguauucgugugugaaa

SEQ ID NO: 3991990 - RNA, 21 nt, Human herpesvirus 6B
gagugaauugugcaagcugua

SEQ ID NO: 3991991 - RNA, 16 nt, Human herpesvirus 6B
gagugcgacaggagau

SEQ ID NO: 3991992 - RNA, 23 nt, Human herpesvirus 6B
gagugguuuuuuggauaagcaga

SEQ ID NO: 3991993 - RNA, 11 nt, Human herpesvirus 6B
gauaaacugua

SEQ ID NO: 3991994 - RNA, 22 nt, Human herpesvirus 6B
gauaacucagauucgcaagacu

SEQ ID NO: 3991995 - RNA, 20 nt, Human herpesvirus 6B
gauaagaauuuccaggguga

SEQ ID NO: 3991996 - RNA, 20 nt, Human herpesvirus 6B
gauacuacguguaauguuuc

SEQ ID NO: 3991997 - RNA, 19 nt, Human herpesvirus 6B
gauagaggaauugcuuugu

SEQ ID NO: 3991998 - RNA, 18 nt, Human herpesvirus 6B
gauaugggaaaagggagu

SEQ ID NO: 3991999 - RNA, 21 nt, Human herpesvirus 6B
gauaugucguuucaugggaga

SEQ ID NO: 3992000 - RNA, 20 nt, Human herpesvirus 6B
gaucaaucuccaaaacacuc

SEQ ID NO: 3992001 - RNA, 13 nt, Human herpesvirus 6B
gaucacgcaggcc

SEQ ID NO: 3992002 - RNA, 20 nt, Human herpesvirus 6B
gaucagguauagagguuaua

SEQ ID NO: 3992003 - RNA, 15 nt, Human herpesvirus 6B
gauccauuuucugaa

SEQ ID NO: 3992004 - RNA, 20 nt, Human herpesvirus 6B
gaucccaaacaaacguguau

SEQ ID NO: 3992005 - RNA, 15 nt, Human herpesvirus 6B
gauccgucaggacca

SEQ ID NO: 3992006 - RNA, 16 nt, Human herpesvirus 6B
gauccgucaggaccag

SEQ ID NO: 3992007 - RNA, 22 nt, Human herpesvirus 6B
gauccuguaauaguauugucug

SEQ ID NO: 3992008 - RNA, 14 nt, Human herpesvirus 6B
gaucugauuuugau

SEQ ID NO: 3992009 - RNA, 15 nt, Human herpesvirus 6B
gaucuuauaaaugug

SEQ ID NO: 3992010 - RNA, 18 nt, Human herpesvirus 6B
gaucuucuucagaaagau

SEQ ID NO: 3992011 - RNA, 17 nt, Human herpesvirus 6B
gaugaaaguuuuggaaa

SEQ ID NO: 3992012 - RNA, 15 nt, Human herpesvirus 6B
gaugacuuuucugau

SEQ ID NO: 3992013 - RNA, 19 nt, Human herpesvirus 6B
gaugagcuucaauuguuuu

SEQ ID NO: 3992014 - RNA, 15 nt, Human herpesvirus 6B
gaugaggaggaggga

SEQ ID NO: 3992015 - RNA, 12 nt, Human herpesvirus 6B
gaugccaaagcu

SEQ ID NO: 3992016 - RNA, 18 nt, Human herpesvirus 6B
gaugcgccacagggaggu

SEQ ID NO: 3992017 - RNA, 17 nt, Human herpesvirus 6B
gaugucgcgaagcucag

SEQ ID NO: 3992018 - RNA, 15 nt, Human herpesvirus 6B
gaugucgggccacau

SEQ ID NO: 3992019 - RNA, 19 nt, Human herpesvirus 6B
gauguugucuucugugcuu

SEQ ID NO: 3992020 - RNA, 13 nt, Human herpesvirus 6B
gauuaauuaucau

SEQ ID NO: 3992021 - RNA, 16 nt, Human herpesvirus 6B
gauucuguugggugau

SEQ ID NO: 3992022 - RNA, 14 nt, Human herpesvirus 6B
gauugggaugucag

SEQ ID NO: 3992023 - RNA, 21 nt, Human herpesvirus 6B
gauugucauucugcauuuaua

SEQ ID NO: 3992024 - RNA, 13 nt, Human herpesvirus 6B
gauuuagugcagu

SEQ ID NO: 3992025 - RNA, 20 nt, Human herpesvirus 6B
gauuuuucugccuauuucuc

SEQ ID NO: 3992026 - RNA, 14 nt, Human herpesvirus 6B
gcaaagggaagcca

SEQ ID NO: 3992027 - RNA, 16 nt, Human herpesvirus 6B
gcaacggcacgagagc

SEQ ID NO: 3992028 - RNA, 21 nt, Human herpesvirus 6B
gcaagaaagcguguucaaaaa

SEQ ID NO: 3992029 - RNA, 23 nt, Human herpesvirus 6B
gcaagauuuuagauuuaugaggc

SEQ ID NO: 3992030 - RNA, 20 nt, Human herpesvirus 6B
gcaagucgcgaagugcuucu

SEQ ID NO: 3992031 - RNA, 21 nt, Human herpesvirus 6B
gcaaguuuucagcaagagaga

SEQ ID NO: 3992032 - RNA, 18 nt, Human herpesvirus 6B
gcaaucgucuuugauuua

SEQ ID NO: 3992033 - RNA, 18 nt, Human herpesvirus 6B
gcaauuuaaacagaaauu

SEQ ID NO: 3992034 - RNA, 20 nt, Human herpesvirus 6B
gcacaguucguccagcagcg

SEQ ID NO: 3992035 - RNA, 22 nt, Human herpesvirus 6B
gcacccguauccgcgagacagc

SEQ ID NO: 3992036 - RNA, 19 nt, Human herpesvirus 6B
gcaccgccuccgccaccac

SEQ ID NO: 3992037 - RNA, 20 nt, Human herpesvirus 6B
gcaccggcgacacgcgcgga

SEQ ID NO: 3992038 - RNA, 16 nt, Human herpesvirus 6B
gcacgucacgggcagc

SEQ ID NO: 3992039 - RNA, 22 nt, Human herpesvirus 6B
gcacuuguagagacgaaagcag

SEQ ID NO: 3992040 - RNA, 22 nt, Human herpesvirus 6B
gcagaaaacgauuauugcuaca

SEQ ID NO: 3992041 - RNA, 14 nt, Human herpesvirus 6B
gcagaggccagacu

SEQ ID NO: 3992042 - RNA, 22 nt, Human herpesvirus 6B
gcagaucuugaaaagccccugc

SEQ ID NO: 3992043 - RNA, 18 nt, Human herpesvirus 6B
gcagauuuacgacacgcu

SEQ ID NO: 3992044 - RNA, 15 nt, Human herpesvirus 6B
gcagauuuuaaugau

SEQ ID NO: 3992045 - RNA, 14 nt, Human herpesvirus 6B
gcagcagcagcucc

SEQ ID NO: 3992046 - RNA, 19 nt, Human herpesvirus 6B
gcaggggccguacgcgcca

SEQ ID NO: 3992047 - RNA, 14 nt, Human herpesvirus 6B
gcaguaucaaucac

SEQ ID NO: 3992048 - RNA, 19 nt, Human herpesvirus 6B
agaaagaacuuuuggaugu

SEQ ID NO: 3992049 - RNA, 16 nt, Human herpesvirus 6B
agaaagcguguucaaa

SEQ ID NO: 3992050 - RNA, 16 nt, Human herpesvirus 6B
agaaauucuccuguag

SEQ ID NO: 3992051 - RNA, 15 nt, Human herpesvirus 6B
agaauacgaagacaa

SEQ ID NO: 3992052 - RNA, 21 nt, Human herpesvirus 6B
agaauagagauaaauguauaa

SEQ ID NO: 3992053 - RNA, 19 nt, Human herpesvirus 6B
agaaucaagaaacacuucu

SEQ ID NO: 3992054 - RNA, 12 nt, Human herpesvirus 6B
agaaucuccaaa

SEQ ID NO: 3992055 - RNA, 23 nt, Human herpesvirus 6B
agaauuccaaggcucuggcaaag

SEQ ID NO: 3992056 - RNA, 23 nt, Human herpesvirus 6B
agaauuuccagggugaagacaga

SEQ ID NO: 3992057 - RNA, 15 nt, Human herpesvirus 6B
agaauuugcaguuug

SEQ ID NO: 3992058 - RNA, 18 nt, Human herpesvirus 6B
agacacggcgaaagccag

SEQ ID NO: 3992059 - RNA, 15 nt, Human herpesvirus 6B
agacagauugaucau

SEQ ID NO: 3992060 - RNA, 16 nt, Human herpesvirus 6B
agacaguuuacuaaaa

SEQ ID NO: 3992061 - RNA, 22 nt, Human herpesvirus 6B
agacaugagcgagaauguugaa

SEQ ID NO: 3992062 - RNA, 17 nt, Human herpesvirus 6B
agacauucaacauuccc

SEQ ID NO: 3992063 - RNA, 22 nt, Human herpesvirus 6B
agacguuucuauggauaugagu

SEQ ID NO: 3992064 - RNA, 17 nt, Human herpesvirus 6B
agacuggacaguguuuu

SEQ ID NO: 3992065 - RNA, 20 nt, Human herpesvirus 6B
agagaaguggaacugcuugg

SEQ ID NO: 3992066 - RNA, 16 nt, Human herpesvirus 6B
agagauuuuggaagca

SEQ ID NO: 3992067 - RNA, 11 nt, Human herpesvirus 6B
agagcauugag

SEQ ID NO: 3992068 - RNA, 15 nt, Human herpesvirus 6B
agagcggagaggcgc

SEQ ID NO: 3992069 - RNA, 18 nt, Human herpesvirus 6B
agaggaagggauggcaga

SEQ ID NO: 3992070 - RNA, 16 nt, Human herpesvirus 6B
agaggcgcgggacagc

SEQ ID NO: 3992071 - RNA, 20 nt, Human herpesvirus 6B
agagggagaaacggacacgc

SEQ ID NO: 3992072 - RNA, 23 nt, Human herpesvirus 6B
agaggguuccuccgcgggaccug

SEQ ID NO: 3992073 - RNA, 19 nt, Human herpesvirus 6B
agaguauuuuaaagauuuu

SEQ ID NO: 3992074 - RNA, 14 nt, Human herpesvirus 6B
agaguuugaauuac

SEQ ID NO: 3992075 - RNA, 14 nt, Human herpesvirus 6B
agauaauuacagau

SEQ ID NO: 3992076 - RNA, 14 nt, Human herpesvirus 6B
agauagaaaauugu

SEQ ID NO: 3992077 - RNA, 20 nt, Human herpesvirus 6B
agaucacaacaaacauguau

SEQ ID NO: 3992078 - RNA, 13 nt, Human herpesvirus 6B
agaucacucagau

SEQ ID NO: 3992079 - RNA, 13 nt, Human herpesvirus 6B
agauccaauggau

SEQ ID NO: 3992080 - RNA, 16 nt, Human herpesvirus 6B
agaucgcuuuucugga

SEQ ID NO: 3992081 - RNA, 14 nt, Human herpesvirus 6B
agaucuaaugaaug

SEQ ID NO: 3992082 - RNA, 20 nt, Human herpesvirus 6B
agaucuucuucagaaagauu

SEQ ID NO: 3992083 - RNA, 16 nt, Human herpesvirus 6B
agaucuugaaaagccc

SEQ ID NO: 3992084 - RNA, 15 nt, Human herpesvirus 6B
agaucuuucuagaca

SEQ ID NO: 3992085 - RNA, 12 nt, Human herpesvirus 6B
agaugaggagga

SEQ ID NO: 3992086 - RNA, 15 nt, Human herpesvirus 6B
agaugcaaaacuguu

SEQ ID NO: 3992087 - RNA, 18 nt, Human herpesvirus 6B
agaugcaaccgaugacaa

SEQ ID NO: 3992088 - RNA, 18 nt, Human herpesvirus 6B
agaugcauuguugaaaug

SEQ ID NO: 3992089 - RNA, 21 nt, Human herpesvirus 6B
agaugcugaauaauuacaaag

SEQ ID NO: 3992090 - RNA, 13 nt, Human herpesvirus 6B
agauuacauguau

SEQ ID NO: 3992091 - RNA, 21 nt, Human herpesvirus 6B
agauuauggcaacauacccuu

SEQ ID NO: 3992092 - RNA, 20 nt, Human herpesvirus 6B
agauucgggaugugcggaga

SEQ ID NO: 3992093 - RNA, 22 nt, Human herpesvirus 6B
agauugauuccagguggugguu

SEQ ID NO: 3992094 - RNA, 14 nt, Human herpesvirus 6B
agauuuaaaaauga

SEQ ID NO: 3992095 - RNA, 20 nt, Human herpesvirus 6B
agcaauuucggcaagaaagc

SEQ ID NO: 3992096 - RNA, 19 nt, Human herpesvirus 6B
agcagaugcuuaccggugu

SEQ ID NO: 3992097 - RNA, 21 nt, Human herpesvirus 6B
agcauccuguuuucccaccua

SEQ ID NO: 3992098 - RNA, 20 nt, Human herpesvirus 6B
agcaugggugaguguauuau

SEQ ID NO: 3992099 - RNA, 17 nt, Human herpesvirus 6B
agcauuauaaaacgcuu

SEQ ID NO: 3992100 - RNA, 14 nt, Human herpesvirus 6B
agcauuaugauggc

SEQ ID NO: 3992101 - RNA, 18 nt, Human herpesvirus 6B
agccuaaacggagacugc

SEQ ID NO: 3992102 - RNA, 13 nt, Human herpesvirus 6B
agccucuugugca

SEQ ID NO: 3992103 - RNA, 17 nt, Human herpesvirus 6B
agccugaaggcuacuau

SEQ ID NO: 3992104 - RNA, 20 nt, Human herpesvirus 6B
agcgaucauaaaacugccaa

SEQ ID NO: 3992105 - RNA, 23 nt, Human herpesvirus 6B
agcgcacuauauacuauagaagc

SEQ ID NO: 3992106 - RNA, 20 nt, Human herpesvirus 6B
agcgcccgaugccaacgcga

SEQ ID NO: 3992107 - RNA, 15 nt, Human herpesvirus 6B
agcguguucagcauc

SEQ ID NO: 3992108 - RNA, 18 nt, Human herpesvirus 6B
agcuaaaauugcuacuaa

SEQ ID NO: 3992109 - RNA, 22 nt, Human herpesvirus 6B
agcucaagaggguuuuuuacaa

SEQ ID NO: 3992110 - RNA, 23 nt, Human herpesvirus 6B
agcuccauguucuauuuuagaga

SEQ ID NO: 3992111 - RNA, 17 nt, Human herpesvirus 6B
agcugacaucugcaaaa

SEQ ID NO: 3992112 - RNA, 18 nt, Human herpesvirus 6B
agcugaugauuugaaaug

SEQ ID NO: 3992113 - RNA, 16 nt, Human herpesvirus 6B
agcuguucgguuuaau

SEQ ID NO: 3992114 - RNA, 14 nt, Human herpesvirus 6B
aggaacaaaaggaa

SEQ ID NO: 3992115 - RNA, 16 nt, Human herpesvirus 6B
aggacggggccucccu

SEQ ID NO: 3992116 - RNA, 22 nt, Human herpesvirus 6B
aggagaauuugcaguuugugaa

SEQ ID NO: 3992117 - RNA, 13 nt, Human herpesvirus 6B
aggauuuguaaaa

SEQ ID NO: 3992118 - RNA, 15 nt, Human herpesvirus 6B
aggcaaaguauucuu

SEQ ID NO: 3992119 - RNA, 19 nt, Human herpesvirus 6B
aggcaacggcacgagagcc

SEQ ID NO: 3992120 - RNA, 13 nt, Human herpesvirus 6B
aggcggacagcgu

SEQ ID NO: 3992121 - RNA, 18 nt, Human herpesvirus 6B
aggcggacagcgugauga

SEQ ID NO: 3992122 - RNA, 17 nt, Human herpesvirus 6B
aggcggcgaccacagcg

SEQ ID NO: 3992123 - RNA, 19 nt, Human herpesvirus 6B
aggcuaucacuuagacacg

SEQ ID NO: 3992124 - RNA, 20 nt, Human herpesvirus 6B
agggaggagagggagaaacg

SEQ ID NO: 3992125 - RNA, 22 nt, Human herpesvirus 6B
agggcauagaaagcggccaggc

SEQ ID NO: 3992126 - RNA, 15 nt, Human herpesvirus 6B
agggucgaacccuga

SEQ ID NO: 3992127 - RNA, 14 nt, Human herpesvirus 6B
agguggaaacuguu

SEQ ID NO: 3992128 - RNA, 19 nt, Human herpesvirus 6B
agguguuguguuugaaacg

SEQ ID NO: 3992129 - RNA, 15 nt, Human herpesvirus 6B
agguguuugcagaua

SEQ ID NO: 3992130 - RNA, 20 nt, Human herpesvirus 6B
agguuggcgcagagaaagga

SEQ ID NO: 3992131 - RNA, 16 nt, Human herpesvirus 6B
agguuucucucucacc

SEQ ID NO: 3992132 - RNA, 20 nt, Human herpesvirus 6B
aguaagccuauugacaugau

SEQ ID NO: 3992133 - RNA, 21 nt, Human herpesvirus 6B
aguaccucuaugauacuuuga

SEQ ID NO: 3992134 - RNA, 14 nt, Human herpesvirus 6B
aguauaaauucuuu

SEQ ID NO: 3992135 - RNA, 12 nt, Human herpesvirus 6B
aguauggaaacg

SEQ ID NO: 3992136 - RNA, 19 nt, Human herpesvirus 6B
aguaugucucgaaaaagac

SEQ ID NO: 3992137 - RNA, 17 nt, Human herpesvirus 6B
aguauuacgaauaccua

SEQ ID NO: 3992138 - RNA, 21 nt, Human herpesvirus 6B
agucaccgcauaucaccccca

SEQ ID NO: 3992139 - RNA, 19 nt, Human herpesvirus 6B
aguccaaugaauacuucuc

SEQ ID NO: 3992140 - RNA, 23 nt, Human herpesvirus 6B
aguccaaugaauacuucucuuua

SEQ ID NO: 3992141 - RNA, 20 nt, Human herpesvirus 6B
aguccuuaucagucucaaaa

SEQ ID NO: 3992142 - RNA, 18 nt, Human herpesvirus 6B
agucgccucacuguaaaa

SEQ ID NO: 3992143 - RNA, 14 nt, Human herpesvirus 6B
agucgcgaagugcu

SEQ ID NO: 3992144 - RNA, 14 nt, Human herpesvirus 6B
agucggucuguucc

SEQ ID NO: 3992145 - RNA, 18 nt, Human herpesvirus 6B
agucguggcggagcaccc

SEQ ID NO: 3992146 - RNA, 22 nt, Human herpesvirus 6B
agucguuacaguaaaaaagccg

SEQ ID NO: 3992147 - RNA, 22 nt, Human herpesvirus 6B
agucuggccucugcggcucucu

SEQ ID NO: 3992148 - RNA, 14 nt, Human herpesvirus 6B
agugcaagcucuuc

SEQ ID NO: 3992149 - RNA, 16 nt, Human herpesvirus 6B
agugcugugcucuuua

SEQ ID NO: 3992150 - RNA, 13 nt, Human herpesvirus 6B
agugcuucugcuc

SEQ ID NO: 3992151 - RNA, 21 nt, Human herpesvirus 6B
aguggcgcgcguuuuugguga

SEQ ID NO: 3992152 - RNA, 23 nt, Human herpesvirus 6B
aguggcuugcugucgcccgccuc

SEQ ID NO: 3992153 - RNA, 17 nt, Human herpesvirus 6B
aguguuaaagaugcuga

SEQ ID NO: 3992154 - RNA, 17 nt, Human herpesvirus 6B
aguugcacauguuucug

SEQ ID NO: 3992155 - RNA, 13 nt, Human herpesvirus 6B
aguuucauccuga

SEQ ID NO: 3992156 - RNA, 19 nt, Human herpesvirus 6B
aguuuugcagcaucgccuu

SEQ ID NO: 3992157 - RNA, 15 nt, Human herpesvirus 6B
aguuuuggaaaaugu

SEQ ID NO: 3992158 - RNA, 16 nt, Human herpesvirus 6B
aguuuugugauccugu

SEQ ID NO: 3992159 - RNA, 16 nt, Human herpesvirus 6B
aguuuuuuucugauga

SEQ ID NO: 3992160 - RNA, 14 nt, Human herpesvirus 6B
auaaagaagaucac

SEQ ID NO: 3992161 - RNA, 13 nt, Human herpesvirus 6B
auuucgguuuaau

SEQ ID NO: 3992162 - RNA, 19 nt, Human herpesvirus 6B
auuucguauguuuaacuaa

SEQ ID NO: 3992163 - RNA, 22 nt, Human herpesvirus 6B
auuucguguaucggcagugcaa

SEQ ID NO: 3992164 - RNA, 23 nt, Human herpesvirus 6B
auuucuagcgaucauaaaacugc

SEQ ID NO: 3992165 - RNA, 15 nt, Human herpesvirus 6B
auuucuaucuacaaa

SEQ ID NO: 3992166 - RNA, 14 nt, Human herpesvirus 6B
auuucuuguagcuu

SEQ ID NO: 3992167 - RNA, 20 nt, Human herpesvirus 6B
auuugaaauguucguucucu

SEQ ID NO: 3992168 - RNA, 14 nt, Human herpesvirus 6B
auuugaacagagau

SEQ ID NO: 3992169 - RNA, 15 nt, Human herpesvirus 6B
auuugaacagagauu

SEQ ID NO: 3992170 - RNA, 19 nt, Human herpesvirus 6B
auuugacaauaaacaugau

SEQ ID NO: 3992171 - RNA, 17 nt, Human herpesvirus 6B
auuugguggaugucaag

SEQ ID NO: 3992172 - RNA, 14 nt, Human herpesvirus 6B
auuugugcaaaaug

SEQ ID NO: 3992173 - RNA, 10 nt, Human herpesvirus 6B
auuuuacugg

SEQ ID NO: 3992174 - RNA, 20 nt, Human herpesvirus 6B
auuuuaguauuuaugcuuca

SEQ ID NO: 3992175 - RNA, 14 nt, Human herpesvirus 6B
auuuuauuuugugg

SEQ ID NO: 3992176 - RNA, 11 nt, Human herpesvirus 6B
auuuucuguau

SEQ ID NO: 3992177 - RNA, 20 nt, Human herpesvirus 6B
auuuugacaccucauaucaa

SEQ ID NO: 3992178 - RNA, 23 nt, Human herpesvirus 6B
auuuugcgucgucugugcaaagc

SEQ ID NO: 3992179 - RNA, 15 nt, Human herpesvirus 6B
auuuuuaaggauuga

SEQ ID NO: 3992180 - RNA, 19 nt, Human herpesvirus 6B
caaaaaaaaaugacugaua

SEQ ID NO: 3992181 - RNA, 15 nt, Human herpesvirus 6B
caaaaaaauauugga

SEQ ID NO: 3992182 - RNA, 16 nt, Human herpesvirus 6B
caaaaaaauauuggau

SEQ ID NO: 3992183 - RNA, 15 nt, Human herpesvirus 6B
caaaaaauguuaaaa

SEQ ID NO: 3992184 - RNA, 13 nt, Human herpesvirus 6B
caaacaguuucag

SEQ ID NO: 3992185 - RNA, 17 nt, Human herpesvirus 6B
caaagggaagccagccg

SEQ ID NO: 3992186 - RNA, 15 nt, Human herpesvirus 6B
caaaugagggagaug

SEQ ID NO: 3992187 - RNA, 15 nt, Human herpesvirus 6B
caacgcauagaagcc

SEQ ID NO: 3992188 - RNA, 12 nt, Human herpesvirus 6B
caacggagaaaa

SEQ ID NO: 3992189 - RNA, 23 nt, Human herpesvirus 6B
caacgugugaaaacuaguaaaaa

SEQ ID NO: 3992190 - RNA, 13 nt, Human herpesvirus 6B
caacuugcugucg

SEQ ID NO: 3992191 - RNA, 18 nt, Human herpesvirus 6B
caacuugugccaaucagu

SEQ ID NO: 3992192 - RNA, 18 nt, Human herpesvirus 6B
caagaaaagaaaaaacag

SEQ ID NO: 3992193 - RNA, 16 nt, Human herpesvirus 6B
caagggaaauccuaua

SEQ ID NO: 3992194 - RNA, 19 nt, Human herpesvirus 6B
caaggguaacgcaggagaa

SEQ ID NO: 3992195 - RNA, 18 nt, Human herpesvirus 6B
caaggguaccaaauguuc

SEQ ID NO: 3992196 - RNA, 16 nt, Human herpesvirus 6B
caagucuagacaugau

SEQ ID NO: 3992197 - RNA, 18 nt, Human herpesvirus 6B
caaguugcggaagggcuc

SEQ ID NO: 3992198 - RNA, 14 nt, Human herpesvirus 6B
caaguuuuuaugca

SEQ ID NO: 3992199 - RNA, 21 nt, Human herpesvirus 6B
caauaacucuuggauugcaga

SEQ ID NO: 3992200 - RNA, 17 nt, Human herpesvirus 6B
caauaccaaaaaauguu

SEQ ID NO: 3992201 - RNA, 16 nt, Human herpesvirus 6B
caauagcuaauuugca

SEQ ID NO: 3992202 - RNA, 16 nt, Human herpesvirus 6B
caauccaauaauugau

SEQ ID NO: 3992203 - RNA, 17 nt, Human herpesvirus 6B
caaugaguuuuuugcaa

SEQ ID NO: 3992204 - RNA, 19 nt, Human herpesvirus 6B
caaugauacuacguguaau

SEQ ID NO: 3992205 - RNA, 16 nt, Human herpesvirus 6B
caauguucuugacaaa

SEQ ID NO: 3992206 - RNA, 19 nt, Human herpesvirus 6B
caauuggcgauuuggguua

SEQ ID NO: 3992207 - RNA, 18 nt, Human herpesvirus 6B
caauuucccaguuaauuu

SEQ ID NO: 3992208 - RNA, 15 nt, Human herpesvirus 6B
caauuuugauuuaaa

SEQ ID NO: 3992209 - RNA, 13 nt, Human herpesvirus 6B
cacaaaaacaggg

SEQ ID NO: 3992210 - RNA, 17 nt, Human herpesvirus 6B
cacaaagugcuguaaac

SEQ ID NO: 3992211 - RNA, 12 nt, Human herpesvirus 6B
cacaccaccgca

SEQ ID NO: 3992212 - RNA, 13 nt, Human herpesvirus 6B
cacacgacaaaua

SEQ ID NO: 3992213 - RNA, 13 nt, Human herpesvirus 6B
cacauagagaaga

SEQ ID NO: 3992214 - RNA, 16 nt, Human herpesvirus 6B
caccagauaggaaaag

SEQ ID NO: 3992215 - RNA, 18 nt, Human herpesvirus 6B
cacccauauacccucgcc

SEQ ID NO: 3992216 - RNA, 16 nt, Human herpesvirus 6B
cacccccauacacacc

SEQ ID NO: 3992217 - RNA, 14 nt, Human herpesvirus 6B
caccccccucuugc

SEQ ID NO: 3992218 - RNA, 18 nt, Human herpesvirus 6B
caccccccucuugcagug

SEQ ID NO: 3992219 - RNA, 20 nt, Human herpesvirus 6B
cacccgcugucgucugagca

SEQ ID NO: 3992220 - RNA, 22 nt, Human herpesvirus 6B
caccgagggcgggcggacggcu

SEQ ID NO: 3992221 - RNA, 17 nt, Human herpesvirus 6B
cacgagccaaggggacg

SEQ ID NO: 3992222 - RNA, 15 nt, Human herpesvirus 6B
cacgcgcggagcacg

SEQ ID NO: 3992223 - RNA, 14 nt, Human herpesvirus 6B
cacggcgaaagcca

SEQ ID NO: 3992224 - RNA, 16 nt, Human herpesvirus 6B
cacgggccacgagagc

SEQ ID NO: 3992225 - RNA, 14 nt, Human herpesvirus 6B
cacgucguggcaga

SEQ ID NO: 3992226 - RNA, 17 nt, Human herpesvirus 6B
cacgugaaauaaaguuu

SEQ ID NO: 3992227 - RNA, 13 nt, Human herpesvirus 6B
cacuaacaaaaaa

SEQ ID NO: 3992228 - RNA, 22 nt, Human herpesvirus 6B
cacucgggccggucggggaggg

SEQ ID NO: 3992229 - RNA, 14 nt, Human herpesvirus 6B
cacugaaauuuaca

SEQ ID NO: 3992230 - RNA, 14 nt, Human herpesvirus 6B
cacugaaucagaaa

SEQ ID NO: 3992231 - RNA, 16 nt, Human herpesvirus 6B
cacuguaaaagggcuc

SEQ ID NO: 3992232 - RNA, 18 nt, Human herpesvirus 6B
cacugugauaugcaaacu

SEQ ID NO: 3992233 - RNA, 19 nt, Human herpesvirus 6B
cacuuaguugauaugaaug

SEQ ID NO: 3992234 - RNA, 12 nt, Human herpesvirus 6B
cagaaaauguuc

SEQ ID NO: 3992235 - RNA, 16 nt, Human herpesvirus 6B
cagaaaugagcaacau

SEQ ID NO: 3992236 - RNA, 19 nt, Human herpesvirus 6B
cagaaguuauagugaaaaa

SEQ ID NO: 3992237 - RNA, 18 nt, Human herpesvirus 6B
cagacaaauggaaacugg

SEQ ID NO: 3992238 - RNA, 17 nt, Human herpesvirus 6B
cagacgugcggagaugc

SEQ ID NO: 3992239 - RNA, 13 nt, Human herpesvirus 6B
cagagagccgcag

SEQ ID NO: 3992240 - RNA, 14 nt, Human herpesvirus 6B
cagagugucucuca

SEQ ID NO: 3992241 - RNA, 19 nt, Human herpesvirus 6B
cagaucaucgccauaguga

SEQ ID NO: 3992242 - RNA, 21 nt, Human herpesvirus 6B
cagaucaucgccauagugaaa

SEQ ID NO: 3992243 - RNA, 22 nt, Human herpesvirus 6B
cagaucuucgauuacuguaaaa

SEQ ID NO: 3992244 - RNA, 19 nt, Human herpesvirus 6B
cagaucuugaaaagccccu

SEQ ID NO: 3992245 - RNA, 14 nt, Human herpesvirus 6B
cagaugaggaggag

SEQ ID NO: 3992246 - RNA, 17 nt, Human herpesvirus 6B
cagaugcagucuccaca

SEQ ID NO: 3992247 - RNA, 19 nt, Human herpesvirus 6B
cagaugcagucuccacagg

SEQ ID NO: 3992248 - RNA, 18 nt, Human herpesvirus 6B
cagauuucccaaaacgug

SEQ ID NO: 3992249 - RNA, 13 nt, Human herpesvirus 6B
cagcaaucagcag

SEQ ID NO: 3992250 - RNA, 22 nt, Human herpesvirus 6B
cagcaauuucggcaagaaagcc

SEQ ID NO: 3992251 - RNA, 19 nt, Human herpesvirus 6B
cagcuaagauuaacaacug

SEQ ID NO: 3992252 - RNA, 18 nt, Human herpesvirus 6B
cagcuauacuacgagaaa

SEQ ID NO: 3992253 - RNA, 24 nt, Human herpesvirus 6B
caggaaauuaauaagauagauauu

SEQ ID NO: 3992254 - RNA, 16 nt, Human herpesvirus 6B
caggaaguucuucaaa

SEQ ID NO: 3992255 - RNA, 22 nt, Human herpesvirus 6B
caggagaaacuuguaaggcuua

SEQ ID NO: 3992256 - RNA, 14 nt, Human herpesvirus 6B
caggauuuguaaaa

SEQ ID NO: 3992257 - RNA, 17 nt, Human herpesvirus 6B
cagggcauagaaagcgg

SEQ ID NO: 3992258 - RNA, 22 nt, Human herpesvirus 6B
caggggccguacgcgccacagc

SEQ ID NO: 3992259 - RNA, 17 nt, Human herpesvirus 6B
caggucaagcgccagga

SEQ ID NO: 3992260 - RNA, 15 nt, Human herpesvirus 6B
caguaaaacauguag

SEQ ID NO: 3992261 - RNA, 15 nt, Human herpesvirus 6B
caguauagacauuuu

SEQ ID NO: 3992262 - RNA, 15 nt, Human herpesvirus 6B
ucuucauccucgaag

SEQ ID NO: 3992263 - RNA, 15 nt, Human herpesvirus 6B
ucuucauucuucgaa

SEQ ID NO: 3992264 - RNA, 23 nt, Human herpesvirus 6B
ucuuccgcggcgcugggcuccuc

SEQ ID NO: 3992265 - RNA, 21 nt, Human herpesvirus 6B
ucuuccggaauuuugagacuu

SEQ ID NO: 3992266 - RNA, 17 nt, Human herpesvirus 6B
ucuucgugcaauaacga

SEQ ID NO: 3992267 - RNA, 19 nt, Human herpesvirus 6B
ucuucuuggagucuggccu

SEQ ID NO: 3992268 - RNA, 17 nt, Human herpesvirus 6B
ucuugcacggaaucucu

SEQ ID NO: 3992269 - RNA, 10 nt, Human herpesvirus 6B
ucuugcagug

SEQ ID NO: 3992270 - RNA, 19 nt, Human herpesvirus 6B
ucuuggauugcagauaaga

SEQ ID NO: 3992271 - RNA, 19 nt, Human herpesvirus 6B
ucuuuaugucugucagaaa

SEQ ID NO: 3992272 - RNA, 22 nt, Human herpesvirus 6B
ucuuuaugucugucagaaauau

SEQ ID NO: 3992273 - RNA, 19 nt, Human herpesvirus 6B
ucuuucaaaaugaccagag

SEQ ID NO: 3992274 - RNA, 19 nt, Human herpesvirus 6B
ucuuuccgaugugucugaa

SEQ ID NO: 3992275 - RNA, 16 nt, Human herpesvirus 6B
ucuuugacuauuucga

SEQ ID NO: 3992276 - RNA, 13 nt, Human herpesvirus 6B
ugaaaaaaaacug

SEQ ID NO: 3992277 - RNA, 12 nt, Human herpesvirus 6B
ugaaaacuagua

SEQ ID NO: 3992278 - RNA, 16 nt, Human herpesvirus 6B
ugaaaagccccugcuu

SEQ ID NO: 3992279 - RNA, 23 nt, Human herpesvirus 6B
ugaaacuaugaggaacugaugag

SEQ ID NO: 3992280 - RNA, 14 nt, Human herpesvirus 6B
ugaaacugaagaaa

SEQ ID NO: 3992281 - RNA, 13 nt, Human herpesvirus 6B
ugaaagcagucag

SEQ ID NO: 3992282 - RNA, 21 nt, Human herpesvirus 6B
ugaaagguguggugaaagaca

SEQ ID NO: 3992283 - RNA, 13 nt, Human herpesvirus 6B
ugaaauacuguga

SEQ ID NO: 3992284 - RNA, 14 nt, Human herpesvirus 6B
ugaaauacugugag

SEQ ID NO: 3992285 - RNA, 18 nt, Human herpesvirus 6B
ugaaauuuucaauucgga

SEQ ID NO: 3992286 - RNA, 11 nt, Human herpesvirus 6B
ugaacagagau

SEQ ID NO: 3992287 - RNA, 15 nt, Human herpesvirus 6B
ugaaggguguuucca

SEQ ID NO: 3992288 - RNA, 13 nt, Human herpesvirus 6B
ugaagucuuuccu

SEQ ID NO: 3992289 - RNA, 21 nt, Human herpesvirus 6B
ugaauacgacuuuggaaaguu

SEQ ID NO: 3992290 - RNA, 12 nt, Human herpesvirus 6B
ugaaugugcuuu

SEQ ID NO: 3992291 - RNA, 14 nt, Human herpesvirus 6B
ugaauucugcucgu

SEQ ID NO: 3992292 - RNA, 16 nt, Human herpesvirus 6B
ugaauugugcaagcug

SEQ ID NO: 3992293 - RNA, 15 nt, Human herpesvirus 6B
ugacaauaaacauga

SEQ ID NO: 3992294 - RNA, 16 nt, Human herpesvirus 6B
ugacaauaaacaugau

SEQ ID NO: 3992295 - RNA, 16 nt, Human herpesvirus 6B
ugacacacagaauaca

SEQ ID NO: 3992296 - RNA, 16 nt, Human herpesvirus 6B
ugacaugauguuuccu

SEQ ID NO: 3992297 - RNA, 22 nt, Human herpesvirus 6B
ugacuacggcgguuaacuguuu

SEQ ID NO: 3992298 - RNA, 20 nt, Human herpesvirus 6B
ugacuauuucuuuaagcaag

SEQ ID NO: 3992299 - RNA, 14 nt, Human herpesvirus 6B
ugacugacaaggua

SEQ ID NO: 3992300 - RNA, 21 nt, Human herpesvirus 6B
ugacuguagaaaacgauuucu

SEQ ID NO: 3992301 - RNA, 13 nt, Human herpesvirus 6B
ugacugugaggug

SEQ ID NO: 3992302 - RNA, 15 nt, Human herpesvirus 6B
ugacugugaggugau

SEQ ID NO: 3992303 - RNA, 13 nt, Human herpesvirus 6B
ugagcaacauuua

SEQ ID NO: 3992304 - RNA, 16 nt, Human herpesvirus 6B
ugaggcggugucuuca

SEQ ID NO: 3992305 - RNA, 21 nt, Human herpesvirus 6B
ugaggugauuugaacagagau

SEQ ID NO: 3992306 - RNA, 15 nt, Human herpesvirus 6B
ugaguuuuuugcaau

SEQ ID NO: 3992307 - RNA, 16 nt, Human herpesvirus 6B
ugauaaaacucaccca

SEQ ID NO: 3992308 - RNA, 15 nt, Human herpesvirus 6B
ugauaaguugucauu

SEQ ID NO: 3992309 - RNA, 18 nt, Human herpesvirus 6B
ugauacgaguaaaauuga

SEQ ID NO: 3992310 - RNA, 14 nt, Human herpesvirus 6B
ugauacuuugaaag

SEQ ID NO: 3992311 - RNA, 13 nt, Human herpesvirus 6B
ugauccagaauua

SEQ ID NO: 3992312 - RNA, 19 nt, Human herpesvirus 6B
ugaugccuugauguuuccu

SEQ ID NO: 3992313 - RNA, 23 nt, Human herpesvirus 6B
ugauuccguugugacagaauuau

SEQ ID NO: 3992314 - RNA, 18 nt, Human herpesvirus 6B
ugauuggaaucacaaaau

SEQ ID NO: 3992315 - RNA, 23 nt, Human herpesvirus 6B
ugcaaaaguaugcuuugaaaucu

SEQ ID NO: 3992316 - RNA, 19 nt, Human herpesvirus 6B
ugcaaaauagguuaaaucu

SEQ ID NO: 3992317 - RNA, 20 nt, Human herpesvirus 6B
ugcaaaaucguguuuucuua

SEQ ID NO: 3992318 - RNA, 16 nt, Human herpesvirus 6B
ugcaagcagaccaguu

SEQ ID NO: 3992319 - RNA, 19 nt, Human herpesvirus 6B
ugcaauuugaauucugcuc

SEQ ID NO: 3992320 - RNA, 15 nt, Human herpesvirus 6B
ugcacgaauaaggag

SEQ ID NO: 3992321 - RNA, 13 nt, Human herpesvirus 6B
ugcagauucuguu

SEQ ID NO: 3992322 - RNA, 13 nt, Human herpesvirus 6B
ugcaugcauugcg

SEQ ID NO: 3992323 - RNA, 14 nt, Human herpesvirus 6B
ugcauuaaggaaaa

SEQ ID NO: 3992324 - RNA, 16 nt, Human herpesvirus 6B
ugcauugcaagauuuu

SEQ ID NO: 3992325 - RNA, 15 nt, Human herpesvirus 6B
ugccagguccaguca

SEQ ID NO: 3992326 - RNA, 18 nt, Human herpesvirus 6B
ugccgcguggaagccgcu

SEQ ID NO: 3992327 - RNA, 11 nt, Human herpesvirus 6B
ugccgugagaa

SEQ ID NO: 3992328 - RNA, 16 nt, Human herpesvirus 6B
ugccuugauguuuccu

SEQ ID NO: 3992329 - RNA, 15 nt, Human herpesvirus 6B
ugccuuuguaaaaug

SEQ ID NO: 3992330 - RNA, 20 nt, Human herpesvirus 6B
ugcgaccucgcucuccugug

SEQ ID NO: 3992331 - RNA, 15 nt, Human herpesvirus 6B
ugcgccacagggagg

SEQ ID NO: 3992332 - RNA, 13 nt, Human herpesvirus 6B
ugcgucuuuugua

SEQ ID NO: 3992333 - RNA, 20 nt, Human herpesvirus 6B
ugcguguaauuguugaaauu

SEQ ID NO: 3992334 - RNA, 12 nt, Human herpesvirus 6B
ugcguguagagu

SEQ ID NO: 3992335 - RNA, 14 nt, Human herpesvirus 6B
ugcuaaaugugaua

SEQ ID NO: 3992336 - RNA, 15 nt, Human herpesvirus 6B
ugcuguaaaccagua

SEQ ID NO: 3992337 - RNA, 17 nt, Human herpesvirus 6B
ugcuguaaaccaguauc

SEQ ID NO: 3992338 - RNA, 19 nt, Human herpesvirus 6B
ugcugucacacucugaacu

SEQ ID NO: 3992339 - RNA, 20 nt, Human herpesvirus 6B
ugcuuaaacugaaucacuua

SEQ ID NO: 3992340 - RNA, 17 nt, Human herpesvirus 6B
ugcuuuggauccuuugu

SEQ ID NO: 3992341 - RNA, 17 nt, Human herpesvirus 6B
uggaaagauuggaaucu

SEQ ID NO: 3992342 - RNA, 23 nt, Human herpesvirus 6B
uggaaguggcguggauaggaacu

SEQ ID NO: 3992343 - RNA, 15 nt, Human herpesvirus 6B
uggagguaaucuaug

SEQ ID NO: 3992344 - RNA, 14 nt, Human herpesvirus 6B
uggauaugagugaa

SEQ ID NO: 3992345 - RNA, 18 nt, Human herpesvirus 6B
uggaucuauguuuuucca

SEQ ID NO: 3992346 - RNA, 18 nt, Human herpesvirus 6B
uggcauucuugcagauuu

SEQ ID NO: 3992347 - RNA, 19 nt, Human herpesvirus 6B
uggccgaguuuagacagag

SEQ ID NO: 3992348 - RNA, 15 nt, Human herpesvirus 6B
uggcgcuuguaggag

SEQ ID NO: 3992349 - RNA, 15 nt, Human herpesvirus 6B
uggcuaauagggaau

SEQ ID NO: 3992350 - RNA, 20 nt, Human herpesvirus 6B
ugggaagauucugcagaaug

SEQ ID NO: 3992351 - RNA, 17 nt, Human herpesvirus 6B
ugggcgcagaaggagaa

SEQ ID NO: 3992352 - RNA, 21 nt, Human herpesvirus 6B
ugggcuccucacccugaaggg

SEQ ID NO: 3992353 - RNA, 11 nt, Human herpesvirus 6B
ugggggauggg

SEQ ID NO: 3992354 - RNA, 13 nt, Human herpesvirus 6B
ugggggauggguu

SEQ ID NO: 3992355 - RNA, 13 nt, Human herpesvirus 6B
uggggucuuuccu

SEQ ID NO: 3992356 - RNA, 13 nt, Human herpesvirus 6B
ugguagcaauaac

SEQ ID NO: 3992357 - RNA, 13 nt, Human herpesvirus 6B
uggugauguguua

SEQ ID NO: 3992358 - RNA, 17 nt, Human herpesvirus 6B
ugguggccgucugucug

SEQ ID NO: 3992359 - RNA, 14 nt, Human herpesvirus 6B
cauauaaacagauu

SEQ ID NO: 3992360 - RNA, 17 nt, Human herpesvirus 6B
cauauacgucuuuguuu

SEQ ID NO: 3992361 - RNA, 22 nt, Human herpesvirus 6B
cauauauugaaauuuguaacaa

SEQ ID NO: 3992362 - RNA, 19 nt, Human herpesvirus 6B
caucgcaagcccggagaac

SEQ ID NO: 3992363 - RNA, 16 nt, Human herpesvirus 6B
caugaaaacauucaga

SEQ ID NO: 3992364 - RNA, 23 nt, Human herpesvirus 6B
caugaauuuauguucagccuugc

SEQ ID NO: 3992365 - RNA, 20 nt, Human herpesvirus 6B
caugacggacuuggaaaagg

SEQ ID NO: 3992366 - RNA, 16 nt, Human herpesvirus 6B
caugcgacagacaguc

SEQ ID NO: 3992367 - RNA, 16 nt, Human herpesvirus 6B
cauggaauucaugccg

SEQ ID NO: 3992368 - RNA, 18 nt, Human herpesvirus 6B
caugugaacaaguggaag

SEQ ID NO: 3992369 - RNA, 16 nt, Human herpesvirus 6B
cauguucgccucuccc

SEQ ID NO: 3992370 - RNA, 11 nt, Human herpesvirus 6B
cauguuuacug

SEQ ID NO: 3992371 - RNA, 18 nt, Human herpesvirus 6B
cauuagcugcuaaaugug

SEQ ID NO: 3992372 - RNA, 16 nt, Human herpesvirus 6B
cauugagguauuggau

SEQ ID NO: 3992373 - RNA, 23 nt, Human herpesvirus 6B
cauuuauuucguauguuuaacua

SEQ ID NO: 3992374 - RNA, 13 nt, Human herpesvirus 6B
cauuucucuacau

SEQ ID NO: 3992375 - RNA, 21 nt, Human herpesvirus 6B
cauuucucuacaugccacaga

SEQ ID NO: 3992376 - RNA, 21 nt, Human herpesvirus 6B
cauuugauguugucuucugug

SEQ ID NO: 3992377 - RNA, 23 nt, Human herpesvirus 6B
cauuugcugacccgauguggaac

SEQ ID NO: 3992378 - RNA, 12 nt, Human herpesvirus 6B
cauuuucugaaa

SEQ ID NO: 3992379 - RNA, 14 nt, Human herpesvirus 6B
cauuuucugaaauc

SEQ ID NO: 3992380 - RNA, 13 nt, Human herpesvirus 6B
ccaaaaaauguua

SEQ ID NO: 3992381 - RNA, 18 nt, Human herpesvirus 6B
ccaaaguaggcacacaug

SEQ ID NO: 3992382 - RNA, 13 nt, Human herpesvirus 6B
ccaacuuaauaaa

SEQ ID NO: 3992383 - RNA, 14 nt, Human herpesvirus 6B
ccaacuuguuuucu

SEQ ID NO: 3992384 - RNA, 19 nt, Human herpesvirus 6B
ccacaucuuuuccugcucu

SEQ ID NO: 3992385 - RNA, 16 nt, Human herpesvirus 6B
ccacgggccacgagag

SEQ ID NO: 3992386 - RNA, 20 nt, Human herpesvirus 6B
ccagaguuaaugcauacaug

SEQ ID NO: 3992387 - RNA, 16 nt, Human herpesvirus 6B
ccagauaggaaaaggu

SEQ ID NO: 3992388 - RNA, 23 nt, Human herpesvirus 6B
ccagcaauuucggcaagaaagcc

SEQ ID NO: 3992389 - RNA, 21 nt, Human herpesvirus 6B
ccagcucuguucucucccacu

SEQ ID NO: 3992390 - RNA, 21 nt, Human herpesvirus 6B
ccauagaguuucgagaaagag

SEQ ID NO: 3992391 - RNA, 18 nt, Human herpesvirus 6B
ccauaggcucggcagggg

SEQ ID NO: 3992392 - RNA, 22 nt, Human herpesvirus 6B
ccaugccauugaauacacgugu

SEQ ID NO: 3992393 - RNA, 13 nt, Human herpesvirus 6B
ccauguucgccuc

SEQ ID NO: 3992394 - RNA, 16 nt, Human herpesvirus 6B
cccacacgcggggauc

SEQ ID NO: 3992395 - RNA, 16 nt, Human herpesvirus 6B
cccacuccaacacggg

SEQ ID NO: 3992396 - RNA, 22 nt, Human herpesvirus 6B
cccagaugcagucuccacaggg

SEQ ID NO: 3992397 - RNA, 23 nt, Human herpesvirus 6B
ccccaggcgcagcagcagcucca

SEQ ID NO: 3992398 - RNA, 17 nt, Human herpesvirus 6B
ccccauacacacccagc

SEQ ID NO: 3992399 - RNA, 19 nt, Human herpesvirus 6B
ccccggagcauacgcgccg

SEQ ID NO: 3992400 - RNA, 14 nt, Human herpesvirus 6B
ccccucuugcagug

SEQ ID NO: 3992401 - RNA, 21 nt, Human herpesvirus 6B
cccgccucucuccgccuccuc

SEQ ID NO: 3992402 - RNA, 20 nt, Human herpesvirus 6B
cccggcuuucucgccgccuc

SEQ ID NO: 3992403 - RNA, 14 nt, Human herpesvirus 6B
cccgggcgcggggc

SEQ ID NO: 3992404 - RNA, 20 nt, Human herpesvirus 6B
cccguccucgugcucuccgc

SEQ ID NO: 3992405 - RNA, 15 nt, Human herpesvirus 6B
cccuccaucccccuc

SEQ ID NO: 3992406 - RNA, 20 nt, Human herpesvirus 6B
cccuccguuaggaucagaca

SEQ ID NO: 3992407 - RNA, 15 nt, Human herpesvirus 6B
cccucgucuguugcu

SEQ ID NO: 3992408 - RNA, 23 nt, Human herpesvirus 6B
cccugagagcaggagcaggcucc

SEQ ID NO: 3992409 - RNA, 14 nt, Human herpesvirus 6B
ccgaaaagaaagaa

SEQ ID NO: 3992410 - RNA, 16 nt, Human herpesvirus 6B
ccgaagaaagaggcgc

SEQ ID NO: 3992411 - RNA, 22 nt, Human herpesvirus 6B
ccgaagaaucugccgaucacca

SEQ ID NO: 3992412 - RNA, 21 nt, Human herpesvirus 6B
ccgagacggugauguugcgau

SEQ ID NO: 3992413 - RNA, 17 nt, Human herpesvirus 6B
ccgaugacuaagaaaaa

SEQ ID NO: 3992414 - RNA, 23 nt, Human herpesvirus 6B
ccgcagaggcggcgaccacagcg

SEQ ID NO: 3992415 - RNA, 19 nt, Human herpesvirus 6B
ccgcagggaaagagcacga

SEQ ID NO: 3992416 - RNA, 14 nt, Human herpesvirus 6B
ccgcaguuccuguu

SEQ ID NO: 3992417 - RNA, 18 nt, Human herpesvirus 6B
ccgcauacacccugccga

SEQ ID NO: 3992418 - RNA, 14 nt, Human herpesvirus 6B
ccgccucucuccgc

SEQ ID NO: 3992419 - RNA, 21 nt, Human herpesvirus 6B
ccgcgaugcgccacagggagg

SEQ ID NO: 3992420 - RNA, 20 nt, Human herpesvirus 6B
ccgcgcugcuggggcucugu

SEQ ID NO: 3992421 - RNA, 13 nt, Human herpesvirus 6B
ccggccaauucau

SEQ ID NO: 3992422 - RNA, 17 nt, Human herpesvirus 6B
ccggcccguccaccguc

SEQ ID NO: 3992423 - RNA, 22 nt, Human herpesvirus 6B
ccggcgacacgcgcggaccacu

SEQ ID NO: 3992424 - RNA, 22 nt, Human herpesvirus 6B
ccgguugucacacgucccuucu

SEQ ID NO: 3992425 - RNA, 15 nt, Human herpesvirus 6B
ccguccucgugcucu

SEQ ID NO: 3992426 - RNA, 22 nt, Human herpesvirus 6B
ccguucccggggggggggggcc

SEQ ID NO: 3992427 - RNA, 15 nt, Human herpesvirus 6B
ccuaaaaucugcuaa

SEQ ID NO: 3992428 - RNA, 15 nt, Human herpesvirus 6B
ccuaaauaccauuuu

SEQ ID NO: 3992429 - RNA, 16 nt, Human herpesvirus 6B
ccuaacagaguuuuca

SEQ ID NO: 3992430 - RNA, 13 nt, Human herpesvirus 6B
ccuagacacacag

SEQ ID NO: 3992431 - RNA, 20 nt, Human herpesvirus 6B
ccuaugaaaguguauuugga

SEQ ID NO: 3992432 - RNA, 16 nt, Human herpesvirus 6B
ccuauguuaacauugu

SEQ ID NO: 3992433 - RNA, 21 nt, Human herpesvirus 6B
ccuauucuaauuauaaaugua

SEQ ID NO: 3992434 - RNA, 21 nt, Human herpesvirus 6B
ccucaaacuuuuagagacuuu

SEQ ID NO: 3992435 - RNA, 19 nt, Human herpesvirus 6B
ccucagaaccaucuuuuca

SEQ ID NO: 3992436 - RNA, 20 nt, Human herpesvirus 6B
ccuccucuuuuccccccgcc

SEQ ID NO: 3992437 - RNA, 16 nt, Human herpesvirus 6B
ccucgaagaauugucu

SEQ ID NO: 3992438 - RNA, 16 nt, Human herpesvirus 6B
ccucgccgcucccgcu

SEQ ID NO: 3992439 - RNA, 13 nt, Human herpesvirus 6B
ccucuauacucug

SEQ ID NO: 3992440 - RNA, 13 nt, Human herpesvirus 6B
ccucuugcagugg

SEQ ID NO: 3992441 - RNA, 13 nt, Human herpesvirus 6B
ccugaaaccccac

SEQ ID NO: 3992442 - RNA, 14 nt, Human herpesvirus 6B
ccugagagcaggag

SEQ ID NO: 3992443 - RNA, 22 nt, Human herpesvirus 6B
ccugcaauuugaauucugcucg

SEQ ID NO: 3992444 - RNA, 16 nt, Human herpesvirus 6B
ccuggaagaaggaaaa

SEQ ID NO: 3992445 - RNA, 10 nt, Human herpesvirus 6B
ccuguuucua

SEQ ID NO: 3992446 - RNA, 19 nt, Human herpesvirus 6B
cgaaaacuagaugacuauu

SEQ ID NO: 3992447 - RNA, 16 nt, Human herpesvirus 6B
cgaaaccaagacuugc

SEQ ID NO: 3992448 - RNA, 16 nt, Human herpesvirus 6B
cgaaauauaaaaccaa

SEQ ID NO: 3992449 - RNA, 18 nt, Human herpesvirus 6B
cgaagcgacgcaagccgu

SEQ ID NO: 3992450 - RNA, 13 nt, Human herpesvirus 6B
cgaauaaggagag

SEQ ID NO: 3992451 - RNA, 15 nt, Human herpesvirus 6B
cgacaaaaaaauaaa

SEQ ID NO: 3992452 - RNA, 13 nt, Human herpesvirus 6B
cgaccaggcacca

SEQ ID NO: 3992453 - RNA, 15 nt, Human herpesvirus 6B
cgaguuuagacagag

SEQ ID NO: 3992454 - RNA, 13 nt, Human herpesvirus 6B
cgaugaaacuguc

SEQ ID NO: 3992455 - RNA, 13 nt, Human herpesvirus 6B
cgauuaaugccac

SEQ ID NO: 3992456 - RNA, 16 nt, Human herpesvirus 6B
cgauucccuccgggac

SEQ ID NO: 3992457 - RNA, 17 nt, Human herpesvirus 6B
cgcagauuuacgacacg

SEQ ID NO: 3992458 - RNA, 14 nt, Human herpesvirus 6B
cgcagcagcagcuc

SEQ ID NO: 3992459 - RNA, 23 nt, Human herpesvirus 6B
cgcauccuuaaaugacacagaau

SEQ ID NO: 3992460 - RNA, 23 nt, Human herpesvirus 6B
cgcauguuuauuucaaugcguuu

SEQ ID NO: 3992461 - RNA, 15 nt, Human herpesvirus 6B
cgccaggacggggcc

SEQ ID NO: 3992462 - RNA, 18 nt, Human herpesvirus 6B
cgccauccacccauauac

SEQ ID NO: 3992463 - RNA, 17 nt, Human herpesvirus 6B
uuuuggaauuucauuca

SEQ ID NO: 3992464 - RNA, 22 nt, Human herpesvirus 6B
uuuugugcuuaucaaauuacaa

SEQ ID NO: 3992465 - RNA, 16 nt, Human herpesvirus 6B
uuuuuaaaaacacacu

SEQ ID NO: 3992466 - RNA, 12 nt, Human herpesvirus 6B
uuuuucuguaag

SEQ ID NO: 3992467 - RNA, 17 nt, Human herpesvirus 6B
gcucgggggacggagag

SEQ ID NO: 3992468 - RNA, 17 nt, Human herpesvirus 6B
gcucuccgcgcugcugg

SEQ ID NO: 3992469 - RNA, 23 nt, Human herpesvirus 6B
gcucuccguuaaagaaacagauc

SEQ ID NO: 3992470 - RNA, 22 nt, Human herpesvirus 6B
gcugacgggggcacaucuguug

SEQ ID NO: 3992471 - RNA, 21 nt, Human herpesvirus 6B
gcugccauuauugauagcauu

SEQ ID NO: 3992472 - RNA, 11 nt, Human herpesvirus 6B
gcuggacagaa

SEQ ID NO: 3992473 - RNA, 10 nt, Human herpesvirus 6B
gcuguaguug

SEQ ID NO: 3992474 - RNA, 22 nt, Human herpesvirus 6B
gcuguaguugaugcuguugcug

SEQ ID NO: 3992475 - RNA, 22 nt, Human herpesvirus 6B
gcuuaaaucaaaaaaaugauag

SEQ ID NO: 3992476 - RNA, 20 nt, Human herpesvirus 6B
gcuuucucgccgccucgccg

SEQ ID NO: 3992477 - RNA, 18 nt, Human herpesvirus 6B
ggaaagauuuuuggauuu

SEQ ID NO: 3992478 - RNA, 22 nt, Human herpesvirus 6B
ggaacccuagacacacagaaaa

SEQ ID NO: 3992479 - RNA, 14 nt, Human herpesvirus 6B
ggaagagaaugaau

SEQ ID NO: 3992480 - RNA, 21 nt, Human herpesvirus 6B
ggaagcauacgucuguggcga

SEQ ID NO: 3992481 - RNA, 13 nt, Human herpesvirus 6B
ggaagggcucugu

SEQ ID NO: 3992482 - RNA, 15 nt, Human herpesvirus 6B
ggaauacaccggaga

SEQ ID NO: 3992483 - RNA, 17 nt, Human herpesvirus 6B
ggacaaaaauucaucag

SEQ ID NO: 3992484 - RNA, 17 nt, Human herpesvirus 6B
ggacaauaaauugauuc

SEQ ID NO: 3992485 - RNA, 21 nt, Human herpesvirus 6B
ggacacgagaagaacaugcag

SEQ ID NO: 3992486 - RNA, 22 nt, Human herpesvirus 6B
ggacccgagguccgacacgccc

SEQ ID NO: 3992487 - RNA, 16 nt, Human herpesvirus 6B
ggacggacagagcgga

SEQ ID NO: 3992488 - RNA, 23 nt, Human herpesvirus 6B
ggacggcguucguucggacucuc

SEQ ID NO: 3992489 - RNA, 12 nt, Human herpesvirus 6B
ggacucugucuu

SEQ ID NO: 3992490 - RNA, 13 nt, Human herpesvirus 6B
ggagaccaugcca

SEQ ID NO: 3992491 - RNA, 16 nt, Human herpesvirus 6B
ggagaggaagccggag

SEQ ID NO: 3992492 - RNA, 17 nt, Human herpesvirus 6B
ggagaggaagccggagc

SEQ ID NO: 3992493 - RNA, 14 nt, Human herpesvirus 6B
ggagcaggcucccc

SEQ ID NO: 3992494 - RNA, 20 nt, Human herpesvirus 6B
ggagcccugagagcaggagc

SEQ ID NO: 3992495 - RNA, 17 nt, Human herpesvirus 6B
ggaggagagggaggaga

SEQ ID NO: 3992496 - RNA, 16 nt, Human herpesvirus 6B
ggaggaggaagaggag

SEQ ID NO: 3992497 - RNA, 14 nt, Human herpesvirus 6B
ggagggcggagaag

SEQ ID NO: 3992498 - RNA, 22 nt, Human herpesvirus 6B
ggagucggucuguuccccgucc

SEQ ID NO: 3992499 - RNA, 14 nt, Human herpesvirus 6B
ggagugcgacagga

SEQ ID NO: 3992500 - RNA, 21 nt, Human herpesvirus 6B
ggagugcguaaucgcaagaaa

SEQ ID NO: 3992501 - RNA, 17 nt, Human herpesvirus 6B
ggaucgacgaccaggca

SEQ ID NO: 3992502 - RNA, 22 nt, Human herpesvirus 6B
ggaucucgacacguccauaggc

SEQ ID NO: 3992503 - RNA, 11 nt, Human herpesvirus 6B
ggaugaagaga

SEQ ID NO: 3992504 - RNA, 18 nt, Human herpesvirus 6B
ggaugcagcguuggaaag

SEQ ID NO: 3992505 - RNA, 17 nt, Human herpesvirus 6B
ggauguaaaugcagaca

SEQ ID NO: 3992506 - RNA, 16 nt, Human herpesvirus 6B
ggcagcggggaaggga

SEQ ID NO: 3992507 - RNA, 19 nt, Human herpesvirus 6B
ggccgaguuggccaagcug

SEQ ID NO: 3992508 - RNA, 17 nt, Human herpesvirus 6B
ggccgucgcgcucgccg

SEQ ID NO: 3992509 - RNA, 18 nt, Human herpesvirus 6B
ggcgcaccacggcucccc

SEQ ID NO: 3992510 - RNA, 13 nt, Human herpesvirus 6B
ggcgcagaaggag

SEQ ID NO: 3992511 - RNA, 12 nt, Human herpesvirus 6B
ggcgcuagugau

SEQ ID NO: 3992512 - RNA, 22 nt, Human herpesvirus 6B
ggcggagcacccggggaggcga

SEQ ID NO: 3992513 - RNA, 15 nt, Human herpesvirus 6B
ggcggccccgcguca

SEQ ID NO: 3992514 - RNA, 14 nt, Human herpesvirus 6B
ggcggcgcgcgccg

SEQ ID NO: 3992515 - RNA, 13 nt, Human herpesvirus 6B
ggcgucgggcgac

SEQ ID NO: 3992516 - RNA, 20 nt, Human herpesvirus 6B
ggcguuaucgacggcagcgg

SEQ ID NO: 3992517 - RNA, 23 nt, Human herpesvirus 6B
ggcuccucacccugaagggaccg

SEQ ID NO: 3992518 - RNA, 16 nt, Human herpesvirus 6B
ggcucucgugccguug

SEQ ID NO: 3992519 - RNA, 15 nt, Human herpesvirus 6B
ggcugggcgcagaag

SEQ ID NO: 3992520 - RNA, 17 nt, Human herpesvirus 6B
ggcuuacugcggagaac

SEQ ID NO: 3992521 - RNA, 13 nt, Human herpesvirus 6B
ggcuuagcuacca

SEQ ID NO: 3992522 - RNA, 14 nt, Human herpesvirus 6B
gggaaaucaaggaa

SEQ ID NO: 3992523 - RNA, 20 nt, Human herpesvirus 6B
gggacuccgagccggacagg

SEQ ID NO: 3992524 - RNA, 21 nt, Human herpesvirus 6B
gggacuccgagccggacagga

SEQ ID NO: 3992525 - RNA, 13 nt, Human herpesvirus 6B
gggaggaggagga

SEQ ID NO: 3992526 - RNA, 13 nt, Human herpesvirus 6B
gggaucgggccug

SEQ ID NO: 3992527 - RNA, 14 nt, Human herpesvirus 6B
gggaucgggccugg

SEQ ID NO: 3992528 - RNA, 20 nt, Human herpesvirus 6B
gggaugugcggagaaaggga

SEQ ID NO: 3992529 - RNA, 14 nt, Human herpesvirus 6B
gggcacggagaaca

SEQ ID NO: 3992530 - RNA, 19 nt, Human herpesvirus 6B
gggcauagaaagcggccag

SEQ ID NO: 3992531 - RNA, 15 nt, Human herpesvirus 6B
gggcauuuuuuugaa

SEQ ID NO: 3992532 - RNA, 16 nt, Human herpesvirus 6B
gggccagcccugaaga

SEQ ID NO: 3992533 - RNA, 16 nt, Human herpesvirus 6B
gggcgacgggcagggc

SEQ ID NO: 3992534 - RNA, 19 nt, Human herpesvirus 6B
gggcgcaccggcgacacgc

SEQ ID NO: 3992535 - RNA, 21 nt, Human herpesvirus 6B
gggcuuaauaaaggauguuug

SEQ ID NO: 3992536 - RNA, 19 nt, Human herpesvirus 6B
ggggaggaggaggaagagg

SEQ ID NO: 3992537 - RNA, 22 nt, Human herpesvirus 6B
gggggcccgggcgcggggcgca

SEQ ID NO: 3992538 - RNA, 11 nt, Human herpesvirus 6B
ggggggggccc

SEQ ID NO: 3992539 - RNA, 13 nt, Human herpesvirus 6B
ggggggggggccc

SEQ ID NO: 3992540 - RNA, 22 nt, Human herpesvirus 6B
gggucuugguuuuauaagcuca

SEQ ID NO: 3992541 - RNA, 14 nt, Human herpesvirus 6B
ggucgccguggccg

SEQ ID NO: 3992542 - RNA, 23 nt, Human herpesvirus 6B
ggucgcguucuaacccaugaaaa

SEQ ID NO: 3992543 - RNA, 15 nt, Human herpesvirus 6B
ggugacuacuguguc

SEQ ID NO: 3992544 - RNA, 13 nt, Human herpesvirus 6B
ggugauuuuccaa

SEQ ID NO: 3992545 - RNA, 15 nt, Human herpesvirus 6B
gguguaccagacaaa

SEQ ID NO: 3992546 - RNA, 19 nt, Human herpesvirus 6B
gguucaaagauagacagug

SEQ ID NO: 3992547 - RNA, 13 nt, Human herpesvirus 6B
gguucgacagaga

SEQ ID NO: 3992548 - RNA, 17 nt, Human herpesvirus 6B
gguuuaccuuuuugcug

SEQ ID NO: 3992549 - RNA, 19 nt, Human herpesvirus 6B
gguuuugucguuuguacau

SEQ ID NO: 3992550 - RNA, 16 nt, Human herpesvirus 6B
guaaauccgaaacaca

SEQ ID NO: 3992551 - RNA, 21 nt, Human herpesvirus 6B
guaaccugagaauuuucgaaa

SEQ ID NO: 3992552 - RNA, 15 nt, Human herpesvirus 6B
guaaccugucuugga

SEQ ID NO: 3992553 - RNA, 19 nt, Human herpesvirus 6B
guaagccuauugacaugau

SEQ ID NO: 3992554 - RNA, 20 nt, Human herpesvirus 6B
guaauuauugugacaaggua

SEQ ID NO: 3992555 - RNA, 17 nt, Human herpesvirus 6B
guacaaagguuuuugcu

SEQ ID NO: 3992556 - RNA, 14 nt, Human herpesvirus 6B
guacauguuaacaa

SEQ ID NO: 3992557 - RNA, 15 nt, Human herpesvirus 6B
guaccgcgguugaag

SEQ ID NO: 3992558 - RNA, 19 nt, Human herpesvirus 6B
guacguggccgucuccugc

SEQ ID NO: 3992559 - RNA, 19 nt, Human herpesvirus 6B
guagaaacguuaauguuua

SEQ ID NO: 3992560 - RNA, 22 nt, Human herpesvirus 6B
guaguggucguuuucgugguug

SEQ ID NO: 3992561 - RNA, 15 nt, Human herpesvirus 6B
guauguuuuguacaa

SEQ ID NO: 3992562 - RNA, 17 nt, Human herpesvirus 6B
guauucuucuuccccaa

SEQ ID NO: 3992563 - RNA, 23 nt, Human herpesvirus 6B
guauuggggaugaagguggaaac

SEQ ID NO: 3992564 - RNA, 11 nt, Human herpesvirus 6B
guauuuccugu

SEQ ID NO: 3992565 - RNA, 16 nt, Human herpesvirus 6B
gucaacgaaaaaauga

SEQ ID NO: 3992566 - RNA, 15 nt, Human herpesvirus 6B
gucaagcgccaggac

SEQ ID NO: 3992567 - RNA, 18 nt, Human herpesvirus 6B
gucacacgucccuucucc

SEQ ID NO: 3992568 - RNA, 17 nt, Human herpesvirus 6B
gucacuuauauaaaaua

SEQ ID NO: 3992569 - RNA, 17 nt, Human herpesvirus 6B
guccaguaagacagcac

SEQ ID NO: 3992570 - RNA, 16 nt, Human herpesvirus 6B
guccccgccgcgcugg

SEQ ID NO: 3992571 - RNA, 22 nt, Human herpesvirus 6B
guccuauguuaacauugugaga

SEQ ID NO: 3992572 - RNA, 21 nt, Human herpesvirus 6B
guccuccgcaaguuuucagca

SEQ ID NO: 3992573 - RNA, 18 nt, Human herpesvirus 6B
guccucguccguccccgc

SEQ ID NO: 3992574 - RNA, 15 nt, Human herpesvirus 6B
gucgcauagaucggg

SEQ ID NO: 3992575 - RNA, 17 nt, Human herpesvirus 6B
gucucauguugauuuua

SEQ ID NO: 3992576 - RNA, 16 nt, Human herpesvirus 6B
gucuccgauccgucag

SEQ ID NO: 3992577 - RNA, 22 nt, Human herpesvirus 6B
acugcggagaacgggcaacucc

SEQ ID NO: 3992578 - RNA, 23 nt, Human herpesvirus 6B
acugcuugguggcggauggcuag

SEQ ID NO: 3992579 - RNA, 16 nt, Human herpesvirus 6B
acuguacacaaaaacc

SEQ ID NO: 3992580 - RNA, 23 nt, Human herpesvirus 6B
acuguucggauccaaugaugaaa

SEQ ID NO: 3992581 - RNA, 14 nt, Human herpesvirus 6B
acuuacaucuuggu

SEQ ID NO: 3992582 - RNA, 22 nt, Human herpesvirus 6B
acuuccucgcgguauaaugcau

SEQ ID NO: 3992583 - RNA, 14 nt, Human herpesvirus 6B
acuugaagagaguu

SEQ ID NO: 3992584 - RNA, 19 nt, Human herpesvirus 6B
acuugcuaacuaucaugug

SEQ ID NO: 3992585 - RNA, 23 nt, Human herpesvirus 6B
acuuucguuuacgaauucaaugu

SEQ ID NO: 3992586 - RNA, 19 nt, Human herpesvirus 6B
acuuucuaagacgagaugu

SEQ ID NO: 3992587 - RNA, 22 nt, Human herpesvirus 6B
acuuuuugccgaagauagcucu

SEQ ID NO: 3992588 - RNA, 23 nt, Human herpesvirus 6B
agaaaaagaacugucgcaucaau

SEQ ID NO: 3992589 - RNA, 16 nt, Human herpesvirus 6B
agaaaacuauauugcc

SEQ ID NO: 3992590 - RNA, 14 nt, Human herpesvirus 6B
agaaaagaaacaau

SEQ ID NO: 3992591 - RNA, 16 nt, Human herpesvirus 6B
agaaaauugacaauga

SEQ ID NO: 3992592 - RNA, 19 nt, Human herpesvirus 6B
agaaacaaaauuaauucaa

SEQ ID NO: 3992593 - RNA, 22 nt, Human herpesvirus 6B
agaaacgcaaagggaagccagc

SEQ ID NO: 3992594 - RNA, 16 nt, Human herpesvirus 6B
agaaacguuaauguuu

SEQ ID NO: 3992595 - RNA, 14 nt, Human herpesvirus 6B
aauuuaaaauaauu

SEQ ID NO: 3992596 - RNA, 22 nt, Human herpesvirus 6B
aauuuaaaguuacaucugucua

SEQ ID NO: 3992597 - RNA, 18 nt, Human herpesvirus 6B
aauuuaugugaauucugu

SEQ ID NO: 3992598 - RNA, 22 nt, Human herpesvirus 6B
aauuuauucacguuuacauaag

SEQ ID NO: 3992599 - RNA, 21 nt, Human herpesvirus 6B
aauuuccggucaacuucuaua

SEQ ID NO: 3992600 - RNA, 22 nt, Human herpesvirus 6B
aauuuguggaacaagagacgaa

SEQ ID NO: 3992601 - RNA, 17 nt, Human herpesvirus 6B
aauuuuaccuauuucua

SEQ ID NO: 3992602 - RNA, 19 nt, Human herpesvirus 6B
aauuuuuuguuucugaaaa

SEQ ID NO: 3992603 - RNA, 21 nt, Human herpesvirus 6B
aauuuuuuucuccugaucuca

SEQ ID NO: 3992604 - RNA, 17 nt, Human herpesvirus 6B
acaaaaaaaaaaaacau

SEQ ID NO: 3992605 - RNA, 14 nt, Human herpesvirus 6B
acaaagccacagcu

SEQ ID NO: 3992606 - RNA, 21 nt, Human herpesvirus 6B
acaaauaaguggugaugaaua

SEQ ID NO: 3992607 - RNA, 14 nt, Human herpesvirus 6B
acaaccaaguguuu

SEQ ID NO: 3992608 - RNA, 18 nt, Human herpesvirus 6B
acaaccuauguacagaua

SEQ ID NO: 3992609 - RNA, 15 nt, Human herpesvirus 6B
acaacgguguggaga

SEQ ID NO: 3992610 - RNA, 21 nt, Human herpesvirus 6B
acaagcaggagaaaaauuuga

SEQ ID NO: 3992611 - RNA, 19 nt, Human herpesvirus 6B
acaagccuuuuuauaugca

SEQ ID NO: 3992612 - RNA, 12 nt, Human herpesvirus 6B
acaauaauuacu

SEQ ID NO: 3992613 - RNA, 14 nt, Human herpesvirus 6B
acaauaauuacucc

SEQ ID NO: 3992614 - RNA, 17 nt, Human herpesvirus 6B
acaauauaugaaauacu

SEQ ID NO: 3992615 - RNA, 15 nt, Human herpesvirus 6B
acacaaaaagacucu

SEQ ID NO: 3992616 - RNA, 17 nt, Human herpesvirus 6B
acacaacuguuaccgaa

SEQ ID NO: 3992617 - RNA, 16 nt, Human herpesvirus 6B
acaccggagaccgagc

SEQ ID NO: 3992618 - RNA, 20 nt, Human herpesvirus 6B
acaccucauaucaaacaacu

SEQ ID NO: 3992619 - RNA, 14 nt, Human herpesvirus 6B
acacgcccccaccu

SEQ ID NO: 3992620 - RNA, 14 nt, Human herpesvirus 6B
acacggcgaaagcc

SEQ ID NO: 3992621 - RNA, 16 nt, Human herpesvirus 6B
acacggggugagagag

SEQ ID NO: 3992622 - RNA, 15 nt, Human herpesvirus 6B
acacgucccuucucc

SEQ ID NO: 3992623 - RNA, 19 nt, Human herpesvirus 6B
acacgucguggcagaacag

SEQ ID NO: 3992624 - RNA, 20 nt, Human herpesvirus 6B
acacucuauuauaaaaaugc

SEQ ID NO: 3992625 - RNA, 17 nt, Human herpesvirus 6B
acagaaaugagcaacau

SEQ ID NO: 3992626 - RNA, 22 nt, Human herpesvirus 6B
acagaacaccugcuuuugguua

SEQ ID NO: 3992627 - RNA, 16 nt, Human herpesvirus 6B
acagaauacaaaaacg

SEQ ID NO: 3992628 - RNA, 18 nt, Human herpesvirus 6B
acagagugcaucuuuaac

SEQ ID NO: 3992629 - RNA, 16 nt, Human herpesvirus 6B
acagauagaucuguuu

SEQ ID NO: 3992630 - RNA, 13 nt, Human herpesvirus 6B
acagcaguuuuuu

SEQ ID NO: 3992631 - RNA, 22 nt, Human herpesvirus 6B
acagcgugaugaggcccagagg

SEQ ID NO: 3992632 - RNA, 14 nt, Human herpesvirus 6B
acaguuugaucccu

SEQ ID NO: 3992633 - RNA, 12 nt, Human herpesvirus 6B
acaguuuugugg

SEQ ID NO: 3992634 - RNA, 13 nt, Human herpesvirus 6B
acauaacauagaa

SEQ ID NO: 3992635 - RNA, 17 nt, Human herpesvirus 6B
acauacaacuuucacug

SEQ ID NO: 3992636 - RNA, 21 nt, Human herpesvirus 6B
acaucaccaugaaagcacaga

SEQ ID NO: 3992637 - RNA, 19 nt, Human herpesvirus 6B
acauccagaaaagcaaaca

SEQ ID NO: 3992638 - RNA, 20 nt, Human herpesvirus 6B
acauccagaaaagcaaacau

SEQ ID NO: 3992639 - RNA, 16 nt, Human herpesvirus 6B
acauguauucuccuca

SEQ ID NO: 3992640 - RNA, 18 nt, Human herpesvirus 6B
acauucguauacuuccuc

SEQ ID NO: 3992641 - RNA, 22 nt, Human herpesvirus 6B
acauucuuguucgggccaaggu

SEQ ID NO: 3992642 - RNA, 18 nt, Human herpesvirus 6B
acauuucgguuuaauaga

SEQ ID NO: 3992643 - RNA, 17 nt, Human herpesvirus 6B
acauuuggcagcgcuug

SEQ ID NO: 3992644 - RNA, 14 nt, Human herpesvirus 6B
accaacugagagac

SEQ ID NO: 3992645 - RNA, 19 nt, Human herpesvirus 6B
accagcucuguucucuccc

SEQ ID NO: 3992646 - RNA, 20 nt, Human herpesvirus 6B
acccaauuuugguacaauuu

SEQ ID NO: 3992647 - RNA, 22 nt, Human herpesvirus 6B
accccuuaugcaacugcauuuu

SEQ ID NO: 3992648 - RNA, 16 nt, Human herpesvirus 6B
acccuagacacacaga

SEQ ID NO: 3992649 - RNA, 12 nt, Human herpesvirus 6B
accgaaaugugc

SEQ ID NO: 3992650 - RNA, 20 nt, Human herpesvirus 6B
accgagagccggaaaacaau

SEQ ID NO: 3992651 - RNA, 19 nt, Human herpesvirus 6B
accgcuauggcagaaagcu

SEQ ID NO: 3992652 - RNA, 15 nt, Human herpesvirus 6B
accuaagcuggacag

SEQ ID NO: 3992653 - RNA, 14 nt, Human herpesvirus 6B
acgacucaguagaa

SEQ ID NO: 3992654 - RNA, 22 nt, Human herpesvirus 6B
acgacugacgauuucauuagaa

SEQ ID NO: 3992655 - RNA, 19 nt, Human herpesvirus 6B
acgauagcagcucugcaau

SEQ ID NO: 3992656 - RNA, 16 nt, Human herpesvirus 6B
acgaucaauauagagg

SEQ ID NO: 3992657 - RNA, 16 nt, Human herpesvirus 6B
acgaugugucggagac

SEQ ID NO: 3992658 - RNA, 15 nt, Human herpesvirus 6B
acgcaaagggaagcc

SEQ ID NO: 3992659 - RNA, 17 nt, Human herpesvirus 6B
acgcaaagggaagccag

SEQ ID NO: 3992660 - RNA, 20 nt, Human herpesvirus 6B
acgcaggauuauaaaaacac

SEQ ID NO: 3992661 - RNA, 16 nt, Human herpesvirus 6B
acgcgcggaccacucg

SEQ ID NO: 3992662 - RNA, 16 nt, Human herpesvirus 6B
acgcuccucccacgcc

SEQ ID NO: 3992663 - RNA, 13 nt, Human herpesvirus 6B
acggcagcgggga

SEQ ID NO: 3992664 - RNA, 20 nt, Human herpesvirus 6B
acggcagcggggaagggaau

SEQ ID NO: 3992665 - RNA, 12 nt, Human herpesvirus 6B
acgggaaaagau

SEQ ID NO: 3992666 - RNA, 20 nt, Human herpesvirus 6B
acguacauaaacuauuguuu

SEQ ID NO: 3992667 - RNA, 22 nt, Human herpesvirus 6B
acgucccucacaacaaagaacu

SEQ ID NO: 3992668 - RNA, 19 nt, Human herpesvirus 6B
acgugaaauaaaguuuaaa

SEQ ID NO: 3992669 - RNA, 19 nt, Human herpesvirus 6B
acuaagugccguggcagaa

SEQ ID NO: 3992670 - RNA, 13 nt, Human herpesvirus 6B
acuacagcuaaga

SEQ ID NO: 3992671 - RNA, 18 nt, Human herpesvirus 6B
acuaccgaugcucucaga

SEQ ID NO: 3992672 - RNA, 20 nt, Human herpesvirus 6B
acuacuguguccaguguuac

SEQ ID NO: 3992673 - RNA, 23 nt, Human herpesvirus 6B
acuagugauuauggugccucagg

SEQ ID NO: 3992674 - RNA, 22 nt, Human herpesvirus 6B
acuaucuccuugaugauacuuu

SEQ ID NO: 3992675 - RNA, 13 nt, Human herpesvirus 6B
acucaaagaaagc

SEQ ID NO: 3992676 - RNA, 19 nt, Human herpesvirus 6B
acucagauuucaggaaguu

SEQ ID NO: 3992677 - RNA, 22 nt, Human herpesvirus 6B
acucgacguguaucgauuuaac

SEQ ID NO: 3992678 - RNA, 15 nt, Human herpesvirus 6B
acucgacuucuuuca

SEQ ID NO: 3992679 - RNA, 23 nt, Human herpesvirus 6B
acucgaggaaacgcgcugggacu

SEQ ID NO: 3992680 - RNA, 15 nt, Human herpesvirus 6B
acucuacuaaaagac

SEQ ID NO: 3992681 - RNA, 16 nt, Human herpesvirus 6B
acucucuuucaguaau

SEQ ID NO: 3992682 - RNA, 15 nt, Human herpesvirus 6B
acucuuggauugcag

SEQ ID NO: 3992683 - RNA, 14 nt, Human herpesvirus 6B
acugaaucagaaac

SEQ ID NO: 3992684 - RNA, 12 nt, Human herpesvirus 6B
acugacaaggua

SEQ ID NO: 3992685 - RNA, 18 nt, Human herpesvirus 6B
acugcgaauccgucuccg

SEQ ID NO: 3992686 - RNA, 18 nt, Human herpesvirus 6B
acugugaaaagugcuuua

SEQ ID NO: 3992687 - RNA, 21 nt, Human herpesvirus 6B
acugugaggugauuugaacag

SEQ ID NO: 3992688 - RNA, 23 nt, Human herpesvirus 6B
acugugguguuugauuuucagag

SEQ ID NO: 3992689 - RNA, 14 nt, Human herpesvirus 6B
acuguucuuucaaa

SEQ ID NO: 3992690 - RNA, 14 nt, Human herpesvirus 6B
acuuaguugauaug

SEQ ID NO: 3992691 - RNA, 12 nt, Human herpesvirus 6B
acuuauuucauu

SEQ ID NO: 3992692 - RNA, 22 nt, Human herpesvirus 6B
acuucuucugcagaucuggaua

SEQ ID NO: 3992693 - RNA, 18 nt, Human herpesvirus 6B
acuuuaucuuuugcaaag

SEQ ID NO: 3992694 - RNA, 19 nt, Human herpesvirus 6B
acuuucuucgccuguaaag

SEQ ID NO: 3992695 - RNA, 21 nt, Human herpesvirus 6B
acuuuguguaaccugagaauu

SEQ ID NO: 3992696 - RNA, 13 nt, Human herpesvirus 6B
acuuuucugauga

SEQ ID NO: 3992697 - RNA, 22 nt, Human herpesvirus 6B
agaaaauuggugugcauuaucg

SEQ ID NO: 3992698 - RNA, 18 nt, Human herpesvirus 6B
agaaauuuaauugcaauu

SEQ ID NO: 3992699 - RNA, 17 nt, Human herpesvirus 6B
agaacgagacuggacag

SEQ ID NO: 3992700 - RNA, 23 nt, Human herpesvirus 6B
agaacuaggcaaaguauucuucu

SEQ ID NO: 3992701 - RNA, 17 nt, Human herpesvirus 6B
agaagcagcagaugcuu

SEQ ID NO: 3992702 - RNA, 21 nt, Human herpesvirus 6B
agaauaaaccggaugugcaaa

SEQ ID NO: 3992703 - RNA, 16 nt, Human herpesvirus 6B
agaauaagaucuacag

SEQ ID NO: 3992704 - RNA, 15 nt, Human herpesvirus 6B
agaauacgaacagaa

SEQ ID NO: 3992705 - RNA, 18 nt, Human herpesvirus 6B
agaauagagauaaaugua

SEQ ID NO: 3992706 - RNA, 16 nt, Human herpesvirus 6B
agaaucgagaucguuu

SEQ ID NO: 3992707 - RNA, 17 nt, Human herpesvirus 6B
agaaucguaguuuuguu

SEQ ID NO: 3992708 - RNA, 16 nt, Human herpesvirus 6B
agaaucugcagauuuu

SEQ ID NO: 3992709 - RNA, 20 nt, Human herpesvirus 6B
agaauuuucgaaaagaucag

SEQ ID NO: 3992710 - RNA, 18 nt, Human herpesvirus 6B
agacaaaaacaugugcuu

SEQ ID NO: 3992711 - RNA, 15 nt, Human herpesvirus 6B
agacaauuauguuug

SEQ ID NO: 3992712 - RNA, 13 nt, Human herpesvirus 6B
agacaucguggac

SEQ ID NO: 3992713 - RNA, 22 nt, Human herpesvirus 6B
agacauugguugauuuuuguaa

SEQ ID NO: 3992714 - RNA, 18 nt, Human herpesvirus 6B
agaccaauuuagauucga

SEQ ID NO: 3992715 - RNA, 19 nt, Human herpesvirus 6B
agaccgguacgauuucugu

SEQ ID NO: 3992716 - RNA, 13 nt, Human herpesvirus 6B
agacgagauguuu

SEQ ID NO: 3992717 - RNA, 21 nt, Human herpesvirus 6B
agacgaguccuacagaagaaa

SEQ ID NO: 3992718 - RNA, 21 nt, Human herpesvirus 6B
agacggaucugccgcguggaa

SEQ ID NO: 3992719 - RNA, 12 nt, Human herpesvirus 6B
agacguuugcuu

SEQ ID NO: 3992720 - RNA, 15 nt, Human herpesvirus 6B
agacugcacagaauc

SEQ ID NO: 3992721 - RNA, 16 nt, Human herpesvirus 6B
agacuggacaguguuu

SEQ ID NO: 3992722 - RNA, 20 nt, Human herpesvirus 6B
agagaauagagauaaaugua

SEQ ID NO: 3992723 - RNA, 24 nt, Human herpesvirus 6B
agagaggaugcuuuuaguuucaaa

SEQ ID NO: 3992724 - RNA, 19 nt, Human herpesvirus 6B
agagucuguuacaacaaua

SEQ ID NO: 3992725 - RNA, 14 nt, Human herpesvirus 6B
agauaagagaguuu

SEQ ID NO: 3992726 - RNA, 22 nt, Human herpesvirus 6B
agauaaucgucgaaaacaauuu

SEQ ID NO: 3992727 - RNA, 17 nt, Human herpesvirus 6B
agaucaagcaaguucca

SEQ ID NO: 3992728 - RNA, 19 nt, Human herpesvirus 6B
agaucaucgccauagugaa

SEQ ID NO: 3992729 - RNA, 15 nt, Human herpesvirus 6B
agaugucgggccaca

SEQ ID NO: 3992730 - RNA, 16 nt, Human herpesvirus 6B
agauuaaauucagaua

SEQ ID NO: 3992731 - RNA, 17 nt, Human herpesvirus 6B
agauuaauuaucauuau

SEQ ID NO: 3992732 - RNA, 21 nt, Human herpesvirus 6B
agauucuccgucucaguguca

SEQ ID NO: 3992733 - RNA, 20 nt, Human herpesvirus 6B
agcaaaugaauguguucaua

SEQ ID NO: 3992734 - RNA, 14 nt, Human herpesvirus 6B
agcaaauuuuacca

SEQ ID NO: 3992735 - RNA, 24 nt, Human herpesvirus 6B
agcaacuugcugucggccgaagga

SEQ ID NO: 3992736 - RNA, 19 nt, Human herpesvirus 6B
agcaauucuuuugcgaaga

SEQ ID NO: 3992737 - RNA, 15 nt, Human herpesvirus 6B
agcagagguaaagua

SEQ ID NO: 3992738 - RNA, 16 nt, Human herpesvirus 6B
agcagcuagagaaauu

SEQ ID NO: 3992739 - RNA, 14 nt, Human herpesvirus 6B
agcaggagaaaaau

SEQ ID NO: 3992740 - RNA, 21 nt, Human herpesvirus 6B
agcaggcuccccaggcgcagc

SEQ ID NO: 3992741 - RNA, 23 nt, Human herpesvirus 6B
agcaucgguuguguuagcuucgc

SEQ ID NO: 3992742 - RNA, 16 nt, Human herpesvirus 6B
agcauucguuuagaga

SEQ ID NO: 3992743 - RNA, 22 nt, Human herpesvirus 6B
agccacuugagugagcagaagc

SEQ ID NO: 3992744 - RNA, 14 nt, Human herpesvirus 6B
agccagccaguauc

SEQ ID NO: 3992745 - RNA, 22 nt, Human herpesvirus 6B
agcccgcucggucucgcacguc

SEQ ID NO: 3992746 - RNA, 17 nt, Human herpesvirus 6B
agcccugaagaagaugc

SEQ ID NO: 3992747 - RNA, 19 nt, Human herpesvirus 6B
agcccugagagcaggagca

SEQ ID NO: 3992748 - RNA, 16 nt, Human herpesvirus 6B
agccggagcccugaga

SEQ ID NO: 3992749 - RNA, 14 nt, Human herpesvirus 6B
agccggccuuggaa

SEQ ID NO: 3992750 - RNA, 23 nt, Human herpesvirus 6B
agccuguccgugacacacagaau

SEQ ID NO: 3992751 - RNA, 16 nt, Human herpesvirus 6B
agcgcauccuuaaaug

SEQ ID NO: 3992752 - RNA, 16 nt, Human herpesvirus 6B
agcgcuguauguuaug

SEQ ID NO: 3992753 - RNA, 12 nt, Human herpesvirus 6B
agcggccaggcc

SEQ ID NO: 3992754 - RNA, 14 nt, Human herpesvirus 6B
agcgucaaacacuc

SEQ ID NO: 3992755 - RNA, 19 nt, Human herpesvirus 6B
agcucgaguucgagaagau

SEQ ID NO: 3992756 - RNA, 16 nt, Human herpesvirus 6B
agcugacaucugcaaa

SEQ ID NO: 3992757 - RNA, 16 nt, Human herpesvirus 6B
agcuuguuaugacaaa

SEQ ID NO: 3992758 - RNA, 14 nt, Human herpesvirus 6B
aggaaaauguguuc

SEQ ID NO: 3992759 - RNA, 16 nt, Human herpesvirus 6B
aggaacugaugagaaa

SEQ ID NO: 3992760 - RNA, 17 nt, Human herpesvirus 6B
aggaagaucaugacaag

SEQ ID NO: 3992761 - RNA, 23 nt, Human herpesvirus 6B
aggacaagccgacuauggaugau

SEQ ID NO: 3992762 - RNA, 15 nt, Human herpesvirus 6B
aggagagggagaaac

SEQ ID NO: 3992763 - RNA, 17 nt, Human herpesvirus 6B
aggaggaaaagaagaag

SEQ ID NO: 3992764 - RNA, 14 nt, Human herpesvirus 6B
aggaggaagaggag

SEQ ID NO: 3992765 - RNA, 16 nt, Human herpesvirus 6B
aggaggaagaggagga

SEQ ID NO: 3992766 - RNA, 20 nt, Human herpesvirus 6B
aggagugaaacgauguguua

SEQ ID NO: 3992767 - RNA, 19 nt, Human herpesvirus 6B
aggauguuugugacucuga

SEQ ID NO: 3992768 - RNA, 20 nt, Human herpesvirus 6B
aggccaggcgauacaacauc

SEQ ID NO: 3992769 - RNA, 16 nt, Human herpesvirus 6B
aggccggcacauacac

SEQ ID NO: 3992770 - RNA, 13 nt, Human herpesvirus 6B
aggcgcagcagca

SEQ ID NO: 3992771 - RNA, 15 nt, Human herpesvirus 6B
aggcggagacacaua

SEQ ID NO: 3992772 - RNA, 16 nt, Human herpesvirus 6B
aggcucggcaggggcc

SEQ ID NO: 3992773 - RNA, 12 nt, Human herpesvirus 6B
aggcucuggcaa

SEQ ID NO: 3992774 - RNA, 21 nt, Human herpesvirus 6B
agggaagccagccgcccuccc

SEQ ID NO: 3992775 - RNA, 19 nt, Human herpesvirus 6B
agggacccacacgcgggga

SEQ ID NO: 3992776 - RNA, 13 nt, Human herpesvirus 6B
agggacgcuugcu

SEQ ID NO: 3992777 - RNA, 16 nt, Human herpesvirus 6B
agggcgggcggacggc

SEQ ID NO: 3992778 - RNA, 14 nt, Human herpesvirus 6B
agggcguuucucgc

SEQ ID NO: 3992779 - RNA, 15 nt, Human herpesvirus 6B
aggggacggacagag

SEQ ID NO: 3992780 - RNA, 16 nt, Human herpesvirus 6B
aggguaacgcaggaga

SEQ ID NO: 3992781 - RNA, 21 nt, Human herpesvirus 6B
aggguaacgcaggagaaacuu

SEQ ID NO: 3992782 - RNA, 17 nt, Human herpesvirus 6B
agggucagcagaagaag

SEQ ID NO: 3992783 - RNA, 17 nt, Human herpesvirus 6B
agggucgaacccugaga

SEQ ID NO: 3992784 - RNA, 17 nt, Human herpesvirus 6B
aggugauuugaacagag

SEQ ID NO: 3992785 - RNA, 17 nt, Human herpesvirus 6B
aggugcguacacggcca

SEQ ID NO: 3992786 - RNA, 16 nt, Human herpesvirus 6B
agguguauuugaaaug

SEQ ID NO: 3992787 - RNA, 12 nt, Human herpesvirus 6B
agguuguccuug

SEQ ID NO: 3992788 - RNA, 18 nt, Human herpesvirus 6B
agguuucuaaaucugaaa

SEQ ID NO: 3992789 - RNA, 21 nt, Human herpesvirus 6B
agguuucuaaaucugaaaugu

SEQ ID NO: 3992790 - RNA, 16 nt, Human herpesvirus 6B
aguaacggaaaaauuu

SEQ ID NO: 3992791 - RNA, 17 nt, Human herpesvirus 6B
aguagugcaaccaugca

SEQ ID NO: 3992792 - RNA, 18 nt, Human herpesvirus 6B
aguauggugucugaaaaa

SEQ ID NO: 3992793 - RNA, 19 nt, Human herpesvirus 6B
aguauuuaugcuucauaau

SEQ ID NO: 3992794 - RNA, 21 nt, Human herpesvirus 6B
agucuagagguuuucuuuccc

SEQ ID NO: 3992795 - RNA, 15 nt, Human herpesvirus 6B
agucuggccucugcg

SEQ ID NO: 3992796 - RNA, 13 nt, Human herpesvirus 6B
agucugucagugg

SEQ ID NO: 3992797 - RNA, 23 nt, Human herpesvirus 6B
agucuucauccucgaagaauugu

SEQ ID NO: 3992798 - RNA, 15 nt, Human herpesvirus 6B
agugaauugugcaag

SEQ ID NO: 3992799 - RNA, 15 nt, Human herpesvirus 6B
agugacaaaauuuuu

SEQ ID NO: 3992800 - RNA, 13 nt, Human herpesvirus 6B
agugcuuuauccg

SEQ ID NO: 3992801 - RNA, 15 nt, Human herpesvirus 6B
agugcuuuauccggc

SEQ ID NO: 3992802 - RNA, 19 nt, Human herpesvirus 6B
aguguaaauguagaagaag

SEQ ID NO: 3992803 - RNA, 22 nt, Human herpesvirus 6B
aguguuauaucuggauauguau

SEQ ID NO: 3992804 - RNA, 15 nt, Human herpesvirus 6B
aguguuaugaagaau

SEQ ID NO: 3992805 - RNA, 19 nt, Human herpesvirus 6B
aguguuugccaaccaaaug

SEQ ID NO: 3992806 - RNA, 16 nt, Human herpesvirus 6B
aguuacuuugcuuuga

SEQ ID NO: 3992807 - RNA, 15 nt, Human herpesvirus 6B
aguugaugcuguugc

SEQ ID NO: 3992808 - RNA, 16 nt, Human herpesvirus 6B
aguugcggaagggcuc

SEQ ID NO: 3992809 - RNA, 16 nt, Human herpesvirus 6B
auaaaaaaaaauacua

SEQ ID NO: 3992810 - RNA, 12 nt, Human herpesvirus 6B
auaaacuauugu

SEQ ID NO: 3992811 - RNA, 14 nt, Human herpesvirus 6B
auaaacuuaaaaga

SEQ ID NO: 3992812 - RNA, 22 nt, Human herpesvirus 6B
auaacagaugaggaggagggac

SEQ ID NO: 3992813 - RNA, 15 nt, Human herpesvirus 6B
auaacaucucagauc

SEQ ID NO: 3992814 - RNA, 22 nt, Human herpesvirus 6B
auaacgauagcagcucugcaau

SEQ ID NO: 3992815 - RNA, 17 nt, Human herpesvirus 6B
auaaguugucauuguau

SEQ ID NO: 3992816 - RNA, 17 nt, Human herpesvirus 6B
auaauuuuauugacugu

SEQ ID NO: 3992817 - RNA, 22 nt, Human herpesvirus 6B
auacaccggagaccgagcggcg

SEQ ID NO: 3992818 - RNA, 23 nt, Human herpesvirus 6B
auaccauuuuauacgaaaauaaa

SEQ ID NO: 3992819 - RNA, 15 nt, Human herpesvirus 6B
auacggaaguugaaa

SEQ ID NO: 3992820 - RNA, 17 nt, Human herpesvirus 6B
auacggaaguugaaaaa

SEQ ID NO: 3992821 - RNA, 17 nt, Human herpesvirus 6B
auacgggaaaagaucaa

SEQ ID NO: 3992822 - RNA, 19 nt, Human herpesvirus 6B
auacuacguguaauguuuc

SEQ ID NO: 3992823 - RNA, 16 nt, Human herpesvirus 6B
auagaaagaaccagug

SEQ ID NO: 3992824 - RNA, 20 nt, Human herpesvirus 6B
auagagaagaauccgcgggc

SEQ ID NO: 3992825 - RNA, 14 nt, Human herpesvirus 6B
aaggucaaaaaacu

SEQ ID NO: 3992826 - RNA, 14 nt, Human herpesvirus 6B
aagguuuugugaau

SEQ ID NO: 3992827 - RNA, 17 nt, Human herpesvirus 6B
aaguauucuucuucccc

SEQ ID NO: 3992828 - RNA, 23 nt, Human herpesvirus 6B
aagucguuacaguaaaaaagccg

SEQ ID NO: 3992829 - RNA, 20 nt, Human herpesvirus 6B
aagucuuccgcggcgcuggg

SEQ ID NO: 3992830 - RNA, 19 nt, Human herpesvirus 6B
aagugaaggcggagaugca

SEQ ID NO: 3992831 - RNA, 22 nt, Human herpesvirus 6B
aagugaaggcggagaugcaaaa

SEQ ID NO: 3992832 - RNA, 17 nt, Human herpesvirus 6B
aaguuagaguuggauuu

SEQ ID NO: 3992833 - RNA, 21 nt, Human herpesvirus 6B
aaguuccacaucuaugaugcu

SEQ ID NO: 3992834 - RNA, 20 nt, Human herpesvirus 6B
aauaagccgaguuugauaau

SEQ ID NO: 3992835 - RNA, 13 nt, Human herpesvirus 6B
aauaauugcauuu

SEQ ID NO: 3992836 - RNA, 18 nt, Human herpesvirus 6B
aauaauugcauuuugggc

SEQ ID NO: 3992837 - RNA, 15 nt, Human herpesvirus 6B
aauaauuuuuguagc

SEQ ID NO: 3992838 - RNA, 21 nt, Human herpesvirus 6B
aauagucccauaaagcuuuca

SEQ ID NO: 3992839 - RNA, 12 nt, Human herpesvirus 6B
aaucaaggaaga

SEQ ID NO: 3992840 - RNA, 12 nt, Human herpesvirus 6B
aaucacaaauau

SEQ ID NO: 3992841 - RNA, 16 nt, Human herpesvirus 6B
aauccuggauuucgac

SEQ ID NO: 3992842 - RNA, 17 nt, Human herpesvirus 6B
aaucgaugcuggccuga

SEQ ID NO: 3992843 - RNA, 19 nt, Human herpesvirus 6B
aaucuccugagaggcugga

SEQ ID NO: 3992844 - RNA, 21 nt, Human herpesvirus 6B
aaucuguaagauuaaauguga

SEQ ID NO: 3992845 - RNA, 16 nt, Human herpesvirus 6B
aaucugugggaaaaua

SEQ ID NO: 3992846 - RNA, 22 nt, Human herpesvirus 6B
aaugagaaucguaguuuuguuc

SEQ ID NO: 3992847 - RNA, 14 nt, Human herpesvirus 6B
aauggaagaaggcu

SEQ ID NO: 3992848 - RNA, 18 nt, Human herpesvirus 6B
aaugggaugcauuauacu

SEQ ID NO: 3992849 - RNA, 14 nt, Human herpesvirus 6B
aaugugagcaguuu

SEQ ID NO: 3992850 - RNA, 23 nt, Human herpesvirus 6B
aauguguucuuacaauguucuug

SEQ ID NO: 3992851 - RNA, 16 nt, Human herpesvirus 6B
aauguuccaauugauu

SEQ ID NO: 3992852 - RNA, 19 nt, Human herpesvirus 6B
aauguugucaaucguguau

SEQ ID NO: 3992853 - RNA, 13 nt, Human herpesvirus 6B
aauguuucuguau

SEQ ID NO: 3992854 - RNA, 16 nt, Human herpesvirus 6B
aauuaaaguuuacugu

SEQ ID NO: 3992855 - RNA, 23 nt, Human herpesvirus 6B
aauuacucccauagaucuucccc

SEQ ID NO: 3992856 - RNA, 20 nt, Human herpesvirus 6B
aauuccauacggucgaauga

SEQ ID NO: 3992857 - RNA, 19 nt, Human herpesvirus 6B
aauuccauaugucgaaugc

SEQ ID NO: 3992858 - RNA, 17 nt, Human herpesvirus 6B
aauuccucuauacucug

SEQ ID NO: 3992859 - RNA, 24 nt, Human herpesvirus 6B
aauucugugaugggaaauguuguc

SEQ ID NO: 3992860 - RNA, 14 nt, Human herpesvirus 6B
auagagauaaaugu

SEQ ID NO: 3992861 - RNA, 14 nt, Human herpesvirus 6B
auagcuggauuauc

SEQ ID NO: 3992862 - RNA, 14 nt, Human herpesvirus 6B
auauacccucgccc

SEQ ID NO: 3992863 - RNA, 11 nt, Human herpesvirus 6B
auauagacacc

SEQ ID NO: 3992864 - RNA, 17 nt, Human herpesvirus 6B
auaucaugauaaauugu

SEQ ID NO: 3992865 - RNA, 15 nt, Human herpesvirus 6B
auaucugaaacacua

SEQ ID NO: 3992866 - RNA, 18 nt, Human herpesvirus 6B
auaugcuuuuuuuugugg

SEQ ID NO: 3992867 - RNA, 17 nt, Human herpesvirus 6B
auauggaucaaucucca

SEQ ID NO: 3992868 - RNA, 20 nt, Human herpesvirus 6B
auauucacaagaagaugcuu

SEQ ID NO: 3992869 - RNA, 22 nt, Human herpesvirus 6B
auauugagacguuuuucacagu

SEQ ID NO: 3992870 - RNA, 15 nt, Human herpesvirus 6B
auauugcaugcauug

SEQ ID NO: 3992871 - RNA, 16 nt, Human herpesvirus 6B
auauuggucaauguau

SEQ ID NO: 3992872 - RNA, 15 nt, Human herpesvirus 6B
aucaaaaaaaugaua

SEQ ID NO: 3992873 - RNA, 16 nt, Human herpesvirus 6B
aucaaacaacuguugu

SEQ ID NO: 3992874 - RNA, 13 nt, Human herpesvirus 6B
aucaaauucaaac

SEQ ID NO: 3992875 - RNA, 20 nt, Human herpesvirus 6B
aucaagacuacucuggcuga

SEQ ID NO: 3992876 - RNA, 15 nt, Human herpesvirus 6B
aucacgaaagaaugu

SEQ ID NO: 3992877 - RNA, 16 nt, Human herpesvirus 6B
aucacuacgaaagaac

SEQ ID NO: 3992878 - RNA, 17 nt, Human herpesvirus 6B
aucacuuagacacggcc

SEQ ID NO: 3992879 - RNA, 11 nt, Human herpesvirus 6B
aucacuuuguu

SEQ ID NO: 3992880 - RNA, 16 nt, Human herpesvirus 6B
aucagauaucugaaac

SEQ ID NO: 3992881 - RNA, 20 nt, Human herpesvirus 6B
auccaaaguaggcacacaug

SEQ ID NO: 3992882 - RNA, 15 nt, Human herpesvirus 6B
auccaucguuuguaa

SEQ ID NO: 3992883 - RNA, 22 nt, Human herpesvirus 6B
auccgcuaagagauuuacuguu

SEQ ID NO: 3992884 - RNA, 17 nt, Human herpesvirus 6B
auccggccaauucauug

SEQ ID NO: 3992885 - RNA, 21 nt, Human herpesvirus 6B
auccuguaguuuuuuucugau

SEQ ID NO: 3992886 - RNA, 23 nt, Human herpesvirus 6B
auccuuagcgcgaucguagacgu

SEQ ID NO: 3992887 - RNA, 16 nt, Human herpesvirus 6B
auccuuauaucugaaa

SEQ ID NO: 3992888 - RNA, 13 nt, Human herpesvirus 6B
aucuacaaaauag

SEQ ID NO: 3992889 - RNA, 11 nt, Human herpesvirus 6B
aucuauguuuu

SEQ ID NO: 3992890 - RNA, 23 nt, Human herpesvirus 6B
aucucaaaaaggguuuucugaau

SEQ ID NO: 3992891 - RNA, 15 nt, Human herpesvirus 6B
aucucgaugccaaag

SEQ ID NO: 3992892 - RNA, 15 nt, Human herpesvirus 6B
aucucuacaacguga

SEQ ID NO: 3992893 - RNA, 15 nt, Human herpesvirus 6B
aucucuagguaaacu

SEQ ID NO: 3992894 - RNA, 18 nt, Human herpesvirus 6B
aucugcuaacggagcaac

SEQ ID NO: 3992895 - RNA, 21 nt, Human herpesvirus 6B
aucuuaaucagauaucugaaa

SEQ ID NO: 3992896 - RNA, 22 nt, Human herpesvirus 6B
aucuugaaaagccccugcuuga

SEQ ID NO: 3992897 - RNA, 21 nt, Human herpesvirus 6B
augaauguguucauagagcau

SEQ ID NO: 3992898 - RNA, 22 nt, Human herpesvirus 6B
augaauuugagaagauaauuac

SEQ ID NO: 3992899 - RNA, 20 nt, Human herpesvirus 6B
augacaaggugaacucaucg

SEQ ID NO: 3992900 - RNA, 15 nt, Human herpesvirus 6B
augacgaagggagug

SEQ ID NO: 3992901 - RNA, 15 nt, Human herpesvirus 6B
augacucaagaauua

SEQ ID NO: 3992902 - RNA, 12 nt, Human herpesvirus 6B
augacuuuucug

SEQ ID NO: 3992903 - RNA, 14 nt, Human herpesvirus 6B
augaguggaguuga

SEQ ID NO: 3992904 - RNA, 23 nt, Human herpesvirus 6B
augcaaucugugggaaaauaaua

SEQ ID NO: 3992905 - RNA, 15 nt, Human herpesvirus 6B
augcaggugcugcua

SEQ ID NO: 3992906 - RNA, 14 nt, Human herpesvirus 6B
augccacagguaca

SEQ ID NO: 3992907 - RNA, 19 nt, Human herpesvirus 6B
augccgccugaaaccccac

SEQ ID NO: 3992908 - RNA, 12 nt, Human herpesvirus 6B
augccuugggga

SEQ ID NO: 3992909 - RNA, 13 nt, Human herpesvirus 6B
augcggagaagua

SEQ ID NO: 3992910 - RNA, 14 nt, Human herpesvirus 6B
auggaacuucauag

SEQ ID NO: 3992911 - RNA, 23 nt, Human herpesvirus 6B
auggaagaaggcuaucacuuaga

SEQ ID NO: 3992912 - RNA, 14 nt, Human herpesvirus 6B
auggagaaaaacuu

SEQ ID NO: 3992913 - RNA, 19 nt, Human herpesvirus 6B
auggaucauaaagugucuu

SEQ ID NO: 3992914 - RNA, 21 nt, Human herpesvirus 6B
auggaucggaagacguuucua

SEQ ID NO: 3992915 - RNA, 22 nt, Human herpesvirus 6B
auggauuacaagggaaauccua

SEQ ID NO: 3992916 - RNA, 13 nt, Human herpesvirus 6B
augguuaaggaaa

SEQ ID NO: 3992917 - RNA, 20 nt, Human herpesvirus 6B
auguaaacauagaaucucca

SEQ ID NO: 3992918 - RNA, 12 nt, Human herpesvirus 6B
auguaaauguua

SEQ ID NO: 3992919 - RNA, 21 nt, Human herpesvirus 6B
auguacguggccgucuccugc

SEQ ID NO: 3992920 - RNA, 16 nt, Human herpesvirus 6B
auguaucaaaguguau

SEQ ID NO: 3992921 - RNA, 19 nt, Human herpesvirus 6B
augucaacgaaaaaaugac

SEQ ID NO: 3992922 - RNA, 20 nt, Human herpesvirus 6B
augucaagucuagacaugau

SEQ ID NO: 3992923 - RNA, 13 nt, Human herpesvirus 6B
augucguuucaug

SEQ ID NO: 3992924 - RNA, 17 nt, Human herpesvirus 6B
augucucgaaaaagaca

SEQ ID NO: 3992925 - RNA, 16 nt, Human herpesvirus 6B
auguggucauggaaaa

SEQ ID NO: 3992926 - RNA, 16 nt, Human herpesvirus 6B
auguguucuuacaaug

SEQ ID NO: 3992927 - RNA, 13 nt, Human herpesvirus 6B
auguuauguaaag

SEQ ID NO: 3992928 - RNA, 19 nt, Human herpesvirus 6B
auguucuucugaaaugguu

SEQ ID NO: 3992929 - RNA, 15 nt, Human herpesvirus 6B
auguuuacugcaugc

SEQ ID NO: 3992930 - RNA, 14 nt, Human herpesvirus 6B
auuaaaguuuacug

SEQ ID NO: 3992931 - RNA, 14 nt, Human herpesvirus 6B
auuaaaguuuucau

SEQ ID NO: 3992932 - RNA, 20 nt, Human herpesvirus 6B
auuaauuuuuuguuucugaa

SEQ ID NO: 3992933 - RNA, 23 nt, Human herpesvirus 6B
auuacagaugucuauaugucaga

SEQ ID NO: 3992934 - RNA, 19 nt, Human herpesvirus 6B
auuacagcuuguccgaaau

SEQ ID NO: 3992935 - RNA, 16 nt, Human herpesvirus 6B
auuaggggacagagcc

SEQ ID NO: 3992936 - RNA, 15 nt, Human herpesvirus 6B
auuauaaugaugcau

SEQ ID NO: 3992937 - RNA, 21 nt, Human herpesvirus 6B
auuauuguguguccugagaau

SEQ ID NO: 3992938 - RNA, 19 nt, Human herpesvirus 6B
auucaauggagucuucaca

SEQ ID NO: 3992939 - RNA, 15 nt, Human herpesvirus 6B
auucaauuucuaaau

SEQ ID NO: 3992940 - RNA, 23 nt, Human herpesvirus 6B
auucagaaaauuggugugcauua

SEQ ID NO: 3992941 - RNA, 20 nt, Human herpesvirus 6B
auucagcuggacagaaauga

SEQ ID NO: 3992942 - RNA, 19 nt, Human herpesvirus 6B
auucgauuaaugccacagg

SEQ ID NO: 3992943 - RNA, 17 nt, Human herpesvirus 6B
auucgcaagacuacaga

SEQ ID NO: 3992944 - RNA, 22 nt, Human herpesvirus 6B
auucuuuugugcuuaucaaauu

SEQ ID NO: 3992945 - RNA, 22 nt, Human herpesvirus 6B
auugaaggguguuuccacacag

SEQ ID NO: 3992946 - RNA, 14 nt, Human herpesvirus 6B
auugagcucuugga

SEQ ID NO: 3992947 - RNA, 17 nt, Human herpesvirus 6B
auugaguagagcuuuga

SEQ ID NO: 3992948 - RNA, 20 nt, Human herpesvirus 6B
auugcagagguaaugugaac

SEQ ID NO: 3992949 - RNA, 16 nt, Human herpesvirus 6B
auugcugaguggacau

SEQ ID NO: 3992950 - RNA, 23 nt, Human herpesvirus 6B
auuggcccuuauauggaugcugg

SEQ ID NO: 3992951 - RNA, 15 nt, Human herpesvirus 6B
auuguagcucucgca

SEQ ID NO: 3992952 - RNA, 14 nt, Human herpesvirus 6B
auugucauucugca

SEQ ID NO: 3992953 - RNA, 15 nt, Human herpesvirus 6B
auugugacaagguau

SEQ ID NO: 3992954 - RNA, 14 nt, Human herpesvirus 6B
auuguguucugcuc

SEQ ID NO: 3992955 - RNA, 22 nt, Human herpesvirus 6B
auuuaacgauccuuuucucaca

SEQ ID NO: 3992956 - RNA, 13 nt, Human herpesvirus 6B
auuuaaguaaacu

SEQ ID NO: 3992957 - RNA, 17 nt, Human herpesvirus 6B
auuuacaaaacaaauau

SEQ ID NO: 3992958 - RNA, 18 nt, Human herpesvirus 6B
auuuauaccaaacgugaa

SEQ ID NO: 3992959 - RNA, 14 nt, Human herpesvirus 6B
auuuauguaaacau

SEQ ID NO: 3992960 - RNA, 16 nt, Human herpesvirus 6B
auuugacuguagaaaa

SEQ ID NO: 3992961 - RNA, 17 nt, Human herpesvirus 6B
auuugcaauuguuugug

SEQ ID NO: 3992962 - RNA, 14 nt, Human herpesvirus 6B
auuugcaguuugug

SEQ ID NO: 3992963 - RNA, 17 nt, Human herpesvirus 6B
auuugcauuaaggaaaa

SEQ ID NO: 3992964 - RNA, 18 nt, Human herpesvirus 6B
auuuguucgcacaaaaug

SEQ ID NO: 3992965 - RNA, 19 nt, Human herpesvirus 6B
auuuuaaaaagaacgugaa

SEQ ID NO: 3992966 - RNA, 16 nt, Human herpesvirus 6B
auuuuaacgguuuugc

SEQ ID NO: 3992967 - RNA, 21 nt, Human herpesvirus 6B
auuuuagaauaaaaaauagac

SEQ ID NO: 3992968 - RNA, 14 nt, Human herpesvirus 6B
auuuucagugucag

SEQ ID NO: 3992969 - RNA, 18 nt, Human herpesvirus 6B
auuuucuccuuuuuugac

SEQ ID NO: 3992970 - RNA, 20 nt, Human herpesvirus 6B
auuuuggaagcauacgucug

SEQ ID NO: 3992971 - RNA, 21 nt, Human herpesvirus 6B
auuuuguggcuauuugacaau

SEQ ID NO: 3992972 - RNA, 20 nt, Human herpesvirus 6B
auuuuucugccuauuucucu

SEQ ID NO: 3992973 - RNA, 23 nt, Human herpesvirus 6B
auuuuuguagcaauuuuaaauau

SEQ ID NO: 3992974 - RNA, 17 nt, Human herpesvirus 6B
auuuuuuugaaaucacu

SEQ ID NO: 3992975 - RNA, 18 nt, Human herpesvirus 6B
caaaagccugcauaugau

SEQ ID NO: 3992976 - RNA, 16 nt, Human herpesvirus 6B
caaaaucguguuuucu

SEQ ID NO: 3992977 - RNA, 19 nt, Human herpesvirus 6B
caaaauuaauucaaaugua

SEQ ID NO: 3992978 - RNA, 12 nt, Human herpesvirus 6B
caaacagagaua

SEQ ID NO: 3992979 - RNA, 16 nt, Human herpesvirus 6B
caaagaugacaaauuu

SEQ ID NO: 3992980 - RNA, 14 nt, Human herpesvirus 6B
caaagguuuuguga

SEQ ID NO: 3992981 - RNA, 17 nt, Human herpesvirus 6B
caaagucuuccgcggcg

SEQ ID NO: 3992982 - RNA, 18 nt, Human herpesvirus 6B
caaauaauuuuauugacu

SEQ ID NO: 3992983 - RNA, 16 nt, Human herpesvirus 6B
caaauguagcaaauga

SEQ ID NO: 3992984 - RNA, 17 nt, Human herpesvirus 6B
caacacuguuguuaauc

SEQ ID NO: 3992985 - RNA, 18 nt, Human herpesvirus 6B
caaccuauguacagauag

SEQ ID NO: 3992986 - RNA, 23 nt, Human herpesvirus 6B
caacgcagauuuuaaugaugugu

SEQ ID NO: 3992987 - RNA, 14 nt, Human herpesvirus 6B
caacgcuccuccca

SEQ ID NO: 3992988 - RNA, 17 nt, Human herpesvirus 6B
caacggcacgagagccu

SEQ ID NO: 3992989 - RNA, 15 nt, Human herpesvirus 6B
caacguuuucugcuc

SEQ ID NO: 3992990 - RNA, 23 nt, Human herpesvirus 6B
caacuuaaaauuuuuaaacagau

SEQ ID NO: 3992991 - RNA, 15 nt, Human herpesvirus 6B
caacuuuauuugaaa

SEQ ID NO: 3992992 - RNA, 23 nt, Human herpesvirus 6B
caagaaaagaaaaaacagagccg

SEQ ID NO: 3992993 - RNA, 19 nt, Human herpesvirus 6B
caagcacaaaaccaggaau

SEQ ID NO: 3992994 - RNA, 13 nt, Human herpesvirus 6B
caagcccggagaa

SEQ ID NO: 3992995 - RNA, 21 nt, Human herpesvirus 6B
caagucgccucacuguaaaag

SEQ ID NO: 3992996 - RNA, 16 nt, Human herpesvirus 6B
caauaucguccucaga

SEQ ID NO: 3992997 - RNA, 15 nt, Human herpesvirus 6B
caaugaauacuucuc

SEQ ID NO: 3992998 - RNA, 18 nt, Human herpesvirus 6B
caaugacuggccaaucau

SEQ ID NO: 3992999 - RNA, 23 nt, Human herpesvirus 6B
caaugauuuuguuuauugcuuuu

SEQ ID NO: 3993000 - RNA, 15 nt, Human herpesvirus 6B
caaugcggaacacca

SEQ ID NO: 3993001 - RNA, 14 nt, Human herpesvirus 6B
caauuguauuguga

SEQ ID NO: 3993002 - RNA, 19 nt, Human herpesvirus 6B
caauuucggcaagaaagcc

SEQ ID NO: 3993003 - RNA, 23 nt, Human herpesvirus 6B
cacagcaugaacucucacggcca

SEQ ID NO: 3993004 - RNA, 15 nt, Human herpesvirus 6B
cacagcggcagcgga

SEQ ID NO: 3993005 - RNA, 20 nt, Human herpesvirus 6B
cacaguugcgugagcaagga

SEQ ID NO: 3993006 - RNA, 18 nt, Human herpesvirus 6B
cacaucgugaguuuucau

SEQ ID NO: 3993007 - RNA, 17 nt, Human herpesvirus 6B
cacauuagcugcuaaau

SEQ ID NO: 3993008 - RNA, 15 nt, Human herpesvirus 6B
caccagauaggaaaa

SEQ ID NO: 3993009 - RNA, 17 nt, Human herpesvirus 6B
caccccccucuugcagu

SEQ ID NO: 3993010 - RNA, 19 nt, Human herpesvirus 6B
caccccccucuugcagugg

SEQ ID NO: 3993011 - RNA, 19 nt, Human herpesvirus 6B
caccgaaauccccagaagg

SEQ ID NO: 3993012 - RNA, 19 nt, Human herpesvirus 6B
caccgucccucucaccccc

SEQ ID NO: 3993013 - RNA, 21 nt, Human herpesvirus 6B
cacgagagccuuaucgaaaga

SEQ ID NO: 3993014 - RNA, 21 nt, Human herpesvirus 6B
cacgcucguauuuuauuuugu

SEQ ID NO: 3993015 - RNA, 23 nt, Human herpesvirus 6B
cacggcgccucccauagaggcgc

SEQ ID NO: 3993016 - RNA, 19 nt, Human herpesvirus 6B
cacggggauuuagugcagu

SEQ ID NO: 3993017 - RNA, 20 nt, Human herpesvirus 6B
cacggggauuuagugcagua

SEQ ID NO: 3993018 - RNA, 22 nt, Human herpesvirus 6B
cacguccauaggcucggcaggg

SEQ ID NO: 3993019 - RNA, 16 nt, Human herpesvirus 6B
cacgucguggcagaac

SEQ ID NO: 3993020 - RNA, 20 nt, Human herpesvirus 6B
cacucgaggaaacgcgcugg

SEQ ID NO: 3993021 - RNA, 16 nt, Human herpesvirus 6B
cacuuagacacggcca

SEQ ID NO: 3993022 - RNA, 15 nt, Human herpesvirus 6B
cacuucuucugcaga

SEQ ID NO: 3993023 - RNA, 19 nt, Human herpesvirus 6B
cacuugucgccaaugcaau

SEQ ID NO: 3993024 - RNA, 15 nt, Human herpesvirus 6B
cagaaaagcaaacau

SEQ ID NO: 3993025 - RNA, 15 nt, Human herpesvirus 6B
cagaaaugagcaaca

SEQ ID NO: 3993026 - RNA, 18 nt, Human herpesvirus 6B
cagaagauccaaacuaug

SEQ ID NO: 3993027 - RNA, 14 nt, Human herpesvirus 6B
cagaaucuucuuug

SEQ ID NO: 3993028 - RNA, 17 nt, Human herpesvirus 6B
cagacgugagacauuug

SEQ ID NO: 3993029 - RNA, 19 nt, Human herpesvirus 6B
cagagccuagaccaagaau

SEQ ID NO: 3993030 - RNA, 16 nt, Human herpesvirus 6B
cagaggaagaaaggag

SEQ ID NO: 3993031 - RNA, 21 nt, Human herpesvirus 6B
cagauuaauuaucauuaugag

SEQ ID NO: 3993032 - RNA, 13 nt, Human herpesvirus 6B
cagauuucccaaa

SEQ ID NO: 3993033 - RNA, 13 nt, Human herpesvirus 6B
cagauuuuacugg

SEQ ID NO: 3993034 - RNA, 16 nt, Human herpesvirus 6B
cagcaauccaauaauu

SEQ ID NO: 3993035 - RNA, 21 nt, Human herpesvirus 6B
cagcgugaugaggcccagagg

SEQ ID NO: 3993036 - RNA, 16 nt, Human herpesvirus 6B
cagcuuuauucccaug

SEQ ID NO: 3993037 - RNA, 18 nt, Human herpesvirus 6B
caggaccagcucuguucu

SEQ ID NO: 3993038 - RNA, 18 nt, Human herpesvirus 6B
caggauuauaaaaacaca

SEQ ID NO: 3993039 - RNA, 13 nt, Human herpesvirus 6B
guuucuuuggaaa

SEQ ID NO: 3993040 - RNA, 14 nt, Human herpesvirus 6B
guuucuuuggaaaa

SEQ ID NO: 3993041 - RNA, 14 nt, Human herpesvirus 6B
guuugaucuagaua

SEQ ID NO: 3993042 - RNA, 19 nt, Human herpesvirus 6B
guuuguggacaaugauacu

SEQ ID NO: 3993043 - RNA, 22 nt, Human herpesvirus 6B
uaaaaaaaaauacuauguggaa

SEQ ID NO: 3993044 - RNA, 21 nt, Human herpesvirus 6B
uaaaaaagagauaaucuuuga

SEQ ID NO: 3993045 - RNA, 20 nt, Human herpesvirus 6B
uaaaaaagauuuuguuucua

SEQ ID NO: 3993046 - RNA, 18 nt, Human herpesvirus 6B
uaaaagcugcuaacggag

SEQ ID NO: 3993047 - RNA, 22 nt, Human herpesvirus 6B
uaaaagugcaacaaagagcuuu

SEQ ID NO: 3993048 - RNA, 16 nt, Human herpesvirus 6B
uaaaaguggagguaau

SEQ ID NO: 3993049 - RNA, 18 nt, Human herpesvirus 6B
uaaaaucugcuaacggag

SEQ ID NO: 3993050 - RNA, 20 nt, Human herpesvirus 6B
uaaacggagacugcacagaa

SEQ ID NO: 3993051 - RNA, 19 nt, Human herpesvirus 6B
uaaacuuaacuuaucaacu

SEQ ID NO: 3993052 - RNA, 19 nt, Human herpesvirus 6B
uaaagaucacaacaaacau

SEQ ID NO: 3993053 - RNA, 21 nt, Human herpesvirus 6B
uaaagucgcuucgaauguuga

SEQ ID NO: 3993054 - RNA, 14 nt, Human herpesvirus 6B
uaaaguuuugugau

SEQ ID NO: 3993055 - RNA, 18 nt, Human herpesvirus 6B
uaaaucaaaaaaaugaua

SEQ ID NO: 3993056 - RNA, 21 nt, Human herpesvirus 6B
uaaauccuagaguuguuuuua

SEQ ID NO: 3993057 - RNA, 12 nt, Human herpesvirus 6B
uaaaucugaaau

SEQ ID NO: 3993058 - RNA, 13 nt, Human herpesvirus 6B
uaaauggacggcg

SEQ ID NO: 3993059 - RNA, 21 nt, Human herpesvirus 6B
uaacauagaaaaauaagacuu

SEQ ID NO: 3993060 - RNA, 23 nt, Human herpesvirus 6B
uaaccggcgagguuaagaugucg

SEQ ID NO: 3993061 - RNA, 12 nt, Human herpesvirus 6B
uaaccuucugau

SEQ ID NO: 3993062 - RNA, 13 nt, Human herpesvirus 6B
uaacgcgguauau

SEQ ID NO: 3993063 - RNA, 20 nt, Human herpesvirus 6B
uaacucuuggauugcagaua

SEQ ID NO: 3993064 - RNA, 18 nt, Human herpesvirus 6B
uaagaaaaccgaaaacac

SEQ ID NO: 3993065 - RNA, 20 nt, Human herpesvirus 6B
uaagagauuuacuguuucuu

SEQ ID NO: 3993066 - RNA, 19 nt, Human herpesvirus 6B
uaaggaagaucgcuuuucu

SEQ ID NO: 3993067 - RNA, 23 nt, Human herpesvirus 6B
uaauaaaaacgaaacucuagaau

SEQ ID NO: 3993068 - RNA, 11 nt, Human herpesvirus 6B
uaauauuugca

SEQ ID NO: 3993069 - RNA, 17 nt, Human herpesvirus 6B
uaauccauauuuggaag

SEQ ID NO: 3993070 - RNA, 14 nt, Human herpesvirus 6B
uaaugaauuucaau

SEQ ID NO: 3993071 - RNA, 13 nt, Human herpesvirus 6B
uaaugcaaagaug

SEQ ID NO: 3993072 - RNA, 12 nt, Human herpesvirus 6B
uaaugccacagg

SEQ ID NO: 3993073 - RNA, 14 nt, Human herpesvirus 6B
uaauggagagaaau

SEQ ID NO: 3993074 - RNA, 17 nt, Human herpesvirus 6B
uaauggagagaaauucu

SEQ ID NO: 3993075 - RNA, 15 nt, Human herpesvirus 6B
uaauuacauuaucca

SEQ ID NO: 3993076 - RNA, 12 nt, Human herpesvirus 6B
uaauuuacuguc

SEQ ID NO: 3993077 - RNA, 21 nt, Human herpesvirus 6B
uaauuuuuuguuucugaaaau

SEQ ID NO: 3993078 - RNA, 21 nt, Human herpesvirus 6B
uacaagggcuuggggcuauag

SEQ ID NO: 3993079 - RNA, 15 nt, Human herpesvirus 6B
ucgaaacgaaagcug

SEQ ID NO: 3993080 - RNA, 19 nt, Human herpesvirus 6B
ucgaagacauucaacauuc

SEQ ID NO: 3993081 - RNA, 17 nt, Human herpesvirus 6B
ucgauaaggcucucgug

SEQ ID NO: 3993082 - RNA, 21 nt, Human herpesvirus 6B
ucgauacaacgugugaaaacu

SEQ ID NO: 3993083 - RNA, 15 nt, Human herpesvirus 6B
ucgauccaaaagauu

SEQ ID NO: 3993084 - RNA, 17 nt, Human herpesvirus 6B
ucgauuaaugccacagg

SEQ ID NO: 3993085 - RNA, 21 nt, Human herpesvirus 6B
ucgcaagaaaagaaaaaacag

SEQ ID NO: 3993086 - RNA, 20 nt, Human herpesvirus 6B
ucgcaagcccggagaacuga

SEQ ID NO: 3993087 - RNA, 19 nt, Human herpesvirus 6B
ucgcagaaucaagaaacac

SEQ ID NO: 3993088 - RNA, 16 nt, Human herpesvirus 6B
ucgcauggaauucaug

SEQ ID NO: 3993089 - RNA, 18 nt, Human herpesvirus 6B
ucgccauagugaaagagu

SEQ ID NO: 3993090 - RNA, 20 nt, Human herpesvirus 6B
ucggaugguauaauguaaaa

SEQ ID NO: 3993091 - RNA, 17 nt, Human herpesvirus 6B
ucggcauuuguguuuuu

SEQ ID NO: 3993092 - RNA, 21 nt, Human herpesvirus 6B
ucgggccuggggacagacagg

SEQ ID NO: 3993093 - RNA, 15 nt, Human herpesvirus 6B
ucgguaaacuucaga

SEQ ID NO: 3993094 - RNA, 13 nt, Human herpesvirus 6B
ucgucauuccagu

SEQ ID NO: 3993095 - RNA, 13 nt, Human herpesvirus 6B
ucguccuccgcaa

SEQ ID NO: 3993096 - RNA, 21 nt, Human herpesvirus 6B
ucgugcgaaaaaacaguuucc

SEQ ID NO: 3993097 - RNA, 18 nt, Human herpesvirus 6B
ucgugggaauuauauguu

SEQ ID NO: 3993098 - RNA, 16 nt, Human herpesvirus 6B
ucguucuuaacauauu

SEQ ID NO: 3993099 - RNA, 13 nt, Human herpesvirus 6B
ucguucuuugcac

SEQ ID NO: 3993100 - RNA, 13 nt, Human herpesvirus 6B
ucguugcagaccg

SEQ ID NO: 3993101 - RNA, 23 nt, Human herpesvirus 6B
ucuaaauggcucguucagcagua

SEQ ID NO: 3993102 - RNA, 20 nt, Human herpesvirus 6B
ucuaacuacauuuuaguauu

SEQ ID NO: 3993103 - RNA, 18 nt, Human herpesvirus 6B
ucuaaucaagaaaccugu

SEQ ID NO: 3993104 - RNA, 19 nt, Human herpesvirus 6B
ucuaauuauaaauguagca

SEQ ID NO: 3993105 - RNA, 16 nt, Human herpesvirus 6B
ucuacccaccuguccu

SEQ ID NO: 3993106 - RNA, 15 nt, Human herpesvirus 6B
ucuagaugaaagagg

SEQ ID NO: 3993107 - RNA, 20 nt, Human herpesvirus 6B
ucuauauaaaucggguaaau

SEQ ID NO: 3993108 - RNA, 15 nt, Human herpesvirus 6B
ucuaugagacuguuu

SEQ ID NO: 3993109 - RNA, 13 nt, Human herpesvirus 6B
ucuauucaggaau

SEQ ID NO: 3993110 - RNA, 14 nt, Human herpesvirus 6B
ucuccggcgucacu

SEQ ID NO: 3993111 - RNA, 22 nt, Human herpesvirus 6B
ucucgauugugauguacguggc

SEQ ID NO: 3993112 - RNA, 15 nt, Human herpesvirus 6B
ucucuaaucaagaaa

SEQ ID NO: 3993113 - RNA, 13 nt, Human herpesvirus 6B
ucucuacaucacc

SEQ ID NO: 3993114 - RNA, 15 nt, Human herpesvirus 6B
ucucuacguuuacau

SEQ ID NO: 3993115 - RNA, 18 nt, Human herpesvirus 6B
ucucuauaaccaccugca

SEQ ID NO: 3993116 - RNA, 14 nt, Human herpesvirus 6B
ucugagacagucaa

SEQ ID NO: 3993117 - RNA, 16 nt, Human herpesvirus 6B
ucugauaaacuccaaa

SEQ ID NO: 3993118 - RNA, 15 nt, Human herpesvirus 6B
ucugcauuuauauca

SEQ ID NO: 3993119 - RNA, 16 nt, Human herpesvirus 6B
ucuggugaauguuucu

SEQ ID NO: 3993120 - RNA, 12 nt, Human herpesvirus 6B
ucuggugagaaa

SEQ ID NO: 3993121 - RNA, 16 nt, Human herpesvirus 6B
ucuggugagaaagacu

SEQ ID NO: 3993122 - RNA, 13 nt, Human herpesvirus 6B
ucuguaaaaggau

SEQ ID NO: 3993123 - RNA, 21 nt, Human herpesvirus 6B
ucuguggcauauuuaaaccag

SEQ ID NO: 3993124 - RNA, 13 nt, Human herpesvirus 6B
ucuguuaauuccu

SEQ ID NO: 3993125 - RNA, 17 nt, Human herpesvirus 6B
ucuuacuuuguggaaau

SEQ ID NO: 3993126 - RNA, 13 nt, Human herpesvirus 6B
ucuuccuucucgu

SEQ ID NO: 3993127 - RNA, 23 nt, Human herpesvirus 6B
ucuucuacuuuaucuuuugcaaa

SEQ ID NO: 3993128 - RNA, 11 nt, Human herpesvirus 6B
ucuugcaagaa

SEQ ID NO: 3993129 - RNA, 23 nt, Human herpesvirus 6B
ucuuuauagagcaauucaucaaa

SEQ ID NO: 3993130 - RNA, 16 nt, Human herpesvirus 6B
ucuuugaugaagaggu

SEQ ID NO: 3993131 - RNA, 18 nt, Human herpesvirus 6B
ucuuuuacguuaaaaggg

SEQ ID NO: 3993132 - RNA, 16 nt, Human herpesvirus 6B
ugaaaaacagaauaag

SEQ ID NO: 3993133 - RNA, 14 nt, Human herpesvirus 6B
ugaaauaaaguuua

SEQ ID NO: 3993134 - RNA, 16 nt, Human herpesvirus 6B
ugaaaucacuccgcau

SEQ ID NO: 3993135 - RNA, 19 nt, Human herpesvirus 6B
ugaaaucucuuuuaacaca

SEQ ID NO: 3993136 - RNA, 17 nt, Human herpesvirus 6B
ugaaaucuuuccugcua

SEQ ID NO: 3993137 - RNA, 16 nt, Human herpesvirus 6B
ugaacaaguggaagug

SEQ ID NO: 3993138 - RNA, 24 nt, Human herpesvirus 6B
ugaacaucuauuaucauuuaugca

SEQ ID NO: 3993139 - RNA, 23 nt, Human herpesvirus 6B
ugaacauguuuuugauguuuuca

SEQ ID NO: 3993140 - RNA, 17 nt, Human herpesvirus 6B
ugaacucucacggccau

SEQ ID NO: 3993141 - RNA, 13 nt, Human herpesvirus 6B
ugaaggcuacuau

SEQ ID NO: 3993142 - RNA, 20 nt, Human herpesvirus 6B
ugaauaucuuuauaaaucau

SEQ ID NO: 3993143 - RNA, 21 nt, Human herpesvirus 6B
ugaauccagauaaacaaaaau

SEQ ID NO: 3993144 - RNA, 22 nt, Human herpesvirus 6B
ugaaugcuuaccgccuccgcag

SEQ ID NO: 3993145 - RNA, 23 nt, Human herpesvirus 6B
ugaauggaguaaauuaaaguuua

SEQ ID NO: 3993146 - RNA, 15 nt, Human herpesvirus 6B
ugacaaguagagaga

SEQ ID NO: 3993147 - RNA, 13 nt, Human herpesvirus 6B
ugacagaaaucuu

SEQ ID NO: 3993148 - RNA, 14 nt, Human herpesvirus 6B
ugaccagagauucu

SEQ ID NO: 3993149 - RNA, 18 nt, Human herpesvirus 6B
ugaccgaauuauguaugu

SEQ ID NO: 3993150 - RNA, 15 nt, Human herpesvirus 6B
ugacgccugugugcc

SEQ ID NO: 3993151 - RNA, 18 nt, Human herpesvirus 6B
ugacggacuuggaaaagg

SEQ ID NO: 3993152 - RNA, 21 nt, Human herpesvirus 6B
ugacguuuagcuuugugaacu

SEQ ID NO: 3993153 - RNA, 20 nt, Human herpesvirus 6B
ugacugcguuacaagcaugc

SEQ ID NO: 3993154 - RNA, 19 nt, Human herpesvirus 6B
ugacugugaaaagugcuuu

SEQ ID NO: 3993155 - RNA, 15 nt, Human herpesvirus 6B
ugacuuuucugauga

SEQ ID NO: 3993156 - RNA, 16 nt, Human herpesvirus 6B
ugagacauuugauguu

SEQ ID NO: 3993157 - RNA, 18 nt, Human herpesvirus 6B
ugagagcaggagcaggcu

SEQ ID NO: 3993158 - RNA, 13 nt, Human herpesvirus 6B
ugagauacauguu

SEQ ID NO: 3993159 - RNA, 13 nt, Human herpesvirus 6B
ugaggauggauuc

SEQ ID NO: 3993160 - RNA, 16 nt, Human herpesvirus 6B
ugauaaguugucauug

SEQ ID NO: 3993161 - RNA, 23 nt, Human herpesvirus 6B
ugauacuacguguaauguuuccu

SEQ ID NO: 3993162 - RNA, 22 nt, Human herpesvirus 6B
ugauaugcuuuuuuuuguggau

SEQ ID NO: 3993163 - RNA, 15 nt, Human herpesvirus 6B
ugauauggagcagau

SEQ ID NO: 3993164 - RNA, 12 nt, Human herpesvirus 6B
ggcgccucccau

SEQ ID NO: 3993165 - RNA, 22 nt, Human herpesvirus 6B
ggcgcgaaaaggggucggauuu

SEQ ID NO: 3993166 - RNA, 13 nt, Human herpesvirus 6B
ggcgcgggacagc

SEQ ID NO: 3993167 - RNA, 16 nt, Human herpesvirus 6B
ggcgggcacggagaac

SEQ ID NO: 3993168 - RNA, 20 nt, Human herpesvirus 6B
ggcgggcggacggcucgucu

SEQ ID NO: 3993169 - RNA, 16 nt, Human herpesvirus 6B
ggcuccccaggcgcag

SEQ ID NO: 3993170 - RNA, 21 nt, Human herpesvirus 6B
ggcugauauacgauggacaga

SEQ ID NO: 3993171 - RNA, 22 nt, Human herpesvirus 6B
gggaagaucuaugagaauuaug

SEQ ID NO: 3993172 - RNA, 20 nt, Human herpesvirus 6B
gggacggacagagcggagag

SEQ ID NO: 3993173 - RNA, 13 nt, Human herpesvirus 6B
gggacggagagga

SEQ ID NO: 3993174 - RNA, 15 nt, Human herpesvirus 6B
gggacuuauuucauu

SEQ ID NO: 3993175 - RNA, 19 nt, Human herpesvirus 6B
gggagccguggugcgccug

SEQ ID NO: 3993176 - RNA, 18 nt, Human herpesvirus 6B
gggagcggcgcacggguu

SEQ ID NO: 3993177 - RNA, 22 nt, Human herpesvirus 6B
ggggacggacagagcggagagg

SEQ ID NO: 3993178 - RNA, 20 nt, Human herpesvirus 6B
ggggagguuuuuucaccccc

SEQ ID NO: 3993179 - RNA, 17 nt, Human herpesvirus 6B
ggggaucgacgaccagg

SEQ ID NO: 3993180 - RNA, 22 nt, Human herpesvirus 6B
ggggcgucgggcgacgggcagg

SEQ ID NO: 3993181 - RNA, 20 nt, Human herpesvirus 6B
gggucgucgaugcgaaggga

SEQ ID NO: 3993182 - RNA, 21 nt, Human herpesvirus 6B
gggugaucauaggacagagga

SEQ ID NO: 3993183 - RNA, 14 nt, Human herpesvirus 6B
ggguguauguuucu

SEQ ID NO: 3993184 - RNA, 12 nt, Human herpesvirus 6B
ggguguggccgg

SEQ ID NO: 3993185 - RNA, 17 nt, Human herpesvirus 6B
ggucgaacccugagacc

SEQ ID NO: 3993186 - RNA, 15 nt, Human herpesvirus 6B
ggucuuuuugccaaa

SEQ ID NO: 3993187 - RNA, 23 nt, Human herpesvirus 6B
gguguccucguccguccccgccg

SEQ ID NO: 3993188 - RNA, 13 nt, Human herpesvirus 6B
gguguggccggca

SEQ ID NO: 3993189 - RNA, 15 nt, Human herpesvirus 6B
gguuagaucugggga

SEQ ID NO: 3993190 - RNA, 15 nt, Human herpesvirus 6B
gguucagacugcugc

SEQ ID NO: 3993191 - RNA, 22 nt, Human herpesvirus 6B
gguugagaaaacaugacggacu

SEQ ID NO: 3993192 - RNA, 18 nt, Human herpesvirus 6B
gguugucagauuucccaa

SEQ ID NO: 3993193 - RNA, 14 nt, Human herpesvirus 6B
gguuuucagacaug

SEQ ID NO: 3993194 - RNA, 17 nt, Human herpesvirus 6B
gguuuuucgauguuucc

SEQ ID NO: 3993195 - RNA, 15 nt, Human herpesvirus 6B
gguuuuugcugucac

SEQ ID NO: 3993196 - RNA, 12 nt, Human herpesvirus 6B
guaaaagggcuc

SEQ ID NO: 3993197 - RNA, 17 nt, Human herpesvirus 6B
guaaacuguucuuucaa

SEQ ID NO: 3993198 - RNA, 18 nt, Human herpesvirus 6B
guaaauuuguaucucaga

SEQ ID NO: 3993199 - RNA, 13 nt, Human herpesvirus 6B
guaacaccagaga

SEQ ID NO: 3993200 - RNA, 13 nt, Human herpesvirus 6B
guaaggcuuagga

SEQ ID NO: 3993201 - RNA, 19 nt, Human herpesvirus 6B
guaaucguuuuugauugua

SEQ ID NO: 3993202 - RNA, 20 nt, Human herpesvirus 6B
guaaucucuagguaaacuuc

SEQ ID NO: 3993203 - RNA, 20 nt, Human herpesvirus 6B
guaaugcguacacugaaauu

SEQ ID NO: 3993204 - RNA, 15 nt, Human herpesvirus 6B
guaauuauugugaca

SEQ ID NO: 3993205 - RNA, 12 nt, Human herpesvirus 6B
guaauuguuaac

SEQ ID NO: 3993206 - RNA, 18 nt, Human herpesvirus 6B
guaccccaagugaaauuc

SEQ ID NO: 3993207 - RNA, 22 nt, Human herpesvirus 6B
guaccccggcuuucucgccgcc

SEQ ID NO: 3993208 - RNA, 17 nt, Human herpesvirus 6B
guaccgcgguugaaguc

SEQ ID NO: 3993209 - RNA, 21 nt, Human herpesvirus 6B
guacguggccgucuccugcaa

SEQ ID NO: 3993210 - RNA, 18 nt, Human herpesvirus 6B
guacuacguguugcuuuu

SEQ ID NO: 3993211 - RNA, 14 nt, Human herpesvirus 6B
guaguugaugcugu

SEQ ID NO: 3993212 - RNA, 13 nt, Human herpesvirus 6B
guauaagaaagac

SEQ ID NO: 3993213 - RNA, 15 nt, Human herpesvirus 6B
guauaauauaaauuc

SEQ ID NO: 3993214 - RNA, 19 nt, Human herpesvirus 6B
guauucgaaaaauauuuua

SEQ ID NO: 3993215 - RNA, 13 nt, Human herpesvirus 6B
guauucuacggga

SEQ ID NO: 3993216 - RNA, 15 nt, Human herpesvirus 6B
gucacacgucccuuc

SEQ ID NO: 3993217 - RNA, 23 nt, Human herpesvirus 6B
gucacgcggaccgacgacaaagg

SEQ ID NO: 3993218 - RNA, 16 nt, Human herpesvirus 6B
gucacucacauagaga

SEQ ID NO: 3993219 - RNA, 15 nt, Human herpesvirus 6B
gucauggaaaaauga

SEQ ID NO: 3993220 - RNA, 19 nt, Human herpesvirus 6B
gucccaacuuguuuucugu

SEQ ID NO: 3993221 - RNA, 19 nt, Human herpesvirus 6B
guccgcgaugcgccacagg

SEQ ID NO: 3993222 - RNA, 18 nt, Human herpesvirus 6B
guccgugacacacagaau

SEQ ID NO: 3993223 - RNA, 17 nt, Human herpesvirus 6B
gucgcagaaucaagaaa

SEQ ID NO: 3993224 - RNA, 21 nt, Human herpesvirus 6B
gucuccgauccgucaggacca

SEQ ID NO: 3993225 - RNA, 18 nt, Human herpesvirus 6B
gucuccugcaauuugaau

SEQ ID NO: 3993226 - RNA, 13 nt, Human herpesvirus 6B
gucuucugugcuu

SEQ ID NO: 3993227 - RNA, 17 nt, Human herpesvirus 6B
gucuugcaaacagcuuu

SEQ ID NO: 3993228 - RNA, 23 nt, Human herpesvirus 6B
gucuugcaaacagcuuuauuccc

SEQ ID NO: 3993229 - RNA, 11 nt, Human herpesvirus 6B
gucuuuccugu

SEQ ID NO: 3993230 - RNA, 21 nt, Human herpesvirus 6B
gucuuugaucuuacuuaaccu

SEQ ID NO: 3993231 - RNA, 13 nt, Human herpesvirus 6B
gucuuugcuuugg

SEQ ID NO: 3993232 - RNA, 13 nt, Human herpesvirus 6B
gugaaaagugcuu

SEQ ID NO: 3993233 - RNA, 18 nt, Human herpesvirus 6B
gugaaacucgggggcagu

SEQ ID NO: 3993234 - RNA, 17 nt, Human herpesvirus 6B
gugaaccuuauguucau

SEQ ID NO: 3993235 - RNA, 18 nt, Human herpesvirus 6B
gugaauugugcaagcugu

SEQ ID NO: 3993236 - RNA, 21 nt, Human herpesvirus 6B
gugaggugauuugaacagaga

SEQ ID NO: 3993237 - RNA, 22 nt, Human herpesvirus 6B
gugaggugauuugaacagagau

SEQ ID NO: 3993238 - RNA, 19 nt, Human herpesvirus 6B
gugauaaaucuaccugccg

SEQ ID NO: 3993239 - RNA, 15 nt, Human herpesvirus 6B
gugaucguggacagu

SEQ ID NO: 3993240 - RNA, 21 nt, Human herpesvirus 6B
gugcaacaaagagcuuuaaag

SEQ ID NO: 3993241 - RNA, 18 nt, Human herpesvirus 6B
gugcaccgagaaauagug

SEQ ID NO: 3993242 - RNA, 18 nt, Human herpesvirus 6B
gugcaguaucuggcuggu

SEQ ID NO: 3993243 - RNA, 13 nt, Human herpesvirus 6B
gugccguggcaga

SEQ ID NO: 3993244 - RNA, 20 nt, Human herpesvirus 6B
gugcguacacggccacccgc

SEQ ID NO: 3993245 - RNA, 23 nt, Human herpesvirus 6B
gugcuuuggaccuugaauguuua

SEQ ID NO: 3993246 - RNA, 21 nt, Human herpesvirus 6B
guggaaacgguuucaaagagu

SEQ ID NO: 3993247 - RNA, 22 nt, Human herpesvirus 6B
guggaaaucuauuaauuuugaa

SEQ ID NO: 3993248 - RNA, 22 nt, Human herpesvirus 6B
guggcaccgaauccggaauuua

SEQ ID NO: 3993249 - RNA, 13 nt, Human herpesvirus 6B
guggcagaagaag

SEQ ID NO: 3993250 - RNA, 22 nt, Human herpesvirus 6B
guggcgcgcguuuuuggugaaa

SEQ ID NO: 3993251 - RNA, 18 nt, Human herpesvirus 6B
gugggcgguagguucacu

SEQ ID NO: 3993252 - RNA, 22 nt, Human herpesvirus 6B
gugguaauacgugaauuucaua

SEQ ID NO: 3993253 - RNA, 18 nt, Human herpesvirus 6B
gugguggccgucugucug

SEQ ID NO: 3993254 - RNA, 15 nt, Human herpesvirus 6B
guguccugagaauga

SEQ ID NO: 3993255 - RNA, 13 nt, Human herpesvirus 6B
guguggcagcaau

SEQ ID NO: 3993256 - RNA, 21 nt, Human herpesvirus 6B
guguuauaacagacauaugca

SEQ ID NO: 3993257 - RNA, 12 nt, Human herpesvirus 6B
guguugaagaac

SEQ ID NO: 3993258 - RNA, 16 nt, Human herpesvirus 6B
guguuguguuugaaac

SEQ ID NO: 3993259 - RNA, 21 nt, Human herpesvirus 6B
guuaaaguccuaucugaguug

SEQ ID NO: 3993260 - RNA, 16 nt, Human herpesvirus 6B
guuaauggagagaaau

SEQ ID NO: 3993261 - RNA, 11 nt, Human herpesvirus 6B
guuaauguuua

SEQ ID NO: 3993262 - RNA, 19 nt, Human herpesvirus 6B
guuaauuccaagaugcagu

SEQ ID NO: 3993263 - RNA, 22 nt, Human herpesvirus 6B
guuacaagcaugcauuguguua

SEQ ID NO: 3993264 - RNA, 12 nt, Human herpesvirus 6B
guuacaguaaaa

SEQ ID NO: 3993265 - RNA, 20 nt, Human herpesvirus 6B
guuagauaaugagauucugu

SEQ ID NO: 3993266 - RNA, 14 nt, Human herpesvirus 6B
guuaggaucagaca

SEQ ID NO: 3993267 - RNA, 12 nt, Human herpesvirus 6B
guuauaugaaug

SEQ ID NO: 3993268 - RNA, 22 nt, Human herpesvirus 6B
guuauuguguucugcucugugu

SEQ ID NO: 3993269 - RNA, 15 nt, Human herpesvirus 6B
guuccaugugucucc

SEQ ID NO: 3993270 - RNA, 18 nt, Human herpesvirus 6B
guucgcgagucugugcuu

SEQ ID NO: 3993271 - RNA, 13 nt, Human herpesvirus 6B
guucuugagcagg

SEQ ID NO: 3993272 - RNA, 22 nt, Human herpesvirus 6B
guucuuucaaaaugaccagaga

SEQ ID NO: 3993273 - RNA, 21 nt, Human herpesvirus 6B
guugccuuuguaaaauguuuc

SEQ ID NO: 3993274 - RNA, 16 nt, Human herpesvirus 6B
guugcgguuucggaaa

SEQ ID NO: 3993275 - RNA, 15 nt, Human herpesvirus 6B
guuguguuuguggac

SEQ ID NO: 3993276 - RNA, 22 nt, Human herpesvirus 6B
guuuaaagugaguuuuggaaau

SEQ ID NO: 3993277 - RNA, 21 nt, Human herpesvirus 6B
guuuagggucgaacccugaga

SEQ ID NO: 3993278 - RNA, 15 nt, Human herpesvirus 6B
guuucuacugcugcu

SEQ ID NO: 3993279 - RNA, 20 nt, Human herpesvirus 6B
aauguuuccaugacugugag

SEQ ID NO: 3993280 - RNA, 13 nt, Human herpesvirus 6B
aauuauaaaugua

SEQ ID NO: 3993281 - RNA, 20 nt, Human herpesvirus 6B
aauucaugccgccugaaacc

SEQ ID NO: 3993282 - RNA, 20 nt, Human herpesvirus 6B
aauucucugauugauccugu

SEQ ID NO: 3993283 - RNA, 15 nt, Human herpesvirus 6B
aauucuuaccaagaa

SEQ ID NO: 3993284 - RNA, 21 nt, Human herpesvirus 6B
aauucuuaccuuuuaagagug

SEQ ID NO: 3993285 - RNA, 16 nt, Human herpesvirus 6B
aauugacaaucuugga

SEQ ID NO: 3993286 - RNA, 13 nt, Human herpesvirus 6B
aauugugucuuug

SEQ ID NO: 3993287 - RNA, 22 nt, Human herpesvirus 6B
aauuuguucgcacaaaaugauu

SEQ ID NO: 3993288 - RNA, 23 nt, Human herpesvirus 6B
aauuuuauugacugugaaaagug

SEQ ID NO: 3993289 - RNA, 16 nt, Human herpesvirus 6B
aauuuuuuguuucuga

SEQ ID NO: 3993290 - RNA, 13 nt, Human herpesvirus 6B
acaaaaccaggaa

SEQ ID NO: 3993291 - RNA, 20 nt, Human herpesvirus 6B
acaaaauuuuuuauggucug

SEQ ID NO: 3993292 - RNA, 11 nt, Human herpesvirus 6B
acaaagguuuu

SEQ ID NO: 3993293 - RNA, 15 nt, Human herpesvirus 6B
acaaauaaaaaauuc

SEQ ID NO: 3993294 - RNA, 22 nt, Human herpesvirus 6B
acaaccaaacaguuucagauga

SEQ ID NO: 3993295 - RNA, 18 nt, Human herpesvirus 6B
acaacgguguggagacac

SEQ ID NO: 3993296 - RNA, 23 nt, Human herpesvirus 6B
acaacugccgccauauuaaaacc

SEQ ID NO: 3993297 - RNA, 15 nt, Human herpesvirus 6B
acaagcuuaauaagu

SEQ ID NO: 3993298 - RNA, 15 nt, Human herpesvirus 6B
acaagggcuuggggc

SEQ ID NO: 3993299 - RNA, 20 nt, Human herpesvirus 6B
acaaguacuacguguugcuu

SEQ ID NO: 3993300 - RNA, 16 nt, Human herpesvirus 6B
acaauaauuacuccca

SEQ ID NO: 3993301 - RNA, 21 nt, Human herpesvirus 6B
acaaugcaugucgaacagcuu

SEQ ID NO: 3993302 - RNA, 21 nt, Human herpesvirus 6B
acaccaucuucagcucagaca

SEQ ID NO: 3993303 - RNA, 21 nt, Human herpesvirus 6B
acaccucguagcgaucuuuua

SEQ ID NO: 3993304 - RNA, 19 nt, Human herpesvirus 6B
acacguuauuuauuuaacg

SEQ ID NO: 3993305 - RNA, 13 nt, Human herpesvirus 6B
acacguuuaucca

SEQ ID NO: 3993306 - RNA, 14 nt, Human herpesvirus 6B
acacuggcgaaggc

SEQ ID NO: 3993307 - RNA, 23 nt, Human herpesvirus 6B
acagaaaaaacaccagaagagcc

SEQ ID NO: 3993308 - RNA, 15 nt, Human herpesvirus 6B
acagaaaaagaacug

SEQ ID NO: 3993309 - RNA, 13 nt, Human herpesvirus 6B
acagaaaauuuca

SEQ ID NO: 3993310 - RNA, 18 nt, Human herpesvirus 6B
acagaaucuucuuugugc

SEQ ID NO: 3993311 - RNA, 15 nt, Human herpesvirus 6B
acagacagggggauc

SEQ ID NO: 3993312 - RNA, 21 nt, Human herpesvirus 6B
acaguauaaauucuuuugugc

SEQ ID NO: 3993313 - RNA, 17 nt, Human herpesvirus 6B
acaguucguccagcagc

SEQ ID NO: 3993314 - RNA, 14 nt, Human herpesvirus 6B
acauagaaucucca

SEQ ID NO: 3993315 - RNA, 17 nt, Human herpesvirus 6B
acauccaaaauacacua

SEQ ID NO: 3993316 - RNA, 14 nt, Human herpesvirus 6B
acaucgcuccauaa

SEQ ID NO: 3993317 - RNA, 23 nt, Human herpesvirus 6B
acaucgugaguuuucaugugaaa

SEQ ID NO: 3993318 - RNA, 13 nt, Human herpesvirus 6B
acaucuaugaugc

SEQ ID NO: 3993319 - RNA, 22 nt, Human herpesvirus 6B
acaugcaacccgccacucuaca

SEQ ID NO: 3993320 - RNA, 20 nt, Human herpesvirus 6B
acauguuuuugauguuuuca

SEQ ID NO: 3993321 - RNA, 20 nt, Human herpesvirus 6B
acauuucgguuuaauagauu

SEQ ID NO: 3993322 - RNA, 20 nt, Human herpesvirus 6B
accaaacaguuucagaugau

SEQ ID NO: 3993323 - RNA, 16 nt, Human herpesvirus 6B
accaaauuuuuaacuc

SEQ ID NO: 3993324 - RNA, 13 nt, Human herpesvirus 6B
accaagaaaucac

SEQ ID NO: 3993325 - RNA, 18 nt, Human herpesvirus 6B
accagcucuguucucucc

SEQ ID NO: 3993326 - RNA, 16 nt, Human herpesvirus 6B
accaucuauuugcaag

SEQ ID NO: 3993327 - RNA, 22 nt, Human herpesvirus 6B
acccaauggcggacaaaaauuc

SEQ ID NO: 3993328 - RNA, 14 nt, Human herpesvirus 6B
accccccucuugca

SEQ ID NO: 3993329 - RNA, 19 nt, Human herpesvirus 6B
accccccucuugcaguggc

SEQ ID NO: 3993330 - RNA, 21 nt, Human herpesvirus 6B
accggagcuuauuuaugaaaa

SEQ ID NO: 3993331 - RNA, 14 nt, Human herpesvirus 6B
accucgcucuccug

SEQ ID NO: 3993332 - RNA, 21 nt, Human herpesvirus 6B
accucgcucuccugugcgucc

SEQ ID NO: 3993333 - RNA, 18 nt, Human herpesvirus 6B
accugcuaacggagcaac

SEQ ID NO: 3993334 - RNA, 23 nt, Human herpesvirus 6B
accugcuaacggagcaaccgcag

SEQ ID NO: 3993335 - RNA, 14 nt, Human herpesvirus 6B
accuggcgcaccgc

SEQ ID NO: 3993336 - RNA, 18 nt, Human herpesvirus 6B
acgaaagacguuugcuuu

SEQ ID NO: 3993337 - RNA, 22 nt, Human herpesvirus 6B
acgaaagacguuugcuuuuuua

SEQ ID NO: 3993338 - RNA, 22 nt, Human herpesvirus 6B
acgacaucaaugcgcuaugcca

SEQ ID NO: 3993339 - RNA, 20 nt, Human herpesvirus 6B
acgaggauuuuuucugccug

SEQ ID NO: 3993340 - RNA, 22 nt, Human herpesvirus 6B
acgauuuucuauuaaaaagacu

SEQ ID NO: 3993341 - RNA, 17 nt, Human herpesvirus 6B
acgccauacgggaaaag

SEQ ID NO: 3993342 - RNA, 15 nt, Human herpesvirus 6B
acgcccccaccuggc

SEQ ID NO: 3993343 - RNA, 22 nt, Human herpesvirus 6B
acgcgcggaccacucgggccgg

SEQ ID NO: 3993344 - RNA, 22 nt, Human herpesvirus 6B
acggaauauauagaagaagaaa

SEQ ID NO: 3993345 - RNA, 16 nt, Human herpesvirus 6B
acggauugacacaaug

SEQ ID NO: 3993346 - RNA, 12 nt, Human herpesvirus 6B
acggcaggagca

SEQ ID NO: 3993347 - RNA, 22 nt, Human herpesvirus 6B
acggcgaggggacggacagagc

SEQ ID NO: 3993348 - RNA, 14 nt, Human herpesvirus 6B
acggcgccucccau

SEQ ID NO: 3993349 - RNA, 12 nt, Human herpesvirus 6B
acgggauaaaga

SEQ ID NO: 3993350 - RNA, 11 nt, Human herpesvirus 6B
acgggcagggc

SEQ ID NO: 3993351 - RNA, 12 nt, Human herpesvirus 6B
acgggcagggcg

SEQ ID NO: 3993352 - RNA, 16 nt, Human herpesvirus 6B
acggugauguugcgau

SEQ ID NO: 3993353 - RNA, 20 nt, Human herpesvirus 6B
acgucauauccagaaaauac

SEQ ID NO: 3993354 - RNA, 20 nt, Human herpesvirus 6B
acguccgugaugauucaaua

SEQ ID NO: 3993355 - RNA, 13 nt, Human herpesvirus 6B
acgucugcguugc

SEQ ID NO: 3993356 - RNA, 21 nt, Human herpesvirus 6B
acgucugcguugcccucccgc

SEQ ID NO: 3993357 - RNA, 16 nt, Human herpesvirus 6B
acgucuuuggacugaa

SEQ ID NO: 3993358 - RNA, 11 nt, Human herpesvirus 6B
acguuaaaagg

SEQ ID NO: 3993359 - RNA, 20 nt, Human herpesvirus 6B
acguugggauugcugcuuga

SEQ ID NO: 3993360 - RNA, 18 nt, Human herpesvirus 6B
acuacagcuaagauuaac

SEQ ID NO: 3993361 - RNA, 19 nt, Human herpesvirus 6B
acuacauccuuuagaauac

SEQ ID NO: 3993362 - RNA, 22 nt, Human herpesvirus 6B
acuacauuuuaguauuuaugcu

SEQ ID NO: 3993363 - RNA, 18 nt, Human herpesvirus 6B
acucauuugcaauuguuu

SEQ ID NO: 3993364 - RNA, 18 nt, Human herpesvirus 6B
acuccgagccggacagga

SEQ ID NO: 3993365 - RNA, 15 nt, Human herpesvirus 6B
acucgcaagaacuag

SEQ ID NO: 3993366 - RNA, 20 nt, Human herpesvirus 6B
acucgcuuacgaucuuuacg

SEQ ID NO: 3993367 - RNA, 12 nt, Human herpesvirus 6B
acucucuuucag

SEQ ID NO: 3993368 - RNA, 21 nt, Human herpesvirus 6B
acucugcaacuuuauuugaaa

SEQ ID NO: 3993369 - RNA, 21 nt, Human herpesvirus 6B
acugcaugcuaauaaaauaua

SEQ ID NO: 3993370 - RNA, 20 nt, Human herpesvirus 6B
acugccgcaucgcaccgcag

SEQ ID NO: 3993371 - RNA, 16 nt, Human herpesvirus 6B
gagccggacaggaggu

SEQ ID NO: 3993372 - RNA, 17 nt, Human herpesvirus 6B
gagccuuuaaccauguu

SEQ ID NO: 3993373 - RNA, 19 nt, Human herpesvirus 6B
gagccuuuaaccauguuuu

SEQ ID NO: 3993374 - RNA, 20 nt, Human herpesvirus 6B
gagcggagaggcgcgggaca

SEQ ID NO: 3993375 - RNA, 19 nt, Human herpesvirus 6B
gaggaaacgcgcugggacu

SEQ ID NO: 3993376 - RNA, 16 nt, Human herpesvirus 6B
gaggaaaugcagcagu

SEQ ID NO: 3993377 - RNA, 18 nt, Human herpesvirus 6B
gaggacgcaaagagagac

SEQ ID NO: 3993378 - RNA, 14 nt, Human herpesvirus 6B
gaggaugcuuugcu

SEQ ID NO: 3993379 - RNA, 13 nt, Human herpesvirus 6B
gaggcccagaggu

SEQ ID NO: 3993380 - RNA, 21 nt, Human herpesvirus 6B
gaggugauugcuucauuucug

SEQ ID NO: 3993381 - RNA, 14 nt, Human herpesvirus 6B
gagguuuuuucacc

SEQ ID NO: 3993382 - RNA, 22 nt, Human herpesvirus 6B
gagguuuuuucaccccccucuu

SEQ ID NO: 3993383 - RNA, 16 nt, Human herpesvirus 6B
gaguaugacagaaauc

SEQ ID NO: 3993384 - RNA, 16 nt, Human herpesvirus 6B
gaguauggagaaaaac

SEQ ID NO: 3993385 - RNA, 18 nt, Human herpesvirus 6B
gaguauggugucugaaaa

SEQ ID NO: 3993386 - RNA, 21 nt, Human herpesvirus 6B
gagugcgacaggagauagagc

SEQ ID NO: 3993387 - RNA, 17 nt, Human herpesvirus 6B
gaguugcacauguuucu

SEQ ID NO: 3993388 - RNA, 17 nt, Human herpesvirus 6B
gauaacggcgcagaauu

SEQ ID NO: 3993389 - RNA, 21 nt, Human herpesvirus 6B
gauaauuucuuuggagggaau

SEQ ID NO: 3993390 - RNA, 21 nt, Human herpesvirus 6B
gauagcauaauccuuuucugu

SEQ ID NO: 3993391 - RNA, 18 nt, Human herpesvirus 6B
gauauacgauggacagaa

SEQ ID NO: 3993392 - RNA, 19 nt, Human herpesvirus 6B
gauauaguuauucagauuu

SEQ ID NO: 3993393 - RNA, 13 nt, Human herpesvirus 6B
gaucacucagauu

SEQ ID NO: 3993394 - RNA, 18 nt, Human herpesvirus 6B
gaucagauuaucaaggcu

SEQ ID NO: 3993395 - RNA, 16 nt, Human herpesvirus 6B
gaucauaggacagagg

SEQ ID NO: 3993396 - RNA, 21 nt, Human herpesvirus 6B
gaucugugcgccuuugcucag

SEQ ID NO: 3993397 - RNA, 13 nt, Human herpesvirus 6B
gaugaaguuccac

SEQ ID NO: 3993398 - RNA, 15 nt, Human herpesvirus 6B
gaugaggcccagagg

SEQ ID NO: 3993399 - RNA, 16 nt, Human herpesvirus 6B
gaugcagcguuggaaa

SEQ ID NO: 3993400 - RNA, 14 nt, Human herpesvirus 6B
gaugccuguaggga

SEQ ID NO: 3993401 - RNA, 14 nt, Human herpesvirus 6B
gaugcgaagggagu

SEQ ID NO: 3993402 - RNA, 19 nt, Human herpesvirus 6B
gauggauaagauuuaccac

SEQ ID NO: 3993403 - RNA, 22 nt, Human herpesvirus 6B
gauguauaauuuacacaauccu

SEQ ID NO: 3993404 - RNA, 19 nt, Human herpesvirus 6B
gauuaugcgaauuaaaacu

SEQ ID NO: 3993405 - RNA, 12 nt, Human herpesvirus 6B
gauucaaaggau

SEQ ID NO: 3993406 - RNA, 14 nt, Human herpesvirus 6B
gauucuuuaaagau

SEQ ID NO: 3993407 - RNA, 22 nt, Human herpesvirus 6B
gauugagucuccggaguuuauu

SEQ ID NO: 3993408 - RNA, 16 nt, Human herpesvirus 6B
gauuguuacuagugau

SEQ ID NO: 3993409 - RNA, 11 nt, Human herpesvirus 6B
gauuguucgcu

SEQ ID NO: 3993410 - RNA, 19 nt, Human herpesvirus 6B
gauuuucagugucagcauu

SEQ ID NO: 3993411 - RNA, 21 nt, Human herpesvirus 6B
gauuuuugcgcaauucuucuc

SEQ ID NO: 3993412 - RNA, 19 nt, Human herpesvirus 6B
gcaaaaaaauauuggauuu

SEQ ID NO: 3993413 - RNA, 15 nt, Human herpesvirus 6B
gcaaaagagaaggaa

SEQ ID NO: 3993414 - RNA, 22 nt, Human herpesvirus 6B
gcaaaaugaaguacaauacuuu

SEQ ID NO: 3993415 - RNA, 16 nt, Human herpesvirus 6B
gcaaacucaaagaaag

SEQ ID NO: 3993416 - RNA, 23 nt, Human herpesvirus 6B
gcaaaugaauguguucauagagc

SEQ ID NO: 3993417 - RNA, 14 nt, Human herpesvirus 6B
gcaacuaagcugua

SEQ ID NO: 3993418 - RNA, 22 nt, Human herpesvirus 6B
gcaacuaagcuguaugacaucu

SEQ ID NO: 3993419 - RNA, 14 nt, Human herpesvirus 6B
gcaacuugcugucg

SEQ ID NO: 3993420 - RNA, 20 nt, Human herpesvirus 6B
gcaagcccggagaacugauc

SEQ ID NO: 3993421 - RNA, 22 nt, Human herpesvirus 6B
gcaccgagggcgggcggacggc

SEQ ID NO: 3993422 - RNA, 15 nt, Human herpesvirus 6B
gcacgaaccaaaaug

SEQ ID NO: 3993423 - RNA, 12 nt, Human herpesvirus 6B
gcagaagcuguc

SEQ ID NO: 3993424 - RNA, 18 nt, Human herpesvirus 6B
gcagaaucaagaaacacu

SEQ ID NO: 3993425 - RNA, 22 nt, Human herpesvirus 6B
gcagacauucuuguucgggcca

SEQ ID NO: 3993426 - RNA, 14 nt, Human herpesvirus 6B
gcagacgugagaca

SEQ ID NO: 3993427 - RNA, 19 nt, Human herpesvirus 6B
gcagagccguuagaaaaau

SEQ ID NO: 3993428 - RNA, 18 nt, Human herpesvirus 6B
gcagaggucuuugcuuug

SEQ ID NO: 3993429 - RNA, 20 nt, Human herpesvirus 6B
gcagauaagaauuuccaggg

SEQ ID NO: 3993430 - RNA, 16 nt, Human herpesvirus 6B
gcagauauauggauca

SEQ ID NO: 3993431 - RNA, 19 nt, Human herpesvirus 6B
gcagauuuacgacacgcuc

SEQ ID NO: 3993432 - RNA, 23 nt, Human herpesvirus 6B
gcaggcuccccaggcgcagcagc

SEQ ID NO: 3993433 - RNA, 23 nt, Human herpesvirus 6B
gcagucaguaauaauauaaaaga

SEQ ID NO: 3993434 - RNA, 15 nt, Human herpesvirus 6B
gcagucgcggcggcc

SEQ ID NO: 3993435 - RNA, 12 nt, Human herpesvirus 6B
gcaguugucugg

SEQ ID NO: 3993436 - RNA, 12 nt, Human herpesvirus 6B
gcaguuugugaa

SEQ ID NO: 3993437 - RNA, 15 nt, Human herpesvirus 6B
gcauaacuaugaauu

SEQ ID NO: 3993438 - RNA, 18 nt, Human herpesvirus 6B
gcauagacugaacacaaa

SEQ ID NO: 3993439 - RNA, 14 nt, Human herpesvirus 6B
gcauauauaugaau

SEQ ID NO: 3993440 - RNA, 13 nt, Human herpesvirus 6B
gcauggaaaaggc

SEQ ID NO: 3993441 - RNA, 16 nt, Human herpesvirus 6B
gccaaucauaagaaac

SEQ ID NO: 3993442 - RNA, 12 nt, Human herpesvirus 6B
gccaauucauug

SEQ ID NO: 3993443 - RNA, 12 nt, Human herpesvirus 6B
gccacauuagcu

SEQ ID NO: 3993444 - RNA, 22 nt, Human herpesvirus 6B
gccagcaauuucggcaagaaag

SEQ ID NO: 3993445 - RNA, 16 nt, Human herpesvirus 6B
gcccgggcgcggggcg

SEQ ID NO: 3993446 - RNA, 21 nt, Human herpesvirus 6B
gcccucccgcagcuccuuccg

SEQ ID NO: 3993447 - RNA, 15 nt, Human herpesvirus 6B
gcccucgucuguugc

SEQ ID NO: 3993448 - RNA, 14 nt, Human herpesvirus 6B
gcccugcuccguuc

SEQ ID NO: 3993449 - RNA, 19 nt, Human herpesvirus 6B
gccgaagaaagaggcgccg

SEQ ID NO: 3993450 - RNA, 16 nt, Human herpesvirus 6B
gccgcgcuggucgccg

SEQ ID NO: 3993451 - RNA, 14 nt, Human herpesvirus 6B
gccgcuuaaaucaa

SEQ ID NO: 3993452 - RNA, 15 nt, Human herpesvirus 6B
gccggagcccugaga

SEQ ID NO: 3993453 - RNA, 21 nt, Human herpesvirus 6B
gccgucgucgcucucccucuu

SEQ ID NO: 3993454 - RNA, 16 nt, Human herpesvirus 6B
gccguuguuaaugaau

SEQ ID NO: 3993455 - RNA, 13 nt, Human herpesvirus 6B
gccuauuucucuu

SEQ ID NO: 3993456 - RNA, 23 nt, Human herpesvirus 6B
gccuccgccggguaugagccgcc

SEQ ID NO: 3993457 - RNA, 22 nt, Human herpesvirus 6B
gccucucuccgccuccucuuuu

SEQ ID NO: 3993458 - RNA, 22 nt, Human herpesvirus 6B
gccugaaggcuacuauaaacaa

SEQ ID NO: 3993459 - RNA, 17 nt, Human herpesvirus 6B
gcgaaucgcuuaaagaa

SEQ ID NO: 3993460 - RNA, 14 nt, Human herpesvirus 6B
gcgacaaaaaaaua

SEQ ID NO: 3993461 - RNA, 20 nt, Human herpesvirus 6B
gcgacuauuuaacugggaaa

SEQ ID NO: 3993462 - RNA, 18 nt, Human herpesvirus 6B
gcgaggggacggacagag

SEQ ID NO: 3993463 - RNA, 16 nt, Human herpesvirus 6B
gcgauauggaaacacu

SEQ ID NO: 3993464 - RNA, 19 nt, Human herpesvirus 6B
gcgaucauaaaacugccaa

SEQ ID NO: 3993465 - RNA, 15 nt, Human herpesvirus 6B
gcgccgucagcggca

SEQ ID NO: 3993466 - RNA, 20 nt, Human herpesvirus 6B
gcgccugccuacacugcgaa

SEQ ID NO: 3993467 - RNA, 13 nt, Human herpesvirus 6B
gcgcgcguugggg

SEQ ID NO: 3993468 - RNA, 14 nt, Human herpesvirus 6B
gcgcggggcgcacc

SEQ ID NO: 3993469 - RNA, 16 nt, Human herpesvirus 6B
gcgcggggcgcaccgg

SEQ ID NO: 3993470 - RNA, 19 nt, Human herpesvirus 6B
gcgcguuuaucaugagaga

SEQ ID NO: 3993471 - RNA, 14 nt, Human herpesvirus 6B
gcgcugcuggggcu

SEQ ID NO: 3993472 - RNA, 23 nt, Human herpesvirus 6B
gcgcugggacuccgagccggaca

SEQ ID NO: 3993473 - RNA, 19 nt, Human herpesvirus 6B
gcggcaugaguggaguuga

SEQ ID NO: 3993474 - RNA, 21 nt, Human herpesvirus 6B
gcggcugauauacgauggaca

SEQ ID NO: 3993475 - RNA, 12 nt, Human herpesvirus 6B
gcgggaccuggc

SEQ ID NO: 3993476 - RNA, 18 nt, Human herpesvirus 6B
gcgggacgugaucugcgg

SEQ ID NO: 3993477 - RNA, 17 nt, Human herpesvirus 6B
gcgguuagaucugggga

SEQ ID NO: 3993478 - RNA, 23 nt, Human herpesvirus 6B
gcgucuuaacguucguccggggu

SEQ ID NO: 3993479 - RNA, 17 nt, Human herpesvirus 6B
gcguguaauuguugaaa

SEQ ID NO: 3993480 - RNA, 17 nt, Human herpesvirus 6B
gcguguuuuggaauuuc

SEQ ID NO: 3993481 - RNA, 18 nt, Human herpesvirus 6B
gcguuaucgacggcagcg

SEQ ID NO: 3993482 - RNA, 17 nt, Human herpesvirus 6B
gcuaaacuuuacaucaa

SEQ ID NO: 3993483 - RNA, 14 nt, Human herpesvirus 6B
gcuauacuacgaga

SEQ ID NO: 3993484 - RNA, 16 nt, Human herpesvirus 6B
cacccugaagggaccg

SEQ ID NO: 3993485 - RNA, 22 nt, Human herpesvirus 6B
caccggcgacacgcgcggacca

SEQ ID NO: 3993486 - RNA, 20 nt, Human herpesvirus 6B
caccgucccucucaccccca

SEQ ID NO: 3993487 - RNA, 22 nt, Human herpesvirus 6B
caccgucccucucacccccacu

SEQ ID NO: 3993488 - RNA, 15 nt, Human herpesvirus 6B
caccucgcaaagucu

SEQ ID NO: 3993489 - RNA, 21 nt, Human herpesvirus 6B
cacgacauggaacuucauagc

SEQ ID NO: 3993490 - RNA, 21 nt, Human herpesvirus 6B
cacgcccccaccuggcgcacc

SEQ ID NO: 3993491 - RNA, 15 nt, Human herpesvirus 6B
cacgcgagacaucgg

SEQ ID NO: 3993492 - RNA, 19 nt, Human herpesvirus 6B
cacgcgcggaccacucggg

SEQ ID NO: 3993493 - RNA, 21 nt, Human herpesvirus 6B
cacggagaacacuuagagggu

SEQ ID NO: 3993494 - RNA, 20 nt, Human herpesvirus 6B
cacggagugcgacaggagau

SEQ ID NO: 3993495 - RNA, 14 nt, Human herpesvirus 6B
cacggcgccuccca

SEQ ID NO: 3993496 - RNA, 19 nt, Human herpesvirus 6B
cacguucuuugaacaguga

SEQ ID NO: 3993497 - RNA, 16 nt, Human herpesvirus 6B
cacucacauagagaag

SEQ ID NO: 3993498 - RNA, 13 nt, Human herpesvirus 6B
cacucauuugcaa

SEQ ID NO: 3993499 - RNA, 22 nt, Human herpesvirus 6B
cacugaaauuuacaaucaucug

SEQ ID NO: 3993500 - RNA, 14 nt, Human herpesvirus 6B
cagaaaaagaacug

SEQ ID NO: 3993501 - RNA, 14 nt, Human herpesvirus 6B
cagaaaagcaaaca

SEQ ID NO: 3993502 - RNA, 20 nt, Human herpesvirus 6B
cagaacagagacccuccugg

SEQ ID NO: 3993503 - RNA, 14 nt, Human herpesvirus 6B
cagaagagccaaca

SEQ ID NO: 3993504 - RNA, 15 nt, Human herpesvirus 6B
cagaauacaaaaacg

SEQ ID NO: 3993505 - RNA, 15 nt, Human herpesvirus 6B
cagaaucaagaaaca

SEQ ID NO: 3993506 - RNA, 23 nt, Human herpesvirus 6B
cagaaucuaaaucgcgagacaga

SEQ ID NO: 3993507 - RNA, 18 nt, Human herpesvirus 6B
cagacaaaacacaauaaa

SEQ ID NO: 3993508 - RNA, 12 nt, Human herpesvirus 6B
cagacgacagcg

SEQ ID NO: 3993509 - RNA, 17 nt, Human herpesvirus 6B
cagagagccgcagaggc

SEQ ID NO: 3993510 - RNA, 18 nt, Human herpesvirus 6B
cagagaucagcaugggca

SEQ ID NO: 3993511 - RNA, 18 nt, Human herpesvirus 6B
cagagauuuuuuaaauaa

SEQ ID NO: 3993512 - RNA, 11 nt, Human herpesvirus 6B
cagagcacaca

SEQ ID NO: 3993513 - RNA, 15 nt, Human herpesvirus 6B
cagaggaagaaagga

SEQ ID NO: 3993514 - RNA, 16 nt, Human herpesvirus 6B
cagauaauaaauaucc

SEQ ID NO: 3993515 - RNA, 13 nt, Human herpesvirus 6B
cagaugaggagga

SEQ ID NO: 3993516 - RNA, 13 nt, Human herpesvirus 6B
cagcagcagcucc

SEQ ID NO: 3993517 - RNA, 11 nt, Human herpesvirus 6B
cagcaugucau

SEQ ID NO: 3993518 - RNA, 15 nt, Human herpesvirus 6B
cagcccugaagaaga

SEQ ID NO: 3993519 - RNA, 13 nt, Human herpesvirus 6B
cagcuaaucacuu

SEQ ID NO: 3993520 - RNA, 19 nt, Human herpesvirus 6B
cagcugcaugguccacaga

SEQ ID NO: 3993521 - RNA, 18 nt, Human herpesvirus 6B
caggacggggccucccuc

SEQ ID NO: 3993522 - RNA, 17 nt, Human herpesvirus 6B
caggagcaggcucccca

SEQ ID NO: 3993523 - RNA, 22 nt, Human herpesvirus 6B
caggcaccauguucgccucucc

SEQ ID NO: 3993524 - RNA, 18 nt, Human herpesvirus 6B
caggcuagcaugguguga

SEQ ID NO: 3993525 - RNA, 13 nt, Human herpesvirus 6B
caggcuccccagg

SEQ ID NO: 3993526 - RNA, 20 nt, Human herpesvirus 6B
cagggacgcuugcuguaaag

SEQ ID NO: 3993527 - RNA, 21 nt, Human herpesvirus 6B
cagggggaucgacgaccaggc

SEQ ID NO: 3993528 - RNA, 15 nt, Human herpesvirus 6B
cagguuucuccgcac

SEQ ID NO: 3993529 - RNA, 15 nt, Human herpesvirus 6B
caguaaaaaagccga

SEQ ID NO: 3993530 - RNA, 14 nt, Human herpesvirus 6B
caguaaaacaugua

SEQ ID NO: 3993531 - RNA, 18 nt, Human herpesvirus 6B
caguaaaacauguagugg

SEQ ID NO: 3993532 - RNA, 13 nt, Human herpesvirus 6B
caguauaaauucu

SEQ ID NO: 3993533 - RNA, 18 nt, Human herpesvirus 6B
caguuguacucaaaguau

SEQ ID NO: 3993534 - RNA, 16 nt, Human herpesvirus 6B
caguuucagaugauca

SEQ ID NO: 3993535 - RNA, 22 nt, Human herpesvirus 6B
cauaacuaugaauuagcagaag

SEQ ID NO: 3993536 - RNA, 14 nt, Human herpesvirus 6B
cauacauccagaaa

SEQ ID NO: 3993537 - RNA, 19 nt, Human herpesvirus 6B
cauacgacugacgauuuca

SEQ ID NO: 3993538 - RNA, 21 nt, Human herpesvirus 6B
cauacgacugacgauuucauu

SEQ ID NO: 3993539 - RNA, 15 nt, Human herpesvirus 6B
cauacgaggaugaag

SEQ ID NO: 3993540 - RNA, 20 nt, Human herpesvirus 6B
cauagagcauccuguuuucc

SEQ ID NO: 3993541 - RNA, 21 nt, Human herpesvirus 6B
caucgaugauuuuucugccua

SEQ ID NO: 3993542 - RNA, 19 nt, Human herpesvirus 6B
caucgucuccuauauuuuc

SEQ ID NO: 3993543 - RNA, 19 nt, Human herpesvirus 6B
caucuaugcgugugaaagu

SEQ ID NO: 3993544 - RNA, 15 nt, Human herpesvirus 6B
caugaaaacauucag

SEQ ID NO: 3993545 - RNA, 17 nt, Human herpesvirus 6B
caugacugugaggugau

SEQ ID NO: 3993546 - RNA, 20 nt, Human herpesvirus 6B
caugaugaucugcuuuguuu

SEQ ID NO: 3993547 - RNA, 14 nt, Human herpesvirus 6B
caugggagaaauaa

SEQ ID NO: 3993548 - RNA, 22 nt, Human herpesvirus 6B
cauguaaaauuaccucaucccu

SEQ ID NO: 3993549 - RNA, 14 nt, Human herpesvirus 6B
caugucuuacagcu

SEQ ID NO: 3993550 - RNA, 15 nt, Human herpesvirus 6B
cauguuaacaauaaa

SEQ ID NO: 3993551 - RNA, 20 nt, Human herpesvirus 6B
cauucgauuaaugccacagg

SEQ ID NO: 3993552 - RNA, 20 nt, Human herpesvirus 6B
cauucuugcagauuucacuu

SEQ ID NO: 3993553 - RNA, 15 nt, Human herpesvirus 6B
cauugagguauugga

SEQ ID NO: 3993554 - RNA, 17 nt, Human herpesvirus 6B
cauugauaguggcuuca

SEQ ID NO: 3993555 - RNA, 18 nt, Human herpesvirus 6B
cauugugagaacagcgca

SEQ ID NO: 3993556 - RNA, 15 nt, Human herpesvirus 6B
cauuuaccagagaua

SEQ ID NO: 3993557 - RNA, 19 nt, Human herpesvirus 6B
cauuucuaucuacaaaaua

SEQ ID NO: 3993558 - RNA, 23 nt, Human herpesvirus 6B
cauuuugauaucgauucuguaau

SEQ ID NO: 3993559 - RNA, 12 nt, Human herpesvirus 6B
ccaaaagacuau

SEQ ID NO: 3993560 - RNA, 14 nt, Human herpesvirus 6B
ccaaaagagaaaga

SEQ ID NO: 3993561 - RNA, 23 nt, Human herpesvirus 6B
ccaacacuguuguuaaucuguuu

SEQ ID NO: 3993562 - RNA, 19 nt, Human herpesvirus 6B
ccaaccaaaugccucgugg

SEQ ID NO: 3993563 - RNA, 18 nt, Human herpesvirus 6B
ccaagugucucauggaaa

SEQ ID NO: 3993564 - RNA, 21 nt, Human herpesvirus 6B
ccacauuagcugcuaaaugug

SEQ ID NO: 3993565 - RNA, 22 nt, Human herpesvirus 6B
ccacauuagcugcuaaauguga

SEQ ID NO: 3993566 - RNA, 22 nt, Human herpesvirus 6B
ccacggcaacgcuccucccacg

SEQ ID NO: 3993567 - RNA, 15 nt, Human herpesvirus 6B
ccagaugcagucucc

SEQ ID NO: 3993568 - RNA, 19 nt, Human herpesvirus 6B
ccagcucuguucucuccca

SEQ ID NO: 3993569 - RNA, 14 nt, Human herpesvirus 6B
ccaggauagaaaaa

SEQ ID NO: 3993570 - RNA, 17 nt, Human herpesvirus 6B
ccagucagauaaugaau

SEQ ID NO: 3993571 - RNA, 19 nt, Human herpesvirus 6B
ccauaccgggacagcaccc

SEQ ID NO: 3993572 - RNA, 18 nt, Human herpesvirus 6B
ccauguucgccucucccg

SEQ ID NO: 3993573 - RNA, 17 nt, Human herpesvirus 6B
cccaacagaagccacca

SEQ ID NO: 3993574 - RNA, 16 nt, Human herpesvirus 6B
ccccaggcgcagcagc

SEQ ID NO: 3993575 - RNA, 14 nt, Human herpesvirus 6B
cccggaguacacgu

SEQ ID NO: 3993576 - RNA, 22 nt, Human herpesvirus 6B
cccggggaggcgacgacgggga

SEQ ID NO: 3993577 - RNA, 12 nt, Human herpesvirus 6B
cccuccaucccc

SEQ ID NO: 3993578 - RNA, 14 nt, Human herpesvirus 6B
cccucccgcagcuc

SEQ ID NO: 3993579 - RNA, 20 nt, Human herpesvirus 6B
cccugcgggacgugaucugc

SEQ ID NO: 3993580 - RNA, 11 nt, Human herpesvirus 6B
ccgaacccggc

SEQ ID NO: 3993581 - RNA, 16 nt, Human herpesvirus 6B
ccgaacgccuccacgg

SEQ ID NO: 3993582 - RNA, 16 nt, Human herpesvirus 6B
ccgagcgggcuccguc

SEQ ID NO: 3993583 - RNA, 23 nt, Human herpesvirus 6B
ccgcacaguucguccagcagcgg

SEQ ID NO: 3993584 - RNA, 11 nt, Human herpesvirus 6B
ccgccuucucu

SEQ ID NO: 3993585 - RNA, 19 nt, Human herpesvirus 6B
ccgcggcgcugggcuccuc

SEQ ID NO: 3993586 - RNA, 14 nt, Human herpesvirus 6B
ccgcgggccagccc

SEQ ID NO: 3993587 - RNA, 18 nt, Human herpesvirus 6B
ccgcgucuccgauccguc

SEQ ID NO: 3993588 - RNA, 19 nt, Human herpesvirus 6B
ccgcguggaagccgcugca

SEQ ID NO: 3993589 - RNA, 21 nt, Human herpesvirus 6B
ccgcuccggacccuccacgcc

SEQ ID NO: 3993590 - RNA, 10 nt, Human herpesvirus 6B
ccggccaauu

SEQ ID NO: 3993591 - RNA, 22 nt, Human herpesvirus 6B
ccggcccguccaccgucccucu

SEQ ID NO: 3993592 - RNA, 15 nt, Human herpesvirus 6B
ccgggacagcacccg

SEQ ID NO: 3993593 - RNA, 14 nt, Human herpesvirus 6B
ccgggcgacgagag

SEQ ID NO: 3993594 - RNA, 16 nt, Human herpesvirus 6B
ccgggcgcggggcgca

SEQ ID NO: 3993595 - RNA, 12 nt, Human herpesvirus 6B
ccguacccagga

SEQ ID NO: 3993596 - RNA, 22 nt, Human herpesvirus 6B
ccguccccgccgcgcuggucgc

SEQ ID NO: 3993597 - RNA, 20 nt, Human herpesvirus 6B
gaaagguguggugaaagaca

SEQ ID NO: 3993598 - RNA, 14 nt, Human herpesvirus 6B
gaaaguuuuggaaa

SEQ ID NO: 3993599 - RNA, 20 nt, Human herpesvirus 6B
gaaaguuuuggaaaauguaa

SEQ ID NO: 3993600 - RNA, 21 nt, Human herpesvirus 6B
gaaauaccaaagaaauuuauu

SEQ ID NO: 3993601 - RNA, 20 nt, Human herpesvirus 6B
gaaaucuuuuucggauuuua

SEQ ID NO: 3993602 - RNA, 15 nt, Human herpesvirus 6B
gaaaugcagcaguuu

SEQ ID NO: 3993603 - RNA, 17 nt, Human herpesvirus 6B
gaaauguugucaaucgu

SEQ ID NO: 3993604 - RNA, 15 nt, Human herpesvirus 6B
gaaauuuacaaucau

SEQ ID NO: 3993605 - RNA, 22 nt, Human herpesvirus 6B
gaacaaaaggucagaugcaaaa

SEQ ID NO: 3993606 - RNA, 14 nt, Human herpesvirus 6B
gaacagaaauuucu

SEQ ID NO: 3993607 - RNA, 13 nt, Human herpesvirus 6B
gaacagagauuuu

SEQ ID NO: 3993608 - RNA, 22 nt, Human herpesvirus 6B
gaaccauagguguuugcagaua

SEQ ID NO: 3993609 - RNA, 12 nt, Human herpesvirus 6B
gaacuauuucuu

SEQ ID NO: 3993610 - RNA, 15 nt, Human herpesvirus 6B
gaagaagacgaagaa

SEQ ID NO: 3993611 - RNA, 22 nt, Human herpesvirus 6B
gaagacaucuuaaauuucuaug

SEQ ID NO: 3993612 - RNA, 17 nt, Human herpesvirus 6B
gaagagguggcggcuca

SEQ ID NO: 3993613 - RNA, 22 nt, Human herpesvirus 6B
gaagagguucagacugcugcug

SEQ ID NO: 3993614 - RNA, 17 nt, Human herpesvirus 6B
gaagccgcugcagugug

SEQ ID NO: 3993615 - RNA, 22 nt, Human herpesvirus 6B
gaagggauggcagaucuugaaa

SEQ ID NO: 3993616 - RNA, 15 nt, Human herpesvirus 6B
gaagguaucaaagaa

SEQ ID NO: 3993617 - RNA, 14 nt, Human herpesvirus 6B
gaagucuuuccugu

SEQ ID NO: 3993618 - RNA, 21 nt, Human herpesvirus 6B
gaauaacagaugaggaggagg

SEQ ID NO: 3993619 - RNA, 22 nt, Human herpesvirus 6B
gaauauuuaaugacguaugauu

SEQ ID NO: 3993620 - RNA, 20 nt, Human herpesvirus 6B
gaaucagaucacucagauuu

SEQ ID NO: 3993621 - RNA, 22 nt, Human herpesvirus 6B
gaaucagaucacucagauuuca

SEQ ID NO: 3993622 - RNA, 15 nt, Human herpesvirus 6B
gaaucccuugucugg

SEQ ID NO: 3993623 - RNA, 15 nt, Human herpesvirus 6B
gaauccgcgggccag

SEQ ID NO: 3993624 - RNA, 23 nt, Human herpesvirus 6B
gaaugagggauucguaguuuaug

SEQ ID NO: 3993625 - RNA, 19 nt, Human herpesvirus 6B
gaauguguucauagagcau

SEQ ID NO: 3993626 - RNA, 15 nt, Human herpesvirus 6B
gaauuaugacugaca

SEQ ID NO: 3993627 - RNA, 17 nt, Human herpesvirus 6B
gaauucagcuggacaga

SEQ ID NO: 3993628 - RNA, 19 nt, Human herpesvirus 6B
gaauucucauuuaaaagcg

SEQ ID NO: 3993629 - RNA, 14 nt, Human herpesvirus 6B
gaauugguuugcuu

SEQ ID NO: 3993630 - RNA, 18 nt, Human herpesvirus 6B
gaauuucauagauugcac

SEQ ID NO: 3993631 - RNA, 16 nt, Human herpesvirus 6B
gacaauuuaucgugcu

SEQ ID NO: 3993632 - RNA, 19 nt, Human herpesvirus 6B
gacaccacauaacaaaaaa

SEQ ID NO: 3993633 - RNA, 21 nt, Human herpesvirus 6B
gacagaguucgguccaaggau

SEQ ID NO: 3993634 - RNA, 15 nt, Human herpesvirus 6B
gacagcgggugcuca

SEQ ID NO: 3993635 - RNA, 20 nt, Human herpesvirus 6B
gacagcgugaugaggcccag

SEQ ID NO: 3993636 - RNA, 23 nt, Human herpesvirus 6B
gacagggggaucgacgaccaggc

SEQ ID NO: 3993637 - RNA, 16 nt, Human herpesvirus 6B
gacaucaaugcgcuau

SEQ ID NO: 3993638 - RNA, 22 nt, Human herpesvirus 6B
gacauugguugauuuuuguaaa

SEQ ID NO: 3993639 - RNA, 15 nt, Human herpesvirus 6B
gaccaacaugccgau

SEQ ID NO: 3993640 - RNA, 20 nt, Human herpesvirus 6B
gaccacucgggccggucggg

SEQ ID NO: 3993641 - RNA, 13 nt, Human herpesvirus 6B
gaccagcucuguu

SEQ ID NO: 3993642 - RNA, 19 nt, Human herpesvirus 6B
gacccuccacgccccuccg

SEQ ID NO: 3993643 - RNA, 15 nt, Human herpesvirus 6B
gaccgaauuauguau

SEQ ID NO: 3993644 - RNA, 23 nt, Human herpesvirus 6B
gaccgcagucgcggcggccccgc

SEQ ID NO: 3993645 - RNA, 18 nt, Human herpesvirus 6B
gaccugaucacagagaaa

SEQ ID NO: 3993646 - RNA, 15 nt, Human herpesvirus 6B
gacgaauugaguaga

SEQ ID NO: 3993647 - RNA, 12 nt, Human herpesvirus 6B
gacgauuucauu

SEQ ID NO: 3993648 - RNA, 19 nt, Human herpesvirus 6B
gacgccuaguguuaaagau

SEQ ID NO: 3993649 - RNA, 22 nt, Human herpesvirus 6B
gacggaauauauagaagaagaa

SEQ ID NO: 3993650 - RNA, 14 nt, Human herpesvirus 6B
gacgggucggucug

SEQ ID NO: 3993651 - RNA, 19 nt, Human herpesvirus 6B
gacgucaguggacaaauaa

SEQ ID NO: 3993652 - RNA, 19 nt, Human herpesvirus 6B
gacuacucuggcugaagga

SEQ ID NO: 3993653 - RNA, 19 nt, Human herpesvirus 6B
gacuccgagccggacagga

SEQ ID NO: 3993654 - RNA, 24 nt, Human herpesvirus 6B
gacugcggggcgucgggcgacggg

SEQ ID NO: 3993655 - RNA, 20 nt, Human herpesvirus 6B
gacuuuucugaugacaauau

SEQ ID NO: 3993656 - RNA, 18 nt, Human herpesvirus 6B
gagaaaccgaaaugugcu

SEQ ID NO: 3993657 - RNA, 18 nt, Human herpesvirus 6B
gagaaacggagagcgaca

SEQ ID NO: 3993658 - RNA, 17 nt, Human herpesvirus 6B
gagaaaggaagaaauuc

SEQ ID NO: 3993659 - RNA, 20 nt, Human herpesvirus 6B
gagaacuucaaaaucugcua

SEQ ID NO: 3993660 - RNA, 17 nt, Human herpesvirus 6B
gagaagaacagaggaag

SEQ ID NO: 3993661 - RNA, 20 nt, Human herpesvirus 6B
gagaauaagaucuacagagu

SEQ ID NO: 3993662 - RNA, 15 nt, Human herpesvirus 6B
gagaauuccaaggcu

SEQ ID NO: 3993663 - RNA, 24 nt, Human herpesvirus 6B
gagacggaauauauagaagaagaa

SEQ ID NO: 3993664 - RNA, 22 nt, Human herpesvirus 6B
gagacugccgguaacgcugccg

SEQ ID NO: 3993665 - RNA, 13 nt, Human herpesvirus 6B
gagagcuccgagc

SEQ ID NO: 3993666 - RNA, 21 nt, Human herpesvirus 6B
gagaguacggaagugccuucu

SEQ ID NO: 3993667 - RNA, 16 nt, Human herpesvirus 6B
gagauuuuuuaaauaa

SEQ ID NO: 3993668 - RNA, 16 nt, Human herpesvirus 6B
gagccacuugagugag

SEQ ID NO: 3993669 - RNA, 21 nt, Human herpesvirus 6B
gagcucaaagagauuggaaaa

SEQ ID NO: 3993670 - RNA, 20 nt, Human herpesvirus 6B
gaggaagucugaauuuaaug

SEQ ID NO: 3993671 - RNA, 9 nt, Human herpesvirus 6B
gaggaggag

SEQ ID NO: 3993672 - RNA, 19 nt, Human herpesvirus 6B
gagggagaaacggacacgc

SEQ ID NO: 3993673 - RNA, 20 nt, Human herpesvirus 6B
gaguauuuuaaagauuuucu

SEQ ID NO: 3993674 - RNA, 23 nt, Human herpesvirus 6B
gauaaacuguacgccauacggga

SEQ ID NO: 3993675 - RNA, 19 nt, Human herpesvirus 6B
gauaccgaaucggaagagg

SEQ ID NO: 3993676 - RNA, 21 nt, Human herpesvirus 6B
gauacuauugcuaagaucugu

SEQ ID NO: 3993677 - RNA, 15 nt, Human herpesvirus 6B
gauauaguuauucag

SEQ ID NO: 3993678 - RNA, 19 nt, Human herpesvirus 6B
gauaucucaccuaugaaua

SEQ ID NO: 3993679 - RNA, 20 nt, Human herpesvirus 6B
gauaugagugaauugugcaa

SEQ ID NO: 3993680 - RNA, 15 nt, Human herpesvirus 6B
gaucacuuuguuucu

SEQ ID NO: 3993681 - RNA, 14 nt, Human herpesvirus 6B
gauccaaugaugaa

SEQ ID NO: 3993682 - RNA, 20 nt, Human herpesvirus 6B
gaucgggccuggggacagac

SEQ ID NO: 3993683 - RNA, 14 nt, Human herpesvirus 6B
gaucuauuucccgu

SEQ ID NO: 3993684 - RNA, 14 nt, Human herpesvirus 6B
gaucucauaugcau

SEQ ID NO: 3993685 - RNA, 21 nt, Human herpesvirus 6B
gaucucauaugcaucagaccu

SEQ ID NO: 3993686 - RNA, 12 nt, Human herpesvirus 6B
gaucugcuuugu

SEQ ID NO: 3993687 - RNA, 16 nt, Human herpesvirus 6B
gaugaauugugcgugu

SEQ ID NO: 3993688 - RNA, 15 nt, Human herpesvirus 6B
gaugcauuguugaaa

SEQ ID NO: 3993689 - RNA, 16 nt, Human herpesvirus 6B
gaugccaaagcuuucu

SEQ ID NO: 3993690 - RNA, 12 nt, Human herpesvirus 6B
gaugcucucaga

SEQ ID NO: 3993691 - RNA, 16 nt, Human herpesvirus 6B
gaugcuuuuaguuuca

SEQ ID NO: 3993692 - RNA, 16 nt, Human herpesvirus 6B
gauguacguggccguc

SEQ ID NO: 3993693 - RNA, 14 nt, Human herpesvirus 6B
gaugugcggagaaa

SEQ ID NO: 3993694 - RNA, 23 nt, Human herpesvirus 6B
gaugugucccucgauaacuauac

SEQ ID NO: 3993695 - RNA, 15 nt, Human herpesvirus 6B
gauguguuaaagaau

SEQ ID NO: 3993696 - RNA, 12 nt, Human herpesvirus 6B
gauguuuccagg

SEQ ID NO: 3993697 - RNA, 20 nt, Human herpesvirus 6B
gauuccguugugacagaauu

SEQ ID NO: 3993698 - RNA, 12 nt, Human herpesvirus 6B
gauucgacauca

SEQ ID NO: 3993699 - RNA, 14 nt, Human herpesvirus 6B
gauugauccuguaa

SEQ ID NO: 3993700 - RNA, 13 nt, Human herpesvirus 6B
gauuuucuagaug

SEQ ID NO: 3993701 - RNA, 16 nt, Human herpesvirus 6B
gauuuuuguaaaaaug

SEQ ID NO: 3993702 - RNA, 17 nt, Human herpesvirus 6B
gauuuuuguaaaaaugg

SEQ ID NO: 3993703 - RNA, 16 nt, Human herpesvirus 6B
gcaaaugaauguguuc

SEQ ID NO: 3993704 - RNA, 21 nt, Human herpesvirus 6B
gcacaaaaccaggaauccuau

SEQ ID NO: 3993705 - RNA, 15 nt, Human herpesvirus 6B
gcacacgacaaauaa

SEQ ID NO: 3993706 - RNA, 19 nt, Human herpesvirus 6B
gcacagaaucgagaucguu

SEQ ID NO: 3993707 - RNA, 20 nt, Human herpesvirus 6B
gcaccgagggcgggcggacg

SEQ ID NO: 3993708 - RNA, 21 nt, Human herpesvirus 6B
gcaccgcagaucacgucccgc

SEQ ID NO: 3993709 - RNA, 14 nt, Human herpesvirus 6B
gcacguaacaccag

SEQ ID NO: 3993710 - RNA, 19 nt, Human herpesvirus 6B
uccucuuuuccccccgccg

SEQ ID NO: 3993711 - RNA, 13 nt, Human herpesvirus 6B
uccugcaauuuga

SEQ ID NO: 3993712 - RNA, 22 nt, Human herpesvirus 6B
uccugcaauuugaauucugcuc

SEQ ID NO: 3993713 - RNA, 22 nt, Human herpesvirus 6B
uccuguaguuuuuuucugauga

SEQ ID NO: 3993714 - RNA, 17 nt, Human herpesvirus 6B
uccuguuuucccaccua

SEQ ID NO: 3993715 - RNA, 20 nt, Human herpesvirus 6B
uccuuaucagucucaaaaau

SEQ ID NO: 3993716 - RNA, 23 nt, Human herpesvirus 6B
uccuuuguggcucuauucuacau

SEQ ID NO: 3993717 - RNA, 14 nt, Human herpesvirus 6B
ucgagacuagauuu

SEQ ID NO: 3993718 - RNA, 24 nt, Human herpesvirus 6B
ucgauaucucaccuaugaauaucu

SEQ ID NO: 3993719 - RNA, 16 nt, Human herpesvirus 6B
ucgaugccaaagcuuu

SEQ ID NO: 3993720 - RNA, 13 nt, Human herpesvirus 6B
ucgcaaaagagaa

SEQ ID NO: 3993721 - RNA, 19 nt, Human herpesvirus 6B
ucgcaaaagagaaggaaaa

SEQ ID NO: 3993722 - RNA, 13 nt, Human herpesvirus 6B
ucggcaagaaagc

SEQ ID NO: 3993723 - RNA, 20 nt, Human herpesvirus 6B
ucgggaugugcggagaaagg

SEQ ID NO: 3993724 - RNA, 14 nt, Human herpesvirus 6B
ucggggggagacag

SEQ ID NO: 3993725 - RNA, 15 nt, Human herpesvirus 6B
ucgucaacaauaaua

SEQ ID NO: 3993726 - RNA, 23 nt, Human herpesvirus 6B
ucguccgcgaugcgccacaggga

SEQ ID NO: 3993727 - RNA, 13 nt, Human herpesvirus 6B
ucguggaagacgu

SEQ ID NO: 3993728 - RNA, 16 nt, Human herpesvirus 6B
ucguuaaaaacguuuu

SEQ ID NO: 3993729 - RNA, 22 nt, Human herpesvirus 6B
ucguuaugacgaucaauauaga

SEQ ID NO: 3993730 - RNA, 14 nt, Human herpesvirus 6B
ucguuucauaccuu

SEQ ID NO: 3993731 - RNA, 19 nt, Human herpesvirus 6B
ucuaaaucugaaauguaga

SEQ ID NO: 3993732 - RNA, 15 nt, Human herpesvirus 6B
ucuacaugccacaga

SEQ ID NO: 3993733 - RNA, 21 nt, Human herpesvirus 6B
ucuacguauaaaaguccucaa

SEQ ID NO: 3993734 - RNA, 14 nt, Human herpesvirus 6B
ucuagaaugccagg

SEQ ID NO: 3993735 - RNA, 14 nt, Human herpesvirus 6B
ucuaugggaguaau

SEQ ID NO: 3993736 - RNA, 18 nt, Human herpesvirus 6B
ucuauucaggaauauuua

SEQ ID NO: 3993737 - RNA, 15 nt, Human herpesvirus 6B
ucuauuugcaagaau

SEQ ID NO: 3993738 - RNA, 20 nt, Human herpesvirus 6B
ucucaaaaaggguuuucuga

SEQ ID NO: 3993739 - RNA, 15 nt, Human herpesvirus 6B
ucucacgaaaguuuu

SEQ ID NO: 3993740 - RNA, 21 nt, Human herpesvirus 6B
ucucagcauuguugagaauuu

SEQ ID NO: 3993741 - RNA, 15 nt, Human herpesvirus 6B
ucucauaauuugccu

SEQ ID NO: 3993742 - RNA, 13 nt, Human herpesvirus 6B
ucuccaaaacacu

SEQ ID NO: 3993743 - RNA, 20 nt, Human herpesvirus 6B
ucuccaaaagcgccugccua

SEQ ID NO: 3993744 - RNA, 20 nt, Human herpesvirus 6B
ucuccacagggcauagaaag

SEQ ID NO: 3993745 - RNA, 14 nt, Human herpesvirus 6B
ucuccgccuccucu

SEQ ID NO: 3993746 - RNA, 23 nt, Human herpesvirus 6B
ucuccgucaccguguccacggca

SEQ ID NO: 3993747 - RNA, 15 nt, Human herpesvirus 6B
ucuccugaucucacg

SEQ ID NO: 3993748 - RNA, 20 nt, Human herpesvirus 6B
ucuccugugcguccuccucg

SEQ ID NO: 3993749 - RNA, 15 nt, Human herpesvirus 6B
ucucgaaaauacaau

SEQ ID NO: 3993750 - RNA, 14 nt, Human herpesvirus 6B
ucucgaaaaugcug

SEQ ID NO: 3993751 - RNA, 20 nt, Human herpesvirus 6B
ucucgguuuauacuugaaga

SEQ ID NO: 3993752 - RNA, 22 nt, Human herpesvirus 6B
ucucgugccguugccuuggccg

SEQ ID NO: 3993753 - RNA, 19 nt, Human herpesvirus 6B
ucucuacaucaccaugaaa

SEQ ID NO: 3993754 - RNA, 17 nt, Human herpesvirus 6B
ucucuacaugccacaga

SEQ ID NO: 3993755 - RNA, 14 nt, Human herpesvirus 6B
ucucucaacuuuua

SEQ ID NO: 3993756 - RNA, 16 nt, Human herpesvirus 6B
ucugaaaauaaaguug

SEQ ID NO: 3993757 - RNA, 15 nt, Human herpesvirus 6B
ucugagacagucaau

SEQ ID NO: 3993758 - RNA, 17 nt, Human herpesvirus 6B
ucugccgaaaagaaaga

SEQ ID NO: 3993759 - RNA, 21 nt, Human herpesvirus 6B
ucugcgcgauauuuuuauggc

SEQ ID NO: 3993760 - RNA, 17 nt, Human herpesvirus 6B
ucugcguugcccucccg

SEQ ID NO: 3993761 - RNA, 21 nt, Human herpesvirus 6B
ucuguaaaaggauaaauuccu

SEQ ID NO: 3993762 - RNA, 22 nt, Human herpesvirus 6B
ucuuaaauucaauuuaaaauaa

SEQ ID NO: 3993763 - RNA, 18 nt, Human herpesvirus 6B
ucuuccuguacagaauuu

SEQ ID NO: 3993764 - RNA, 16 nt, Human herpesvirus 6B
ucuugcggcaugugua

SEQ ID NO: 3993765 - RNA, 21 nt, Human herpesvirus 6B
ucuuggcgguuuuuuaauucu

SEQ ID NO: 3993766 - RNA, 14 nt, Human herpesvirus 6B
ucuuuggaaaacgu

SEQ ID NO: 3993767 - RNA, 14 nt, Human herpesvirus 6B
ucuuuguccuaugu

SEQ ID NO: 3993768 - RNA, 13 nt, Human herpesvirus 6B
ugaaaaagguucg

SEQ ID NO: 3993769 - RNA, 22 nt, Human herpesvirus 6B
ugaaaucgauguagauguuuug

SEQ ID NO: 3993770 - RNA, 14 nt, Human herpesvirus 6B
ugaaaucuuuccug

SEQ ID NO: 3993771 - RNA, 22 nt, Human herpesvirus 6B
ugaacaaguggaaguguaaaug

SEQ ID NO: 3993772 - RNA, 14 nt, Human herpesvirus 6B
ugaacagagauuuu

SEQ ID NO: 3993773 - RNA, 13 nt, Human herpesvirus 6B
ugaacuguuucca

SEQ ID NO: 3993774 - RNA, 21 nt, Human herpesvirus 6B
ugaagagguucagacugcugc

SEQ ID NO: 3993775 - RNA, 18 nt, Human herpesvirus 6B
ugaaguguuaugaagaau

SEQ ID NO: 3993776 - RNA, 17 nt, Human herpesvirus 6B
ugaaguuccacaucuau

SEQ ID NO: 3993777 - RNA, 19 nt, Human herpesvirus 6B
ugaauauucacaagaagau

SEQ ID NO: 3993778 - RNA, 17 nt, Human herpesvirus 6B
ugaaucccgugaaggaa

SEQ ID NO: 3993779 - RNA, 13 nt, Human herpesvirus 6B
ugacacaauuucu

SEQ ID NO: 3993780 - RNA, 15 nt, Human herpesvirus 6B
ugacauuagagaaau

SEQ ID NO: 3993781 - RNA, 11 nt, Human herpesvirus 6B
ugaccuuuucc

SEQ ID NO: 3993782 - RNA, 23 nt, Human herpesvirus 6B
ugacuacggcgguuaacuguuuc

SEQ ID NO: 3993783 - RNA, 20 nt, Human herpesvirus 6B
ugacuguaccauugucaaca

SEQ ID NO: 3993784 - RNA, 19 nt, Human herpesvirus 6B
ugacuuggccgaguuuaga

SEQ ID NO: 3993785 - RNA, 23 nt, Human herpesvirus 6B
ugagacaucgagauucuuuaaag

SEQ ID NO: 3993786 - RNA, 23 nt, Human herpesvirus 6B
ugagacgccuauucuaauuauaa

SEQ ID NO: 3993787 - RNA, 11 nt, Human herpesvirus 6B
ugagcaaagaa

SEQ ID NO: 3993788 - RNA, 23 nt, Human herpesvirus 6B
ugagcaugacacaucgugaguuu

SEQ ID NO: 3993789 - RNA, 16 nt, Human herpesvirus 6B
ugauaaacuguacgcc

SEQ ID NO: 3993790 - RNA, 17 nt, Human herpesvirus 6B
ugauaccgucuuugcau

SEQ ID NO: 3993791 - RNA, 17 nt, Human herpesvirus 6B
ugauaguuauuuuguau

SEQ ID NO: 3993792 - RNA, 16 nt, Human herpesvirus 6B
ugaugaucugcuuugu

SEQ ID NO: 3993793 - RNA, 15 nt, Human herpesvirus 6B
ugauguugucuucug

SEQ ID NO: 3993794 - RNA, 18 nt, Human herpesvirus 6B
ugauucuguuuucuacgu

SEQ ID NO: 3993795 - RNA, 19 nt, Human herpesvirus 6B
ugauugucuuuucuggaaa

SEQ ID NO: 3993796 - RNA, 14 nt, Human herpesvirus 6B
ugauuugaacagag

SEQ ID NO: 3993797 - RNA, 15 nt, Human herpesvirus 6B
ugcaaaacagauuuu

SEQ ID NO: 3993798 - RNA, 20 nt, Human herpesvirus 6B
ugcaacccgccacucuacaa

SEQ ID NO: 3993799 - RNA, 20 nt, Human herpesvirus 6B
ugcaaugucuucgagauuuu

SEQ ID NO: 3993800 - RNA, 18 nt, Human herpesvirus 6B
ugcaauuugaauucugcu

SEQ ID NO: 3993801 - RNA, 20 nt, Human herpesvirus 6B
ugcagaaccucgcauugaua

SEQ ID NO: 3993802 - RNA, 19 nt, Human herpesvirus 6B
ugcagcgauauggaaacac

SEQ ID NO: 3993803 - RNA, 22 nt, Human herpesvirus 6B
ugcccacaccaucuucagcuca

SEQ ID NO: 3993804 - RNA, 23 nt, Human herpesvirus 6B
ugcccacauuuccuucaaaguga

SEQ ID NO: 3993805 - RNA, 17 nt, Human herpesvirus 6B
ugccccccuucauccag

SEQ ID NO: 3993806 - RNA, 18 nt, Human herpesvirus 6B
ugccgccgaagaaagagg

SEQ ID NO: 3993807 - RNA, 14 nt, Human herpesvirus 6B
ugccgucaccugca

SEQ ID NO: 3993808 - RNA, 21 nt, Human herpesvirus 6B
ugcgaauuaaaacucuaaaag

SEQ ID NO: 3993809 - RNA, 14 nt, Human herpesvirus 6B
ugcucuggaucuaa

SEQ ID NO: 3993810 - RNA, 22 nt, Human herpesvirus 6B
ugcugcuucuguaaccugucuu

SEQ ID NO: 3993811 - RNA, 21 nt, Human herpesvirus 6B
ugcuguaagguuucuaaaucu

SEQ ID NO: 3993812 - RNA, 13 nt, Human herpesvirus 6B
ugcuuaaacugaa

SEQ ID NO: 3993813 - RNA, 14 nt, Human herpesvirus 6B
ugcuucguuucuuc

SEQ ID NO: 3993814 - RNA, 16 nt, Human herpesvirus 6B
ugcuuuaaaaaugcuc

SEQ ID NO: 3993815 - RNA, 13 nt, Human herpesvirus 6B
uggaaaauuuaua

SEQ ID NO: 3993816 - RNA, 22 nt, Human herpesvirus 6B
uggaaacguguuugucuguaug

SEQ ID NO: 3993817 - RNA, 12 nt, Human herpesvirus 6B
uggaacugcuug

SEQ ID NO: 3993818 - RNA, 16 nt, Human herpesvirus 6B
uggaaguguaaauguc

SEQ ID NO: 3993819 - RNA, 19 nt, Human herpesvirus 6B
uggacagaaaaaacaccag

SEQ ID NO: 3993820 - RNA, 13 nt, Human herpesvirus 6B
uggauaaacaucg

SEQ ID NO: 3993821 - RNA, 17 nt, Human herpesvirus 6B
uggaugucaagucuaga

SEQ ID NO: 3993822 - RNA, 21 nt, Human herpesvirus 6B
uggauuacaagggaaauccua

SEQ ID NO: 3993823 - RNA, 20 nt, Human herpesvirus 6B
cugucaguggcuugcugucg

SEQ ID NO: 3993824 - RNA, 13 nt, Human herpesvirus 6B
cuguccgugagac

SEQ ID NO: 3993825 - RNA, 21 nt, Human herpesvirus 6B
cugucgcccgccucucuccgc

SEQ ID NO: 3993826 - RNA, 14 nt, Human herpesvirus 6B
cugugcucuuuaua

SEQ ID NO: 3993827 - RNA, 13 nt, Human herpesvirus 6B
cuguguauuguga

SEQ ID NO: 3993828 - RNA, 21 nt, Human herpesvirus 6B
cuguucaugcgaauuaaaacu

SEQ ID NO: 3993829 - RNA, 11 nt, Human herpesvirus 6B
cuauucagagg

SEQ ID NO: 3993830 - RNA, 15 nt, Human herpesvirus 6B
cuauuuugacaccuc

SEQ ID NO: 3993831 - RNA, 20 nt, Human herpesvirus 6B
cucaaacuuuuagagacuuu

SEQ ID NO: 3993832 - RNA, 18 nt, Human herpesvirus 6B
cucaaagaaagcuccgcg

SEQ ID NO: 3993833 - RNA, 13 nt, Human herpesvirus 6B
cucaagaggguuu

SEQ ID NO: 3993834 - RNA, 22 nt, Human herpesvirus 6B
cucaagaugaaguuuggggaga

SEQ ID NO: 3993835 - RNA, 20 nt, Human herpesvirus 6B
cucaaggucaaaaaacucag

SEQ ID NO: 3993836 - RNA, 13 nt, Human herpesvirus 6B
cucacccccacuc

SEQ ID NO: 3993837 - RNA, 23 nt, Human herpesvirus 6B
cucagcauuguugagaauuuaac

SEQ ID NO: 3993838 - RNA, 21 nt, Human herpesvirus 6B
cucaguagaaugaaugaaaca

SEQ ID NO: 3993839 - RNA, 18 nt, Human herpesvirus 6B
cuccaaauggucccguaa

SEQ ID NO: 3993840 - RNA, 13 nt, Human herpesvirus 6B
cuccacgccccuc

SEQ ID NO: 3993841 - RNA, 14 nt, Human herpesvirus 6B
cucccgcagcuccu

SEQ ID NO: 3993842 - RNA, 22 nt, Human herpesvirus 6B
cucccguccguggaaaaacacu

SEQ ID NO: 3993843 - RNA, 14 nt, Human herpesvirus 6B
cuccgcgcugcugg

SEQ ID NO: 3993844 - RNA, 16 nt, Human herpesvirus 6B
cuccguucccuucucg

SEQ ID NO: 3993845 - RNA, 14 nt, Human herpesvirus 6B
cuccuggguacggc

SEQ ID NO: 3993846 - RNA, 22 nt, Human herpesvirus 6B
cucgccgucgucgcucucccuc

SEQ ID NO: 3993847 - RNA, 18 nt, Human herpesvirus 6B
cucggcgacgagccuugu

SEQ ID NO: 3993848 - RNA, 14 nt, Human herpesvirus 6B
cucguggcccgugg

SEQ ID NO: 3993849 - RNA, 17 nt, Human herpesvirus 6B
cucucacccccacucga

SEQ ID NO: 3993850 - RNA, 14 nt, Human herpesvirus 6B
cucucccucuuccc

SEQ ID NO: 3993851 - RNA, 23 nt, Human herpesvirus 6B
cucucgugccguugccuuggccg

SEQ ID NO: 3993852 - RNA, 12 nt, Human herpesvirus 6B
cucucucaccug

SEQ ID NO: 3993853 - RNA, 19 nt, Human herpesvirus 6B
cucugcaacuuuauuugaa

SEQ ID NO: 3993854 - RNA, 20 nt, Human herpesvirus 6B
cucugcaauuugguucagcu

SEQ ID NO: 3993855 - RNA, 15 nt, Human herpesvirus 6B
cucugcccuucuucg

SEQ ID NO: 3993856 - RNA, 23 nt, Human herpesvirus 6B
cucuuaacaagagaggaugcuuu

SEQ ID NO: 3993857 - RNA, 15 nt, Human herpesvirus 6B
cucuugcaguggcgc

SEQ ID NO: 3993858 - RNA, 21 nt, Human herpesvirus 6B
cugaacuguuuccagagcaca

SEQ ID NO: 3993859 - RNA, 15 nt, Human herpesvirus 6B
cugaaucagaaacug

SEQ ID NO: 3993860 - RNA, 15 nt, Human herpesvirus 6B
cugagaccgagagaa

SEQ ID NO: 3993861 - RNA, 15 nt, Human herpesvirus 6B
cugagagcaggagca

SEQ ID NO: 3993862 - RNA, 20 nt, Human herpesvirus 6B
cugagagcaggagcaggcuc

SEQ ID NO: 3993863 - RNA, 12 nt, Human herpesvirus 6B
cugauaaacucc

SEQ ID NO: 3993864 - RNA, 18 nt, Human herpesvirus 6B
cugauccaugagcacccg

SEQ ID NO: 3993865 - RNA, 19 nt, Human herpesvirus 6B
cugaugauuugaaauguuc

SEQ ID NO: 3993866 - RNA, 13 nt, Human herpesvirus 6B
cugcaaaaacaaa

SEQ ID NO: 3993867 - RNA, 21 nt, Human herpesvirus 6B
cugcaauuugaauucugcucg

SEQ ID NO: 3993868 - RNA, 22 nt, Human herpesvirus 6B
cugcagauucggggggagacag

SEQ ID NO: 3993869 - RNA, 16 nt, Human herpesvirus 6B
cugcauacagaaauug

SEQ ID NO: 3993870 - RNA, 16 nt, Human herpesvirus 6B
cugccgcaucgcaccg

SEQ ID NO: 3993871 - RNA, 21 nt, Human herpesvirus 6B
cugccuuuaacccgaugagaa

SEQ ID NO: 3993872 - RNA, 12 nt, Human herpesvirus 6B
cugccuuuggac

SEQ ID NO: 3993873 - RNA, 17 nt, Human herpesvirus 6B
cugcgcagacggaaaga

SEQ ID NO: 3993874 - RNA, 20 nt, Human herpesvirus 6B
cugcgguugaaaucuuuccu

SEQ ID NO: 3993875 - RNA, 14 nt, Human herpesvirus 6B
cugcguuaagugaa

SEQ ID NO: 3993876 - RNA, 21 nt, Human herpesvirus 6B
cugcguuccaugugucuccgg

SEQ ID NO: 3993877 - RNA, 20 nt, Human herpesvirus 6B
cuggaagaaggaaaaaauuc

SEQ ID NO: 3993878 - RNA, 13 nt, Human herpesvirus 6B
cuggauacuauug

SEQ ID NO: 3993879 - RNA, 18 nt, Human herpesvirus 6B
cuggcaugcguuacggag

SEQ ID NO: 3993880 - RNA, 18 nt, Human herpesvirus 6B
cugggcgcagaaggagaa

SEQ ID NO: 3993881 - RNA, 20 nt, Human herpesvirus 6B
cugguucaggauuuguaaaa

SEQ ID NO: 3993882 - RNA, 16 nt, Human herpesvirus 6B
cugguuugcuuuggau

SEQ ID NO: 3993883 - RNA, 13 nt, Human herpesvirus 6B
cuguaaacaaauu

SEQ ID NO: 3993884 - RNA, 16 nt, Human herpesvirus 6B
cuguaaaccaguaucu

SEQ ID NO: 3993885 - RNA, 14 nt, Human herpesvirus 6B
cuguacacaaaaac

SEQ ID NO: 3993886 - RNA, 16 nt, Human herpesvirus 6B
cuguaccccaagugaa

SEQ ID NO: 3993887 - RNA, 22 nt, Human herpesvirus 6B
cuguaguuuuuuucugaugacu

SEQ ID NO: 3993888 - RNA, 12 nt, Human herpesvirus 6B
cugucacacucu

SEQ ID NO: 3993889 - RNA, 14 nt, Human herpesvirus 6B
cuguccgugacaca

SEQ ID NO: 3993890 - RNA, 20 nt, Human herpesvirus 6B
cugucgcccgccucucuccg

SEQ ID NO: 3993891 - RNA, 20 nt, Human herpesvirus 6B
cugucuguguuucagaaggc

SEQ ID NO: 3993892 - RNA, 11 nt, Human herpesvirus 6B
cugucuguucc

SEQ ID NO: 3993893 - RNA, 22 nt, Human herpesvirus 6B
cugugaucaggaaauuaauaag

SEQ ID NO: 3993894 - RNA, 11 nt, Human herpesvirus 6B
cugugcaaagc

SEQ ID NO: 3993895 - RNA, 20 nt, Human herpesvirus 6B
cuguggaccaugcagcugcc

SEQ ID NO: 3993896 - RNA, 22 nt, Human herpesvirus 6B
cuguucggauccaaugaugaaa

SEQ ID NO: 3993897 - RNA, 13 nt, Human herpesvirus 6B
cuguuguuguagu

SEQ ID NO: 3993898 - RNA, 14 nt, Human herpesvirus 6B
cuuaacaagagagg

SEQ ID NO: 3993899 - RNA, 15 nt, Human herpesvirus 6B
cuuaacauacaacuu

SEQ ID NO: 3993900 - RNA, 13 nt, Human herpesvirus 6B
cuuacgaucuuua

SEQ ID NO: 3993901 - RNA, 22 nt, Human herpesvirus 6B
cuuagacgaaaauuguaacuuc

SEQ ID NO: 3993902 - RNA, 19 nt, Human herpesvirus 6B
cuuagauaugucguuucau

SEQ ID NO: 3993903 - RNA, 16 nt, Human herpesvirus 6B
cuuaggauguaaaugc

SEQ ID NO: 3993904 - RNA, 17 nt, Human herpesvirus 6B
cuuauggcaagcacuga

SEQ ID NO: 3993905 - RNA, 22 nt, Human herpesvirus 6B
cuuauguaguguggaauuuaaa

SEQ ID NO: 3993906 - RNA, 19 nt, Human herpesvirus 6B
cuuauugaggaaaugcagc

SEQ ID NO: 3993907 - RNA, 15 nt, Human herpesvirus 6B
cuucaauguuuuuca

SEQ ID NO: 3993908 - RNA, 13 nt, Human herpesvirus 6B
cuucacgugauuu

SEQ ID NO: 3993909 - RNA, 14 nt, Human herpesvirus 6B
cuuccccaagcaaa

SEQ ID NO: 3993910 - RNA, 20 nt, Human herpesvirus 6B
cuucgagauuuuagaauaaa

SEQ ID NO: 3993911 - RNA, 18 nt, Human herpesvirus 6B
cuucuuggagucuggccu

SEQ ID NO: 3993912 - RNA, 16 nt, Human herpesvirus 6B
cuugaaagaguacagg

SEQ ID NO: 3993913 - RNA, 15 nt, Human herpesvirus 6B
cuugauuuuugagau

SEQ ID NO: 3993914 - RNA, 21 nt, Human herpesvirus 6B
cuugcaaacagcuuuauuccc

SEQ ID NO: 3993915 - RNA, 13 nt, Human herpesvirus 6B
cuugcaagaaagc

SEQ ID NO: 3993916 - RNA, 16 nt, Human herpesvirus 6B
cuugcacggaaucucu

SEQ ID NO: 3993917 - RNA, 23 nt, Human herpesvirus 6B
cuugugcaaaaaucucuuauggu

SEQ ID NO: 3993918 - RNA, 16 nt, Human herpesvirus 6B
cuuuauuucuaaggag

SEQ ID NO: 3993919 - RNA, 12 nt, Human herpesvirus 6B
cuuucaaugucc

SEQ ID NO: 3993920 - RNA, 11 nt, Human herpesvirus 6B
cuuuccaagga

SEQ ID NO: 3993921 - RNA, 18 nt, Human herpesvirus 6B
cuuugaacaucuauuauc

SEQ ID NO: 3993922 - RNA, 22 nt, Human herpesvirus 6B
cuuugaaggacuaucugagaca

SEQ ID NO: 3993923 - RNA, 14 nt, Human herpesvirus 6B
cuuugauaaaacca

SEQ ID NO: 3993924 - RNA, 23 nt, Human herpesvirus 6B
cuuugauaaaaccaucuauuugc

SEQ ID NO: 3993925 - RNA, 22 nt, Human herpesvirus 6B
cuuugggaccuucaggaacaaa

SEQ ID NO: 3993926 - RNA, 19 nt, Human herpesvirus 6B
cuuuuuuccucgaugguag

SEQ ID NO: 3993927 - RNA, 15 nt, Human herpesvirus 6B
cuuuuuuucccgaaa

SEQ ID NO: 3993928 - RNA, 20 nt, Human herpesvirus 6B
gaaaaagccugaaggcuacu

SEQ ID NO: 3993929 - RNA, 11 nt, Human herpesvirus 6B
gaaaacaaugc

SEQ ID NO: 3993930 - RNA, 22 nt, Human herpesvirus 6B
gaaaacaugacggacuuggaaa

SEQ ID NO: 3993931 - RNA, 19 nt, Human herpesvirus 6B
gaaaacgcagcaugaugau

SEQ ID NO: 3993932 - RNA, 20 nt, Human herpesvirus 6B
gaaaacgguaaagaugagau

SEQ ID NO: 3993933 - RNA, 16 nt, Human herpesvirus 6B
gaaaacuucuguuuua

SEQ ID NO: 3993934 - RNA, 17 nt, Human herpesvirus 6B
gaaaagaucaagcaagu

SEQ ID NO: 3993935 - RNA, 13 nt, Human herpesvirus 6B
gaaaagugcuuua

SEQ ID NO: 3993936 - RNA, 20 nt, Human herpesvirus 6B
gaaaauacgucagcucuuca

SEQ ID NO: 3993937 - RNA, 23 nt, Human herpesvirus 6B
gaaacacuuucuucgccuguaaa

SEQ ID NO: 3993938 - RNA, 17 nt, Human herpesvirus 6B
gaaaccccacaaagccu

SEQ ID NO: 3993939 - RNA, 12 nt, Human herpesvirus 6B
gaaagagggaag

SEQ ID NO: 3993940 - RNA, 17 nt, Human herpesvirus 6B
gaaaggcggagacacau

SEQ ID NO: 3993941 - RNA, 17 nt, Human herpesvirus 6B
gaaagggacguccccgg

SEQ ID NO: 3993942 - RNA, 15 nt, Human herpesvirus 6B
gggauaaauauuucu

SEQ ID NO: 3993943 - RNA, 18 nt, Human herpesvirus 6B
gggaucgacgaccaggca

SEQ ID NO: 3993944 - RNA, 22 nt, Human herpesvirus 6B
gggcauagaaagcggccaggcc

SEQ ID NO: 3993945 - RNA, 12 nt, Human herpesvirus 6B
gggccagcccug

SEQ ID NO: 3993946 - RNA, 12 nt, Human herpesvirus 6B
gggccucccucc

SEQ ID NO: 3993947 - RNA, 16 nt, Human herpesvirus 6B
gggcuuaauaaaggau

SEQ ID NO: 3993948 - RNA, 16 nt, Human herpesvirus 6B
ggggaccacugucguc

SEQ ID NO: 3993949 - RNA, 12 nt, Human herpesvirus 6B
ggucagaugcaa

SEQ ID NO: 3993950 - RNA, 15 nt, Human herpesvirus 6B
ggugauuugaacaga

SEQ ID NO: 3993951 - RNA, 16 nt, Human herpesvirus 6B
gguggacaccaauaaa

SEQ ID NO: 3993952 - RNA, 20 nt, Human herpesvirus 6B
gguugucacacgucccuucu

SEQ ID NO: 3993953 - RNA, 14 nt, Human herpesvirus 6B
gguuguccuugguc

SEQ ID NO: 3993954 - RNA, 19 nt, Human herpesvirus 6B
gguugucuuguuagacaag

SEQ ID NO: 3993955 - RNA, 15 nt, Human herpesvirus 6B
gguuguuuuucuaaa

SEQ ID NO: 3993956 - RNA, 12 nt, Human herpesvirus 6B
gguuugcuuugg

SEQ ID NO: 3993957 - RNA, 20 nt, Human herpesvirus 6B
gguuuugucguuuguacaug

SEQ ID NO: 3993958 - RNA, 15 nt, Human herpesvirus 6B
guaagauuaaaugug

SEQ ID NO: 3993959 - RNA, 19 nt, Human herpesvirus 6B
guacaaagguuuuugcugu

SEQ ID NO: 3993960 - RNA, 16 nt, Human herpesvirus 6B
guaccgaauaaaacaa

SEQ ID NO: 3993961 - RNA, 22 nt, Human herpesvirus 6B
guaccucuaugauacuuugaaa

SEQ ID NO: 3993962 - RNA, 13 nt, Human herpesvirus 6B
guacgauuucugu

SEQ ID NO: 3993963 - RNA, 14 nt, Human herpesvirus 6B
guacgcgccacagc

SEQ ID NO: 3993964 - RNA, 12 nt, Human herpesvirus 6B
guauaauguaaa

SEQ ID NO: 3993965 - RNA, 16 nt, Human herpesvirus 6B
guauauggugaugaau

SEQ ID NO: 3993966 - RNA, 23 nt, Human herpesvirus 6B
guaucugccccccuucauccagc

SEQ ID NO: 3993967 - RNA, 16 nt, Human herpesvirus 6B
guaucuggcuggucaa

SEQ ID NO: 3993968 - RNA, 19 nt, Human herpesvirus 6B
guaucuuacaacacaauau

SEQ ID NO: 3993969 - RNA, 23 nt, Human herpesvirus 6B
guaucuugcggcauguguaagaa

SEQ ID NO: 3993970 - RNA, 15 nt, Human herpesvirus 6B
guaugagcguuuaua

SEQ ID NO: 3993971 - RNA, 22 nt, Human herpesvirus 6B
guauuaauuuuuuguuucugaa

SEQ ID NO: 3993972 - RNA, 22 nt, Human herpesvirus 6B
gucaagggcaagguucucagca

SEQ ID NO: 3993973 - RNA, 18 nt, Human herpesvirus 6B
gucacucacauagagaag

SEQ ID NO: 3993974 - RNA, 18 nt, Human herpesvirus 6B
gucauauccagaaaauac

SEQ ID NO: 3993975 - RNA, 17 nt, Human herpesvirus 6B
gucaugcaaaacagauu

SEQ ID NO: 3993976 - RNA, 19 nt, Human herpesvirus 6B
gucaugugcuauuguaaga

SEQ ID NO: 3993977 - RNA, 19 nt, Human herpesvirus 6B
gucauucgcguggcggcgc

SEQ ID NO: 3993978 - RNA, 14 nt, Human herpesvirus 6B
guccaaggauuaug

SEQ ID NO: 3993979 - RNA, 16 nt, Human herpesvirus 6B
guccaaugaauacuuc

SEQ ID NO: 3993980 - RNA, 19 nt, Human herpesvirus 6B
gucccgguauggaucucac

SEQ ID NO: 3993981 - RNA, 18 nt, Human herpesvirus 6B
gucccuucuccgucaccc

SEQ ID NO: 3993982 - RNA, 18 nt, Human herpesvirus 6B
guccgacacgcccccacc

SEQ ID NO: 3993983 - RNA, 12 nt, Human herpesvirus 6B
guccguggaaaa

SEQ ID NO: 3993984 - RNA, 15 nt, Human herpesvirus 6B
guccuacagaagaaa

SEQ ID NO: 3993985 - RNA, 23 nt, Human herpesvirus 6B
guccuauucagaggugcugauga

SEQ ID NO: 3993986 - RNA, 23 nt, Human herpesvirus 6B
gucgcccgccucucuccgccucc

SEQ ID NO: 3993987 - RNA, 21 nt, Human herpesvirus 6B
gucgcggccgucgcgcucgcc

SEQ ID NO: 3993988 - RNA, 23 nt, Human herpesvirus 6B
gucuaugacuuuucugaaauucu

SEQ ID NO: 3993989 - RNA, 14 nt, Human herpesvirus 6B
gucucuuuaaacag

SEQ ID NO: 3993990 - RNA, 14 nt, Human herpesvirus 6B
gucugagcagaggu

SEQ ID NO: 3993991 - RNA, 14 nt, Human herpesvirus 6B
gucuguugcuguag

SEQ ID NO: 3993992 - RNA, 16 nt, Human herpesvirus 6B
gucuguugcuguaguu

SEQ ID NO: 3993993 - RNA, 17 nt, Human herpesvirus 6B
gucuuacaucuaagcug

SEQ ID NO: 3993994 - RNA, 17 nt, Human herpesvirus 6B
gucuucauucuucgaau

SEQ ID NO: 3993995 - RNA, 16 nt, Human herpesvirus 6B
gugaaacgauguguua

SEQ ID NO: 3993996 - RNA, 19 nt, Human herpesvirus 6B
gugaauugugcaagcugua

SEQ ID NO: 3993997 - RNA, 11 nt, Human herpesvirus 6B
gugacaaggua

SEQ ID NO: 3993998 - RNA, 19 nt, Human herpesvirus 6B
gugacagcaacuaagcugu

SEQ ID NO: 3993999 - RNA, 20 nt, Human herpesvirus 6B
gugaccguaucccucccugc

SEQ ID NO: 3994000 - RNA, 19 nt, Human herpesvirus 6B
gugacuaaugcgauuucac

SEQ ID NO: 3994001 - RNA, 12 nt, Human herpesvirus 6B
gugagugcuauu

SEQ ID NO: 3994002 - RNA, 21 nt, Human herpesvirus 6B
gugaguuuucaugugaaauua

SEQ ID NO: 3994003 - RNA, 13 nt, Human herpesvirus 6B
gugaguuuuggaa

SEQ ID NO: 3994004 - RNA, 17 nt, Human herpesvirus 6B
gugaucauaggacagag

SEQ ID NO: 3994005 - RNA, 22 nt, Human herpesvirus 6B
gugaucgcaaaagagaaggaaa

SEQ ID NO: 3994006 - RNA, 18 nt, Human herpesvirus 6B
gugauuucacgugaaaua

SEQ ID NO: 3994007 - RNA, 15 nt, Human herpesvirus 6B
gugcacauagaaaac

SEQ ID NO: 3994008 - RNA, 20 nt, Human herpesvirus 6B
gugcacgcacgucacgggca

SEQ ID NO: 3994009 - RNA, 15 nt, Human herpesvirus 6B
gugccggcgcgcaaa

SEQ ID NO: 3994010 - RNA, 19 nt, Human herpesvirus 6B
gugcguuauuuucuguauu

SEQ ID NO: 3994011 - RNA, 17 nt, Human herpesvirus 6B
gugcuuguuuuggugga

SEQ ID NO: 3994012 - RNA, 12 nt, Human herpesvirus 6B
guggaaauuaaa

SEQ ID NO: 3994013 - RNA, 14 nt, Human herpesvirus 6B
guggaaauuaaaaa

SEQ ID NO: 3994014 - RNA, 17 nt, Human herpesvirus 6B
guggaaguguaaauguc

SEQ ID NO: 3994015 - RNA, 22 nt, Human herpesvirus 6B
guggaaguguaaaugucacuca

SEQ ID NO: 3994016 - RNA, 17 nt, Human herpesvirus 6B
guggcagggcuguuguc

SEQ ID NO: 3994017 - RNA, 16 nt, Human herpesvirus 6B
guggccgucuccugca

SEQ ID NO: 3994018 - RNA, 13 nt, Human herpesvirus 6B
guguucauagagc

SEQ ID NO: 3994019 - RNA, 19 nt, Human herpesvirus 6B
guguugcgauugcugcuuc

SEQ ID NO: 3994020 - RNA, 18 nt, Human herpesvirus 6B
guguuuguuuuuagaagc

SEQ ID NO: 3994021 - RNA, 14 nt, Human herpesvirus 6B
guuaaagaugcuga

SEQ ID NO: 3994022 - RNA, 21 nt, Human herpesvirus 6B
guuacauuugguuugacauua

SEQ ID NO: 3994023 - RNA, 16 nt, Human herpesvirus 6B
guuagcccgugcagag

SEQ ID NO: 3994024 - RNA, 13 nt, Human herpesvirus 6B
guuauuagacacc

SEQ ID NO: 3994025 - RNA, 18 nt, Human herpesvirus 6B
guucaugcgaauuaaaac

SEQ ID NO: 3994026 - RNA, 19 nt, Human herpesvirus 6B
guuccuccgcgggaccugg

SEQ ID NO: 3994027 - RNA, 15 nt, Human herpesvirus 6B
guucggacucucguc

SEQ ID NO: 3994028 - RNA, 21 nt, Human herpesvirus 6B
guucuugauguuagauaaaau

SEQ ID NO: 3994029 - RNA, 15 nt, Human herpesvirus 6B
guugaaaucuuuccu

SEQ ID NO: 3994030 - RNA, 19 nt, Human herpesvirus 6B
guugcccucccgcagcucc

SEQ ID NO: 3994031 - RNA, 14 nt, Human herpesvirus 6B
guugggggaugggu

SEQ ID NO: 3994032 - RNA, 21 nt, Human herpesvirus 6B
guugucuucugugcuuuccaa

SEQ ID NO: 3994033 - RNA, 21 nt, Human herpesvirus 6B
guuuaaagugaguuuuggaaa

SEQ ID NO: 3994034 - RNA, 18 nt, Human herpesvirus 6B
guuuagcaugggugagug

SEQ ID NO: 3994035 - RNA, 20 nt, Human herpesvirus 6B
guuuaucaugagagagcaaa

SEQ ID NO: 3994036 - RNA, 14 nt, Human herpesvirus 6B
guuuuauggcuggg

SEQ ID NO: 3994037 - RNA, 20 nt, Human herpesvirus 6B
guuuucaaugguauucgaaa

SEQ ID NO: 3994038 - RNA, 16 nt, Human herpesvirus 6B
guuuuguaggacugaa

SEQ ID NO: 3994039 - RNA, 15 nt, Human herpesvirus 6B
guuuuucacagaaug

SEQ ID NO: 3994040 - RNA, 18 nt, Human herpesvirus 6B
uaaaaccaucuauuugca

SEQ ID NO: 3994041 - RNA, 18 nt, Human herpesvirus 6B
uaaaaccugcuaacggag

SEQ ID NO: 3994042 - RNA, 22 nt, Human herpesvirus 6B
uaaaacggauaguuaaaaguug

SEQ ID NO: 3994043 - RNA, 16 nt, Human herpesvirus 6B
uaaaagcuauguauga

SEQ ID NO: 3994044 - RNA, 12 nt, Human herpesvirus 6B
uaaaauguuucc

SEQ ID NO: 3994045 - RNA, 15 nt, Human herpesvirus 6B
uaaaauugcuacuaa

SEQ ID NO: 3994046 - RNA, 22 nt, Human herpesvirus 6B
uaaaauuuugcgucgucugugc

SEQ ID NO: 3994047 - RNA, 15 nt, Human herpesvirus 6B
uaaagguuagugggu

SEQ ID NO: 3994048 - RNA, 16 nt, Human herpesvirus 6B
uaaagguuagugggua

SEQ ID NO: 3994049 - RNA, 22 nt, Human herpesvirus 6B
uaaagugccgugagugcuauuu

SEQ ID NO: 3994050 - RNA, 14 nt, Human herpesvirus 6B
uaaaguuuacugug

SEQ ID NO: 3994051 - RNA, 13 nt, Human herpesvirus 6B
uaaauaaucaacu

SEQ ID NO: 3994052 - RNA, 22 nt, Human herpesvirus 6B
uaaauaccauuuuauacgaaaa

SEQ ID NO: 3994053 - RNA, 17 nt, Human herpesvirus 6B
uaaaucgcgagacagau

SEQ ID NO: 3994054 - RNA, 20 nt, Human herpesvirus 6B
uaaaucggguaaauauguga

SEQ ID NO: 3994055 - RNA, 19 nt, Human herpesvirus 6B
auugacggguauuuuacau

SEQ ID NO: 3994056 - RNA, 21 nt, Human herpesvirus 6B
auugaugggauguaaucaaug

SEQ ID NO: 3994057 - RNA, 20 nt, Human herpesvirus 6B
auugcuaagaucugucucca

SEQ ID NO: 3994058 - RNA, 14 nt, Human herpesvirus 6B
auugcucaaaauug

SEQ ID NO: 3994059 - RNA, 17 nt, Human herpesvirus 6B
auuggaaucacaaaaug

SEQ ID NO: 3994060 - RNA, 16 nt, Human herpesvirus 6B
auuguaagacuaaaug

SEQ ID NO: 3994061 - RNA, 19 nt, Human herpesvirus 6B
auuguaauuccaauugcug

SEQ ID NO: 3994062 - RNA, 14 nt, Human herpesvirus 6B
auugugacaaggua

SEQ ID NO: 3994063 - RNA, 19 nt, Human herpesvirus 6B
auuguguguccugagaaug

SEQ ID NO: 3994064 - RNA, 16 nt, Human herpesvirus 6B
auuguguucugcucug

SEQ ID NO: 3994065 - RNA, 18 nt, Human herpesvirus 6B
auuguugauagguaaacu

SEQ ID NO: 3994066 - RNA, 23 nt, Human herpesvirus 6B
auuuaaaaagcaaggugaaacau

SEQ ID NO: 3994067 - RNA, 20 nt, Human herpesvirus 6B
auuuaaaaaugauaacuguu

SEQ ID NO: 3994068 - RNA, 17 nt, Human herpesvirus 6B
auuuaacauccaaaaua

SEQ ID NO: 3994069 - RNA, 15 nt, Human herpesvirus 6B
auuuacuguuuugac

SEQ ID NO: 3994070 - RNA, 20 nt, Human herpesvirus 6B
auuuagccuauuaagcagcc

SEQ ID NO: 3994071 - RNA, 19 nt, Human herpesvirus 6B
auuuaguuuauguuaaaaa

SEQ ID NO: 3994072 - RNA, 19 nt, Human herpesvirus 6B
auuucauagauugcacgcu

SEQ ID NO: 3994073 - RNA, 19 nt, Human herpesvirus 6B
auuucucuacaugccacag

SEQ ID NO: 3994074 - RNA, 17 nt, Human herpesvirus 6B
auuugauguugucuucu

SEQ ID NO: 3994075 - RNA, 13 nt, Human herpesvirus 6B
auuuuaaaaagaa

SEQ ID NO: 3994076 - RNA, 16 nt, Human herpesvirus 6B
auuuuaaacuuaacuu

SEQ ID NO: 3994077 - RNA, 20 nt, Human herpesvirus 6B
auuuuaaaugacaaugugaa

SEQ ID NO: 3994078 - RNA, 17 nt, Human herpesvirus 6B
auuuuauuuuguggcua

SEQ ID NO: 3994079 - RNA, 19 nt, Human herpesvirus 6B
auuuucguugaagaauaag

SEQ ID NO: 3994080 - RNA, 15 nt, Human herpesvirus 6B
auuuucugaaaucuu

SEQ ID NO: 3994081 - RNA, 17 nt, Human herpesvirus 6B
auuuucuguauuaauuu

SEQ ID NO: 3994082 - RNA, 22 nt, Human herpesvirus 6B
auuuugauggucgauuguaauu

SEQ ID NO: 3994083 - RNA, 22 nt, Human herpesvirus 6B
auuuugggccguaaacuuauug

SEQ ID NO: 3994084 - RNA, 23 nt, Human herpesvirus 6B
auuuuuuaauccauauuuggaag

SEQ ID NO: 3994085 - RNA, 22 nt, Human herpesvirus 6B
auuuuuuauuaguauccuucuc

SEQ ID NO: 3994086 - RNA, 13 nt, Human herpesvirus 6B
caaaaagaaaaca

SEQ ID NO: 3994087 - RNA, 21 nt, Human herpesvirus 6B
caaaaauccaggaguaaugau

SEQ ID NO: 3994088 - RNA, 19 nt, Human herpesvirus 6B
caaaagauuauggcaacau

SEQ ID NO: 3994089 - RNA, 15 nt, Human herpesvirus 6B
caaaagcgccugccu

SEQ ID NO: 3994090 - RNA, 17 nt, Human herpesvirus 6B
caaaaugaccagagauu

SEQ ID NO: 3994091 - RNA, 21 nt, Human herpesvirus 6B
caaacaacuguuguguuugaa

SEQ ID NO: 3994092 - RNA, 11 nt, Human herpesvirus 6B
caaacagagau

SEQ ID NO: 3994093 - RNA, 17 nt, Human herpesvirus 6B
caaacucaaagaaagcu

SEQ ID NO: 3994094 - RNA, 15 nt, Human herpesvirus 6B
caaagauagacagug

SEQ ID NO: 3994095 - RNA, 20 nt, Human herpesvirus 6B
caaagauagacagugaaaaa

SEQ ID NO: 3994096 - RNA, 21 nt, Human herpesvirus 6B
caaagauauuucuaucuggaa

SEQ ID NO: 3994097 - RNA, 16 nt, Human herpesvirus 6B
caaagggaagccagcc

SEQ ID NO: 3994098 - RNA, 18 nt, Human herpesvirus 6B
caaagguuuuugcuguca

SEQ ID NO: 3994099 - RNA, 20 nt, Human herpesvirus 6B
caaaguccuggaaagcaucc

SEQ ID NO: 3994100 - RNA, 17 nt, Human herpesvirus 6B
caaauaaguggugauga

SEQ ID NO: 3994101 - RNA, 21 nt, Human herpesvirus 6B
caaaucuguaagauuaaaugu

SEQ ID NO: 3994102 - RNA, 17 nt, Human herpesvirus 6B
caacaacccuuauuuua

SEQ ID NO: 3994103 - RNA, 11 nt, Human herpesvirus 6B
caacaauaaua

SEQ ID NO: 3994104 - RNA, 20 nt, Human herpesvirus 6B
caacacggggugagagagcu

SEQ ID NO: 3994105 - RNA, 12 nt, Human herpesvirus 6B
caacaucucaua

SEQ ID NO: 3994106 - RNA, 14 nt, Human herpesvirus 6B
caacauguauucuc

SEQ ID NO: 3994107 - RNA, 16 nt, Human herpesvirus 6B
caaccaaacaguuuca

SEQ ID NO: 3994108 - RNA, 19 nt, Human herpesvirus 6B
caacgcuaaauuuaucaaa

SEQ ID NO: 3994109 - RNA, 17 nt, Human herpesvirus 6B
caacgugugaaaacuag

SEQ ID NO: 3994110 - RNA, 18 nt, Human herpesvirus 6B
caacguuacgauuuucua

SEQ ID NO: 3994111 - RNA, 20 nt, Human herpesvirus 6B
caacuaacuucacagggaaa

SEQ ID NO: 3994112 - RNA, 23 nt, Human herpesvirus 6B
caacugagagacggaucugccgc

SEQ ID NO: 3994113 - RNA, 23 nt, Human herpesvirus 6B
caagaaaucacguugaaaugucg

SEQ ID NO: 3994114 - RNA, 17 nt, Human herpesvirus 6B
caagccugcgcguggaa

SEQ ID NO: 3994115 - RNA, 14 nt, Human herpesvirus 6B
caagcgccaggacg

SEQ ID NO: 3994116 - RNA, 20 nt, Human herpesvirus 6B
caagcugggaaagaucgaga

SEQ ID NO: 3994117 - RNA, 17 nt, Human herpesvirus 6B
caaggaagagaaugaau

SEQ ID NO: 3994118 - RNA, 13 nt, Human herpesvirus 6B
caagguucucagc

SEQ ID NO: 3994119 - RNA, 20 nt, Human herpesvirus 6B
caagucgccucacuguaaaa

SEQ ID NO: 3994120 - RNA, 19 nt, Human herpesvirus 6B
caaguggaaguguaaaugu

SEQ ID NO: 3994121 - RNA, 19 nt, Human herpesvirus 6B
caaguuaaauuucguugua

SEQ ID NO: 3994122 - RNA, 19 nt, Human herpesvirus 6B
caauaaaaaacuuauaauu

SEQ ID NO: 3994123 - RNA, 23 nt, Human herpesvirus 6B
caauaaaaaacuuauaauuggaa

SEQ ID NO: 3994124 - RNA, 12 nt, Human herpesvirus 6B
caauaaacauga

SEQ ID NO: 3994125 - RNA, 16 nt, Human herpesvirus 6B
caauauaugaaauacu

SEQ ID NO: 3994126 - RNA, 16 nt, Human herpesvirus 6B
caaucaucugguaaau

SEQ ID NO: 3994127 - RNA, 21 nt, Human herpesvirus 6B
caaugcgguuugucuugcaaa

SEQ ID NO: 3994128 - RNA, 21 nt, Human herpesvirus 6B
caaugucgcagaaucaagaaa

SEQ ID NO: 3994129 - RNA, 21 nt, Human herpesvirus 6B
caauugcugcuggguguaugu

SEQ ID NO: 3994130 - RNA, 20 nt, Human herpesvirus 6B
caauuucugacucucuuuca

SEQ ID NO: 3994131 - RNA, 15 nt, Human herpesvirus 6B
caauuugaauucugc

SEQ ID NO: 3994132 - RNA, 12 nt, Human herpesvirus 6B
cacaaaucugua

SEQ ID NO: 3994133 - RNA, 13 nt, Human herpesvirus 6B
cacaacacaucua

SEQ ID NO: 3994134 - RNA, 23 nt, Human herpesvirus 6B
cacaaugucgcagaaucaagaaa

SEQ ID NO: 3994135 - RNA, 20 nt, Human herpesvirus 6B
cacaguucguccagcagcgg

SEQ ID NO: 3994136 - RNA, 17 nt, Human herpesvirus 6B
caccagauaggaaaagg

SEQ ID NO: 3994137 - RNA, 21 nt, Human herpesvirus 6B
caccccccucuugcaguggcg

SEQ ID NO: 3994138 - RNA, 16 nt, Human herpesvirus 6B
cacccgaugaggaaaa

SEQ ID NO: 3994139 - RNA, 15 nt, Human herpesvirus 6B
caccgaauuuauuca

SEQ ID NO: 3994140 - RNA, 22 nt, Human herpesvirus 6B
caccugccuagaauucucuccc

SEQ ID NO: 3994141 - RNA, 15 nt, Human herpesvirus 6B
caccuggcgcaccgc

SEQ ID NO: 3994142 - RNA, 19 nt, Human herpesvirus 6B
cacgccauccacccauaua

SEQ ID NO: 3994143 - RNA, 23 nt, Human herpesvirus 6B
cacgcccccucgguccccccucc

SEQ ID NO: 3994144 - RNA, 13 nt, Human herpesvirus 6B
cacgcgcggacca

SEQ ID NO: 3994145 - RNA, 16 nt, Human herpesvirus 6B
cacgcgcggaccacuc

SEQ ID NO: 3994146 - RNA, 19 nt, Human herpesvirus 6B
cacgcggggaucgggccug

SEQ ID NO: 3994147 - RNA, 21 nt, Human herpesvirus 6B
cacggagaauaccgacaagcc

SEQ ID NO: 3994148 - RNA, 18 nt, Human herpesvirus 6B
cacggcaacgcuccuccc

SEQ ID NO: 3994149 - RNA, 23 nt, Human herpesvirus 6B
cacggcaacgcuccucccacgcc

SEQ ID NO: 3994150 - RNA, 20 nt, Human herpesvirus 6B
cacggcgaaagccagggcgu

SEQ ID NO: 3994151 - RNA, 15 nt, Human herpesvirus 6B
cacggcgccucccau

SEQ ID NO: 3994152 - RNA, 20 nt, Human herpesvirus 6B
cacgguagucguggcggagc

SEQ ID NO: 3994153 - RNA, 18 nt, Human herpesvirus 6B
cacguccagcgcauccuu

SEQ ID NO: 3994154 - RNA, 17 nt, Human herpesvirus 6B
cacuggcgaaggcccgu

SEQ ID NO: 3994155 - RNA, 23 nt, Human herpesvirus 6B
cagaagcugucuguguuucagaa

SEQ ID NO: 3994156 - RNA, 16 nt, Human herpesvirus 6B
cagaauuacaaacugg

SEQ ID NO: 3994157 - RNA, 20 nt, Human herpesvirus 6B
cagaccguuaucggcauuga

SEQ ID NO: 3994158 - RNA, 14 nt, Human herpesvirus 6B
cagagagccgcaga

SEQ ID NO: 3994159 - RNA, 14 nt, Human herpesvirus 6B
cagagcggagaggc

SEQ ID NO: 3994160 - RNA, 19 nt, Human herpesvirus 6B
cagagcugaugauuugaaa

SEQ ID NO: 3994161 - RNA, 20 nt, Human herpesvirus 6B
cagauagaaaauugucuaca

SEQ ID NO: 3994162 - RNA, 15 nt, Human herpesvirus 6B
cagaucgagaauaau

SEQ ID NO: 3994163 - RNA, 14 nt, Human herpesvirus 6B
cagaucuuucuaga

SEQ ID NO: 3994164 - RNA, 13 nt, Human herpesvirus 6B
cagauuucuguag

SEQ ID NO: 3994165 - RNA, 22 nt, Human herpesvirus 6B
cagauuuuacuggugauuuaaa

SEQ ID NO: 3994166 - RNA, 18 nt, Human herpesvirus 6B
cagcaguaucaaucacug

SEQ ID NO: 3994167 - RNA, 13 nt, Human herpesvirus 6B
cuaggaaaacuac

SEQ ID NO: 3994168 - RNA, 20 nt, Human herpesvirus 6B
cuaguuacggggaagaucua

SEQ ID NO: 3994169 - RNA, 23 nt, Human herpesvirus 6B
cuauaugucagauuauaaugaug

SEQ ID NO: 3994170 - RNA, 20 nt, Human herpesvirus 6B
cuaucaacuuucuccgcaca

SEQ ID NO: 3994171 - RNA, 21 nt, Human herpesvirus 6B
cuaucacuuagacacggccag

SEQ ID NO: 3994172 - RNA, 13 nt, Human herpesvirus 6B
cuauguuaacauu

SEQ ID NO: 3994173 - RNA, 14 nt, Human herpesvirus 6B
cuauguuaacauug

SEQ ID NO: 3994174 - RNA, 16 nt, Human herpesvirus 6B
cuauuugacaauaaac

SEQ ID NO: 3994175 - RNA, 16 nt, Human herpesvirus 6B
cucaaagaaagcuccg

SEQ ID NO: 3994176 - RNA, 13 nt, Human herpesvirus 6B
cucacccagaguu

SEQ ID NO: 3994177 - RNA, 15 nt, Human herpesvirus 6B
cucacgucguccgcc

SEQ ID NO: 3994178 - RNA, 19 nt, Human herpesvirus 6B
cucauacccggcggaggcg

SEQ ID NO: 3994179 - RNA, 14 nt, Human herpesvirus 6B
cucauuugcaauug

SEQ ID NO: 3994180 - RNA, 14 nt, Human herpesvirus 6B
cuccagcuauuuug

SEQ ID NO: 3994181 - RNA, 22 nt, Human herpesvirus 6B
cuccauacccauuuaucugccg

SEQ ID NO: 3994182 - RNA, 16 nt, Human herpesvirus 6B
cucccgcagcuccuuc

SEQ ID NO: 3994183 - RNA, 18 nt, Human herpesvirus 6B
cuccgcgcugcuggggcu

SEQ ID NO: 3994184 - RNA, 20 nt, Human herpesvirus 6B
cuccgcgggaccuggcgggc

SEQ ID NO: 3994185 - RNA, 23 nt, Human herpesvirus 6B
cuccgcgggaccuggcgggcacc

SEQ ID NO: 3994186 - RNA, 21 nt, Human herpesvirus 6B
cuccguuacccgggagcuuca

SEQ ID NO: 3994187 - RNA, 19 nt, Human herpesvirus 6B
cuccguuaggaucagacag

SEQ ID NO: 3994188 - RNA, 23 nt, Human herpesvirus 6B
cuccugagaggcuggaaaaauuu

SEQ ID NO: 3994189 - RNA, 12 nt, Human herpesvirus 6B
cuccugcaauuu

SEQ ID NO: 3994190 - RNA, 19 nt, Human herpesvirus 6B
cuccugugcguccuccucg

SEQ ID NO: 3994191 - RNA, 23 nt, Human herpesvirus 6B
cucgccgccucgccgcucccgcu

SEQ ID NO: 3994192 - RNA, 21 nt, Human herpesvirus 6B
cucgccgucgucgcucucccu

SEQ ID NO: 3994193 - RNA, 16 nt, Human herpesvirus 6B
cucgccuaucuguauu

SEQ ID NO: 3994194 - RNA, 15 nt, Human herpesvirus 6B
cucggauuccgcaca

SEQ ID NO: 3994195 - RNA, 23 nt, Human herpesvirus 6B
cucgggggacggagaggaagccg

SEQ ID NO: 3994196 - RNA, 20 nt, Human herpesvirus 6B
cucgguccccccucccucca

SEQ ID NO: 3994197 - RNA, 17 nt, Human herpesvirus 6B
cucgucuguugcuguag

SEQ ID NO: 3994198 - RNA, 22 nt, Human herpesvirus 6B
cucgugugucucugugaagagg

SEQ ID NO: 3994199 - RNA, 15 nt, Human herpesvirus 6B
cucuaaucaagaaac

SEQ ID NO: 3994200 - RNA, 17 nt, Human herpesvirus 6B
cucuauuguuuaaaagg

SEQ ID NO: 3994201 - RNA, 13 nt, Human herpesvirus 6B
cucucuccgccuc

SEQ ID NO: 3994202 - RNA, 20 nt, Human herpesvirus 6B
cucuuaugguucuugagcag

SEQ ID NO: 3994203 - RNA, 13 nt, Human herpesvirus 6B
cucuuccuucucg

SEQ ID NO: 3994204 - RNA, 21 nt, Human herpesvirus 6B
cucuuuccacacuaucuucga

SEQ ID NO: 3994205 - RNA, 15 nt, Human herpesvirus 6B
cucuuuuccccccgc

SEQ ID NO: 3994206 - RNA, 22 nt, Human herpesvirus 6B
cugaaaaguuagaguuggauuu

SEQ ID NO: 3994207 - RNA, 22 nt, Human herpesvirus 6B
cugaacggggugauuuuccaaa

SEQ ID NO: 3994208 - RNA, 23 nt, Human herpesvirus 6B
cugaauggaguaaauuaaaguuu

SEQ ID NO: 3994209 - RNA, 15 nt, Human herpesvirus 6B
cugacaucugcaaaa

SEQ ID NO: 3994210 - RNA, 13 nt, Human herpesvirus 6B
cugaccccccaca

SEQ ID NO: 3994211 - RNA, 16 nt, Human herpesvirus 6B
cugagagcaggagcag

SEQ ID NO: 3994212 - RNA, 21 nt, Human herpesvirus 6B
cugagauucgccaccuccgac

SEQ ID NO: 3994213 - RNA, 16 nt, Human herpesvirus 6B
cugagcaaagaaauga

SEQ ID NO: 3994214 - RNA, 19 nt, Human herpesvirus 6B
cugauaaacuccaaaaucu

SEQ ID NO: 3994215 - RNA, 17 nt, Human herpesvirus 6B
cugaucacagagaaaaa

SEQ ID NO: 3994216 - RNA, 20 nt, Human herpesvirus 6B
cugaucacagagaaaaaaca

SEQ ID NO: 3994217 - RNA, 16 nt, Human herpesvirus 6B
cugaugacuuuucuga

SEQ ID NO: 3994218 - RNA, 15 nt, Human herpesvirus 6B
cugaugguuaaggaa

SEQ ID NO: 3994219 - RNA, 17 nt, Human herpesvirus 6B
cugauuuguucuagugc

SEQ ID NO: 3994220 - RNA, 23 nt, Human herpesvirus 6B
cugcaacuuuauuugaaacugaa

SEQ ID NO: 3994221 - RNA, 21 nt, Human herpesvirus 6B
cugccgaccugauccaugagc

SEQ ID NO: 3994222 - RNA, 13 nt, Human herpesvirus 6B
cugccgcguggaa

SEQ ID NO: 3994223 - RNA, 19 nt, Human herpesvirus 6B
cugcguuccaugugucucc

SEQ ID NO: 3994224 - RNA, 22 nt, Human herpesvirus 6B
cugcucguuuguuuuuuucugc

SEQ ID NO: 3994225 - RNA, 11 nt, Human herpesvirus 6B
cuggacagaaa

SEQ ID NO: 3994226 - RNA, 14 nt, Human herpesvirus 6B
cuggagcuagagaa

SEQ ID NO: 3994227 - RNA, 19 nt, Human herpesvirus 6B
cuggaucggacggugaugg

SEQ ID NO: 3994228 - RNA, 15 nt, Human herpesvirus 6B
cuggcgaaaauuguu

SEQ ID NO: 3994229 - RNA, 15 nt, Human herpesvirus 6B
cuggcgaugcagaug

SEQ ID NO: 3994230 - RNA, 21 nt, Human herpesvirus 6B
cuggguaucuccggacagaaa

SEQ ID NO: 3994231 - RNA, 14 nt, Human herpesvirus 6B
cugguaguucuuga

SEQ ID NO: 3994232 - RNA, 17 nt, Human herpesvirus 6B
cuggugaauguuucuga

SEQ ID NO: 3994233 - RNA, 20 nt, Human herpesvirus 6B
cuguaaacaaauucuuacaa

SEQ ID NO: 3994234 - RNA, 13 nt, Human herpesvirus 6B
cuguaagauuaaa

SEQ ID NO: 3994235 - RNA, 20 nt, Human herpesvirus 6B
cuguaguuuuuuucugauga

SEQ ID NO: 3994236 - RNA, 17 nt, Human herpesvirus 6B
cuguauaucuaugcuuu

SEQ ID NO: 3994237 - RNA, 22 nt, Human herpesvirus 6B
cugugaggugauuugaacagag

SEQ ID NO: 3994238 - RNA, 23 nt, Human herpesvirus 6B
cugugaggugauuugaacagaga

SEQ ID NO: 3994239 - RNA, 21 nt, Human herpesvirus 6B
cuguuaauuccuuguguugaa

SEQ ID NO: 3994240 - RNA, 19 nt, Human herpesvirus 6B
cuguuauucuacugugcau

SEQ ID NO: 3994241 - RNA, 20 nt, Human herpesvirus 6B
cuguucacauugugacggcu

SEQ ID NO: 3994242 - RNA, 23 nt, Human herpesvirus 6B
cuguuuaaagugaguuuuggaaa

SEQ ID NO: 3994243 - RNA, 16 nt, Human herpesvirus 6B
cuguuuuucucauaaa

SEQ ID NO: 3994244 - RNA, 15 nt, Human herpesvirus 6B
cuuaaaggcagcugg

SEQ ID NO: 3994245 - RNA, 23 nt, Human herpesvirus 6B
cuuaaauucaauuuaaaauaauu

SEQ ID NO: 3994246 - RNA, 15 nt, Human herpesvirus 6B
cuuaagaagggcuuu

SEQ ID NO: 3994247 - RNA, 17 nt, Human herpesvirus 6B
cuuaagaagggcuuuaa

SEQ ID NO: 3994248 - RNA, 16 nt, Human herpesvirus 6B
cuuacaaguauguuuu

SEQ ID NO: 3994249 - RNA, 23 nt, Human herpesvirus 6B
cuuacaaguauguuuuguacaaa

SEQ ID NO: 3994250 - RNA, 14 nt, Human herpesvirus 6B
cuuacguguguauu

SEQ ID NO: 3994251 - RNA, 13 nt, Human herpesvirus 6B
cuuaguuuuggau

SEQ ID NO: 3994252 - RNA, 12 nt, Human herpesvirus 6B
cuuauaaaugug

SEQ ID NO: 3994253 - RNA, 16 nt, Human herpesvirus 6B
cuuauauuaaagauug

SEQ ID NO: 3994254 - RNA, 16 nt, Human herpesvirus 6B
cuucaaaaucugcuaa

SEQ ID NO: 3994255 - RNA, 13 nt, Human herpesvirus 6B
cuucaucuggagu

SEQ ID NO: 3994256 - RNA, 18 nt, Human herpesvirus 6B
cuuccgcggcgcugggcu

SEQ ID NO: 3994257 - RNA, 17 nt, Human herpesvirus 6B
cuuccgcuaccgcccug

SEQ ID NO: 3994258 - RNA, 21 nt, Human herpesvirus 6B
cuuccgcuaccgcccugcucc

SEQ ID NO: 3994259 - RNA, 14 nt, Human herpesvirus 6B
cuucgugcaauaac

SEQ ID NO: 3994260 - RNA, 16 nt, Human herpesvirus 6B
cuugaaccaagucacc

SEQ ID NO: 3994261 - RNA, 15 nt, Human herpesvirus 6B
cuugauguuuccuga

SEQ ID NO: 3994262 - RNA, 17 nt, Human herpesvirus 6B
cuugcacuuuuuucuaa

SEQ ID NO: 3994263 - RNA, 11 nt, Human herpesvirus 6B
cuugcaguggc

SEQ ID NO: 3994264 - RNA, 18 nt, Human herpesvirus 6B
cuugcgauuguucugcga

SEQ ID NO: 3994265 - RNA, 15 nt, Human herpesvirus 6B
cuuguuaugacaaaa

SEQ ID NO: 3994266 - RNA, 23 nt, Human herpesvirus 6B
cuuguucgggccaagguaaagga

SEQ ID NO: 3994267 - RNA, 16 nt, Human herpesvirus 6B
cuuucuuuuauuuaaa

SEQ ID NO: 3994268 - RNA, 13 nt, Human herpesvirus 6B
cuuugaaggacua

SEQ ID NO: 3994269 - RNA, 22 nt, Human herpesvirus 6B
cuuugagugguuuuuuggauaa

SEQ ID NO: 3994270 - RNA, 20 nt, Human herpesvirus 6B
cuuuguuuaauaugugggcg

SEQ ID NO: 3994271 - RNA, 14 nt, Human herpesvirus 6B
cuuuucugaugacu

SEQ ID NO: 3994272 - RNA, 13 nt, Human herpesvirus 6B
cuuuuuaacaaaa

SEQ ID NO: 3994273 - RNA, 14 nt, Human herpesvirus 6B
gaaaaaaagcagau

SEQ ID NO: 3994274 - RNA, 19 nt, Human herpesvirus 6B
gaaaaaucucuauuguuua

SEQ ID NO: 3994275 - RNA, 19 nt, Human herpesvirus 6B
gaaaagccccugcuugaaa

SEQ ID NO: 3994276 - RNA, 17 nt, Human herpesvirus 6B
gaaaagguguuguguuu

SEQ ID NO: 3994277 - RNA, 15 nt, Human herpesvirus 6B
gaaaauguguucuua

SEQ ID NO: 3994278 - RNA, 14 nt, Human herpesvirus 6B
gaaacaaaauuaau

SEQ ID NO: 3994279 - RNA, 19 nt, Human herpesvirus 6B
gaaaccaagacuugcauga

SEQ ID NO: 3994280 - RNA, 23 nt, Human herpesvirus 6B
ggggacagugauuaggauguuug

SEQ ID NO: 3994281 - RNA, 16 nt, Human herpesvirus 6B
ggggagccguggugcg

SEQ ID NO: 3994282 - RNA, 23 nt, Human herpesvirus 6B
ggggaggcgacgacggggacuac

SEQ ID NO: 3994283 - RNA, 18 nt, Human herpesvirus 6B
ggggcuucuaccguaguc

SEQ ID NO: 3994284 - RNA, 21 nt, Human herpesvirus 6B
gggucacuaucuucgcagaag

SEQ ID NO: 3994285 - RNA, 16 nt, Human herpesvirus 6B
gggucgaacccugaga

SEQ ID NO: 3994286 - RNA, 15 nt, Human herpesvirus 6B
gguaacgcaggagaa

SEQ ID NO: 3994287 - RNA, 20 nt, Human herpesvirus 6B
gguaauaaaccuaacagagu

SEQ ID NO: 3994288 - RNA, 18 nt, Human herpesvirus 6B
gguauucauaaaauuuug

SEQ ID NO: 3994289 - RNA, 16 nt, Human herpesvirus 6B
gguguuugcagauaag

SEQ ID NO: 3994290 - RNA, 22 nt, Human herpesvirus 6B
gguucaccacugugauaugcaa

SEQ ID NO: 3994291 - RNA, 14 nt, Human herpesvirus 6B
gguuucuuuauccc

SEQ ID NO: 3994292 - RNA, 23 nt, Human herpesvirus 6B
guaaacuucugcuauuuuuuuaa

SEQ ID NO: 3994293 - RNA, 13 nt, Human herpesvirus 6B
guaaccugagaau

SEQ ID NO: 3994294 - RNA, 18 nt, Human herpesvirus 6B
guaaccugucuuggaaga

SEQ ID NO: 3994295 - RNA, 22 nt, Human herpesvirus 6B
guaaucucuagguaaacuucug

SEQ ID NO: 3994296 - RNA, 14 nt, Human herpesvirus 6B
guaauuggacauug

SEQ ID NO: 3994297 - RNA, 15 nt, Human herpesvirus 6B
guaauuuugaaauug

SEQ ID NO: 3994298 - RNA, 11 nt, Human herpesvirus 6B
guaccaacaug

SEQ ID NO: 3994299 - RNA, 21 nt, Human herpesvirus 6B
guagaagacaucuuaaauuuc

SEQ ID NO: 3994300 - RNA, 21 nt, Human herpesvirus 6B
guagauacgaccccuuaugca

SEQ ID NO: 3994301 - RNA, 13 nt, Human herpesvirus 6B
guagcaaaugaau

SEQ ID NO: 3994302 - RNA, 16 nt, Human herpesvirus 6B
guagcaagggagaaag

SEQ ID NO: 3994303 - RNA, 19 nt, Human herpesvirus 6B
guagugcggcgguaaacaa

SEQ ID NO: 3994304 - RNA, 17 nt, Human herpesvirus 6B
guauauaguuuucugau

SEQ ID NO: 3994305 - RNA, 13 nt, Human herpesvirus 6B
guauuggaugcuu

SEQ ID NO: 3994306 - RNA, 17 nt, Human herpesvirus 6B
guauuguagcagcuggc

SEQ ID NO: 3994307 - RNA, 19 nt, Human herpesvirus 6B
gucaagacgccuaguguua

SEQ ID NO: 3994308 - RNA, 17 nt, Human herpesvirus 6B
gucaagguugucagauu

SEQ ID NO: 3994309 - RNA, 18 nt, Human herpesvirus 6B
gucaagguugucagauuu

SEQ ID NO: 3994310 - RNA, 14 nt, Human herpesvirus 6B
gucacuaucuucgc

SEQ ID NO: 3994311 - RNA, 17 nt, Human herpesvirus 6B
gucacucacauagagaa

SEQ ID NO: 3994312 - RNA, 16 nt, Human herpesvirus 6B
gucauaauuuuccagc

SEQ ID NO: 3994313 - RNA, 24 nt, Human herpesvirus 6B
gucauucgcguggcggcgcgcgcc

SEQ ID NO: 3994314 - RNA, 12 nt, Human herpesvirus 6B
guccaaugcucu

SEQ ID NO: 3994315 - RNA, 23 nt, Human herpesvirus 6B
guccgcucauuuugauuuguaaa

SEQ ID NO: 3994316 - RNA, 20 nt, Human herpesvirus 6B
guccuuggggucuuuuugcc

SEQ ID NO: 3994317 - RNA, 22 nt, Human herpesvirus 6B
gucgacucuuuccgaugugucu

SEQ ID NO: 3994318 - RNA, 15 nt, Human herpesvirus 6B
gucguaacaugauuc

SEQ ID NO: 3994319 - RNA, 17 nt, Human herpesvirus 6B
gucuaugacuuuucuga

SEQ ID NO: 3994320 - RNA, 18 nt, Human herpesvirus 6B
gucucaaaaauuagaccg

SEQ ID NO: 3994321 - RNA, 15 nt, Human herpesvirus 6B
gucucaguucaaaau

SEQ ID NO: 3994322 - RNA, 18 nt, Human herpesvirus 6B
gucucuggaagcacggcu

SEQ ID NO: 3994323 - RNA, 15 nt, Human herpesvirus 6B
gucucugugaagagg

SEQ ID NO: 3994324 - RNA, 15 nt, Human herpesvirus 6B
gucugucagaaauau

SEQ ID NO: 3994325 - RNA, 13 nt, Human herpesvirus 6B
gucugucuguucc

SEQ ID NO: 3994326 - RNA, 18 nt, Human herpesvirus 6B
gucuucgcauaauagaca

SEQ ID NO: 3994327 - RNA, 23 nt, Human herpesvirus 6B
gucuuuccuacccaggcuaacga

SEQ ID NO: 3994328 - RNA, 11 nt, Human herpesvirus 6B
gucuuuguccu

SEQ ID NO: 3994329 - RNA, 20 nt, Human herpesvirus 6B
gugacgugcgugcacgcgcc

SEQ ID NO: 3994330 - RNA, 15 nt, Human herpesvirus 6B
gugagcagaagcugu

SEQ ID NO: 3994331 - RNA, 16 nt, Human herpesvirus 6B
gugagcagaagcuguc

SEQ ID NO: 3994332 - RNA, 19 nt, Human herpesvirus 6B
gugauaccgucuuugcaua

SEQ ID NO: 3994333 - RNA, 13 nt, Human herpesvirus 6B
gugcaaaugcuca

SEQ ID NO: 3994334 - RNA, 12 nt, Human herpesvirus 6B
gugccuacggga

SEQ ID NO: 3994335 - RNA, 17 nt, Human herpesvirus 6B
gugccuauuaaugcuua

SEQ ID NO: 3994336 - RNA, 22 nt, Human herpesvirus 6B
guggccgcuuucuuggcgcccg

SEQ ID NO: 3994337 - RNA, 19 nt, Human herpesvirus 6B
gugguuaaccguuaguaaa

SEQ ID NO: 3994338 - RNA, 22 nt, Human herpesvirus 6B
guguauaacgauaauagaaaaa

SEQ ID NO: 3994339 - RNA, 13 nt, Human herpesvirus 6B
guguauuaaaaug

SEQ ID NO: 3994340 - RNA, 16 nt, Human herpesvirus 6B
guguccucguccgucc

SEQ ID NO: 3994341 - RNA, 15 nt, Human herpesvirus 6B
gugucguucagguca

SEQ ID NO: 3994342 - RNA, 13 nt, Human herpesvirus 6B
gugucucaaccuu

SEQ ID NO: 3994343 - RNA, 24 nt, Human herpesvirus 6B
guguuaaucggaauguugguaaac

SEQ ID NO: 3994344 - RNA, 14 nt, Human herpesvirus 6B
guguuuggacagga

SEQ ID NO: 3994345 - RNA, 13 nt, Human herpesvirus 6B
guuaaaagggaag

SEQ ID NO: 3994346 - RNA, 14 nt, Human herpesvirus 6B
guuaaaauguguua

SEQ ID NO: 3994347 - RNA, 22 nt, Human herpesvirus 6B
guuaauaguuacuuugauguua

SEQ ID NO: 3994348 - RNA, 17 nt, Human herpesvirus 6B
guuacccgggagcuuca

SEQ ID NO: 3994349 - RNA, 15 nt, Human herpesvirus 6B
guuagauucggaaac

SEQ ID NO: 3994350 - RNA, 20 nt, Human herpesvirus 6B
guuaguggguaccgcgguug

SEQ ID NO: 3994351 - RNA, 16 nt, Human herpesvirus 6B
guuauaauauuaacaa

SEQ ID NO: 3994352 - RNA, 15 nt, Human herpesvirus 6B
guuauggggaagauc

SEQ ID NO: 3994353 - RNA, 15 nt, Human herpesvirus 6B
guucacacagaugca

SEQ ID NO: 3994354 - RNA, 15 nt, Human herpesvirus 6B
guucgacuauguuag

SEQ ID NO: 3994355 - RNA, 20 nt, Human herpesvirus 6B
guugacgacgcccuggcuuu

SEQ ID NO: 3994356 - RNA, 14 nt, Human herpesvirus 6B
guugcguguggaaa

SEQ ID NO: 3994357 - RNA, 20 nt, Human herpesvirus 6B
guugcuguaguugaugcugu

SEQ ID NO: 3994358 - RNA, 17 nt, Human herpesvirus 6B
guuggccaagcugucuc

SEQ ID NO: 3994359 - RNA, 15 nt, Human herpesvirus 6B
guuggcgcucucgug

SEQ ID NO: 3994360 - RNA, 17 nt, Human herpesvirus 6B
guuguucuuugaugaag

SEQ ID NO: 3994361 - RNA, 21 nt, Human herpesvirus 6B
guuuauuuucucgacaucgcu

SEQ ID NO: 3994362 - RNA, 22 nt, Human herpesvirus 6B
guuugaguugggacuuggaaac

SEQ ID NO: 3994363 - RNA, 14 nt, Human herpesvirus 6B
guuugcuuuggauc

SEQ ID NO: 3994364 - RNA, 15 nt, Human herpesvirus 6B
guuuggacaggagca

SEQ ID NO: 3994365 - RNA, 22 nt, Human herpesvirus 6B
guuuggugacggcgaugaaaaa

SEQ ID NO: 3994366 - RNA, 17 nt, Human herpesvirus 6B
guuuuugauuguaagag

SEQ ID NO: 3994367 - RNA, 10 nt, Human herpesvirus 6B
guuuuuugca

SEQ ID NO: 3994368 - RNA, 16 nt, Human herpesvirus 6B
uaaaacaucagaugaa

SEQ ID NO: 3994369 - RNA, 17 nt, Human herpesvirus 6B
uaaaauaacaugugaca

SEQ ID NO: 3994370 - RNA, 16 nt, Human herpesvirus 6B
uaaaauugcuacuaau

SEQ ID NO: 3994371 - RNA, 18 nt, Human herpesvirus 6B
uaaaauuuuuaaacagau

SEQ ID NO: 3994372 - RNA, 14 nt, Human herpesvirus 6B
uaaacagauuuuga

SEQ ID NO: 3994373 - RNA, 17 nt, Human herpesvirus 6B
uaaacaugauuguaaua

SEQ ID NO: 3994374 - RNA, 18 nt, Human herpesvirus 6B
uaaacuccaaaaucuuua

SEQ ID NO: 3994375 - RNA, 24 nt, Human herpesvirus 6B
uaaacuguucuuucaaaaugacca

SEQ ID NO: 3994376 - RNA, 20 nt, Human herpesvirus 6B
uaaaguccuaucugaguugu

SEQ ID NO: 3994377 - RNA, 16 nt, Human herpesvirus 6B
uaaagugaguuuugga

SEQ ID NO: 3994378 - RNA, 17 nt, Human herpesvirus 6B
uaaauaucaugauaaau

SEQ ID NO: 3994379 - RNA, 15 nt, Human herpesvirus 6B
uaacaauucucucaa

SEQ ID NO: 3994380 - RNA, 21 nt, Human herpesvirus 6B
uaacagacauaugcaaucugu

SEQ ID NO: 3994381 - RNA, 23 nt, Human herpesvirus 6B
uaaccugagaauuuucgaaaaga

SEQ ID NO: 3994382 - RNA, 20 nt, Human herpesvirus 6B
uaacgauauugauccagaau

SEQ ID NO: 3994383 - RNA, 16 nt, Human herpesvirus 6B
uaacgauguugcacga

SEQ ID NO: 3994384 - RNA, 17 nt, Human herpesvirus 6B
uaacgcggcaaccgcag

SEQ ID NO: 3994385 - RNA, 15 nt, Human herpesvirus 6B
uaacgguuuugcaga

SEQ ID NO: 3994386 - RNA, 16 nt, Human herpesvirus 6B
uaacuaucaugugugg

SEQ ID NO: 3994387 - RNA, 21 nt, Human herpesvirus 6B
uaacugguucaggauuuguaa

SEQ ID NO: 3994388 - RNA, 17 nt, Human herpesvirus 6B
uaagacgagauguuucu

SEQ ID NO: 3994389 - RNA, 18 nt, Human herpesvirus 6B
uaagacgagauguuucug

SEQ ID NO: 3994390 - RNA, 14 nt, Human herpesvirus 6B
uaagcgugugguaa

SEQ ID NO: 3994391 - RNA, 21 nt, Human herpesvirus 6B
uaaggaguuuaucguuuuuau

SEQ ID NO: 3994392 - RNA, 11 nt, Human herpesvirus 6B
uaagggacagc

SEQ ID NO: 3994393 - RNA, 13 nt, Human herpesvirus 6B
aaaaaccuauuca

SEQ ID NO: 3994394 - RNA, 13 nt, Human herpesvirus 6B
aaaaaguuaguuu

SEQ ID NO: 3994395 - RNA, 20 nt, Human herpesvirus 6B
aaaaauugacaaucuuggaa

SEQ ID NO: 3994396 - RNA, 13 nt, Human herpesvirus 6B
aaaacuacagaga

SEQ ID NO: 3994397 - RNA, 15 nt, Human herpesvirus 6B
aaaagucguuacagu

SEQ ID NO: 3994398 - RNA, 17 nt, Human herpesvirus 6B
aaaagucguuacaguaa

SEQ ID NO: 3994399 - RNA, 23 nt, Human herpesvirus 6B
aaaauaagaaaggcggagacaca

SEQ ID NO: 3994400 - RNA, 15 nt, Human herpesvirus 6B
aaaauaagacuuagc

SEQ ID NO: 3994401 - RNA, 12 nt, Human herpesvirus 6B
aaaauaagcaag

SEQ ID NO: 3994402 - RNA, 14 nt, Human herpesvirus 6B
aaaauaauccucuu

SEQ ID NO: 3994403 - RNA, 18 nt, Human herpesvirus 6B
aaaauauuggauuuuacg

SEQ ID NO: 3994404 - RNA, 15 nt, Human herpesvirus 6B
aaaaucugcuaacgc

SEQ ID NO: 3994405 - RNA, 14 nt, Human herpesvirus 6B
aaaauguguuaauu

SEQ ID NO: 3994406 - RNA, 21 nt, Human herpesvirus 6B
aaaauguuuccaugacuguga

SEQ ID NO: 3994407 - RNA, 22 nt, Human herpesvirus 6B
aaaauguuuccaugacugugag

SEQ ID NO: 3994408 - RNA, 14 nt, Human herpesvirus 6B
aaaauuggcauuua

SEQ ID NO: 3994409 - RNA, 14 nt, Human herpesvirus 6B
aaaauuuuucugua

SEQ ID NO: 3994410 - RNA, 20 nt, Human herpesvirus 6B
aaacaaacguguauuaagaa

SEQ ID NO: 3994411 - RNA, 14 nt, Human herpesvirus 6B
aaacauagaaucuc

SEQ ID NO: 3994412 - RNA, 17 nt, Human herpesvirus 6B
aaacauagaaucuccaa

SEQ ID NO: 3994413 - RNA, 18 nt, Human herpesvirus 6B
aaacgauuauugcuacaa

SEQ ID NO: 3994414 - RNA, 15 nt, Human herpesvirus 6B
aaacucuagaauuau

SEQ ID NO: 3994415 - RNA, 17 nt, Human herpesvirus 6B
aaacugcuugcgauugu

SEQ ID NO: 3994416 - RNA, 12 nt, Human herpesvirus 6B
aaacuuaacaua

SEQ ID NO: 3994417 - RNA, 15 nt, Human herpesvirus 6B
aaagaaacaaagucu

SEQ ID NO: 3994418 - RNA, 11 nt, Human herpesvirus 6B
aaagaacagaa

SEQ ID NO: 3994419 - RNA, 13 nt, Human herpesvirus 6B
aaagaacagaauc

SEQ ID NO: 3994420 - RNA, 19 nt, Human herpesvirus 6B
aaagauauauugguagaca

SEQ ID NO: 3994421 - RNA, 17 nt, Human herpesvirus 6B
aaagauccaauggauuu

SEQ ID NO: 3994422 - RNA, 22 nt, Human herpesvirus 6B
aaagauggaaaauuuauaaaaa

SEQ ID NO: 3994423 - RNA, 21 nt, Human herpesvirus 6B
aaagcaaucgucuuugauuua

SEQ ID NO: 3994424 - RNA, 19 nt, Human herpesvirus 6B
aaagcaguuuugcagcauc

SEQ ID NO: 3994425 - RNA, 15 nt, Human herpesvirus 6B
aaagggaagccagcc

SEQ ID NO: 3994426 - RNA, 17 nt, Human herpesvirus 6B
aaagguguggugaaaga

SEQ ID NO: 3994427 - RNA, 17 nt, Human herpesvirus 6B
aaagucaaaguccugga

SEQ ID NO: 3994428 - RNA, 14 nt, Human herpesvirus 6B
aaagugcuuuaucc

SEQ ID NO: 3994429 - RNA, 13 nt, Human herpesvirus 6B
aaaguucaguaag

SEQ ID NO: 3994430 - RNA, 15 nt, Human herpesvirus 6B
aaaguuuacugugau

SEQ ID NO: 3994431 - RNA, 15 nt, Human herpesvirus 6B
aaauaaaguugaauu

SEQ ID NO: 3994432 - RNA, 11 nt, Human herpesvirus 6B
aaauaaaguuu

SEQ ID NO: 3994433 - RNA, 14 nt, Human herpesvirus 6B
aaauaauauuugca

SEQ ID NO: 3994434 - RNA, 16 nt, Human herpesvirus 6B
aaauauaauucugacu

SEQ ID NO: 3994435 - RNA, 16 nt, Human herpesvirus 6B
aaauauggcagagcug

SEQ ID NO: 3994436 - RNA, 13 nt, Human herpesvirus 6B
aaauauuggauuu

SEQ ID NO: 3994437 - RNA, 17 nt, Human herpesvirus 6B
aaaucgauguagauguu

SEQ ID NO: 3994438 - RNA, 19 nt, Human herpesvirus 6B
aaaucucgaugccaaagcu

SEQ ID NO: 3994439 - RNA, 13 nt, Human herpesvirus 6B
aaaucucuauugu

SEQ ID NO: 3994440 - RNA, 18 nt, Human herpesvirus 6B
aaaucugcuaacggagca

SEQ ID NO: 3994441 - RNA, 14 nt, Human herpesvirus 6B
aaaugaauguguuc

SEQ ID NO: 3994442 - RNA, 14 nt, Human herpesvirus 6B
aaaugacacagaau

SEQ ID NO: 3994443 - RNA, 17 nt, Human herpesvirus 6B
aaaugacacagaaucua

SEQ ID NO: 3994444 - RNA, 13 nt, Human herpesvirus 6B
aaauguagcaaau

SEQ ID NO: 3994445 - RNA, 15 nt, Human herpesvirus 6B
aaauuuguaacaaug

SEQ ID NO: 3994446 - RNA, 20 nt, Human herpesvirus 6B
aaauuuguucgcacaaaaug

SEQ ID NO: 3994447 - RNA, 20 nt, Human herpesvirus 6B
aacaaugaaaauucaguuuu

SEQ ID NO: 3994448 - RNA, 13 nt, Human herpesvirus 6B
aacaaugcuuugg

SEQ ID NO: 3994449 - RNA, 11 nt, Human herpesvirus 6B
aacaauuuccc

SEQ ID NO: 3994450 - RNA, 22 nt, Human herpesvirus 6B
aacacccgaugaggaaaaacgu

SEQ ID NO: 3994451 - RNA, 14 nt, Human herpesvirus 6B
aacagaggaagaaa

SEQ ID NO: 3994452 - RNA, 16 nt, Human herpesvirus 6B
aacaucaaaaacaccg

SEQ ID NO: 3994453 - RNA, 21 nt, Human herpesvirus 6B
aacaugacggacuuggaaaag

SEQ ID NO: 3994454 - RNA, 13 nt, Human herpesvirus 6B
aaccaaguguuuu

SEQ ID NO: 3994455 - RNA, 15 nt, Human herpesvirus 6B
aaccaucuauuugca

SEQ ID NO: 3994456 - RNA, 18 nt, Human herpesvirus 6B
aaccaucuauuugcaaga

SEQ ID NO: 3994457 - RNA, 15 nt, Human herpesvirus 6B
aaccauguuuuuacu

SEQ ID NO: 3994458 - RNA, 21 nt, Human herpesvirus 6B
aacgaagguucgacuauguua

SEQ ID NO: 3994459 - RNA, 16 nt, Human herpesvirus 6B
aacgaugccuugggga

SEQ ID NO: 3994460 - RNA, 13 nt, Human herpesvirus 6B
aacgcaaagggaa

SEQ ID NO: 3994461 - RNA, 15 nt, Human herpesvirus 6B
aacgcaggagaaacu

SEQ ID NO: 3994462 - RNA, 16 nt, Human herpesvirus 6B
aacgcuucuaacaaua

SEQ ID NO: 3994463 - RNA, 20 nt, Human herpesvirus 6B
aacggcggcggcggcugucg

SEQ ID NO: 3994464 - RNA, 18 nt, Human herpesvirus 6B
aacgugggguaaaaaugu

SEQ ID NO: 3994465 - RNA, 18 nt, Human herpesvirus 6B
aacguugaaaaaucucua

SEQ ID NO: 3994466 - RNA, 19 nt, Human herpesvirus 6B
aacuacuucuguuacagca

SEQ ID NO: 3994467 - RNA, 15 nt, Human herpesvirus 6B
aacucaaagaaagcu

SEQ ID NO: 3994468 - RNA, 22 nt, Human herpesvirus 6B
aacuccggaaaagaaaaguugu

SEQ ID NO: 3994469 - RNA, 14 nt, Human herpesvirus 6B
aacucucacggcca

SEQ ID NO: 3994470 - RNA, 21 nt, Human herpesvirus 6B
aacucuugcacggaaucucua

SEQ ID NO: 3994471 - RNA, 16 nt, Human herpesvirus 6B
aacugauacuguucaa

SEQ ID NO: 3994472 - RNA, 15 nt, Human herpesvirus 6B
aacuguuguucuugg

SEQ ID NO: 3994473 - RNA, 22 nt, Human herpesvirus 6B
aacuucauacccgauguucucu

SEQ ID NO: 3994474 - RNA, 17 nt, Human herpesvirus 6B
aacuuuuuuaaauaaua

SEQ ID NO: 3994475 - RNA, 20 nt, Human herpesvirus 6B
aagaaagaagacgcuuuuua

SEQ ID NO: 3994476 - RNA, 23 nt, Human herpesvirus 6B
aagaagaucacuuuguuucugaa

SEQ ID NO: 3994477 - RNA, 16 nt, Human herpesvirus 6B
aagaagaugcuuuaaa

SEQ ID NO: 3994478 - RNA, 17 nt, Human herpesvirus 6B
aagaagcagcagaugcu

SEQ ID NO: 3994479 - RNA, 17 nt, Human herpesvirus 6B
aagacauugguugauuu

SEQ ID NO: 3994480 - RNA, 19 nt, Human herpesvirus 6B
aagacguuuuuguguagaa

SEQ ID NO: 3994481 - RNA, 15 nt, Human herpesvirus 6B
aagacuugcagauga

SEQ ID NO: 3994482 - RNA, 21 nt, Human herpesvirus 6B
aagacuuuuaucaaauuugca

SEQ ID NO: 3994483 - RNA, 16 nt, Human herpesvirus 6B
aagagacgagaaguga

SEQ ID NO: 3994484 - RNA, 23 nt, Human herpesvirus 6B
aagagugauucaagguggagguu

SEQ ID NO: 3994485 - RNA, 18 nt, Human herpesvirus 6B
aagaguguaaauguagaa

SEQ ID NO: 3994486 - RNA, 21 nt, Human herpesvirus 6B
aagauaacggcgcagaauuac

SEQ ID NO: 3994487 - RNA, 21 nt, Human herpesvirus 6B
aagauauuaugucgauacaau

SEQ ID NO: 3994488 - RNA, 16 nt, Human herpesvirus 6B
aagaugacaaauuuuc

SEQ ID NO: 3994489 - RNA, 17 nt, Human herpesvirus 6B
aagaugagauuggagua

SEQ ID NO: 3994490 - RNA, 19 nt, Human herpesvirus 6B
aagaugucgcuguuuuuca

SEQ ID NO: 3994491 - RNA, 16 nt, Human herpesvirus 6B
aagauucugcagaaug

SEQ ID NO: 3994492 - RNA, 15 nt, Human herpesvirus 6B
aagcaaguuccauuu

SEQ ID NO: 3994493 - RNA, 19 nt, Human herpesvirus 6B
aagcagaggucuuugcuuu

SEQ ID NO: 3994494 - RNA, 16 nt, Human herpesvirus 6B
aagcccggagaacuga

SEQ ID NO: 3994495 - RNA, 15 nt, Human herpesvirus 6B
aagccggagcccuga

SEQ ID NO: 3994496 - RNA, 21 nt, Human herpesvirus 6B
aagcgacuuuuuaacaaaaug

SEQ ID NO: 3994497 - RNA, 17 nt, Human herpesvirus 6B
aagcugcuaacggagca

SEQ ID NO: 3994498 - RNA, 19 nt, Human herpesvirus 6B
aaggaaaaagccuugauuu

SEQ ID NO: 3994499 - RNA, 15 nt, Human herpesvirus 6B
aaggacuaucugaga

SEQ ID NO: 3994500 - RNA, 13 nt, Human herpesvirus 6B
aaggcaacggcac

SEQ ID NO: 3994501 - RNA, 10 nt, Human herpesvirus 6B
aaggcucucg

SEQ ID NO: 3994502 - RNA, 17 nt, Human herpesvirus 6B
aaggcuuaggauguaaa

SEQ ID NO: 3994503 - RNA, 15 nt, Human herpesvirus 6B
aagggacagcaguuu

SEQ ID NO: 3994504 - RNA, 19 nt, Human herpesvirus 6B
aagggucgaagacauucaa

SEQ ID NO: 3994505 - RNA, 19 nt, Human herpesvirus 6B
aagguaugaaacgaaugcc

SEQ ID NO: 3994506 - RNA, 17 nt, Human herpesvirus 6B
caggcgcagcagcagcu

SEQ ID NO: 3994507 - RNA, 14 nt, Human herpesvirus 6B
caggcuccccaggc

SEQ ID NO: 3994508 - RNA, 15 nt, Human herpesvirus 6B
caggguguggccggc

SEQ ID NO: 3994509 - RNA, 22 nt, Human herpesvirus 6B
caguaugucucaguucaaaauu

SEQ ID NO: 3994510 - RNA, 13 nt, Human herpesvirus 6B
caguauuuacuga

SEQ ID NO: 3994511 - RNA, 15 nt, Human herpesvirus 6B
cagucuccacagggc

SEQ ID NO: 3994512 - RNA, 18 nt, Human herpesvirus 6B
caguuaaucauucgauua

SEQ ID NO: 3994513 - RNA, 12 nt, Human herpesvirus 6B
caguuagugcac

SEQ ID NO: 3994514 - RNA, 17 nt, Human herpesvirus 6B
caguucacacagaugca

SEQ ID NO: 3994515 - RNA, 23 nt, Human herpesvirus 6B
caguuuuugaccggaauaaugaa

SEQ ID NO: 3994516 - RNA, 18 nt, Human herpesvirus 6B
caguuuuuuuuucauaug

SEQ ID NO: 3994517 - RNA, 10 nt, Human herpesvirus 6B
cauaaaguua

SEQ ID NO: 3994518 - RNA, 17 nt, Human herpesvirus 6B
cauaacaaguuuuuguc

SEQ ID NO: 3994519 - RNA, 18 nt, Human herpesvirus 6B
cauaagcucuacacagag

SEQ ID NO: 3994520 - RNA, 22 nt, Human herpesvirus 6B
cauagccgggagauuccucugu

SEQ ID NO: 3994521 - RNA, 18 nt, Human herpesvirus 6B
caucaacuacuucuguua

SEQ ID NO: 3994522 - RNA, 20 nt, Human herpesvirus 6B
caucagaugaauugugcgug

SEQ ID NO: 3994523 - RNA, 19 nt, Human herpesvirus 6B
caucccuuaaaaaaacaca

SEQ ID NO: 3994524 - RNA, 15 nt, Human herpesvirus 6B
caucuauuaucauuu

SEQ ID NO: 3994525 - RNA, 21 nt, Human herpesvirus 6B
caucucauaauuugccugagu

SEQ ID NO: 3994526 - RNA, 23 nt, Human herpesvirus 6B
caugaaaucucuuuuaacacaca

SEQ ID NO: 3994527 - RNA, 14 nt, Human herpesvirus 6B
caugacgaagggag

SEQ ID NO: 3994528 - RNA, 14 nt, Human herpesvirus 6B
caugauuguaauaa

SEQ ID NO: 3994529 - RNA, 21 nt, Human herpesvirus 6B
caugccgccugaaaccccaca

SEQ ID NO: 3994530 - RNA, 13 nt, Human herpesvirus 6B
cauggugaaacuu

SEQ ID NO: 3994531 - RNA, 18 nt, Human herpesvirus 6B
caugugguaauacgugaa

SEQ ID NO: 3994532 - RNA, 21 nt, Human herpesvirus 6B
cauucagucucagcaaucacc

SEQ ID NO: 3994533 - RNA, 13 nt, Human herpesvirus 6B
cauucugcauuua

SEQ ID NO: 3994534 - RNA, 20 nt, Human herpesvirus 6B
cauucugcauuuauaucaaa

SEQ ID NO: 3994535 - RNA, 21 nt, Human herpesvirus 6B
cauugaguagagcuuugagca

SEQ ID NO: 3994536 - RNA, 19 nt, Human herpesvirus 6B
cauuuauuucguauguuua

SEQ ID NO: 3994537 - RNA, 16 nt, Human herpesvirus 6B
cauuucuccacacugu

SEQ ID NO: 3994538 - RNA, 13 nt, Human herpesvirus 6B
cauuuuauacgaa

SEQ ID NO: 3994539 - RNA, 17 nt, Human herpesvirus 6B
cauuuuuuugaaaucac

SEQ ID NO: 3994540 - RNA, 13 nt, Human herpesvirus 6B
ccaaaagagaaag

SEQ ID NO: 3994541 - RNA, 13 nt, Human herpesvirus 6B
ccaaagcuuucug

SEQ ID NO: 3994542 - RNA, 22 nt, Human herpesvirus 6B
ccaacggucaagggugaugagg

SEQ ID NO: 3994543 - RNA, 11 nt, Human herpesvirus 6B
ccaacugagag

SEQ ID NO: 3994544 - RNA, 12 nt, Human herpesvirus 6B
ccaacuuaauaa

SEQ ID NO: 3994545 - RNA, 23 nt, Human herpesvirus 6B
ccaaggauuaugaucauacgagg

SEQ ID NO: 3994546 - RNA, 14 nt, Human herpesvirus 6B
ccagaauauaucga

SEQ ID NO: 3994547 - RNA, 23 nt, Human herpesvirus 6B
ccagauaggaaaagguugagaaa

SEQ ID NO: 3994548 - RNA, 12 nt, Human herpesvirus 6B
ccagcccugaag

SEQ ID NO: 3994549 - RNA, 16 nt, Human herpesvirus 6B
ccagcucuguucucuc

SEQ ID NO: 3994550 - RNA, 15 nt, Human herpesvirus 6B
ccaggcgcagcagca

SEQ ID NO: 3994551 - RNA, 14 nt, Human herpesvirus 6B
ccagggugaagaca

SEQ ID NO: 3994552 - RNA, 19 nt, Human herpesvirus 6B
ccagugauucugcuaugau

SEQ ID NO: 3994553 - RNA, 18 nt, Human herpesvirus 6B
ccauagaguuucgagaaa

SEQ ID NO: 3994554 - RNA, 11 nt, Human herpesvirus 6B
ccauauuugcc

SEQ ID NO: 3994555 - RNA, 16 nt, Human herpesvirus 6B
ccaucaacacaccugc

SEQ ID NO: 3994556 - RNA, 15 nt, Human herpesvirus 6B
ccaucaaucucuaug

SEQ ID NO: 3994557 - RNA, 15 nt, Human herpesvirus 6B
cgacauagaguguuu

SEQ ID NO: 3994558 - RNA, 16 nt, Human herpesvirus 6B
cgacccaacagaagcc

SEQ ID NO: 3994559 - RNA, 18 nt, Human herpesvirus 6B
cgaccugaucacagagaa

SEQ ID NO: 3994560 - RNA, 15 nt, Human herpesvirus 6B
cgacgggcagggcgg

SEQ ID NO: 3994561 - RNA, 21 nt, Human herpesvirus 6B
cgagaacccuaaaaucugcua

SEQ ID NO: 3994562 - RNA, 15 nt, Human herpesvirus 6B
cgagacggugauguu

SEQ ID NO: 3994563 - RNA, 13 nt, Human herpesvirus 6B
cgagccggacagg

SEQ ID NO: 3994564 - RNA, 11 nt, Human herpesvirus 6B
cgaucuguaua

SEQ ID NO: 3994565 - RNA, 22 nt, Human herpesvirus 6B
cgauuacuguccguuauugugu

SEQ ID NO: 3994566 - RNA, 15 nt, Human herpesvirus 6B
cgcagacagauaucu

SEQ ID NO: 3994567 - RNA, 19 nt, Human herpesvirus 6B
cgcagggaacggugaagcg

SEQ ID NO: 3994568 - RNA, 16 nt, Human herpesvirus 6B
cgcaguuccuguuuuu

SEQ ID NO: 3994569 - RNA, 20 nt, Human herpesvirus 6B
cgcaguuucuguuuuucuca

SEQ ID NO: 3994570 - RNA, 17 nt, Human herpesvirus 6B
cgcauucacuggaggcg

SEQ ID NO: 3994571 - RNA, 23 nt, Human herpesvirus 6B
cgcauuucucuacaugccacaga

SEQ ID NO: 3994572 - RNA, 20 nt, Human herpesvirus 6B
cgccaacgcuaaauuuauca

SEQ ID NO: 3994573 - RNA, 18 nt, Human herpesvirus 6B
cgcccuccccgcacaguu

SEQ ID NO: 3994574 - RNA, 21 nt, Human herpesvirus 6B
cgccuagagaacagauagaaa

SEQ ID NO: 3994575 - RNA, 21 nt, Human herpesvirus 6B
cgcgcggaccacucgggccgg

SEQ ID NO: 3994576 - RNA, 14 nt, Human herpesvirus 6B
cgcgguggacggcg

SEQ ID NO: 3994577 - RNA, 22 nt, Human herpesvirus 6B
cgcgguggacggcgaggggacg

SEQ ID NO: 3994578 - RNA, 18 nt, Human herpesvirus 6B
cgcuaucggcggacgacg

SEQ ID NO: 3994579 - RNA, 17 nt, Human herpesvirus 6B
cgcucuccugugcgucc

SEQ ID NO: 3994580 - RNA, 17 nt, Human herpesvirus 6B
cgcugggcuccucaccc

SEQ ID NO: 3994581 - RNA, 20 nt, Human herpesvirus 6B
cggagcccugagagcaggag

SEQ ID NO: 3994582 - RNA, 17 nt, Human herpesvirus 6B
cggauucauuuauucuc

SEQ ID NO: 3994583 - RNA, 21 nt, Human herpesvirus 6B
cggcagauucuucggacgcgg

SEQ ID NO: 3994584 - RNA, 16 nt, Human herpesvirus 6B
cggccauuuaacggaa

SEQ ID NO: 3994585 - RNA, 18 nt, Human herpesvirus 6B
cggcgaagggacacgaga

SEQ ID NO: 3994586 - RNA, 14 nt, Human herpesvirus 6B
cggcgcgcgccguc

SEQ ID NO: 3994587 - RNA, 18 nt, Human herpesvirus 6B
cggcgcugggcuccucac

SEQ ID NO: 3994588 - RNA, 20 nt, Human herpesvirus 6B
cggcggaagugaaagcaguc

SEQ ID NO: 3994589 - RNA, 20 nt, Human herpesvirus 6B
cggcguuacuuuaccucugc

SEQ ID NO: 3994590 - RNA, 17 nt, Human herpesvirus 6B
cgggaucccagaugcag

SEQ ID NO: 3994591 - RNA, 16 nt, Human herpesvirus 6B
cgggcgacgggcaggg

SEQ ID NO: 3994592 - RNA, 18 nt, Human herpesvirus 6B
cgggcgguucucgccagc

SEQ ID NO: 3994593 - RNA, 17 nt, Human herpesvirus 6B
cggggaggaggaggaag

SEQ ID NO: 3994594 - RNA, 15 nt, Human herpesvirus 6B
cggucgaaugagcuu

SEQ ID NO: 3994595 - RNA, 20 nt, Human herpesvirus 6B
cggucgagaauacgcugugu

SEQ ID NO: 3994596 - RNA, 15 nt, Human herpesvirus 6B
cggugguuucugcuc

SEQ ID NO: 3994597 - RNA, 20 nt, Human herpesvirus 6B
cgguuagaucuggggagaug

SEQ ID NO: 3994598 - RNA, 22 nt, Human herpesvirus 6B
cgguuugucuugcaaacagcuu

SEQ ID NO: 3994599 - RNA, 15 nt, Human herpesvirus 6B
cguagggacugcgag

SEQ ID NO: 3994600 - RNA, 21 nt, Human herpesvirus 6B
cgucagcucuucacuuucuaa

SEQ ID NO: 3994601 - RNA, 14 nt, Human herpesvirus 6B
cgucccuucuccgu

SEQ ID NO: 3994602 - RNA, 14 nt, Human herpesvirus 6B
cguccguccccgcc

SEQ ID NO: 3994603 - RNA, 18 nt, Human herpesvirus 6B
cguccguggaaaaacacu

SEQ ID NO: 3994604 - RNA, 17 nt, Human herpesvirus 6B
cguccucgugcucuccg

SEQ ID NO: 3994605 - RNA, 18 nt, Human herpesvirus 6B
cguccucgugcucuccgc

SEQ ID NO: 3994606 - RNA, 16 nt, Human herpesvirus 6B
cgucgccuccaaggag

SEQ ID NO: 3994607 - RNA, 15 nt, Human herpesvirus 6B
cgucugucuguuccu

SEQ ID NO: 3994608 - RNA, 19 nt, Human herpesvirus 6B
cgugaaacacaagaagaau

SEQ ID NO: 3994609 - RNA, 16 nt, Human herpesvirus 6B
cguggccgucuccugc

SEQ ID NO: 3994610 - RNA, 20 nt, Human herpesvirus 6B
cguggccgucuccugcaauu

SEQ ID NO: 3994611 - RNA, 14 nt, Human herpesvirus 6B
cgugucuucauucu

SEQ ID NO: 3994612 - RNA, 16 nt, Human herpesvirus 6B
cgugugucucugugaa

SEQ ID NO: 3994613 - RNA, 15 nt, Human herpesvirus 6B
ugaucggaacaaauu

SEQ ID NO: 3994614 - RNA, 17 nt, Human herpesvirus 6B
ugaugauuugaaauguu

SEQ ID NO: 3994615 - RNA, 20 nt, Human herpesvirus 6B
ugaugccuugauguuuccug

SEQ ID NO: 3994616 - RNA, 18 nt, Human herpesvirus 6B
ugaugcuguugcuguugu

SEQ ID NO: 3994617 - RNA, 20 nt, Human herpesvirus 6B
ugauggguuuggccaugccg

SEQ ID NO: 3994618 - RNA, 15 nt, Human herpesvirus 6B
ugauguugcgauaua

SEQ ID NO: 3994619 - RNA, 18 nt, Human herpesvirus 6B
ugauuugaacagagauuu

SEQ ID NO: 3994620 - RNA, 19 nt, Human herpesvirus 6B
ugcaaaaacaaaugaaagu

SEQ ID NO: 3994621 - RNA, 21 nt, Human herpesvirus 6B
ugcaaaaacaaaugaaagucu

SEQ ID NO: 3994622 - RNA, 15 nt, Human herpesvirus 6B
ugcaauuugaauucu

SEQ ID NO: 3994623 - RNA, 19 nt, Human herpesvirus 6B
ugcagagguaaugugaacg

SEQ ID NO: 3994624 - RNA, 17 nt, Human herpesvirus 6B
ugcagccuaccauggcc

SEQ ID NO: 3994625 - RNA, 16 nt, Human herpesvirus 6B
ugcauaacaucucaga

SEQ ID NO: 3994626 - RNA, 20 nt, Human herpesvirus 6B
ugcaucucgguuuaccuuuu

SEQ ID NO: 3994627 - RNA, 18 nt, Human herpesvirus 6B
ugcaucuugcaagaaagc

SEQ ID NO: 3994628 - RNA, 15 nt, Human herpesvirus 6B
ugcccucccgcagcu

SEQ ID NO: 3994629 - RNA, 16 nt, Human herpesvirus 6B
ugccgcguggaagccg

SEQ ID NO: 3994630 - RNA, 14 nt, Human herpesvirus 6B
ugccggcgcgcaaa

SEQ ID NO: 3994631 - RNA, 17 nt, Human herpesvirus 6B
ugccguggcagaagaag

SEQ ID NO: 3994632 - RNA, 14 nt, Human herpesvirus 6B
ugccguguaugaga

SEQ ID NO: 3994633 - RNA, 21 nt, Human herpesvirus 6B
ugccucaggguuggaguuuag

SEQ ID NO: 3994634 - RNA, 21 nt, Human herpesvirus 6B
ugccuuuguaaaauguuucca

SEQ ID NO: 3994635 - RNA, 16 nt, Human herpesvirus 6B
ugcuaagaucugucuc

SEQ ID NO: 3994636 - RNA, 16 nt, Human herpesvirus 6B
ugcucaugucaguauu

SEQ ID NO: 3994637 - RNA, 14 nt, Human herpesvirus 6B
ugcucuuagagaua

SEQ ID NO: 3994638 - RNA, 22 nt, Human herpesvirus 6B
ugcugcuggguguauguuucua

SEQ ID NO: 3994639 - RNA, 13 nt, Human herpesvirus 6B
ugcugucggccga

SEQ ID NO: 3994640 - RNA, 12 nt, Human herpesvirus 6B
ugcuucugcucu

SEQ ID NO: 3994641 - RNA, 15 nt, Human herpesvirus 6B
uucaauuguuuuuua

SEQ ID NO: 3994642 - RNA, 19 nt, Human herpesvirus 6B
uucaccccccucuugcagu

SEQ ID NO: 3994643 - RNA, 20 nt, Human herpesvirus 6B
uucaccccccucuugcagug

SEQ ID NO: 3994644 - RNA, 15 nt, Human herpesvirus 6B
uucagauuucuguag

SEQ ID NO: 3994645 - RNA, 15 nt, Human herpesvirus 6B
uucaggagaagaaca

SEQ ID NO: 3994646 - RNA, 20 nt, Human herpesvirus 6B
uucauaagcucuacacagag

SEQ ID NO: 3994647 - RNA, 17 nt, Human herpesvirus 6B
uucauaguuguuuuuua

SEQ ID NO: 3994648 - RNA, 14 nt, Human herpesvirus 6B
uucauuguacgaua

SEQ ID NO: 3994649 - RNA, 13 nt, Human herpesvirus 6B
uucauuucuguag

SEQ ID NO: 3994650 - RNA, 23 nt, Human herpesvirus 6B
uuccaaaagagaaagaacuuuug

SEQ ID NO: 3994651 - RNA, 15 nt, Human herpesvirus 6B
uucgacauagagugu

SEQ ID NO: 3994652 - RNA, 16 nt, Human herpesvirus 6B
uucuaauuauaaaugu

SEQ ID NO: 3994653 - RNA, 14 nt, Human herpesvirus 6B
uucuaucuacaaaa

SEQ ID NO: 3994654 - RNA, 20 nt, Human herpesvirus 6B
uucuauuaaaaagacuaaag

SEQ ID NO: 3994655 - RNA, 13 nt, Human herpesvirus 6B
uucuguaccccaa

SEQ ID NO: 3994656 - RNA, 22 nt, Human herpesvirus 6B
uucuucaaaaaaagaggaggaa

SEQ ID NO: 3994657 - RNA, 23 nt, Human herpesvirus 6B
uucuucaagggccguaccuuucu

SEQ ID NO: 3994658 - RNA, 19 nt, Human herpesvirus 6B
uucuugcgauuuugugaaa

SEQ ID NO: 3994659 - RNA, 15 nt, Human herpesvirus 6B
uucuugggaaaucaa

SEQ ID NO: 3994660 - RNA, 18 nt, Human herpesvirus 6B
uucuuuggaaaacgucaa

SEQ ID NO: 3994661 - RNA, 17 nt, Human herpesvirus 6B
uugaacaucuauuauca

SEQ ID NO: 3994662 - RNA, 22 nt, Human herpesvirus 6B
uugacggcgugcauauauauga

SEQ ID NO: 3994663 - RNA, 13 nt, Human herpesvirus 6B
caguggcaauaau

SEQ ID NO: 3994664 - RNA, 23 nt, Human herpesvirus 6B
caguggcgcgcguuuuuggugaa

SEQ ID NO: 3994665 - RNA, 16 nt, Human herpesvirus 6B
caguucguccagcagc

SEQ ID NO: 3994666 - RNA, 21 nt, Human herpesvirus 6B
caguugucugcggaaauaauu

SEQ ID NO: 3994667 - RNA, 20 nt, Human herpesvirus 6B
caguuuuuuguuucuggggg

SEQ ID NO: 3994668 - RNA, 19 nt, Human herpesvirus 6B
cauaaaaaagagauaaucu

SEQ ID NO: 3994669 - RNA, 23 nt, Human herpesvirus 6B
cauaagggacagcaguuuuuugg

SEQ ID NO: 3994670 - RNA, 20 nt, Human herpesvirus 6B
cauacauccagaaaagcaaa

SEQ ID NO: 3994671 - RNA, 20 nt, Human herpesvirus 6B
cauagacugaacacaaaaac

SEQ ID NO: 3994672 - RNA, 16 nt, Human herpesvirus 6B
cauagaguuucgagaa

SEQ ID NO: 3994673 - RNA, 20 nt, Human herpesvirus 6B
cauagaguuucgagaaagag

SEQ ID NO: 3994674 - RNA, 18 nt, Human herpesvirus 6B
cgcggcgcugggcuccuc

SEQ ID NO: 3994675 - RNA, 13 nt, Human herpesvirus 6B
cgcgggacagcgg

SEQ ID NO: 3994676 - RNA, 19 nt, Human herpesvirus 6B
cgcgggaccuggcgggcac

SEQ ID NO: 3994677 - RNA, 18 nt, Human herpesvirus 6B
cgcgguggacggcgaggg

SEQ ID NO: 3994678 - RNA, 16 nt, Human herpesvirus 6B
cgcgguugaagucuuu

SEQ ID NO: 3994679 - RNA, 18 nt, Human herpesvirus 6B
cgcguuuuuggugaaaaa

SEQ ID NO: 3994680 - RNA, 20 nt, Human herpesvirus 6B
cgcucgggggacggagagga

SEQ ID NO: 3994681 - RNA, 18 nt, Human herpesvirus 6B
cggaagacgaugcagggu

SEQ ID NO: 3994682 - RNA, 22 nt, Human herpesvirus 6B
cggaauaaugaaauuuaagaag

SEQ ID NO: 3994683 - RNA, 18 nt, Human herpesvirus 6B
cggacagagcggagaggc

SEQ ID NO: 3994684 - RNA, 22 nt, Human herpesvirus 6B
cggagauauaccgugacagcaa

SEQ ID NO: 3994685 - RNA, 17 nt, Human herpesvirus 6B
cggagcaaccgcaguuc

SEQ ID NO: 3994686 - RNA, 20 nt, Human herpesvirus 6B
cggaggcuacggcuaaggcg

SEQ ID NO: 3994687 - RNA, 16 nt, Human herpesvirus 6B
cggagucggucuguuc

SEQ ID NO: 3994688 - RNA, 19 nt, Human herpesvirus 6B
cggauacgggugcuguccc

SEQ ID NO: 3994689 - RNA, 20 nt, Human herpesvirus 6B
cggauuuuauuuuaucucau

SEQ ID NO: 3994690 - RNA, 15 nt, Human herpesvirus 6B
cggcaaccgcaguuc

SEQ ID NO: 3994691 - RNA, 16 nt, Human herpesvirus 6B
cggcacauacacacgc

SEQ ID NO: 3994692 - RNA, 18 nt, Human herpesvirus 6B
cggcagcggggaagggaa

SEQ ID NO: 3994693 - RNA, 14 nt, Human herpesvirus 6B
cggcauuuguguuu

SEQ ID NO: 3994694 - RNA, 13 nt, Human herpesvirus 6B
cggcgcgcgccgu

SEQ ID NO: 3994695 - RNA, 15 nt, Human herpesvirus 6B
cggcggauggagccc

SEQ ID NO: 3994696 - RNA, 15 nt, Human herpesvirus 6B
cggcggcugucgccg

SEQ ID NO: 3994697 - RNA, 13 nt, Human herpesvirus 6B
cgggaagacgaua

SEQ ID NO: 3994698 - RNA, 16 nt, Human herpesvirus 6B
cgggcagggcgggcac

SEQ ID NO: 3994699 - RNA, 20 nt, Human herpesvirus 6B
cgggccuggggacagacagg

SEQ ID NO: 3994700 - RNA, 20 nt, Human herpesvirus 6B
cgggcguuaucgacggcagc

SEQ ID NO: 3994701 - RNA, 16 nt, Human herpesvirus 6B
cggggaggaggaggaa

SEQ ID NO: 3994702 - RNA, 14 nt, Human herpesvirus 6B
cgguccccccuccc

SEQ ID NO: 3994703 - RNA, 17 nt, Human herpesvirus 6B
cgguggugaucggcaga

SEQ ID NO: 3994704 - RNA, 21 nt, Human herpesvirus 6B
cgguuaaagaaucugcagauu

SEQ ID NO: 3994705 - RNA, 17 nt, Human herpesvirus 6B
cgucaggaccagcucug

SEQ ID NO: 3994706 - RNA, 16 nt, Human herpesvirus 6B
cguccauaggcucggc

SEQ ID NO: 3994707 - RNA, 14 nt, Human herpesvirus 6B
cgucguggcagaac

SEQ ID NO: 3994708 - RNA, 20 nt, Human herpesvirus 6B
cgugaaaacgcuucagauuc

SEQ ID NO: 3994709 - RNA, 17 nt, Human herpesvirus 6B
cgugcucuccgcgcugc

SEQ ID NO: 3994710 - RNA, 15 nt, Human herpesvirus 6B
cguggaagccgcugc

SEQ ID NO: 3994711 - RNA, 17 nt, Human herpesvirus 6B
cgugguggccgucuguc

SEQ ID NO: 3994712 - RNA, 19 nt, Human herpesvirus 6B
cguuacaguaaaaaagccg

SEQ ID NO: 3994713 - RNA, 20 nt, Human herpesvirus 6B
cguucaggucaagcgccagg

SEQ ID NO: 3994714 - RNA, 18 nt, Human herpesvirus 6B
cguuuguacauguuaaca

SEQ ID NO: 3994715 - RNA, 22 nt, Human herpesvirus 6B
cuaaagaguaugacagaaaucu

SEQ ID NO: 3994716 - RNA, 20 nt, Human herpesvirus 6B
cuaacuguuguucuuggaga

SEQ ID NO: 3994717 - RNA, 19 nt, Human herpesvirus 6B
cuaagaaaccgauuuacca

SEQ ID NO: 3994718 - RNA, 21 nt, Human herpesvirus 6B
cuaagcucguuaguaauuugg

SEQ ID NO: 3994719 - RNA, 19 nt, Human herpesvirus 6B
cuaagcuguaugacaucua

SEQ ID NO: 3994720 - RNA, 18 nt, Human herpesvirus 6B
cuaaucaagaaaccuguu

SEQ ID NO: 3994721 - RNA, 14 nt, Human herpesvirus 6B
cuacaucaaaaucc

SEQ ID NO: 3994722 - RNA, 17 nt, Human herpesvirus 6B
cuaccgcccugcuccgu

SEQ ID NO: 3994723 - RNA, 13 nt, Human herpesvirus 6B
cuagacacacaga

SEQ ID NO: 3994724 - RNA, 15 nt, Human herpesvirus 6B
cuagacgugucuuca

SEQ ID NO: 3994725 - RNA, 14 nt, Human herpesvirus 6B
cuagauaacucaga

SEQ ID NO: 3994726 - RNA, 23 nt, Human herpesvirus 6B
cuauauuuucguugaagaauaag

SEQ ID NO: 3994727 - RNA, 19 nt, Human herpesvirus 6B
cuaugagaaccacagccag

SEQ ID NO: 3994728 - RNA, 18 nt, Human herpesvirus 6B
cuauguuaacauugugag

SEQ ID NO: 3994729 - RNA, 16 nt, Human herpesvirus 6B
cuauguuauguaaaga

SEQ ID NO: 3994730 - RNA, 22 nt, Human herpesvirus 6B
cuauucaggaauauuuaguuua

SEQ ID NO: 3994731 - RNA, 11 nt, Human herpesvirus 6B
cuauucuaauu

SEQ ID NO: 3994732 - RNA, 16 nt, Human herpesvirus 6B
cuauuuaacugggaaa

SEQ ID NO: 3994733 - RNA, 14 nt, Human herpesvirus 6B
cucacauagagaag

SEQ ID NO: 3994734 - RNA, 15 nt, Human herpesvirus 6B
cucaccuucagacuc

SEQ ID NO: 3994735 - RNA, 14 nt, Human herpesvirus 6B
cucacgaauuuaaa

SEQ ID NO: 3994736 - RNA, 21 nt, Human herpesvirus 6B
cucauggaucaggucggcagg

SEQ ID NO: 3994737 - RNA, 16 nt, Human herpesvirus 6B
cucauguugauuuuag

SEQ ID NO: 3994738 - RNA, 15 nt, Human herpesvirus 6B
cucccauagaggcgc

SEQ ID NO: 3994739 - RNA, 15 nt, Human herpesvirus 6B
cucccguccguggaa

SEQ ID NO: 3994740 - RNA, 17 nt, Human herpesvirus 6B
cuccgccggguaugagc

SEQ ID NO: 3994741 - RNA, 19 nt, Human herpesvirus 6B
cuccgcgagacgguacagc

SEQ ID NO: 3994742 - RNA, 13 nt, Human herpesvirus 6B
cuccucccacgcc

SEQ ID NO: 3994743 - RNA, 20 nt, Human herpesvirus 6B
cucgacaaccaacgugauaa

SEQ ID NO: 3994744 - RNA, 13 nt, Human herpesvirus 6B
cucgaugccaaag

SEQ ID NO: 3994745 - RNA, 15 nt, Human herpesvirus 6B
cucgaugccaaagcu

SEQ ID NO: 3994746 - RNA, 16 nt, Human herpesvirus 6B
cucgggggacggagag

SEQ ID NO: 3994747 - RNA, 20 nt, Human herpesvirus 6B
cucgggggacggagaggaag

SEQ ID NO: 3994748 - RNA, 17 nt, Human herpesvirus 6B
cucgguauaucuucuug

SEQ ID NO: 3994749 - RNA, 19 nt, Human herpesvirus 6B
cucguaccccggcuuucuc

SEQ ID NO: 3994750 - RNA, 13 nt, Human herpesvirus 6B
cucguugggaugg

SEQ ID NO: 3994751 - RNA, 18 nt, Human herpesvirus 6B
cucuaccgucagaggcuu

SEQ ID NO: 3994752 - RNA, 15 nt, Human herpesvirus 6B
cucucacccccacuc

SEQ ID NO: 3994753 - RNA, 13 nt, Human herpesvirus 6B
cucucacggccau

SEQ ID NO: 3994754 - RNA, 13 nt, Human herpesvirus 6B
cucucuucaggag

SEQ ID NO: 3994755 - RNA, 22 nt, Human herpesvirus 6B
cucugcggcucucugcccuucu

SEQ ID NO: 3994756 - RNA, 16 nt, Human herpesvirus 6B
cucuggcugaaggaau

SEQ ID NO: 3994757 - RNA, 12 nt, Human herpesvirus 6B
cucuugcagugg

SEQ ID NO: 3994758 - RNA, 23 nt, Human herpesvirus 6B
cucuuuguuuuuuuuuuucugug

SEQ ID NO: 3994759 - RNA, 19 nt, Human herpesvirus 6B
cugagaccgagagaauaga

SEQ ID NO: 3994760 - RNA, 19 nt, Human herpesvirus 6B
cugauauggcaaauuucaa

SEQ ID NO: 3994761 - RNA, 16 nt, Human herpesvirus 6B
cugaucgguauuugcg

SEQ ID NO: 3994762 - RNA, 19 nt, Human herpesvirus 6B
cugaugacuuuucugauga

SEQ ID NO: 3994763 - RNA, 19 nt, Human herpesvirus 6B
cugauuccuucaauguuuu

SEQ ID NO: 3994764 - RNA, 23 nt, Human herpesvirus 6B
cugauuuucagugucagcauugu

SEQ ID NO: 3994765 - RNA, 12 nt, Human herpesvirus 6B
cugcaaaacaaa

SEQ ID NO: 3994766 - RNA, 18 nt, Human herpesvirus 6B
cugcaauuugguucagcu

SEQ ID NO: 3994767 - RNA, 23 nt, Human herpesvirus 6B
cugcagggaugugguaugagcug

SEQ ID NO: 3994768 - RNA, 15 nt, Human herpesvirus 6B
cugcccccacgggcc

SEQ ID NO: 3994769 - RNA, 21 nt, Human herpesvirus 6B
cugcucaugucaguauuucgc

SEQ ID NO: 3994770 - RNA, 14 nt, Human herpesvirus 6B
cugcuuuguuuucu

SEQ ID NO: 3994771 - RNA, 14 nt, Human herpesvirus 6B
cuggacagaaaguc

SEQ ID NO: 3994772 - RNA, 14 nt, Human herpesvirus 6B
cuggauuaucagag

SEQ ID NO: 3994773 - RNA, 18 nt, Human herpesvirus 6B
cuggccaaucauaagaaa

SEQ ID NO: 3994774 - RNA, 22 nt, Human herpesvirus 6B
cuggcgcuuguaggagcacgag

SEQ ID NO: 3994775 - RNA, 22 nt, Human herpesvirus 6B
cuggcgggcaccgagggcgggc

SEQ ID NO: 3994776 - RNA, 14 nt, Human herpesvirus 6B
cuggggacagacag

SEQ ID NO: 3994777 - RNA, 20 nt, Human herpesvirus 6B
cugguuacgcagaauccugu

SEQ ID NO: 3994778 - RNA, 12 nt, Human herpesvirus 6B
cuguaaaguuug

SEQ ID NO: 3994779 - RNA, 16 nt, Human herpesvirus 6B
cuguacacaaaaaccg

SEQ ID NO: 3994780 - RNA, 19 nt, Human herpesvirus 6B
cuguacgauuacuguccgu

SEQ ID NO: 3994781 - RNA, 13 nt, Human herpesvirus 6B
uuuauaugcauuu

SEQ ID NO: 3994782 - RNA, 24 nt, Human herpesvirus 6B
uuuaugaaaucgauguagauguuu

SEQ ID NO: 3994783 - RNA, 23 nt, Human herpesvirus 6B
uuuaugcagcucgggaaagauuu

SEQ ID NO: 3994784 - RNA, 13 nt, Human herpesvirus 6B
uuuaugucuguca

SEQ ID NO: 3994785 - RNA, 17 nt, Human herpesvirus 6B
uuucaccccccucuugc

SEQ ID NO: 3994786 - RNA, 13 nt, Human herpesvirus 6B
uuucauacuguau

SEQ ID NO: 3994787 - RNA, 14 nt, Human herpesvirus 6B
uuucauauuuuuaa

SEQ ID NO: 3994788 - RNA, 19 nt, Human herpesvirus 6B
uuucgugcgaaaaaacagu

SEQ ID NO: 3994789 - RNA, 16 nt, Human herpesvirus 6B
uuucugcgacaaaaaa

SEQ ID NO: 3994790 - RNA, 12 nt, Human herpesvirus 6B
uuucuuugacau

SEQ ID NO: 3994791 - RNA, 15 nt, Human herpesvirus 6B
uuugacaauaaacau

SEQ ID NO: 3994792 - RNA, 17 nt, Human herpesvirus 6B
uuugacaccucauauca

SEQ ID NO: 3994793 - RNA, 18 nt, Human herpesvirus 6B
uuugcgcaauucuucucu

SEQ ID NO: 3994794 - RNA, 15 nt, Human herpesvirus 6B
uuuggcauauacaaa

SEQ ID NO: 3994795 - RNA, 22 nt, Human herpesvirus 6B
uuuguacucgcuuacgaucuuu

SEQ ID NO: 3994796 - RNA, 16 nt, Human herpesvirus 6B
uuugucguuuguacau

SEQ ID NO: 3994797 - RNA, 21 nt, Human herpesvirus 6B
uuugucguuuguacauguuaa

SEQ ID NO: 3994798 - RNA, 22 nt, Human herpesvirus 6B
uuuuaaaagugcaacaaagagc

SEQ ID NO: 3994799 - RNA, 15 nt, Human herpesvirus 6B
uuuuauuuuaucuca

SEQ ID NO: 3994800 - RNA, 11 nt, Human herpesvirus 6B
uuuucugcaaa

SEQ ID NO: 3994801 - RNA, 17 nt, Human herpesvirus 6B
uuuucugccugcguuaa

SEQ ID NO: 3994802 - RNA, 22 nt, Human herpesvirus 6B
uuuucugccugcguuaagugaa

SEQ ID NO: 3994803 - RNA, 12 nt, Human herpesvirus 6B
uuuugaaaaggu

SEQ ID NO: 3994804 - RNA, 16 nt, Human herpesvirus 6B
uuuugaagguaucaaa

SEQ ID NO: 3994805 - RNA, 16 nt, Human herpesvirus 6B
uuuugcgaagaauugg

SEQ ID NO: 3994806 - RNA, 19 nt, Human herpesvirus 6B
aagaaguuguuuagaaagc

SEQ ID NO: 3994807 - RNA, 23 nt, Human herpesvirus 6B
aagaauccgcgggccagcccuga

SEQ ID NO: 3994808 - RNA, 17 nt, Human herpesvirus 6B
aagaaugggauugucau

SEQ ID NO: 3994809 - RNA, 15 nt, Human herpesvirus 6B
aagacguuuuugugu

SEQ ID NO: 3994810 - RNA, 18 nt, Human herpesvirus 6B
aagacuuagcuagacgug

SEQ ID NO: 3994811 - RNA, 15 nt, Human herpesvirus 6B
aagagagauacaggu

SEQ ID NO: 3994812 - RNA, 21 nt, Human herpesvirus 6B
aagagcuuuaaagcagcuaga

SEQ ID NO: 3994813 - RNA, 15 nt, Human herpesvirus 6B
aagaggaagggaugg

SEQ ID NO: 3994814 - RNA, 21 nt, Human herpesvirus 6B
aagauugcgucuuuuguaaag

SEQ ID NO: 3994815 - RNA, 22 nt, Human herpesvirus 6B
aagauugcgucuuuuguaaaga

SEQ ID NO: 3994816 - RNA, 15 nt, Human herpesvirus 6B
aagauuguucagagc

SEQ ID NO: 3994817 - RNA, 18 nt, Human herpesvirus 6B
aagauuuaaaaaugauaa

SEQ ID NO: 3994818 - RNA, 22 nt, Human herpesvirus 6B
aagcgccugccuacacugcgaa

SEQ ID NO: 3994819 - RNA, 22 nt, Human herpesvirus 6B
aagcuauguaugaacaggugcu

SEQ ID NO: 3994820 - RNA, 13 nt, Human herpesvirus 6B
aagcuuucuguac

SEQ ID NO: 3994821 - RNA, 22 nt, Human herpesvirus 6B
aaggcagcuggcaaugcaaagc

SEQ ID NO: 3994822 - RNA, 12 nt, Human herpesvirus 6B
aaggcggacagc

SEQ ID NO: 3994823 - RNA, 19 nt, Human herpesvirus 6B
aagguguuaaacgaaaacu

SEQ ID NO: 3994824 - RNA, 23 nt, Human herpesvirus 6B
aagguguuugaucuagauaaagu

SEQ ID NO: 3994825 - RNA, 18 nt, Human herpesvirus 6B
aaguauacggaagugcau

SEQ ID NO: 3994826 - RNA, 22 nt, Human herpesvirus 6B
aaguccgauauugaagaacugg

SEQ ID NO: 3994827 - RNA, 23 nt, Human herpesvirus 6B
aagucuuauuuuucuauguuaug

SEQ ID NO: 3994828 - RNA, 18 nt, Human herpesvirus 6B
aaguggaaguguaaaugu

SEQ ID NO: 3994829 - RNA, 17 nt, Human herpesvirus 6B
aaguuucggcaacugaa

SEQ ID NO: 3994830 - RNA, 14 nt, Human herpesvirus 6B
aauaaacaugauug

SEQ ID NO: 3994831 - RNA, 15 nt, Human herpesvirus 6B
aauaaaucaugugaa

SEQ ID NO: 3994832 - RNA, 21 nt, Human herpesvirus 6B
aauaacgguguugaguuuauc

SEQ ID NO: 3994833 - RNA, 16 nt, Human herpesvirus 6B
aauaauagguuauuua

SEQ ID NO: 3994834 - RNA, 21 nt, Human herpesvirus 6B
aauaauauaaaagaaacucuu

SEQ ID NO: 3994835 - RNA, 12 nt, Human herpesvirus 6B
aauaauuacaaa

SEQ ID NO: 3994836 - RNA, 15 nt, Human herpesvirus 6B
aauagagaaaaauaa

SEQ ID NO: 3994837 - RNA, 21 nt, Human herpesvirus 6B
aauaucaugauaaauuguuuc

SEQ ID NO: 3994838 - RNA, 17 nt, Human herpesvirus 6B
aauauugguauugauuu

SEQ ID NO: 3994839 - RNA, 19 nt, Human herpesvirus 6B
aauauuuuuucagcuuuca

SEQ ID NO: 3994840 - RNA, 21 nt, Human herpesvirus 6B
aauauuuuuucagcuuucaua

SEQ ID NO: 3994841 - RNA, 16 nt, Human herpesvirus 6B
aaucaaaaaaaugaua

SEQ ID NO: 3994842 - RNA, 15 nt, Human herpesvirus 6B
aaucaagaaacacuu

SEQ ID NO: 3994843 - RNA, 21 nt, Human herpesvirus 6B
aaucauccguucagcuuuaua

SEQ ID NO: 3994844 - RNA, 22 nt, Human herpesvirus 6B
aauccgcgggccagcccugaag

SEQ ID NO: 3994845 - RNA, 20 nt, Human herpesvirus 6B
aaucggguaaauaugugaaa

SEQ ID NO: 3994846 - RNA, 17 nt, Human herpesvirus 6B
aaucguguuuucuuaug

SEQ ID NO: 3994847 - RNA, 20 nt, Human herpesvirus 6B
aaucuauuaauuuugaagac

SEQ ID NO: 3994848 - RNA, 17 nt, Human herpesvirus 6B
aaucucaagaaacaagu

SEQ ID NO: 3994849 - RNA, 16 nt, Human herpesvirus 6B
aaucuccaaaacacuc

SEQ ID NO: 3994850 - RNA, 18 nt, Human herpesvirus 6B
aaucucgaugccaaagcu

SEQ ID NO: 3994851 - RNA, 20 nt, Human herpesvirus 6B
aaucuguaagauuaaaugug

SEQ ID NO: 3994852 - RNA, 22 nt, Human herpesvirus 6B
aaugacgaccauacguggugau

SEQ ID NO: 3994853 - RNA, 17 nt, Human herpesvirus 6B
aaugacuaucaaaauaa

SEQ ID NO: 3994854 - RNA, 12 nt, Human herpesvirus 6B
aaugagccuggc

SEQ ID NO: 3994855 - RNA, 21 nt, Human herpesvirus 6B
aaugaguugcacauguuucug

SEQ ID NO: 3994856 - RNA, 19 nt, Human herpesvirus 6B
aaugauaacuguuuuuguc

SEQ ID NO: 3994857 - RNA, 18 nt, Human herpesvirus 6B
aaugaugcauacagcaug

SEQ ID NO: 3994858 - RNA, 15 nt, Human herpesvirus 6B
aauggaaagauugga

SEQ ID NO: 3994859 - RNA, 16 nt, Human herpesvirus 6B
aaugguuucaaagucg

SEQ ID NO: 3994860 - RNA, 23 nt, Human herpesvirus 6B
aauguguucauagagcauccugu

SEQ ID NO: 3994861 - RNA, 16 nt, Human herpesvirus 6B
aauuaaucauuucgau

SEQ ID NO: 3994862 - RNA, 19 nt, Human herpesvirus 6B
aauuaugacugacaaggua

SEQ ID NO: 3994863 - RNA, 18 nt, Human herpesvirus 6B
aauuauugugacaaggua

SEQ ID NO: 3994864 - RNA, 21 nt, Human herpesvirus 6B
aauugauugggucuuucccgu

SEQ ID NO: 3994865 - RNA, 17 nt, Human herpesvirus 6B
aauuuaaacagaaauuu

SEQ ID NO: 3994866 - RNA, 12 nt, Human herpesvirus 6B
aauuuagacgaa

SEQ ID NO: 3994867 - RNA, 14 nt, Human herpesvirus 6B
aauuuauauucgac

SEQ ID NO: 3994868 - RNA, 22 nt, Human herpesvirus 6B
aauuuccagggugaagacagaa

SEQ ID NO: 3994869 - RNA, 14 nt, Human herpesvirus 6B
aauuucuuuggagg

SEQ ID NO: 3994870 - RNA, 20 nt, Human herpesvirus 6B
aauuuuaaauauuaauaguu

SEQ ID NO: 3994871 - RNA, 23 nt, Human herpesvirus 6B
acaaauaauuuuauugacuguga

SEQ ID NO: 3994872 - RNA, 14 nt, Human herpesvirus 6B
acaaaucugaaugu

SEQ ID NO: 3994873 - RNA, 18 nt, Human herpesvirus 6B
acaacacaauauaugaaa

SEQ ID NO: 3994874 - RNA, 14 nt, Human herpesvirus 6B
acaacaucucauaa

SEQ ID NO: 3994875 - RNA, 13 nt, Human herpesvirus 6B
acaacgugugaaa

SEQ ID NO: 3994876 - RNA, 16 nt, Human herpesvirus 6B
acaaggaucucgaaau

SEQ ID NO: 3994877 - RNA, 22 nt, Human herpesvirus 6B
acaaggguaacgcaggagaaac

SEQ ID NO: 3994878 - RNA, 22 nt, Human herpesvirus 6B
acaaguggaaguguaaauguca

SEQ ID NO: 3994879 - RNA, 20 nt, Human herpesvirus 6B
acaaugccaacacuguuguu

SEQ ID NO: 3994880 - RNA, 17 nt, Human herpesvirus 6B
acaauuuacacaggaug

SEQ ID NO: 3994881 - RNA, 13 nt, Human herpesvirus 6B
acacaacacaucu

SEQ ID NO: 3994882 - RNA, 16 nt, Human herpesvirus 6B
acaccgaauuuauuca

SEQ ID NO: 3994883 - RNA, 17 nt, Human herpesvirus 6B
acaccgacacgucucca

SEQ ID NO: 3994884 - RNA, 18 nt, Human herpesvirus 6B
acaccgcagacaucacaa

SEQ ID NO: 3994885 - RNA, 22 nt, Human herpesvirus 6B
acaccgugucaaaaaaaaauga

SEQ ID NO: 3994886 - RNA, 18 nt, Human herpesvirus 6B
acacggccacccgcgucu

SEQ ID NO: 3994887 - RNA, 20 nt, Human herpesvirus 6B
acacuguuguuaaucuguuu

SEQ ID NO: 3994888 - RNA, 21 nt, Human herpesvirus 6B
acacuguuguuaaucuguuua

SEQ ID NO: 3994889 - RNA, 21 nt, Human herpesvirus 6B
acacuuucuucgccuguaaag

SEQ ID NO: 3994890 - RNA, 22 nt, Human herpesvirus 6B
acagaaaaaaaaauguuuuguc

SEQ ID NO: 3994891 - RNA, 16 nt, Human herpesvirus 6B
acagcgcauaaauaaa

SEQ ID NO: 3994892 - RNA, 19 nt, Human herpesvirus 6B
acagcuuguccgaaauaca

SEQ ID NO: 3994893 - RNA, 19 nt, Human herpesvirus 6B
acagcuuugcagaacgaga

SEQ ID NO: 3994894 - RNA, 23 nt, Human herpesvirus 6B
acaguacaagaagggguuccuuc

SEQ ID NO: 3994895 - RNA, 15 nt, Human herpesvirus 6B
acaguucguccagca

SEQ ID NO: 3994896 - RNA, 18 nt, Human herpesvirus 6B
acaguucguccagcagcg

SEQ ID NO: 3994897 - RNA, 20 nt, Human herpesvirus 6B
acauaugcaaucugugggaa

SEQ ID NO: 3994898 - RNA, 13 nt, Human herpesvirus 6B
acauccaaaauac

SEQ ID NO: 3994899 - RNA, 12 nt, Human herpesvirus 6B
acaucuaugaug

SEQ ID NO: 3994900 - RNA, 18 nt, Human herpesvirus 6B
acaugacggacuuggaaa

SEQ ID NO: 3994901 - RNA, 17 nt, Human herpesvirus 6B
acaugagcgagaauguu

SEQ ID NO: 3994902 - RNA, 15 nt, Human herpesvirus 6B
acauuagagaaauuu

SEQ ID NO: 3994903 - RNA, 22 nt, Human herpesvirus 6B
accaagaaucguuaaaugagau

SEQ ID NO: 3994904 - RNA, 18 nt, Human herpesvirus 6B
accauguucgccucuccc

SEQ ID NO: 3994905 - RNA, 15 nt, Human herpesvirus 6B
acccaugaaaaucau

SEQ ID NO: 3994906 - RNA, 17 nt, Human herpesvirus 6B
accccccucuugcagug

SEQ ID NO: 3994907 - RNA, 22 nt, Human herpesvirus 6B
accgcccugcuccguucccuuc

SEQ ID NO: 3994908 - RNA, 16 nt, Human herpesvirus 6B
accgucaagaaguugu

SEQ ID NO: 3994909 - RNA, 18 nt, Human herpesvirus 6B
accucaaaaaugcacaau

SEQ ID NO: 3994910 - RNA, 13 nt, Human herpesvirus 6B
accuuagcucuaa

SEQ ID NO: 3994911 - RNA, 21 nt, Human herpesvirus 6B
accuugucacaauaauuacuc

SEQ ID NO: 3994912 - RNA, 15 nt, Human herpesvirus 6B
acgaacauucaaugg

SEQ ID NO: 3994913 - RNA, 13 nt, Human herpesvirus 6B
acgacaugugguu

SEQ ID NO: 3994914 - RNA, 16 nt, Human herpesvirus 6B
acgaucucauaugcau

SEQ ID NO: 3994915 - RNA, 19 nt, Human herpesvirus 6B
acgauguuacgucuuugga

SEQ ID NO: 3994916 - RNA, 13 nt, Human herpesvirus 6B
acgcaaagggaag

SEQ ID NO: 3994917 - RNA, 15 nt, Human herpesvirus 6B
acgccauccacccau

SEQ ID NO: 3994918 - RNA, 23 nt, Human herpesvirus 6B
uggauuaucagagagugacaucu

SEQ ID NO: 3994919 - RNA, 15 nt, Human herpesvirus 6B
uggauuauguuaauu

SEQ ID NO: 3994920 - RNA, 23 nt, Human herpesvirus 6B
uggauuccauccgcuaagagauu

SEQ ID NO: 3994921 - RNA, 17 nt, Human herpesvirus 6B
uggcagccuaaacggag

SEQ ID NO: 3994922 - RNA, 15 nt, Human herpesvirus 6B
uggccgucuccugca

SEQ ID NO: 3994923 - RNA, 17 nt, Human herpesvirus 6B
uggcgcuuguaggagca

SEQ ID NO: 3994924 - RNA, 14 nt, Human herpesvirus 6B
uggcgggcaccgag

SEQ ID NO: 3994925 - RNA, 19 nt, Human herpesvirus 6B
uggcguuccgaauccugug

SEQ ID NO: 3994926 - RNA, 16 nt, Human herpesvirus 6B
uggcuuggccagccac

SEQ ID NO: 3994927 - RNA, 20 nt, Human herpesvirus 6B
ugggggauggguuaggguua

SEQ ID NO: 3994928 - RNA, 21 nt, Human herpesvirus 6B
uggguacaaugccaacacugu

SEQ ID NO: 3994929 - RNA, 15 nt, Human herpesvirus 6B
ugguaauaaacagac

SEQ ID NO: 3994930 - RNA, 20 nt, Human herpesvirus 6B
ugguaauccaugaacuacag

SEQ ID NO: 3994931 - RNA, 16 nt, Human herpesvirus 6B
ugguauugauuucuau

SEQ ID NO: 3994932 - RNA, 23 nt, Human herpesvirus 6B
uggucaagggcaagguucucagc

SEQ ID NO: 3994933 - RNA, 18 nt, Human herpesvirus 6B
ugguggcgaucuguauau

SEQ ID NO: 3994934 - RNA, 21 nt, Human herpesvirus 6B
uguaagcgaauugguuugcuu

SEQ ID NO: 3994935 - RNA, 18 nt, Human herpesvirus 6B
uguacaacgacugggaga

SEQ ID NO: 3994936 - RNA, 19 nt, Human herpesvirus 6B
uguacauguuaacaauaaa

SEQ ID NO: 3994937 - RNA, 21 nt, Human herpesvirus 6B
uguacgccauacgggaaaaga

SEQ ID NO: 3994938 - RNA, 11 nt, Human herpesvirus 6B
uguagaagaag

SEQ ID NO: 3994939 - RNA, 12 nt, Human herpesvirus 6B
uguagcagcugg

SEQ ID NO: 3994940 - RNA, 17 nt, Human herpesvirus 6B
uguaguuaguuuugaua

SEQ ID NO: 3994941 - RNA, 16 nt, Human herpesvirus 6B
uguaguugaugcuguu

SEQ ID NO: 3994942 - RNA, 20 nt, Human herpesvirus 6B
uguauaagagucugcaucaa

SEQ ID NO: 3994943 - RNA, 18 nt, Human herpesvirus 6B
uguauaauauaaauucuu

SEQ ID NO: 3994944 - RNA, 22 nt, Human herpesvirus 6B
uguaucgaggaauguguuucua

SEQ ID NO: 3994945 - RNA, 14 nt, Human herpesvirus 6B
uguaugaggcuauu

SEQ ID NO: 3994946 - RNA, 12 nt, Human herpesvirus 6B
uguauguuucua

SEQ ID NO: 3994947 - RNA, 13 nt, Human herpesvirus 6B
uguauguuucuau

SEQ ID NO: 3994948 - RNA, 22 nt, Human herpesvirus 6B
uguauuguagcagcuggcgaaa

SEQ ID NO: 3994949 - RNA, 16 nt, Human herpesvirus 6B
uguauuugaaaugacg

SEQ ID NO: 3994950 - RNA, 12 nt, Human herpesvirus 6B
uguauuuggaug

SEQ ID NO: 3994951 - RNA, 11 nt, Human herpesvirus 6B
uguccugagaa

SEQ ID NO: 3994952 - RNA, 15 nt, Human herpesvirus 6B
ugucgcccgccucuc

SEQ ID NO: 3994953 - RNA, 15 nt, Human herpesvirus 6B
ugucgggccacauuu

SEQ ID NO: 3994954 - RNA, 15 nt, Human herpesvirus 6B
ugucguuuguacaug

SEQ ID NO: 3994955 - RNA, 15 nt, Human herpesvirus 6B
ugucuggcuguaucu

SEQ ID NO: 3994956 - RNA, 21 nt, Human herpesvirus 6B
ugucuuggaagagagaugcuu

SEQ ID NO: 3994957 - RNA, 18 nt, Human herpesvirus 6B
ugugaacguguuuggaca

SEQ ID NO: 3994958 - RNA, 16 nt, Human herpesvirus 6B
ugugaggugauuugaa

SEQ ID NO: 3994959 - RNA, 20 nt, Human herpesvirus 6B
ugugauaguuauuuuguaua

SEQ ID NO: 3994960 - RNA, 13 nt, Human herpesvirus 6B
ugugaucaagugg

SEQ ID NO: 3994961 - RNA, 23 nt, Human herpesvirus 6B
uguggcuauuugacaauaaacau

SEQ ID NO: 3994962 - RNA, 22 nt, Human herpesvirus 6B
ugugggaaaauaauauuugcaa

SEQ ID NO: 3994963 - RNA, 18 nt, Human herpesvirus 6B
uguuagcaagcugggaaa

SEQ ID NO: 3994964 - RNA, 21 nt, Human herpesvirus 6B
uguuaugcaguuguacucaaa

SEQ ID NO: 3994965 - RNA, 12 nt, Human herpesvirus 6B
uguucucuccca

SEQ ID NO: 3994966 - RNA, 16 nt, Human herpesvirus 6B
uguucuuuugucauug

SEQ ID NO: 3994967 - RNA, 18 nt, Human herpesvirus 6B
uguugaguaauuggacau

SEQ ID NO: 3994968 - RNA, 16 nt, Human herpesvirus 6B
uguuguucuuggagac

SEQ ID NO: 3994969 - RNA, 15 nt, Human herpesvirus 6B
uguuuaacuaauaaa

SEQ ID NO: 3994970 - RNA, 13 nt, Human herpesvirus 6B
uguuuccagaaua

SEQ ID NO: 3994971 - RNA, 12 nt, Human herpesvirus 6B
uguuucuuagaa

SEQ ID NO: 3994972 - RNA, 20 nt, Human herpesvirus 6B
uguuuucaaugguauucgaa

SEQ ID NO: 3994973 - RNA, 19 nt, Human herpesvirus 6B
uguuuuguacaaagguuuu

SEQ ID NO: 3994974 - RNA, 21 nt, Human herpesvirus 6B
uuaaaacucuaaaaccugcua

SEQ ID NO: 3994975 - RNA, 13 nt, Human herpesvirus 6B
uuaaaagugcaac

SEQ ID NO: 3994976 - RNA, 19 nt, Human herpesvirus 6B
uuaaaaucaaaaaaaucuc

SEQ ID NO: 3994977 - RNA, 17 nt, Human herpesvirus 6B
uuaaacgaaaacuuuuu

SEQ ID NO: 3994978 - RNA, 15 nt, Human herpesvirus 6B
uuaaauccuagaguu

SEQ ID NO: 3994979 - RNA, 15 nt, Human herpesvirus 6B
uuaaaugacacagaa

SEQ ID NO: 3994980 - RNA, 20 nt, Human herpesvirus 6B
uuaaauuguuuuaaacauuc

SEQ ID NO: 3994981 - RNA, 13 nt, Human herpesvirus 6B
uuaacugucaugu

SEQ ID NO: 3994982 - RNA, 14 nt, Human herpesvirus 6B
uuaagaagaaacaa

SEQ ID NO: 3994983 - RNA, 15 nt, Human herpesvirus 6B
uuaauccauauuugg

SEQ ID NO: 3994984 - RNA, 13 nt, Human herpesvirus 6B
uuaaucggaaugu

SEQ ID NO: 3994985 - RNA, 11 nt, Human herpesvirus 6B
uuacaaguaug

SEQ ID NO: 3994986 - RNA, 16 nt, Human herpesvirus 6B
uuacaugaaaacauuc

SEQ ID NO: 3994987 - RNA, 20 nt, Human herpesvirus 6B
uuaccagagauacgugauac

SEQ ID NO: 3994988 - RNA, 18 nt, Human herpesvirus 6B
uuacgagaccuguuugag

SEQ ID NO: 3994989 - RNA, 16 nt, Human herpesvirus 6B
uuacgugccguguuac

SEQ ID NO: 3994990 - RNA, 19 nt, Human herpesvirus 6B
uuacuguccgcuucccagc

SEQ ID NO: 3994991 - RNA, 20 nt, Human herpesvirus 6B
uuacuguccguuauuguguu

SEQ ID NO: 3994992 - RNA, 14 nt, Human herpesvirus 6B
uuagaagcauuugc

SEQ ID NO: 3994993 - RNA, 16 nt, Human herpesvirus 6B
uuaggacaugugguaa

SEQ ID NO: 3994994 - RNA, 14 nt, Human herpesvirus 6B
uuagguaucugccc

SEQ ID NO: 3994995 - RNA, 16 nt, Human herpesvirus 6B
uuaguuucuuuggaaa

SEQ ID NO: 3994996 - RNA, 13 nt, Human herpesvirus 6B
uuaguuuuggaug

SEQ ID NO: 3994997 - RNA, 21 nt, Human herpesvirus 6B
uuaucagagagugacaucuua

SEQ ID NO: 3994998 - RNA, 14 nt, Human herpesvirus 6B
uuauccggccaauu

SEQ ID NO: 3994999 - RNA, 13 nt, Human herpesvirus 6B
uuauuugugcaaa

SEQ ID NO: 3995000 - RNA, 11 nt, Human herpesvirus 6B
uucaaaaugac

SEQ ID NO: 3995001 - RNA, 23 nt, Human herpesvirus 6B
uucaacauccuauuaagauucuc

SEQ ID NO: 3995002 - RNA, 17 nt, Human herpesvirus 6B
uucaauaaaaaacuuau

SEQ ID NO: 3995003 - RNA, 17 nt, Human herpesvirus 6B
uucacacgguucugauu

SEQ ID NO: 3995004 - RNA, 18 nt, Human herpesvirus 6B
uucaggcauuaaacugag

SEQ ID NO: 3995005 - RNA, 14 nt, Human herpesvirus 6B
uucagucucagcaa

SEQ ID NO: 3995006 - RNA, 20 nt, Human herpesvirus 6B
uucagugucagcauugucag

SEQ ID NO: 3995007 - RNA, 17 nt, Human herpesvirus 6B
uucauagcguucaaaac

SEQ ID NO: 3995008 - RNA, 14 nt, Human herpesvirus 6B
uucaucgaauccaa

SEQ ID NO: 3995009 - RNA, 18 nt, Human herpesvirus 6B
uuccagguuuuucauaac

SEQ ID NO: 3995010 - RNA, 15 nt, Human herpesvirus 6B
uuccaugacugugag

SEQ ID NO: 3995011 - RNA, 17 nt, Human herpesvirus 6B
uuccuguuuuucucaua

SEQ ID NO: 3995012 - RNA, 12 nt, Human herpesvirus 6B
uucgauguuucc

SEQ ID NO: 3995013 - RNA, 18 nt, Human herpesvirus 6B
uucguaaauccgaaacac

SEQ ID NO: 3995014 - RNA, 13 nt, Human herpesvirus 6B
uucguuuucccgc

SEQ ID NO: 3995015 - RNA, 19 nt, Human herpesvirus 6B
uucuaagacgagauguuuc

SEQ ID NO: 3995016 - RNA, 18 nt, Human herpesvirus 6B
uucuagaugcauuguuga

SEQ ID NO: 3995017 - RNA, 19 nt, Human herpesvirus 6B
uucuccucaacuaaaucau

SEQ ID NO: 3995018 - RNA, 13 nt, Human herpesvirus 6B
uucuccuguaguu

SEQ ID NO: 3995019 - RNA, 17 nt, Human herpesvirus 6B
uucucgaccacgguuaa

SEQ ID NO: 3995020 - RNA, 15 nt, Human herpesvirus 6B
uucucugcaugucuu

SEQ ID NO: 3995021 - RNA, 13 nt, Human herpesvirus 6B
uucucugucgcug

SEQ ID NO: 3995022 - RNA, 12 nt, Human herpesvirus 6B
uucugaaaucuu

SEQ ID NO: 3995023 - RNA, 22 nt, Human herpesvirus 6B
uucugaauacgagaacgguuaa

SEQ ID NO: 3995024 - RNA, 21 nt, Human herpesvirus 6B
uucuggguauuuccuguuuug

SEQ ID NO: 3995025 - RNA, 17 nt, Human herpesvirus 6B
uucuuugacuauuucga

SEQ ID NO: 3995026 - RNA, 22 nt, Human herpesvirus 6B
uucuuugugcgucagcuuugac

SEQ ID NO: 3995027 - RNA, 22 nt, Human herpesvirus 6B
uugaaaagguguuguguuugaa

SEQ ID NO: 3995028 - RNA, 12 nt, Human herpesvirus 6B
uugaagaacugg

SEQ ID NO: 3995029 - RNA, 20 nt, Human herpesvirus 6B
uugaauccucuuagauaucc

SEQ ID NO: 3995030 - RNA, 16 nt, Human herpesvirus 6B
uugacaauaaacauga

SEQ ID NO: 3995031 - RNA, 17 nt, Human herpesvirus 6B
uugacaaucuuggaaaa

SEQ ID NO: 3995032 - RNA, 19 nt, Human herpesvirus 6B
ucuccgucucagugucacu

SEQ ID NO: 3995033 - RNA, 23 nt, Human herpesvirus 6B
ucuccguuacccgggagcuucac

SEQ ID NO: 3995034 - RNA, 16 nt, Human herpesvirus 6B
ucuccugugcguccuc

SEQ ID NO: 3995035 - RNA, 12 nt, Human herpesvirus 6B
ucucucccuacg

SEQ ID NO: 3995036 - RNA, 14 nt, Human herpesvirus 6B
ucucugcaugucuu

SEQ ID NO: 3995037 - RNA, 17 nt, Human herpesvirus 6B
ucugaaaaguuagaguu

SEQ ID NO: 3995038 - RNA, 22 nt, Human herpesvirus 6B
ucugauuauuaucacaaaguuu

SEQ ID NO: 3995039 - RNA, 23 nt, Human herpesvirus 6B
ucugauuuucagugucagcauug

SEQ ID NO: 3995040 - RNA, 22 nt, Human herpesvirus 6B
ucugcaucaagcuucacgugau

SEQ ID NO: 3995041 - RNA, 22 nt, Human herpesvirus 6B
ucugcauuuauaucaaacuuuu

SEQ ID NO: 3995042 - RNA, 20 nt, Human herpesvirus 6B
ucugccccccuucauccagc

SEQ ID NO: 3995043 - RNA, 20 nt, Human herpesvirus 6B
ucuguuacaacaauauguaa

SEQ ID NO: 3995044 - RNA, 15 nt, Human herpesvirus 6B
ucuuaccaagaaauc

SEQ ID NO: 3995045 - RNA, 21 nt, Human herpesvirus 6B
ucuuacgggcgcuuuugacgu

SEQ ID NO: 3995046 - RNA, 20 nt, Human herpesvirus 6B
gcggauuagguaucugcccc

SEQ ID NO: 3995047 - RNA, 18 nt, Human herpesvirus 6B
gcggcauguguaagaaaa

SEQ ID NO: 3995048 - RNA, 13 nt, Human herpesvirus 6B
gcggcgcugggcu

SEQ ID NO: 3995049 - RNA, 20 nt, Human herpesvirus 6B
gcggggcgcaccggcgacac

SEQ ID NO: 3995050 - RNA, 14 nt, Human herpesvirus 6B
gcgucgggcgguuc

SEQ ID NO: 3995051 - RNA, 24 nt, Human herpesvirus 6B
gcgucuccgauccgucaggaccag

SEQ ID NO: 3995052 - RNA, 17 nt, Human herpesvirus 6B
gcgucuuuuguaaagau

SEQ ID NO: 3995053 - RNA, 20 nt, Human herpesvirus 6B
gcguucggucucuggaagca

SEQ ID NO: 3995054 - RNA, 22 nt, Human herpesvirus 6B
gcuaagauuaacaacugccgcc

SEQ ID NO: 3995055 - RNA, 16 nt, Human herpesvirus 6B
gcuaggcuuaaugaau

SEQ ID NO: 3995056 - RNA, 12 nt, Human herpesvirus 6B
gcuauuugacaa

SEQ ID NO: 3995057 - RNA, 18 nt, Human herpesvirus 6B
gcuauuugacaauaaaca

SEQ ID NO: 3995058 - RNA, 12 nt, Human herpesvirus 6B
gcucaagaugaa

SEQ ID NO: 3995059 - RNA, 23 nt, Human herpesvirus 6B
gcuccauaaugguaugccugagc

SEQ ID NO: 3995060 - RNA, 16 nt, Human herpesvirus 6B
gcuccccaggcgcagc

SEQ ID NO: 3995061 - RNA, 14 nt, Human herpesvirus 6B
gcucucccucuucc

SEQ ID NO: 3995062 - RNA, 23 nt, Human herpesvirus 6B
gcucucgaugaaaguuuuggaaa

SEQ ID NO: 3995063 - RNA, 22 nt, Human herpesvirus 6B
gcucucguggcccgugggggca

SEQ ID NO: 3995064 - RNA, 16 nt, Human herpesvirus 6B
gcugauucuguuuucu

SEQ ID NO: 3995065 - RNA, 21 nt, Human herpesvirus 6B
gcugcgggcuuaauaaaggau

SEQ ID NO: 3995066 - RNA, 18 nt, Human herpesvirus 6B
gcugguccuucgacauag

SEQ ID NO: 3995067 - RNA, 21 nt, Human herpesvirus 6B
gcugucgcccgccucucuccg

SEQ ID NO: 3995068 - RNA, 16 nt, Human herpesvirus 6B
gcugucggccgaagga

SEQ ID NO: 3995069 - RNA, 20 nt, Human herpesvirus 6B
gcuucaguaugucucaguuc

SEQ ID NO: 3995070 - RNA, 17 nt, Human herpesvirus 6B
gcuugguguaccagaca

SEQ ID NO: 3995071 - RNA, 22 nt, Human herpesvirus 6B
gcuuguuuugguggacaccaau

SEQ ID NO: 3995072 - RNA, 20 nt, Human herpesvirus 6B
gcuuuauggagauuugacuu

SEQ ID NO: 3995073 - RNA, 18 nt, Human herpesvirus 6B
ggaagaggaagggauggc

SEQ ID NO: 3995074 - RNA, 15 nt, Human herpesvirus 6B
ggaauaaugaaauuu

SEQ ID NO: 3995075 - RNA, 14 nt, Human herpesvirus 6B
ggaauggacaugac

SEQ ID NO: 3995076 - RNA, 21 nt, Human herpesvirus 6B
ggaauggacaugacgaaggga

SEQ ID NO: 3995077 - RNA, 18 nt, Human herpesvirus 6B
ggaauuauauguugauug

SEQ ID NO: 3995078 - RNA, 20 nt, Human herpesvirus 6B
ggaauuuaaaucguaugagc

SEQ ID NO: 3995079 - RNA, 16 nt, Human herpesvirus 6B
ggacacgagaagaaca

SEQ ID NO: 3995080 - RNA, 18 nt, Human herpesvirus 6B
ggacgcguucggucucug

SEQ ID NO: 3995081 - RNA, 17 nt, Human herpesvirus 6B
ggacggacagagcggag

SEQ ID NO: 3995082 - RNA, 12 nt, Human herpesvirus 6B
ggacugaaggag

SEQ ID NO: 3995083 - RNA, 16 nt, Human herpesvirus 6B
ggagacugcacagaau

SEQ ID NO: 3995084 - RNA, 19 nt, Human herpesvirus 6B
ggagcacgagccaagggga

SEQ ID NO: 3995085 - RNA, 18 nt, Human herpesvirus 6B
ggagcacgcacgagaaca

SEQ ID NO: 3995086 - RNA, 20 nt, Human herpesvirus 6B
ggagcaggcuccccaggcgc

SEQ ID NO: 3995087 - RNA, 14 nt, Human herpesvirus 6B
ggagcuuuuucaaa

SEQ ID NO: 3995088 - RNA, 17 nt, Human herpesvirus 6B
ggaggaggaggaagagg

SEQ ID NO: 3995089 - RNA, 16 nt, Human herpesvirus 6B
ggaggaggaggagagg

SEQ ID NO: 3995090 - RNA, 21 nt, Human herpesvirus 6B
ggagguuuuuucaccccccuc

SEQ ID NO: 3995091 - RNA, 23 nt, Human herpesvirus 6B
ggaguaauuauugugacaaggua

SEQ ID NO: 3995092 - RNA, 12 nt, Human herpesvirus 6B
ggaguauucgug

SEQ ID NO: 3995093 - RNA, 15 nt, Human herpesvirus 6B
ggagugcgacaggag

SEQ ID NO: 3995094 - RNA, 14 nt, Human herpesvirus 6B
ggagugggaggagc

SEQ ID NO: 3995095 - RNA, 14 nt, Human herpesvirus 6B
ggauaaauuccucu

SEQ ID NO: 3995096 - RNA, 14 nt, Human herpesvirus 6B
ggaucaaucuccaa

SEQ ID NO: 3995097 - RNA, 22 nt, Human herpesvirus 6B
ggaucagacagacgugcggaga

SEQ ID NO: 3995098 - RNA, 18 nt, Human herpesvirus 6B
ggaucgggccuggggaca

SEQ ID NO: 3995099 - RNA, 18 nt, Human herpesvirus 6B
ggcaaccgcaguuccugu

SEQ ID NO: 3995100 - RNA, 23 nt, Human herpesvirus 6B
ggcaacguuuucugcucaacaau

SEQ ID NO: 3995101 - RNA, 13 nt, Human herpesvirus 6B
ggcacgagagccu

SEQ ID NO: 3995102 - RNA, 15 nt, Human herpesvirus 6B
ggcacgcgccgucag

SEQ ID NO: 3995103 - RNA, 17 nt, Human herpesvirus 6B
ggcagggcgggcacgga

SEQ ID NO: 3995104 - RNA, 20 nt, Human herpesvirus 6B
ggcccgugggggcagaacug

SEQ ID NO: 3995105 - RNA, 11 nt, Human herpesvirus 6B
ggcccuuggug

SEQ ID NO: 3995106 - RNA, 19 nt, Human herpesvirus 6B
ggccgaguuuagacagagu

SEQ ID NO: 3995107 - RNA, 21 nt, Human herpesvirus 6B
ggccgcuuucuuggcgcccgu

SEQ ID NO: 3995108 - RNA, 15 nt, Human herpesvirus 6B
ggccgucuccugcaa

SEQ ID NO: 3995109 - RNA, 15 nt, Human herpesvirus 6B
ggccuggggacagac

SEQ ID NO: 3995110 - RNA, 14 nt, Human herpesvirus 6B
ggcgacguaaggau

SEQ ID NO: 3995111 - RNA, 12 nt, Human herpesvirus 6B
ggcgcaccgccu

SEQ ID NO: 3995112 - RNA, 19 nt, Human herpesvirus 6B
ggcgcccgugguggccguc

SEQ ID NO: 3995113 - RNA, 17 nt, Human herpesvirus 6B
ucauaauuugccugagu

SEQ ID NO: 3995114 - RNA, 15 nt, Human herpesvirus 6B
ucaucucccaugguu

SEQ ID NO: 3995115 - RNA, 16 nt, Human herpesvirus 6B
ucauguaaaauuaccu

SEQ ID NO: 3995116 - RNA, 14 nt, Human herpesvirus 6B
ucauuguaauucca

SEQ ID NO: 3995117 - RNA, 19 nt, Human herpesvirus 6B
uccaaguuuuuaugcaacg

SEQ ID NO: 3995118 - RNA, 21 nt, Human herpesvirus 6B
uccaauguccauuuuuuccca

SEQ ID NO: 3995119 - RNA, 22 nt, Human herpesvirus 6B
uccacggcaacgcuccucccac

SEQ ID NO: 3995120 - RNA, 17 nt, Human herpesvirus 6B
uccagcaagaaaaagag

SEQ ID NO: 3995121 - RNA, 17 nt, Human herpesvirus 6B
uccaguuguauuuugcg

SEQ ID NO: 3995122 - RNA, 13 nt, Human herpesvirus 6B
uccauaaugguau

SEQ ID NO: 3995123 - RNA, 20 nt, Human herpesvirus 6B
uccaucucuagaaucuuacu

SEQ ID NO: 3995124 - RNA, 15 nt, Human herpesvirus 6B
uccaugcgaguagau

SEQ ID NO: 3995125 - RNA, 18 nt, Human herpesvirus 6B
uccccccgccgccuucuc

SEQ ID NO: 3995126 - RNA, 22 nt, Human herpesvirus 6B
uccccccgccgccuucucuguc

SEQ ID NO: 3995127 - RNA, 17 nt, Human herpesvirus 6B
uccccucauacauccag

SEQ ID NO: 3995128 - RNA, 23 nt, Human herpesvirus 6B
ucccgcucgggggacggagagga

SEQ ID NO: 3995129 - RNA, 17 nt, Human herpesvirus 6B
ucccuccaucccccucc

SEQ ID NO: 3995130 - RNA, 14 nt, Human herpesvirus 6B
uccgaguauggaga

SEQ ID NO: 3995131 - RNA, 12 nt, Human herpesvirus 6B
uccgcagucucu

SEQ ID NO: 3995132 - RNA, 20 nt, Human herpesvirus 6B
uccgccuccucuuuuccccc

SEQ ID NO: 3995133 - RNA, 15 nt, Human herpesvirus 6B
uccgucaucuagaga

SEQ ID NO: 3995134 - RNA, 21 nt, Human herpesvirus 6B
uccguuauuguguucugcucu

SEQ ID NO: 3995135 - RNA, 23 nt, Human herpesvirus 6B
uccuauguuaacauugugagaac

SEQ ID NO: 3995136 - RNA, 13 nt, Human herpesvirus 6B
uccucgaagaauu

SEQ ID NO: 3995137 - RNA, 15 nt, Human herpesvirus 6B
uccucugaauuucaa

SEQ ID NO: 3995138 - RNA, 20 nt, Human herpesvirus 6B
uccucuuuuccccccgccgc

SEQ ID NO: 3995139 - RNA, 23 nt, Human herpesvirus 6B
uccugcaauuugaauucugcucg

SEQ ID NO: 3995140 - RNA, 19 nt, Human herpesvirus 6B
uccuuaaaugacacagaau

SEQ ID NO: 3995141 - RNA, 19 nt, Human herpesvirus 6B
uccuuaucagucucaaaaa

SEQ ID NO: 3995142 - RNA, 23 nt, Human herpesvirus 6B
ucgaaaaugcugauuuuaaacua

SEQ ID NO: 3995143 - RNA, 17 nt, Human herpesvirus 6B
uacaauacuuucacaca

SEQ ID NO: 3995144 - RNA, 15 nt, Human herpesvirus 6B
uacaaugagccuggc

SEQ ID NO: 3995145 - RNA, 22 nt, Human herpesvirus 6B
uacaaugaguuuuuugcaauuu

SEQ ID NO: 3995146 - RNA, 16 nt, Human herpesvirus 6B
uacacacgaggucggu

SEQ ID NO: 3995147 - RNA, 19 nt, Human herpesvirus 6B
uacacagagugcaucuuua

SEQ ID NO: 3995148 - RNA, 23 nt, Human herpesvirus 6B
uacagguuugcucgucuguacag

SEQ ID NO: 3995149 - RNA, 17 nt, Human herpesvirus 6B
uacauaagcaugaaucu

SEQ ID NO: 3995150 - RNA, 17 nt, Human herpesvirus 6B
uacaucccgaguauaac

SEQ ID NO: 3995151 - RNA, 21 nt, Human herpesvirus 6B
uaccauuuuauacgaaaauaa

SEQ ID NO: 3995152 - RNA, 20 nt, Human herpesvirus 6B
uacccaucguucuuaacaua

SEQ ID NO: 3995153 - RNA, 12 nt, Human herpesvirus 6B
uaccgacaagcc

SEQ ID NO: 3995154 - RNA, 22 nt, Human herpesvirus 6B
uacggagauauaccgugacagc

SEQ ID NO: 3995155 - RNA, 11 nt, Human herpesvirus 6B
uacguuuucaa

SEQ ID NO: 3995156 - RNA, 13 nt, Human herpesvirus 6B
uacuaaagcaauc

SEQ ID NO: 3995157 - RNA, 16 nt, Human herpesvirus 6B
uacuaugauagaagau

SEQ ID NO: 3995158 - RNA, 18 nt, Human herpesvirus 6B
uacucugcaacuuuauuu

SEQ ID NO: 3995159 - RNA, 21 nt, Human herpesvirus 6B
uagaacauaagggacagcagu

SEQ ID NO: 3995160 - RNA, 14 nt, Human herpesvirus 6B
uagaaguuaaucaa

SEQ ID NO: 3995161 - RNA, 13 nt, Human herpesvirus 6B
uagacacacagaa

SEQ ID NO: 3995162 - RNA, 13 nt, Human herpesvirus 6B
uagaguuggauuu

SEQ ID NO: 3995163 - RNA, 17 nt, Human herpesvirus 6B
uagaucuggaagacugu

SEQ ID NO: 3995164 - RNA, 14 nt, Human herpesvirus 6B
uagcacacgacaaa

SEQ ID NO: 3995165 - RNA, 19 nt, Human herpesvirus 6B
uagcaccccacaaaacuua

SEQ ID NO: 3995166 - RNA, 17 nt, Human herpesvirus 6B
uagcuagacgugucuuc

SEQ ID NO: 3995167 - RNA, 22 nt, Human herpesvirus 6B
uaggacaauuggauaaacaucg

SEQ ID NO: 3995168 - RNA, 19 nt, Human herpesvirus 6B
uagucaggauucggaucac

SEQ ID NO: 3995169 - RNA, 17 nt, Human herpesvirus 6B
uagucguggcggagcac

SEQ ID NO: 3995170 - RNA, 17 nt, Human herpesvirus 6B
uaguugaugcuguugcu

SEQ ID NO: 3995171 - RNA, 14 nt, Human herpesvirus 6B
uaguuuuggaugaa

SEQ ID NO: 3995172 - RNA, 14 nt, Human herpesvirus 6B
uauaaauguagcac

SEQ ID NO: 3995173 - RNA, 14 nt, Human herpesvirus 6B
uauaacagacauau

SEQ ID NO: 3995174 - RNA, 18 nt, Human herpesvirus 6B
uauaccgugacagcaacu

SEQ ID NO: 3995175 - RNA, 23 nt, Human herpesvirus 6B
uauacucugcaacuuuauuugaa

SEQ ID NO: 3995176 - RNA, 22 nt, Human herpesvirus 6B
uauagauuauacgaaauuccga

SEQ ID NO: 3995177 - RNA, 13 nt, Human herpesvirus 6B
uauauagaagaag

SEQ ID NO: 3995178 - RNA, 13 nt, Human herpesvirus 6B
uauaucuggauau

SEQ ID NO: 3995179 - RNA, 17 nt, Human herpesvirus 6B
uauauuggcacguguac

SEQ ID NO: 3995180 - RNA, 19 nt, Human herpesvirus 6B
uauauuuucguugaagaau

SEQ ID NO: 3995181 - RNA, 20 nt, Human herpesvirus 6B
uaucacuuagacacggccag

SEQ ID NO: 3995182 - RNA, 16 nt, Human herpesvirus 6B
uaucuaugcuuuugua

SEQ ID NO: 3995183 - RNA, 21 nt, Human herpesvirus 6B
uaucucaaauuuuccaaacau

SEQ ID NO: 3995184 - RNA, 15 nt, Human herpesvirus 6B
uaucucgaaaugcau

SEQ ID NO: 3995185 - RNA, 21 nt, Human herpesvirus 6B
uaugagauugguuguuuuucu

SEQ ID NO: 3995186 - RNA, 21 nt, Human herpesvirus 6B
uaugaucgcuucauaguuguu

SEQ ID NO: 3995187 - RNA, 13 nt, Human herpesvirus 6B
uauguaucugaaa

SEQ ID NO: 3995188 - RNA, 15 nt, Human herpesvirus 6B
uauguaugaacaggu

SEQ ID NO: 3995189 - RNA, 23 nt, Human herpesvirus 6B
uauuaaaaugugaugaaacggaa

SEQ ID NO: 3995190 - RNA, 14 nt, Human herpesvirus 6B
uauuaagaaugaau

SEQ ID NO: 3995191 - RNA, 22 nt, Human herpesvirus 6B
uauuaauuuuuuguuucugaaa

SEQ ID NO: 3995192 - RNA, 19 nt, Human herpesvirus 6B
uauugcuaaagaguaugac

SEQ ID NO: 3995193 - RNA, 18 nt, Human herpesvirus 6B
uauugcuaagaucugucu

SEQ ID NO: 3995194 - RNA, 19 nt, Human herpesvirus 6B
uauuuaaaccagucuucua

SEQ ID NO: 3995195 - RNA, 16 nt, Human herpesvirus 6B
uauuuaacauccaaaa

SEQ ID NO: 3995196 - RNA, 22 nt, Human herpesvirus 6B
uauuuaacauccaaaauacacu

SEQ ID NO: 3995197 - RNA, 22 nt, Human herpesvirus 6B
uauuuacugagcaaagaaauga

SEQ ID NO: 3995198 - RNA, 20 nt, Human herpesvirus 6B
uauuucgaucagauuaucaa

SEQ ID NO: 3995199 - RNA, 16 nt, Human herpesvirus 6B
uauuucguauguuuaa

SEQ ID NO: 3995200 - RNA, 18 nt, Human herpesvirus 6B
uauuugaaacugaagaaa

SEQ ID NO: 3995201 - RNA, 22 nt, Human herpesvirus 6B
uauuugacaauaaacaugauug

SEQ ID NO: 3995202 - RNA, 18 nt, Human herpesvirus 6B
uauuuuaaagauuuucua

SEQ ID NO: 3995203 - RNA, 17 nt, Human herpesvirus 6B
ucaaaaugaccagagau

SEQ ID NO: 3995204 - RNA, 15 nt, Human herpesvirus 6B
ucaaacacucaugag

SEQ ID NO: 3995205 - RNA, 18 nt, Human herpesvirus 6B
ucaaacagcgacaugaaa

SEQ ID NO: 3995206 - RNA, 16 nt, Human herpesvirus 6B
ucaacacaccugccua

SEQ ID NO: 3995207 - RNA, 17 nt, Human herpesvirus 6B
ucaagacgccuaguguu

SEQ ID NO: 3995208 - RNA, 18 nt, Human herpesvirus 6B
ucaagcgaagucaugaau

SEQ ID NO: 3995209 - RNA, 10 nt, Human herpesvirus 6B
ucaaggaaac

SEQ ID NO: 3995210 - RNA, 16 nt, Human herpesvirus 6B
ucaagggcaagguucu

SEQ ID NO: 3995211 - RNA, 17 nt, Human herpesvirus 6B
ucaauuucuaaagauuu

SEQ ID NO: 3995212 - RNA, 21 nt, Human herpesvirus 6B
ucacaaccaaacaguuucaga

SEQ ID NO: 3995213 - RNA, 15 nt, Human herpesvirus 6B
ucacuuuuugaagag

SEQ ID NO: 3995214 - RNA, 18 nt, Human herpesvirus 6B
ucagauaucugaaacacu

SEQ ID NO: 3995215 - RNA, 16 nt, Human herpesvirus 6B
ucagcucgccguuuuu

SEQ ID NO: 3995216 - RNA, 22 nt, Human herpesvirus 6B
ucaggaauguaaugaauuauua

SEQ ID NO: 3995217 - RNA, 17 nt, Human herpesvirus 6B
ucauaauugugauaguu

SEQ ID NO: 3995218 - RNA, 17 nt, Human herpesvirus 6B
aaaaaagauauauuggu

SEQ ID NO: 3995219 - RNA, 10 nt, Human herpesvirus 6B
aaaaacacuc

SEQ ID NO: 3995220 - RNA, 16 nt, Human herpesvirus 6B
aaaaaccguugcacuu

SEQ ID NO: 3995221 - RNA, 23 nt, Human herpesvirus 6B
aaaaagaauggaagcgugguaga

SEQ ID NO: 3995222 - RNA, 22 nt, Human herpesvirus 6B
aaaacagagccgcgguggaaau

SEQ ID NO: 3995223 - RNA, 14 nt, Human herpesvirus 6B
aaaacaugugcuua

SEQ ID NO: 3995224 - RNA, 18 nt, Human herpesvirus 6B
aaaaccaaaaaaaaagug

SEQ ID NO: 3995225 - RNA, 17 nt, Human herpesvirus 6B
aaaacccggagaaucua

SEQ ID NO: 3995226 - RNA, 19 nt, Human herpesvirus 6B
aaaaccugcuaacggagca

SEQ ID NO: 3995227 - RNA, 21 nt, Human herpesvirus 6B
aaaacgagcgacgguuuccaa

SEQ ID NO: 3995228 - RNA, 15 nt, Human herpesvirus 6B
aaaacggguuuauuu

SEQ ID NO: 3995229 - RNA, 20 nt, Human herpesvirus 6B
aaaacuaaaacaucagauga

SEQ ID NO: 3995230 - RNA, 14 nt, Human herpesvirus 6B
aaaagcgccugccu

SEQ ID NO: 3995231 - RNA, 15 nt, Human herpesvirus 6B
aaaaggguuuucuga

SEQ ID NO: 3995232 - RNA, 19 nt, Human herpesvirus 6B
aaaaguuagaguuggauuu

SEQ ID NO: 3995233 - RNA, 12 nt, Human herpesvirus 6B
aaaauaaaguug

SEQ ID NO: 3995234 - RNA, 15 nt, Human herpesvirus 6B
aaaaucugcuaacgg

SEQ ID NO: 3995235 - RNA, 15 nt, Human herpesvirus 6B
aaaaugacugauauu

SEQ ID NO: 3995236 - RNA, 17 nt, Human herpesvirus 6B
aaaauuggugugcauua

SEQ ID NO: 3995237 - RNA, 16 nt, Human herpesvirus 6B
aaacaaaauuaauuca

SEQ ID NO: 3995238 - RNA, 17 nt, Human herpesvirus 6B
aaacagauuuugaggau

SEQ ID NO: 3995239 - RNA, 16 nt, Human herpesvirus 6B
aaacagcgacaugaaa

SEQ ID NO: 3995240 - RNA, 14 nt, Human herpesvirus 6B
aaaccaagguguuu

SEQ ID NO: 3995241 - RNA, 14 nt, Human herpesvirus 6B
aaacuaacaugaca

SEQ ID NO: 3995242 - RNA, 22 nt, Human herpesvirus 6B
aaacuggauacuauugcuaaga

SEQ ID NO: 3995243 - RNA, 12 nt, Human herpesvirus 6B
aaagagaaguua

SEQ ID NO: 3995244 - RNA, 11 nt, Human herpesvirus 6B
aaagauugcau

SEQ ID NO: 3995245 - RNA, 13 nt, Human herpesvirus 6B
aaaggugugguga

SEQ ID NO: 3995246 - RNA, 12 nt, Human herpesvirus 6B
aaagguguuaaa

SEQ ID NO: 3995247 - RNA, 14 nt, Human herpesvirus 6B
aaagguuuuugcug

SEQ ID NO: 3995248 - RNA, 19 nt, Human herpesvirus 6B
aaagguuuuugcugucaca

SEQ ID NO: 3995249 - RNA, 14 nt, Human herpesvirus 6B
aaagucggucgaga

SEQ ID NO: 3995250 - RNA, 19 nt, Human herpesvirus 6B
aaagucguuuuggagaaau

SEQ ID NO: 3995251 - RNA, 13 nt, Human herpesvirus 6B
aaagugcuguaaa

SEQ ID NO: 3995252 - RNA, 22 nt, Human herpesvirus 6B
aaauauggcuaaugagucucug

SEQ ID NO: 3995253 - RNA, 21 nt, Human herpesvirus 6B
aaauauuggauuuuacgcaaa

SEQ ID NO: 3995254 - RNA, 20 nt, Human herpesvirus 6B
aaauauuuugaaaagguguu

SEQ ID NO: 3995255 - RNA, 22 nt, Human herpesvirus 6B
aaauccuagaguuguuuuuagu

SEQ ID NO: 3995256 - RNA, 12 nt, Human herpesvirus 6B
aaaugacucuaa

SEQ ID NO: 3995257 - RNA, 17 nt, Human herpesvirus 6B
aaaugagaaggacacaa

SEQ ID NO: 3995258 - RNA, 16 nt, Human herpesvirus 6B
aaaugagcaacauuua

SEQ ID NO: 3995259 - RNA, 13 nt, Human herpesvirus 6B
aaauuacaugaaa

SEQ ID NO: 3995260 - RNA, 13 nt, Human herpesvirus 6B
aaauugucuacaa

SEQ ID NO: 3995261 - RNA, 14 nt, Human herpesvirus 6B
aaauuuuuauguau

SEQ ID NO: 3995262 - RNA, 21 nt, Human herpesvirus 6B
aacaaaucucaagaaacaagu

SEQ ID NO: 3995263 - RNA, 17 nt, Human herpesvirus 6B
aacaaguuauuuaaaau

SEQ ID NO: 3995264 - RNA, 23 nt, Human herpesvirus 6B
aacaaugaaaauucaguuuuuau

SEQ ID NO: 3995265 - RNA, 18 nt, Human herpesvirus 6B
aacagaaauuuaauugca

SEQ ID NO: 3995266 - RNA, 12 nt, Human herpesvirus 6B
aacaguuguagc

SEQ ID NO: 3995267 - RNA, 13 nt, Human herpesvirus 6B
aacaguuucagau

SEQ ID NO: 3995268 - RNA, 18 nt, Human herpesvirus 6B
aacauucggcggcauuua

SEQ ID NO: 3995269 - RNA, 20 nt, Human herpesvirus 6B
aaccacagccagaagcaauu

SEQ ID NO: 3995270 - RNA, 23 nt, Human herpesvirus 6B
aaccgcaguuucuguuuuucuca

SEQ ID NO: 3995271 - RNA, 16 nt, Human herpesvirus 6B
aaccuguuuccagaau

SEQ ID NO: 3995272 - RNA, 19 nt, Human herpesvirus 6B
aacgauuuucuauuaaaaa

SEQ ID NO: 3995273 - RNA, 15 nt, Human herpesvirus 6B
aacggaaacaugaac

SEQ ID NO: 3995274 - RNA, 21 nt, Human herpesvirus 6B
aacuaucuuacuguaaacaaa

SEQ ID NO: 3995275 - RNA, 19 nt, Human herpesvirus 6B
aacugagauauuuuaaaug

SEQ ID NO: 3995276 - RNA, 16 nt, Human herpesvirus 6B
aacugcuuaacuugca

SEQ ID NO: 3995277 - RNA, 22 nt, Human herpesvirus 6B
aacuguucggauccaaugauga

SEQ ID NO: 3995278 - RNA, 11 nt, Human herpesvirus 6B
aagaaggaaaa

SEQ ID NO: 3995279 - RNA, 14 nt, Human herpesvirus 6B
aagaaucugccgau

SEQ ID NO: 3995280 - RNA, 17 nt, Human herpesvirus 6B
aagaaugggaugcauua

SEQ ID NO: 3995281 - RNA, 16 nt, Human herpesvirus 6B
aagaggaagggauggc

SEQ ID NO: 3995282 - RNA, 20 nt, Human herpesvirus 6B
aagcagaccaguuuacaagu

SEQ ID NO: 3995283 - RNA, 13 nt, Human herpesvirus 6B
aagcgccugccua

SEQ ID NO: 3995284 - RNA, 15 nt, Human herpesvirus 6B
aagcuggacagaaag

SEQ ID NO: 3995285 - RNA, 20 nt, Human herpesvirus 6B
aaggaaucgguaaacuucag

SEQ ID NO: 3995286 - RNA, 14 nt, Human herpesvirus 6B
aaggaugguagggu

SEQ ID NO: 3995287 - RNA, 18 nt, Human herpesvirus 6B
aaguauguuuuguacaaa

SEQ ID NO: 3995288 - RNA, 15 nt, Human herpesvirus 6B
aagucguuacaguaa

SEQ ID NO: 3995289 - RNA, 23 nt, Human herpesvirus 6B
aagugccgugagugcuauuugca

SEQ ID NO: 3995290 - RNA, 11 nt, Human herpesvirus 6B
aaguugucauu

SEQ ID NO: 3995291 - RNA, 15 nt, Human herpesvirus 6B
aaguuuaaguucuca

SEQ ID NO: 3995292 - RNA, 17 nt, Human herpesvirus 6B
aaguuuuggaaaaugua

SEQ ID NO: 3995293 - RNA, 13 nt, Human herpesvirus 6B
aauaauuuacugu

SEQ ID NO: 3995294 - RNA, 21 nt, Human herpesvirus 6B
aauacgccgucguaugucaau

SEQ ID NO: 3995295 - RNA, 21 nt, Human herpesvirus 6B
aauacuauguggaaauuaaaa

SEQ ID NO: 3995296 - RNA, 22 nt, Human herpesvirus 6B
aauacuauguggaaauuaaaaa

SEQ ID NO: 3995297 - RNA, 14 nt, Human herpesvirus 6B
aauauuuuuacugc

SEQ ID NO: 3995298 - RNA, 13 nt, Human herpesvirus 6B
aaucaaucuuucu

SEQ ID NO: 3995299 - RNA, 21 nt, Human herpesvirus 6B
aaucacuguacggaacguuuc

SEQ ID NO: 3995300 - RNA, 18 nt, Human herpesvirus 6B
aaucaucugguaaauugu

SEQ ID NO: 3995301 - RNA, 21 nt, Human herpesvirus 6B
aauccaaaguaggcacacaug

SEQ ID NO: 3995302 - RNA, 19 nt, Human herpesvirus 6B
aauccacggauugacacaa

SEQ ID NO: 3995303 - RNA, 23 nt, Human herpesvirus 6B
aaucucaagcacaaaaccaggaa

SEQ ID NO: 3995304 - RNA, 14 nt, Human herpesvirus 6B
aaugacacagaauc

SEQ ID NO: 3995305 - RNA, 21 nt, Human herpesvirus 6B
aaugacauuuauuagcauuca

SEQ ID NO: 3995306 - RNA, 13 nt, Human herpesvirus 6B
aaugagcaacauu

SEQ ID NO: 3995307 - RNA, 17 nt, Human herpesvirus 6B
aaugcagcaguuuuugu

SEQ ID NO: 3995308 - RNA, 19 nt, Human herpesvirus 6B
aaugcagcaguuuuugugc

SEQ ID NO: 3995309 - RNA, 20 nt, Human herpesvirus 6B
aaugucugagcauuguguau

SEQ ID NO: 3995310 - RNA, 23 nt, Human herpesvirus 6B
aaugucuucgagauuuuagaaua

SEQ ID NO: 3995311 - RNA, 15 nt, Human herpesvirus 6B
aauguucuucugaaa

SEQ ID NO: 3995312 - RNA, 24 nt, Human herpesvirus 6B
cuguuccccguccucgugcucucc

SEQ ID NO: 3995313 - RNA, 15 nt, Human herpesvirus 6B
cuguucuaaaaguuu

SEQ ID NO: 3995314 - RNA, 22 nt, Human herpesvirus 6B
cuguuuacucugggaaccugug

SEQ ID NO: 3995315 - RNA, 21 nt, Human herpesvirus 6B
cuguuuuguaggacugaagga

SEQ ID NO: 3995316 - RNA, 20 nt, Human herpesvirus 6B
cuguuuuucucauaaaguua

SEQ ID NO: 3995317 - RNA, 20 nt, Human herpesvirus 6B
cuuaaagaaaaaaagcagau

SEQ ID NO: 3995318 - RNA, 15 nt, Human herpesvirus 6B
cuuacgagaggcuuu

SEQ ID NO: 3995319 - RNA, 20 nt, Human herpesvirus 6B
cuuagauaugucguuucaug

SEQ ID NO: 3995320 - RNA, 15 nt, Human herpesvirus 6B
cuuaucaacuauacu

SEQ ID NO: 3995321 - RNA, 20 nt, Human herpesvirus 6B
cuuaucagucucaaaaauua

SEQ ID NO: 3995322 - RNA, 20 nt, Human herpesvirus 6B
cuuauugaggaaaugcagca

SEQ ID NO: 3995323 - RNA, 14 nt, Human herpesvirus 6B
cuucagaaagauug

SEQ ID NO: 3995324 - RNA, 19 nt, Human herpesvirus 6B
cuuccgaguauggugucuu

SEQ ID NO: 3995325 - RNA, 15 nt, Human herpesvirus 6B
cuucucgucucuucu

SEQ ID NO: 3995326 - RNA, 13 nt, Human herpesvirus 6B
cuucuuuuggaug

SEQ ID NO: 3995327 - RNA, 13 nt, Human herpesvirus 6B
cuugaauguuuaa

SEQ ID NO: 3995328 - RNA, 23 nt, Human herpesvirus 6B
cuugaauguuuaaaguuuuguga

SEQ ID NO: 3995329 - RNA, 22 nt, Human herpesvirus 6B
cuugauaucuucgugcaauaac

SEQ ID NO: 3995330 - RNA, 12 nt, Human herpesvirus 6B
cuugcuguaaag

SEQ ID NO: 3995331 - RNA, 16 nt, Human herpesvirus 6B
cuuggggauauugugg

SEQ ID NO: 3995332 - RNA, 22 nt, Human herpesvirus 6B
cuuuacauaacauagaaaaaua

SEQ ID NO: 3995333 - RNA, 14 nt, Human herpesvirus 6B
cuuuauacgucaua

SEQ ID NO: 3995334 - RNA, 13 nt, Human herpesvirus 6B
cuuuauccggcca

SEQ ID NO: 3995335 - RNA, 13 nt, Human herpesvirus 6B
cuuuaugugcaau

SEQ ID NO: 3995336 - RNA, 21 nt, Human herpesvirus 6B
cuuucaauguccgaaguaaaa

SEQ ID NO: 3995337 - RNA, 14 nt, Human herpesvirus 6B
cuuugaacagugac

SEQ ID NO: 3995338 - RNA, 15 nt, Human herpesvirus 6B
cuuugauccauuuuc

SEQ ID NO: 3995339 - RNA, 13 nt, Human herpesvirus 6B
cuuugcggugcau

SEQ ID NO: 3995340 - RNA, 16 nt, Human herpesvirus 6B
cuuugggaugaagaga

SEQ ID NO: 3995341 - RNA, 16 nt, Human herpesvirus 6B
cuuuguccuauguuaa

SEQ ID NO: 3995342 - RNA, 18 nt, Human herpesvirus 6B
cuuuguccuauguuaaca

SEQ ID NO: 3995343 - RNA, 13 nt, Human herpesvirus 6B
cuuuguucugcug

SEQ ID NO: 3995344 - RNA, 22 nt, Human herpesvirus 6B
cuuuucaguauagacauuuugu

SEQ ID NO: 3995345 - RNA, 19 nt, Human herpesvirus 6B
cuuuuggcaggaagccugu

SEQ ID NO: 3995346 - RNA, 13 nt, Human herpesvirus 6B
cuuuuugccaaaa

SEQ ID NO: 3995347 - RNA, 20 nt, Human herpesvirus 6B
cuuuuuuucccgaaaaacuu

SEQ ID NO: 3995348 - RNA, 19 nt, Human herpesvirus 6B
gaaaagugcuuuauccggc

SEQ ID NO: 3995349 - RNA, 16 nt, Human herpesvirus 6B
gaaaaugcugauuuua

SEQ ID NO: 3995350 - RNA, 21 nt, Human herpesvirus 6B
gaaacucuuauggcaagcacu

SEQ ID NO: 3995351 - RNA, 13 nt, Human herpesvirus 6B
gaaacugaagaaa

SEQ ID NO: 3995352 - RNA, 14 nt, Human herpesvirus 6B
gaaagcgcgccaca

SEQ ID NO: 3995353 - RNA, 14 nt, Human herpesvirus 6B
gaaaucuuuccugc

SEQ ID NO: 3995354 - RNA, 19 nt, Human herpesvirus 6B
gaaaugagcaacauuuaug

SEQ ID NO: 3995355 - RNA, 17 nt, Human herpesvirus 6B
gaaauucuccuguaguu

SEQ ID NO: 3995356 - RNA, 14 nt, Human herpesvirus 6B
gaacaccagcaugu

SEQ ID NO: 3995357 - RNA, 19 nt, Human herpesvirus 6B
gaacauaagggacagcagu

SEQ ID NO: 3995358 - RNA, 19 nt, Human herpesvirus 6B
gaaccacaucuuuuccugc

SEQ ID NO: 3995359 - RNA, 17 nt, Human herpesvirus 6B
gaaccgaaauuuccggu

SEQ ID NO: 3995360 - RNA, 17 nt, Human herpesvirus 6B
gaaccugugaacaaauu

SEQ ID NO: 3995361 - RNA, 14 nt, Human herpesvirus 6B
gaacucucacggcc

SEQ ID NO: 3995362 - RNA, 22 nt, Human herpesvirus 6B
gaacuggaccagugauucugcu

SEQ ID NO: 3995363 - RNA, 18 nt, Human herpesvirus 6B
gaacuguuuccagagcac

SEQ ID NO: 3995364 - RNA, 21 nt, Human herpesvirus 6B
gaagaaauaccuuuggccuug

SEQ ID NO: 3995365 - RNA, 18 nt, Human herpesvirus 6B
gaagaacagaggaagaaa

SEQ ID NO: 3995366 - RNA, 20 nt, Human herpesvirus 6B
gaagacauuaauacugguuu

SEQ ID NO: 3995367 - RNA, 21 nt, Human herpesvirus 6B
gaagaucuuuauggagggaau

SEQ ID NO: 3995368 - RNA, 15 nt, Human herpesvirus 6B
gaagccggagcccug

SEQ ID NO: 3995369 - RNA, 16 nt, Human herpesvirus 6B
gaagccggagcccuga

SEQ ID NO: 3995370 - RNA, 14 nt, Human herpesvirus 6B
gaagugaaagcagu

SEQ ID NO: 3995371 - RNA, 17 nt, Human herpesvirus 6B
gaaguguuaugaagaau

SEQ ID NO: 3995372 - RNA, 22 nt, Human herpesvirus 6B
gaauauauagaagaagaaauac

SEQ ID NO: 3995373 - RNA, 17 nt, Human herpesvirus 6B
gaauauucuucgugaau

SEQ ID NO: 3995374 - RNA, 16 nt, Human herpesvirus 6B
gaauauuuaguuuaug

SEQ ID NO: 3995375 - RNA, 14 nt, Human herpesvirus 6B
gaauccgcgggcca

SEQ ID NO: 3995376 - RNA, 21 nt, Human herpesvirus 6B
gaauccgcgggccagcccuga

SEQ ID NO: 3995377 - RNA, 19 nt, Human herpesvirus 6B
gaaucgucgaaaaaaauga

SEQ ID NO: 3995378 - RNA, 17 nt, Human herpesvirus 6B
gaauguugauauggagc

SEQ ID NO: 3995379 - RNA, 20 nt, Human herpesvirus 6B
gaauuaaagauuuaaaaaug

SEQ ID NO: 3995380 - RNA, 14 nt, Human herpesvirus 6B
gaauuacugcugcg

SEQ ID NO: 3995381 - RNA, 20 nt, Human herpesvirus 6B
gaauuaugacugacaaggua

SEQ ID NO: 3995382 - RNA, 18 nt, Human herpesvirus 6B
gaauucagcuggacagaa

SEQ ID NO: 3995383 - RNA, 23 nt, Human herpesvirus 6B
gaauucuuucuacguuagcuucc

SEQ ID NO: 3995384 - RNA, 21 nt, Human herpesvirus 6B
gacaaauaaguggugaugaau

SEQ ID NO: 3995385 - RNA, 12 nt, Human herpesvirus 6B
gacaggcgcacc

SEQ ID NO: 3995386 - RNA, 19 nt, Human herpesvirus 6B
gacaguauuuacugagcaa

SEQ ID NO: 3995387 - RNA, 20 nt, Human herpesvirus 6B
gacagucaauuucuaaagau

SEQ ID NO: 3995388 - RNA, 17 nt, Human herpesvirus 6B
gacaucaggcaaagaug

SEQ ID NO: 3995389 - RNA, 18 nt, Human herpesvirus 6B
gacaucuuaaauuucuau

SEQ ID NO: 3995390 - RNA, 22 nt, Human herpesvirus 6B
gacaugcucgggaucacgcagg

SEQ ID NO: 3995391 - RNA, 16 nt, Human herpesvirus 6B
gacauuuaccagagau

SEQ ID NO: 3995392 - RNA, 14 nt, Human herpesvirus 6B
gaccagcucuguuc

SEQ ID NO: 3995393 - RNA, 16 nt, Human herpesvirus 6B
gaccaggauagaaaaa

SEQ ID NO: 3995394 - RNA, 14 nt, Human herpesvirus 6B
gaccgagacgguga

SEQ ID NO: 3995395 - RNA, 14 nt, Human herpesvirus 6B
gaccucgcgggaag

SEQ ID NO: 3995396 - RNA, 21 nt, Human herpesvirus 6B
gacgguucaaacgguaaacau

SEQ ID NO: 3995397 - RNA, 23 nt, Human herpesvirus 6B
gacgguucaggcucuuugggaaa

SEQ ID NO: 3995398 - RNA, 14 nt, Human herpesvirus 6B
gacgugcggagaug

SEQ ID NO: 3995399 - RNA, 15 nt, Human herpesvirus 6B
gacucugucuuaguu

SEQ ID NO: 3995400 - RNA, 13 nt, Human herpesvirus 6B
gacugacaaggua

SEQ ID NO: 3995401 - RNA, 22 nt, Human herpesvirus 6B
gacugcccuggggucuaagaua

SEQ ID NO: 3995402 - RNA, 15 nt, Human herpesvirus 6B
gacugugaggugauu

SEQ ID NO: 3995403 - RNA, 19 nt, Human herpesvirus 6B
gacuuagcuagacgugucu

SEQ ID NO: 3995404 - RNA, 16 nt, Human herpesvirus 6B
gacuugcccacagcug

SEQ ID NO: 3995405 - RNA, 14 nt, Human herpesvirus 6B
gagaaagagggaag

SEQ ID NO: 3995406 - RNA, 16 nt, Human herpesvirus 6B
gagacugcccuggggu

SEQ ID NO: 3995407 - RNA, 16 nt, Human herpesvirus 6B
gagacuggacaguguu

SEQ ID NO: 3995408 - RNA, 22 nt, Human herpesvirus 6B
gagacuuuguguaaccugagaa

SEQ ID NO: 3995409 - RNA, 13 nt, Human herpesvirus 6B
gagagcaggagca

SEQ ID NO: 3995410 - RNA, 13 nt, Human herpesvirus 6B
gagagcgggcaca

SEQ ID NO: 3995411 - RNA, 14 nt, Human herpesvirus 6B
gagauagagccggc

SEQ ID NO: 3995412 - RNA, 20 nt, Human herpesvirus 6B
gagaucuggugaauguuucu

SEQ ID NO: 3995413 - RNA, 21 nt, Human herpesvirus 6B
gagaucuggugaauguuucug

SEQ ID NO: 3995414 - RNA, 13 nt, Human herpesvirus 6B
gagcaaccgcagu

SEQ ID NO: 3995415 - RNA, 14 nt, Human herpesvirus 6B
gagcaauucaucaa

SEQ ID NO: 3995416 - RNA, 21 nt, Human herpesvirus 6B
gagcauaauaaucuaguaccu

SEQ ID NO: 3995417 - RNA, 14 nt, Human herpesvirus 6B
gagcauugaguaga

SEQ ID NO: 3995418 - RNA, 20 nt, Human herpesvirus 6B
gagcauugaguagagcuuug

SEQ ID NO: 3995419 - RNA, 23 nt, Human herpesvirus 6B
gagcccauaacgauagcagcucu

SEQ ID NO: 3995420 - RNA, 18 nt, Human herpesvirus 6B
gagccgcagaggccagac

SEQ ID NO: 3995421 - RNA, 16 nt, Human herpesvirus 6B
gucugugcuuggaagu

SEQ ID NO: 3995422 - RNA, 11 nt, Human herpesvirus 6B
gucuuuccuga

SEQ ID NO: 3995423 - RNA, 18 nt, Human herpesvirus 6B
gugaaaaacacggcgccu

SEQ ID NO: 3995424 - RNA, 17 nt, Human herpesvirus 6B
gugagggacuucgucuc

SEQ ID NO: 3995425 - RNA, 13 nt, Human herpesvirus 6B
gugaggugauuug

SEQ ID NO: 3995426 - RNA, 16 nt, Human herpesvirus 6B
gugauauaguuauuca

SEQ ID NO: 3995427 - RNA, 15 nt, Human herpesvirus 6B
gugaucaggaaauua

SEQ ID NO: 3995428 - RNA, 22 nt, Human herpesvirus 6B
gugauuccuucggggacaguga

SEQ ID NO: 3995429 - RNA, 19 nt, Human herpesvirus 6B
gugauugaugagacggaau

SEQ ID NO: 3995430 - RNA, 16 nt, Human herpesvirus 6B
gugcccacuguggugu

SEQ ID NO: 3995431 - RNA, 18 nt, Human herpesvirus 6B
gugcccacugugguguuu

SEQ ID NO: 3995432 - RNA, 19 nt, Human herpesvirus 6B
gugcuuguuuugguggaca

SEQ ID NO: 3995433 - RNA, 19 nt, Human herpesvirus 6B
guggaaauuaacugucaug

SEQ ID NO: 3995434 - RNA, 19 nt, Human herpesvirus 6B
guggaguauggugucugaa

SEQ ID NO: 3995435 - RNA, 19 nt, Human herpesvirus 6B
guggccggcacgcgccguc

SEQ ID NO: 3995436 - RNA, 18 nt, Human herpesvirus 6B
gugucuccggcgucacuc

SEQ ID NO: 3995437 - RNA, 17 nt, Human herpesvirus 6B
gugucugaaaaauggug

SEQ ID NO: 3995438 - RNA, 14 nt, Human herpesvirus 6B
gugugucggcuccg

SEQ ID NO: 3995439 - RNA, 11 nt, Human herpesvirus 6B
guguuauucag

SEQ ID NO: 3995440 - RNA, 13 nt, Human herpesvirus 6B
guguuuuguaagu

SEQ ID NO: 3995441 - RNA, 22 nt, Human herpesvirus 6B
guuaacggagagucuucauccu

SEQ ID NO: 3995442 - RNA, 20 nt, Human herpesvirus 6B
guuacaguaaaaaagccgaa

SEQ ID NO: 3995443 - RNA, 20 nt, Human herpesvirus 6B
guuacccgucaugugcuauu

SEQ ID NO: 3995444 - RNA, 15 nt, Human herpesvirus 6B
guuacggggaagauc

SEQ ID NO: 3995445 - RNA, 17 nt, Human herpesvirus 6B
guuacgucuuuggacug

SEQ ID NO: 3995446 - RNA, 18 nt, Human herpesvirus 6B
guuacuuuaccucugcuc

SEQ ID NO: 3995447 - RNA, 18 nt, Human herpesvirus 6B
guuagagauuuuggaagc

SEQ ID NO: 3995448 - RNA, 17 nt, Human herpesvirus 6B
guuagcaagcugggaaa

SEQ ID NO: 3995449 - RNA, 13 nt, Human herpesvirus 6B
guuauuaugcugu

SEQ ID NO: 3995450 - RNA, 15 nt, Human herpesvirus 6B
guucagagcugauga

SEQ ID NO: 3995451 - RNA, 20 nt, Human herpesvirus 6B
guucaggucaagcgccagga

SEQ ID NO: 3995452 - RNA, 13 nt, Human herpesvirus 6B
guucguuaaaaac

SEQ ID NO: 3995453 - RNA, 18 nt, Human herpesvirus 6B
guucuuugaacagugaca

SEQ ID NO: 3995454 - RNA, 15 nt, Human herpesvirus 6B
guugaagucuuuccu

SEQ ID NO: 3995455 - RNA, 18 nt, Human herpesvirus 6B
guugcagauuugcggaaa

SEQ ID NO: 3995456 - RNA, 19 nt, Human herpesvirus 6B
guugcauggugauguguua

SEQ ID NO: 3995457 - RNA, 14 nt, Human herpesvirus 6B
guugccuuggccgc

SEQ ID NO: 3995458 - RNA, 22 nt, Human herpesvirus 6B
guugccuuuguaaaauguuucc

SEQ ID NO: 3995459 - RNA, 12 nt, Human herpesvirus 6B
guugcuguaguu

SEQ ID NO: 3995460 - RNA, 21 nt, Human herpesvirus 6B
guugggauggcagauugcaaa

SEQ ID NO: 3995461 - RNA, 16 nt, Human herpesvirus 6B
guuuaaagauguguua

SEQ ID NO: 3995462 - RNA, 13 nt, Human herpesvirus 6B
uaaaaacacacug

SEQ ID NO: 3995463 - RNA, 21 nt, Human herpesvirus 6B
uaaaaauguuaccgaaauauc

SEQ ID NO: 3995464 - RNA, 18 nt, Human herpesvirus 6B
uaaaaauuauucuggcga

SEQ ID NO: 3995465 - RNA, 20 nt, Human herpesvirus 6B
uaaaacucuaaaagcugcua

SEQ ID NO: 3995466 - RNA, 17 nt, Human herpesvirus 6B
uaaaagauuguuuucau

SEQ ID NO: 3995467 - RNA, 23 nt, Human herpesvirus 6B
uaaaauaauuuuuguagcaauuu

SEQ ID NO: 3995468 - RNA, 12 nt, Human herpesvirus 6B
uaaaaucugcua

SEQ ID NO: 3995469 - RNA, 16 nt, Human herpesvirus 6B
uaaaauugaauuuaua

SEQ ID NO: 3995470 - RNA, 17 nt, Human herpesvirus 6B
uaaacagauuuuaugcc

SEQ ID NO: 3995471 - RNA, 22 nt, Human herpesvirus 6B
uaaacauucuuaaauucaauuu

SEQ ID NO: 3995472 - RNA, 19 nt, Human herpesvirus 6B
uaaagauguguuaaagaau

SEQ ID NO: 3995473 - RNA, 12 nt, Human herpesvirus 6B
uaaagcagcuag

SEQ ID NO: 3995474 - RNA, 13 nt, Human herpesvirus 6B
uaaaguauuggcu

SEQ ID NO: 3995475 - RNA, 12 nt, Human herpesvirus 6B
uaaaguuuucau

SEQ ID NO: 3995476 - RNA, 17 nt, Human herpesvirus 6B
uaaauaauaguaaacuu

SEQ ID NO: 3995477 - RNA, 15 nt, Human herpesvirus 6B
uaacagaguuuucau

SEQ ID NO: 3995478 - RNA, 22 nt, Human herpesvirus 6B
uaacauagaaaaauaagacuua

SEQ ID NO: 3995479 - RNA, 11 nt, Human herpesvirus 6B
uaacauauucg

SEQ ID NO: 3995480 - RNA, 21 nt, Human herpesvirus 6B
uaacaucucagaucuagaucu

SEQ ID NO: 3995481 - RNA, 15 nt, Human herpesvirus 6B
uaacauugugagaac

SEQ ID NO: 3995482 - RNA, 18 nt, Human herpesvirus 6B
uaaccuaagcuggacaga

SEQ ID NO: 3995483 - RNA, 15 nt, Human herpesvirus 6B
uaacgaacaaaucuc

SEQ ID NO: 3995484 - RNA, 17 nt, Human herpesvirus 6B
uaacuguggguuuucag

SEQ ID NO: 3995485 - RNA, 13 nt, Human herpesvirus 6B
uaacuucaagaau

SEQ ID NO: 3995486 - RNA, 13 nt, Human herpesvirus 6B
uaagacuuagcua

SEQ ID NO: 3995487 - RNA, 18 nt, Human herpesvirus 6B
uaagauagauauuaugua

SEQ ID NO: 3995488 - RNA, 13 nt, Human herpesvirus 6B
uaagcugcagaca

SEQ ID NO: 3995489 - RNA, 14 nt, Human herpesvirus 6B
uaaucuauggugau

SEQ ID NO: 3995490 - RNA, 18 nt, Human herpesvirus 6B
uaaugacguaugauuuuc

SEQ ID NO: 3995491 - RNA, 16 nt, Human herpesvirus 6B
uaaugagauucuguug

SEQ ID NO: 3995492 - RNA, 17 nt, Human herpesvirus 6B
uaaugguaugccugagc

SEQ ID NO: 3995493 - RNA, 14 nt, Human herpesvirus 6B
uaauucaaauguag

SEQ ID NO: 3995494 - RNA, 17 nt, Human herpesvirus 6B
uaauuccuuguguugaa

SEQ ID NO: 3995495 - RNA, 23 nt, Human herpesvirus 6B
uaauucggugaugacucaagaau

SEQ ID NO: 3995496 - RNA, 23 nt, Human herpesvirus 6B
uaauuuuuuguuucugaaaauaa

SEQ ID NO: 3995497 - RNA, 15 nt, Human herpesvirus 6B
uacaaaguucucaga

SEQ ID NO: 3995498 - RNA, 17 nt, Human herpesvirus 6B
uacaagaaaagaaacaa

SEQ ID NO: 3995499 - RNA, 18 nt, Human herpesvirus 6B
uacaugaaaacauucaga

SEQ ID NO: 3995500 - RNA, 14 nt, Human herpesvirus 6B
uaccaagaaaucac

SEQ ID NO: 3995501 - RNA, 23 nt, Human herpesvirus 6B
uaccccggcuuucucgccgccuc

SEQ ID NO: 3995502 - RNA, 17 nt, Human herpesvirus 6B
uacguggccgucuccug

SEQ ID NO: 3995503 - RNA, 13 nt, Human herpesvirus 6B
uacuaauguggau

SEQ ID NO: 3995504 - RNA, 19 nt, Human herpesvirus 6B
uacuuacaucgauccaaaa

SEQ ID NO: 3995505 - RNA, 17 nt, Human herpesvirus 6B
uacuuuguuuucuuggg

SEQ ID NO: 3995506 - RNA, 18 nt, Human herpesvirus 6B
uagaaaauugucuacaau

SEQ ID NO: 3995507 - RNA, 22 nt, Human herpesvirus 6B
uagaauuuaacgauccuuuucu

SEQ ID NO: 3995508 - RNA, 16 nt, Human herpesvirus 6B
uagaccguucaacaag

SEQ ID NO: 3995509 - RNA, 19 nt, Human herpesvirus 6B
uagagaacagauagaaaau

SEQ ID NO: 3995510 - RNA, 13 nt, Human herpesvirus 6B
uagagccggccuu

SEQ ID NO: 3995511 - RNA, 11 nt, Human herpesvirus 6B
uagauaugucg

SEQ ID NO: 3995512 - RNA, 13 nt, Human herpesvirus 6B
uagaucuguuuaa

SEQ ID NO: 3995513 - RNA, 14 nt, Human herpesvirus 6B
uagcaaaugaaugu

SEQ ID NO: 3995514 - RNA, 20 nt, Human herpesvirus 6B
uagguuucagacacguuuau

SEQ ID NO: 3995515 - RNA, 14 nt, Human herpesvirus 6B
uaguaagaggcuua

SEQ ID NO: 3995516 - RNA, 13 nt, Human herpesvirus 6B
uaguacaaagaua

SEQ ID NO: 3995517 - RNA, 17 nt, Human herpesvirus 6B
uaguguuaaagaugcug

SEQ ID NO: 3995518 - RNA, 13 nt, Human herpesvirus 6B
uauaaaucauaaa

SEQ ID NO: 3995519 - RNA, 20 nt, Human herpesvirus 6B
uauaagucuaaugcaaagau

SEQ ID NO: 3995520 - RNA, 16 nt, Human herpesvirus 6B
uauaccaaacgugaaa

SEQ ID NO: 3995521 - RNA, 17 nt, Human herpesvirus 6B
uauagcuauccuuauau

SEQ ID NO: 3995522 - RNA, 20 nt, Human herpesvirus 6B
uauaucaaacuuuuuuugaa

SEQ ID NO: 3995523 - RNA, 19 nt, Human herpesvirus 6B
uauaugaaaugucugagca

SEQ ID NO: 3995524 - RNA, 13 nt, Human herpesvirus 6B
uauauggugaugu

SEQ ID NO: 3995525 - RNA, 19 nt, Human herpesvirus 6B
uauauuaaugaucauagua

SEQ ID NO: 3995526 - RNA, 18 nt, Human herpesvirus 6B
uaucaaacuuuuuuugaa

SEQ ID NO: 3995527 - RNA, 16 nt, Human herpesvirus 6B
uaucaacuauacuuaa

SEQ ID NO: 3995528 - RNA, 15 nt, Human herpesvirus 6B
uaucaugagagagca

SEQ ID NO: 3995529 - RNA, 20 nt, Human herpesvirus 6B
uaucguagagcaguuucuuu

SEQ ID NO: 3995530 - RNA, 22 nt, Human herpesvirus 6B
uaucugaaaucgcauuucucua

SEQ ID NO: 3995531 - RNA, 17 nt, Human herpesvirus 6B
uaugaaaucgauguaga

SEQ ID NO: 3995532 - RNA, 20 nt, Human herpesvirus 6B
uaugaacaggugcuucuuuu

SEQ ID NO: 3995533 - RNA, 16 nt, Human herpesvirus 6B
uaugaagaauugacuu

SEQ ID NO: 3995534 - RNA, 20 nt, Human herpesvirus 6B
uaugacuuuucugaaauucu

SEQ ID NO: 3995535 - RNA, 16 nt, Human herpesvirus 6B
uaugaugcuguagaaa

SEQ ID NO: 3995536 - RNA, 22 nt, Human herpesvirus 6B
uaugcuuuuuuuuguggauggu

SEQ ID NO: 3995537 - RNA, 23 nt, Human herpesvirus 6B
gcucgccgucgucgcucucccuc

SEQ ID NO: 3995538 - RNA, 12 nt, Human herpesvirus 6B
gcucggcagggg

SEQ ID NO: 3995539 - RNA, 18 nt, Human herpesvirus 6B
gucuccgauccgucagga

SEQ ID NO: 3995540 - RNA, 23 nt, Human herpesvirus 6B
gucuccgauccgucaggaccagc

SEQ ID NO: 3995541 - RNA, 11 nt, Human herpesvirus 6B
gucucuagacg

SEQ ID NO: 3995542 - RNA, 12 nt, Human herpesvirus 6B
gucugcaggacu

SEQ ID NO: 3995543 - RNA, 13 nt, Human herpesvirus 6B
gucuggccucugc

SEQ ID NO: 3995544 - RNA, 16 nt, Human herpesvirus 6B
gaaacgcaaagggaag

SEQ ID NO: 3995545 - RNA, 20 nt, Human herpesvirus 6B
gaaacggugguuucugcucc

SEQ ID NO: 3995546 - RNA, 17 nt, Human herpesvirus 6B
gaaagacguuugcuuuu

SEQ ID NO: 3995547 - RNA, 14 nt, Human herpesvirus 6B
gaaauauggcuaau

SEQ ID NO: 3995548 - RNA, 15 nt, Human herpesvirus 6B
gaaaucuuuccugcu

SEQ ID NO: 3995549 - RNA, 22 nt, Human herpesvirus 6B
gaaauguugccuuuguaaaaug

SEQ ID NO: 3995550 - RNA, 14 nt, Human herpesvirus 6B
gaaauuaauaagau

SEQ ID NO: 3995551 - RNA, 22 nt, Human herpesvirus 6B
gaacaagagacgaaagacguuu

SEQ ID NO: 3995552 - RNA, 16 nt, Human herpesvirus 6B
gaacacgucguggcag

SEQ ID NO: 3995553 - RNA, 24 nt, Human herpesvirus 6B
gaacauuguucuaaaagauuguuu

SEQ ID NO: 3995554 - RNA, 18 nt, Human herpesvirus 6B
gaaccacagccagaagca

SEQ ID NO: 3995555 - RNA, 20 nt, Human herpesvirus 6B
gaaccacaucuuuuccugcu

SEQ ID NO: 3995556 - RNA, 22 nt, Human herpesvirus 6B
gaacgauaugcugccauuauug

SEQ ID NO: 3995557 - RNA, 17 nt, Human herpesvirus 6B
gaagaacagaggaagaa

SEQ ID NO: 3995558 - RNA, 15 nt, Human herpesvirus 6B
gaagaacaugcagaa

SEQ ID NO: 3995559 - RNA, 18 nt, Human herpesvirus 6B
gaagaauccgcgggccag

SEQ ID NO: 3995560 - RNA, 18 nt, Human herpesvirus 6B
gaagccggagcccugaga

SEQ ID NO: 3995561 - RNA, 13 nt, Human herpesvirus 6B
gaaggguugcaga

SEQ ID NO: 3995562 - RNA, 20 nt, Human herpesvirus 6B
gaagguaucaaagaacagaa

SEQ ID NO: 3995563 - RNA, 17 nt, Human herpesvirus 6B
gaagugcuucugcucuc

SEQ ID NO: 3995564 - RNA, 20 nt, Human herpesvirus 6B
gaauaaaacaaguuaaauuu

SEQ ID NO: 3995565 - RNA, 12 nt, Human herpesvirus 6B
gaauaagaguuu

SEQ ID NO: 3995566 - RNA, 17 nt, Human herpesvirus 6B
gaauagagauaaaugua

SEQ ID NO: 3995567 - RNA, 19 nt, Human herpesvirus 6B
gaauaugaauaugccguau

SEQ ID NO: 3995568 - RNA, 12 nt, Human herpesvirus 6B
gaaucacaaaau

SEQ ID NO: 3995569 - RNA, 20 nt, Human herpesvirus 6B
gaauccagauaaacaaaaau

SEQ ID NO: 3995570 - RNA, 14 nt, Human herpesvirus 6B
gaaucggaagagga

SEQ ID NO: 3995571 - RNA, 21 nt, Human herpesvirus 6B
gaaucucuguuccucaugaac

SEQ ID NO: 3995572 - RNA, 19 nt, Human herpesvirus 6B
gaaugagggauucguaguu

SEQ ID NO: 3995573 - RNA, 20 nt, Human herpesvirus 6B
gaauguugguaaacuuacca

SEQ ID NO: 3995574 - RNA, 18 nt, Human herpesvirus 6B
gaauuauuuccucugaau

SEQ ID NO: 3995575 - RNA, 19 nt, Human herpesvirus 6B
gaauucguuacaaucucug

SEQ ID NO: 3995576 - RNA, 18 nt, Human herpesvirus 6B
gacaaaaacaugugcuua

SEQ ID NO: 3995577 - RNA, 19 nt, Human herpesvirus 6B
gacaauaaacaugauugua

SEQ ID NO: 3995578 - RNA, 22 nt, Human herpesvirus 6B
gacacaucgugaguuuucaugu

SEQ ID NO: 3995579 - RNA, 19 nt, Human herpesvirus 6B
gacacggagugcgacagga

SEQ ID NO: 3995580 - RNA, 20 nt, Human herpesvirus 6B
gacagaucagcauuuggcag

SEQ ID NO: 3995581 - RNA, 21 nt, Human herpesvirus 6B
gacagcaguuuuuuggggaag

SEQ ID NO: 3995582 - RNA, 15 nt, Human herpesvirus 6B
gacagcuuggccaac

SEQ ID NO: 3995583 - RNA, 23 nt, Human herpesvirus 6B
gacaguaacggcggcggcggcug

SEQ ID NO: 3995584 - RNA, 13 nt, Human herpesvirus 6B
gacccaacagaag

SEQ ID NO: 3995585 - RNA, 16 nt, Human herpesvirus 6B
gaccguaucccucccu

SEQ ID NO: 3995586 - RNA, 18 nt, Human herpesvirus 6B
gacgaagaaacgaggacg

SEQ ID NO: 3995587 - RNA, 14 nt, Human herpesvirus 6B
gacgagauguuucu

SEQ ID NO: 3995588 - RNA, 14 nt, Human herpesvirus 6B
gacgcaaagagaga

SEQ ID NO: 3995589 - RNA, 14 nt, Human herpesvirus 6B
gacggcagcgggga

SEQ ID NO: 3995590 - RNA, 14 nt, Human herpesvirus 6B
gacgucugggauca

SEQ ID NO: 3995591 - RNA, 19 nt, Human herpesvirus 6B
gacuaucaaaauaaaaauu

SEQ ID NO: 3995592 - RNA, 16 nt, Human herpesvirus 6B
gacucgccgaugaaac

SEQ ID NO: 3995593 - RNA, 20 nt, Human herpesvirus 6B
gacugaucuguagcgaauuu

SEQ ID NO: 3995594 - RNA, 17 nt, Human herpesvirus 6B
gacugcguuacaagcau

SEQ ID NO: 3995595 - RNA, 13 nt, Human herpesvirus 6B
gacuguagaaaac

SEQ ID NO: 3995596 - RNA, 23 nt, Human herpesvirus 6B
gacuuagcuagacgugucuucau

SEQ ID NO: 3995597 - RNA, 15 nt, Human herpesvirus 6B
gacuuauuaucucac

SEQ ID NO: 3995598 - RNA, 18 nt, Human herpesvirus 6B
gacuuuucugaugacaau

SEQ ID NO: 3995599 - RNA, 12 nt, Human herpesvirus 6B
gagaauagagau

SEQ ID NO: 3995600 - RNA, 22 nt, Human herpesvirus 6B
gagaauuaugacugacaaggua

SEQ ID NO: 3995601 - RNA, 19 nt, Human herpesvirus 6B
gagacuuugcugauucugu

SEQ ID NO: 3995602 - RNA, 18 nt, Human herpesvirus 6B
gagaguucauuuguuccg

SEQ ID NO: 3995603 - RNA, 13 nt, Human herpesvirus 6B
gagaucugaggac

SEQ ID NO: 3995604 - RNA, 13 nt, Human herpesvirus 6B
gagcacuugggga

SEQ ID NO: 3995605 - RNA, 18 nt, Human herpesvirus 6B
gagcccugagagcaggag

SEQ ID NO: 3995606 - RNA, 13 nt, Human herpesvirus 6B
gagcucaaagaga

SEQ ID NO: 3995607 - RNA, 14 nt, Human herpesvirus 6B
gagcuccauguucu

SEQ ID NO: 3995608 - RNA, 17 nt, Human herpesvirus 6B
gaggacgcaaagagaga

SEQ ID NO: 3995609 - RNA, 17 nt, Human herpesvirus 6B
gaggacggugagaagau

SEQ ID NO: 3995610 - RNA, 10 nt, Human herpesvirus 6B
gaggaggagg

SEQ ID NO: 3995611 - RNA, 19 nt, Human herpesvirus 6B
gaggugauuugaacagaga

SEQ ID NO: 3995612 - RNA, 22 nt, Human herpesvirus 6B
gagucggcuguccaaacagaga

SEQ ID NO: 3995613 - RNA, 13 nt, Human herpesvirus 6B
gagucuguuacaa

SEQ ID NO: 3995614 - RNA, 17 nt, Human herpesvirus 6B
gaguuuagcauggguga

SEQ ID NO: 3995615 - RNA, 13 nt, Human herpesvirus 6B
gauaaacaucgcu

SEQ ID NO: 3995616 - RNA, 21 nt, Human herpesvirus 6B
gauaaauguauaaaagagaaa

SEQ ID NO: 3995617 - RNA, 14 nt, Human herpesvirus 6B
gauacaaaugaggg

SEQ ID NO: 3995618 - RNA, 21 nt, Human herpesvirus 6B
gauacuacguguaauguuucc

SEQ ID NO: 3995619 - RNA, 19 nt, Human herpesvirus 6B
gauauaaauauuuacggga

SEQ ID NO: 3995620 - RNA, 13 nt, Human herpesvirus 6B
gauaucaaagcuc

SEQ ID NO: 3995621 - RNA, 17 nt, Human herpesvirus 6B
gauaucaauuccuguga

SEQ ID NO: 3995622 - RNA, 16 nt, Human herpesvirus 6B
gauaucguuuuugcuu

SEQ ID NO: 3995623 - RNA, 19 nt, Human herpesvirus 6B
gaucaacuccguauaugcu

SEQ ID NO: 3995624 - RNA, 19 nt, Human herpesvirus 6B
gaucgaguuacauucguau

SEQ ID NO: 3995625 - RNA, 21 nt, Human herpesvirus 6B
gaucuuauaaaugugagcagu

SEQ ID NO: 3995626 - RNA, 20 nt, Human herpesvirus 6B
gaugacaaggugaacucauc

SEQ ID NO: 3995627 - RNA, 17 nt, Human herpesvirus 6B
gaugagaacuucaaaau

SEQ ID NO: 3995628 - RNA, 20 nt, Human herpesvirus 6B
gaugcaagucgcgaagugcu

SEQ ID NO: 3995629 - RNA, 21 nt, Human herpesvirus 6B
gaugcagucuccacagggcau

SEQ ID NO: 3995630 - RNA, 14 nt, Human herpesvirus 6B
gaugcauacagcau

SEQ ID NO: 3995631 - RNA, 13 nt, Human herpesvirus 6B
gaugccaaagcuu

SEQ ID NO: 3995632 - RNA, 18 nt, Human herpesvirus 6B
gaugccaaagcuuucugu

SEQ ID NO: 3995633 - RNA, 17 nt, Human herpesvirus 6B
gaugccuugauguuucc

SEQ ID NO: 3995634 - RNA, 21 nt, Human herpesvirus 6B
gauggaucggaagacguuucu

SEQ ID NO: 3995635 - RNA, 17 nt, Human herpesvirus 6B
gauugaugaaagcuuca

SEQ ID NO: 3995636 - RNA, 22 nt, Human herpesvirus 6B
gauugcgucacuguccaaagaa

SEQ ID NO: 3995637 - RNA, 16 nt, Human herpesvirus 6B
gauuguucgcuugugu

SEQ ID NO: 3995638 - RNA, 13 nt, Human herpesvirus 6B
gauuucuguaguu

SEQ ID NO: 3995639 - RNA, 21 nt, Human herpesvirus 6B
gauuucuuuaucuuccuguac

SEQ ID NO: 3995640 - RNA, 12 nt, Human herpesvirus 6B
gauuugaacaga

SEQ ID NO: 3995641 - RNA, 17 nt, Human herpesvirus 6B
gcaaagaugcagauucu

SEQ ID NO: 3995642 - RNA, 24 nt, Human herpesvirus 6B
gcaacaaagagcuuuaaagcagcu

SEQ ID NO: 3995643 - RNA, 15 nt, Human herpesvirus 6B
gcaacgcagauuuua

SEQ ID NO: 3995644 - RNA, 18 nt, Human herpesvirus 6B
gcaagcaaacgcucgccg

SEQ ID NO: 3995645 - RNA, 20 nt, Human herpesvirus 6B
gcaagucgccucacuguaaa

SEQ ID NO: 3995646 - RNA, 18 nt, Human herpesvirus 6B
gcaauuugaauucugcuc

SEQ ID NO: 3995647 - RNA, 20 nt, Human herpesvirus 6B
gcacaauucuaacuaaaauu

SEQ ID NO: 3995648 - RNA, 17 nt, Human herpesvirus 6B
gcacacgucccuaugau

SEQ ID NO: 3995649 - RNA, 19 nt, Human herpesvirus 6B
gcacaguucguccagcagc

SEQ ID NO: 3995650 - RNA, 18 nt, Human herpesvirus 6B
gcacccguauccgcgaga

SEQ ID NO: 3995651 - RNA, 15 nt, Human herpesvirus 6B
gcaccgagggcgggc

SEQ ID NO: 3995652 - RNA, 23 nt, Human herpesvirus 6B
gcacgaagaagggcagagagccg

SEQ ID NO: 3995653 - RNA, 20 nt, Human herpesvirus 6B
gcacgagaacacgcgagaca

SEQ ID NO: 3995654 - RNA, 14 nt, Human herpesvirus 6B
gcacgagccaaggg

SEQ ID NO: 3995655 - RNA, 22 nt, Human herpesvirus 6B
gcacuuuuuucuaaaacccgga

SEQ ID NO: 3995656 - RNA, 12 nt, Human herpesvirus 6B
gcagacaucaca

SEQ ID NO: 3995657 - RNA, 16 nt, Human herpesvirus 6B
gcacucuccgaccagc

SEQ ID NO: 3995658 - RNA, 19 nt, Human herpesvirus 6B
gcacucuccgaccagcacc

SEQ ID NO: 3995659 - RNA, 19 nt, Human herpesvirus 6B
gcagaaguuuccgcgcugg

SEQ ID NO: 3995660 - RNA, 15 nt, Human herpesvirus 6B
gcagcggggaaggga

SEQ ID NO: 3995661 - RNA, 17 nt, Human herpesvirus 6B
gcaggcuccccaggcgc

SEQ ID NO: 3995662 - RNA, 19 nt, Human herpesvirus 6B
gcaggcuccccaggcgcag

SEQ ID NO: 3995663 - RNA, 14 nt, Human herpesvirus 6B
gcagggcgggcacg

SEQ ID NO: 3995664 - RNA, 14 nt, Human herpesvirus 6B
gcaggguguggccg

SEQ ID NO: 3995665 - RNA, 15 nt, Human herpesvirus 6B
gcaggugcugcuaaa

SEQ ID NO: 3995666 - RNA, 17 nt, Human herpesvirus 6B
gcagucuccacagggca

SEQ ID NO: 3995667 - RNA, 15 nt, Human herpesvirus 6B
gcauaauccuuuucu

SEQ ID NO: 3995668 - RNA, 17 nt, Human herpesvirus 6B
gcauacacccugccgac

SEQ ID NO: 3995669 - RNA, 19 nt, Human herpesvirus 6B
gcauccuguuuucccaccu

SEQ ID NO: 3995670 - RNA, 17 nt, Human herpesvirus 6B
gcaugcgacagacaguc

SEQ ID NO: 3995671 - RNA, 16 nt, Human herpesvirus 6B
gcauggaaaaggcgga

SEQ ID NO: 3995672 - RNA, 18 nt, Human herpesvirus 6B
gccaaacauaucacagau

SEQ ID NO: 3995673 - RNA, 16 nt, Human herpesvirus 6B
gccaaagcuuucugua

SEQ ID NO: 3995674 - RNA, 17 nt, Human herpesvirus 6B
gccaaagcuuucuguac

SEQ ID NO: 3995675 - RNA, 15 nt, Human herpesvirus 6B
gccaacgcgacacgg

SEQ ID NO: 3995676 - RNA, 22 nt, Human herpesvirus 6B
gccacauuagcugcuaaaugug

SEQ ID NO: 3995677 - RNA, 10 nt, Human herpesvirus 6B
gccagccgcc

SEQ ID NO: 3995678 - RNA, 13 nt, Human herpesvirus 6B
gccauccacccau

SEQ ID NO: 3995679 - RNA, 19 nt, Human herpesvirus 6B
gccauccacccauauaccc

SEQ ID NO: 3995680 - RNA, 13 nt, Human herpesvirus 6B
gccauggguguca

SEQ ID NO: 3995681 - RNA, 17 nt, Human herpesvirus 6B
gcccucgucuguugcug

SEQ ID NO: 3995682 - RNA, 20 nt, Human herpesvirus 6B
gcccucucacgcgcauuaaa

SEQ ID NO: 3995683 - RNA, 21 nt, Human herpesvirus 6B
gccgccauauuaaaacccggc

SEQ ID NO: 3995684 - RNA, 16 nt, Human herpesvirus 6B
gccgccuucucugucg

SEQ ID NO: 3995685 - RNA, 16 nt, Human herpesvirus 6B
gccggucggggagggg

SEQ ID NO: 3995686 - RNA, 21 nt, Human herpesvirus 6B
gccucccuccguuaggaucag

SEQ ID NO: 3995687 - RNA, 18 nt, Human herpesvirus 6B
gccucgccgcucccgcuc

SEQ ID NO: 3995688 - RNA, 16 nt, Human herpesvirus 6B
gccuggggacagacag

SEQ ID NO: 3995689 - RNA, 12 nt, Human herpesvirus 6B
gccuugauuuuu

SEQ ID NO: 3995690 - RNA, 22 nt, Human herpesvirus 6B
gcgaagguaggaauggacauga

SEQ ID NO: 3995691 - RNA, 16 nt, Human herpesvirus 6B
gcgaagugcuucugcu

SEQ ID NO: 3995692 - RNA, 13 nt, Human herpesvirus 6B
gcgacacgcgcgg

SEQ ID NO: 3995693 - RNA, 15 nt, Human herpesvirus 6B
gcgaccacagcggca

SEQ ID NO: 3995694 - RNA, 15 nt, Human herpesvirus 6B
gcgaccucgcucucc

SEQ ID NO: 3995695 - RNA, 19 nt, Human herpesvirus 6B
gcgacgacggggacuaccg

SEQ ID NO: 3995696 - RNA, 18 nt, Human herpesvirus 6B
gcgacgggcagggcgggc

SEQ ID NO: 3995697 - RNA, 14 nt, Human herpesvirus 6B
gcgagucugugcuu

SEQ ID NO: 3995698 - RNA, 17 nt, Human herpesvirus 6B
gcgaugcgccacaggga

SEQ ID NO: 3995699 - RNA, 18 nt, Human herpesvirus 6B
gcgaugcgccacagggag

SEQ ID NO: 3995700 - RNA, 19 nt, Human herpesvirus 6B
gcgauugcugcuucuguaa

SEQ ID NO: 3995701 - RNA, 14 nt, Human herpesvirus 6B
gcgcaccggcgaca

SEQ ID NO: 3995702 - RNA, 20 nt, Human herpesvirus 6B
gcgcauggaaaaggcggaca

SEQ ID NO: 3995703 - RNA, 13 nt, Human herpesvirus 6B
gcgcccggagucg

SEQ ID NO: 3995704 - RNA, 18 nt, Human herpesvirus 6B
gcgccgguuuccaugaga

SEQ ID NO: 3995705 - RNA, 19 nt, Human herpesvirus 6B
gcgcgugaccguaucccuc

SEQ ID NO: 3995706 - RNA, 17 nt, Human herpesvirus 6B
gcgcguugggggauggg

SEQ ID NO: 3995707 - RNA, 12 nt, Human herpesvirus 6B
gcggaagggcuc

SEQ ID NO: 3995708 - RNA, 20 nt, Human herpesvirus 6B
gcggaagggcucuguuacua

SEQ ID NO: 3995709 - RNA, 22 nt, Human herpesvirus 6B
gcggaugucgcgaagcucagcu

SEQ ID NO: 3995710 - RNA, 14 nt, Human herpesvirus 6B
gcggcucucugccc

SEQ ID NO: 3995711 - RNA, 16 nt, Human herpesvirus 6B
gcggggaucgggccug

SEQ ID NO: 3995712 - RNA, 19 nt, Human herpesvirus 6B
gcgguggugaucggcagau

SEQ ID NO: 3995713 - RNA, 17 nt, Human herpesvirus 6B
gcgucauuagaagguug

SEQ ID NO: 3995714 - RNA, 15 nt, Human herpesvirus 6B
gcguccuccgcgaga

SEQ ID NO: 3995715 - RNA, 14 nt, Human herpesvirus 6B
gcguguuuuggaau

SEQ ID NO: 3995716 - RNA, 19 nt, Human herpesvirus 6B
gcguugcccucccgcagcu

SEQ ID NO: 3995717 - RNA, 16 nt, Human herpesvirus 6B
gcuaaguguugacuga

SEQ ID NO: 3995718 - RNA, 14 nt, Human herpesvirus 6B
gcuccguucccuuc

SEQ ID NO: 3995719 - RNA, 13 nt, Human herpesvirus 6B
gcucgggaucacg

SEQ ID NO: 3995720 - RNA, 23 nt, Human herpesvirus 6B
gcucgggggacggagaggaagcc

SEQ ID NO: 3995721 - RNA, 17 nt, Human herpesvirus 6B
gcucucccucuucccuc

SEQ ID NO: 3995722 - RNA, 20 nt, Human herpesvirus 6B
gcucuccgcgcugcuggggc

SEQ ID NO: 3995723 - RNA, 14 nt, Human herpesvirus 6B
gcucucgaugaaag

SEQ ID NO: 3995724 - RNA, 15 nt, Human herpesvirus 6B
gcucucgcaagccag

SEQ ID NO: 3995725 - RNA, 16 nt, Human herpesvirus 6B
gcucuggcaaaggugu

SEQ ID NO: 3995726 - RNA, 20 nt, Human herpesvirus 6B
gcugaguggacauuggacuu

SEQ ID NO: 3995727 - RNA, 12 nt, Human herpesvirus 6B
gcuggucgccgu

SEQ ID NO: 3995728 - RNA, 20 nt, Human herpesvirus 6B
gcugucgcccgccucucucc

SEQ ID NO: 3995729 - RNA, 12 nt, Human herpesvirus 6B
gcuuggccaacu

SEQ ID NO: 3995730 - RNA, 18 nt, Human herpesvirus 6B
gcuuucuguaccccaagu

SEQ ID NO: 3995731 - RNA, 15 nt, Human herpesvirus 6B
ggaaguguaaauguc

SEQ ID NO: 3995732 - RNA, 22 nt, Human herpesvirus 6B
ggacaaauaaguggugaugaau

SEQ ID NO: 3995733 - RNA, 19 nt, Human herpesvirus 6B
ggacagaaaaaacaccaga

SEQ ID NO: 3995734 - RNA, 18 nt, Human herpesvirus 6B
ggacagaaaugagcaaca

SEQ ID NO: 3995735 - RNA, 15 nt, Human herpesvirus 6B
ggacagacaggggga

SEQ ID NO: 3995736 - RNA, 22 nt, Human herpesvirus 6B
ggacagagcggagaggcgcggg

SEQ ID NO: 3995737 - RNA, 14 nt, Human herpesvirus 6B
ggacggggccuccc

SEQ ID NO: 3995738 - RNA, 19 nt, Human herpesvirus 6B
ggacuugcgagucugucag

SEQ ID NO: 3995739 - RNA, 19 nt, Human herpesvirus 6B
ggagugaaacgauguguua

SEQ ID NO: 3995740 - RNA, 17 nt, Human herpesvirus 6B
ggagugcgacaggagau

SEQ ID NO: 3995741 - RNA, 18 nt, Human herpesvirus 6B
ggaucagcucagcucuga

SEQ ID NO: 3995742 - RNA, 17 nt, Human herpesvirus 6B
ggaucccagaugcaguc

SEQ ID NO: 3995743 - RNA, 22 nt, Human herpesvirus 6B
ggauuccccucauacauccaga

SEQ ID NO: 3995744 - RNA, 19 nt, Human herpesvirus 6B
ggauuuaguuucuuuggaa

SEQ ID NO: 3995745 - RNA, 19 nt, Human herpesvirus 6B
ggauuuuauuuuaucucau

SEQ ID NO: 3995746 - RNA, 12 nt, Human herpesvirus 6B
ggcaaccgcagu

SEQ ID NO: 3995747 - RNA, 12 nt, Human herpesvirus 6B
ggcaucagauuu

SEQ ID NO: 3995748 - RNA, 22 nt, Human herpesvirus 6B
ggcaugcguuacggagauauac

SEQ ID NO: 3995749 - RNA, 16 nt, Human herpesvirus 6B
ggccagcccugaagaa

SEQ ID NO: 3995750 - RNA, 14 nt, Human herpesvirus 6B
ggccgucuccugca

SEQ ID NO: 3995751 - RNA, 24 nt, Human herpesvirus 6B
ggccucccuccguuaggaucagac

SEQ ID NO: 3995752 - RNA, 23 nt, Human herpesvirus 6B
ggcgaagggacacgagaagaaca

SEQ ID NO: 3995753 - RNA, 19 nt, Human herpesvirus 6B
ggcgaggggacggacagag

SEQ ID NO: 3995754 - RNA, 19 nt, Human herpesvirus 6B
ggcgcaaaccaagguguuu

SEQ ID NO: 3995755 - RNA, 17 nt, Human herpesvirus 6B
ggcgcccgugguggccg

SEQ ID NO: 3995756 - RNA, 14 nt, Human herpesvirus 6B
ggcgcugggcuccu

SEQ ID NO: 3995757 - RNA, 16 nt, Human herpesvirus 6B
ggcgcuuccuguucua

SEQ ID NO: 3995758 - RNA, 23 nt, Human herpesvirus 6B
ggcggagcacccggggaggcgac

SEQ ID NO: 3995759 - RNA, 22 nt, Human herpesvirus 6B
ggcggcgaccacagcggcagcg

SEQ ID NO: 3995760 - RNA, 14 nt, Human herpesvirus 6B
ggcggcggcggcug

SEQ ID NO: 3995761 - RNA, 14 nt, Human herpesvirus 6B
ggcggcugucgccg

SEQ ID NO: 3995762 - RNA, 12 nt, Human herpesvirus 6B
ggcgggcacgga

SEQ ID NO: 3995763 - RNA, 15 nt, Human herpesvirus 6B
ggcgucaccaagaaa

SEQ ID NO: 3995764 - RNA, 21 nt, Human herpesvirus 6B
ggcuauuugacaauaaacaug

SEQ ID NO: 3995765 - RNA, 12 nt, Human herpesvirus 6B
ggcucggcaggg

SEQ ID NO: 3995766 - RNA, 15 nt, Human herpesvirus 6B
ggcucucugcccuuc

SEQ ID NO: 3995767 - RNA, 18 nt, Human herpesvirus 6B
ggcugauaaguugucauu

SEQ ID NO: 3995768 - RNA, 18 nt, Human herpesvirus 6B
ggcuuaaaggcagcuggc

SEQ ID NO: 3995769 - RNA, 16 nt, Human herpesvirus 6B
gggaauuuggcagaau

SEQ ID NO: 3995770 - RNA, 15 nt, Human herpesvirus 6B
gggacuccgagccgg

SEQ ID NO: 3995771 - RNA, 13 nt, Human herpesvirus 6B
aaaaaacaguuuc

SEQ ID NO: 3995772 - RNA, 12 nt, Human herpesvirus 6B
aaaaacagaaua

SEQ ID NO: 3995773 - RNA, 14 nt, Human herpesvirus 6B
aaaaauaagacuua

SEQ ID NO: 3995774 - RNA, 15 nt, Human herpesvirus 6B
aaaaauauuggauuu

SEQ ID NO: 3995775 - RNA, 13 nt, Human herpesvirus 6B
aaaacccggagaa

SEQ ID NO: 3995776 - RNA, 20 nt, Human herpesvirus 6B
aaaacgaaacucuagaauua

SEQ ID NO: 3995777 - RNA, 16 nt, Human herpesvirus 6B
aaaacgguaaagauga

SEQ ID NO: 3995778 - RNA, 12 nt, Human herpesvirus 6B
aaaacuacagag

SEQ ID NO: 3995779 - RNA, 18 nt, Human herpesvirus 6B
aaaagauuauggcaacau

SEQ ID NO: 3995780 - RNA, 13 nt, Human herpesvirus 6B
aaaagguugagaa

SEQ ID NO: 3995781 - RNA, 13 nt, Human herpesvirus 6B
aaaauaagacuua

SEQ ID NO: 3995782 - RNA, 18 nt, Human herpesvirus 6B
aaaauaccugacuguucu

SEQ ID NO: 3995783 - RNA, 13 nt, Human herpesvirus 6B
aaaauauuuugaa

SEQ ID NO: 3995784 - RNA, 21 nt, Human herpesvirus 6B
aaaaucgauacgacucaguag

SEQ ID NO: 3995785 - RNA, 23 nt, Human herpesvirus 6B
aaaauguuuccaugacugugagg

SEQ ID NO: 3995786 - RNA, 15 nt, Human herpesvirus 6B
aaaauucuaccguag

SEQ ID NO: 3995787 - RNA, 15 nt, Human herpesvirus 6B
aaacacggcgccucc

SEQ ID NO: 3995788 - RNA, 16 nt, Human herpesvirus 6B
aaacacggcgccuccc

SEQ ID NO: 3995789 - RNA, 15 nt, Human herpesvirus 6B
aaacacuaagugccg

SEQ ID NO: 3995790 - RNA, 12 nt, Human herpesvirus 6B
aaacagaauaag

SEQ ID NO: 3995791 - RNA, 15 nt, Human herpesvirus 6B
aaacauaaaauguuu

SEQ ID NO: 3995792 - RNA, 16 nt, Human herpesvirus 6B
aaacauagaaucucca

SEQ ID NO: 3995793 - RNA, 12 nt, Human herpesvirus 6B
aaacauucuuaa

SEQ ID NO: 3995794 - RNA, 18 nt, Human herpesvirus 6B
aaacgauuucuuuaucuu

SEQ ID NO: 3995795 - RNA, 12 nt, Human herpesvirus 6B
aaacgcuuuuuu

SEQ ID NO: 3995796 - RNA, 22 nt, Human herpesvirus 6B
aaacgugagguguauuugaaau

SEQ ID NO: 3995797 - RNA, 15 nt, Human herpesvirus 6B
aaacuaaauuuuaug

SEQ ID NO: 3995798 - RNA, 22 nt, Human herpesvirus 6B
aaacuagaugacuauuucuuua

SEQ ID NO: 3995799 - RNA, 20 nt, Human herpesvirus 6B
aaacuaugaggaacugauga

SEQ ID NO: 3995800 - RNA, 16 nt, Human herpesvirus 6B
aaacucaaagaaagcu

SEQ ID NO: 3995801 - RNA, 16 nt, Human herpesvirus 6B
aaacugccgcuuaaau

SEQ ID NO: 3995802 - RNA, 12 nt, Human herpesvirus 6B
aaagaacauuug

SEQ ID NO: 3995803 - RNA, 14 nt, Human herpesvirus 6B
aaagagaaggaaaa

SEQ ID NO: 3995804 - RNA, 23 nt, Human herpesvirus 6B
aaagauuagauuaggggagagac

SEQ ID NO: 3995805 - RNA, 14 nt, Human herpesvirus 6B
aaagcagaucgagu

SEQ ID NO: 3995806 - RNA, 13 nt, Human herpesvirus 6B
aaagcgccugccu

SEQ ID NO: 3995807 - RNA, 18 nt, Human herpesvirus 6B
aaaggucagaugcaaaaa

SEQ ID NO: 3995808 - RNA, 17 nt, Human herpesvirus 6B
aaaguaugcuuugaaau

SEQ ID NO: 3995809 - RNA, 18 nt, Human herpesvirus 6B
aaagucgcuucgaauguu

SEQ ID NO: 3995810 - RNA, 19 nt, Human herpesvirus 6B
aaagucguuacaguaaaaa

SEQ ID NO: 3995811 - RNA, 13 nt, Human herpesvirus 6B
aaaguuuuugguu

SEQ ID NO: 3995812 - RNA, 23 nt, Human herpesvirus 6B
aaaucaaugaguugcacauguuu

SEQ ID NO: 3995813 - RNA, 15 nt, Human herpesvirus 6B
aaaucacuccgcauc

SEQ ID NO: 3995814 - RNA, 19 nt, Human herpesvirus 6B
aaaucgguuaaagaaucug

SEQ ID NO: 3995815 - RNA, 18 nt, Human herpesvirus 6B
aaaucguaggcaucuuca

SEQ ID NO: 3995816 - RNA, 15 nt, Human herpesvirus 6B
aaauguggucaugga

SEQ ID NO: 3995817 - RNA, 21 nt, Human herpesvirus 6B
aaauguuuccaugacugugag

SEQ ID NO: 3995818 - RNA, 18 nt, Human herpesvirus 6B
aaauuaacugucaugucu

SEQ ID NO: 3995819 - RNA, 21 nt, Human herpesvirus 6B
aacaaaaggucagaugcaaaa

SEQ ID NO: 3995820 - RNA, 19 nt, Human herpesvirus 6B
aacaacugccgccauauua

SEQ ID NO: 3995821 - RNA, 18 nt, Human herpesvirus 6B
aacaaguuauuuaaaauc

SEQ ID NO: 3995822 - RNA, 13 nt, Human herpesvirus 6B
aacaauaauugca

SEQ ID NO: 3995823 - RNA, 15 nt, Human herpesvirus 6B
aacaauuuugauuua

SEQ ID NO: 3995824 - RNA, 21 nt, Human herpesvirus 6B
aacacaauauaugaaauacug

SEQ ID NO: 3995825 - RNA, 14 nt, Human herpesvirus 6B
aacagaaucuucuu

SEQ ID NO: 3995826 - RNA, 15 nt, Human herpesvirus 6B
aacagaugaggagga

SEQ ID NO: 3995827 - RNA, 18 nt, Human herpesvirus 6B
aacagauuuugaggauca

SEQ ID NO: 3995828 - RNA, 11 nt, Human herpesvirus 6B
aacagugacag

SEQ ID NO: 3995829 - RNA, 14 nt, Human herpesvirus 6B
aaccacguuuuucc

SEQ ID NO: 3995830 - RNA, 21 nt, Human herpesvirus 6B
aaccgcaguuccuguuuuucu

SEQ ID NO: 3995831 - RNA, 22 nt, Human herpesvirus 6B
aacgaagguucgacuauguuag

SEQ ID NO: 3995832 - RNA, 23 nt, Human herpesvirus 6B
aacgcaaagggaagccagccgcc

SEQ ID NO: 3995833 - RNA, 18 nt, Human herpesvirus 6B
aacguccgugaugauuca

SEQ ID NO: 3995834 - RNA, 16 nt, Human herpesvirus 6B
aacgugacuguaucaa

SEQ ID NO: 3995835 - RNA, 12 nt, Human herpesvirus 6B
aacuauguguua

SEQ ID NO: 3995836 - RNA, 21 nt, Human herpesvirus 6B
aacugaggacguccuguucga

SEQ ID NO: 3995837 - RNA, 18 nt, Human herpesvirus 6B
aacugauacuguucaagu

SEQ ID NO: 3995838 - RNA, 20 nt, Human herpesvirus 6B
aacuuuagacagcugcauua

SEQ ID NO: 3995839 - RNA, 19 nt, Human herpesvirus 6B
aagaaaggaguuugcauuu

SEQ ID NO: 3995840 - RNA, 13 nt, Human herpesvirus 6B
aagaacuucauuu

SEQ ID NO: 3995841 - RNA, 17 nt, Human herpesvirus 6B
aagaagggcagagagcc

SEQ ID NO: 3995842 - RNA, 22 nt, Human herpesvirus 6B
augaauuugcgucagaguuuga

SEQ ID NO: 3995843 - RNA, 18 nt, Human herpesvirus 6B
augacaaauuuucagcua

SEQ ID NO: 3995844 - RNA, 16 nt, Human herpesvirus 6B
augacucaagaauuac

SEQ ID NO: 3995845 - RNA, 15 nt, Human herpesvirus 6B
augacugacaaggua

SEQ ID NO: 3995846 - RNA, 14 nt, Human herpesvirus 6B
augacuuuucugaa

SEQ ID NO: 3995847 - RNA, 21 nt, Human herpesvirus 6B
augagaauauauaaaaaaaac

SEQ ID NO: 3995848 - RNA, 21 nt, Human herpesvirus 6B
augagaauguucuucugaaau

SEQ ID NO: 3995849 - RNA, 23 nt, Human herpesvirus 6B
augaggauggauuccugaugguu

SEQ ID NO: 3995850 - RNA, 11 nt, Human herpesvirus 6B
augauagaaga

SEQ ID NO: 3995851 - RNA, 18 nt, Human herpesvirus 6B
augauccaauguuucugu

SEQ ID NO: 3995852 - RNA, 16 nt, Human herpesvirus 6B
augaugaucugcuuug

SEQ ID NO: 3995853 - RNA, 15 nt, Human herpesvirus 6B
augauucaauagcag

SEQ ID NO: 3995854 - RNA, 18 nt, Human herpesvirus 6B
augauuccacucugcaga

SEQ ID NO: 3995855 - RNA, 13 nt, Human herpesvirus 6B
augcgaauuaaaa

SEQ ID NO: 3995856 - RNA, 18 nt, Human herpesvirus 6B
augcgaccuacggccaga

SEQ ID NO: 3995857 - RNA, 16 nt, Human herpesvirus 6B
augcuaauaaaauaua

SEQ ID NO: 3995858 - RNA, 20 nt, Human herpesvirus 6B
augcuuaaacugaaucacuu

SEQ ID NO: 3995859 - RNA, 17 nt, Human herpesvirus 6B
auggaaaacugcagauu

SEQ ID NO: 3995860 - RNA, 20 nt, Human herpesvirus 6B
auggaaaauuuauaaaaaac

SEQ ID NO: 3995861 - RNA, 15 nt, Human herpesvirus 6B
auggacagaaaaaac

SEQ ID NO: 3995862 - RNA, 14 nt, Human herpesvirus 6B
auggcguuccgaau

SEQ ID NO: 3995863 - RNA, 14 nt, Human herpesvirus 6B
auggguuaggguua

SEQ ID NO: 3995864 - RNA, 14 nt, Human herpesvirus 6B
auggugucugaaaa

SEQ ID NO: 3995865 - RNA, 21 nt, Human herpesvirus 6B
auguaaacacgaaacugcuug

SEQ ID NO: 3995866 - RNA, 20 nt, Human herpesvirus 6B
auguaauguauuguucgcug

SEQ ID NO: 3995867 - RNA, 15 nt, Human herpesvirus 6B
auguagcacacgaca

SEQ ID NO: 3995868 - RNA, 20 nt, Human herpesvirus 6B
auguaucccgagaaaaaagc

SEQ ID NO: 3995869 - RNA, 20 nt, Human herpesvirus 6B
auguccgaaguaaaaaagau

SEQ ID NO: 3995870 - RNA, 19 nt, Human herpesvirus 6B
augucguuucaugggagaa

SEQ ID NO: 3995871 - RNA, 15 nt, Human herpesvirus 6B
augucucaguucaaa

SEQ ID NO: 3995872 - RNA, 18 nt, Human herpesvirus 6B
augugcggagaaagggac

SEQ ID NO: 3995873 - RNA, 13 nt, Human herpesvirus 6B
auguguaagaaaa

SEQ ID NO: 3995874 - RNA, 13 nt, Human herpesvirus 6B
auguguucauaga

SEQ ID NO: 3995875 - RNA, 20 nt, Human herpesvirus 6B
auuaaaaauaaaaaaaauga

SEQ ID NO: 3995876 - RNA, 13 nt, Human herpesvirus 6B
auuaaaugugaac

SEQ ID NO: 3995877 - RNA, 22 nt, Human herpesvirus 6B
auuaauucaaauguagcaaaug

SEQ ID NO: 3995878 - RNA, 13 nt, Human herpesvirus 6B
auuacaagggaaa

SEQ ID NO: 3995879 - RNA, 14 nt, Human herpesvirus 6B
auuacuuuugggau

SEQ ID NO: 3995880 - RNA, 16 nt, Human herpesvirus 6B
auuagauaagagaguu

SEQ ID NO: 3995881 - RNA, 18 nt, Human herpesvirus 6B
auuagauaagagaguuuc

SEQ ID NO: 3995882 - RNA, 16 nt, Human herpesvirus 6B
auuauaaaaacacacc

SEQ ID NO: 3995883 - RNA, 12 nt, Human herpesvirus 6B
auuauaaaaaug

SEQ ID NO: 3995884 - RNA, 13 nt, Human herpesvirus 6B
auucagcuggaca

SEQ ID NO: 3995885 - RNA, 16 nt, Human herpesvirus 6B
auucauuuauucucca

SEQ ID NO: 3995886 - RNA, 20 nt, Human herpesvirus 6B
auuccugaugguuaaggaaa

SEQ ID NO: 3995887 - RNA, 19 nt, Human herpesvirus 6B
auucugcauuuauaucaaa

SEQ ID NO: 3995888 - RNA, 15 nt, Human herpesvirus 6B
auucugugacauguu

SEQ ID NO: 3995889 - RNA, 23 nt, Human herpesvirus 6B
auucuguugggugaucauaggac

SEQ ID NO: 3995890 - RNA, 23 nt, Human herpesvirus 6B
auucuuguucgggccaagguaaa

SEQ ID NO: 3995891 - RNA, 17 nt, Human herpesvirus 6B
auugaauacgacuuugg

SEQ ID NO: 3995892 - RNA, 16 nt, Human herpesvirus 6B
auugacaugauguuuc

SEQ ID NO: 3995893 - RNA, 23 nt, Human herpesvirus 6B
auugacuacggcgguuaacuguu

SEQ ID NO: 3995894 - RNA, 21 nt, Human herpesvirus 6B
auugcacgcugggcuucagua

SEQ ID NO: 3995895 - RNA, 17 nt, Human herpesvirus 6B
auugcagguuggcgcuc

SEQ ID NO: 3995896 - RNA, 22 nt, Human herpesvirus 6B
auugcugcuggguguauguuuc

SEQ ID NO: 3995897 - RNA, 13 nt, Human herpesvirus 6B
auuguacgauaau

SEQ ID NO: 3995898 - RNA, 18 nt, Human herpesvirus 6B
auuuaauaaauugcagcu

SEQ ID NO: 3995899 - RNA, 12 nt, Human herpesvirus 6B
auuuaccagaga

SEQ ID NO: 3995900 - RNA, 16 nt, Human herpesvirus 6B
auuucccaaaacguga

SEQ ID NO: 3995901 - RNA, 22 nt, Human herpesvirus 6B
auuucuuuuuaaaaucaaaaaa

SEQ ID NO: 3995902 - RNA, 22 nt, Human herpesvirus 6B
auuuggaagcgaaucgcuuaaa

SEQ ID NO: 3995903 - RNA, 15 nt, Human herpesvirus 6B
auuuggaugaaacgu

SEQ ID NO: 3995904 - RNA, 21 nt, Human herpesvirus 6B
auuuggcagccucuugugcaa

SEQ ID NO: 3995905 - RNA, 16 nt, Human herpesvirus 6B
auuugguacccuugca

SEQ ID NO: 3995906 - RNA, 15 nt, Human herpesvirus 6B
auuugguuugacauu

SEQ ID NO: 3995907 - RNA, 17 nt, Human herpesvirus 6B
auuugugcaaaaugugg

SEQ ID NO: 3995908 - RNA, 22 nt, Human herpesvirus 6B
auuuugaggaucacuaacuuca

SEQ ID NO: 3995909 - RNA, 15 nt, Human herpesvirus 6B
auuuuucuuuacaga

SEQ ID NO: 3995910 - RNA, 13 nt, Human herpesvirus 6B
auuuuuuaaauaa

SEQ ID NO: 3995911 - RNA, 18 nt, Human herpesvirus 6B
auuuuuuugaaaucacuc

SEQ ID NO: 3995912 - RNA, 21 nt, Human herpesvirus 6B
caaaaaaaaaugacugauauu

SEQ ID NO: 3995913 - RNA, 16 nt, Human herpesvirus 6B
caaaaaaaugauagac

SEQ ID NO: 3995914 - RNA, 12 nt, Human herpesvirus 6B
caaaaaauguua

SEQ ID NO: 3995915 - RNA, 21 nt, Human herpesvirus 6B
caaaaaugcacaauuuagccu

SEQ ID NO: 3995916 - RNA, 17 nt, Human herpesvirus 6B
caaaagacuauguagua

SEQ ID NO: 3995917 - RNA, 19 nt, Human herpesvirus 6B
caaaaggaaaagucaaagu

SEQ ID NO: 3995918 - RNA, 13 nt, Human herpesvirus 6B
caaaaucugcuaa

SEQ ID NO: 3995919 - RNA, 15 nt, Human herpesvirus 6B
caaaaugaccagaga

SEQ ID NO: 3995920 - RNA, 15 nt, Human herpesvirus 6B
caaaaugggaauuuc

SEQ ID NO: 3995921 - RNA, 23 nt, Human herpesvirus 6B
caaacguguauuaagaaugaauu

SEQ ID NO: 3995922 - RNA, 19 nt, Human herpesvirus 6B
caaagaugacaaauuuuca

SEQ ID NO: 3995923 - RNA, 23 nt, Human herpesvirus 6B
caaauaauuuuauugacugugaa

SEQ ID NO: 3995924 - RNA, 16 nt, Human herpesvirus 6B
caaaucucaagaaaca

SEQ ID NO: 3995925 - RNA, 19 nt, Human herpesvirus 6B
caaauguagcaaaugaaug

SEQ ID NO: 3995926 - RNA, 16 nt, Human herpesvirus 6B
caaauucuaucuuaua

SEQ ID NO: 3995927 - RNA, 14 nt, Human herpesvirus 6B
caacacggggugag

SEQ ID NO: 3995928 - RNA, 20 nt, Human herpesvirus 6B
caaccuaacgacuacagaag

SEQ ID NO: 3995929 - RNA, 20 nt, Human herpesvirus 6B
caacgguguggagacaccuc

SEQ ID NO: 3995930 - RNA, 13 nt, Human herpesvirus 6B
caacuguuguguu

SEQ ID NO: 3995931 - RNA, 18 nt, Human herpesvirus 6B
caagaaugggaugcauua

SEQ ID NO: 3995932 - RNA, 19 nt, Human herpesvirus 6B
caagccgugcuuccagaga

SEQ ID NO: 3995933 - RNA, 17 nt, Human herpesvirus 6B
caagcucgaguucgaga

SEQ ID NO: 3995934 - RNA, 19 nt, Human herpesvirus 6B
caagguaaaggaaggcgua

SEQ ID NO: 3995935 - RNA, 15 nt, Human herpesvirus 6B
caagguaugaaacga

SEQ ID NO: 3995936 - RNA, 14 nt, Human herpesvirus 6B
caauaaacaugauu

SEQ ID NO: 3995937 - RNA, 12 nt, Human herpesvirus 6B
caauagcaguug

SEQ ID NO: 3995938 - RNA, 20 nt, Human herpesvirus 6B
caauaucguccucagagaaa

SEQ ID NO: 3995939 - RNA, 20 nt, Human herpesvirus 6B
caauccggaguuaaucucuu

SEQ ID NO: 3995940 - RNA, 16 nt, Human herpesvirus 6B
caaugaauacuucucu

SEQ ID NO: 3995941 - RNA, 14 nt, Human herpesvirus 6B
caaugagccuggcu

SEQ ID NO: 3995942 - RNA, 22 nt, Human herpesvirus 6B
caaugucaaguuagaaauguug

SEQ ID NO: 3995943 - RNA, 18 nt, Human herpesvirus 6B
caauguccgaaguaaaaa

SEQ ID NO: 3995944 - RNA, 13 nt, Human herpesvirus 6B
caauucauuguac

SEQ ID NO: 3995945 - RNA, 19 nt, Human herpesvirus 6B
caauucauuguacgauaau

SEQ ID NO: 3995946 - RNA, 11 nt, Human herpesvirus 6B
caauuccugug

SEQ ID NO: 3995947 - RNA, 22 nt, Human herpesvirus 6B
cacaaacgccuagagaacagau

SEQ ID NO: 3995948 - RNA, 18 nt, Human herpesvirus 6B
cacacagaauacaaaaac

SEQ ID NO: 3995949 - RNA, 23 nt, Human herpesvirus 6B
cacacgcggggaucgggccuggg

SEQ ID NO: 3995950 - RNA, 18 nt, Human herpesvirus 6B
cacacuggcgaaggcccg

SEQ ID NO: 3995951 - RNA, 22 nt, Human herpesvirus 6B
cacagaauguauauagagguuu

SEQ ID NO: 3995952 - RNA, 18 nt, Human herpesvirus 6B
cacauaugccgaggcuua

SEQ ID NO: 3995953 - RNA, 23 nt, Human herpesvirus 6B
cacaucgugaaaacgcuucagau

SEQ ID NO: 3995954 - RNA, 15 nt, Human herpesvirus 6B
caccaugaaagcaca

SEQ ID NO: 3995955 - RNA, 16 nt, Human herpesvirus 6B
auaaagcuuucauuuc

SEQ ID NO: 3995956 - RNA, 15 nt, Human herpesvirus 6B
auaaccuucugauuu

SEQ ID NO: 3995957 - RNA, 15 nt, Human herpesvirus 6B
auaauccuuuucugu

SEQ ID NO: 3995958 - RNA, 19 nt, Human herpesvirus 6B
auaaugugaacuaaauaau

SEQ ID NO: 3995959 - RNA, 13 nt, Human herpesvirus 6B
auaauuacagaug

SEQ ID NO: 3995960 - RNA, 20 nt, Human herpesvirus 6B
auaccuuuggccuugauugu

SEQ ID NO: 3995961 - RNA, 17 nt, Human herpesvirus 6B
auagaaagcggccaggc

SEQ ID NO: 3995962 - RNA, 23 nt, Human herpesvirus 6B
auagguucuauucguucagaaug

SEQ ID NO: 3995963 - RNA, 12 nt, Human herpesvirus 6B
auauacaaaauu

SEQ ID NO: 3995964 - RNA, 17 nt, Human herpesvirus 6B
auauacgauggacagaa

SEQ ID NO: 3995965 - RNA, 23 nt, Human herpesvirus 6B
auauccguuuaguuacuuugcuu

SEQ ID NO: 3995966 - RNA, 15 nt, Human herpesvirus 6B
auaucgauucuguaa

SEQ ID NO: 3995967 - RNA, 21 nt, Human herpesvirus 6B
auaucugaaaucgcauuucuc

SEQ ID NO: 3995968 - RNA, 16 nt, Human herpesvirus 6B
auaugcgaauguuaaa

SEQ ID NO: 3995969 - RNA, 14 nt, Human herpesvirus 6B
auauggcgaaugcc

SEQ ID NO: 3995970 - RNA, 22 nt, Human herpesvirus 6B
auauuuguuaguguuaauucca

SEQ ID NO: 3995971 - RNA, 14 nt, Human herpesvirus 6B
aucaaagaacagaa

SEQ ID NO: 3995972 - RNA, 20 nt, Human herpesvirus 6B
aucaaggucuaucucuuggc

SEQ ID NO: 3995973 - RNA, 21 nt, Human herpesvirus 6B
aucaaugucacaaaucuguaa

SEQ ID NO: 3995974 - RNA, 22 nt, Human herpesvirus 6B
aucaugauaaauuguuuccgaa

SEQ ID NO: 3995975 - RNA, 17 nt, Human herpesvirus 6B
aucaugcacacguguau

SEQ ID NO: 3995976 - RNA, 14 nt, Human herpesvirus 6B
auccauuuucugaa

SEQ ID NO: 3995977 - RNA, 16 nt, Human herpesvirus 6B
auccauuuucugaaau

SEQ ID NO: 3995978 - RNA, 23 nt, Human herpesvirus 6B
aucccagaugcagucuccacagg

SEQ ID NO: 3995979 - RNA, 14 nt, Human herpesvirus 6B
auccgcgggccagc

SEQ ID NO: 3995980 - RNA, 19 nt, Human herpesvirus 6B
aucgaauucagcuggacag

SEQ ID NO: 3995981 - RNA, 17 nt, Human herpesvirus 6B
aucgagaauaauuuacu

SEQ ID NO: 3995982 - RNA, 15 nt, Human herpesvirus 6B
aucgagacugcccug

SEQ ID NO: 3995983 - RNA, 15 nt, Human herpesvirus 6B
aucgauucuguaauu

SEQ ID NO: 3995984 - RNA, 20 nt, Human herpesvirus 6B
aucgcgguguccucguccgu

SEQ ID NO: 3995985 - RNA, 13 nt, Human herpesvirus 6B
aucggaagaggaa

SEQ ID NO: 3995986 - RNA, 23 nt, Human herpesvirus 6B
aucggaagaggaagggauggcag

SEQ ID NO: 3995987 - RNA, 17 nt, Human herpesvirus 6B
aucgucgaaaacaauuu

SEQ ID NO: 3995988 - RNA, 22 nt, Human herpesvirus 6B
aucuaugaugcuguagaaacgu

SEQ ID NO: 3995989 - RNA, 14 nt, Human herpesvirus 6B
aucuccaaaacacu

SEQ ID NO: 3995990 - RNA, 18 nt, Human herpesvirus 6B
aucucgaugccaaagcuu

SEQ ID NO: 3995991 - RNA, 17 nt, Human herpesvirus 6B
aucuggauauguaucca

SEQ ID NO: 3995992 - RNA, 19 nt, Human herpesvirus 6B
aucuguauaucuaugcuuu

SEQ ID NO: 3995993 - RNA, 21 nt, Human herpesvirus 6B
aucuucuuggagucuggccuc

SEQ ID NO: 3995994 - RNA, 16 nt, Human herpesvirus 6B
aucuugccguuuugau

SEQ ID NO: 3995995 - RNA, 20 nt, Human herpesvirus 6B
augaaagcacagaaaaagaa

SEQ ID NO: 3995996 - RNA, 17 nt, Human herpesvirus 6B
augaaaucgauguagau

SEQ ID NO: 3995997 - RNA, 18 nt, Human herpesvirus 6B
augaaguuccacaucuau

SEQ ID NO: 3995998 - RNA, 19 nt, Human herpesvirus 6B
augaauuaccugucuuaga

SEQ ID NO: 3995999 - RNA, 12 nt, Human herpesvirus 6B
augaauuucaau

SEQ ID NO: 3996000 - RNA, 17 nt, Human herpesvirus 6B
augaauuucaaugacug

SEQ ID NO: 3996001 - RNA, 20 nt, Human herpesvirus 6B
augacacaucgugaguuuuc

SEQ ID NO: 3996002 - RNA, 23 nt, Human herpesvirus 6B
augacauuuauuagcauucaagu

SEQ ID NO: 3996003 - RNA, 15 nt, Human herpesvirus 6B
augacuaucaaaaua

SEQ ID NO: 3996004 - RNA, 22 nt, Human herpesvirus 6B
augagaucguccggugcauaua

SEQ ID NO: 3996005 - RNA, 17 nt, Human herpesvirus 6B
augaguuuuuugcaauu

SEQ ID NO: 3996006 - RNA, 11 nt, Human herpesvirus 6B
augauagcuug

SEQ ID NO: 3996007 - RNA, 17 nt, Human herpesvirus 6B
augaugaaacuccuucu

SEQ ID NO: 3996008 - RNA, 14 nt, Human herpesvirus 6B
augcacacguguau

SEQ ID NO: 3996009 - RNA, 18 nt, Human herpesvirus 6B
augcaggguguggccggc

SEQ ID NO: 3996010 - RNA, 13 nt, Human herpesvirus 6B
augccacagaaca

SEQ ID NO: 3996011 - RNA, 18 nt, Human herpesvirus 6B
augcuggcgcugcauaga

SEQ ID NO: 3996012 - RNA, 21 nt, Human herpesvirus 6B
augcuguugcuguuguuguag

SEQ ID NO: 3996013 - RNA, 16 nt, Human herpesvirus 6B
augcuuuaaaaaugcu

SEQ ID NO: 3996014 - RNA, 18 nt, Human herpesvirus 6B
auggaaaaggcggacagc

SEQ ID NO: 3996015 - RNA, 16 nt, Human herpesvirus 6B
auggaaacacuuucuu

SEQ ID NO: 3996016 - RNA, 18 nt, Human herpesvirus 6B
auggacagaaaaaacacc

SEQ ID NO: 3996017 - RNA, 15 nt, Human herpesvirus 6B
auggauaagauuuac

SEQ ID NO: 3996018 - RNA, 19 nt, Human herpesvirus 6B
auggcaaauuucaaaaaga

SEQ ID NO: 3996019 - RNA, 20 nt, Human herpesvirus 6B
auggcaaauuucaaaaagaa

SEQ ID NO: 3996020 - RNA, 18 nt, Human herpesvirus 6B
auggcagaucuugaaaag

SEQ ID NO: 3996021 - RNA, 15 nt, Human herpesvirus 6B
augguagcaauaacu

SEQ ID NO: 3996022 - RNA, 19 nt, Human herpesvirus 6B
augguauuuaggagcuagu

SEQ ID NO: 3996023 - RNA, 12 nt, Human herpesvirus 6B
auggugaaaaua

SEQ ID NO: 3996024 - RNA, 19 nt, Human herpesvirus 6B
auguaaacacgaaacugcu

SEQ ID NO: 3996025 - RNA, 17 nt, Human herpesvirus 6B
auguagcacacgacaaa

SEQ ID NO: 3996026 - RNA, 17 nt, Human herpesvirus 6B
auguauauaguuuucug

SEQ ID NO: 3996027 - RNA, 19 nt, Human herpesvirus 6B
auguauuggaauugggaag

SEQ ID NO: 3996028 - RNA, 18 nt, Human herpesvirus 6B
augucacaaaucuguaag

SEQ ID NO: 3996029 - RNA, 14 nt, Human herpesvirus 6B
augucgggccacau

SEQ ID NO: 3996030 - RNA, 21 nt, Human herpesvirus 6B
augucguguucuuuugucauu

SEQ ID NO: 3996031 - RNA, 21 nt, Human herpesvirus 6B
augugaacaguauaaauucuu

SEQ ID NO: 3996032 - RNA, 15 nt, Human herpesvirus 6B
auguuauuguuccuu

SEQ ID NO: 3996033 - RNA, 17 nt, Human herpesvirus 6B
auguucuugacaaauaa

SEQ ID NO: 3996034 - RNA, 16 nt, Human herpesvirus 6B
auguuuauuucaaugc

SEQ ID NO: 3996035 - RNA, 21 nt, Human herpesvirus 6B
auuaaaaauaaaaaaaaugaa

SEQ ID NO: 3996036 - RNA, 23 nt, Human herpesvirus 6B
auuaaaguuuucauaaaaacgac

SEQ ID NO: 3996037 - RNA, 18 nt, Human herpesvirus 6B
auuaauuuuuuguuucug

SEQ ID NO: 3996038 - RNA, 22 nt, Human herpesvirus 6B
auuaauuuuuuguuucugaaaa

SEQ ID NO: 3996039 - RNA, 23 nt, Human herpesvirus 6B
auuaauuuuuuguuucugaaaau

SEQ ID NO: 3996040 - RNA, 14 nt, Human herpesvirus 6B
auuaucgacauaca

SEQ ID NO: 3996041 - RNA, 20 nt, Human herpesvirus 6B
auucagaaaauuggugugca

SEQ ID NO: 3996042 - RNA, 19 nt, Human herpesvirus 6B
auucaguuuuuuguuucug

SEQ ID NO: 3996043 - RNA, 16 nt, Human herpesvirus 6B
auucuaauuauaaaug

SEQ ID NO: 3996044 - RNA, 20 nt, Human herpesvirus 6B
auucuccucaacuaaaucau

SEQ ID NO: 3996045 - RNA, 18 nt, Human herpesvirus 6B
auucucugcaugucuuua

SEQ ID NO: 3996046 - RNA, 15 nt, Human herpesvirus 6B
auucugauaaacucc

SEQ ID NO: 3996047 - RNA, 14 nt, Human herpesvirus 6B
auucugcuaugaug

SEQ ID NO: 3996048 - RNA, 20 nt, Human herpesvirus 6B
auucugcuugcacuauuuua

SEQ ID NO: 3996049 - RNA, 23 nt, Human herpesvirus 6B
auucuuacaaguauguuuuguac

SEQ ID NO: 3996050 - RNA, 20 nt, Human herpesvirus 6B
auucuuaccaagaaaucacg

SEQ ID NO: 3996051 - RNA, 13 nt, Human herpesvirus 6B
auugaauccucuu

SEQ ID NO: 3996052 - RNA, 17 nt, Human herpesvirus 6B
auugaauuuauaucaca

SEQ ID NO: 3996053 - RNA, 18 nt, Human herpesvirus 6B
auugacggcgugcauaua

SEQ ID NO: 3996054 - RNA, 13 nt, Human herpesvirus 6B
auugacugugaaa

SEQ ID NO: 3996055 - RNA, 16 nt, Human herpesvirus 6B
auugauccagaauuau

SEQ ID NO: 3996056 - RNA, 19 nt, Human herpesvirus 6B
auugcucaaaauuggcauu

SEQ ID NO: 3996057 - RNA, 16 nt, Human herpesvirus 6B
auugggaagauucugc

SEQ ID NO: 3996058 - RNA, 19 nt, Human herpesvirus 6B
auugucuuuucuggaaaca

SEQ ID NO: 3996059 - RNA, 18 nt, Human herpesvirus 6B
auugugagaacagcgcau

SEQ ID NO: 3996060 - RNA, 18 nt, Human herpesvirus 6B
auuuaacauccaaaauac

SEQ ID NO: 3996061 - RNA, 15 nt, Human herpesvirus 6B
auuuaauaaaauaac

SEQ ID NO: 3996062 - RNA, 12 nt, Human herpesvirus 6B
auuuaaugcaaa

SEQ ID NO: 3996063 - RNA, 13 nt, Human herpesvirus 6B
auuuaccagagau

SEQ ID NO: 3996064 - RNA, 12 nt, Human herpesvirus 6B
auuuaugugaau

SEQ ID NO: 3996065 - RNA, 18 nt, Human herpesvirus 6B
auuuauuagcauucaagu

SEQ ID NO: 3996066 - RNA, 21 nt, Human herpesvirus 6B
auuucaggaaguucuucaaaa

SEQ ID NO: 3996067 - RNA, 16 nt, Human herpesvirus 6B
auuucccaguuaauuu

SEQ ID NO: 3996068 - RNA, 20 nt, Human herpesvirus 6B
uauggcuaaugagucucugc

SEQ ID NO: 3996069 - RNA, 12 nt, Human herpesvirus 6B
uauggggaagau

SEQ ID NO: 3996070 - RNA, 22 nt, Human herpesvirus 6B
uauggugccgagcaaaccugaa

SEQ ID NO: 3996071 - RNA, 17 nt, Human herpesvirus 6B
uauguaagaaauguuuu

SEQ ID NO: 3996072 - RNA, 12 nt, Human herpesvirus 6B
uauguacagaua

SEQ ID NO: 3996073 - RNA, 15 nt, Human herpesvirus 6B
uauguauauaguuuu

SEQ ID NO: 3996074 - RNA, 19 nt, Human herpesvirus 6B
uauguccgcucauuuugau

SEQ ID NO: 3996075 - RNA, 17 nt, Human herpesvirus 6B
uaugugcaauuacagua

SEQ ID NO: 3996076 - RNA, 10 nt, Human herpesvirus 6B
uauguuucua

SEQ ID NO: 3996077 - RNA, 18 nt, Human herpesvirus 6B
uauuaaugcuuauuucga

SEQ ID NO: 3996078 - RNA, 20 nt, Human herpesvirus 6B
uauuaugucgauacaauaaa

SEQ ID NO: 3996079 - RNA, 23 nt, Human herpesvirus 6B
uauucgccggacgaauugaguag

SEQ ID NO: 3996080 - RNA, 15 nt, Human herpesvirus 6B
uauugacugugaaaa

SEQ ID NO: 3996081 - RNA, 18 nt, Human herpesvirus 6B
uauuguguaccuuguaau

SEQ ID NO: 3996082 - RNA, 22 nt, Human herpesvirus 6B
uauuugaggcggugucuucaaa

SEQ ID NO: 3996083 - RNA, 11 nt, Human herpesvirus 6B
uauuuggaagc

SEQ ID NO: 3996084 - RNA, 14 nt, Human herpesvirus 6B
uauuuucuguauua

SEQ ID NO: 3996085 - RNA, 19 nt, Human herpesvirus 6B
uauuuuuucagcuuucaua

SEQ ID NO: 3996086 - RNA, 22 nt, Human herpesvirus 6B
ucaaacagcgacaugaaaucuc

SEQ ID NO: 3996087 - RNA, 14 nt, Human herpesvirus 6B
ucaaccugaaaaga

SEQ ID NO: 3996088 - RNA, 14 nt, Human herpesvirus 6B
ucaagaaacacuuc

SEQ ID NO: 3996089 - RNA, 17 nt, Human herpesvirus 6B
ucaagaaaccuguuuuu

SEQ ID NO: 3996090 - RNA, 20 nt, Human herpesvirus 6B
ucaagaaaccuguuuuugcu

SEQ ID NO: 3996091 - RNA, 18 nt, Human herpesvirus 6B
ucaaggucaaaaaacuca

SEQ ID NO: 3996092 - RNA, 19 nt, Human herpesvirus 6B
ucaagguugucagauuucc

SEQ ID NO: 3996093 - RNA, 22 nt, Human herpesvirus 6B
ucaaucuccaaaacacuccgcu

SEQ ID NO: 3996094 - RNA, 20 nt, Human herpesvirus 6B
ucaaugcguuggagcaagcg

SEQ ID NO: 3996095 - RNA, 14 nt, Human herpesvirus 6B
ucaauuucuaaaga

SEQ ID NO: 3996096 - RNA, 13 nt, Human herpesvirus 6B
ucacauagagaag

SEQ ID NO: 3996097 - RNA, 19 nt, Human herpesvirus 6B
ucaccccccucuugcagug

SEQ ID NO: 3996098 - RNA, 19 nt, Human herpesvirus 6B
ucaccuaugaauaucuuua

SEQ ID NO: 3996099 - RNA, 15 nt, Human herpesvirus 6B
ucacggcuagaugug

SEQ ID NO: 3996100 - RNA, 14 nt, Human herpesvirus 6B
ucacucagauuuca

SEQ ID NO: 3996101 - RNA, 12 nt, Human herpesvirus 6B
ucagaugugaua

SEQ ID NO: 3996102 - RNA, 16 nt, Human herpesvirus 6B
ucagauuucuguaguu

SEQ ID NO: 3996103 - RNA, 10 nt, Human herpesvirus 6B
ucagcagaag

SEQ ID NO: 3996104 - RNA, 13 nt, Human herpesvirus 6B
ucagcuggacaga

SEQ ID NO: 3996105 - RNA, 22 nt, Human herpesvirus 6B
ucaguaugucucaguucaaaau

SEQ ID NO: 3996106 - RNA, 13 nt, Human herpesvirus 6B
ucauacauccaga

SEQ ID NO: 3996107 - RNA, 21 nt, Human herpesvirus 6B
ucauacgacugacgauuucau

SEQ ID NO: 3996108 - RNA, 18 nt, Human herpesvirus 6B
ucaucaaauccucuacgu

SEQ ID NO: 3996109 - RNA, 15 nt, Human herpesvirus 6B
ucaucaaaugugauu

SEQ ID NO: 3996110 - RNA, 23 nt, Human herpesvirus 6B
ucauuccaguccaaugaauacuu

SEQ ID NO: 3996111 - RNA, 22 nt, Human herpesvirus 6B
ucauuucgaucuaacuacauuu

SEQ ID NO: 3996112 - RNA, 12 nt, Human herpesvirus 6B
ucauuucuguag

SEQ ID NO: 3996113 - RNA, 20 nt, Human herpesvirus 6B
uccaaaagcgccugccuaca

SEQ ID NO: 3996114 - RNA, 13 nt, Human herpesvirus 6B
uccaaaauacacu

SEQ ID NO: 3996115 - RNA, 16 nt, Human herpesvirus 6B
uccaaguuuuuaugca

SEQ ID NO: 3996116 - RNA, 22 nt, Human herpesvirus 6B
uccacaccaaaaaagacgguuc

SEQ ID NO: 3996117 - RNA, 15 nt, Human herpesvirus 6B
uccaggaguaaugau

SEQ ID NO: 3996118 - RNA, 16 nt, Human herpesvirus 6B
uccagggugaagacag

SEQ ID NO: 3996119 - RNA, 20 nt, Human herpesvirus 6B
uccauaccgggacagcaccc

SEQ ID NO: 3996120 - RNA, 14 nt, Human herpesvirus 6B
uccaugacugugag

SEQ ID NO: 3996121 - RNA, 22 nt, Human herpesvirus 6B
uccauuuucugaaaucuuugau

SEQ ID NO: 3996122 - RNA, 18 nt, Human herpesvirus 6B
uccccaggcgcagcagca

SEQ ID NO: 3996123 - RNA, 18 nt, Human herpesvirus 6B
ucccccgaacgccuccac

SEQ ID NO: 3996124 - RNA, 15 nt, Human herpesvirus 6B
uccccguccucgugc

SEQ ID NO: 3996125 - RNA, 23 nt, Human herpesvirus 6B
ucccuccguuaggaucagacaga

SEQ ID NO: 3996126 - RNA, 24 nt, Human herpesvirus 6B
ucccuccguuaggaucagacagac

SEQ ID NO: 3996127 - RNA, 14 nt, Human herpesvirus 6B
ucccucucaaacag

SEQ ID NO: 3996128 - RNA, 21 nt, Human herpesvirus 6B
ucccugcgggacgugaucugc

SEQ ID NO: 3996129 - RNA, 18 nt, Human herpesvirus 6B
uccgcgaugcgccacagg

SEQ ID NO: 3996130 - RNA, 23 nt, Human herpesvirus 6B
uccgcggcgcugggcuccucacc

SEQ ID NO: 3996131 - RNA, 16 nt, Human herpesvirus 6B
uccggucaacuucuau

SEQ ID NO: 3996132 - RNA, 16 nt, Human herpesvirus 6B
uccgucaucuagagaa

SEQ ID NO: 3996133 - RNA, 16 nt, Human herpesvirus 6B
uccgugacacacagaa

SEQ ID NO: 3996134 - RNA, 16 nt, Human herpesvirus 6B
uccguucccuucucgu

SEQ ID NO: 3996135 - RNA, 18 nt, Human herpesvirus 6B
uccguuuuuucugcaaaa

SEQ ID NO: 3996136 - RNA, 21 nt, Human herpesvirus 6B
uccucaaacuuuuagagacuu

SEQ ID NO: 3996137 - RNA, 20 nt, Human herpesvirus 6B
uccucguccguccccgccgc

SEQ ID NO: 3996138 - RNA, 15 nt, Human herpesvirus 6B
uccugagaggcugga

SEQ ID NO: 3996139 - RNA, 13 nt, Human herpesvirus 6B
uccuguuuuccca

SEQ ID NO: 3996140 - RNA, 21 nt, Human herpesvirus 6B
uccuuauaaugugaacuaaau

SEQ ID NO: 3996141 - RNA, 18 nt, Human herpesvirus 6B
ucgaaaagucuauucaga

SEQ ID NO: 3996142 - RNA, 11 nt, Human herpesvirus 6B
ucgaaagagau

SEQ ID NO: 3996143 - RNA, 18 nt, Human herpesvirus 6B
ucgacauagaguguuugg

SEQ ID NO: 3996144 - RNA, 17 nt, Human herpesvirus 6B
ucgacuaacaauuuaua

SEQ ID NO: 3996145 - RNA, 23 nt, Human herpesvirus 6B
ucgaguuguauuauaaaaacuaa

SEQ ID NO: 3996146 - RNA, 18 nt, Human herpesvirus 6B
ucgauucuguaauuuuga

SEQ ID NO: 3996147 - RNA, 15 nt, Human herpesvirus 6B
ucgccggcccgucca

SEQ ID NO: 3996148 - RNA, 20 nt, Human herpesvirus 6B
ucgcuaaguguugacugauc

SEQ ID NO: 3996149 - RNA, 19 nt, Human herpesvirus 6B
ucggaacaaauucugcuug

SEQ ID NO: 3996150 - RNA, 17 nt, Human herpesvirus 6B
ucggcgugagacaauua

SEQ ID NO: 3996151 - RNA, 21 nt, Human herpesvirus 6B
ucgggccaagguaaaggaagg

SEQ ID NO: 3996152 - RNA, 20 nt, Human herpesvirus 6B
ucgggccuggggacagacag

SEQ ID NO: 3996153 - RNA, 23 nt, Human herpesvirus 6B
ucggggacagugauuaggauguu

SEQ ID NO: 3996154 - RNA, 23 nt, Human herpesvirus 6B
ucgguccccccucccuccauccc

SEQ ID NO: 3996155 - RNA, 18 nt, Human herpesvirus 6B
ucguaguuuaugaaaucg

SEQ ID NO: 3996156 - RNA, 20 nt, Human herpesvirus 6B
ucgucgaaaacaauuuccca

SEQ ID NO: 3996157 - RNA, 14 nt, Human herpesvirus 6B
ucgucgcucucccu

SEQ ID NO: 3996158 - RNA, 18 nt, Human herpesvirus 6B
ucgugugugaaaauuccu

SEQ ID NO: 3996159 - RNA, 20 nt, Human herpesvirus 6B
ucguuucgaaugauagcguu

SEQ ID NO: 3996160 - RNA, 15 nt, Human herpesvirus 6B
ucguuuguacauguu

SEQ ID NO: 3996161 - RNA, 14 nt, Human herpesvirus 6B
ucuaagcugguuac

SEQ ID NO: 3996162 - RNA, 13 nt, Human herpesvirus 6B
ucuaaucaagaaa

SEQ ID NO: 3996163 - RNA, 17 nt, Human herpesvirus 6B
ucuaauuauaaauguag

SEQ ID NO: 3996164 - RNA, 22 nt, Human herpesvirus 6B
ucuacguauaaaaguccucaaa

SEQ ID NO: 3996165 - RNA, 14 nt, Human herpesvirus 6B
ucuaggacaguucc

SEQ ID NO: 3996166 - RNA, 17 nt, Human herpesvirus 6B
ucuauuuuuuauuagua

SEQ ID NO: 3996167 - RNA, 23 nt, Human herpesvirus 6B
ucucagcaaucaccaucaacaca

SEQ ID NO: 3996168 - RNA, 19 nt, Human herpesvirus 6B
uguaaacaaauucuuacaa

SEQ ID NO: 3996169 - RNA, 13 nt, Human herpesvirus 6B
uguaauguuuccu

SEQ ID NO: 3996170 - RNA, 21 nt, Human herpesvirus 6B
uguaauuuggaucugugcgcc

SEQ ID NO: 3996171 - RNA, 17 nt, Human herpesvirus 6B
uguaauuuuuagcaguc

SEQ ID NO: 3996172 - RNA, 14 nt, Human herpesvirus 6B
uguacgaaaacgac

SEQ ID NO: 3996173 - RNA, 20 nt, Human herpesvirus 6B
uguacguggccgucuccugc

SEQ ID NO: 3996174 - RNA, 21 nt, Human herpesvirus 6B
uguacugguaauucaauuucu

SEQ ID NO: 3996175 - RNA, 16 nt, Human herpesvirus 6B
uguaggacugaaggag

SEQ ID NO: 3996176 - RNA, 18 nt, Human herpesvirus 6B
uguaggacugaaggagau

SEQ ID NO: 3996177 - RNA, 22 nt, Human herpesvirus 6B
uguaucaaaguguauacauuca

SEQ ID NO: 3996178 - RNA, 22 nt, Human herpesvirus 6B
uguauuaauuuuuuguuucuga

SEQ ID NO: 3996179 - RNA, 13 nt, Human herpesvirus 6B
uguauuuggauga

SEQ ID NO: 3996180 - RNA, 21 nt, Human herpesvirus 6B
ugucacaauaauuacucccau

SEQ ID NO: 3996181 - RNA, 14 nt, Human herpesvirus 6B
ugucacacucugaa

SEQ ID NO: 3996182 - RNA, 14 nt, Human herpesvirus 6B
ugucugagcauugu

SEQ ID NO: 3996183 - RNA, 23 nt, Human herpesvirus 6B
ugucuucgagauuuuagaauaaa

SEQ ID NO: 3996184 - RNA, 15 nt, Human herpesvirus 6B
ugugaaaagugcuuu

SEQ ID NO: 3996185 - RNA, 12 nt, Human herpesvirus 6B
ugugauaugcaa

SEQ ID NO: 3996186 - RNA, 17 nt, Human herpesvirus 6B
ugugucggcuccgaaac

SEQ ID NO: 3996187 - RNA, 19 nt, Human herpesvirus 6B
uguuaacauugugagaaca

SEQ ID NO: 3996188 - RNA, 15 nt, Human herpesvirus 6B
uguuagauaaaauga

SEQ ID NO: 3996189 - RNA, 15 nt, Human herpesvirus 6B
uguuauaucuggaua

SEQ ID NO: 3996190 - RNA, 21 nt, Human herpesvirus 6B
uguucagacacaugucuucaa

SEQ ID NO: 3996191 - RNA, 18 nt, Human herpesvirus 6B
uguuccgaauucuuacca

SEQ ID NO: 3996192 - RNA, 19 nt, Human herpesvirus 6B
uguugcgauugcugcuucu

SEQ ID NO: 3996193 - RNA, 19 nt, Human herpesvirus 6B
uguugcuguaguugaugcu

SEQ ID NO: 3996194 - RNA, 13 nt, Human herpesvirus 6B
uguuguucuugga

SEQ ID NO: 3996195 - RNA, 19 nt, Human herpesvirus 6B
uguuuccagagcacacaua

SEQ ID NO: 3996196 - RNA, 19 nt, Human herpesvirus 6B
uguuucugaacuauuaaaa

SEQ ID NO: 3996197 - RNA, 14 nt, Human herpesvirus 6B
uguuucuguaugaa

SEQ ID NO: 3996198 - RNA, 19 nt, Human herpesvirus 6B
uguuuucccaccuaauaaa

SEQ ID NO: 3996199 - RNA, 13 nt, Human herpesvirus 6B
uguuuugcuacgu

SEQ ID NO: 3996200 - RNA, 18 nt, Human herpesvirus 6B
uguuuuuuucaagaaugg

SEQ ID NO: 3996201 - RNA, 17 nt, Human herpesvirus 6B
uuaaacucgacuucuuu

SEQ ID NO: 3996202 - RNA, 15 nt, Human herpesvirus 6B
uuaaagauguguuaa

SEQ ID NO: 3996203 - RNA, 20 nt, Human herpesvirus 6B
uuaaaggauucgagaaacuc

SEQ ID NO: 3996204 - RNA, 23 nt, Human herpesvirus 6B
uuaaaggauucgagaaacucugu

SEQ ID NO: 3996205 - RNA, 19 nt, Human herpesvirus 6B
uuaacauacaacuuucacu

SEQ ID NO: 3996206 - RNA, 16 nt, Human herpesvirus 6B
uuaagagugauucaag

SEQ ID NO: 3996207 - RNA, 14 nt, Human herpesvirus 6B
uuaagaugucgugu

SEQ ID NO: 3996208 - RNA, 18 nt, Human herpesvirus 6B
uuaauaguuaaaaaauug

SEQ ID NO: 3996209 - RNA, 12 nt, Human herpesvirus 6B
uuaaucauucga

SEQ ID NO: 3996210 - RNA, 16 nt, Human herpesvirus 6B
uuaaugagaggacagu

SEQ ID NO: 3996211 - RNA, 14 nt, Human herpesvirus 6B
uuacaaguauguuu

SEQ ID NO: 3996212 - RNA, 9 nt, Human herpesvirus 6B
uuacuauug

SEQ ID NO: 3996213 - RNA, 22 nt, Human herpesvirus 6B
uuacuuacaucgauccaaaaga

SEQ ID NO: 3996214 - RNA, 16 nt, Human herpesvirus 6B
uuagaaccgaaauuuc

SEQ ID NO: 3996215 - RNA, 17 nt, Human herpesvirus 6B
uuagagauuuuggaagc

SEQ ID NO: 3996216 - RNA, 17 nt, Human herpesvirus 6B
uuaguugugcgucucuu

SEQ ID NO: 3996217 - RNA, 14 nt, Human herpesvirus 6B
uuaguuuuggauga

SEQ ID NO: 3996218 - RNA, 14 nt, Human herpesvirus 6B
uuauaucaacgaug

SEQ ID NO: 3996219 - RNA, 15 nt, Human herpesvirus 6B
uuauauggaugcugg

SEQ ID NO: 3996220 - RNA, 19 nt, Human herpesvirus 6B
uuaugacaaaaccaucuuu

SEQ ID NO: 3996221 - RNA, 22 nt, Human herpesvirus 6B
uuauugacugugaaaagugcuu

SEQ ID NO: 3996222 - RNA, 21 nt, Human herpesvirus 6B
uuauuuacaaaagccugcaua

SEQ ID NO: 3996223 - RNA, 15 nt, Human herpesvirus 6B
uuauuuccucugaau

SEQ ID NO: 3996224 - RNA, 23 nt, Human herpesvirus 6B
uucaaaaaaagaggaggaaaaga

SEQ ID NO: 3996225 - RNA, 18 nt, Human herpesvirus 6B
uucaaccuguuuccagaa

SEQ ID NO: 3996226 - RNA, 16 nt, Human herpesvirus 6B
uucaaugcguuucuuc

SEQ ID NO: 3996227 - RNA, 12 nt, Human herpesvirus 6B
uucacagcaguu

SEQ ID NO: 3996228 - RNA, 13 nt, Human herpesvirus 6B
uucacuaacaaaa

SEQ ID NO: 3996229 - RNA, 20 nt, Human herpesvirus 6B
uucagaaaauuggugugcau

SEQ ID NO: 3996230 - RNA, 18 nt, Human herpesvirus 6B
uucagacucgacguguau

SEQ ID NO: 3996231 - RNA, 20 nt, Human herpesvirus 6B
uucagagcugaugauuugaa

SEQ ID NO: 3996232 - RNA, 13 nt, Human herpesvirus 6B
uucagagucuguu

SEQ ID NO: 3996233 - RNA, 14 nt, Human herpesvirus 6B
uucagcaguaucaa

SEQ ID NO: 3996234 - RNA, 17 nt, Human herpesvirus 6B
uucaguauagacauuuu

SEQ ID NO: 3996235 - RNA, 22 nt, Human herpesvirus 6B
uucauagccgggagauuccucu

SEQ ID NO: 3996236 - RNA, 15 nt, Human herpesvirus 6B
uucauuguaauucca

SEQ ID NO: 3996237 - RNA, 13 nt, Human herpesvirus 6B
uuccaguuguauu

SEQ ID NO: 3996238 - RNA, 13 nt, Human herpesvirus 6B
uuccccguccucg

SEQ ID NO: 3996239 - RNA, 16 nt, Human herpesvirus 6B
uucccuccauguugca

SEQ ID NO: 3996240 - RNA, 17 nt, Human herpesvirus 6B
uucccucuuccuucucg

SEQ ID NO: 3996241 - RNA, 20 nt, Human herpesvirus 6B
uuccugaugguuaaggaaaa

SEQ ID NO: 3996242 - RNA, 16 nt, Human herpesvirus 6B
uuccuguccgugagac

SEQ ID NO: 3996243 - RNA, 21 nt, Human herpesvirus 6B
uuccuuguguugaagaacaaa

SEQ ID NO: 3996244 - RNA, 16 nt, Human herpesvirus 6B
uucgguuuugucguuu

SEQ ID NO: 3996245 - RNA, 18 nt, Human herpesvirus 6B
uucuaauuauaaauguag

SEQ ID NO: 3996246 - RNA, 22 nt, Human herpesvirus 6B
uucuaccguagaccguuuuuua

SEQ ID NO: 3996247 - RNA, 15 nt, Human herpesvirus 6B
uucuccgcccuccug

SEQ ID NO: 3996248 - RNA, 19 nt, Human herpesvirus 6B
uucuccgucaccccccucg

SEQ ID NO: 3996249 - RNA, 14 nt, Human herpesvirus 6B
uucucgccgccucg

SEQ ID NO: 3996250 - RNA, 19 nt, Human herpesvirus 6B
uucucgccgccucgccgcu

SEQ ID NO: 3996251 - RNA, 18 nt, Human herpesvirus 6B
uucugcucguuuguuuuu

SEQ ID NO: 3996252 - RNA, 22 nt, Human herpesvirus 6B
uucuguaaccugucuuggaaga

SEQ ID NO: 3996253 - RNA, 13 nt, Human herpesvirus 6B
uucuuaaauucaa

SEQ ID NO: 3996254 - RNA, 20 nt, Human herpesvirus 6B
uucuuaccaagaaaucacgu

SEQ ID NO: 3996255 - RNA, 18 nt, Human herpesvirus 6B
uugaauguuuaaaguuuu

SEQ ID NO: 3996256 - RNA, 14 nt, Human herpesvirus 6B
uugaauucugcucg

SEQ ID NO: 3996257 - RNA, 16 nt, Human herpesvirus 6B
uugaggcaacuuuuuu

SEQ ID NO: 3996258 - RNA, 15 nt, Human herpesvirus 6B
uugauaaaaccaucu

SEQ ID NO: 3996259 - RNA, 17 nt, Human herpesvirus 6B
uugauguuuccugaauu

SEQ ID NO: 3996260 - RNA, 21 nt, Human herpesvirus 6B
uugcagaacgagacuggacag

SEQ ID NO: 3996261 - RNA, 14 nt, Human herpesvirus 6B
uugcagcaucgccu

SEQ ID NO: 3996262 - RNA, 14 nt, Human herpesvirus 6B
uugcaguuugugaa

SEQ ID NO: 3996263 - RNA, 21 nt, Human herpesvirus 6B
uugcauauuauaaggucauuu

SEQ ID NO: 3996264 - RNA, 16 nt, Human herpesvirus 6B
uugcgagucugucagu

SEQ ID NO: 3996265 - RNA, 15 nt, Human herpesvirus 6B
uugcugucacacucu

SEQ ID NO: 3996266 - RNA, 13 nt, Human herpesvirus 6B
uugcuguuuacga

SEQ ID NO: 3996267 - RNA, 15 nt, Human herpesvirus 6B
uugguacaauuuuua

SEQ ID NO: 3996268 - RNA, 20 nt, Human herpesvirus 6B
uuggugacguuuagcuuugu

SEQ ID NO: 3996269 - RNA, 14 nt, Human herpesvirus 6B
uuguacaaagguuu

SEQ ID NO: 3996270 - RNA, 20 nt, Human herpesvirus 6B
uuguacauguuaacaauaaa

SEQ ID NO: 3996271 - RNA, 17 nt, Human herpesvirus 6B
uuguuuauugcuuuugu

SEQ ID NO: 3996272 - RNA, 21 nt, Human herpesvirus 6B
uuguuuucuguaggcaacuua

SEQ ID NO: 3996273 - RNA, 14 nt, Human herpesvirus 6B
uuuaacgcagauau

SEQ ID NO: 3996274 - RNA, 21 nt, Human herpesvirus 6B
uuuaacgcagauauauggauc

SEQ ID NO: 3996275 - RNA, 15 nt, Human herpesvirus 6B
uuuaccgguuuggug

SEQ ID NO: 3996276 - RNA, 14 nt, Human herpesvirus 6B
uuuacuugucgugu

SEQ ID NO: 3996277 - RNA, 22 nt, Human herpesvirus 6B
uuuagccuauuaagcagccgcg

SEQ ID NO: 3996278 - RNA, 20 nt, Human herpesvirus 6B
cguguuauggggaagaucua

SEQ ID NO: 3996279 - RNA, 20 nt, Human herpesvirus 6B
cguguucaaaaaugugguca

SEQ ID NO: 3996280 - RNA, 18 nt, Human herpesvirus 6B
cguuacaagcaugcauug

SEQ ID NO: 3996281 - RNA, 20 nt, Human herpesvirus 6B
cguuauuugugcaaaaugug

SEQ ID NO: 3996282 - RNA, 19 nt, Human herpesvirus 6B
cguugcccucccgcagcuc

SEQ ID NO: 3996283 - RNA, 20 nt, Human herpesvirus 6B
cguugcccucccgcagcucc

SEQ ID NO: 3996284 - RNA, 14 nt, Human herpesvirus 6B
cguugucuauuuuu

SEQ ID NO: 3996285 - RNA, 17 nt, Human herpesvirus 6B
cguuuucaaugugaauc

SEQ ID NO: 3996286 - RNA, 20 nt, Human herpesvirus 6B
cguuuuuggugaaaaacacg

SEQ ID NO: 3996287 - RNA, 23 nt, Human herpesvirus 6B
cuaaaagacgcuugcuguuuucg

SEQ ID NO: 3996288 - RNA, 22 nt, Human herpesvirus 6B
cuaaacggagacugcacagaau

SEQ ID NO: 3996289 - RNA, 17 nt, Human herpesvirus 6B
cuaaaucugaaauguag

SEQ ID NO: 3996290 - RNA, 21 nt, Human herpesvirus 6B
cuaacgacggaauuuacuguu

SEQ ID NO: 3996291 - RNA, 21 nt, Human herpesvirus 6B
cuaacgcggcaaccgcaguuc

SEQ ID NO: 3996292 - RNA, 21 nt, Human herpesvirus 6B
cuaagaaauauugcaugcauu

SEQ ID NO: 3996293 - RNA, 12 nt, Human herpesvirus 6B
cuaagcuggaca

SEQ ID NO: 3996294 - RNA, 15 nt, Human herpesvirus 6B
cuaagcuggacagaa

SEQ ID NO: 3996295 - RNA, 14 nt, Human herpesvirus 6B
cuacaugccacaga

SEQ ID NO: 3996296 - RNA, 21 nt, Human herpesvirus 6B
cuacauuuuaguauuuaugcu

SEQ ID NO: 3996297 - RNA, 14 nt, Human herpesvirus 6B
cuacgguaaucguu

SEQ ID NO: 3996298 - RNA, 16 nt, Human herpesvirus 6B
cuacuguguauugugu

SEQ ID NO: 3996299 - RNA, 21 nt, Human herpesvirus 6B
cuaguacaaagauauuucuau

SEQ ID NO: 3996300 - RNA, 16 nt, Human herpesvirus 6B
cuaugcaaugucuucg

SEQ ID NO: 3996301 - RNA, 13 nt, Human herpesvirus 6B
cuauguauuggaa

SEQ ID NO: 3996302 - RNA, 13 nt, Human herpesvirus 6B
cucagagaaaguu

SEQ ID NO: 3996303 - RNA, 17 nt, Human herpesvirus 6B
cucaggucguauuauug

SEQ ID NO: 3996304 - RNA, 9 nt, Human herpesvirus 6B
cuccaagga

SEQ ID NO: 3996305 - RNA, 20 nt, Human herpesvirus 6B
cuccgaaccacaucuuuucc

SEQ ID NO: 3996306 - RNA, 13 nt, Human herpesvirus 6B
cuccgccuccucu

SEQ ID NO: 3996307 - RNA, 17 nt, Human herpesvirus 6B
cuccgucgccgcuccgg

SEQ ID NO: 3996308 - RNA, 18 nt, Human herpesvirus 6B
cuccguuccaaccuccuc

SEQ ID NO: 3996309 - RNA, 19 nt, Human herpesvirus 6B
cuccugucauuuuuacuca

SEQ ID NO: 3996310 - RNA, 18 nt, Human herpesvirus 6B
cuccugugcguccuccuc

SEQ ID NO: 3996311 - RNA, 16 nt, Human herpesvirus 6B
cucgcccguucccggg

SEQ ID NO: 3996312 - RNA, 17 nt, Human herpesvirus 6B
cucgccgucgucgcucu

SEQ ID NO: 3996313 - RNA, 19 nt, Human herpesvirus 6B
cucgccguuuuuguuugac

SEQ ID NO: 3996314 - RNA, 13 nt, Human herpesvirus 6B
cucgcucuccugu

SEQ ID NO: 3996315 - RNA, 14 nt, Human herpesvirus 6B
cucggcaggggccg

SEQ ID NO: 3996316 - RNA, 19 nt, Human herpesvirus 6B
cucucuucaggagaagaac

SEQ ID NO: 3996317 - RNA, 14 nt, Human herpesvirus 6B
cucuguucucuccc

SEQ ID NO: 3996318 - RNA, 20 nt, Human herpesvirus 6B
cucuuagauauccauuugcu

SEQ ID NO: 3996319 - RNA, 20 nt, Human herpesvirus 6B
cucuucuugcgaccucgcuc

SEQ ID NO: 3996320 - RNA, 14 nt, Human herpesvirus 6B
cucuugcaguggcg

SEQ ID NO: 3996321 - RNA, 12 nt, Human herpesvirus 6B
cucuugugcaaa

SEQ ID NO: 3996322 - RNA, 15 nt, Human herpesvirus 6B
cugacugcguuacaa

SEQ ID NO: 3996323 - RNA, 14 nt, Human herpesvirus 6B
cugacuuagauaug

SEQ ID NO: 3996324 - RNA, 21 nt, Human herpesvirus 6B
cugauauacgauggacagaaa

SEQ ID NO: 3996325 - RNA, 21 nt, Human herpesvirus 6B
cugaucucacgucacaguuuu

SEQ ID NO: 3996326 - RNA, 15 nt, Human herpesvirus 6B
cugcagaucuggaua

SEQ ID NO: 3996327 - RNA, 18 nt, Human herpesvirus 6B
cugcguuacaagcaugca

SEQ ID NO: 3996328 - RNA, 20 nt, Human herpesvirus 6B
cugcguuacaagcaugcauu

SEQ ID NO: 3996329 - RNA, 21 nt, Human herpesvirus 6B
cugcuaaaagcuauguaugaa

SEQ ID NO: 3996330 - RNA, 19 nt, Human herpesvirus 6B
cugcuccguucccuucucg

SEQ ID NO: 3996331 - RNA, 16 nt, Human herpesvirus 6B
cuggaagcacggcuug

SEQ ID NO: 3996332 - RNA, 13 nt, Human herpesvirus 6B
cuggccucugcgg

SEQ ID NO: 3996333 - RNA, 22 nt, Human herpesvirus 6B
cugggacuccgagccggacagg

SEQ ID NO: 3996334 - RNA, 12 nt, Human herpesvirus 6B
cuggggacagac

SEQ ID NO: 3996335 - RNA, 15 nt, Human herpesvirus 6B
gaacagauagaaaau

SEQ ID NO: 3996336 - RNA, 15 nt, Human herpesvirus 6B
gaacagcgcauaaau

SEQ ID NO: 3996337 - RNA, 15 nt, Human herpesvirus 6B
gaaccauagguguuu

SEQ ID NO: 3996338 - RNA, 14 nt, Human herpesvirus 6B
gaacccuagacaca

SEQ ID NO: 3996339 - RNA, 15 nt, Human herpesvirus 6B
gaacgcguccuccgc

SEQ ID NO: 3996340 - RNA, 17 nt, Human herpesvirus 6B
gaagaauugucuuuucg

SEQ ID NO: 3996341 - RNA, 13 nt, Human herpesvirus 6B
gaagauauuuccc

SEQ ID NO: 3996342 - RNA, 18 nt, Human herpesvirus 6B
gaagccuggaagaaggaa

SEQ ID NO: 3996343 - RNA, 15 nt, Human herpesvirus 6B
gaagucuuuccugau

SEQ ID NO: 3996344 - RNA, 13 nt, Human herpesvirus 6B
gaauaaugaaauu

SEQ ID NO: 3996345 - RNA, 13 nt, Human herpesvirus 6B
gaauacagcugca

SEQ ID NO: 3996346 - RNA, 17 nt, Human herpesvirus 6B
gaaucacuuaguugaua

SEQ ID NO: 3996347 - RNA, 18 nt, Human herpesvirus 6B
gaaucccuugucuggcug

SEQ ID NO: 3996348 - RNA, 13 nt, Human herpesvirus 6B
gaaugguaugaau

SEQ ID NO: 3996349 - RNA, 15 nt, Human herpesvirus 6B
gaauucagcuggaca

SEQ ID NO: 3996350 - RNA, 20 nt, Human herpesvirus 6B
gacaaggguaacgcaggaga

SEQ ID NO: 3996351 - RNA, 15 nt, Human herpesvirus 6B
gacaagggugugaaa

SEQ ID NO: 3996352 - RNA, 19 nt, Human herpesvirus 6B
gacacagacgucuacggua

SEQ ID NO: 3996353 - RNA, 13 nt, Human herpesvirus 6B
gacagaaaugagc

SEQ ID NO: 3996354 - RNA, 12 nt, Human herpesvirus 6B
gacaucuguuua

SEQ ID NO: 3996355 - RNA, 14 nt, Human herpesvirus 6B
gacauuagagaaau

SEQ ID NO: 3996356 - RNA, 15 nt, Human herpesvirus 6B
gaccacucgggccgg

SEQ ID NO: 3996357 - RNA, 17 nt, Human herpesvirus 6B
gacccaacagaagccac

SEQ ID NO: 3996358 - RNA, 18 nt, Human herpesvirus 6B
gacccuccuggcgcuugu

SEQ ID NO: 3996359 - RNA, 11 nt, Human herpesvirus 6B
gacggaauuua

SEQ ID NO: 3996360 - RNA, 15 nt, Human herpesvirus 6B
gacggcagcggggaa

SEQ ID NO: 3996361 - RNA, 22 nt, Human herpesvirus 6B
gacggcgaggggacggacagag

SEQ ID NO: 3996362 - RNA, 22 nt, Human herpesvirus 6B
gacggcgugcauauauaugaau

SEQ ID NO: 3996363 - RNA, 12 nt, Human herpesvirus 6B
gacgggcagggc

SEQ ID NO: 3996364 - RNA, 22 nt, Human herpesvirus 6B
gacgggcguuaucgacggcagc

SEQ ID NO: 3996365 - RNA, 19 nt, Human herpesvirus 6B
gacgugcggagaugccgug

SEQ ID NO: 3996366 - RNA, 21 nt, Human herpesvirus 6B
gacgugcggagaugccgugag

SEQ ID NO: 3996367 - RNA, 16 nt, Human herpesvirus 6B
gacuguucuaaaggau

SEQ ID NO: 3996368 - RNA, 20 nt, Human herpesvirus 6B
gacuuagcuagacgugucuu

SEQ ID NO: 3996369 - RNA, 15 nt, Human herpesvirus 6B
gacuuuucugaaauu

SEQ ID NO: 3996370 - RNA, 15 nt, Human herpesvirus 6B
gagaaaggaagaaau

SEQ ID NO: 3996371 - RNA, 19 nt, Human herpesvirus 6B
gagaauguucuucugaaau

SEQ ID NO: 3996372 - RNA, 15 nt, Human herpesvirus 6B
gagagccgcagaggc

SEQ ID NO: 3996373 - RNA, 21 nt, Human herpesvirus 6B
gagaguuuccgggcauguuuu

SEQ ID NO: 3996374 - RNA, 16 nt, Human herpesvirus 6B
gagaucagcaugggca

SEQ ID NO: 3996375 - RNA, 20 nt, Human herpesvirus 6B
gagauccauaccgggacagc

SEQ ID NO: 3996376 - RNA, 12 nt, Human herpesvirus 6B
gagaugaagagu

SEQ ID NO: 3996377 - RNA, 15 nt, Human herpesvirus 6B
gagcaaagaaaugac

SEQ ID NO: 3996378 - RNA, 19 nt, Human herpesvirus 6B
gagcaaccgcaguuccugu

SEQ ID NO: 3996379 - RNA, 14 nt, Human herpesvirus 6B
gagcacgcacgaga

SEQ ID NO: 3996380 - RNA, 22 nt, Human herpesvirus 6B
gagcaugucggagguggcgaau

SEQ ID NO: 3996381 - RNA, 22 nt, Human herpesvirus 6B
gagcggagaggcgcgggacagc

SEQ ID NO: 3996382 - RNA, 20 nt, Human herpesvirus 6B
gagcucaaagagauuggaaa

SEQ ID NO: 3996383 - RNA, 17 nt, Human herpesvirus 6B
gagcuuuaaagcagcua

SEQ ID NO: 3996384 - RNA, 11 nt, Human herpesvirus 6B
gaggaagagga

SEQ ID NO: 3996385 - RNA, 16 nt, Human herpesvirus 6B
gaggacggugagaaga

SEQ ID NO: 3996386 - RNA, 14 nt, Human herpesvirus 6B
gaggagagggagga

SEQ ID NO: 3996387 - RNA, 21 nt, Human herpesvirus 6B
gcaguuacaauuacuaaauca

SEQ ID NO: 3996388 - RNA, 15 nt, Human herpesvirus 6B
gcauacagcaugaac

SEQ ID NO: 3996389 - RNA, 20 nt, Human herpesvirus 6B
gcauagaucgggacugcuug

SEQ ID NO: 3996390 - RNA, 15 nt, Human herpesvirus 6B
gcauauauaugaauu

SEQ ID NO: 3996391 - RNA, 23 nt, Human herpesvirus 6B
gcauauuauuaacaaugaaaauu

SEQ ID NO: 3996392 - RNA, 19 nt, Human herpesvirus 6B
gcaugaaguguuaugaaga

SEQ ID NO: 3996393 - RNA, 24 nt, Human herpesvirus 6B
gcaugacacaucgugaguuuucau

SEQ ID NO: 3996394 - RNA, 16 nt, Human herpesvirus 6B
gcauggugauguguua

SEQ ID NO: 3996395 - RNA, 20 nt, Human herpesvirus 6B
gcauucuuacggaagcaaaa

SEQ ID NO: 3996396 - RNA, 16 nt, Human herpesvirus 6B
gcauuguugagaauuu

SEQ ID NO: 3996397 - RNA, 16 nt, Human herpesvirus 6B
gcauuucuaucuacaa

SEQ ID NO: 3996398 - RNA, 21 nt, Human herpesvirus 6B
gcauuuggcagccuaaacgga

SEQ ID NO: 3996399 - RNA, 15 nt, Human herpesvirus 6B
gccaaucauaagaaa

SEQ ID NO: 3996400 - RNA, 19 nt, Human herpesvirus 6B
gccacguucuuugaacagu

SEQ ID NO: 3996401 - RNA, 14 nt, Human herpesvirus 6B
gccagcccugaaga

SEQ ID NO: 3996402 - RNA, 14 nt, Human herpesvirus 6B
gccaggccgcgucg

SEQ ID NO: 3996403 - RNA, 19 nt, Human herpesvirus 6B
gccaguucacacagaugca

SEQ ID NO: 3996404 - RNA, 12 nt, Human herpesvirus 6B
gccaugauuuug

SEQ ID NO: 3996405 - RNA, 16 nt, Human herpesvirus 6B
gccccgcgucaggugc

SEQ ID NO: 3996406 - RNA, 14 nt, Human herpesvirus 6B
gcccuccuggguac

SEQ ID NO: 3996407 - RNA, 11 nt, Human herpesvirus 6B
gcccugagagc

SEQ ID NO: 3996408 - RNA, 23 nt, Human herpesvirus 6B
gccgaccugauccaugagcaccc

SEQ ID NO: 3996409 - RNA, 13 nt, Human herpesvirus 6B
gccgccuucucug

SEQ ID NO: 3996410 - RNA, 18 nt, Human herpesvirus 6B
gccgccuucucugucgcu

SEQ ID NO: 3996411 - RNA, 13 nt, Human herpesvirus 6B
gccgcgcggagcu

SEQ ID NO: 3996412 - RNA, 20 nt, Human herpesvirus 6B
gccgcgugaggugacggagg

SEQ ID NO: 3996413 - RNA, 12 nt, Human herpesvirus 6B
gccgguuauuag

SEQ ID NO: 3996414 - RNA, 13 nt, Human herpesvirus 6B
gccgucuccugca

SEQ ID NO: 3996415 - RNA, 20 nt, Human herpesvirus 6B
gccgucugucuguuccucag

SEQ ID NO: 3996416 - RNA, 16 nt, Human herpesvirus 6B
gccguggugcgccugu

SEQ ID NO: 3996417 - RNA, 20 nt, Human herpesvirus 6B
gccgugucuuucgauaaggc

SEQ ID NO: 3996418 - RNA, 20 nt, Human herpesvirus 6B
gccucacuguaaaagggcuc

SEQ ID NO: 3996419 - RNA, 17 nt, Human herpesvirus 6B
gccucaggguuggaguu

SEQ ID NO: 3996420 - RNA, 14 nt, Human herpesvirus 6B
gccucccauagagg

SEQ ID NO: 3996421 - RNA, 20 nt, Human herpesvirus 6B
gccuccucuuuuccccccgc

SEQ ID NO: 3996422 - RNA, 14 nt, Human herpesvirus 6B
gccugaccaacaug

SEQ ID NO: 3996423 - RNA, 16 nt, Human herpesvirus 6B
gccugcgcguggaaac

SEQ ID NO: 3996424 - RNA, 13 nt, Human herpesvirus 6B
gcgacaggagaua

SEQ ID NO: 3996425 - RNA, 12 nt, Human herpesvirus 6B
gcgacgagaguc

SEQ ID NO: 3996426 - RNA, 11 nt, Human herpesvirus 6B
gcgagaugcag

SEQ ID NO: 3996427 - RNA, 13 nt, Human herpesvirus 6B
gcgaugcggcagu

SEQ ID NO: 3996428 - RNA, 20 nt, Human herpesvirus 6B
gcgauuuugugaaaggugug

SEQ ID NO: 3996429 - RNA, 12 nt, Human herpesvirus 6B
gcgcagaaggag

SEQ ID NO: 3996430 - RNA, 14 nt, Human herpesvirus 6B
gcgcagcagcagcu

SEQ ID NO: 3996431 - RNA, 18 nt, Human herpesvirus 6B
gcgcaggcgaagguagga

SEQ ID NO: 3996432 - RNA, 14 nt, Human herpesvirus 6B
gcgcgcgcgcguug

SEQ ID NO: 3996433 - RNA, 16 nt, Human herpesvirus 6B
gcggacacgacaugug

SEQ ID NO: 3996434 - RNA, 17 nt, Human herpesvirus 6B
gcggagaggcgcgggac

SEQ ID NO: 3996435 - RNA, 22 nt, Human herpesvirus 6B
gcggaguuuuauggcuggguau

SEQ ID NO: 3996436 - RNA, 13 nt, Human herpesvirus 6B
ugcuugaaagagu

SEQ ID NO: 3996437 - RNA, 15 nt, Human herpesvirus 6B
ugcuuguuuuggugg

SEQ ID NO: 3996438 - RNA, 15 nt, Human herpesvirus 6B
ugcuuuuaguuucaa

SEQ ID NO: 3996439 - RNA, 14 nt, Human herpesvirus 6B
uggaagaaggaaaa

SEQ ID NO: 3996440 - RNA, 14 nt, Human herpesvirus 6B
uggauauguaucca

SEQ ID NO: 3996441 - RNA, 20 nt, Human herpesvirus 6B
uggaugucaagucuagacau

SEQ ID NO: 3996442 - RNA, 24 nt, Human herpesvirus 6B
uggcagccuaaacggagacugcac

SEQ ID NO: 3996443 - RNA, 21 nt, Human herpesvirus 6B
uggcgcuuguaggagcacgag

SEQ ID NO: 3996444 - RNA, 18 nt, Human herpesvirus 6B
uggcugggcgcagaagga

SEQ ID NO: 3996445 - RNA, 21 nt, Human herpesvirus 6B
ugggacuccgagccggacagg

SEQ ID NO: 3996446 - RNA, 15 nt, Human herpesvirus 6B
ugggaguaauuauug

SEQ ID NO: 3996447 - RNA, 21 nt, Human herpesvirus 6B
ugggcauuuuuuugaaaucac

SEQ ID NO: 3996448 - RNA, 20 nt, Human herpesvirus 6B
ugguguuguguuuguggaca

SEQ ID NO: 3996449 - RNA, 20 nt, Human herpesvirus 6B
ugguuugcuucgucaacaau

SEQ ID NO: 3996450 - RNA, 19 nt, Human herpesvirus 6B
ugguuuuucgauguuucca

SEQ ID NO: 3996451 - RNA, 21 nt, Human herpesvirus 6B
ugguuuuucgauguuuccagg

SEQ ID NO: 3996452 - RNA, 23 nt, Human herpesvirus 6B
uguaaagaucacaacaaacaugu

SEQ ID NO: 3996453 - RNA, 19 nt, Human herpesvirus 6B
uguaagguuucuaaaucug

SEQ ID NO: 3996454 - RNA, 18 nt, Human herpesvirus 6B
uguaauaguauugucuga

SEQ ID NO: 3996455 - RNA, 15 nt, Human herpesvirus 6B
uguaauuuugaaauu

SEQ ID NO: 3996456 - RNA, 18 nt, Human herpesvirus 6B
uguagauccuguuauucu

SEQ ID NO: 3996457 - RNA, 15 nt, Human herpesvirus 6B
uguaguuaguuuuga

SEQ ID NO: 3996458 - RNA, 16 nt, Human herpesvirus 6B
uguauaaggauggaua

SEQ ID NO: 3996459 - RNA, 14 nt, Human herpesvirus 6B
ugucacaauaauua

SEQ ID NO: 3996460 - RNA, 21 nt, Human herpesvirus 6B
ugucgcugacgcaauacguaa

SEQ ID NO: 3996461 - RNA, 19 nt, Human herpesvirus 6B
ugucgguaaauauugucug

SEQ ID NO: 3996462 - RNA, 17 nt, Human herpesvirus 6B
ugucuucauucuucgaa

SEQ ID NO: 3996463 - RNA, 21 nt, Human herpesvirus 6B
ugugaaguucgauguuauugu

SEQ ID NO: 3996464 - RNA, 19 nt, Human herpesvirus 6B
ugugaggugauuugaacag

SEQ ID NO: 3996465 - RNA, 20 nt, Human herpesvirus 6B
ugugaggugauuugaacaga

SEQ ID NO: 3996466 - RNA, 20 nt, Human herpesvirus 6B
ugugauuccuucggggacag

SEQ ID NO: 3996467 - RNA, 16 nt, Human herpesvirus 6B
ugugcacgaauaagga

SEQ ID NO: 3996468 - RNA, 13 nt, Human herpesvirus 6B
uguguugaagaac

SEQ ID NO: 3996469 - RNA, 17 nt, Human herpesvirus 6B
uguuaugcaguuguacu

SEQ ID NO: 3996470 - RNA, 16 nt, Human herpesvirus 6B
uguuccgaaaacuuua

SEQ ID NO: 3996471 - RNA, 16 nt, Human herpesvirus 6B
uguucgagcaacaguu

SEQ ID NO: 3996472 - RNA, 18 nt, Human herpesvirus 6B
uguucgcuugugucaugu

SEQ ID NO: 3996473 - RNA, 15 nt, Human herpesvirus 6B
uguucuuugaugaag

SEQ ID NO: 3996474 - RNA, 15 nt, Human herpesvirus 6B
uguuguucuuggaga

SEQ ID NO: 3996475 - RNA, 19 nt, Human herpesvirus 6B
uguuuauugcuuuuguuau

SEQ ID NO: 3996476 - RNA, 23 nt, Human herpesvirus 6B
uguuucuuugacauuuaccagag

SEQ ID NO: 3996477 - RNA, 20 nt, Human herpesvirus 6B
uguuugaaacguugugcuga

SEQ ID NO: 3996478 - RNA, 14 nt, Human herpesvirus 6B
uguuugauuuucag

SEQ ID NO: 3996479 - RNA, 16 nt, Human herpesvirus 6B
uguuuucauucugcua

SEQ ID NO: 3996480 - RNA, 21 nt, Human herpesvirus 6B
uguuuuguaggacugaaggag

SEQ ID NO: 3996481 - RNA, 12 nt, Human herpesvirus 6B
uguuuuugcuac

SEQ ID NO: 3996482 - RNA, 21 nt, Human herpesvirus 6B
uuaaaaaugauaacuguuuuu

SEQ ID NO: 3996483 - RNA, 22 nt, Human herpesvirus 6B
uuaaaagggaagucaaggaaac

SEQ ID NO: 3996484 - RNA, 16 nt, Human herpesvirus 6B
uuaaagaaucugcaga

SEQ ID NO: 3996485 - RNA, 16 nt, Human herpesvirus 6B
uuaacugggaaaucug

SEQ ID NO: 3996486 - RNA, 14 nt, Human herpesvirus 6B
uuaacuguuucuuc

SEQ ID NO: 3996487 - RNA, 19 nt, Human herpesvirus 6B
uuaagaugucgcuguuuuu

SEQ ID NO: 3996488 - RNA, 20 nt, Human herpesvirus 6B
uuaagcaacugauuaagauu

SEQ ID NO: 3996489 - RNA, 14 nt, Human herpesvirus 6B
uuaauaucugucaa

SEQ ID NO: 3996490 - RNA, 15 nt, Human herpesvirus 6B
uuacaacugaaacuc

SEQ ID NO: 3996491 - RNA, 15 nt, Human herpesvirus 6B
uuacaagggaaaucc

SEQ ID NO: 3996492 - RNA, 12 nt, Human herpesvirus 6B
uuacagaugucu

SEQ ID NO: 3996493 - RNA, 14 nt, Human herpesvirus 6B
uuacauaacauaga

SEQ ID NO: 3996494 - RNA, 23 nt, Human herpesvirus 6B
uuacauaacauagaaaaauaaga

SEQ ID NO: 3996495 - RNA, 23 nt, Human herpesvirus 6B
uuacaucaacuauuuaacaucca

SEQ ID NO: 3996496 - RNA, 17 nt, Human herpesvirus 6B
uuacaugaaaacauuca

SEQ ID NO: 3996497 - RNA, 15 nt, Human herpesvirus 6B
uuaccaagaaaucac

SEQ ID NO: 3996498 - RNA, 17 nt, Human herpesvirus 6B
uuacggcgcgaaacaug

SEQ ID NO: 3996499 - RNA, 13 nt, Human herpesvirus 6B
uuacggggaagau

SEQ ID NO: 3996500 - RNA, 14 nt, Human herpesvirus 6B
uuacgucuuuggac

SEQ ID NO: 3996501 - RNA, 11 nt, Human herpesvirus 6B
uuacuguuuug

SEQ ID NO: 3996502 - RNA, 18 nt, Human herpesvirus 6B
uuacuuuguggaaaucua

SEQ ID NO: 3996503 - RNA, 22 nt, Human herpesvirus 6B
uuagaaauguugccuuuguaaa

SEQ ID NO: 3996504 - RNA, 19 nt, Human herpesvirus 6B
uuagacagcugcauuauua

SEQ ID NO: 3996505 - RNA, 15 nt, Human herpesvirus 6B
uuagaucuucuucag

SEQ ID NO: 3996506 - RNA, 13 nt, Human herpesvirus 6B
uuaggauguuugg

SEQ ID NO: 3996507 - RNA, 15 nt, Human herpesvirus 6B
uuaguaauuuggauu

SEQ ID NO: 3996508 - RNA, 19 nt, Human herpesvirus 6B
uuauaaauucucugcaugu

SEQ ID NO: 3996509 - RNA, 16 nt, Human herpesvirus 6B
uuauaagauuuacaga

SEQ ID NO: 3996510 - RNA, 14 nt, Human herpesvirus 6B
uuauacgaaaauaa

SEQ ID NO: 3996511 - RNA, 16 nt, Human herpesvirus 6B
uuaugacugacaaggu

SEQ ID NO: 3996512 - RNA, 19 nt, Human herpesvirus 6B
uuaugcaacugcauuuucu

SEQ ID NO: 3996513 - RNA, 14 nt, Human herpesvirus 6B
uuauguauguguua

SEQ ID NO: 3996514 - RNA, 16 nt, Human herpesvirus 6B
uuaugugaauucugug

SEQ ID NO: 3996515 - RNA, 15 nt, Human herpesvirus 6B
uuauuauguuuuuac

SEQ ID NO: 3996516 - RNA, 15 nt, Human herpesvirus 6B
uuauucuacugugca

SEQ ID NO: 3996517 - RNA, 14 nt, Human herpesvirus 6B
uuauuuucuguauu

SEQ ID NO: 3996518 - RNA, 15 nt, Human herpesvirus 6B
uucaaaaucugcuaa

SEQ ID NO: 3996519 - RNA, 19 nt, Human herpesvirus 6B
uucaaaauuuuucuguaag

SEQ ID NO: 3996520 - RNA, 15 nt, Human herpesvirus 6B
uucaaagugaauucc

SEQ ID NO: 3996521 - RNA, 13 nt, Human herpesvirus 6B
uucaauagcaguu

SEQ ID NO: 3996522 - RNA, 19 nt, Human herpesvirus 6B
uucaauagcaguugucugc

SEQ ID NO: 3996523 - RNA, 20 nt, Human herpesvirus 6B
uugacugugaaaagugcuuu

SEQ ID NO: 3996524 - RNA, 13 nt, Human herpesvirus 6B
uugagaaaacaug

SEQ ID NO: 3996525 - RNA, 22 nt, Human herpesvirus 6B
uugcagaacgagacuggacagu

SEQ ID NO: 3996526 - RNA, 9 nt, Human herpesvirus 6B
uugcagugg

SEQ ID NO: 3996527 - RNA, 13 nt, Human herpesvirus 6B
uugcauggcaugu

SEQ ID NO: 3996528 - RNA, 14 nt, Human herpesvirus 6B
uugcugguuugcuu

SEQ ID NO: 3996529 - RNA, 15 nt, Human herpesvirus 6B
uugguauaagaaaga

SEQ ID NO: 3996530 - RNA, 16 nt, Human herpesvirus 6B
uugucauucugcauuu

SEQ ID NO: 3996531 - RNA, 18 nt, Human herpesvirus 6B
uuguccuauguuaacauu

SEQ ID NO: 3996532 - RNA, 20 nt, Human herpesvirus 6B
uuguuacuuucauaacaagu

SEQ ID NO: 3996533 - RNA, 19 nt, Human herpesvirus 6B
uuguuccacgguggauuau

SEQ ID NO: 3996534 - RNA, 12 nt, Human herpesvirus 6B
uuguucuuggag

SEQ ID NO: 3996535 - RNA, 22 nt, Human herpesvirus 6B
uuuaaugacguaugauuuucaa

SEQ ID NO: 3996536 - RNA, 15 nt, Human herpesvirus 6B
uuuaccuuuuugcug

SEQ ID NO: 3996537 - RNA, 16 nt, Human herpesvirus 6B
uuuacgcggcugauau

SEQ ID NO: 3996538 - RNA, 15 nt, Human herpesvirus 6B
uuuacgggauaaaga

SEQ ID NO: 3996539 - RNA, 19 nt, Human herpesvirus 6B
uuuacucgugugucucugu

SEQ ID NO: 3996540 - RNA, 13 nt, Human herpesvirus 6B
uuuacuguuuuga

SEQ ID NO: 3996541 - RNA, 23 nt, Human herpesvirus 6B
uuuaucccaaaauauaauucuga

SEQ ID NO: 3996542 - RNA, 14 nt, Human herpesvirus 6B
uuuaucgugcuugu

SEQ ID NO: 3996543 - RNA, 19 nt, Human herpesvirus 6B
uuucaaaaugaccagagau

SEQ ID NO: 3996544 - RNA, 14 nt, Human herpesvirus 6B
uuucauucaaugag

SEQ ID NO: 3996545 - RNA, 23 nt, Human herpesvirus 6B
uuuccauugcucuuuccacacua

SEQ ID NO: 3996546 - RNA, 14 nt, Human herpesvirus 6B
uuucguccauccag

SEQ ID NO: 3996547 - RNA, 22 nt, Human herpesvirus 6B
uuucuaaaacccggagaaucua

SEQ ID NO: 3996548 - RNA, 20 nt, Human herpesvirus 6B
uuucuaaaucugaaauguag

SEQ ID NO: 3996549 - RNA, 23 nt, Human herpesvirus 6B
uuucuagacaugagcgagaaugu

SEQ ID NO: 3996550 - RNA, 16 nt, Human herpesvirus 6B
uuugaucccuaauacu

SEQ ID NO: 3996551 - RNA, 22 nt, Human herpesvirus 6B
uuugccaccagauaggaaaagg

SEQ ID NO: 3996552 - RNA, 23 nt, Human herpesvirus 6B
uuugcccauugcagguuggcgcu

SEQ ID NO: 3996553 - RNA, 12 nt, Human herpesvirus 6B
uuuggcagaauc

SEQ ID NO: 3996554 - RNA, 19 nt, Human herpesvirus 6B
uuuguccuauguuaacauu

SEQ ID NO: 3996555 - RNA, 13 nt, Human herpesvirus 6B
uuuguuucugaaa

SEQ ID NO: 3996556 - RNA, 21 nt, Human herpesvirus 6B
uuuuacggaggaauggaagac

SEQ ID NO: 3996557 - RNA, 13 nt, Human herpesvirus 6B
uuuuaugcaagac

SEQ ID NO: 3996558 - RNA, 19 nt, Human herpesvirus 6B
uuuucacggaacaucaaaa

SEQ ID NO: 3996559 - RNA, 16 nt, Human herpesvirus 6B
uuuuccaacuuaauaa

SEQ ID NO: 3996560 - RNA, 23 nt, Human herpesvirus 6B
uuuucugcaaaacaaaaguagca

SEQ ID NO: 3996561 - RNA, 22 nt, Human herpesvirus 6B
uuuugcagaaugaauguaacug

SEQ ID NO: 3996562 - RNA, 19 nt, Human herpesvirus 6B
uuuuggaaaauguaaacac

SEQ ID NO: 3996563 - RNA, 12 nt, Human herpesvirus 6B
uuuuggugaaaa

SEQ ID NO: 3996564 - RNA, 16 nt, Human herpesvirus 6B
uuuuuaauccauauuu

SEQ ID NO: 3996565 - RNA, 17 nt, Human herpesvirus 6B
uuuuucuucaggugucu

SEQ ID NO: 3996566 - RNA, 17 nt, Human herpesvirus 6B
uuuuuggcauauacaaa

SEQ ID NO: 3996567 - RNA, 18 nt, Human herpesvirus 6B
uuuuuggcauauacaaaa

SEQ ID NO: 3996568 - RNA, 12 nt, Human herpesvirus 6B
uuuuuguuugac

SEQ ID NO: 3996569 - RNA, 12 nt, Human herpesvirus 6B
cgcccguucccg

SEQ ID NO: 3996570 - RNA, 19 nt, Human herpesvirus 6B
cgccgccuucucugucgcu

SEQ ID NO: 3996571 - RNA, 22 nt, Human herpesvirus 6B
cgccguccauuuaaccuccggc

SEQ ID NO: 3996572 - RNA, 18 nt, Human herpesvirus 6B
cgccgucgucgcucuccc

SEQ ID NO: 3996573 - RNA, 13 nt, Human herpesvirus 6B
cgcgccacagcgg

SEQ ID NO: 3996574 - RNA, 15 nt, Human herpesvirus 6B
cgcgccgugacacgg

SEQ ID NO: 3996575 - RNA, 20 nt, Human herpesvirus 6B
cgcggccgucgcgcucgccg

SEQ ID NO: 3996576 - RNA, 18 nt, Human herpesvirus 6B
cgcggcgacgucgcggcc

SEQ ID NO: 3996577 - RNA, 17 nt, Human herpesvirus 7
gauacauuuuugcaaua

SEQ ID NO: 3996578 - RNA, 20 nt, Human herpesvirus 7
gauagcauuagagcauauuc

SEQ ID NO: 3996579 - RNA, 23 nt, Human herpesvirus 7
gauauaaaguuuauauuuucuau

SEQ ID NO: 3996580 - RNA, 17 nt, Human herpesvirus 7
gauauaguuuguuucaa

SEQ ID NO: 3996581 - RNA, 16 nt, Human herpesvirus 7
gauaucuuaaaauaug

SEQ ID NO: 3996582 - RNA, 15 nt, Human herpesvirus 7
gauaugaauuugaaa

SEQ ID NO: 3996583 - RNA, 13 nt, Human herpesvirus 7
gauauuaguuuca

SEQ ID NO: 3996584 - RNA, 14 nt, Human herpesvirus 7
gauauuauuaaaaa

SEQ ID NO: 3996585 - RNA, 16 nt, Human herpesvirus 7
gauauuguacuucugu

SEQ ID NO: 3996586 - RNA, 19 nt, Human herpesvirus 7
gauauuguacuucuguguu

SEQ ID NO: 3996587 - RNA, 18 nt, Human herpesvirus 7
gaucaaaagcugcagcug

SEQ ID NO: 3996588 - RNA, 20 nt, Human herpesvirus 7
gauccaucuguaacagaccu

SEQ ID NO: 3996589 - RNA, 17 nt, Human herpesvirus 7
gaucguagcaacagaga

SEQ ID NO: 3996590 - RNA, 23 nt, Human herpesvirus 7
gaucguguguuacuauuugacug

SEQ ID NO: 3996591 - RNA, 16 nt, Human herpesvirus 7
gaucuacauauacuuu

SEQ ID NO: 3996592 - RNA, 20 nt, Human herpesvirus 7
gaugacaacaaagcaugaaa

SEQ ID NO: 3996593 - RNA, 17 nt, Human herpesvirus 7
gaugcauccaaagaaaa

SEQ ID NO: 3996594 - RNA, 17 nt, Human herpesvirus 7
gauguauaaaucagaau

SEQ ID NO: 3996595 - RNA, 15 nt, Human herpesvirus 7
gaugucaaccuuuua

SEQ ID NO: 3996596 - RNA, 13 nt, Human herpesvirus 7
gauguguuggaaa

SEQ ID NO: 3996597 - RNA, 15 nt, Human herpesvirus 7
gauguuacccaaaau

SEQ ID NO: 3996598 - RNA, 21 nt, Human herpesvirus 7
gauuaaaaacccuuuauucau

SEQ ID NO: 3996599 - RNA, 14 nt, Human herpesvirus 7
gauuagcuuucagc

SEQ ID NO: 3996600 - RNA, 19 nt, Human herpesvirus 7
gauucacauugucacugca

SEQ ID NO: 3996601 - RNA, 13 nt, Human herpesvirus 7
gauuccaaagagc

SEQ ID NO: 3996602 - RNA, 17 nt, Human herpesvirus 7
gauugaucacuuugcau

SEQ ID NO: 3996603 - RNA, 17 nt, Human herpesvirus 7
gauuucagaauuuccag

SEQ ID NO: 3996604 - RNA, 20 nt, Human herpesvirus 7
gauuuuaaaagguugacauc

SEQ ID NO: 3996605 - RNA, 23 nt, Human herpesvirus 7
gauuuuuuaaaugugucuuacaa

SEQ ID NO: 3996606 - RNA, 17 nt, Human herpesvirus 7
gcaaauccuauaaaagc

SEQ ID NO: 3996607 - RNA, 18 nt, Human herpesvirus 7
gcaaauccuauaaaagca

SEQ ID NO: 3996608 - RNA, 14 nt, Human herpesvirus 7
gcaaaucugaaaau

SEQ ID NO: 3996609 - RNA, 16 nt, Human herpesvirus 7
gcaaauuaaaaauauu

SEQ ID NO: 3996610 - RNA, 14 nt, Human herpesvirus 7
gcaacaaacaaaua

SEQ ID NO: 3996611 - RNA, 22 nt, Human herpesvirus 7
gcaacaaacaaauaauucaaaa

SEQ ID NO: 3996612 - RNA, 14 nt, Human herpesvirus 7
gcaacaaauguuua

SEQ ID NO: 3996613 - RNA, 15 nt, Human herpesvirus 7
gcaacagagaacacc

SEQ ID NO: 3996614 - RNA, 14 nt, Human herpesvirus 7
gcaacauuaauaaa

SEQ ID NO: 3996615 - RNA, 21 nt, Human herpesvirus 7
gcaacuggcauuccuuggaaa

SEQ ID NO: 3996616 - RNA, 19 nt, Human herpesvirus 7
gcaacugugcaugaaaucu

SEQ ID NO: 3996617 - RNA, 19 nt, Human herpesvirus 7
gcaacuuugugccugaaau

SEQ ID NO: 3996618 - RNA, 15 nt, Human herpesvirus 7
gcaauuaauucaguu

SEQ ID NO: 3996619 - RNA, 15 nt, Human herpesvirus 7
gcacacuaaaaaaga

SEQ ID NO: 3996620 - RNA, 20 nt, Human herpesvirus 7
gcacugggagcaaugcauga

SEQ ID NO: 3996621 - RNA, 14 nt, Human herpesvirus 7
gcagacaccgucau

SEQ ID NO: 3996622 - RNA, 16 nt, Human herpesvirus 7
gcagacauugaagauu

SEQ ID NO: 3996623 - RNA, 16 nt, Human herpesvirus 7
gcagaccguaaaacaa

SEQ ID NO: 3996624 - RNA, 16 nt, Human herpesvirus 7
gcagauuguagagaau

SEQ ID NO: 3996625 - RNA, 21 nt, Human herpesvirus 7
gcaguacuacuaaucaugaaa

SEQ ID NO: 3996626 - RNA, 18 nt, Human herpesvirus 7
gcaguauucuuaugccag

SEQ ID NO: 3996627 - RNA, 13 nt, Human herpesvirus 7
gcauaaagcacca

SEQ ID NO: 3996628 - RNA, 13 nt, Human herpesvirus 7
gcauauaugaauc

SEQ ID NO: 3996629 - RNA, 15 nt, Human herpesvirus 7
gcauauaugaaucaa

SEQ ID NO: 3996630 - RNA, 16 nt, Human herpesvirus 7
gcauaucaugauuaua

SEQ ID NO: 3996631 - RNA, 13 nt, Human herpesvirus 7
gcauauugaagau

SEQ ID NO: 3996632 - RNA, 21 nt, Human herpesvirus 7
gcauauugaagaucaacaaau

SEQ ID NO: 3996633 - RNA, 23 nt, Human herpesvirus 7
gcaucaaaacauaucagauuuua

SEQ ID NO: 3996634 - RNA, 16 nt, Human herpesvirus 7
gcaugaaaucuugaau

SEQ ID NO: 3996635 - RNA, 15 nt, Human herpesvirus 7
gcaugcuuacaguga

SEQ ID NO: 3996636 - RNA, 21 nt, Human herpesvirus 7
gcauugcuuuuagaaaaucaa

SEQ ID NO: 3996637 - RNA, 21 nt, Human herpesvirus 7
gcauuugguaaaaaaaaugga

SEQ ID NO: 3996638 - RNA, 13 nt, Human herpesvirus 7
gcauuuguuacag

SEQ ID NO: 3996639 - RNA, 19 nt, Human herpesvirus 7
gcauuuuguauuaaaggaa

SEQ ID NO: 3996640 - RNA, 17 nt, Human herpesvirus 7
gccaacguugagaaaac

SEQ ID NO: 3996641 - RNA, 13 nt, Human herpesvirus 7
gccaauaaaaauc

SEQ ID NO: 3996642 - RNA, 16 nt, Human herpesvirus 7
gccaauaaaucuucau

SEQ ID NO: 3996643 - RNA, 12 nt, Human herpesvirus 7
gccaauugaaga

SEQ ID NO: 3996644 - RNA, 22 nt, Human herpesvirus 7
gccacagauauucuaacaaaua

SEQ ID NO: 3996645 - RNA, 15 nt, Human herpesvirus 7
gccauaaaugcuuaa

SEQ ID NO: 3996646 - RNA, 13 nt, Human herpesvirus 7
gccgacaagaaac

SEQ ID NO: 3996647 - RNA, 19 nt, Human herpesvirus 7
gccgcugccuucgcucugu

SEQ ID NO: 3996648 - RNA, 15 nt, Human herpesvirus 7
gccuguuaaaaguga

SEQ ID NO: 3996649 - RNA, 22 nt, Human herpesvirus 7
gcuaaaauuuugaaauaaagga

SEQ ID NO: 3996650 - RNA, 21 nt, Human herpesvirus 7
gcuaagaaagaacauuuuucu

SEQ ID NO: 3996651 - RNA, 21 nt, Human herpesvirus 7
gcuaauugagaaauuuuacag

SEQ ID NO: 3996652 - RNA, 18 nt, Human herpesvirus 7
gcuaugacuuugaaucaa

SEQ ID NO: 3996653 - RNA, 20 nt, Human herpesvirus 7
gcucaaaacuugccauccaa

SEQ ID NO: 3996654 - RNA, 22 nt, Human herpesvirus 7
gcucagcuagaauguguagauu

SEQ ID NO: 3996655 - RNA, 15 nt, Human herpesvirus 7
gcucugaaaaaaucu

SEQ ID NO: 3996656 - RNA, 19 nt, Human herpesvirus 7
gcucugucuccaaaucaaa

SEQ ID NO: 3996657 - RNA, 20 nt, Human herpesvirus 7
gcugaaacucaucauugaag

SEQ ID NO: 3996658 - RNA, 18 nt, Human herpesvirus 7
gcugauuauucaugcaga

SEQ ID NO: 3996659 - RNA, 20 nt, Human herpesvirus 7
gcugauuccuucuaaauucu

SEQ ID NO: 3996660 - RNA, 16 nt, Human herpesvirus 7
gcuuacucuuucugac

SEQ ID NO: 3996661 - RNA, 21 nt, Human herpesvirus 7
gcuugcauugcauaucaugau

SEQ ID NO: 3996662 - RNA, 17 nt, Human herpesvirus 7
gcuuguuaaagaaaagc

SEQ ID NO: 3996663 - RNA, 19 nt, Human herpesvirus 7
gcuuuagaguaugaguuug

SEQ ID NO: 3996664 - RNA, 19 nt, Human herpesvirus 7
gcuuugaucuacauauacu

SEQ ID NO: 3996665 - RNA, 16 nt, Human herpesvirus 7
ggaaaauuucauuuaa

SEQ ID NO: 3996666 - RNA, 16 nt, Human herpesvirus 7
ggaaagcucauuucau

SEQ ID NO: 3996667 - RNA, 18 nt, Human herpesvirus 7
ggaaaugagauuucugaa

SEQ ID NO: 3996668 - RNA, 14 nt, Human herpesvirus 7
ggaaccgagaaugu

SEQ ID NO: 3996669 - RNA, 16 nt, Human herpesvirus 7
ggaaccguuugcagcc

SEQ ID NO: 3996670 - RNA, 14 nt, Human herpesvirus 7
ggaaugcaucugaa

SEQ ID NO: 3996671 - RNA, 14 nt, Human herpesvirus 7
ggacauuuguugug

SEQ ID NO: 3996672 - RNA, 17 nt, Human herpesvirus 7
ggagaaggaaaauuaua

SEQ ID NO: 3996673 - RNA, 13 nt, Human herpesvirus 7
ggagagauucaaa

SEQ ID NO: 3996674 - RNA, 23 nt, Human herpesvirus 7
ggaucaaaagcugcagcugaaag

SEQ ID NO: 3996675 - RNA, 13 nt, Human herpesvirus 7
ggcaaaaaacgua

SEQ ID NO: 3996676 - RNA, 12 nt, Human herpesvirus 7
ggcuucuucuaa

SEQ ID NO: 3996677 - RNA, 18 nt, Human herpesvirus 7
gggaaaaagcauaaagca

SEQ ID NO: 3996678 - RNA, 13 nt, Human herpesvirus 7
gggaaacaucuuu

SEQ ID NO: 3996679 - RNA, 18 nt, Human herpesvirus 7
gguaaagaaccuaucaaa

SEQ ID NO: 3996680 - RNA, 15 nt, Human herpesvirus 7
gguaauagcuuuaaa

SEQ ID NO: 3996681 - RNA, 21 nt, Human herpesvirus 7
gguaauuuuaaaacugaagca

SEQ ID NO: 3996682 - RNA, 13 nt, Human herpesvirus 7
gguuauuggaaau

SEQ ID NO: 3996683 - RNA, 21 nt, Human herpesvirus 7
guaaagauuuaacugauaauu

SEQ ID NO: 3996684 - RNA, 15 nt, Human herpesvirus 7
guaaaggaaauuagu

SEQ ID NO: 3996685 - RNA, 20 nt, Human herpesvirus 7
guaaauauuuuuaaaaucua

SEQ ID NO: 3996686 - RNA, 23 nt, Human herpesvirus 7
guaaaugaucagagaugaucuua

SEQ ID NO: 3996687 - RNA, 13 nt, Human herpesvirus 7
guaacagauuuua

SEQ ID NO: 3996688 - RNA, 17 nt, Human herpesvirus 7
guaaguuguuauagcca

SEQ ID NO: 3996689 - RNA, 15 nt, Human herpesvirus 7
guaaucauauaugca

SEQ ID NO: 3996690 - RNA, 16 nt, Human herpesvirus 7
guaauuuaugauuuuu

SEQ ID NO: 3996691 - RNA, 13 nt, Human herpesvirus 7
guacaaauguuuu

SEQ ID NO: 3996692 - RNA, 15 nt, Human herpesvirus 7
guacaacgacauuga

SEQ ID NO: 3996693 - RNA, 13 nt, Human herpesvirus 7
guacuaaagccaa

SEQ ID NO: 3996694 - RNA, 13 nt, Human herpesvirus 7
aaaaaaacaauga

SEQ ID NO: 3996695 - RNA, 19 nt, Human herpesvirus 7
aaaaacaugggauuucugu

SEQ ID NO: 3996696 - RNA, 11 nt, Human herpesvirus 7
aaaaaggaaaa

SEQ ID NO: 3996697 - RNA, 14 nt, Human herpesvirus 7
aaaaauaaacaaua

SEQ ID NO: 3996698 - RNA, 20 nt, Human herpesvirus 7
aaaaaucaguguaacucugc

SEQ ID NO: 3996699 - RNA, 14 nt, Human herpesvirus 7
aaaacgauccuaaa

SEQ ID NO: 3996700 - RNA, 15 nt, Human herpesvirus 7
aaaacgguauguaaa

SEQ ID NO: 3996701 - RNA, 14 nt, Human herpesvirus 7
aaaacguaaaacug

SEQ ID NO: 3996702 - RNA, 22 nt, Human herpesvirus 7
aaaacgugugaaaacaauuaag

SEQ ID NO: 3996703 - RNA, 13 nt, Human herpesvirus 7
aaaagaaaaucuc

SEQ ID NO: 3996704 - RNA, 22 nt, Human herpesvirus 7
aaaagaauggcgguuguacugu

SEQ ID NO: 3996705 - RNA, 23 nt, Human herpesvirus 7
aaaaggccguuuaugaacaaggu

SEQ ID NO: 3996706 - RNA, 17 nt, Human herpesvirus 7
aaaauaacuuuaaauua

SEQ ID NO: 3996707 - RNA, 22 nt, Human herpesvirus 7
aaaauacaauagugaacaugug

SEQ ID NO: 3996708 - RNA, 13 nt, Human herpesvirus 7
aaaauaugcaaaa

SEQ ID NO: 3996709 - RNA, 22 nt, Human herpesvirus 7
aaaauauguucagauugaaauu

SEQ ID NO: 3996710 - RNA, 18 nt, Human herpesvirus 7
aaaaucucagcucuguaa

SEQ ID NO: 3996711 - RNA, 20 nt, Human herpesvirus 7
aaaaucuuuaugugggauuu

SEQ ID NO: 3996712 - RNA, 19 nt, Human herpesvirus 7
aaaaugcccucagaacugu

SEQ ID NO: 3996713 - RNA, 17 nt, Human herpesvirus 7
aaaauguaaaauucgcu

SEQ ID NO: 3996714 - RNA, 18 nt, Human herpesvirus 7
aaaauuccaaaauguaaa

SEQ ID NO: 3996715 - RNA, 15 nt, Human herpesvirus 7
aaaauuugacauuug

SEQ ID NO: 3996716 - RNA, 13 nt, Human herpesvirus 7
aaacaaacaauga

SEQ ID NO: 3996717 - RNA, 14 nt, Human herpesvirus 7
aaacaauacaugaa

SEQ ID NO: 3996718 - RNA, 19 nt, Human herpesvirus 7
aaacacuugcuagcuguga

SEQ ID NO: 3996719 - RNA, 23 nt, Human herpesvirus 7
aaacagcgugucaaaaaaaaaac

SEQ ID NO: 3996720 - RNA, 15 nt, Human herpesvirus 7
aaacauguugaaaga

SEQ ID NO: 3996721 - RNA, 20 nt, Human herpesvirus 7
aaacauuguguuuuuuguaa

SEQ ID NO: 3996722 - RNA, 19 nt, Human herpesvirus 7
aaaccaaguuuuuugagau

SEQ ID NO: 3996723 - RNA, 16 nt, Human herpesvirus 7
aaacgguauguaaauu

SEQ ID NO: 3996724 - RNA, 15 nt, Human herpesvirus 7
aaacuguuuuuacuu

SEQ ID NO: 3996725 - RNA, 23 nt, Human herpesvirus 7
aaagaaaaaaucuuuauguggga

SEQ ID NO: 3996726 - RNA, 12 nt, Human herpesvirus 7
aaagaaaagcuu

SEQ ID NO: 3996727 - RNA, 14 nt, Human herpesvirus 7
aaagaccuguacug

SEQ ID NO: 3996728 - RNA, 22 nt, Human herpesvirus 7
aaagaccuguacuguugcuaau

SEQ ID NO: 3996729 - RNA, 22 nt, Human herpesvirus 7
aaagagaacgaugaauuuuucu

SEQ ID NO: 3996730 - RNA, 16 nt, Human herpesvirus 7
aaagcaacaaauguuu

SEQ ID NO: 3996731 - RNA, 16 nt, Human herpesvirus 7
aaagcugcauguguac

SEQ ID NO: 3996732 - RNA, 17 nt, Human herpesvirus 7
aaagcuuacucuuucug

SEQ ID NO: 3996733 - RNA, 13 nt, Human herpesvirus 7
aaagggggaaaga

SEQ ID NO: 3996734 - RNA, 18 nt, Human herpesvirus 7
aaaguaaaaacuuuucuu

SEQ ID NO: 3996735 - RNA, 22 nt, Human herpesvirus 7
aaaguauaacauugcuucagaa

SEQ ID NO: 3996736 - RNA, 21 nt, Human herpesvirus 7
aaaguauggaaaaauguuaug

SEQ ID NO: 3996737 - RNA, 23 nt, Human herpesvirus 7
aaauaaaaccauuuauugauguc

SEQ ID NO: 3996738 - RNA, 21 nt, Human herpesvirus 7
aaauaaaggaucucucuuucu

SEQ ID NO: 3996739 - RNA, 20 nt, Human herpesvirus 7
aaauaauaacaauuauagaa

SEQ ID NO: 3996740 - RNA, 15 nt, Human herpesvirus 7
aaauaauagaugucu

SEQ ID NO: 3996741 - RNA, 15 nt, Human herpesvirus 7
aaauauuuauuugcu

SEQ ID NO: 3996742 - RNA, 14 nt, Human herpesvirus 7
aaaucacuuagacu

SEQ ID NO: 3996743 - RNA, 18 nt, Human herpesvirus 7
aaaucagaaauguuacuu

SEQ ID NO: 3996744 - RNA, 13 nt, Human herpesvirus 7
aaauccaaaauca

SEQ ID NO: 3996745 - RNA, 12 nt, Human herpesvirus 7
aaaucuguaaaa

SEQ ID NO: 3996746 - RNA, 17 nt, Human herpesvirus 7
aaaugagauuucugaaa

SEQ ID NO: 3996747 - RNA, 14 nt, Human herpesvirus 7
aaaugaugauguau

SEQ ID NO: 3996748 - RNA, 19 nt, Human herpesvirus 7
aaaugggcguaacugugac

SEQ ID NO: 3996749 - RNA, 14 nt, Human herpesvirus 7
aaaugguugugcaa

SEQ ID NO: 3996750 - RNA, 16 nt, Human herpesvirus 7
aaauuaaaaauauuca

SEQ ID NO: 3996751 - RNA, 18 nt, Human herpesvirus 7
aaauuacacucuguuacu

SEQ ID NO: 3996752 - RNA, 14 nt, Human herpesvirus 7
aaauuaucggaaau

SEQ ID NO: 3996753 - RNA, 20 nt, Human herpesvirus 7
aaauuauuagauuccauuua

SEQ ID NO: 3996754 - RNA, 22 nt, Human herpesvirus 7
aaauucgcugaugaaaauauga

SEQ ID NO: 3996755 - RNA, 17 nt, Human herpesvirus 7
aaauucugcuugucucu

SEQ ID NO: 3996756 - RNA, 22 nt, Human herpesvirus 7
aaauucuggcucuuuacaaaau

SEQ ID NO: 3996757 - RNA, 13 nt, Human herpesvirus 7
aaauugaauagau

SEQ ID NO: 3996758 - RNA, 23 nt, Human herpesvirus 7
aaauugauccugcuauucauuuc

SEQ ID NO: 3996759 - RNA, 15 nt, Human herpesvirus 7
aaauuguaaguaaau

SEQ ID NO: 3996760 - RNA, 20 nt, Human herpesvirus 7
aaauuuuucgaucuguaaaa

SEQ ID NO: 3996761 - RNA, 14 nt, Human herpesvirus 7
aaauuuuuuacugu

SEQ ID NO: 3996762 - RNA, 11 nt, Human herpesvirus 7
gaaauuucaug

SEQ ID NO: 3996763 - RNA, 17 nt, Human herpesvirus 7
gaacaucccuggacaga

SEQ ID NO: 3996764 - RNA, 20 nt, Human herpesvirus 7
gaacaugacuucagaaaaac

SEQ ID NO: 3996765 - RNA, 14 nt, Human herpesvirus 7
gaaccugaaucaaa

SEQ ID NO: 3996766 - RNA, 21 nt, Human herpesvirus 7
gaacgacuccaacugaccaga

SEQ ID NO: 3996767 - RNA, 13 nt, Human herpesvirus 7
gaacuuuuaaaaa

SEQ ID NO: 3996768 - RNA, 19 nt, Human herpesvirus 7
gaacuuuuaaauuaaaaga

SEQ ID NO: 3996769 - RNA, 18 nt, Human herpesvirus 7
gaagaaucaagacgcugu

SEQ ID NO: 3996770 - RNA, 14 nt, Human herpesvirus 7
gaagauuugacaaa

SEQ ID NO: 3996771 - RNA, 21 nt, Human herpesvirus 7
gaagcgcugagaucuuccaau

SEQ ID NO: 3996772 - RNA, 18 nt, Human herpesvirus 7
gaaggcaucaagaaacaa

SEQ ID NO: 3996773 - RNA, 18 nt, Human herpesvirus 7
gaagguugucuguucuca

SEQ ID NO: 3996774 - RNA, 20 nt, Human herpesvirus 7
gaauagacacauuuauccau

SEQ ID NO: 3996775 - RNA, 20 nt, Human herpesvirus 7
gaauauuuauguucaaauau

SEQ ID NO: 3996776 - RNA, 14 nt, Human herpesvirus 7
gaaugcaucugaau

SEQ ID NO: 3996777 - RNA, 21 nt, Human herpesvirus 7
gaaugccaucuauaaacauuc

SEQ ID NO: 3996778 - RNA, 22 nt, Human herpesvirus 7
gaauggcgguuguacuguaauu

SEQ ID NO: 3996779 - RNA, 20 nt, Human herpesvirus 7
gaauucaacaccagucucug

SEQ ID NO: 3996780 - RNA, 15 nt, Human herpesvirus 7
gacaaacagaaaaac

SEQ ID NO: 3996781 - RNA, 17 nt, Human herpesvirus 7
gacaaauuaaacaaucu

SEQ ID NO: 3996782 - RNA, 15 nt, Human herpesvirus 7
gacaacgacuacagg

SEQ ID NO: 3996783 - RNA, 19 nt, Human herpesvirus 7
gacacuauuggacaaaaga

SEQ ID NO: 3996784 - RNA, 16 nt, Human herpesvirus 7
gacagcuguauaucua

SEQ ID NO: 3996785 - RNA, 18 nt, Human herpesvirus 7
gaccuaacaaaaaaauac

SEQ ID NO: 3996786 - RNA, 23 nt, Human herpesvirus 7
gaccucgacauucuccaguggca

SEQ ID NO: 3996787 - RNA, 18 nt, Human herpesvirus 7
gacgcuguaugcaagaaa

SEQ ID NO: 3996788 - RNA, 21 nt, Human herpesvirus 7
gacuuaucaccauaugccaau

SEQ ID NO: 3996789 - RNA, 14 nt, Human herpesvirus 7
gagcgcuuugcuua

SEQ ID NO: 3996790 - RNA, 19 nt, Human herpesvirus 7
gagcuugguuuuacaaauu

SEQ ID NO: 3996791 - RNA, 18 nt, Human herpesvirus 7
gaggauucggaaguaaac

SEQ ID NO: 3996792 - RNA, 15 nt, Human herpesvirus 7
gaguaaagauuuaac

SEQ ID NO: 3996793 - RNA, 22 nt, Human herpesvirus 7
gaguaucuccgugacaaagcau

SEQ ID NO: 3996794 - RNA, 15 nt, Human herpesvirus 7
gauaaugaaacuguu

SEQ ID NO: 3996795 - RNA, 19 nt, Human herpesvirus 7
gauacguuaguugcagcug

SEQ ID NO: 3996796 - RNA, 18 nt, Human herpesvirus 7
gauauauguguacagauu

SEQ ID NO: 3996797 - RNA, 17 nt, Human herpesvirus 7
gauauucuaacaaauac

SEQ ID NO: 3996798 - RNA, 20 nt, Human herpesvirus 7
gaucauagagaaaacauugu

SEQ ID NO: 3996799 - RNA, 18 nt, Human herpesvirus 7
gaucuaagucuacaucau

SEQ ID NO: 3996800 - RNA, 11 nt, Human herpesvirus 7
gaucuuguaau

SEQ ID NO: 3996801 - RNA, 20 nt, Human herpesvirus 7
gaugaauuaauucuuuccac

SEQ ID NO: 3996802 - RNA, 14 nt, Human herpesvirus 7
gaugacuuccaagu

SEQ ID NO: 3996803 - RNA, 15 nt, Human herpesvirus 7
gaugcauccaaagaa

SEQ ID NO: 3996804 - RNA, 21 nt, Human herpesvirus 7
gaugcauuuuuauugcaguuu

SEQ ID NO: 3996805 - RNA, 16 nt, Human herpesvirus 7
gauguauaaaucagaa

SEQ ID NO: 3996806 - RNA, 15 nt, Human herpesvirus 7
gauguuaaagaacaa

SEQ ID NO: 3996807 - RNA, 23 nt, Human herpesvirus 7
gauguuuggcaacaaacaaauaa

SEQ ID NO: 3996808 - RNA, 14 nt, Human herpesvirus 7
gauuagaaucagac

SEQ ID NO: 3996809 - RNA, 13 nt, Human herpesvirus 7
gauuauucaaaag

SEQ ID NO: 3996810 - RNA, 15 nt, Human herpesvirus 7
gauuccaaaccuauc

SEQ ID NO: 3996811 - RNA, 17 nt, Human herpesvirus 7
gauuccaaagagccucc

SEQ ID NO: 3996812 - RNA, 21 nt, Human herpesvirus 7
gauuguagagaauauuuauca

SEQ ID NO: 3996813 - RNA, 23 nt, Human herpesvirus 7
gauuguauuugucucugugcauu

SEQ ID NO: 3996814 - RNA, 17 nt, Human herpesvirus 7
gauuguuuaauuaacca

SEQ ID NO: 3996815 - RNA, 15 nt, Human herpesvirus 7
gauuuacauuucauu

SEQ ID NO: 3996816 - RNA, 17 nt, Human herpesvirus 7
gauuuagauuuaaaaca

SEQ ID NO: 3996817 - RNA, 16 nt, Human herpesvirus 7
gauuucagaauuucca

SEQ ID NO: 3996818 - RNA, 22 nt, Human herpesvirus 7
gauuucauguuuuaugacucag

SEQ ID NO: 3996819 - RNA, 23 nt, Human herpesvirus 7
gauuuuaguuccacgucaaucac

SEQ ID NO: 3996820 - RNA, 15 nt, Human herpesvirus 7
gcaaaagccacugau

SEQ ID NO: 3996821 - RNA, 20 nt, Human herpesvirus 7
gcaaagcuuuugcgagaaaa

SEQ ID NO: 3996822 - RNA, 21 nt, Human herpesvirus 7
gcaaagucucauucaugcaca

SEQ ID NO: 3996823 - RNA, 11 nt, Human herpesvirus 7
gcaacuucuga

SEQ ID NO: 3996824 - RNA, 17 nt, Human herpesvirus 7
gcaauaugcuagaagac

SEQ ID NO: 3996825 - RNA, 16 nt, Human herpesvirus 7
gcaauuuuagauuuua

SEQ ID NO: 3996826 - RNA, 22 nt, Human herpesvirus 7
gcacuugcucugugaaacaaug

SEQ ID NO: 3996827 - RNA, 15 nt, Human herpesvirus 7
gcagaaugcguaacu

SEQ ID NO: 3996828 - RNA, 17 nt, Human herpesvirus 7
gcagauuuggggucuga

SEQ ID NO: 3996829 - RNA, 18 nt, Human herpesvirus 7
gcagcaucccuauugcau

SEQ ID NO: 3996830 - RNA, 15 nt, Human herpesvirus 7
gcagguaaguauaaa

SEQ ID NO: 3996831 - RNA, 17 nt, Human herpesvirus 7
gcaguacuacuaaucau

SEQ ID NO: 3996832 - RNA, 16 nt, Human herpesvirus 7
gcaucaaaacauauca

SEQ ID NO: 3996833 - RNA, 15 nt, Human herpesvirus 7
gcaucaagaaacaag

SEQ ID NO: 3996834 - RNA, 22 nt, Human herpesvirus 7
gcaugcaaaaaacaguggaaaa

SEQ ID NO: 3996835 - RNA, 15 nt, Human herpesvirus 7
gcaugcuugcuuugc

SEQ ID NO: 3996836 - RNA, 20 nt, Human herpesvirus 7
gcauggaucguagcaacaga

SEQ ID NO: 3996837 - RNA, 12 nt, Human herpesvirus 7
gccaaugaacaa

SEQ ID NO: 3996838 - RNA, 13 nt, Human herpesvirus 7
gccacugauuuuu

SEQ ID NO: 3996839 - RNA, 23 nt, Human herpesvirus 7
gccacuguugaugauuuaauaua

SEQ ID NO: 3996840 - RNA, 22 nt, Human herpesvirus 7
gccagaucguucauugauuaua

SEQ ID NO: 3996841 - RNA, 20 nt, Human herpesvirus 7
gccaguucuaucucaaaaca

SEQ ID NO: 3996842 - RNA, 16 nt, Human herpesvirus 7
gcccugaauuuuacac

SEQ ID NO: 3996843 - RNA, 15 nt, Human herpesvirus 7
gccgccaaacuaugu

SEQ ID NO: 3996844 - RNA, 20 nt, Human herpesvirus 7
gccugaagagauuaagguga

SEQ ID NO: 3996845 - RNA, 22 nt, Human herpesvirus 7
gcgaaaaacacuuuaaccgcaa

SEQ ID NO: 3996846 - RNA, 19 nt, Human herpesvirus 7
gcgaaagccacuguugaug

SEQ ID NO: 3996847 - RNA, 21 nt, Human herpesvirus 7
gcgacauuauaaaagauggaa

SEQ ID NO: 3996848 - RNA, 18 nt, Human herpesvirus 7
gcgcuuggcaaacagucu

SEQ ID NO: 3996849 - RNA, 13 nt, Human herpesvirus 7
gcggcucucuguu

SEQ ID NO: 3996850 - RNA, 14 nt, Human herpesvirus 7
gcuaugacuuugaa

SEQ ID NO: 3996851 - RNA, 15 nt, Human herpesvirus 7
gcucucagauuagcu

SEQ ID NO: 3996852 - RNA, 22 nt, Human herpesvirus 7
gcugaaacucaucauugaagaa

SEQ ID NO: 3996853 - RNA, 13 nt, Human herpesvirus 7
gcugaaauuucau

SEQ ID NO: 3996854 - RNA, 14 nt, Human herpesvirus 7
gcugcaucuuuuca

SEQ ID NO: 3996855 - RNA, 17 nt, Human herpesvirus 7
gcuguguccacuacaga

SEQ ID NO: 3996856 - RNA, 12 nt, Human herpesvirus 7
gcuguucaaaau

SEQ ID NO: 3996857 - RNA, 18 nt, Human herpesvirus 7
gcuucagaaauaacaaaa

SEQ ID NO: 3996858 - RNA, 20 nt, Human herpesvirus 7
gcuucauuuuaaaaaagaca

SEQ ID NO: 3996859 - RNA, 16 nt, Human herpesvirus 7
gcuucuauuauagaag

SEQ ID NO: 3996860 - RNA, 14 nt, Human herpesvirus 7
gcuugaugaaucaa

SEQ ID NO: 3996861 - RNA, 20 nt, Human herpesvirus 7
gcuugguuuuacaaauuaaa

SEQ ID NO: 3996862 - RNA, 15 nt, Human herpesvirus 7
gcuugucucugucca

SEQ ID NO: 3996863 - RNA, 23 nt, Human herpesvirus 7
gcuuucuaaguacuucuggcuua

SEQ ID NO: 3996864 - RNA, 20 nt, Human herpesvirus 7
ggaaacaaauuguggagaga

SEQ ID NO: 3996865 - RNA, 19 nt, Human herpesvirus 7
ggaaacauugaaaaagcag

SEQ ID NO: 3996866 - RNA, 15 nt, Human herpesvirus 7
ggaaugauauaaagu

SEQ ID NO: 3996867 - RNA, 17 nt, Human herpesvirus 7
ggacuugauaauguuuc

SEQ ID NO: 3996868 - RNA, 23 nt, Human herpesvirus 7
ggaugcacugauaaucaagaaac

SEQ ID NO: 3996869 - RNA, 18 nt, Human herpesvirus 7
ggauuucuucuucuaaau

SEQ ID NO: 3996870 - RNA, 23 nt, Human herpesvirus 7
ggauuugaaugaacaaauaauga

SEQ ID NO: 3996871 - RNA, 14 nt, Human herpesvirus 7
ucucuaugauccag

SEQ ID NO: 3996872 - RNA, 13 nt, Human herpesvirus 7
ucucucacacuca

SEQ ID NO: 3996873 - RNA, 19 nt, Human herpesvirus 7
ucugaaauaaacauuucaa

SEQ ID NO: 3996874 - RNA, 13 nt, Human herpesvirus 7
ucugaauaaaagu

SEQ ID NO: 3996875 - RNA, 17 nt, Human herpesvirus 7
ucugauuuauauagcaa

SEQ ID NO: 3996876 - RNA, 15 nt, Human herpesvirus 7
ucugccucuuggccu

SEQ ID NO: 3996877 - RNA, 16 nt, Human herpesvirus 7
ucuggaucugccucug

SEQ ID NO: 3996878 - RNA, 16 nt, Human herpesvirus 7
ucuguggagugagaaa

SEQ ID NO: 3996879 - RNA, 12 nt, Human herpesvirus 7
ucuuaaaauaug

SEQ ID NO: 3996880 - RNA, 13 nt, Human herpesvirus 7
ucuuaaaugucaa

SEQ ID NO: 3996881 - RNA, 17 nt, Human herpesvirus 7
ucuuacggcucuaacau

SEQ ID NO: 3996882 - RNA, 17 nt, Human herpesvirus 7
ucuucugaaucugcaaa

SEQ ID NO: 3996883 - RNA, 21 nt, Human herpesvirus 7
ucuugcuugcgaucaucauug

SEQ ID NO: 3996884 - RNA, 17 nt, Human herpesvirus 7
ucuuucuaguucccauu

SEQ ID NO: 3996885 - RNA, 16 nt, Human herpesvirus 7
ucuuuuucauuaacuu

SEQ ID NO: 3996886 - RNA, 20 nt, Human herpesvirus 7
ccguugaguugcugcugucu

SEQ ID NO: 3996887 - RNA, 18 nt, Human herpesvirus 7
ccuaaaaaaaaaggaaaa

SEQ ID NO: 3996888 - RNA, 11 nt, Human herpesvirus 7
ccuaacaaaaa

SEQ ID NO: 3996889 - RNA, 16 nt, Human herpesvirus 7
ccucagaacuguuuua

SEQ ID NO: 3996890 - RNA, 21 nt, Human herpesvirus 7
ccugaaaaaauaaauucugaa

SEQ ID NO: 3996891 - RNA, 15 nt, Human herpesvirus 7
ccuucccaacuaaaa

SEQ ID NO: 3996892 - RNA, 14 nt, Human herpesvirus 7
cgaaagccacuguu

SEQ ID NO: 3996893 - RNA, 19 nt, Human herpesvirus 7
cgaacaucgagauuccaaa

SEQ ID NO: 3996894 - RNA, 18 nt, Human herpesvirus 7
cgaacugauauuaaauca

SEQ ID NO: 3996895 - RNA, 15 nt, Human herpesvirus 7
cgacaaacagaaaaa

SEQ ID NO: 3996896 - RNA, 20 nt, Human herpesvirus 7
cgauaugaauuugaaacugg

SEQ ID NO: 3996897 - RNA, 23 nt, Human herpesvirus 7
cgcaaugguauaaagugcugucu

SEQ ID NO: 3996898 - RNA, 14 nt, Human herpesvirus 7
cgcagacacaaugg

SEQ ID NO: 3996899 - RNA, 22 nt, Human herpesvirus 7
cgcuucguaaauauaaucaaaa

SEQ ID NO: 3996900 - RNA, 14 nt, Human herpesvirus 7
cggagguuugcuau

SEQ ID NO: 3996901 - RNA, 12 nt, Human herpesvirus 7
cggaucuucauu

SEQ ID NO: 3996902 - RNA, 13 nt, Human herpesvirus 7
cguaucugugacu

SEQ ID NO: 3996903 - RNA, 13 nt, Human herpesvirus 7
cgucaacuaaaau

SEQ ID NO: 3996904 - RNA, 16 nt, Human herpesvirus 7
cguugaguugcugcug

SEQ ID NO: 3996905 - RNA, 16 nt, Human herpesvirus 7
cguuugaauguauguc

SEQ ID NO: 3996906 - RNA, 20 nt, Human herpesvirus 7
cguuuucuaaacgugcccuc

SEQ ID NO: 3996907 - RNA, 21 nt, Human herpesvirus 7
cuaaaguauggaaaaauguua

SEQ ID NO: 3996908 - RNA, 23 nt, Human herpesvirus 7
cuaaccccgcucuuuuauuuuca

SEQ ID NO: 3996909 - RNA, 20 nt, Human herpesvirus 7
cuaagaaaaaaacaaaaucu

SEQ ID NO: 3996910 - RNA, 20 nt, Human herpesvirus 7
cuaagacggaacuucuuucu

SEQ ID NO: 3996911 - RNA, 23 nt, Human herpesvirus 7
cuaauauguaugaaauaauagau

SEQ ID NO: 3996912 - RNA, 15 nt, Human herpesvirus 7
cuacaaaaguucugu

SEQ ID NO: 3996913 - RNA, 21 nt, Human herpesvirus 7
cuacaauuucuggcaauaaag

SEQ ID NO: 3996914 - RNA, 16 nt, Human herpesvirus 7
cuacaccaauaguugu

SEQ ID NO: 3996915 - RNA, 14 nt, Human herpesvirus 7
cuacuguuaagaau

SEQ ID NO: 3996916 - RNA, 15 nt, Human herpesvirus 7
cuagaaguuuagaga

SEQ ID NO: 3996917 - RNA, 16 nt, Human herpesvirus 7
cuagaguaucuuuuca

SEQ ID NO: 3996918 - RNA, 18 nt, Human herpesvirus 7
cuagcucaguccauuagu

SEQ ID NO: 3996919 - RNA, 20 nt, Human herpesvirus 7
cuaguugcaacucuucuuca

SEQ ID NO: 3996920 - RNA, 15 nt, Human herpesvirus 7
cuauagaaaacaucc

SEQ ID NO: 3996921 - RNA, 15 nt, Human herpesvirus 7
cuauaguuuguauuu

SEQ ID NO: 3996922 - RNA, 18 nt, Human herpesvirus 7
cuauaucaucaucuuuuu

SEQ ID NO: 3996923 - RNA, 20 nt, Human herpesvirus 7
cuauccagaacauuuauuuu

SEQ ID NO: 3996924 - RNA, 11 nt, Human herpesvirus 7
cuaugauacaa

SEQ ID NO: 3996925 - RNA, 20 nt, Human herpesvirus 7
cuaugauugcaguaaauuug

SEQ ID NO: 3996926 - RNA, 17 nt, Human herpesvirus 7
cuauguccaaaaauuua

SEQ ID NO: 3996927 - RNA, 21 nt, Human herpesvirus 7
cuauuaagcguucguaacaaa

SEQ ID NO: 3996928 - RNA, 14 nt, Human herpesvirus 7
cuauuacacaggaa

SEQ ID NO: 3996929 - RNA, 15 nt, Human herpesvirus 7
cuauuuaaaauauua

SEQ ID NO: 3996930 - RNA, 19 nt, Human herpesvirus 7
cuauuucugucaucuuaua

SEQ ID NO: 3996931 - RNA, 19 nt, Human herpesvirus 7
cucaauuuuucgcugaaga

SEQ ID NO: 3996932 - RNA, 18 nt, Human herpesvirus 7
cucagauucgacuucuaa

SEQ ID NO: 3996933 - RNA, 19 nt, Human herpesvirus 7
cucauggccagugaaugau

SEQ ID NO: 3996934 - RNA, 14 nt, Human herpesvirus 7
cuccaaucauaauu

SEQ ID NO: 3996935 - RNA, 21 nt, Human herpesvirus 7
cuccacuaugccacaaaaaac

SEQ ID NO: 3996936 - RNA, 19 nt, Human herpesvirus 7
cuccccaguaaauaaaaug

SEQ ID NO: 3996937 - RNA, 12 nt, Human herpesvirus 7
cucuaguuuaau

SEQ ID NO: 3996938 - RNA, 14 nt, Human herpesvirus 7
cucuguaaaacguu

SEQ ID NO: 3996939 - RNA, 21 nt, Human herpesvirus 7
aaaucauuuuuaaaaauaaua

SEQ ID NO: 3996940 - RNA, 12 nt, Human herpesvirus 7
aaauccuggauu

SEQ ID NO: 3996941 - RNA, 22 nt, Human herpesvirus 7
aaaucguuuuuggcaaaauauc

SEQ ID NO: 3996942 - RNA, 14 nt, Human herpesvirus 7
aaaucuacuguaau

SEQ ID NO: 3996943 - RNA, 19 nt, Human herpesvirus 7
aaaucuguagaaaauguuu

SEQ ID NO: 3996944 - RNA, 16 nt, Human herpesvirus 7
aaaucuuuauugguaa

SEQ ID NO: 3996945 - RNA, 18 nt, Human herpesvirus 7
aaaugggaauguuaacca

SEQ ID NO: 3996946 - RNA, 17 nt, Human herpesvirus 7
aaauggguuugggaaac

SEQ ID NO: 3996947 - RNA, 22 nt, Human herpesvirus 7
aaauguaucuuaaaauacuaau

SEQ ID NO: 3996948 - RNA, 21 nt, Human herpesvirus 7
aaaugucuuugucaugaugaa

SEQ ID NO: 3996949 - RNA, 19 nt, Human herpesvirus 7
aaauuaaguuuuucaugua

SEQ ID NO: 3996950 - RNA, 15 nt, Human herpesvirus 7
aaauuaauaauauua

SEQ ID NO: 3996951 - RNA, 15 nt, Human herpesvirus 7
aaauuauuaauauua

SEQ ID NO: 3996952 - RNA, 19 nt, Human herpesvirus 7
aaauuauuaauauuaguau

SEQ ID NO: 3996953 - RNA, 20 nt, Human herpesvirus 7
aaauucaaggaauucugacu

SEQ ID NO: 3996954 - RNA, 9 nt, Human herpesvirus 7
aaauuuaaa

SEQ ID NO: 3996955 - RNA, 14 nt, Human herpesvirus 7
aaauuucaaacgua

SEQ ID NO: 3996956 - RNA, 17 nt, Human herpesvirus 7
aacaaaaugacaaaaag

SEQ ID NO: 3996957 - RNA, 14 nt, Human herpesvirus 7
aacaaacaaauaau

SEQ ID NO: 3996958 - RNA, 15 nt, Human herpesvirus 7
aacaaguagugcuaa

SEQ ID NO: 3996959 - RNA, 13 nt, Human herpesvirus 7
aacaauguguuaa

SEQ ID NO: 3996960 - RNA, 19 nt, Human herpesvirus 7
aacacauucugucuuggaa

SEQ ID NO: 3996961 - RNA, 19 nt, Human herpesvirus 7
aacacugcaagcugauuca

SEQ ID NO: 3996962 - RNA, 11 nt, Human herpesvirus 7
aacagaccucc

SEQ ID NO: 3996963 - RNA, 18 nt, Human herpesvirus 7
aacagccaucuaauugca

SEQ ID NO: 3996964 - RNA, 14 nt, Human herpesvirus 7
aacagugggaaagu

SEQ ID NO: 3996965 - RNA, 16 nt, Human herpesvirus 7
aacauacugauguaaa

SEQ ID NO: 3996966 - RNA, 19 nt, Human herpesvirus 7
aacauacuuaaaaaaauga

SEQ ID NO: 3996967 - RNA, 18 nt, Human herpesvirus 7
aacaucuuuauauguguu

SEQ ID NO: 3996968 - RNA, 22 nt, Human herpesvirus 7
aacaugucuuuuaguuuucauu

SEQ ID NO: 3996969 - RNA, 20 nt, Human herpesvirus 7
aacauguuuucuuagaugca

SEQ ID NO: 3996970 - RNA, 14 nt, Human herpesvirus 7
aacauuaaaacuac

SEQ ID NO: 3996971 - RNA, 23 nt, Human herpesvirus 7
aacauuccucauggccagugaau

SEQ ID NO: 3996972 - RNA, 17 nt, Human herpesvirus 7
aacccagaagaaacuug

SEQ ID NO: 3996973 - RNA, 21 nt, Human herpesvirus 7
aaccuacuguuaagaauucca

SEQ ID NO: 3996974 - RNA, 13 nt, Human herpesvirus 7
aaccuaucaaaau

SEQ ID NO: 3996975 - RNA, 17 nt, Human herpesvirus 7
aacggaauaaacaaugu

SEQ ID NO: 3996976 - RNA, 15 nt, Human herpesvirus 7
aacuagcaaacagug

SEQ ID NO: 3996977 - RNA, 23 nt, Human herpesvirus 7
aacuauaucaucaucuuuuugaa

SEQ ID NO: 3996978 - RNA, 16 nt, Human herpesvirus 7
aacuauucgaaaauau

SEQ ID NO: 3996979 - RNA, 14 nt, Human herpesvirus 7
aacucuaucuccua

SEQ ID NO: 3996980 - RNA, 21 nt, Human herpesvirus 7
aacugaauuaagguggaaauc

SEQ ID NO: 3996981 - RNA, 15 nt, Human herpesvirus 7
aacugagaaaaauga

SEQ ID NO: 3996982 - RNA, 17 nt, Human herpesvirus 7
aacugauauaaaugcuu

SEQ ID NO: 3996983 - RNA, 22 nt, Human herpesvirus 7
aacuggaauuauacacugugaa

SEQ ID NO: 3996984 - RNA, 18 nt, Human herpesvirus 7
aacuuacauuucaaacaa

SEQ ID NO: 3996985 - RNA, 19 nt, Human herpesvirus 7
aacuuugcaacaaaaucua

SEQ ID NO: 3996986 - RNA, 16 nt, Human herpesvirus 7
aacuuuucuuaaacau

SEQ ID NO: 3996987 - RNA, 22 nt, Human herpesvirus 7
aagaauuaauaaaaguaucauu

SEQ ID NO: 3996988 - RNA, 12 nt, Human herpesvirus 7
aagaauuuggau

SEQ ID NO: 3996989 - RNA, 20 nt, Human herpesvirus 7
aagaauuuuguaagaaacau

SEQ ID NO: 3996990 - RNA, 20 nt, Human herpesvirus 7
aagacacguuucucuguaga

SEQ ID NO: 3996991 - RNA, 14 nt, Human herpesvirus 7
aagacagaaaugaa

SEQ ID NO: 3996992 - RNA, 18 nt, Human herpesvirus 7
aagacgugagcaauacac

SEQ ID NO: 3996993 - RNA, 17 nt, Human herpesvirus 7
aagaugcguagcuacag

SEQ ID NO: 3996994 - RNA, 15 nt, Human herpesvirus 7
aagauuaaaugggcu

SEQ ID NO: 3996995 - RNA, 16 nt, Human herpesvirus 7
aagcaacaaauguuua

SEQ ID NO: 3996996 - RNA, 20 nt, Human herpesvirus 7
aagcagacauugaagauugu

SEQ ID NO: 3996997 - RNA, 16 nt, Human herpesvirus 7
aagcauauugaagauc

SEQ ID NO: 3996998 - RNA, 18 nt, Human herpesvirus 7
aagcccaaacuguuuuua

SEQ ID NO: 3996999 - RNA, 23 nt, Human herpesvirus 7
aagcgagauuuauuuuuaaaaau

SEQ ID NO: 3997000 - RNA, 24 nt, Human herpesvirus 7
aagcuaaacuuuuaacuguuaaag

SEQ ID NO: 3997001 - RNA, 18 nt, Human herpesvirus 7
aagcuugcuuaaaacuuu

SEQ ID NO: 3997002 - RNA, 20 nt, Human herpesvirus 7
aaggaagcuuuacagcagcc

SEQ ID NO: 3997003 - RNA, 13 nt, Human herpesvirus 7
aaggaagguacau

SEQ ID NO: 3997004 - RNA, 15 nt, Human herpesvirus 7
aaggugguuacauau

SEQ ID NO: 3997005 - RNA, 16 nt, Human herpesvirus 7
aagguugaguugacaa

SEQ ID NO: 3997006 - RNA, 22 nt, Human herpesvirus 7
aaguguaagcuuuuucuuccgc

SEQ ID NO: 3997007 - RNA, 22 nt, Human herpesvirus 7
aaguucuccuuguuguguuuua

SEQ ID NO: 3997008 - RNA, 11 nt, Human herpesvirus 7
aaguugaacaa

SEQ ID NO: 3997009 - RNA, 21 nt, Human herpesvirus 7
aaguuuccauaaauaaaaaca

SEQ ID NO: 3997010 - RNA, 12 nt, Human herpesvirus 7
aauaaaaugguu

SEQ ID NO: 3997011 - RNA, 15 nt, Human herpesvirus 7
aauaaaauuuaaaau

SEQ ID NO: 3997012 - RNA, 16 nt, Human herpesvirus 7
aauaaagauuacauuu

SEQ ID NO: 3997013 - RNA, 23 nt, Human herpesvirus 7
aauaaauuuuucgaucuguaaaa

SEQ ID NO: 3997014 - RNA, 20 nt, Human herpesvirus 7
aauaacaauuauagaaacau

SEQ ID NO: 3997015 - RNA, 12 nt, Human herpesvirus 7
aauaacaggaaa

SEQ ID NO: 3997016 - RNA, 17 nt, Human herpesvirus 7
aauaagauguguuggaa

SEQ ID NO: 3997017 - RNA, 13 nt, Human herpesvirus 7
aauaauuuaaaau

SEQ ID NO: 3997018 - RNA, 17 nt, Human herpesvirus 7
aauacugagagaauaag

SEQ ID NO: 3997019 - RNA, 14 nt, Human herpesvirus 7
aauaucucugugau

SEQ ID NO: 3997020 - RNA, 19 nt, Human herpesvirus 7
aauaucuuuuucaaaugga

SEQ ID NO: 3997021 - RNA, 19 nt, Human herpesvirus 7
aauaugaugaaacuuccaa

SEQ ID NO: 3997022 - RNA, 19 nt, Human herpesvirus 7
aauauuuggcuuagaauau

SEQ ID NO: 3997023 - RNA, 14 nt, Human herpesvirus 7
aaucaaaaacugaa

SEQ ID NO: 3997024 - RNA, 19 nt, Human herpesvirus 7
aaucaaccaacauucuugu

SEQ ID NO: 3997025 - RNA, 22 nt, Human herpesvirus 7
aaucaaccaacauucuugucaa

SEQ ID NO: 3997026 - RNA, 22 nt, Human herpesvirus 7
aaucauaauucaaucugcaaaa

SEQ ID NO: 3997027 - RNA, 15 nt, Human herpesvirus 7
aauccaacagaauac

SEQ ID NO: 3997028 - RNA, 20 nt, Human herpesvirus 7
aaucuguaaaauuuaaauac

SEQ ID NO: 3997029 - RNA, 20 nt, Human herpesvirus 7
aaucuuggcauugaaauucu

SEQ ID NO: 3997030 - RNA, 19 nt, Human herpesvirus 7
aaucuuuauuauuuacuga

SEQ ID NO: 3997031 - RNA, 20 nt, Human herpesvirus 7
aaucuuugacuguaucucca

SEQ ID NO: 3997032 - RNA, 14 nt, Human herpesvirus 7
aaugaaaaagccau

SEQ ID NO: 3997033 - RNA, 13 nt, Human herpesvirus 7
aaugaaguuuauc

SEQ ID NO: 3997034 - RNA, 21 nt, Human herpesvirus 7
aaugaauaaaaucuauuuuau

SEQ ID NO: 3997035 - RNA, 16 nt, Human herpesvirus 7
aaugaauuagcuaaau

SEQ ID NO: 3997036 - RNA, 15 nt, Human herpesvirus 7
aaugauuucagaaaa

SEQ ID NO: 3997037 - RNA, 19 nt, Human herpesvirus 7
aaugcaacaucuuaaaugu

SEQ ID NO: 3997038 - RNA, 21 nt, Human herpesvirus 7
aaugcagccuacuuuuaaaau

SEQ ID NO: 3997039 - RNA, 20 nt, Human herpesvirus 7
aaugccaucuauaaacauuc

SEQ ID NO: 3997040 - RNA, 16 nt, Human herpesvirus 7
aauggauuuaaucgau

SEQ ID NO: 3997041 - RNA, 21 nt, Human herpesvirus 7
aaugugguaaauuugcuugcu

SEQ ID NO: 3997042 - RNA, 12 nt, Human herpesvirus 7
aauguuucugag

SEQ ID NO: 3997043 - RNA, 11 nt, Human herpesvirus 7
aauuaaauacu

SEQ ID NO: 3997044 - RNA, 14 nt, Human herpesvirus 7
aauuaacagcucua

SEQ ID NO: 3997045 - RNA, 18 nt, Human herpesvirus 7
aauuaagaaucauuugua

SEQ ID NO: 3997046 - RNA, 14 nt, Human herpesvirus 7
aauuaaucaaacaa

SEQ ID NO: 3997047 - RNA, 15 nt, Human herpesvirus 7
aauuauuagauucca

SEQ ID NO: 3997048 - RNA, 20 nt, Human herpesvirus 7
aauuauuuaaacagcguuca

SEQ ID NO: 3997049 - RNA, 21 nt, Human herpesvirus 7
aauuccugcuugcacaaagau

SEQ ID NO: 3997050 - RNA, 19 nt, Human herpesvirus 7
aauucucgcuucaaagaua

SEQ ID NO: 3997051 - RNA, 22 nt, Human herpesvirus 7
aauucuguggagugagaaauua

SEQ ID NO: 3997052 - RNA, 22 nt, Human herpesvirus 7
aauuguaaguaaauuuacuuga

SEQ ID NO: 3997053 - RNA, 13 nt, Human herpesvirus 7
auucaguuucuuu

SEQ ID NO: 3997054 - RNA, 21 nt, Human herpesvirus 7
auucauuuccucccaaaaauu

SEQ ID NO: 3997055 - RNA, 16 nt, Human herpesvirus 7
auuccgauuuaaguga

SEQ ID NO: 3997056 - RNA, 13 nt, Human herpesvirus 7
auucgacacuauu

SEQ ID NO: 3997057 - RNA, 17 nt, Human herpesvirus 7
auucgacacuauuggac

SEQ ID NO: 3997058 - RNA, 15 nt, Human herpesvirus 7
auucguuaagcaccg

SEQ ID NO: 3997059 - RNA, 23 nt, Human herpesvirus 7
auucuauaaaacgugugaaaaca

SEQ ID NO: 3997060 - RNA, 14 nt, Human herpesvirus 7
auucucuacuuaau

SEQ ID NO: 3997061 - RNA, 16 nt, Human herpesvirus 7
auucugaaauaaacau

SEQ ID NO: 3997062 - RNA, 23 nt, Human herpesvirus 7
auucugacuccuuuuuuucugcu

SEQ ID NO: 3997063 - RNA, 15 nt, Human herpesvirus 7
auucuuuguacuugu

SEQ ID NO: 3997064 - RNA, 18 nt, Human herpesvirus 7
auugaaaaugcauugcuu

SEQ ID NO: 3997065 - RNA, 14 nt, Human herpesvirus 7
auugacagcaccaa

SEQ ID NO: 3997066 - RNA, 15 nt, Human herpesvirus 7
auugcuucagaaaua

SEQ ID NO: 3997067 - RNA, 14 nt, Human herpesvirus 7
auugcuuucuaagu

SEQ ID NO: 3997068 - RNA, 18 nt, Human herpesvirus 7
auuguaaauauuauuaac

SEQ ID NO: 3997069 - RNA, 21 nt, Human herpesvirus 7
auuguagagguccaauagaaa

SEQ ID NO: 3997070 - RNA, 21 nt, Human herpesvirus 7
auuguaugggaaaaauaagaa

SEQ ID NO: 3997071 - RNA, 19 nt, Human herpesvirus 7
auugugcaucuccuguaac

SEQ ID NO: 3997072 - RNA, 16 nt, Human herpesvirus 7
auuguuaccgguuaaa

SEQ ID NO: 3997073 - RNA, 18 nt, Human herpesvirus 7
auuuaaaguagcugaauu

SEQ ID NO: 3997074 - RNA, 19 nt, Human herpesvirus 7
auuuaacauguguauauuu

SEQ ID NO: 3997075 - RNA, 18 nt, Human herpesvirus 7
auuuaaugguuuuaaaau

SEQ ID NO: 3997076 - RNA, 19 nt, Human herpesvirus 7
auuuagcaccaacugaauu

SEQ ID NO: 3997077 - RNA, 22 nt, Human herpesvirus 7
auuuagucggcacacguacaau

SEQ ID NO: 3997078 - RNA, 13 nt, Human herpesvirus 7
auuuaugcuuuaa

SEQ ID NO: 3997079 - RNA, 21 nt, Human herpesvirus 7
auuuauuuguguuuuguaaau

SEQ ID NO: 3997080 - RNA, 23 nt, Human herpesvirus 7
auuuauuuguguuuuguaaauaa

SEQ ID NO: 3997081 - RNA, 22 nt, Human herpesvirus 7
auuucaaacguaaugcaaaaua

SEQ ID NO: 3997082 - RNA, 13 nt, Human herpesvirus 7
auuucaaaggaag

SEQ ID NO: 3997083 - RNA, 17 nt, Human herpesvirus 7
auuucaaaggaagacau

SEQ ID NO: 3997084 - RNA, 16 nt, Human herpesvirus 7
auuucaauaaucaaug

SEQ ID NO: 3997085 - RNA, 18 nt, Human herpesvirus 7
auuucaauaaucaaugca

SEQ ID NO: 3997086 - RNA, 21 nt, Human herpesvirus 7
auuucagaaaauaaaaguaaa

SEQ ID NO: 3997087 - RNA, 17 nt, Human herpesvirus 7
auuuccguuguuaaaaa

SEQ ID NO: 3997088 - RNA, 20 nt, Human herpesvirus 7
auuucgcaggggguucuaaa

SEQ ID NO: 3997089 - RNA, 20 nt, Human herpesvirus 7
auuucuauuagauaaugaca

SEQ ID NO: 3997090 - RNA, 14 nt, Human herpesvirus 7
auuucucaaaucuu

SEQ ID NO: 3997091 - RNA, 17 nt, Human herpesvirus 7
auuucuggaugaaaacu

SEQ ID NO: 3997092 - RNA, 22 nt, Human herpesvirus 7
auuucuuaaagaugucuuaauu

SEQ ID NO: 3997093 - RNA, 19 nt, Human herpesvirus 7
auuucuuauaauuaugaug

SEQ ID NO: 3997094 - RNA, 21 nt, Human herpesvirus 7
auuugacuuuuucuguagaca

SEQ ID NO: 3997095 - RNA, 18 nt, Human herpesvirus 7
auuugaugaaauuguuaa

SEQ ID NO: 3997096 - RNA, 14 nt, Human herpesvirus 7
auuugcuucuucua

SEQ ID NO: 3997097 - RNA, 14 nt, Human herpesvirus 7
auuugcuugcugaa

SEQ ID NO: 3997098 - RNA, 13 nt, Human herpesvirus 7
auuuguaugucua

SEQ ID NO: 3997099 - RNA, 18 nt, Human herpesvirus 7
auuuuaaaacugaagcau

SEQ ID NO: 3997100 - RNA, 22 nt, Human herpesvirus 7
auuuuacauauuaguuuaacuu

SEQ ID NO: 3997101 - RNA, 15 nt, Human herpesvirus 7
auuuuccaacgaaau

SEQ ID NO: 3997102 - RNA, 20 nt, Human herpesvirus 7
auuuugaucuugucaaaaaa

SEQ ID NO: 3997103 - RNA, 18 nt, Human herpesvirus 7
auuuugucuuuagauaga

SEQ ID NO: 3997104 - RNA, 17 nt, Human herpesvirus 7
caaaaaacguaaaacug

SEQ ID NO: 3997105 - RNA, 21 nt, Human herpesvirus 7
caaaacgccuugggcacacca

SEQ ID NO: 3997106 - RNA, 18 nt, Human herpesvirus 7
caaaagacauaacaaaaa

SEQ ID NO: 3997107 - RNA, 20 nt, Human herpesvirus 7
caaaccaugauguuaaagaa

SEQ ID NO: 3997108 - RNA, 20 nt, Human herpesvirus 7
caaagaacauguaguacaau

SEQ ID NO: 3997109 - RNA, 12 nt, Human herpesvirus 7
caaagcaagcau

SEQ ID NO: 3997110 - RNA, 19 nt, Human herpesvirus 7
caaaggaaaaaugcugcuc

SEQ ID NO: 3997111 - RNA, 19 nt, Human herpesvirus 7
caaauagaguuuaauugua

SEQ ID NO: 3997112 - RNA, 21 nt, Human herpesvirus 7
caaauagaguuuaauuguacu

SEQ ID NO: 3997113 - RNA, 14 nt, Human herpesvirus 7
caaauccacucugg

SEQ ID NO: 3997114 - RNA, 16 nt, Human herpesvirus 7
caaaucugauaaauua

SEQ ID NO: 3997115 - RNA, 17 nt, Human herpesvirus 7
caaauuaaacaaucugg

SEQ ID NO: 3997116 - RNA, 22 nt, Human herpesvirus 7
caaauugaaccuuaacauacug

SEQ ID NO: 3997117 - RNA, 19 nt, Human herpesvirus 7
caaauuguaaauucuccaa

SEQ ID NO: 3997118 - RNA, 12 nt, Human herpesvirus 7
caacaaauguuu

SEQ ID NO: 3997119 - RNA, 16 nt, Human herpesvirus 7
caacaucuuaaauguc

SEQ ID NO: 3997120 - RNA, 16 nt, Human herpesvirus 7
caacgguauacauuaa

SEQ ID NO: 3997121 - RNA, 22 nt, Human herpesvirus 7
caacuaaaacuacauuuaaaaa

SEQ ID NO: 3997122 - RNA, 12 nt, Human herpesvirus 7
caacugugcaug

SEQ ID NO: 3997123 - RNA, 22 nt, Human herpesvirus 7
caaggucuuucaugcauugcau

SEQ ID NO: 3997124 - RNA, 23 nt, Human herpesvirus 7
caagucugaaggcugcuuuuuca

SEQ ID NO: 3997125 - RNA, 17 nt, Human herpesvirus 7
caaguguuucuuugaau

SEQ ID NO: 3997126 - RNA, 18 nt, Human herpesvirus 7
caauagcauaugcuggau

SEQ ID NO: 3997127 - RNA, 16 nt, Human herpesvirus 7
caauagugaacaugug

SEQ ID NO: 3997128 - RNA, 18 nt, Human herpesvirus 7
caauaugcauguguaaag

SEQ ID NO: 3997129 - RNA, 17 nt, Human herpesvirus 7
caaugauuuuucugcuu

SEQ ID NO: 3997130 - RNA, 14 nt, Human herpesvirus 7
caauggaacagcaa

SEQ ID NO: 3997131 - RNA, 14 nt, Human herpesvirus 7
caauuauagaaaca

SEQ ID NO: 3997132 - RNA, 20 nt, Human herpesvirus 7
caauuauuuuaaauucuaau

SEQ ID NO: 3997133 - RNA, 16 nt, Human herpesvirus 7
caauuuuaaugugcuu

SEQ ID NO: 3997134 - RNA, 16 nt, Human herpesvirus 7
cacaagguacauuuug

SEQ ID NO: 3997135 - RNA, 17 nt, Human herpesvirus 7
cacaauuguauuucagu

SEQ ID NO: 3997136 - RNA, 23 nt, Human herpesvirus 7
cacauacucuagaacaaacugua

SEQ ID NO: 3997137 - RNA, 23 nt, Human herpesvirus 7
cacauguacagacagaaugccag

SEQ ID NO: 3997138 - RNA, 23 nt, Human herpesvirus 7
caccgaugaauuuuuuuugguaa

SEQ ID NO: 3997139 - RNA, 16 nt, Human herpesvirus 7
cacguagaacaaacug

SEQ ID NO: 3997140 - RNA, 23 nt, Human herpesvirus 7
cacucugcauuccacuaaaagag

SEQ ID NO: 3997141 - RNA, 22 nt, Human herpesvirus 7
cacugagccaucaaaaaauuua

SEQ ID NO: 3997142 - RNA, 22 nt, Human herpesvirus 7
cacuguuguagguaauuucuua

SEQ ID NO: 3997143 - RNA, 20 nt, Human herpesvirus 7
cacuugaauagguaucuuua

SEQ ID NO: 3997144 - RNA, 22 nt, Human herpesvirus 7
cagaaagaucaaugcacacauu

SEQ ID NO: 3997145 - RNA, 21 nt, Human herpesvirus 7
cagaacaucccuggacagaga

SEQ ID NO: 3997146 - RNA, 19 nt, Human herpesvirus 7
cagaagcugacuuugucau

SEQ ID NO: 3997147 - RNA, 19 nt, Human herpesvirus 7
cagacacaccauuguucaa

SEQ ID NO: 3997148 - RNA, 16 nt, Human herpesvirus 7
cagaguauuuaagaac

SEQ ID NO: 3997149 - RNA, 15 nt, Human herpesvirus 7
cagauucgacuucua

SEQ ID NO: 3997150 - RNA, 15 nt, Human herpesvirus 7
cagauucuccagaaa

SEQ ID NO: 3997151 - RNA, 16 nt, Human herpesvirus 7
cagauuuucuguuuca

SEQ ID NO: 3997152 - RNA, 22 nt, Human herpesvirus 7
cagcuagauugacuaugaauuu

SEQ ID NO: 3997153 - RNA, 16 nt, Human herpesvirus 7
cagcuggaguuauuua

SEQ ID NO: 3997154 - RNA, 13 nt, Human herpesvirus 7
caggauuugggaa

SEQ ID NO: 3997155 - RNA, 13 nt, Human herpesvirus 7
caggcaaugcaag

SEQ ID NO: 3997156 - RNA, 23 nt, Human herpesvirus 7
caggcauuuaagaauuuaaucau

SEQ ID NO: 3997157 - RNA, 16 nt, Human herpesvirus 7
caggcugcaucuuuuc

SEQ ID NO: 3997158 - RNA, 17 nt, Human herpesvirus 7
caguauauaaugguuug

SEQ ID NO: 3997159 - RNA, 17 nt, Human herpesvirus 7
caguaucacuuaaagca

SEQ ID NO: 3997160 - RNA, 23 nt, Human herpesvirus 7
caguuauuucuuauuggagaugu

SEQ ID NO: 3997161 - RNA, 18 nt, Human herpesvirus 7
cauaauucaaucugcaaa

SEQ ID NO: 3997162 - RNA, 12 nt, Human herpesvirus 7
cauaauuucagc

SEQ ID NO: 3997163 - RNA, 20 nt, Human herpesvirus 7
cauaauuuuaauaaacggug

SEQ ID NO: 3997164 - RNA, 20 nt, Human herpesvirus 7
cauacuaaauuucuuaaaga

SEQ ID NO: 3997165 - RNA, 22 nt, Human herpesvirus 7
cauacuuuuuugguuauuggaa

SEQ ID NO: 3997166 - RNA, 22 nt, Human herpesvirus 7
cauagacauuauuagacagaua

SEQ ID NO: 3997167 - RNA, 11 nt, Human herpesvirus 7
cuguuuaagua

SEQ ID NO: 3997168 - RNA, 15 nt, Human herpesvirus 7
cuuaacaauuauuuu

SEQ ID NO: 3997169 - RNA, 24 nt, Human herpesvirus 7
cuuaaggcggacaaauauacgaau

SEQ ID NO: 3997170 - RNA, 15 nt, Human herpesvirus 7
cuuaauuuguucaau

SEQ ID NO: 3997171 - RNA, 12 nt, Human herpesvirus 7
cuuagaaucuuu

SEQ ID NO: 3997172 - RNA, 19 nt, Human herpesvirus 7
cuuagaucgaacuguuaca

SEQ ID NO: 3997173 - RNA, 18 nt, Human herpesvirus 7
cuuagcguucgacagcaa

SEQ ID NO: 3997174 - RNA, 14 nt, Human herpesvirus 7
cuuauaacuucgua

SEQ ID NO: 3997175 - RNA, 17 nt, Human herpesvirus 7
cuuauacuccacauuca

SEQ ID NO: 3997176 - RNA, 22 nt, Human herpesvirus 7
cuuaucugucauggacggcauu

SEQ ID NO: 3997177 - RNA, 21 nt, Human herpesvirus 7
cuuauuccagauaugacaaau

SEQ ID NO: 3997178 - RNA, 22 nt, Human herpesvirus 7
cuuauuuauauauggcaauaaa

SEQ ID NO: 3997179 - RNA, 14 nt, Human herpesvirus 7
cuucaaagauaccu

SEQ ID NO: 3997180 - RNA, 17 nt, Human herpesvirus 7
cuucaacuucucuugga

SEQ ID NO: 3997181 - RNA, 17 nt, Human herpesvirus 7
cuuccgcauuuuguauu

SEQ ID NO: 3997182 - RNA, 13 nt, Human herpesvirus 7
cuuccuaaaaaaa

SEQ ID NO: 3997183 - RNA, 14 nt, Human herpesvirus 7
cuucgcugcuguga

SEQ ID NO: 3997184 - RNA, 22 nt, Human herpesvirus 7
cuucuagaaacuaaagaaaaaa

SEQ ID NO: 3997185 - RNA, 18 nt, Human herpesvirus 7
cuucucuauaccgcuucu

SEQ ID NO: 3997186 - RNA, 15 nt, Human herpesvirus 7
cuucugcuaacucau

SEQ ID NO: 3997187 - RNA, 14 nt, Human herpesvirus 7
cuucuugcauuucc

SEQ ID NO: 3997188 - RNA, 16 nt, Human herpesvirus 7
cuucuugcauuuccga

SEQ ID NO: 3997189 - RNA, 20 nt, Human herpesvirus 7
cuucuuugacaaaaauguua

SEQ ID NO: 3997190 - RNA, 22 nt, Human herpesvirus 7
cuucuuuuuuugaacuguugcc

SEQ ID NO: 3997191 - RNA, 13 nt, Human herpesvirus 7
cuugaaaaaaucu

SEQ ID NO: 3997192 - RNA, 22 nt, Human herpesvirus 7
cuugaaaaagaauuuucugcuu

SEQ ID NO: 3997193 - RNA, 21 nt, Human herpesvirus 7
cuugcauacaguuuauuugaa

SEQ ID NO: 3997194 - RNA, 16 nt, Human herpesvirus 7
cuugcuagcugugaua

SEQ ID NO: 3997195 - RNA, 19 nt, Human herpesvirus 7
cuugcuuguaggcagaaau

SEQ ID NO: 3997196 - RNA, 16 nt, Human herpesvirus 7
cuuggaguuugucuca

SEQ ID NO: 3997197 - RNA, 17 nt, Human herpesvirus 7
cuugugaaaauaacagg

SEQ ID NO: 3997198 - RNA, 20 nt, Human herpesvirus 7
cuuuacgaaacaauuucaca

SEQ ID NO: 3997199 - RNA, 18 nt, Human herpesvirus 7
cuuuacuuucauagcuua

SEQ ID NO: 3997200 - RNA, 22 nt, Human herpesvirus 7
cuuuaucagucaagaacuguga

SEQ ID NO: 3997201 - RNA, 19 nt, Human herpesvirus 7
cuuucggagacguugcuca

SEQ ID NO: 3997202 - RNA, 14 nt, Human herpesvirus 7
cuuucguuuucaaa

SEQ ID NO: 3997203 - RNA, 19 nt, Human herpesvirus 7
cuuucuggaguucaguaaa

SEQ ID NO: 3997204 - RNA, 21 nt, Human herpesvirus 7
cuuucuuuaccgauucuaaau

SEQ ID NO: 3997205 - RNA, 22 nt, Human herpesvirus 7
cuuucuuugagcuaaccuuuua

SEQ ID NO: 3997206 - RNA, 16 nt, Human herpesvirus 7
cuuugaaaucauucug

SEQ ID NO: 3997207 - RNA, 23 nt, Human herpesvirus 7
cuuugagcccauauuuuuaaauu

SEQ ID NO: 3997208 - RNA, 19 nt, Human herpesvirus 7
cuuugauagggauucuuug

SEQ ID NO: 3997209 - RNA, 15 nt, Human herpesvirus 7
cuuuuacagaagaac

SEQ ID NO: 3997210 - RNA, 16 nt, Human herpesvirus 7
cuuuuauuacucgaaa

SEQ ID NO: 3997211 - RNA, 19 nt, Human herpesvirus 7
cuuuuuucaguguguauuu

SEQ ID NO: 3997212 - RNA, 20 nt, Human herpesvirus 7
gaaaaaaaaaguuaaaagau

SEQ ID NO: 3997213 - RNA, 15 nt, Human herpesvirus 7
gaaaaauguacaaua

SEQ ID NO: 3997214 - RNA, 16 nt, Human herpesvirus 7
gaaaagaaaaagcaac

SEQ ID NO: 3997215 - RNA, 14 nt, Human herpesvirus 7
gaaaagcuuguaua

SEQ ID NO: 3997216 - RNA, 17 nt, Human herpesvirus 7
gaaaaguugcuuuucau

SEQ ID NO: 3997217 - RNA, 13 nt, Human herpesvirus 7
gaaaauaaaagag

SEQ ID NO: 3997218 - RNA, 14 nt, Human herpesvirus 7
gaaaauaaacagga

SEQ ID NO: 3997219 - RNA, 21 nt, Human herpesvirus 7
gaaaauauauuaaucuugaaa

SEQ ID NO: 3997220 - RNA, 16 nt, Human herpesvirus 7
gaaaauaucuucugaa

SEQ ID NO: 3997221 - RNA, 22 nt, Human herpesvirus 7
gaaaaugaugguugcaauacaa

SEQ ID NO: 3997222 - RNA, 20 nt, Human herpesvirus 7
gaaaauuuauauuugcuugc

SEQ ID NO: 3997223 - RNA, 18 nt, Human herpesvirus 7
gaaacaagguuuaaaaca

SEQ ID NO: 3997224 - RNA, 14 nt, Human herpesvirus 7
gaaagcuguuucca

SEQ ID NO: 3997225 - RNA, 14 nt, Human herpesvirus 7
gaaagcuugugaag

SEQ ID NO: 3997226 - RNA, 16 nt, Human herpesvirus 7
gaaagggauuuauuau

SEQ ID NO: 3997227 - RNA, 15 nt, Human herpesvirus 7
gaaagugaaaauauu

SEQ ID NO: 3997228 - RNA, 14 nt, Human herpesvirus 7
gaaauaaugaagga

SEQ ID NO: 3997229 - RNA, 16 nt, Human herpesvirus 7
gaaaucauucugaaua

SEQ ID NO: 3997230 - RNA, 21 nt, Human herpesvirus 7
gaaauccgucaccgacaauau

SEQ ID NO: 3997231 - RNA, 22 nt, Human herpesvirus 7
gaaaugcacuugcucugugaaa

SEQ ID NO: 3997232 - RNA, 19 nt, Human herpesvirus 7
gaacaaaagucgagaaaac

SEQ ID NO: 3997233 - RNA, 14 nt, Human herpesvirus 7
gaacaaauaaugag

SEQ ID NO: 3997234 - RNA, 19 nt, Human herpesvirus 7
gaacaauggugugucugug

SEQ ID NO: 3997235 - RNA, 16 nt, Human herpesvirus 7
gaacagucccagauaa

SEQ ID NO: 3997236 - RNA, 12 nt, Human herpesvirus 7
gaacauaaaaaa

SEQ ID NO: 3997237 - RNA, 15 nt, Human herpesvirus 7
gaacaucuugagaaa

SEQ ID NO: 3997238 - RNA, 18 nt, Human herpesvirus 7
gaacauuaauaucaauuu

SEQ ID NO: 3997239 - RNA, 19 nt, Human herpesvirus 7
gaaccaguuuuacuuuuga

SEQ ID NO: 3997240 - RNA, 21 nt, Human herpesvirus 7
gaacuguuacaacuuugccaa

SEQ ID NO: 3997241 - RNA, 16 nt, Human herpesvirus 7
gaacuguugccagaaa

SEQ ID NO: 3997242 - RNA, 15 nt, Human herpesvirus 7
gaagagguugcuucu

SEQ ID NO: 3997243 - RNA, 19 nt, Human herpesvirus 7
gaauaagcaaauaaauugu

SEQ ID NO: 3997244 - RNA, 20 nt, Human herpesvirus 7
gaaucaagacgcuguaugca

SEQ ID NO: 3997245 - RNA, 23 nt, Human herpesvirus 7
gaaucagacuaaauauggagcag

SEQ ID NO: 3997246 - RNA, 19 nt, Human herpesvirus 7
gaaucauagcaggaagcac

SEQ ID NO: 3997247 - RNA, 20 nt, Human herpesvirus 7
gaaucaucuuaaaaguacaa

SEQ ID NO: 3997248 - RNA, 14 nt, Human herpesvirus 7
gaaucuauuaaaga

SEQ ID NO: 3997249 - RNA, 20 nt, Human herpesvirus 7
gaauuaauaaaacaaacuau

SEQ ID NO: 3997250 - RNA, 12 nt, Human herpesvirus 7
gaauuacagaua

SEQ ID NO: 3997251 - RNA, 22 nt, Human herpesvirus 7
gaauucaucuuaaguaaggaag

SEQ ID NO: 3997252 - RNA, 12 nt, Human herpesvirus 7
gacauugaagau

SEQ ID NO: 3997253 - RNA, 23 nt, Human herpesvirus 7
gacauuguacaauuacaaaaugu

SEQ ID NO: 3997254 - RNA, 14 nt, Human herpesvirus 7
gacgacgucuucuu

SEQ ID NO: 3997255 - RNA, 14 nt, Human herpesvirus 7
gacgaugagcauga

SEQ ID NO: 3997256 - RNA, 14 nt, Human herpesvirus 7
gacggaauuuguau

SEQ ID NO: 3997257 - RNA, 23 nt, Human herpesvirus 7
gacguuaucuaauauuauaucua

SEQ ID NO: 3997258 - RNA, 19 nt, Human herpesvirus 7
gacguuucuagcaaaauau

SEQ ID NO: 3997259 - RNA, 18 nt, Human herpesvirus 7
gagauggauugagugcau

SEQ ID NO: 3997260 - RNA, 13 nt, Human herpesvirus 7
gagauuccaaaga

SEQ ID NO: 3997261 - RNA, 23 nt, Human herpesvirus 7
gagcauauuccauuaagccagau

SEQ ID NO: 3997262 - RNA, 22 nt, Human herpesvirus 7
gagcuguguccacuacagauau

SEQ ID NO: 3997263 - RNA, 15 nt, Human herpesvirus 7
gagcuuuugcaaagc

SEQ ID NO: 3997264 - RNA, 16 nt, Human herpesvirus 7
gaggucuacuggacca

SEQ ID NO: 3997265 - RNA, 14 nt, Human herpesvirus 7
gaguauguugcaua

SEQ ID NO: 3997266 - RNA, 20 nt, Human herpesvirus 7
gaguuguuaaaauuaaaacu

SEQ ID NO: 3997267 - RNA, 15 nt, Human herpesvirus 7
gaguuuaaaguaaaa

SEQ ID NO: 3997268 - RNA, 17 nt, Human herpesvirus 7
gauaauguuuuuuucau

SEQ ID NO: 3997269 - RNA, 17 nt, Human herpesvirus 7
gauaucuuaaaauaugu

SEQ ID NO: 3997270 - RNA, 16 nt, Human herpesvirus 7
gauaugguuugaaaac

SEQ ID NO: 3997271 - RNA, 13 nt, Human herpesvirus 7
gauauuuugacaa

SEQ ID NO: 3997272 - RNA, 13 nt, Human herpesvirus 7
gaugcucucuaau

SEQ ID NO: 3997273 - RNA, 23 nt, Human herpesvirus 7
gauuacgcacaaauuucuuguaa

SEQ ID NO: 3997274 - RNA, 21 nt, Human herpesvirus 7
gauuauauucaaauaagggau

SEQ ID NO: 3997275 - RNA, 19 nt, Human herpesvirus 7
gauuauguuuucugcuaau

SEQ ID NO: 3997276 - RNA, 16 nt, Human herpesvirus 7
gauucuauaaaacgug

SEQ ID NO: 3997277 - RNA, 18 nt, Human herpesvirus 7
gauuucauggacuucaga

SEQ ID NO: 3997278 - RNA, 13 nt, Human herpesvirus 7
gauuuuaaaggaa

SEQ ID NO: 3997279 - RNA, 21 nt, Human herpesvirus 7
gauuuugacauuaguucuggc

SEQ ID NO: 3997280 - RNA, 19 nt, Human herpesvirus 7
gauuuuuaaacuugugaaa

SEQ ID NO: 3997281 - RNA, 23 nt, Human herpesvirus 7
gcaacaaacaaauaauucaaaaa

SEQ ID NO: 3997282 - RNA, 16 nt, Human herpesvirus 7
uuuaagagacauugaa

SEQ ID NO: 3997283 - RNA, 20 nt, Human herpesvirus 7
uuuaagauacauuuuugcaa

SEQ ID NO: 3997284 - RNA, 14 nt, Human herpesvirus 7
uuuaauacaacaua

SEQ ID NO: 3997285 - RNA, 13 nt, Human herpesvirus 7
uuuaauaugugaa

SEQ ID NO: 3997286 - RNA, 17 nt, Human herpesvirus 7
uuuaaugcuuugucuua

SEQ ID NO: 3997287 - RNA, 21 nt, Human herpesvirus 7
uuuaauuuggaaauuguuuga

SEQ ID NO: 3997288 - RNA, 16 nt, Human herpesvirus 7
uuuaccccaaacgccu

SEQ ID NO: 3997289 - RNA, 15 nt, Human herpesvirus 7
uuuaccgguacauuu

SEQ ID NO: 3997290 - RNA, 22 nt, Human herpesvirus 7
uuuagaaguggcuucucuaguu

SEQ ID NO: 3997291 - RNA, 21 nt, Human herpesvirus 7
uuuagcuaauucauuguauga

SEQ ID NO: 3997292 - RNA, 21 nt, Human herpesvirus 7
uuuauuauuuguuuguucugu

SEQ ID NO: 3997293 - RNA, 13 nt, Human herpesvirus 7
uuuauugccuugu

SEQ ID NO: 3997294 - RNA, 23 nt, Human herpesvirus 7
uuuauugguaauuagugaaaacu

SEQ ID NO: 3997295 - RNA, 21 nt, Human herpesvirus 7
uuucaaaauuuuauugucuaa

SEQ ID NO: 3997296 - RNA, 15 nt, Human herpesvirus 7
uuucauaucuaugau

SEQ ID NO: 3997297 - RNA, 20 nt, Human herpesvirus 7
uuuccaucuaccgcgaugaa

SEQ ID NO: 3997298 - RNA, 18 nt, Human herpesvirus 7
uuuccuacaaaaguucug

SEQ ID NO: 3997299 - RNA, 15 nt, Human herpesvirus 7
uuuccucacagauuu

SEQ ID NO: 3997300 - RNA, 16 nt, Human herpesvirus 7
uuucguaucugugacu

SEQ ID NO: 3997301 - RNA, 16 nt, Human herpesvirus 7
uuucuguagacauuuc

SEQ ID NO: 3997302 - RNA, 12 nt, Human herpesvirus 7
uuucuguugacu

SEQ ID NO: 3997303 - RNA, 20 nt, Human herpesvirus 7
uuucuuuaccgauucuaaau

SEQ ID NO: 3997304 - RNA, 17 nt, Human herpesvirus 7
uuugaaaaaaacacuuu

SEQ ID NO: 3997305 - RNA, 16 nt, Human herpesvirus 7
uuugaacuuguuuuga

SEQ ID NO: 3997306 - RNA, 19 nt, Human herpesvirus 7
uuugaagagcguguuuuga

SEQ ID NO: 3997307 - RNA, 18 nt, Human herpesvirus 7
uuugacaagcgcauuugu

SEQ ID NO: 3997308 - RNA, 21 nt, Human herpesvirus 7
uuugauacagauauuuuaauu

SEQ ID NO: 3997309 - RNA, 19 nt, Human herpesvirus 7
uuugaucaaaaucuguaga

SEQ ID NO: 3997310 - RNA, 15 nt, Human herpesvirus 7
uuugaucuacauaua

SEQ ID NO: 3997311 - RNA, 20 nt, Human herpesvirus 7
uuugauuccaucucacuuau

SEQ ID NO: 3997312 - RNA, 23 nt, Human herpesvirus 7
uuugcaaucaugauccugguuaa

SEQ ID NO: 3997313 - RNA, 17 nt, Human herpesvirus 7
uuuggauaguucguaaa

SEQ ID NO: 3997314 - RNA, 18 nt, Human herpesvirus 7
uuuguaaacauuuuugaa

SEQ ID NO: 3997315 - RNA, 19 nt, Human herpesvirus 7
uuuguagcucuagauguuu

SEQ ID NO: 3997316 - RNA, 15 nt, Human herpesvirus 7
uuuguauacaacuuu

SEQ ID NO: 3997317 - RNA, 17 nt, Human herpesvirus 7
uuuuaaacuugugaaaa

SEQ ID NO: 3997318 - RNA, 22 nt, Human herpesvirus 7
uuuuacuucgagaaaauuuagc

SEQ ID NO: 3997319 - RNA, 14 nt, Human herpesvirus 7
uuuucaggaaaauc

SEQ ID NO: 3997320 - RNA, 18 nt, Human herpesvirus 7
uuuucuuaaacaugauuu

SEQ ID NO: 3997321 - RNA, 21 nt, Human herpesvirus 7
uuuucuuagcuuucaugauuu

SEQ ID NO: 3997322 - RNA, 16 nt, Human herpesvirus 7
uuuugaauguuuacau

SEQ ID NO: 3997323 - RNA, 14 nt, Human herpesvirus 7
uuuuggaagguuua

SEQ ID NO: 3997324 - RNA, 20 nt, Human herpesvirus 7
uuuuguacauuuaauaaggu

SEQ ID NO: 3997325 - RNA, 22 nt, Human herpesvirus 7
uuuuugcauauggacuuaucaa

SEQ ID NO: 3997326 - RNA, 21 nt, Human herpesvirus 7
ccagagucucuaaaauuuucu

SEQ ID NO: 3997327 - RNA, 22 nt, Human herpesvirus 7
ccaguucuaucucaaaacaaac

SEQ ID NO: 3997328 - RNA, 22 nt, Human herpesvirus 7
ccauguauugucuuacagcacu

SEQ ID NO: 3997329 - RNA, 18 nt, Human herpesvirus 7
ccauuccguuuuaaauag

SEQ ID NO: 3997330 - RNA, 19 nt, Human herpesvirus 7
ccccuggaacguccucugg

SEQ ID NO: 3997331 - RNA, 18 nt, Human herpesvirus 7
ccgcucuuuuauuuucag

SEQ ID NO: 3997332 - RNA, 18 nt, Human herpesvirus 7
ccguuggcgaucacaaaa

SEQ ID NO: 3997333 - RNA, 21 nt, Human herpesvirus 7
ccuacaaaaguucuguuuuga

SEQ ID NO: 3997334 - RNA, 20 nt, Human herpesvirus 7
ccuaggauaccaaacaaaau

SEQ ID NO: 3997335 - RNA, 13 nt, Human herpesvirus 7
ccucacagauuuu

SEQ ID NO: 3997336 - RNA, 15 nt, Human herpesvirus 7
ccucugccucuuggc

SEQ ID NO: 3997337 - RNA, 19 nt, Human herpesvirus 7
ccugcaauaugcaugugua

SEQ ID NO: 3997338 - RNA, 23 nt, Human herpesvirus 7
ccuuauauuaaaaaccacagagg

SEQ ID NO: 3997339 - RNA, 11 nt, Human herpesvirus 7
ccuugggcaca

SEQ ID NO: 3997340 - RNA, 13 nt, Human herpesvirus 7
cgaacccuggaga

SEQ ID NO: 3997341 - RNA, 14 nt, Human herpesvirus 7
cgaaugacagacac

SEQ ID NO: 3997342 - RNA, 15 nt, Human herpesvirus 7
cgacaauauaaaaga

SEQ ID NO: 3997343 - RNA, 14 nt, Human herpesvirus 7
cgacauaauuuuaa

SEQ ID NO: 3997344 - RNA, 18 nt, Human herpesvirus 7
cgagaaaauuuagcacca

SEQ ID NO: 3997345 - RNA, 20 nt, Human herpesvirus 7
cgauccucagaauguacaca

SEQ ID NO: 3997346 - RNA, 13 nt, Human herpesvirus 7
cgaugauauuguc

SEQ ID NO: 3997347 - RNA, 20 nt, Human herpesvirus 7
cgcauuuuguauuaaaggaa

SEQ ID NO: 3997348 - RNA, 18 nt, Human herpesvirus 7
cgccaaaucuaauuuaug

SEQ ID NO: 3997349 - RNA, 15 nt, Human herpesvirus 7
cgcguuuucaugcuc

SEQ ID NO: 3997350 - RNA, 22 nt, Human herpesvirus 7
cgcuguacaaugcugucucuga

SEQ ID NO: 3997351 - RNA, 11 nt, Human herpesvirus 7
cgcugucuuua

SEQ ID NO: 3997352 - RNA, 13 nt, Human herpesvirus 7
cggauuaagagaa

SEQ ID NO: 3997353 - RNA, 18 nt, Human herpesvirus 7
cgggaggugcuguuucca

SEQ ID NO: 3997354 - RNA, 20 nt, Human herpesvirus 7
cgguacauuuauguauuuua

SEQ ID NO: 3997355 - RNA, 16 nt, Human herpesvirus 7
cggugaauguagaagu

SEQ ID NO: 3997356 - RNA, 13 nt, Human herpesvirus 7
cgucucuuugccu

SEQ ID NO: 3997357 - RNA, 12 nt, Human herpesvirus 7
cguuacuucugu

SEQ ID NO: 3997358 - RNA, 18 nt, Human herpesvirus 7
cguuucuagcaaaauaug

SEQ ID NO: 3997359 - RNA, 12 nt, Human herpesvirus 7
cuaaaaaaauuc

SEQ ID NO: 3997360 - RNA, 18 nt, Human herpesvirus 7
cuaaaaauccuaaauuuc

SEQ ID NO: 3997361 - RNA, 19 nt, Human herpesvirus 7
cuaaagacacuuauuugau

SEQ ID NO: 3997362 - RNA, 12 nt, Human herpesvirus 7
cuaaauuuccuu

SEQ ID NO: 3997363 - RNA, 23 nt, Human herpesvirus 7
cuaaccaucugcuggaaauuugu

SEQ ID NO: 3997364 - RNA, 22 nt, Human herpesvirus 7
cuaagguuuaggaaauugcuuu

SEQ ID NO: 3997365 - RNA, 15 nt, Human herpesvirus 7
cuaaugguuggauuu

SEQ ID NO: 3997366 - RNA, 19 nt, Human herpesvirus 7
cuaauucuggaaaauguga

SEQ ID NO: 3997367 - RNA, 19 nt, Human herpesvirus 7
cuaauugcgcaguguuuaa

SEQ ID NO: 3997368 - RNA, 16 nt, Human herpesvirus 7
cuacaugaauggaucu

SEQ ID NO: 3997369 - RNA, 13 nt, Human herpesvirus 7
cuacuaugggcug

SEQ ID NO: 3997370 - RNA, 13 nt, Human herpesvirus 7
cuagaaaaacacu

SEQ ID NO: 3997371 - RNA, 21 nt, Human herpesvirus 7
cuagcaccgaaaaugguauuu

SEQ ID NO: 3997372 - RNA, 17 nt, Human herpesvirus 7
cuaggucuuccacuguu

SEQ ID NO: 3997373 - RNA, 17 nt, Human herpesvirus 7
cuagugaaacacauucu

SEQ ID NO: 3997374 - RNA, 17 nt, Human herpesvirus 7
cuaguucccauuuucag

SEQ ID NO: 3997375 - RNA, 15 nt, Human herpesvirus 7
cuauauuuuguuaag

SEQ ID NO: 3997376 - RNA, 17 nt, Human herpesvirus 7
cuauucggguaaugucu

SEQ ID NO: 3997377 - RNA, 16 nt, Human herpesvirus 7
cucaauuaaaacaucu

SEQ ID NO: 3997378 - RNA, 16 nt, Human herpesvirus 7
cucagaacuguuuuaa

SEQ ID NO: 3997379 - RNA, 11 nt, Human herpesvirus 7
cucauagcuua

SEQ ID NO: 3997380 - RNA, 17 nt, Human herpesvirus 7
cuccaugcauauuugaa

SEQ ID NO: 3997381 - RNA, 16 nt, Human herpesvirus 7
cucccauucaauaaug

SEQ ID NO: 3997382 - RNA, 13 nt, Human herpesvirus 7
cuccuucuaccuc

SEQ ID NO: 3997383 - RNA, 13 nt, Human herpesvirus 7
cugaaaaaauaaa

SEQ ID NO: 3997384 - RNA, 17 nt, Human herpesvirus 7
cugaaaucaaaaaugug

SEQ ID NO: 3997385 - RNA, 18 nt, Human herpesvirus 7
cugaauagacacauuuau

SEQ ID NO: 3997386 - RNA, 17 nt, Human herpesvirus 7
cugaauccgcauuugag

SEQ ID NO: 3997387 - RNA, 19 nt, Human herpesvirus 7
cugaauugguaauguuacu

SEQ ID NO: 3997388 - RNA, 20 nt, Human herpesvirus 7
cugacauuggaacuuuaugc

SEQ ID NO: 3997389 - RNA, 15 nt, Human herpesvirus 7
cugacauuguacaau

SEQ ID NO: 3997390 - RNA, 17 nt, Human herpesvirus 7
cugagaaaaacagacuu

SEQ ID NO: 3997391 - RNA, 20 nt, Human herpesvirus 7
cugaguaaaacucaauguaa

SEQ ID NO: 3997392 - RNA, 20 nt, Human herpesvirus 7
cugauaaucaagaaacaugu

SEQ ID NO: 3997393 - RNA, 20 nt, Human herpesvirus 7
cugaugauaaucgagaauaa

SEQ ID NO: 3997394 - RNA, 17 nt, Human herpesvirus 7
cugcaaagaaaaaaaug

SEQ ID NO: 3997395 - RNA, 21 nt, Human herpesvirus 7
cugcaaccugauaaauacuca

SEQ ID NO: 3997396 - RNA, 19 nt, Human herpesvirus 7
cugcaacuuugugccugaa

SEQ ID NO: 3997397 - RNA, 12 nt, Human herpesvirus 7
cugccaauuuuu

SEQ ID NO: 3997398 - RNA, 17 nt, Human herpesvirus 7
cugccaccauuucugaa

SEQ ID NO: 3997399 - RNA, 16 nt, Human herpesvirus 7
cugcuaacucauaauu

SEQ ID NO: 3997400 - RNA, 22 nt, Human herpesvirus 7
cugcuaauucuggaaaauguga

SEQ ID NO: 3997401 - RNA, 19 nt, Human herpesvirus 7
cugcuggaaagcuugugaa

SEQ ID NO: 3997402 - RNA, 12 nt, Human herpesvirus 7
cuggaauuguaa

SEQ ID NO: 3997403 - RNA, 17 nt, Human herpesvirus 7
cuggaugauguuauaca

SEQ ID NO: 3997404 - RNA, 14 nt, Human herpesvirus 7
cuggcaauauccca

SEQ ID NO: 3997405 - RNA, 12 nt, Human herpesvirus 7
cugguauguuuu

SEQ ID NO: 3997406 - RNA, 15 nt, Human herpesvirus 7
cuguagaaaauguuu

SEQ ID NO: 3997407 - RNA, 15 nt, Human herpesvirus 7
cuguagauauuuuga

SEQ ID NO: 3997408 - RNA, 22 nt, Human herpesvirus 7
cugucagucaacuuuuuguuca

SEQ ID NO: 3997409 - RNA, 15 nt, Human herpesvirus 7
cuguuaaaaucuguu

SEQ ID NO: 3997410 - RNA, 20 nt, Human herpesvirus 7
cuguuaagaauuccagauuu

SEQ ID NO: 3997411 - RNA, 21 nt, Human herpesvirus 7
cuguugaaacauagcuagaaa

SEQ ID NO: 3997412 - RNA, 18 nt, Human herpesvirus 7
cuguugagucgaaugcau

SEQ ID NO: 3997413 - RNA, 18 nt, Human herpesvirus 7
cuguuuuucaaaaacguu

SEQ ID NO: 3997414 - RNA, 15 nt, Human herpesvirus 7
cuuaaaaaaaggccu

SEQ ID NO: 3997415 - RNA, 23 nt, Human herpesvirus 7
cuuaaauaaagaguguuuucaaa

SEQ ID NO: 3997416 - RNA, 20 nt, Human herpesvirus 7
cuuaauaaaguuuaauucuc

SEQ ID NO: 3997417 - RNA, 22 nt, Human herpesvirus 7
cuuaaugcccguuuucggaaau

SEQ ID NO: 3997418 - RNA, 20 nt, Human herpesvirus 7
cuuauaaccgauauaguuug

SEQ ID NO: 3997419 - RNA, 14 nt, Human herpesvirus 7
cuucaaaaauguuu

SEQ ID NO: 3997420 - RNA, 22 nt, Human herpesvirus 7
cuucagguuguugucauugaaa

SEQ ID NO: 3997421 - RNA, 18 nt, Human herpesvirus 7
cuucauaucugacauuca

SEQ ID NO: 3997422 - RNA, 19 nt, Human herpesvirus 7
cuucuagaaacuaaagaaa

SEQ ID NO: 3997423 - RNA, 21 nt, Human herpesvirus 7
cuucugauaucuuaaaauaug

SEQ ID NO: 3997424 - RNA, 16 nt, Human herpesvirus 7
cuucuuuauaagcagu

SEQ ID NO: 3997425 - RNA, 15 nt, Human herpesvirus 7
cuugacucagauucg

SEQ ID NO: 3997426 - RNA, 23 nt, Human herpesvirus 7
cuugauacaggccuguuucuuga

SEQ ID NO: 3997427 - RNA, 16 nt, Human herpesvirus 7
cuugauuuucuuacac

SEQ ID NO: 3997428 - RNA, 13 nt, Human herpesvirus 7
cuuggcuguucaa

SEQ ID NO: 3997429 - RNA, 20 nt, Human herpesvirus 7
cuugugaaaauaacaggaaa

SEQ ID NO: 3997430 - RNA, 20 nt, Human herpesvirus 7
cuuuaccccaaacgccuuau

SEQ ID NO: 3997431 - RNA, 13 nt, Human herpesvirus 7
cuuuaccgauucu

SEQ ID NO: 3997432 - RNA, 14 nt, Human herpesvirus 7
cuuuauuuaauaac

SEQ ID NO: 3997433 - RNA, 23 nt, Human herpesvirus 7
cuuucacuacuacaugaauggau

SEQ ID NO: 3997434 - RNA, 18 nt, Human herpesvirus 7
cuuugacuguaucuccaa

SEQ ID NO: 3997435 - RNA, 12 nt, Human herpesvirus 7
cuuugucaugau

SEQ ID NO: 3997436 - RNA, 19 nt, Human herpesvirus 7
cuuugucugcugguaauaa

SEQ ID NO: 3997437 - RNA, 13 nt, Human herpesvirus 7
cuuuguuugagac

SEQ ID NO: 3997438 - RNA, 13 nt, Human herpesvirus 7
cuuuucagugaag

SEQ ID NO: 3997439 - RNA, 14 nt, Human herpesvirus 7
cuuuucaugcuuug

SEQ ID NO: 3997440 - RNA, 21 nt, Human herpesvirus 7
cuuuucucuccccaguaaaua

SEQ ID NO: 3997441 - RNA, 16 nt, Human herpesvirus 7
uaacuuuaaauuauua

SEQ ID NO: 3997442 - RNA, 21 nt, Human herpesvirus 7
uaagaaauuuucuuuuggaag

SEQ ID NO: 3997443 - RNA, 12 nt, Human herpesvirus 7
uaagccaaauau

SEQ ID NO: 3997444 - RNA, 16 nt, Human herpesvirus 7
uaauaacaauuugaag

SEQ ID NO: 3997445 - RNA, 19 nt, Human herpesvirus 7
uaauaauuuaaaauuauua

SEQ ID NO: 3997446 - RNA, 14 nt, Human herpesvirus 7
uaauaucaauuuga

SEQ ID NO: 3997447 - RNA, 17 nt, Human herpesvirus 7
uaaucauaguacaucuu

SEQ ID NO: 3997448 - RNA, 17 nt, Human herpesvirus 7
uaaucauggaaaaugga

SEQ ID NO: 3997449 - RNA, 21 nt, Human herpesvirus 7
uaaucgauuaugauguuugua

SEQ ID NO: 3997450 - RNA, 17 nt, Human herpesvirus 7
uaaugaaaaagccauaa

SEQ ID NO: 3997451 - RNA, 19 nt, Human herpesvirus 7
uaaugaaguuuaucuugga

SEQ ID NO: 3997452 - RNA, 15 nt, Human herpesvirus 7
uaaugaauaaaaucu

SEQ ID NO: 3997453 - RNA, 12 nt, Human herpesvirus 7
uaaugucucugu

SEQ ID NO: 3997454 - RNA, 13 nt, Human herpesvirus 7
uaauguuacuaua

SEQ ID NO: 3997455 - RNA, 20 nt, Human herpesvirus 7
uaauucucgcuucaaagaua

SEQ ID NO: 3997456 - RNA, 21 nt, Human herpesvirus 7
uaauuguuuuuuauuuagcua

SEQ ID NO: 3997457 - RNA, 16 nt, Human herpesvirus 7
uaauuucucaaaucaa

SEQ ID NO: 3997458 - RNA, 20 nt, Human herpesvirus 7
uacaaaacaaagauugaagc

SEQ ID NO: 3997459 - RNA, 14 nt, Human herpesvirus 7
uacaaaagacauaa

SEQ ID NO: 3997460 - RNA, 14 nt, Human herpesvirus 7
uacaaaaguucugu

SEQ ID NO: 3997461 - RNA, 19 nt, Human herpesvirus 7
uacaacgacauugaaacuc

SEQ ID NO: 3997462 - RNA, 17 nt, Human herpesvirus 7
uacaaugcugucucuga

SEQ ID NO: 3997463 - RNA, 16 nt, Human herpesvirus 7
uacaauuacaaaaugu

SEQ ID NO: 3997464 - RNA, 20 nt, Human herpesvirus 7
uacagauacgcgcagauuuu

SEQ ID NO: 3997465 - RNA, 13 nt, Human herpesvirus 7
uacagcacuuuga

SEQ ID NO: 3997466 - RNA, 22 nt, Human herpesvirus 7
uaccguuuaaugaaaaagccau

SEQ ID NO: 3997467 - RNA, 14 nt, Human herpesvirus 7
uacuaaucaugaaa

SEQ ID NO: 3997468 - RNA, 18 nt, Human herpesvirus 7
uacucuagaacaaacugu

SEQ ID NO: 3997469 - RNA, 23 nt, Human herpesvirus 7
uacuggaccacguuuuugcagag

SEQ ID NO: 3997470 - RNA, 21 nt, Human herpesvirus 7
uacuuaaggcggacaaauaua

SEQ ID NO: 3997471 - RNA, 18 nt, Human herpesvirus 7
uacuugauuuucuuacac

SEQ ID NO: 3997472 - RNA, 15 nt, Human herpesvirus 7
uacuuggaaacaaau

SEQ ID NO: 3997473 - RNA, 15 nt, Human herpesvirus 7
uacuuuuacuccuca

SEQ ID NO: 3997474 - RNA, 14 nt, Human herpesvirus 7
uagaaaccaaguuu

SEQ ID NO: 3997475 - RNA, 17 nt, Human herpesvirus 7
uagaaacgucccuguga

SEQ ID NO: 3997476 - RNA, 18 nt, Human herpesvirus 7
uagaacaaacuguaccca

SEQ ID NO: 3997477 - RNA, 17 nt, Human herpesvirus 7
uagacguagugucauca

SEQ ID NO: 3997478 - RNA, 12 nt, Human herpesvirus 7
uagagcugaaua

SEQ ID NO: 3997479 - RNA, 12 nt, Human herpesvirus 7
uagaugcaucca

SEQ ID NO: 3997480 - RNA, 17 nt, Human herpesvirus 7
uagauguuuuugauauu

SEQ ID NO: 3997481 - RNA, 19 nt, Human herpesvirus 7
uagcauaugcuggaucuuc

SEQ ID NO: 3997482 - RNA, 15 nt, Human herpesvirus 7
uagccauaaaugcuu

SEQ ID NO: 3997483 - RNA, 15 nt, Human herpesvirus 7
uagccuuucggacac

SEQ ID NO: 3997484 - RNA, 13 nt, Human herpesvirus 7
uaggauaccaaac

SEQ ID NO: 3997485 - RNA, 22 nt, Human herpesvirus 7
uaguauuguaauaauuuaaaau

SEQ ID NO: 3997486 - RNA, 21 nt, Human herpesvirus 7
uagugauagaguacauguguc

SEQ ID NO: 3997487 - RNA, 13 nt, Human herpesvirus 7
uaguuaauugugu

SEQ ID NO: 3997488 - RNA, 19 nt, Human herpesvirus 7
uaguugcaacucuucuuca

SEQ ID NO: 3997489 - RNA, 23 nt, Human herpesvirus 7
uauaauaaaggaaagacaaacua

SEQ ID NO: 3997490 - RNA, 22 nt, Human herpesvirus 7
uauacauacuaaauuucuuaaa

SEQ ID NO: 3997491 - RNA, 15 nt, Human herpesvirus 7
uauacgcuuaaaauu

SEQ ID NO: 3997492 - RNA, 15 nt, Human herpesvirus 7
uauagaucuugacuc

SEQ ID NO: 3997493 - RNA, 17 nt, Human herpesvirus 7
uauauccaauaaugcau

SEQ ID NO: 3997494 - RNA, 14 nt, Human herpesvirus 7
uauaugaaauuuca

SEQ ID NO: 3997495 - RNA, 19 nt, Human herpesvirus 7
uauaugaagaauguaugaa

SEQ ID NO: 3997496 - RNA, 20 nt, Human herpesvirus 7
uauccacgcgggguuaaaaa

SEQ ID NO: 3997497 - RNA, 14 nt, Human herpesvirus 7
uaucgcguuuucau

SEQ ID NO: 3997498 - RNA, 15 nt, Human herpesvirus 7
uaucuccauucuaaa

SEQ ID NO: 3997499 - RNA, 20 nt, Human herpesvirus 7
uaucuccuaaaugaauuuua

SEQ ID NO: 3997500 - RNA, 18 nt, Human herpesvirus 7
uaucucuguaaaacguuc

SEQ ID NO: 3997501 - RNA, 16 nt, Human herpesvirus 7
uaucuuuucaaaggaa

SEQ ID NO: 3997502 - RNA, 21 nt, Human herpesvirus 7
uaugaaaagcccaaacuguuu

SEQ ID NO: 3997503 - RNA, 15 nt, Human herpesvirus 7
uaugaguuugauugu

SEQ ID NO: 3997504 - RNA, 16 nt, Human herpesvirus 7
uauguauuuuacugga

SEQ ID NO: 3997505 - RNA, 21 nt, Human herpesvirus 7
uauuaacaagcacacuaaaaa

SEQ ID NO: 3997506 - RNA, 21 nt, Human herpesvirus 7
uauuaaguguuugcucugaaa

SEQ ID NO: 3997507 - RNA, 18 nt, Human herpesvirus 7
uauuagauuauacaaauc

SEQ ID NO: 3997508 - RNA, 19 nt, Human herpesvirus 7
uauucaaauuccuccugaa

SEQ ID NO: 3997509 - RNA, 16 nt, Human herpesvirus 7
uauugaaaauuuauug

SEQ ID NO: 3997510 - RNA, 19 nt, Human herpesvirus 7
uauuuaaugguuuuaaaau

SEQ ID NO: 3997511 - RNA, 23 nt, Human herpesvirus 7
uauuuagacuuuuuucuuuaaau

SEQ ID NO: 3997512 - RNA, 22 nt, Human herpesvirus 7
uauuucgguuggaaaugaugau

SEQ ID NO: 3997513 - RNA, 20 nt, Human herpesvirus 7
uauuuuuuaaagaaaagcuu

SEQ ID NO: 3997514 - RNA, 14 nt, Human herpesvirus 7
ucaaaucaauguga

SEQ ID NO: 3997515 - RNA, 23 nt, Human herpesvirus 7
ucaaauuccuccugaaaauuugu

SEQ ID NO: 3997516 - RNA, 19 nt, Human herpesvirus 7
ucaaauuuaucucauagcu

SEQ ID NO: 3997517 - RNA, 22 nt, Human herpesvirus 7
ucaacagagcgcuuugcuuauu

SEQ ID NO: 3997518 - RNA, 22 nt, Human herpesvirus 7
ucaagaaauaaugaaggauggc

SEQ ID NO: 3997519 - RNA, 14 nt, Human herpesvirus 7
ucaagcacaaucac

SEQ ID NO: 3997520 - RNA, 16 nt, Human herpesvirus 7
ucaauaaaugguuuua

SEQ ID NO: 3997521 - RNA, 15 nt, Human herpesvirus 7
ucaaugcaucuuuaa

SEQ ID NO: 3997522 - RNA, 13 nt, Human herpesvirus 7
ucacaauggaaag

SEQ ID NO: 3997523 - RNA, 14 nt, Human herpesvirus 7
ucacagacgcauca

SEQ ID NO: 3997524 - RNA, 15 nt, Human herpesvirus 7
ucacauugucacugc

SEQ ID NO: 3997525 - RNA, 21 nt, Human herpesvirus 7
ucaccaaagaguauacaaaag

SEQ ID NO: 3997526 - RNA, 20 nt, Human herpesvirus 7
ucagaaaaaaucaaaacauu

SEQ ID NO: 3997527 - RNA, 17 nt, Human herpesvirus 7
ucagaaauguuacuuaa

SEQ ID NO: 3997528 - RNA, 14 nt, Human herpesvirus 7
ucagaauuuccaga

SEQ ID NO: 3997529 - RNA, 23 nt, Human herpesvirus 7
ucaguacaacgacauugaaacuc

SEQ ID NO: 3997530 - RNA, 13 nt, Human herpesvirus 7
ucauaccauaaau

SEQ ID NO: 3997531 - RNA, 16 nt, Human herpesvirus 7
ucauagagaaaacauu

SEQ ID NO: 3997532 - RNA, 14 nt, Human herpesvirus 7
ucauagguugcuau

SEQ ID NO: 3997533 - RNA, 20 nt, Human herpesvirus 7
ucauccaaaaagaaacuuuc

SEQ ID NO: 3997534 - RNA, 18 nt, Human herpesvirus 7
ucaugcgauaucugacug

SEQ ID NO: 3997535 - RNA, 19 nt, Human herpesvirus 7
ucaugcggaagaacaagca

SEQ ID NO: 3997536 - RNA, 14 nt, Human herpesvirus 7
ucauuguacauuuu

SEQ ID NO: 3997537 - RNA, 22 nt, Human herpesvirus 7
ucauuuaucaggugcucuaaau

SEQ ID NO: 3997538 - RNA, 21 nt, Human herpesvirus 7
uccaaucauaauuuucaugaa

SEQ ID NO: 3997539 - RNA, 15 nt, Human herpesvirus 7
uccacucuccugaaa

SEQ ID NO: 3997540 - RNA, 17 nt, Human herpesvirus 7
uccagauaugacaaauu

SEQ ID NO: 3997541 - RNA, 22 nt, Human herpesvirus 7
uccaucuuaugauaaagaaaac

SEQ ID NO: 3997542 - RNA, 17 nt, Human herpesvirus 7
ucccaugccuauucaaa

SEQ ID NO: 3997543 - RNA, 24 nt, Human herpesvirus 7
uccugcaauaauaaacauuguguu

SEQ ID NO: 3997544 - RNA, 19 nt, Human herpesvirus 7
uccuuauauuaaaaaccac

SEQ ID NO: 3997545 - RNA, 23 nt, Human herpesvirus 7
uccuuugauagggauucuuugaa

SEQ ID NO: 3997546 - RNA, 23 nt, Human herpesvirus 7
ucgauguuuuaucuaacacugca

SEQ ID NO: 3997547 - RNA, 13 nt, Human herpesvirus 7
ucgcugaugaaaa

SEQ ID NO: 3997548 - RNA, 19 nt, Human herpesvirus 7
ucgcuuggguuugaucgag

SEQ ID NO: 3997549 - RNA, 21 nt, Human herpesvirus 7
ucguaacgaauaaaaaguuuu

SEQ ID NO: 3997550 - RNA, 15 nt, Human herpesvirus 7
ucuaaaaaacaaaaa

SEQ ID NO: 3997551 - RNA, 17 nt, Human herpesvirus 7
ucuaacacugcaagcug

SEQ ID NO: 3997552 - RNA, 22 nt, Human herpesvirus 7
ucuaaccccgcucuuuuauuuu

SEQ ID NO: 3997553 - RNA, 15 nt, Human herpesvirus 7
ucuaauugcagacua

SEQ ID NO: 3997554 - RNA, 23 nt, Human herpesvirus 7
ucuaccucuuacauuugauuuua

SEQ ID NO: 3997555 - RNA, 17 nt, Human herpesvirus 7
uuuuuguuguuuucaua

SEQ ID NO: 3997556 - RNA, 19 nt, Human herpesvirus 7
ugaauuuuaaguggaaucu

SEQ ID NO: 3997557 - RNA, 19 nt, Human herpesvirus 7
ugacagauuuaagugcaca

SEQ ID NO: 3997558 - RNA, 22 nt, Human herpesvirus 7
ugacauuguacaauuacaaaau

SEQ ID NO: 3997559 - RNA, 13 nt, Human herpesvirus 7
ugacccugucaca

SEQ ID NO: 3997560 - RNA, 16 nt, Human herpesvirus 7
ugacgaagcuaaacuu

SEQ ID NO: 3997561 - RNA, 22 nt, Human herpesvirus 7
ugacucagauucgacuucuaaa

SEQ ID NO: 3997562 - RNA, 21 nt, Human herpesvirus 7
ugacuccuuuuuuucugcucg

SEQ ID NO: 3997563 - RNA, 14 nt, Human herpesvirus 7
ugacuguaucucca

SEQ ID NO: 3997564 - RNA, 21 nt, Human herpesvirus 7
ugagaaucauagcaggaagca

SEQ ID NO: 3997565 - RNA, 17 nt, Human herpesvirus 7
ugagacucacuccuugc

SEQ ID NO: 3997566 - RNA, 22 nt, Human herpesvirus 7
ugaggaaaugucuuugucauga

SEQ ID NO: 3997567 - RNA, 18 nt, Human herpesvirus 7
ugaguauaacucaaaaga

SEQ ID NO: 3997568 - RNA, 16 nt, Human herpesvirus 7
ugauaaugaaacuguu

SEQ ID NO: 3997569 - RNA, 18 nt, Human herpesvirus 7
ugauagccauaaaugcuu

SEQ ID NO: 3997570 - RNA, 15 nt, Human herpesvirus 7
ugauccugcuauuca

SEQ ID NO: 3997571 - RNA, 23 nt, Human herpesvirus 7
ugaucuugucaaaaaaaauuaaa

SEQ ID NO: 3997572 - RNA, 17 nt, Human herpesvirus 7
ugauuguggggcauuca

SEQ ID NO: 3997573 - RNA, 19 nt, Human herpesvirus 7
ugcaacauaaccaaugcug

SEQ ID NO: 3997574 - RNA, 21 nt, Human herpesvirus 7
ugcaauaugcuagaagacugc

SEQ ID NO: 3997575 - RNA, 19 nt, Human herpesvirus 7
ugcaauuuucacaauggaa

SEQ ID NO: 3997576 - RNA, 22 nt, Human herpesvirus 7
ugcaguuauuucuuauuggaga

SEQ ID NO: 3997577 - RNA, 15 nt, Human herpesvirus 7
ugcauauuugaacau

SEQ ID NO: 3997578 - RNA, 12 nt, Human herpesvirus 7
ugcaugaaaucu

SEQ ID NO: 3997579 - RNA, 18 nt, Human herpesvirus 7
ugcaugcuaauauuucca

SEQ ID NO: 3997580 - RNA, 17 nt, Human herpesvirus 7
ugcgaauacuuguugag

SEQ ID NO: 3997581 - RNA, 15 nt, Human herpesvirus 7
ugcgcggauuaagag

SEQ ID NO: 3997582 - RNA, 13 nt, Human herpesvirus 7
ugcggaagaacaa

SEQ ID NO: 3997583 - RNA, 12 nt, Human herpesvirus 7
ugcgucucuuug

SEQ ID NO: 3997584 - RNA, 13 nt, Human herpesvirus 7
ugcuaugaaaauu

SEQ ID NO: 3997585 - RNA, 17 nt, Human herpesvirus 7
ugcuauuauuaaagcuu

SEQ ID NO: 3997586 - RNA, 12 nt, Human herpesvirus 7
ugcucaaaucaa

SEQ ID NO: 3997587 - RNA, 21 nt, Human herpesvirus 7
ugcuggcucaagcacaaucac

SEQ ID NO: 3997588 - RNA, 21 nt, Human herpesvirus 7
ugcugucuuggaguauuacca

SEQ ID NO: 3997589 - RNA, 22 nt, Human herpesvirus 7
ugcuuacgugaugccauaauuu

SEQ ID NO: 3997590 - RNA, 23 nt, Human herpesvirus 7
ugcuuccuaaaaaaaaaggaaaa

SEQ ID NO: 3997591 - RNA, 21 nt, Human herpesvirus 7
ugcuuuagaauuagagugcuu

SEQ ID NO: 3997592 - RNA, 14 nt, Human herpesvirus 7
uggaacaugaaaac

SEQ ID NO: 3997593 - RNA, 17 nt, Human herpesvirus 7
uggagaccgcacaggcu

SEQ ID NO: 3997594 - RNA, 21 nt, Human herpesvirus 7
uggauaaccaaacuauauuga

SEQ ID NO: 3997595 - RNA, 21 nt, Human herpesvirus 7
uggaucuucugcuaacucaua

SEQ ID NO: 3997596 - RNA, 17 nt, Human herpesvirus 7
ugggcguaacugugacg

SEQ ID NO: 3997597 - RNA, 19 nt, Human herpesvirus 7
uggguaauuuuaaaacuga

SEQ ID NO: 3997598 - RNA, 15 nt, Human herpesvirus 7
ugguaaaaaaguuug

SEQ ID NO: 3997599 - RNA, 15 nt, Human herpesvirus 7
ugguaauaauagugg

SEQ ID NO: 3997600 - RNA, 21 nt, Human herpesvirus 7
uggugcucaaacguucuuggu

SEQ ID NO: 3997601 - RNA, 18 nt, Human herpesvirus 7
ugguugauuugagcagug

SEQ ID NO: 3997602 - RNA, 16 nt, Human herpesvirus 7
uguaaaaaaaaguugu

SEQ ID NO: 3997603 - RNA, 19 nt, Human herpesvirus 7
uguaaccuuggcuguucaa

SEQ ID NO: 3997604 - RNA, 17 nt, Human herpesvirus 7
uguaacuguuuuucaaa

SEQ ID NO: 3997605 - RNA, 13 nt, Human herpesvirus 7
uguaaguaaauuu

SEQ ID NO: 3997606 - RNA, 17 nt, Human herpesvirus 7
uguacgauuuauaucug

SEQ ID NO: 3997607 - RNA, 17 nt, Human herpesvirus 7
uguagacguagugucau

SEQ ID NO: 3997608 - RNA, 15 nt, Human herpesvirus 7
uguaguuuuugcaua

SEQ ID NO: 3997609 - RNA, 22 nt, Human herpesvirus 7
uguauaaucuuaauguuucuga

SEQ ID NO: 3997610 - RNA, 19 nt, Human herpesvirus 7
uguaucaauauucgaauuu

SEQ ID NO: 3997611 - RNA, 13 nt, Human herpesvirus 7
uguauuugucucu

SEQ ID NO: 3997612 - RNA, 23 nt, Human herpesvirus 7
ugucagaguuuaaaguaaaauua

SEQ ID NO: 3997613 - RNA, 21 nt, Human herpesvirus 7
ugucucuugaagaacaacaug

SEQ ID NO: 3997614 - RNA, 13 nt, Human herpesvirus 7
ugucugauucuua

SEQ ID NO: 3997615 - RNA, 22 nt, Human herpesvirus 7
ugucuucggccuugcugaagau

SEQ ID NO: 3997616 - RNA, 15 nt, Human herpesvirus 7
ugugaaaauaaacag

SEQ ID NO: 3997617 - RNA, 18 nt, Human herpesvirus 7
ugugaaaauaaacaggaa

SEQ ID NO: 3997618 - RNA, 20 nt, Human herpesvirus 7
ugugaagucuuuauaaagga

SEQ ID NO: 3997619 - RNA, 16 nt, Human herpesvirus 7
ugugaaguuugcugaa

SEQ ID NO: 3997620 - RNA, 15 nt, Human herpesvirus 7
ugugacccugucaca

SEQ ID NO: 3997621 - RNA, 16 nt, Human herpesvirus 7
ugugagugaacauuug

SEQ ID NO: 3997622 - RNA, 17 nt, Human herpesvirus 7
uguguacuaaagccaau

SEQ ID NO: 3997623 - RNA, 12 nt, Human herpesvirus 7
uguguuggaaac

SEQ ID NO: 3997624 - RNA, 23 nt, Human herpesvirus 7
uguuaaaacuuggauaaccaaac

SEQ ID NO: 3997625 - RNA, 20 nt, Human herpesvirus 7
uguuacagcuuucauuauuu

SEQ ID NO: 3997626 - RNA, 19 nt, Human herpesvirus 7
uguuacaucauguuaaaaa

SEQ ID NO: 3997627 - RNA, 15 nt, Human herpesvirus 7
uguuacaugaucuug

SEQ ID NO: 3997628 - RNA, 14 nt, Human herpesvirus 7
uguuccauucaaua

SEQ ID NO: 3997629 - RNA, 18 nt, Human herpesvirus 7
uguuccuuauauuaaaaa

SEQ ID NO: 3997630 - RNA, 17 nt, Human herpesvirus 7
uguugaaguugaacaau

SEQ ID NO: 3997631 - RNA, 13 nt, Human herpesvirus 7
uguuuaaaauguu

SEQ ID NO: 3997632 - RNA, 20 nt, Human herpesvirus 7
uguuuaaauuacaguaaauu

SEQ ID NO: 3997633 - RNA, 16 nt, Human herpesvirus 7
uguuuaagacauuauu

SEQ ID NO: 3997634 - RNA, 12 nt, Human herpesvirus 7
uguuuacacauu

SEQ ID NO: 3997635 - RNA, 15 nt, Human herpesvirus 7
uguuuggcaacucuu

SEQ ID NO: 3997636 - RNA, 22 nt, Human herpesvirus 7
uguuuucaaauaucucuguuuu

SEQ ID NO: 3997637 - RNA, 13 nt, Human herpesvirus 7
uuaaaaauauuca

SEQ ID NO: 3997638 - RNA, 18 nt, Human herpesvirus 7
uuaaaacauuuacaaaaa

SEQ ID NO: 3997639 - RNA, 15 nt, Human herpesvirus 7
uuaaaaguucauaau

SEQ ID NO: 3997640 - RNA, 17 nt, Human herpesvirus 7
uuaaaauuaaaacuugg

SEQ ID NO: 3997641 - RNA, 14 nt, Human herpesvirus 7
uuaaaauuauuaau

SEQ ID NO: 3997642 - RNA, 22 nt, Human herpesvirus 7
uuaaaauucucuauuguucuuu

SEQ ID NO: 3997643 - RNA, 13 nt, Human herpesvirus 7
uuaaacuuaucag

SEQ ID NO: 3997644 - RNA, 22 nt, Human herpesvirus 7
uuaaaucaguuguuggaaauac

SEQ ID NO: 3997645 - RNA, 18 nt, Human herpesvirus 7
uuaaauccgugaaugcug

SEQ ID NO: 3997646 - RNA, 20 nt, Human herpesvirus 7
uuaacaugaguacuguuucu

SEQ ID NO: 3997647 - RNA, 14 nt, Human herpesvirus 7
uuaacgaaugacag

SEQ ID NO: 3997648 - RNA, 14 nt, Human herpesvirus 7
uuaagaaauaaaag

SEQ ID NO: 3997649 - RNA, 20 nt, Human herpesvirus 7
uuaagcuuuuguaaacauga

SEQ ID NO: 3997650 - RNA, 19 nt, Human herpesvirus 7
uuaaucauaucuugcuuag

SEQ ID NO: 3997651 - RNA, 22 nt, Human herpesvirus 7
uuaauuauucggugucuucuug

SEQ ID NO: 3997652 - RNA, 20 nt, Human herpesvirus 7
uuacaacuuugccaaugcca

SEQ ID NO: 3997653 - RNA, 13 nt, Human herpesvirus 7
uuacacugauuuu

SEQ ID NO: 3997654 - RNA, 20 nt, Human herpesvirus 7
uuacagccuguacaaauuuc

SEQ ID NO: 3997655 - RNA, 21 nt, Human herpesvirus 7
uuacgaaacaauuucacagac

SEQ ID NO: 3997656 - RNA, 17 nt, Human herpesvirus 7
uuacuuacgugaguguu

SEQ ID NO: 3997657 - RNA, 14 nt, Human herpesvirus 7
uuacuuauuuuaaa

SEQ ID NO: 3997658 - RNA, 17 nt, Human herpesvirus 7
uuagaaaaaaaacauua

SEQ ID NO: 3997659 - RNA, 20 nt, Human herpesvirus 7
uuagaugcauccaaagaaaa

SEQ ID NO: 3997660 - RNA, 21 nt, Human herpesvirus 7
uuaguacuuuuucuggaaugu

SEQ ID NO: 3997661 - RNA, 21 nt, Human herpesvirus 7
uuagucggcacacguacaaua

SEQ ID NO: 3997662 - RNA, 17 nt, Human herpesvirus 7
uuauaagaauuuggaua

SEQ ID NO: 3997663 - RNA, 17 nt, Human herpesvirus 7
uuauaauacuggcaugu

SEQ ID NO: 3997664 - RNA, 22 nt, Human herpesvirus 7
uuaucauacguuuacaguuuuu

SEQ ID NO: 3997665 - RNA, 16 nt, Human herpesvirus 7
uuaucugcauugauuu

SEQ ID NO: 3997666 - RNA, 17 nt, Human herpesvirus 7
uuaucuggagaacaauu

SEQ ID NO: 3997667 - RNA, 18 nt, Human herpesvirus 7
uuauggauacaaggaaaa

SEQ ID NO: 3997668 - RNA, 20 nt, Human herpesvirus 7
uuauguccgcuuacaagaug

SEQ ID NO: 3997669 - RNA, 15 nt, Human herpesvirus 7
uuauguguacacuuu

SEQ ID NO: 3997670 - RNA, 19 nt, Human herpesvirus 7
uuauuaauuuuuaauucuu

SEQ ID NO: 3997671 - RNA, 20 nt, Human herpesvirus 7
uucaaaaaccgggcuuuuuu

SEQ ID NO: 3997672 - RNA, 17 nt, Human herpesvirus 7
augaugacaaaaaauuu

SEQ ID NO: 3997673 - RNA, 14 nt, Human herpesvirus 7
augauggaaagcaa

SEQ ID NO: 3997674 - RNA, 20 nt, Human herpesvirus 7
augauugguaaaaaauuacu

SEQ ID NO: 3997675 - RNA, 18 nt, Human herpesvirus 7
augauuuaauauagaaau

SEQ ID NO: 3997676 - RNA, 21 nt, Human herpesvirus 7
augcaagaaaguccaaaguga

SEQ ID NO: 3997677 - RNA, 20 nt, Human herpesvirus 7
augcagaccguaaaacaauc

SEQ ID NO: 3997678 - RNA, 15 nt, Human herpesvirus 7
augcagacugcgcuu

SEQ ID NO: 3997679 - RNA, 14 nt, Human herpesvirus 7
augcauccaaagaa

SEQ ID NO: 3997680 - RNA, 19 nt, Human herpesvirus 7
augccacaaaaaacuuuga

SEQ ID NO: 3997681 - RNA, 15 nt, Human herpesvirus 7
augccagaaauuaaa

SEQ ID NO: 3997682 - RNA, 17 nt, Human herpesvirus 7
augccugcaauaugcau

SEQ ID NO: 3997683 - RNA, 18 nt, Human herpesvirus 7
augccuugccaaaagcuu

SEQ ID NO: 3997684 - RNA, 15 nt, Human herpesvirus 7
augcuuuaacuggaa

SEQ ID NO: 3997685 - RNA, 14 nt, Human herpesvirus 7
auggauacaaggaa

SEQ ID NO: 3997686 - RNA, 16 nt, Human herpesvirus 7
auggauacaaggaaaa

SEQ ID NO: 3997687 - RNA, 13 nt, Human herpesvirus 7
auggaugugcaca

SEQ ID NO: 3997688 - RNA, 22 nt, Human herpesvirus 7
auggggcauuaauucuuucagu

SEQ ID NO: 3997689 - RNA, 13 nt, Human herpesvirus 7
augguaagcaaaa

SEQ ID NO: 3997690 - RNA, 20 nt, Human herpesvirus 7
augguaagcaaaaaaaggua

SEQ ID NO: 3997691 - RNA, 17 nt, Human herpesvirus 7
auguacaauuugcauaa

SEQ ID NO: 3997692 - RNA, 20 nt, Human herpesvirus 7
auguaugaaaaaaacauuau

SEQ ID NO: 3997693 - RNA, 21 nt, Human herpesvirus 7
augucuaaaaguacaguguau

SEQ ID NO: 3997694 - RNA, 16 nt, Human herpesvirus 7
augucugauucuuauu

SEQ ID NO: 3997695 - RNA, 12 nt, Human herpesvirus 7
augugaaaagaa

SEQ ID NO: 3997696 - RNA, 17 nt, Human herpesvirus 7
augugaaaauaaacagg

SEQ ID NO: 3997697 - RNA, 15 nt, Human herpesvirus 7
auguuacccaaaaug

SEQ ID NO: 3997698 - RNA, 14 nt, Human herpesvirus 7
auguugcaaauguu

SEQ ID NO: 3997699 - RNA, 21 nt, Human herpesvirus 7
auguuuuagaccuaucaaauu

SEQ ID NO: 3997700 - RNA, 18 nt, Human herpesvirus 7
auuaaaauguacauaacu

SEQ ID NO: 3997701 - RNA, 15 nt, Human herpesvirus 7
auuaaacgaacucuu

SEQ ID NO: 3997702 - RNA, 12 nt, Human herpesvirus 7
auuaaguguuug

SEQ ID NO: 3997703 - RNA, 18 nt, Human herpesvirus 7
auuaauguaauuuaugau

SEQ ID NO: 3997704 - RNA, 16 nt, Human herpesvirus 7
auuaauucuagcagcu

SEQ ID NO: 3997705 - RNA, 13 nt, Human herpesvirus 7
auuaauugcagcu

SEQ ID NO: 3997706 - RNA, 19 nt, Human herpesvirus 7
auuacauugcagucaaaga

SEQ ID NO: 3997707 - RNA, 18 nt, Human herpesvirus 7
auuagauuccauuuaaau

SEQ ID NO: 3997708 - RNA, 17 nt, Human herpesvirus 7
auuagcgcgugaacaaa

SEQ ID NO: 3997709 - RNA, 14 nt, Human herpesvirus 7
auuauaagaaucug

SEQ ID NO: 3997710 - RNA, 19 nt, Human herpesvirus 7
auuauauccaauaaugcau

SEQ ID NO: 3997711 - RNA, 17 nt, Human herpesvirus 7
auuauaucuaaagugga

SEQ ID NO: 3997712 - RNA, 19 nt, Human herpesvirus 7
auuauaucuuaauaaaguu

SEQ ID NO: 3997713 - RNA, 16 nt, Human herpesvirus 7
auuauauucaaauaag

SEQ ID NO: 3997714 - RNA, 16 nt, Human herpesvirus 7
auuauuaaagcuuuca

SEQ ID NO: 3997715 - RNA, 20 nt, Human herpesvirus 7
auucaaucaccaaagaguau

SEQ ID NO: 3997716 - RNA, 14 nt, Human herpesvirus 7
auucaaucugcaaa

SEQ ID NO: 3997717 - RNA, 17 nt, Human herpesvirus 7
auucaaugcuaguguuc

SEQ ID NO: 3997718 - RNA, 18 nt, Human herpesvirus 7
auucauuugugaaauuga

SEQ ID NO: 3997719 - RNA, 16 nt, Human herpesvirus 7
auuccaaaauguaaac

SEQ ID NO: 3997720 - RNA, 17 nt, Human herpesvirus 7
auuccuucuaaauucuu

SEQ ID NO: 3997721 - RNA, 15 nt, Human herpesvirus 7
auucuaauauguaug

SEQ ID NO: 3997722 - RNA, 18 nt, Human herpesvirus 7
auucuacauagaaaucuu

SEQ ID NO: 3997723 - RNA, 16 nt, Human herpesvirus 7
auucugaauaaaagua

SEQ ID NO: 3997724 - RNA, 14 nt, Human herpesvirus 7
auucuugucaacuu

SEQ ID NO: 3997725 - RNA, 12 nt, Human herpesvirus 7
auucuuucaguu

SEQ ID NO: 3997726 - RNA, 13 nt, Human herpesvirus 7
auucuuuguacuu

SEQ ID NO: 3997727 - RNA, 21 nt, Human herpesvirus 7
auucuuuugcgggaaaaaacg

SEQ ID NO: 3997728 - RNA, 12 nt, Human herpesvirus 7
auugaaaguaaa

SEQ ID NO: 3997729 - RNA, 23 nt, Human herpesvirus 7
auugaauggaacauguuuguaaa

SEQ ID NO: 3997730 - RNA, 14 nt, Human herpesvirus 7
auugauuauaugca

SEQ ID NO: 3997731 - RNA, 14 nt, Human herpesvirus 7
auugcagucaaaga

SEQ ID NO: 3997732 - RNA, 14 nt, Human herpesvirus 7
auugccgauuccua

SEQ ID NO: 3997733 - RNA, 14 nt, Human herpesvirus 7
auugcuuuuagaaa

SEQ ID NO: 3997734 - RNA, 19 nt, Human herpesvirus 7
auuggcaugcuuacaguga

SEQ ID NO: 3997735 - RNA, 14 nt, Human herpesvirus 7
auugguaauuagug

SEQ ID NO: 3997736 - RNA, 15 nt, Human herpesvirus 7
auuguaaauggcaaa

SEQ ID NO: 3997737 - RNA, 23 nt, Human herpesvirus 7
auuguagauggcaccaauagaaa

SEQ ID NO: 3997738 - RNA, 16 nt, Human herpesvirus 7
auuguccuuucaacga

SEQ ID NO: 3997739 - RNA, 23 nt, Human herpesvirus 7
auuuacuaucgacaaacagaaaa

SEQ ID NO: 3997740 - RNA, 18 nt, Human herpesvirus 7
auuuauauuugcuugcug

SEQ ID NO: 3997741 - RNA, 18 nt, Human herpesvirus 7
auuucagaauuuccagaa

SEQ ID NO: 3997742 - RNA, 19 nt, Human herpesvirus 7
uaacauggaaauucagaau

SEQ ID NO: 3997743 - RNA, 22 nt, Human herpesvirus 7
uaagaaaaaucauuuuuaaaaa

SEQ ID NO: 3997744 - RNA, 16 nt, Human herpesvirus 7
uaagaaagaacauuuu

SEQ ID NO: 3997745 - RNA, 12 nt, Human herpesvirus 7
uaagaaucuauu

SEQ ID NO: 3997746 - RNA, 20 nt, Human herpesvirus 7
uaagcaguuauaugaaauuu

SEQ ID NO: 3997747 - RNA, 18 nt, Human herpesvirus 7
uaaguauuuuacaacaau

SEQ ID NO: 3997748 - RNA, 23 nt, Human herpesvirus 7
uaagugaacuguuacaguuaaag

SEQ ID NO: 3997749 - RNA, 17 nt, Human herpesvirus 7
uaagugauacugaaucu

SEQ ID NO: 3997750 - RNA, 20 nt, Human herpesvirus 7
uaauaaaaauuacucaugaa

SEQ ID NO: 3997751 - RNA, 18 nt, Human herpesvirus 7
uaauaaaacaaacuaugu

SEQ ID NO: 3997752 - RNA, 19 nt, Human herpesvirus 7
uaauaaaaguaucauuaaa

SEQ ID NO: 3997753 - RNA, 23 nt, Human herpesvirus 7
uaauacauggggcauuaauucuu

SEQ ID NO: 3997754 - RNA, 17 nt, Human herpesvirus 7
uaauacucagaugugga

SEQ ID NO: 3997755 - RNA, 22 nt, Human herpesvirus 7
uaauaucaauuugaauauugcu

SEQ ID NO: 3997756 - RNA, 16 nt, Human herpesvirus 7
uaauaugugaaaauaa

SEQ ID NO: 3997757 - RNA, 22 nt, Human herpesvirus 7
uaauauuuuaccgguacauuua

SEQ ID NO: 3997758 - RNA, 15 nt, Human herpesvirus 7
uaaugaaaaagccau

SEQ ID NO: 3997759 - RNA, 16 nt, Human herpesvirus 7
uaaugauguaauguug

SEQ ID NO: 3997760 - RNA, 14 nt, Human herpesvirus 7
uaauguaauuuaug

SEQ ID NO: 3997761 - RNA, 13 nt, Human herpesvirus 7
uaauuaaaguugc

SEQ ID NO: 3997762 - RNA, 23 nt, Human herpesvirus 7
uaauuuccacguuuuuuagcuuu

SEQ ID NO: 3997763 - RNA, 23 nt, Human herpesvirus 7
uaauuucucaaaucuuuaagaau

SEQ ID NO: 3997764 - RNA, 20 nt, Human herpesvirus 7
uaauuuggaaauuguuugau

SEQ ID NO: 3997765 - RNA, 13 nt, Human herpesvirus 7
uacaauaaugcug

SEQ ID NO: 3997766 - RNA, 13 nt, Human herpesvirus 7
uacaaugcagccu

SEQ ID NO: 3997767 - RNA, 21 nt, Human herpesvirus 7
uacaaugcugucucugaggag

SEQ ID NO: 3997768 - RNA, 20 nt, Human herpesvirus 7
uacacaaauugauccugcua

SEQ ID NO: 3997769 - RNA, 15 nt, Human herpesvirus 7
uacacuuuuguccug

SEQ ID NO: 3997770 - RNA, 19 nt, Human herpesvirus 7
uacagaucauuuuucgacu

SEQ ID NO: 3997771 - RNA, 18 nt, Human herpesvirus 7
uacauaaguuaaaucagu

SEQ ID NO: 3997772 - RNA, 14 nt, Human herpesvirus 7
uacauccuuaaauu

SEQ ID NO: 3997773 - RNA, 17 nt, Human herpesvirus 7
uacauggacauaagaau

SEQ ID NO: 3997774 - RNA, 12 nt, Human herpesvirus 7
uacauucucaaa

SEQ ID NO: 3997775 - RNA, 20 nt, Human herpesvirus 7
uacauugcagucaaagauuu

SEQ ID NO: 3997776 - RNA, 13 nt, Human herpesvirus 7
uacauuuuucuau

SEQ ID NO: 3997777 - RNA, 17 nt, Human herpesvirus 7
uaccaaaaaccugaaaa

SEQ ID NO: 3997778 - RNA, 19 nt, Human herpesvirus 7
uaccgauucuaaauuaaaa

SEQ ID NO: 3997779 - RNA, 17 nt, Human herpesvirus 7
uacgguggcaauuaaau

SEQ ID NO: 3997780 - RNA, 16 nt, Human herpesvirus 7
uacguucugaaacagu

SEQ ID NO: 3997781 - RNA, 15 nt, Human herpesvirus 7
uacuacgguuuucag

SEQ ID NO: 3997782 - RNA, 19 nt, Human herpesvirus 7
uacucuucucgaagaauuc

SEQ ID NO: 3997783 - RNA, 14 nt, Human herpesvirus 7
uacuuguaugcuau

SEQ ID NO: 3997784 - RNA, 14 nt, Human herpesvirus 7
uacuuucguuuucu

SEQ ID NO: 3997785 - RNA, 22 nt, Human herpesvirus 7
uagaaaaucuaccaauaaaagg

SEQ ID NO: 3997786 - RNA, 15 nt, Human herpesvirus 7
uagaaauuaugaaaa

SEQ ID NO: 3997787 - RNA, 20 nt, Human herpesvirus 7
uagauacauuauaaauguaa

SEQ ID NO: 3997788 - RNA, 18 nt, Human herpesvirus 7
uagauuacgcacaaauuu

SEQ ID NO: 3997789 - RNA, 22 nt, Human herpesvirus 7
uagauuacgcacaaauuucuug

SEQ ID NO: 3997790 - RNA, 16 nt, Human herpesvirus 7
uagauuuaaaacaauu

SEQ ID NO: 3997791 - RNA, 19 nt, Human herpesvirus 7
uagcagcuuuuauuccuuc

SEQ ID NO: 3997792 - RNA, 17 nt, Human herpesvirus 7
uaggaaucagaccagca

SEQ ID NO: 3997793 - RNA, 19 nt, Human herpesvirus 7
uaggauaccaaacaaaauu

SEQ ID NO: 3997794 - RNA, 21 nt, Human herpesvirus 7
uaggcaagaaggccacgcugu

SEQ ID NO: 3997795 - RNA, 19 nt, Human herpesvirus 7
uaguaaucacauuaucuug

SEQ ID NO: 3997796 - RNA, 19 nt, Human herpesvirus 7
uagucaggaucuccuggaa

SEQ ID NO: 3997797 - RNA, 22 nt, Human herpesvirus 7
uauaaaggaccaugggaaaaga

SEQ ID NO: 3997798 - RNA, 15 nt, Human herpesvirus 7
uauaacuuguaauuu

SEQ ID NO: 3997799 - RNA, 13 nt, Human herpesvirus 7
uauaauaaaucgu

SEQ ID NO: 3997800 - RNA, 12 nt, Human herpesvirus 7
uauaauagccuu

SEQ ID NO: 3997801 - RNA, 16 nt, Human herpesvirus 7
uauauagcaauauuua

SEQ ID NO: 3997802 - RNA, 16 nt, Human herpesvirus 7
uauaugaugacaacaa

SEQ ID NO: 3997803 - RNA, 15 nt, Human herpesvirus 7
uauauggcaauaaau

SEQ ID NO: 3997804 - RNA, 15 nt, Human herpesvirus 7
uauauguguacagau

SEQ ID NO: 3997805 - RNA, 19 nt, Human herpesvirus 7
uucaacacauaauguguau

SEQ ID NO: 3997806 - RNA, 13 nt, Human herpesvirus 7
uucaagaaaucag

SEQ ID NO: 3997807 - RNA, 21 nt, Human herpesvirus 7
uucaagaaggaaaauuucauu

SEQ ID NO: 3997808 - RNA, 18 nt, Human herpesvirus 7
uucaauugguuguucaaa

SEQ ID NO: 3997809 - RNA, 15 nt, Human herpesvirus 7
uucaauuucugucuu

SEQ ID NO: 3997810 - RNA, 12 nt, Human herpesvirus 7
uucacagaaauc

SEQ ID NO: 3997811 - RNA, 20 nt, Human herpesvirus 7
uucacaucuagaguaucuuu

SEQ ID NO: 3997812 - RNA, 18 nt, Human herpesvirus 7
uucagaauagacaucuuc

SEQ ID NO: 3997813 - RNA, 15 nt, Human herpesvirus 7
uucaggcaacauuaa

SEQ ID NO: 3997814 - RNA, 23 nt, Human herpesvirus 7
uucaggucucuuucuaaaaagag

SEQ ID NO: 3997815 - RNA, 18 nt, Human herpesvirus 7
uucauuuauauuaauuug

SEQ ID NO: 3997816 - RNA, 14 nt, Human herpesvirus 7
uuccgguauuuugu

SEQ ID NO: 3997817 - RNA, 17 nt, Human herpesvirus 7
uuccugcaauaauaaac

SEQ ID NO: 3997818 - RNA, 18 nt, Human herpesvirus 7
uuccugugugcaaugaug

SEQ ID NO: 3997819 - RNA, 16 nt, Human herpesvirus 7
uucgaucuguaaaaac

SEQ ID NO: 3997820 - RNA, 18 nt, Human herpesvirus 7
uucgcuaacuuugcuauu

SEQ ID NO: 3997821 - RNA, 20 nt, Human herpesvirus 7
uucggcugaguaaaacucaa

SEQ ID NO: 3997822 - RNA, 12 nt, Human herpesvirus 7
uucuaaaaauuc

SEQ ID NO: 3997823 - RNA, 15 nt, Human herpesvirus 7
uucuaaaaauucugg

SEQ ID NO: 3997824 - RNA, 18 nt, Human herpesvirus 7
uucuaccggaaguuuuua

SEQ ID NO: 3997825 - RNA, 21 nt, Human herpesvirus 7
uucuagcaaaauaugcaaaac

SEQ ID NO: 3997826 - RNA, 17 nt, Human herpesvirus 7
uucuauucaguuucuuu

SEQ ID NO: 3997827 - RNA, 22 nt, Human herpesvirus 7
uucucccgcagagauuaccugc

SEQ ID NO: 3997828 - RNA, 12 nt, Human herpesvirus 7
uucugaaaaucu

SEQ ID NO: 3997829 - RNA, 14 nt, Human herpesvirus 7
uucugaauaaaagu

SEQ ID NO: 3997830 - RNA, 16 nt, Human herpesvirus 7
uucugacuccuuuuuu

SEQ ID NO: 3997831 - RNA, 23 nt, Human herpesvirus 7
uucuggaucugccucugccucuu

SEQ ID NO: 3997832 - RNA, 16 nt, Human herpesvirus 7
uucuguaaaaacuugu

SEQ ID NO: 3997833 - RNA, 21 nt, Human herpesvirus 7
uucuucuaauugcgcaguguu

SEQ ID NO: 3997834 - RNA, 14 nt, Human herpesvirus 7
uucuuguuuggaaa

SEQ ID NO: 3997835 - RNA, 16 nt, Human herpesvirus 7
uucuuguuuggaaaac

SEQ ID NO: 3997836 - RNA, 18 nt, Human herpesvirus 7
uucuuugacaaaaauguu

SEQ ID NO: 3997837 - RNA, 15 nt, Human herpesvirus 7
uucuuugcaaucauu

SEQ ID NO: 3997838 - RNA, 12 nt, Human herpesvirus 7
uucuuugucugc

SEQ ID NO: 3997839 - RNA, 13 nt, Human herpesvirus 7
uugaaaagaaugg

SEQ ID NO: 3997840 - RNA, 18 nt, Human herpesvirus 7
uugaaauagugucuguug

SEQ ID NO: 3997841 - RNA, 16 nt, Human herpesvirus 7
uugaaccuuaacauac

SEQ ID NO: 3997842 - RNA, 22 nt, Human herpesvirus 7
uugaagaaauugugaagucuuu

SEQ ID NO: 3997843 - RNA, 18 nt, Human herpesvirus 7
uugaagaacaacaugaaa

SEQ ID NO: 3997844 - RNA, 20 nt, Human herpesvirus 7
uugaagauaaguauaaacag

SEQ ID NO: 3997845 - RNA, 19 nt, Human herpesvirus 7
uugacaggugauauucuuu

SEQ ID NO: 3997846 - RNA, 16 nt, Human herpesvirus 7
uugcaauuuuagauuu

SEQ ID NO: 3997847 - RNA, 14 nt, Human herpesvirus 7
uugcauacuuuuuu

SEQ ID NO: 3997848 - RNA, 14 nt, Human herpesvirus 7
uugcauaucaugau

SEQ ID NO: 3997849 - RNA, 16 nt, Human herpesvirus 7
uugcuuuagaacaauu

SEQ ID NO: 3997850 - RNA, 20 nt, Human herpesvirus 7
uuggaaagggauuuauuauu

SEQ ID NO: 3997851 - RNA, 16 nt, Human herpesvirus 7
uuggauuuucuguaau

SEQ ID NO: 3997852 - RNA, 13 nt, Human herpesvirus 7
uugggaaacaucu

SEQ ID NO: 3997853 - RNA, 22 nt, Human herpesvirus 7
uuguaacagauuuuauuucagc

SEQ ID NO: 3997854 - RNA, 13 nt, Human herpesvirus 7
uuguaacuuuuug

SEQ ID NO: 3997855 - RNA, 16 nt, Human herpesvirus 7
uugugaguuucuacau

SEQ ID NO: 3997856 - RNA, 13 nt, Human herpesvirus 7
uugugcaauuugg

SEQ ID NO: 3997857 - RNA, 18 nt, Human herpesvirus 7
uuguuuggucuauugaaa

SEQ ID NO: 3997858 - RNA, 21 nt, Human herpesvirus 7
uuuaaaaaaaaaaccacaaaa

SEQ ID NO: 3997859 - RNA, 19 nt, Human herpesvirus 7
uuuaaaaaugauuuuucuu

SEQ ID NO: 3997860 - RNA, 23 nt, Human herpesvirus 7
uuuaaaacaagacagaaaugaau

SEQ ID NO: 3997861 - RNA, 19 nt, Human herpesvirus 7
uuuaaagaaaagcuuguau

SEQ ID NO: 3997862 - RNA, 15 nt, Human herpesvirus 7
uuuaaauuugucugu

SEQ ID NO: 3997863 - RNA, 19 nt, Human herpesvirus 7
uuuaacugauaauuucuac

SEQ ID NO: 3997864 - RNA, 16 nt, Human herpesvirus 7
uuuaagugauacugaa

SEQ ID NO: 3997865 - RNA, 23 nt, Human herpesvirus 7
uuuacagaagaacauuuauuauu

SEQ ID NO: 3997866 - RNA, 20 nt, Human herpesvirus 7
uuuacaguuuuuuaauacaa

SEQ ID NO: 3997867 - RNA, 23 nt, Human herpesvirus 7
uuuacuuuugagcgcugaaauaa

SEQ ID NO: 3997868 - RNA, 22 nt, Human herpesvirus 7
uuuaggaaauugcuuucuaagu

SEQ ID NO: 3997869 - RNA, 16 nt, Human herpesvirus 7
uuuauaaaauauggac

SEQ ID NO: 3997870 - RNA, 14 nt, Human herpesvirus 7
uuuauauuaauuug

SEQ ID NO: 3997871 - RNA, 13 nt, Human herpesvirus 7
uuuaucuaacacu

SEQ ID NO: 3997872 - RNA, 18 nt, Human herpesvirus 7
uuuaugaaaaacaaaaug

SEQ ID NO: 3997873 - RNA, 12 nt, Human herpesvirus 7
uuuaugaacaag

SEQ ID NO: 3997874 - RNA, 19 nt, Human herpesvirus 7
uuuauguucaaauaugcau

SEQ ID NO: 3997875 - RNA, 23 nt, Human herpesvirus 7
uuuauugaauggaacauguuugu

SEQ ID NO: 3997876 - RNA, 17 nt, Human herpesvirus 7
uuucaaacaacauaucg

SEQ ID NO: 3997877 - RNA, 14 nt, Human herpesvirus 7
uuucaaauagaguu

SEQ ID NO: 3997878 - RNA, 17 nt, Human herpesvirus 7
uuucacccuuuguuuga

SEQ ID NO: 3997879 - RNA, 18 nt, Human herpesvirus 7
uuucagugaguggaagca

SEQ ID NO: 3997880 - RNA, 12 nt, Human herpesvirus 7
uuucauuuaauu

SEQ ID NO: 3997881 - RNA, 21 nt, Human herpesvirus 7
uuucuaggcuucauuggcauu

SEQ ID NO: 3997882 - RNA, 20 nt, Human herpesvirus 7
uuucuggcaacaguucaaaa

SEQ ID NO: 3997883 - RNA, 20 nt, Human herpesvirus 7
uuucuucgggguauguaugg

SEQ ID NO: 3997884 - RNA, 19 nt, Human herpesvirus 7
uuucuuuaccgauucuaaa

SEQ ID NO: 3997885 - RNA, 22 nt, Human herpesvirus 7
uuugcagcuucuaaaugugcua

SEQ ID NO: 3997886 - RNA, 16 nt, Human herpesvirus 7
uuugguuauccaaguu

SEQ ID NO: 3997887 - RNA, 14 nt, Human herpesvirus 7
uuuguaaacauuuu

SEQ ID NO: 3997888 - RNA, 16 nt, Human herpesvirus 7
uuuguauacaacuuua

SEQ ID NO: 3997889 - RNA, 12 nt, Human herpesvirus 7
uuuuaacuuuuu

SEQ ID NO: 3997890 - RNA, 12 nt, Human herpesvirus 7
uuuuaauaaacg

SEQ ID NO: 3997891 - RNA, 21 nt, Human herpesvirus 7
uuuuauaauacuggcaugucu

SEQ ID NO: 3997892 - RNA, 14 nt, Human herpesvirus 7
uuuucaaacaugau

SEQ ID NO: 3997893 - RNA, 21 nt, Human herpesvirus 7
uuuucauuuuuuucuuauaaa

SEQ ID NO: 3997894 - RNA, 21 nt, Human herpesvirus 7
uuuucuccaugcauauuugaa

SEQ ID NO: 3997895 - RNA, 21 nt, Human herpesvirus 7
uuuucuuccuagcauuaauuu

SEQ ID NO: 3997896 - RNA, 16 nt, Human herpesvirus 7
uuuuuaaaaaugauuu

SEQ ID NO: 3997897 - RNA, 18 nt, Human herpesvirus 7
aaccacagacacaccauu

SEQ ID NO: 3997898 - RNA, 22 nt, Human herpesvirus 7
aaccacgcauaugcuaagaaag

SEQ ID NO: 3997899 - RNA, 18 nt, Human herpesvirus 7
aaccaguuuuacuuuuga

SEQ ID NO: 3997900 - RNA, 21 nt, Human herpesvirus 7
aaccaugaaaaauaaauacua

SEQ ID NO: 3997901 - RNA, 17 nt, Human herpesvirus 7
aacccacuaacauuuua

SEQ ID NO: 3997902 - RNA, 18 nt, Human herpesvirus 7
aacgauccaguacuugca

SEQ ID NO: 3997903 - RNA, 17 nt, Human herpesvirus 7
aacuaaaacuacauuua

SEQ ID NO: 3997904 - RNA, 13 nt, Human herpesvirus 7
aacuaacaucuuu

SEQ ID NO: 3997905 - RNA, 22 nt, Human herpesvirus 7
aacuacauuuaaaaaaucugaa

SEQ ID NO: 3997906 - RNA, 16 nt, Human herpesvirus 7
aacuagaaaaacacua

SEQ ID NO: 3997907 - RNA, 20 nt, Human herpesvirus 7
aacucaauaaagauugauca

SEQ ID NO: 3997908 - RNA, 12 nt, Human herpesvirus 7
aacucuucuuua

SEQ ID NO: 3997909 - RNA, 13 nt, Human herpesvirus 7
aacugaaaacaau

SEQ ID NO: 3997910 - RNA, 16 nt, Human herpesvirus 7
aacugaauuaaggugg

SEQ ID NO: 3997911 - RNA, 17 nt, Human herpesvirus 7
aacugagaaaaaugaca

SEQ ID NO: 3997912 - RNA, 15 nt, Human herpesvirus 7
aacugauaauuucuu

SEQ ID NO: 3997913 - RNA, 17 nt, Human herpesvirus 7
aacuuugauuugagaaa

SEQ ID NO: 3997914 - RNA, 19 nt, Human herpesvirus 7
aagaaaagcaaaccuuaca

SEQ ID NO: 3997915 - RNA, 17 nt, Human herpesvirus 7
aagaacuuacauuucaa

SEQ ID NO: 3997916 - RNA, 19 nt, Human herpesvirus 7
aagaacuucagauuuuagu

SEQ ID NO: 3997917 - RNA, 20 nt, Human herpesvirus 7
aagaaugaacaccgcaaaca

SEQ ID NO: 3997918 - RNA, 19 nt, Human herpesvirus 7
aagaauuuucugcuuuaag

SEQ ID NO: 3997919 - RNA, 19 nt, Human herpesvirus 7
aagaauuuuguaagaaaca

SEQ ID NO: 3997920 - RNA, 21 nt, Human herpesvirus 7
aagacagcucaaaaguauaac

SEQ ID NO: 3997921 - RNA, 13 nt, Human herpesvirus 7
aagacaucgaaga

SEQ ID NO: 3997922 - RNA, 18 nt, Human herpesvirus 7
aagagaaaguaaaagcua

SEQ ID NO: 3997923 - RNA, 23 nt, Human herpesvirus 7
aagagccucccaccauggcuuuu

SEQ ID NO: 3997924 - RNA, 17 nt, Human herpesvirus 7
aagagcuuuugcaaagc

SEQ ID NO: 3997925 - RNA, 17 nt, Human herpesvirus 7
aagaggagaauucugua

SEQ ID NO: 3997926 - RNA, 17 nt, Human herpesvirus 7
aagagucuauugacaua

SEQ ID NO: 3997927 - RNA, 22 nt, Human herpesvirus 7
aagaugauagccauaaaugcuu

SEQ ID NO: 3997928 - RNA, 20 nt, Human herpesvirus 7
aagaugucuaaaaguacagu

SEQ ID NO: 3997929 - RNA, 20 nt, Human herpesvirus 7
aagauguuacccaaaaugua

SEQ ID NO: 3997930 - RNA, 16 nt, Human herpesvirus 7
aagauugaagcacaca

SEQ ID NO: 3997931 - RNA, 21 nt, Human herpesvirus 7
aagauuuguuccaaacucgag

SEQ ID NO: 3997932 - RNA, 21 nt, Human herpesvirus 7
aagauuuuaacauaccuaaag

SEQ ID NO: 3997933 - RNA, 16 nt, Human herpesvirus 7
aagcaaaagccacaga

SEQ ID NO: 3997934 - RNA, 18 nt, Human herpesvirus 7
aagcacaaaucaaaacga

SEQ ID NO: 3997935 - RNA, 16 nt, Human herpesvirus 7
aagcaucgauguuuua

SEQ ID NO: 3997936 - RNA, 19 nt, Human herpesvirus 7
aagccacgaugacuuccaa

SEQ ID NO: 3997937 - RNA, 15 nt, Human herpesvirus 7
aagccauaaaaugua

SEQ ID NO: 3997938 - RNA, 17 nt, Human herpesvirus 7
aagccauaaaauguaca

SEQ ID NO: 3997939 - RNA, 19 nt, Human herpesvirus 7
aagcgcugagaucuuccaa

SEQ ID NO: 3997940 - RNA, 18 nt, Human herpesvirus 7
aagcuauguauaaucaag

SEQ ID NO: 3997941 - RNA, 19 nt, Human herpesvirus 7
aaggaaaaaugcugcucag

SEQ ID NO: 3997942 - RNA, 15 nt, Human herpesvirus 7
aaggaaaaauuucuu

SEQ ID NO: 3997943 - RNA, 14 nt, Human herpesvirus 7
aaggaagacacgga

SEQ ID NO: 3997944 - RNA, 15 nt, Human herpesvirus 7
aaggaucaaaagcug

SEQ ID NO: 3997945 - RNA, 18 nt, Human herpesvirus 7
aaggaucaaaagcugcag

SEQ ID NO: 3997946 - RNA, 17 nt, Human herpesvirus 7
aaggucuuucaugcauu

SEQ ID NO: 3997947 - RNA, 20 nt, Human herpesvirus 7
aagguuaagugaaugugcuu

SEQ ID NO: 3997948 - RNA, 15 nt, Human herpesvirus 7
aagguugucuguucu

SEQ ID NO: 3997949 - RNA, 15 nt, Human herpesvirus 7
aaguaaacaaaacag

SEQ ID NO: 3997950 - RNA, 16 nt, Human herpesvirus 7
aaguacacguagacug

SEQ ID NO: 3997951 - RNA, 22 nt, Human herpesvirus 7
aaguagguaaaaaauaaauaua

SEQ ID NO: 3997952 - RNA, 16 nt, Human herpesvirus 7
aaguguuucuuugaau

SEQ ID NO: 3997953 - RNA, 16 nt, Human herpesvirus 7
aaguuuuuugagauau

SEQ ID NO: 3997954 - RNA, 19 nt, Human herpesvirus 7
aauaaaaagcccaugaaca

SEQ ID NO: 3997955 - RNA, 13 nt, Human herpesvirus 7
aauaaaacaaacu

SEQ ID NO: 3997956 - RNA, 13 nt, Human herpesvirus 7
aauaaacaaaauu

SEQ ID NO: 3997957 - RNA, 16 nt, Human herpesvirus 7
aauaaauuaauuccuu

SEQ ID NO: 3997958 - RNA, 14 nt, Human herpesvirus 7
aauaaauuuaaaau

SEQ ID NO: 3997959 - RNA, 22 nt, Human herpesvirus 7
aauaacauuuuguaugaaaagc

SEQ ID NO: 3997960 - RNA, 13 nt, Human herpesvirus 7
aauaagcaaauaa

SEQ ID NO: 3997961 - RNA, 14 nt, Human herpesvirus 7
aauaagcaaauaaa

SEQ ID NO: 3997962 - RNA, 16 nt, Human herpesvirus 7
aauacaucuaggucuu

SEQ ID NO: 3997963 - RNA, 19 nt, Human herpesvirus 7
aauagauacguuaguugca

SEQ ID NO: 3997964 - RNA, 22 nt, Human herpesvirus 7
aauagguaucuuuacuuucaua

SEQ ID NO: 3997965 - RNA, 16 nt, Human herpesvirus 7
aauauaaaaaauuuga

SEQ ID NO: 3997966 - RNA, 13 nt, Human herpesvirus 7
aauauaacaaaaa

SEQ ID NO: 3997967 - RNA, 18 nt, Human herpesvirus 7
aauauauuccaacucaau

SEQ ID NO: 3997968 - RNA, 16 nt, Human herpesvirus 7
aauaucccagaauauc

SEQ ID NO: 3997969 - RNA, 14 nt, Human herpesvirus 7
aauaugcauggaga

SEQ ID NO: 3997970 - RNA, 12 nt, Human herpesvirus 7
aauauuuagagu

SEQ ID NO: 3997971 - RNA, 18 nt, Human herpesvirus 7
aauauuuauuugcuuuua

SEQ ID NO: 3997972 - RNA, 13 nt, Human herpesvirus 7
aaucaaauuucaa

SEQ ID NO: 3997973 - RNA, 21 nt, Human herpesvirus 7
aaucauaccauaaauaccaaa

SEQ ID NO: 3997974 - RNA, 21 nt, Human herpesvirus 7
aauccgucaccgacaauauaa

SEQ ID NO: 3997975 - RNA, 17 nt, Human herpesvirus 7
aaucuaauuaaucugca

SEQ ID NO: 3997976 - RNA, 16 nt, Human herpesvirus 7
aaucuauuucuauuca

SEQ ID NO: 3997977 - RNA, 16 nt, Human herpesvirus 7
aaucuguagaaaaugu

SEQ ID NO: 3997978 - RNA, 19 nt, Human herpesvirus 7
aaucuguagaaaauguuuu

SEQ ID NO: 3997979 - RNA, 17 nt, Human herpesvirus 7
aaugaguguaauugguu

SEQ ID NO: 3997980 - RNA, 12 nt, Human herpesvirus 7
aaugaugaugua

SEQ ID NO: 3997981 - RNA, 13 nt, Human herpesvirus 7
aaugcaugaugca

SEQ ID NO: 3997982 - RNA, 14 nt, Human herpesvirus 7
aaugcaugaugcac

SEQ ID NO: 3997983 - RNA, 13 nt, Human herpesvirus 7
aauguaacuuuca

SEQ ID NO: 3997984 - RNA, 15 nt, Human herpesvirus 7
aaugucucuugaaga

SEQ ID NO: 3997985 - RNA, 19 nt, Human herpesvirus 7
aaugucuuugucaugauga

SEQ ID NO: 3997986 - RNA, 18 nt, Human herpesvirus 7
aaugugguaaauuugcuu

SEQ ID NO: 3997987 - RNA, 17 nt, Human herpesvirus 7
aauguuuaaauuacagu

SEQ ID NO: 3997988 - RNA, 15 nt, Human herpesvirus 7
aauguuuuuuucaua

SEQ ID NO: 3997989 - RNA, 12 nt, Human herpesvirus 7
aauuaaauacuu

SEQ ID NO: 3997990 - RNA, 12 nt, Human herpesvirus 7
aauuaacagcuc

SEQ ID NO: 3997991 - RNA, 16 nt, Human herpesvirus 7
aauuaaugcauuggaa

SEQ ID NO: 3997992 - RNA, 15 nt, Human herpesvirus 7
aauuacacaaauuga

SEQ ID NO: 3997993 - RNA, 23 nt, Human herpesvirus 7
aauuaccgauggaacugaaaaca

SEQ ID NO: 3997994 - RNA, 17 nt, Human herpesvirus 7
aauuaucuagacccuuu

SEQ ID NO: 3997995 - RNA, 14 nt, Human herpesvirus 7
aauuaugaguaaag

SEQ ID NO: 3997996 - RNA, 22 nt, Human herpesvirus 7
aauuauuuccagaguaugaauu

SEQ ID NO: 3997997 - RNA, 18 nt, Human herpesvirus 7
aauucgcugaugaaaaua

SEQ ID NO: 3997998 - RNA, 17 nt, Human herpesvirus 7
aauucuucuacuucuag

SEQ ID NO: 3997999 - RNA, 21 nt, Human herpesvirus 7
aauugaaauauuuaugccuuu

SEQ ID NO: 3998000 - RNA, 21 nt, Human herpesvirus 7
aauugugguacaacaaacauu

SEQ ID NO: 3998001 - RNA, 20 nt, Human herpesvirus 7
aauuguuuuucuuucuugca

SEQ ID NO: 3998002 - RNA, 16 nt, Human herpesvirus 7
aauuuacccugaaaag

SEQ ID NO: 3998003 - RNA, 19 nt, Human herpesvirus 7
aauuucaaacguaaugcaa

SEQ ID NO: 3998004 - RNA, 20 nt, Human herpesvirus 7
aauuuggugaagauucuuaa

SEQ ID NO: 3998005 - RNA, 12 nt, Human herpesvirus 7
aauuuuaaaacu

SEQ ID NO: 3998006 - RNA, 23 nt, Human herpesvirus 7
aauuuuauuccgugcuguacuga

SEQ ID NO: 3998007 - RNA, 12 nt, Human herpesvirus 7
aauuuugaagag

SEQ ID NO: 3998008 - RNA, 18 nt, Human herpesvirus 7
aauuuuuuacugucuuua

SEQ ID NO: 3998009 - RNA, 20 nt, Human herpesvirus 7
acaaauuuaagagacauuga

SEQ ID NO: 3998010 - RNA, 17 nt, Human herpesvirus 7
acaaccuggauguaaug

SEQ ID NO: 3998011 - RNA, 21 nt, Human herpesvirus 7
acaacuaaaauugacagcacc

SEQ ID NO: 3998012 - RNA, 17 nt, Human herpesvirus 7
acaacuaaagagaaugu

SEQ ID NO: 3998013 - RNA, 13 nt, Human herpesvirus 7
acaacuagcaaac

SEQ ID NO: 3998014 - RNA, 18 nt, Human herpesvirus 7
acaagacagaaaugaauc

SEQ ID NO: 3998015 - RNA, 22 nt, Human herpesvirus 7
acaauaaugcugugauuuuccu

SEQ ID NO: 3998016 - RNA, 19 nt, Human herpesvirus 7
acaauacccaauacauaag

SEQ ID NO: 3998017 - RNA, 14 nt, Human herpesvirus 7
acaaucaaacaugu

SEQ ID NO: 3998018 - RNA, 17 nt, Human herpesvirus 7
acaaucgauaaacuuug

SEQ ID NO: 3998019 - RNA, 21 nt, Human herpesvirus 7
acaaucgcggggaaaaaauga

SEQ ID NO: 3998020 - RNA, 20 nt, Human herpesvirus 7
acaauggugugucugugguu

SEQ ID NO: 3998021 - RNA, 16 nt, Human herpesvirus 7
acaauuguauuucagu

SEQ ID NO: 3998022 - RNA, 21 nt, Human herpesvirus 7
acacagggaagaaacagcuga

SEQ ID NO: 3998023 - RNA, 20 nt, Human herpesvirus 7
acacaguugaauaaagauua

SEQ ID NO: 3998024 - RNA, 12 nt, Human herpesvirus 7
acacuuauucca

SEQ ID NO: 3998025 - RNA, 16 nt, Human herpesvirus 7
acacuuauuccagaua

SEQ ID NO: 3998026 - RNA, 15 nt, Human herpesvirus 7
acacuuauuugauua

SEQ ID NO: 3998027 - RNA, 12 nt, Human herpesvirus 7
acagaaacaugu

SEQ ID NO: 3998028 - RNA, 14 nt, Human herpesvirus 7
acagaaaucccaaa

SEQ ID NO: 3998029 - RNA, 17 nt, Human herpesvirus 7
acagagucaaucuguga

SEQ ID NO: 3998030 - RNA, 15 nt, Human herpesvirus 7
acagcaacugugcau

SEQ ID NO: 3998031 - RNA, 17 nt, Human herpesvirus 7
acagcaacugugcauga

SEQ ID NO: 3998032 - RNA, 20 nt, Human herpesvirus 7
acagcauauaucuuugauua

SEQ ID NO: 3998033 - RNA, 22 nt, Human herpesvirus 7
acagcuagauugacuaugaauu

SEQ ID NO: 3998034 - RNA, 16 nt, Human herpesvirus 7
acagguaaauuguaaa

SEQ ID NO: 3998035 - RNA, 12 nt, Human herpesvirus 7
acauaaaaauuu

SEQ ID NO: 3998036 - RNA, 13 nt, Human herpesvirus 7
acauaaaaauuuc

SEQ ID NO: 3998037 - RNA, 18 nt, Human herpesvirus 7
acauauaaauagccauua

SEQ ID NO: 3998038 - RNA, 19 nt, Human herpesvirus 7
acauauaggaacaaaucua

SEQ ID NO: 3998039 - RNA, 13 nt, Human herpesvirus 7
acauauuaguuua

SEQ ID NO: 3998040 - RNA, 17 nt, Human herpesvirus 7
acauauuaguuuaacuu

SEQ ID NO: 3998041 - RNA, 20 nt, Human herpesvirus 7
acaucagaccuaacaaaaaa

SEQ ID NO: 3998042 - RNA, 14 nt, Human herpesvirus 7
acaucgaagaaauu

SEQ ID NO: 3998043 - RNA, 22 nt, Human herpesvirus 7
acaugagauaaacuuuuauuca

SEQ ID NO: 3998044 - RNA, 15 nt, Human herpesvirus 7
uaucuuaaaauacua

SEQ ID NO: 3998045 - RNA, 20 nt, Human herpesvirus 7
uaucuuaucuggagaacaau

SEQ ID NO: 3998046 - RNA, 15 nt, Human herpesvirus 7
uaugaaaaaaacauu

SEQ ID NO: 3998047 - RNA, 13 nt, Human herpesvirus 7
uaugaaaacagcu

SEQ ID NO: 3998048 - RNA, 17 nt, Human herpesvirus 7
uaugaaauaauagaugu

SEQ ID NO: 3998049 - RNA, 21 nt, Human herpesvirus 7
uaugacgaagcuaaacuuuua

SEQ ID NO: 3998050 - RNA, 18 nt, Human herpesvirus 7
uaugauacuuguucaauu

SEQ ID NO: 3998051 - RNA, 19 nt, Human herpesvirus 7
uaugccacaaaaaacuuug

SEQ ID NO: 3998052 - RNA, 20 nt, Human herpesvirus 7
uaugccacaaaaaacuuuga

SEQ ID NO: 3998053 - RNA, 17 nt, Human herpesvirus 7
uaugugaaaauaaacag

SEQ ID NO: 3998054 - RNA, 14 nt, Human herpesvirus 7
uauguguacagauu

SEQ ID NO: 3998055 - RNA, 12 nt, Human herpesvirus 7
uauguuaucauu

SEQ ID NO: 3998056 - RNA, 14 nt, Human herpesvirus 7
uauguugcauauca

SEQ ID NO: 3998057 - RNA, 13 nt, Human herpesvirus 7
uauuagaauuggg

SEQ ID NO: 3998058 - RNA, 18 nt, Human herpesvirus 7
uauuagauaaugacaaac

SEQ ID NO: 3998059 - RNA, 22 nt, Human herpesvirus 7
uauucaaacgcuugaacaaauu

SEQ ID NO: 3998060 - RNA, 20 nt, Human herpesvirus 7
uauuccagauaugacaaauu

SEQ ID NO: 3998061 - RNA, 21 nt, Human herpesvirus 7
uauucuacacaucuucaaugu

SEQ ID NO: 3998062 - RNA, 15 nt, Human herpesvirus 7
uauugacagaaugau

SEQ ID NO: 3998063 - RNA, 11 nt, Human herpesvirus 7
uauugcaauuu

SEQ ID NO: 3998064 - RNA, 20 nt, Human herpesvirus 7
uauuggagaugucagcaaau

SEQ ID NO: 3998065 - RNA, 16 nt, Human herpesvirus 7
uauuuagagucgucuu

SEQ ID NO: 3998066 - RNA, 18 nt, Human herpesvirus 7
uauuucagcuccaugucu

SEQ ID NO: 3998067 - RNA, 14 nt, Human herpesvirus 7
uauuuuacauauua

SEQ ID NO: 3998068 - RNA, 19 nt, Human herpesvirus 7
ucaaaagacgcuugcuauu

SEQ ID NO: 3998069 - RNA, 19 nt, Human herpesvirus 7
ucaaaaguagaggccgaaa

SEQ ID NO: 3998070 - RNA, 13 nt, Human herpesvirus 7
ucaaaaucagaaa

SEQ ID NO: 3998071 - RNA, 14 nt, Human herpesvirus 7
ucaaacauuauucg

SEQ ID NO: 3998072 - RNA, 16 nt, Human herpesvirus 7
ucaaauuauuuccaga

SEQ ID NO: 3998073 - RNA, 17 nt, Human herpesvirus 7
ucaacaaaaugacaaaa

SEQ ID NO: 3998074 - RNA, 16 nt, Human herpesvirus 7
ucaacgacaaacuuug

SEQ ID NO: 3998075 - RNA, 17 nt, Human herpesvirus 7
ucaacuugaaugagcug

SEQ ID NO: 3998076 - RNA, 15 nt, Human herpesvirus 7
ucaacuugcagagga

SEQ ID NO: 3998077 - RNA, 18 nt, Human herpesvirus 7
ucaaggucuuucaugcau

SEQ ID NO: 3998078 - RNA, 15 nt, Human herpesvirus 7
ucaaguagaauacca

SEQ ID NO: 3998079 - RNA, 15 nt, Human herpesvirus 7
ucaauaaaaaguuug

SEQ ID NO: 3998080 - RNA, 17 nt, Human herpesvirus 7
ucaauagcagagaauau

SEQ ID NO: 3998081 - RNA, 13 nt, Human herpesvirus 7
ucaauguuuucau

SEQ ID NO: 3998082 - RNA, 14 nt, Human herpesvirus 7
ucacauuuaugaaa

SEQ ID NO: 3998083 - RNA, 20 nt, Human herpesvirus 7
ucaccgcagauccaucuuug

SEQ ID NO: 3998084 - RNA, 19 nt, Human herpesvirus 7
ucacugacgaaaacugcaa

SEQ ID NO: 3998085 - RNA, 21 nt, Human herpesvirus 7
ucacuuagacucguaguaaga

SEQ ID NO: 3998086 - RNA, 20 nt, Human herpesvirus 7
ucagaaaaaccauuguauga

SEQ ID NO: 3998087 - RNA, 23 nt, Human herpesvirus 7
ucagacaauuucacacaaugccu

SEQ ID NO: 3998088 - RNA, 15 nt, Human herpesvirus 7
ucagaguuuaaagua

SEQ ID NO: 3998089 - RNA, 21 nt, Human herpesvirus 7
ucagcacugggagcaaugcau

SEQ ID NO: 3998090 - RNA, 19 nt, Human herpesvirus 7
ucaggacaaucaaacaugu

SEQ ID NO: 3998091 - RNA, 14 nt, Human herpesvirus 7
ucaguuguuggaaa

SEQ ID NO: 3998092 - RNA, 22 nt, Human herpesvirus 7
ucauguuuuaugacucagacga

SEQ ID NO: 3998093 - RNA, 22 nt, Human herpesvirus 7
uccaaaaucagacaauuucaca

SEQ ID NO: 3998094 - RNA, 15 nt, Human herpesvirus 7
uccaaagugaugaaa

SEQ ID NO: 3998095 - RNA, 17 nt, Human herpesvirus 7
uccaaagugaugaaagu

SEQ ID NO: 3998096 - RNA, 14 nt, Human herpesvirus 7
uccagacagcugua

SEQ ID NO: 3998097 - RNA, 14 nt, Human herpesvirus 7
uccagcacuuuuuu

SEQ ID NO: 3998098 - RNA, 21 nt, Human herpesvirus 7
uccauaaaacaugcaacauaa

SEQ ID NO: 3998099 - RNA, 20 nt, Human herpesvirus 7
uccaugcauauuugaacaua

SEQ ID NO: 3998100 - RNA, 15 nt, Human herpesvirus 7
uccauucauuuccuc

SEQ ID NO: 3998101 - RNA, 14 nt, Human herpesvirus 7
uccgaaaagacaac

SEQ ID NO: 3998102 - RNA, 19 nt, Human herpesvirus 7
uccgaaaagacaacaaggg

SEQ ID NO: 3998103 - RNA, 16 nt, Human herpesvirus 7
uccgagacagagucaa

SEQ ID NO: 3998104 - RNA, 11 nt, Human herpesvirus 7
uccguaacugc

SEQ ID NO: 3998105 - RNA, 17 nt, Human herpesvirus 7
uccuaagcuuuucaggc

SEQ ID NO: 3998106 - RNA, 17 nt, Human herpesvirus 7
uccuucuaccucuuaca

SEQ ID NO: 3998107 - RNA, 21 nt, Human herpesvirus 7
uccuuucaacgaucucaaaau

SEQ ID NO: 3998108 - RNA, 22 nt, Human herpesvirus 7
ucgaaaccgucagcaucucaga

SEQ ID NO: 3998109 - RNA, 19 nt, Human herpesvirus 7
ucgaaagauuuaaaguuuu

SEQ ID NO: 3998110 - RNA, 15 nt, Human herpesvirus 7
ucgaucuaagagauu

SEQ ID NO: 3998111 - RNA, 16 nt, Human herpesvirus 7
ucggaaccgagaaugu

SEQ ID NO: 3998112 - RNA, 14 nt, Human herpesvirus 7
ucguaucugugacu

SEQ ID NO: 3998113 - RNA, 17 nt, Human herpesvirus 7
ucguucuauguaugaaa

SEQ ID NO: 3998114 - RNA, 15 nt, Human herpesvirus 7
ucguuuucaaagugu

SEQ ID NO: 3998115 - RNA, 12 nt, Human herpesvirus 7
ucuaaacaaaca

SEQ ID NO: 3998116 - RNA, 13 nt, Human herpesvirus 7
ucuaaauaaacaa

SEQ ID NO: 3998117 - RNA, 23 nt, Human herpesvirus 7
ucuaacacugcaagcugauucaa

SEQ ID NO: 3998118 - RNA, 19 nt, Human herpesvirus 7
ucuaauuuaugauacuugu

SEQ ID NO: 3998119 - RNA, 20 nt, Human herpesvirus 7
ucuacacaaacgaguuucaa

SEQ ID NO: 3998120 - RNA, 15 nt, Human herpesvirus 7
ucuacacaucuucaa

SEQ ID NO: 3998121 - RNA, 15 nt, Human herpesvirus 7
ucuaccaauaaaagg

SEQ ID NO: 3998122 - RNA, 23 nt, Human herpesvirus 7
ucuaugaaauaaaauuuuucauu

SEQ ID NO: 3998123 - RNA, 20 nt, Human herpesvirus 7
ucuauuagauaaugacaaac

SEQ ID NO: 3998124 - RNA, 14 nt, Human herpesvirus 7
ucuauuauuucuac

SEQ ID NO: 3998125 - RNA, 17 nt, Human herpesvirus 7
ucucuuauuuugucugg

SEQ ID NO: 3998126 - RNA, 21 nt, Human herpesvirus 7
ucucuuggaguuugucucauu

SEQ ID NO: 3998127 - RNA, 17 nt, Human herpesvirus 7
ucugaaaaucuccuuga

SEQ ID NO: 3998128 - RNA, 15 nt, Human herpesvirus 7
ucugagaauuuaaag

SEQ ID NO: 3998129 - RNA, 16 nt, Human herpesvirus 7
ucugauucuuauucua

SEQ ID NO: 3998130 - RNA, 12 nt, Human herpesvirus 7
ucugcuaauucu

SEQ ID NO: 3998131 - RNA, 21 nt, Human herpesvirus 7
ucuggagaacaauuagaauuu

SEQ ID NO: 3998132 - RNA, 23 nt, Human herpesvirus 7
ucugguaaugucauaaaacuuuu

SEQ ID NO: 3998133 - RNA, 23 nt, Human herpesvirus 7
ucuguacccaugggcacauuugu

SEQ ID NO: 3998134 - RNA, 14 nt, Human herpesvirus 7
ucuuagcaguaaac

SEQ ID NO: 3998135 - RNA, 20 nt, Human herpesvirus 7
ucuuauaaauaaaauguuuu

SEQ ID NO: 3998136 - RNA, 23 nt, Human herpesvirus 7
ucuuauaacaaaguucaaguuuu

SEQ ID NO: 3998137 - RNA, 17 nt, Human herpesvirus 7
ucuucaacuucucuugg

SEQ ID NO: 3998138 - RNA, 14 nt, Human herpesvirus 7
ucuucuaauacauc

SEQ ID NO: 3998139 - RNA, 22 nt, Human herpesvirus 7
ucuuuaucgccauuuucuugag

SEQ ID NO: 3998140 - RNA, 14 nt, Human herpesvirus 7
ucuuucuauuggag

SEQ ID NO: 3998141 - RNA, 18 nt, Human herpesvirus 7
ucuuuuugaacagaauuu

SEQ ID NO: 3998142 - RNA, 19 nt, Human herpesvirus 7
ugaaaaaaauuauguguau

SEQ ID NO: 3998143 - RNA, 18 nt, Human herpesvirus 7
ugaaaaauaaauacuauu

SEQ ID NO: 3998144 - RNA, 22 nt, Human herpesvirus 7
ugaaaaauuuuuuacugucuuu

SEQ ID NO: 3998145 - RNA, 19 nt, Human herpesvirus 7
ugaaaaucaauccaaauaa

SEQ ID NO: 3998146 - RNA, 21 nt, Human herpesvirus 7
ugaaacucaucauugaagaaa

SEQ ID NO: 3998147 - RNA, 17 nt, Human herpesvirus 7
ugaaauaaaauuuuuca

SEQ ID NO: 3998148 - RNA, 14 nt, Human herpesvirus 7
ugaaauaaacauuu

SEQ ID NO: 3998149 - RNA, 17 nt, Human herpesvirus 7
ugaaaucauuuugcugu

SEQ ID NO: 3998150 - RNA, 19 nt, Human herpesvirus 7
ugaaauuguaguuuuugca

SEQ ID NO: 3998151 - RNA, 19 nt, Human herpesvirus 7
ugaacaauggugugucugu

SEQ ID NO: 3998152 - RNA, 19 nt, Human herpesvirus 7
ugaacaccgcaaacauuuu

SEQ ID NO: 3998153 - RNA, 13 nt, Human herpesvirus 7
ugaagaacaacau

SEQ ID NO: 3998154 - RNA, 14 nt, Human herpesvirus 7
ugaauaaaaguaaa

SEQ ID NO: 3998155 - RNA, 22 nt, Human herpesvirus 7
ugaauaaucucaauuaaaacau

SEQ ID NO: 3998156 - RNA, 18 nt, Human herpesvirus 7
ugaauauaaguuuucuua

SEQ ID NO: 3998157 - RNA, 19 nt, Human herpesvirus 7
ugaauauugcuagucucaa

SEQ ID NO: 3998158 - RNA, 13 nt, Human herpesvirus 7
ugaauuaauucuu

SEQ ID NO: 3998159 - RNA, 17 nt, Human herpesvirus 7
ugaauuaauucuuucca

SEQ ID NO: 3998160 - RNA, 18 nt, Human herpesvirus 7
ugaauuauguauaucuuu

SEQ ID NO: 3998161 - RNA, 20 nt, Human herpesvirus 7
acaugauugguaaaaaauua

SEQ ID NO: 3998162 - RNA, 16 nt, Human herpesvirus 7
acaugggauuucugua

SEQ ID NO: 3998163 - RNA, 19 nt, Human herpesvirus 7
acaugggauuucuguaaaa

SEQ ID NO: 3998164 - RNA, 20 nt, Human herpesvirus 7
acaugucuuuuaguuuucau

SEQ ID NO: 3998165 - RNA, 16 nt, Human herpesvirus 7
acauuaguucuggccg

SEQ ID NO: 3998166 - RNA, 17 nt, Human herpesvirus 7
acauuauaaauguaacu

SEQ ID NO: 3998167 - RNA, 22 nt, Human herpesvirus 7
acauucagaaaaaaucaaaaca

SEQ ID NO: 3998168 - RNA, 22 nt, Human herpesvirus 7
acauucucaaaaaugauaugac

SEQ ID NO: 3998169 - RNA, 16 nt, Human herpesvirus 7
acauugaaaaugcauu

SEQ ID NO: 3998170 - RNA, 22 nt, Human herpesvirus 7
acauugcuucagaaauaacaaa

SEQ ID NO: 3998171 - RNA, 22 nt, Human herpesvirus 7
acauuuaaaaaaucugaauaga

SEQ ID NO: 3998172 - RNA, 20 nt, Human herpesvirus 7
acauuuacaaaaaaaagcuu

SEQ ID NO: 3998173 - RNA, 23 nt, Human herpesvirus 7
acauuuauuauuuuuaaaaauga

SEQ ID NO: 3998174 - RNA, 22 nt, Human herpesvirus 7
accaagagccggaaagcaaugu

SEQ ID NO: 3998175 - RNA, 22 nt, Human herpesvirus 7
accaaugauaauaagauguguu

SEQ ID NO: 3998176 - RNA, 19 nt, Human herpesvirus 7
accaaugcugauuccuucu

SEQ ID NO: 3998177 - RNA, 23 nt, Human herpesvirus 7
accacaaccgauaaaagguguuu

SEQ ID NO: 3998178 - RNA, 16 nt, Human herpesvirus 7
accaguaugaaaucaa

SEQ ID NO: 3998179 - RNA, 16 nt, Human herpesvirus 7
accaugauguuaaaga

SEQ ID NO: 3998180 - RNA, 15 nt, Human herpesvirus 7
acccagaagaaacuu

SEQ ID NO: 3998181 - RNA, 21 nt, Human herpesvirus 7
accccaugcaagaaaaaaaug

SEQ ID NO: 3998182 - RNA, 20 nt, Human herpesvirus 7
accgucauuuaauuggcaac

SEQ ID NO: 3998183 - RNA, 18 nt, Human herpesvirus 7
accuaaagugaacaugac

SEQ ID NO: 3998184 - RNA, 14 nt, Human herpesvirus 7
accuauguguuuac

SEQ ID NO: 3998185 - RNA, 23 nt, Human herpesvirus 7
acgaauauucuaggcuugcauuc

SEQ ID NO: 3998186 - RNA, 21 nt, Human herpesvirus 7
acgauaugguuugaaaaccau

SEQ ID NO: 3998187 - RNA, 16 nt, Human herpesvirus 7
acgcagucuaaaagua

SEQ ID NO: 3998188 - RNA, 15 nt, Human herpesvirus 7
acgcucucaaucaaa

SEQ ID NO: 3998189 - RNA, 20 nt, Human herpesvirus 7
acggaaaauuuccgaccuga

SEQ ID NO: 3998190 - RNA, 18 nt, Human herpesvirus 7
acggauuuacauuucauu

SEQ ID NO: 3998191 - RNA, 20 nt, Human herpesvirus 7
acgguaacggauuuacauuu

SEQ ID NO: 3998192 - RNA, 12 nt, Human herpesvirus 7
acguccaaaaau

SEQ ID NO: 3998193 - RNA, 16 nt, Human herpesvirus 7
acgucuucuucugagu

SEQ ID NO: 3998194 - RNA, 19 nt, Human herpesvirus 7
acguguuuuugaugugcaa

SEQ ID NO: 3998195 - RNA, 20 nt, Human herpesvirus 7
acguucugaaacagucugaa

SEQ ID NO: 3998196 - RNA, 14 nt, Human herpesvirus 7
acuaaaaaaaauua

SEQ ID NO: 3998197 - RNA, 19 nt, Human herpesvirus 7
acuaaauauggagcagcuu

SEQ ID NO: 3998198 - RNA, 23 nt, Human herpesvirus 7
acuaauaaaaauuacucaugaag

SEQ ID NO: 3998199 - RNA, 14 nt, Human herpesvirus 7
acuauaugaaaaca

SEQ ID NO: 3998200 - RNA, 18 nt, Human herpesvirus 7
acuauuuacgauaauaau

SEQ ID NO: 3998201 - RNA, 16 nt, Human herpesvirus 7
acucaaaacagaacuu

SEQ ID NO: 3998202 - RNA, 21 nt, Human herpesvirus 7
acucauacuaauagaaaaaug

SEQ ID NO: 3998203 - RNA, 19 nt, Human herpesvirus 7
acuccauucgguuuucaaa

SEQ ID NO: 3998204 - RNA, 17 nt, Human herpesvirus 7
acucgauuagguaauag

SEQ ID NO: 3998205 - RNA, 15 nt, Human herpesvirus 7
acugagaaaaaugac

SEQ ID NO: 3998206 - RNA, 18 nt, Human herpesvirus 7
acugauuuuuuuaauaau

SEQ ID NO: 3998207 - RNA, 18 nt, Human herpesvirus 7
acugcaaauccaacagaa

SEQ ID NO: 3998208 - RNA, 16 nt, Human herpesvirus 7
acugcaaauuguaaau

SEQ ID NO: 3998209 - RNA, 20 nt, Human herpesvirus 7
acuggagagaauaagcaaau

SEQ ID NO: 3998210 - RNA, 22 nt, Human herpesvirus 7
acuggcaaucguccgaaaagac

SEQ ID NO: 3998211 - RNA, 23 nt, Human herpesvirus 7
acuguuguagguaauuucuuaua

SEQ ID NO: 3998212 - RNA, 14 nt, Human herpesvirus 7
acuuaaauauuuua

SEQ ID NO: 3998213 - RNA, 18 nt, Human herpesvirus 7
acuuaaauauuuuacaua

SEQ ID NO: 3998214 - RNA, 21 nt, Human herpesvirus 7
acuuaguucgaaugaauuuug

SEQ ID NO: 3998215 - RNA, 16 nt, Human herpesvirus 7
acuucagaaaaaccau

SEQ ID NO: 3998216 - RNA, 17 nt, Human herpesvirus 7
acuucuaguucugaaau

SEQ ID NO: 3998217 - RNA, 19 nt, Human herpesvirus 7
acuucugauaucuuaaaau

SEQ ID NO: 3998218 - RNA, 16 nt, Human herpesvirus 7
acuugcaaagacagaa

SEQ ID NO: 3998219 - RNA, 18 nt, Human herpesvirus 7
acuuguuuguagcucuag

SEQ ID NO: 3998220 - RNA, 13 nt, Human herpesvirus 7
acuuuuaaaauug

SEQ ID NO: 3998221 - RNA, 15 nt, Human herpesvirus 7
agaaaaaaacaauga

SEQ ID NO: 3998222 - RNA, 14 nt, Human herpesvirus 7
agaaaaacagacuu

SEQ ID NO: 3998223 - RNA, 15 nt, Human herpesvirus 7
agaaaacauuauauu

SEQ ID NO: 3998224 - RNA, 22 nt, Human herpesvirus 7
agaaaaguugcuuuucaugcuu

SEQ ID NO: 3998225 - RNA, 15 nt, Human herpesvirus 7
agaaaaucucucaac

SEQ ID NO: 3998226 - RNA, 12 nt, Human herpesvirus 7
agaaacaagguu

SEQ ID NO: 3998227 - RNA, 22 nt, Human herpesvirus 7
agaaacuaaagaaaaaaaaagu

SEQ ID NO: 3998228 - RNA, 18 nt, Human herpesvirus 7
agaaacucacaauguuuu

SEQ ID NO: 3998229 - RNA, 15 nt, Human herpesvirus 7
agaaauugaugaaga

SEQ ID NO: 3998230 - RNA, 23 nt, Human herpesvirus 7
agaaauuguuccugugugcaaug

SEQ ID NO: 3998231 - RNA, 22 nt, Human herpesvirus 7
agaaauuuuacagccuguacaa

SEQ ID NO: 3998232 - RNA, 21 nt, Human herpesvirus 7
agaacaucuugagaaauauga

SEQ ID NO: 3998233 - RNA, 16 nt, Human herpesvirus 7
agaacauguaguacaa

SEQ ID NO: 3998234 - RNA, 16 nt, Human herpesvirus 7
agaacauuaauaucaa

SEQ ID NO: 3998235 - RNA, 17 nt, Human herpesvirus 7
agaaccuaucaaaauuc

SEQ ID NO: 3998236 - RNA, 13 nt, Human herpesvirus 7
agaagaagauuuu

SEQ ID NO: 3998237 - RNA, 18 nt, Human herpesvirus 7
agaagacauauuagauua

SEQ ID NO: 3998238 - RNA, 20 nt, Human herpesvirus 7
agaagugaguuuuucaguga

SEQ ID NO: 3998239 - RNA, 18 nt, Human herpesvirus 7
agaaucagacuaaauaug

SEQ ID NO: 3998240 - RNA, 23 nt, Human herpesvirus 7
agaaucauagcaggaagcacaaa

SEQ ID NO: 3998241 - RNA, 20 nt, Human herpesvirus 7
agaaucauuuguauauucua

SEQ ID NO: 3998242 - RNA, 16 nt, Human herpesvirus 7
agaaugggugucagcu

SEQ ID NO: 3998243 - RNA, 19 nt, Human herpesvirus 7
agaaugggugucagcuucu

SEQ ID NO: 3998244 - RNA, 14 nt, Human herpesvirus 7
agaauuuucaagau

SEQ ID NO: 3998245 - RNA, 15 nt, Human herpesvirus 7
agacaaaaccaaacu

SEQ ID NO: 3998246 - RNA, 13 nt, Human herpesvirus 7
agacauugaagau

SEQ ID NO: 3998247 - RNA, 17 nt, Human herpesvirus 7
agacguugcucauuuug

SEQ ID NO: 3998248 - RNA, 22 nt, Human herpesvirus 7
agacuaaucacgagaaaaauau

SEQ ID NO: 3998249 - RNA, 20 nt, Human herpesvirus 7
agacuauaaaaagugcucug

SEQ ID NO: 3998250 - RNA, 21 nt, Human herpesvirus 7
agagaaaaaauuaugaguaaa

SEQ ID NO: 3998251 - RNA, 14 nt, Human herpesvirus 7
agagaaaauguuua

SEQ ID NO: 3998252 - RNA, 18 nt, Human herpesvirus 7
agagaacuagaacagcug

SEQ ID NO: 3998253 - RNA, 23 nt, Human herpesvirus 7
agagaugauguuuuuugucuuuu

SEQ ID NO: 3998254 - RNA, 13 nt, Human herpesvirus 7
agauaaugacaaa

SEQ ID NO: 3998255 - RNA, 18 nt, Human herpesvirus 7
agauacauuuuugcaaua

SEQ ID NO: 3998256 - RNA, 17 nt, Human herpesvirus 7
agauacgcgcagauuuu

SEQ ID NO: 3998257 - RNA, 19 nt, Human herpesvirus 7
agaucaauugaguuuacug

SEQ ID NO: 3998258 - RNA, 20 nt, Human herpesvirus 7
agaucauaauuacauugcag

SEQ ID NO: 3998259 - RNA, 17 nt, Human herpesvirus 7
agauuaaauagcaaagu

SEQ ID NO: 3998260 - RNA, 20 nt, Human herpesvirus 7
agauuuaaaacaauuuccuu

SEQ ID NO: 3998261 - RNA, 21 nt, Human herpesvirus 7
agauuuccauuucaaaagaaa

SEQ ID NO: 3998262 - RNA, 16 nt, Human herpesvirus 7
agauuuguuccaaacu

SEQ ID NO: 3998263 - RNA, 19 nt, Human herpesvirus 7
agauuuuccaacgaaauuu

SEQ ID NO: 3998264 - RNA, 21 nt, Human herpesvirus 7
agcaaauucacgcucucaauc

SEQ ID NO: 3998265 - RNA, 16 nt, Human herpesvirus 7
agcaauacacccaguc

SEQ ID NO: 3998266 - RNA, 15 nt, Human herpesvirus 7
agcaaugcaugaugc

SEQ ID NO: 3998267 - RNA, 16 nt, Human herpesvirus 7
agcacauguacagaca

SEQ ID NO: 3998268 - RNA, 18 nt, Human herpesvirus 7
agcacccggcuuaaugaa

SEQ ID NO: 3998269 - RNA, 16 nt, Human herpesvirus 7
agcagacaaggggcau

SEQ ID NO: 3998270 - RNA, 22 nt, Human herpesvirus 7
agcagcuuaagacaccccaaaa

SEQ ID NO: 3998271 - RNA, 16 nt, Human herpesvirus 7
agcaguuauaugaaau

SEQ ID NO: 3998272 - RNA, 14 nt, Human herpesvirus 7
agcauaaagcacca

SEQ ID NO: 3998273 - RNA, 16 nt, Human herpesvirus 7
agcauacuuucgcaac

SEQ ID NO: 3998274 - RNA, 19 nt, Human herpesvirus 7
agcaugcguaaaaaaucaa

SEQ ID NO: 3998275 - RNA, 23 nt, Human herpesvirus 7
agcauggaucguagcaacagaga

SEQ ID NO: 3998276 - RNA, 14 nt, Human herpesvirus 7
agccauaaaugcuu

SEQ ID NO: 3998277 - RNA, 22 nt, Human herpesvirus 7
agcccauauuuuuaaauuuguc

SEQ ID NO: 3998278 - RNA, 18 nt, Human herpesvirus 7
agcgcugagaucuuccaa

SEQ ID NO: 3998279 - RNA, 22 nt, Human herpesvirus 7
agcuaacgauccaguacuugca

SEQ ID NO: 3998280 - RNA, 17 nt, Human herpesvirus 7
agcuaauugagaaauuu

SEQ ID NO: 3998281 - RNA, 15 nt, Human herpesvirus 7
agcuagccuauaauu

SEQ ID NO: 3998282 - RNA, 21 nt, Human herpesvirus 7
agcuggaauuguaauugaaag

SEQ ID NO: 3998283 - RNA, 20 nt, Human herpesvirus 7
agcuucaaaaauguuuacaa

SEQ ID NO: 3998284 - RNA, 21 nt, Human herpesvirus 7
agcuugaaaacuuagugauga

SEQ ID NO: 3998285 - RNA, 23 nt, Human herpesvirus 7
agcuugcuuaaaacuuugaaaau

SEQ ID NO: 3998286 - RNA, 14 nt, Human herpesvirus 7
agcuuucuuucuca

SEQ ID NO: 3998287 - RNA, 20 nt, Human herpesvirus 7
aggaaaccaauuaauauuaa

SEQ ID NO: 3998288 - RNA, 12 nt, Human herpesvirus 7
aggaaauugcuu

SEQ ID NO: 3998289 - RNA, 23 nt, Human herpesvirus 7
aggaagaggaguauguugcauau

SEQ ID NO: 3998290 - RNA, 17 nt, Human herpesvirus 7
aggaagcuuuacagcag

SEQ ID NO: 3998291 - RNA, 19 nt, Human herpesvirus 7
aggaaucgcaguguucauu

SEQ ID NO: 3998292 - RNA, 17 nt, Human herpesvirus 7
aggacaugauuggccag

SEQ ID NO: 3998293 - RNA, 20 nt, Human herpesvirus 7
aggaucaaaagcugcagcug

SEQ ID NO: 3998294 - RNA, 15 nt, Human herpesvirus 7
aggaugaaagugcau

SEQ ID NO: 3998295 - RNA, 17 nt, Human herpesvirus 7
agggauuucuucuucua

SEQ ID NO: 3998296 - RNA, 20 nt, Human herpesvirus 7
agggggacaauuauuuaaac

SEQ ID NO: 3998297 - RNA, 17 nt, Human herpesvirus 7
aggggguucuaaaugua

SEQ ID NO: 3998298 - RNA, 21 nt, Human herpesvirus 7
aggguauuguucacagcaauu

SEQ ID NO: 3998299 - RNA, 16 nt, Human herpesvirus 7
aggucacaaaagcuuu

SEQ ID NO: 3998300 - RNA, 23 nt, Human herpesvirus 7
aggucacaaaagcuuugaucuac

SEQ ID NO: 3998301 - RNA, 16 nt, Human herpesvirus 7
aggugacagagggcau

SEQ ID NO: 3998302 - RNA, 19 nt, Human herpesvirus 7
agguugaguugacaauauu

SEQ ID NO: 3998303 - RNA, 18 nt, Human herpesvirus 7
aguaaaacucaauguaaa

SEQ ID NO: 3998304 - RNA, 17 nt, Human herpesvirus 7
aguaacagguaaauugu

SEQ ID NO: 3998305 - RNA, 21 nt, Human herpesvirus 7
aguaauguuauuuuucaugcc

SEQ ID NO: 3998306 - RNA, 15 nt, Human herpesvirus 7
aguacaucuuucuag

SEQ ID NO: 3998307 - RNA, 11 nt, Human herpesvirus 7
aguacaugugu

SEQ ID NO: 3998308 - RNA, 14 nt, Human herpesvirus 7
aguagaaaaugcug

SEQ ID NO: 3998309 - RNA, 17 nt, Human herpesvirus 7
aguaucacuuaaagcag

SEQ ID NO: 3998310 - RNA, 19 nt, Human herpesvirus 7
aguauuguaauaauuuaaa

SEQ ID NO: 3998311 - RNA, 15 nt, Human herpesvirus 7
agucgagaaaacacg

SEQ ID NO: 3998312 - RNA, 13 nt, Human herpesvirus 7
agucuaaaaaugu

SEQ ID NO: 3998313 - RNA, 15 nt, Human herpesvirus 7
agucuacaucaucaa

SEQ ID NO: 3998314 - RNA, 19 nt, Human herpesvirus 7
agucuauugacauaaucau

SEQ ID NO: 3998315 - RNA, 14 nt, Human herpesvirus 7
agucucuaaacuuc

SEQ ID NO: 3998316 - RNA, 23 nt, Human herpesvirus 7
agucucuaaacuucuagccugca

SEQ ID NO: 3998317 - RNA, 22 nt, Human herpesvirus 7
agucugaaagccgcugccuucg

SEQ ID NO: 3998318 - RNA, 13 nt, Human herpesvirus 7
aguggcuucucua

SEQ ID NO: 3998319 - RNA, 22 nt, Human herpesvirus 7
aguuauuuguuccaguugaaug

SEQ ID NO: 3998320 - RNA, 21 nt, Human herpesvirus 7
aguucauaaugacacgacacu

SEQ ID NO: 3998321 - RNA, 16 nt, Human herpesvirus 7
aguucugacuaaagcu

SEQ ID NO: 3998322 - RNA, 14 nt, Human herpesvirus 7
aguugaaaauguuu

SEQ ID NO: 3998323 - RNA, 16 nt, Human herpesvirus 7
aguugacaaugucaau

SEQ ID NO: 3998324 - RNA, 16 nt, Human herpesvirus 7
aguugggcaaacaguu

SEQ ID NO: 3998325 - RNA, 16 nt, Human herpesvirus 7
aguuucuuuuucauua

SEQ ID NO: 3998326 - RNA, 23 nt, Human herpesvirus 7
aguuuguuucaauaugcaugcaa

SEQ ID NO: 3998327 - RNA, 17 nt, Human herpesvirus 7
aguuuuacagaaauuga

SEQ ID NO: 3998328 - RNA, 22 nt, Human herpesvirus 7
aguuuuuaaacuuaucagauuc

SEQ ID NO: 3998329 - RNA, 12 nt, Human herpesvirus 7
auaaaaaaagaa

SEQ ID NO: 3998330 - RNA, 15 nt, Human herpesvirus 7
auaaaaauuacucau

SEQ ID NO: 3998331 - RNA, 23 nt, Human herpesvirus 7
auaaaacaaacuauguccaaaaa

SEQ ID NO: 3998332 - RNA, 18 nt, Human herpesvirus 7
auaaaaccauuuauugau

SEQ ID NO: 3998333 - RNA, 18 nt, Human herpesvirus 7
auaaaagggcagacacua

SEQ ID NO: 3998334 - RNA, 14 nt, Human herpesvirus 7
auaaaauuuuucau

SEQ ID NO: 3998335 - RNA, 22 nt, Human herpesvirus 7
auaaagagucuauugacauaau

SEQ ID NO: 3998336 - RNA, 23 nt, Human herpesvirus 7
auaaagaguguuuucaaauaucu

SEQ ID NO: 3998337 - RNA, 20 nt, Human herpesvirus 7
auaaaggaaagacaaacuau

SEQ ID NO: 3998338 - RNA, 23 nt, Human herpesvirus 7
auaaaggaucucucuuucuggag

SEQ ID NO: 3998339 - RNA, 14 nt, Human herpesvirus 7
auaaaguuuuguaa

SEQ ID NO: 3998340 - RNA, 19 nt, Human herpesvirus 7
auaaauguaacuuucaucu

SEQ ID NO: 3998341 - RNA, 20 nt, Human herpesvirus 7
auaacaaaaaagguguugau

SEQ ID NO: 3998342 - RNA, 20 nt, Human herpesvirus 7
auaacaauuauagaaacauu

SEQ ID NO: 3998343 - RNA, 22 nt, Human herpesvirus 7
auaacaauuugaagaggagaau

SEQ ID NO: 3998344 - RNA, 18 nt, Human herpesvirus 7
auaacccacuaacauuuu

SEQ ID NO: 3998345 - RNA, 17 nt, Human herpesvirus 7
auaagcaaauaaauugu

SEQ ID NO: 3998346 - RNA, 20 nt, Human herpesvirus 7
auaauguuuccguguuuaug

SEQ ID NO: 3998347 - RNA, 13 nt, Human herpesvirus 7
auacaaaagacau

SEQ ID NO: 3998348 - RNA, 22 nt, Human herpesvirus 7
auacaacugcagaaauuuuuaa

SEQ ID NO: 3998349 - RNA, 13 nt, Human herpesvirus 7
auacacuauuuua

SEQ ID NO: 3998350 - RNA, 16 nt, Human herpesvirus 7
auacagauauuuuaau

SEQ ID NO: 3998351 - RNA, 19 nt, Human herpesvirus 7
auacauaaguuaaaucagu

SEQ ID NO: 3998352 - RNA, 17 nt, Human herpesvirus 7
auacguuaguugcagcu

SEQ ID NO: 3998353 - RNA, 12 nt, Human herpesvirus 7
auacuaauagaa

SEQ ID NO: 3998354 - RNA, 21 nt, Human herpesvirus 7
auacuaauagaaaaauguaca

SEQ ID NO: 3998355 - RNA, 14 nt, Human herpesvirus 7
auacuuguugagcu

SEQ ID NO: 3998356 - RNA, 14 nt, Human herpesvirus 7
auacuuuuuugguu

SEQ ID NO: 3998357 - RNA, 17 nt, Human herpesvirus 7
auagauuucagaauuuc

SEQ ID NO: 3998358 - RNA, 20 nt, Human herpesvirus 7
auagugaaucauauuuuagu

SEQ ID NO: 3998359 - RNA, 14 nt, Human herpesvirus 7
auauaaacaaaauu

SEQ ID NO: 3998360 - RNA, 13 nt, Human herpesvirus 7
auauaugcuuuau

SEQ ID NO: 3998361 - RNA, 22 nt, Human herpesvirus 7
auaugcuaagaaagaacauuuu

SEQ ID NO: 3998362 - RNA, 11 nt, Human herpesvirus 7
auauggcaaua

SEQ ID NO: 3998363 - RNA, 22 nt, Human herpesvirus 7
auauuuaaggcuguaaaagaaa

SEQ ID NO: 3998364 - RNA, 12 nt, Human herpesvirus 7
aucaaaaaauuc

SEQ ID NO: 3998365 - RNA, 12 nt, Human herpesvirus 7
aucaaaauccug

SEQ ID NO: 3998366 - RNA, 15 nt, Human herpesvirus 7
aucaagaaacaaggu

SEQ ID NO: 3998367 - RNA, 17 nt, Human herpesvirus 7
aucaauuuuaaugugcu

SEQ ID NO: 3998368 - RNA, 14 nt, Human herpesvirus 7
aucauagagaaaac

SEQ ID NO: 3998369 - RNA, 18 nt, Human herpesvirus 7
aucauagagaaaacauug

SEQ ID NO: 3998370 - RNA, 20 nt, Human herpesvirus 7
aucauguuuaagaaaaguug

SEQ ID NO: 3998371 - RNA, 13 nt, Human herpesvirus 7
aucauugaagaaa

SEQ ID NO: 3998372 - RNA, 15 nt, Human herpesvirus 7
auccagcaaagacuu

SEQ ID NO: 3998373 - RNA, 16 nt, Human herpesvirus 7
aucccugcugauacaa

SEQ ID NO: 3998374 - RNA, 17 nt, Human herpesvirus 7
auccguuaauggauaac

SEQ ID NO: 3998375 - RNA, 14 nt, Human herpesvirus 7
aucgaugagaaugu

SEQ ID NO: 3998376 - RNA, 23 nt, Human herpesvirus 7
aucgauguuuuaucuaacacugc

SEQ ID NO: 3998377 - RNA, 14 nt, Human herpesvirus 7
aucuagauaaagua

SEQ ID NO: 3998378 - RNA, 12 nt, Human herpesvirus 7
aucuauaaacau

SEQ ID NO: 3998379 - RNA, 17 nt, Human herpesvirus 7
aucuaugugcucugaau

SEQ ID NO: 3998380 - RNA, 19 nt, Human herpesvirus 7
aucucagaaguuucaauug

SEQ ID NO: 3998381 - RNA, 13 nt, Human herpesvirus 7
aucucauagcuua

SEQ ID NO: 3998382 - RNA, 15 nt, Human herpesvirus 7
aucucucaacgacaa

SEQ ID NO: 3998383 - RNA, 22 nt, Human herpesvirus 7
aucugucaggucacaaaagcuu

SEQ ID NO: 3998384 - RNA, 22 nt, Human herpesvirus 7
aucuucugaaucugcaaagaaa

SEQ ID NO: 3998385 - RNA, 22 nt, Human herpesvirus 7
aucuuuaugugggauuugaaug

SEQ ID NO: 3998386 - RNA, 15 nt, Human herpesvirus 7
aucuuucauaacaaa

SEQ ID NO: 3998387 - RNA, 17 nt, Human herpesvirus 7
aucuuuuucaaauggau

SEQ ID NO: 3998388 - RNA, 14 nt, Human herpesvirus 7
aucuuuuuucagug

SEQ ID NO: 3998389 - RNA, 15 nt, Human herpesvirus 7
augaaggaugcgugu

SEQ ID NO: 3998390 - RNA, 22 nt, Human herpesvirus 7
augaaggaugcguguguucaaa

SEQ ID NO: 3998391 - RNA, 14 nt, Human herpesvirus 7
augaauaucuguuu

SEQ ID NO: 3998392 - RNA, 16 nt, Human herpesvirus 7
augacaaacaaaaaua

SEQ ID NO: 3998393 - RNA, 15 nt, Human herpesvirus 7
caaugguaagcaaaa

SEQ ID NO: 3998394 - RNA, 17 nt, Human herpesvirus 7
caaugguauaaagugcu

SEQ ID NO: 3998395 - RNA, 15 nt, Human herpesvirus 7
caauuaaaguauuua

SEQ ID NO: 3998396 - RNA, 13 nt, Human herpesvirus 7
caauuaaugcauu

SEQ ID NO: 3998397 - RNA, 17 nt, Human herpesvirus 7
uuaccuuuguuaacaug

SEQ ID NO: 3998398 - RNA, 21 nt, Human herpesvirus 7
uuacucaugaagcuguacaac

SEQ ID NO: 3998399 - RNA, 22 nt, Human herpesvirus 7
uuacugccaccauuucugaaac

SEQ ID NO: 3998400 - RNA, 16 nt, Human herpesvirus 7
uuacuugcuaugcuug

SEQ ID NO: 3998401 - RNA, 16 nt, Human herpesvirus 7
uuacuuucauagcuua

SEQ ID NO: 3998402 - RNA, 17 nt, Human herpesvirus 7
uuagaaacaucuguuuu

SEQ ID NO: 3998403 - RNA, 21 nt, Human herpesvirus 7
uuagaaucacaacauauagau

SEQ ID NO: 3998404 - RNA, 14 nt, Human herpesvirus 7
uuagcgaaucaucu

SEQ ID NO: 3998405 - RNA, 18 nt, Human herpesvirus 7
uuagcgaauuugugcugu

SEQ ID NO: 3998406 - RNA, 17 nt, Human herpesvirus 7
uuaguuccacgucaauc

SEQ ID NO: 3998407 - RNA, 21 nt, Human herpesvirus 7
uuauaaaagauggaaaguuua

SEQ ID NO: 3998408 - RNA, 12 nt, Human herpesvirus 7
uuauagaaguac

SEQ ID NO: 3998409 - RNA, 18 nt, Human herpesvirus 7
uuauauuugcuugcugaa

SEQ ID NO: 3998410 - RNA, 19 nt, Human herpesvirus 7
uuaucaaguagaauaccag

SEQ ID NO: 3998411 - RNA, 14 nt, Human herpesvirus 7
uuauccaaguuuua

SEQ ID NO: 3998412 - RNA, 15 nt, Human herpesvirus 7
uuaucucagaugcua

SEQ ID NO: 3998413 - RNA, 16 nt, Human herpesvirus 7
uuaugugguuaaagau

SEQ ID NO: 3998414 - RNA, 15 nt, Human herpesvirus 7
uuauucauacguaag

SEQ ID NO: 3998415 - RNA, 15 nt, Human herpesvirus 7
uuauucccaugccua

SEQ ID NO: 3998416 - RNA, 13 nt, Human herpesvirus 7
uucaacaucuuuc

SEQ ID NO: 3998417 - RNA, 13 nt, Human herpesvirus 7
uucaacuguguuu

SEQ ID NO: 3998418 - RNA, 18 nt, Human herpesvirus 7
uucaacuucuaguucuga

SEQ ID NO: 3998419 - RNA, 14 nt, Human herpesvirus 7
uucaagaaaucaga

SEQ ID NO: 3998420 - RNA, 13 nt, Human herpesvirus 7
uucaaucaaauua

SEQ ID NO: 3998421 - RNA, 19 nt, Human herpesvirus 7
uucacaauggaaagaagaa

SEQ ID NO: 3998422 - RNA, 15 nt, Human herpesvirus 7
uucacacaaugccuu

SEQ ID NO: 3998423 - RNA, 13 nt, Human herpesvirus 7
uucacagaaaucc

SEQ ID NO: 3998424 - RNA, 19 nt, Human herpesvirus 7
uucacagacgcaucauucc

SEQ ID NO: 3998425 - RNA, 20 nt, Human herpesvirus 7
uucagaaaauaaaaguaaaa

SEQ ID NO: 3998426 - RNA, 20 nt, Human herpesvirus 7
uucagucuuacagugcucuu

SEQ ID NO: 3998427 - RNA, 19 nt, Human herpesvirus 7
uucauauggagaaggcaug

SEQ ID NO: 3998428 - RNA, 23 nt, Human herpesvirus 7
uucauccaaaaagaaacuuucua

SEQ ID NO: 3998429 - RNA, 16 nt, Human herpesvirus 7
uucaucuucugaaucu

SEQ ID NO: 3998430 - RNA, 17 nt, Human herpesvirus 7
uucauuggcauuauucu

SEQ ID NO: 3998431 - RNA, 22 nt, Human herpesvirus 7
uuccagagggguuugaacuugu

SEQ ID NO: 3998432 - RNA, 21 nt, Human herpesvirus 7
uuccagauaugacaaauuuca

SEQ ID NO: 3998433 - RNA, 16 nt, Human herpesvirus 7
uuccaucacaaaacuc

SEQ ID NO: 3998434 - RNA, 14 nt, Human herpesvirus 7
uuccauuucaaaag

SEQ ID NO: 3998435 - RNA, 20 nt, Human herpesvirus 7
uuccgcgcgguauaaugcac

SEQ ID NO: 3998436 - RNA, 14 nt, Human herpesvirus 7
uuccgguguggaaa

SEQ ID NO: 3998437 - RNA, 15 nt, Human herpesvirus 7
uuccuguuaauaucu

SEQ ID NO: 3998438 - RNA, 21 nt, Human herpesvirus 7
uucgaauuuguucaauugcca

SEQ ID NO: 3998439 - RNA, 15 nt, Human herpesvirus 7
uucgcaaauguacaa

SEQ ID NO: 3998440 - RNA, 14 nt, Human herpesvirus 7
uucguaaacauuug

SEQ ID NO: 3998441 - RNA, 20 nt, Human herpesvirus 7
uucguuaacccagaagaaac

SEQ ID NO: 3998442 - RNA, 19 nt, Human herpesvirus 7
uucuagaaacuaaagaaaa

SEQ ID NO: 3998443 - RNA, 16 nt, Human herpesvirus 7
uucuauucaguuucuu

SEQ ID NO: 3998444 - RNA, 12 nt, Human herpesvirus 7
uucucaaaucuu

SEQ ID NO: 3998445 - RNA, 15 nt, Human herpesvirus 7
uucugaaauaaacau

SEQ ID NO: 3998446 - RNA, 20 nt, Human herpesvirus 7
uucuggcaacaguucaaaaa

SEQ ID NO: 3998447 - RNA, 11 nt, Human herpesvirus 7
uugaaaaccau

SEQ ID NO: 3998448 - RNA, 14 nt, Human herpesvirus 7
uugaaagaccaaau

SEQ ID NO: 3998449 - RNA, 21 nt, Human herpesvirus 7
uugaaagcguuucacugggaa

SEQ ID NO: 3998450 - RNA, 13 nt, Human herpesvirus 7
uugaaauaaagga

SEQ ID NO: 3998451 - RNA, 16 nt, Human herpesvirus 7
uugaacauaaauauuc

SEQ ID NO: 3998452 - RNA, 16 nt, Human herpesvirus 7
uugaagauaaguauaa

SEQ ID NO: 3998453 - RNA, 19 nt, Human herpesvirus 7
uugaauuauguauaucuuu

SEQ ID NO: 3998454 - RNA, 15 nt, Human herpesvirus 7
uugagcaauugauuc

SEQ ID NO: 3998455 - RNA, 22 nt, Human herpesvirus 7
uugauucacauugucacugcaa

SEQ ID NO: 3998456 - RNA, 23 nt, Human herpesvirus 7
uugauuuuuaaguuguucucaau

SEQ ID NO: 3998457 - RNA, 23 nt, Human herpesvirus 7
uugcaauacaaauuccugcuugc

SEQ ID NO: 3998458 - RNA, 15 nt, Human herpesvirus 7
uugcagauuguagag

SEQ ID NO: 3998459 - RNA, 19 nt, Human herpesvirus 7
uugcagcccaauguugccu

SEQ ID NO: 3998460 - RNA, 13 nt, Human herpesvirus 7
uugcauacaguuu

SEQ ID NO: 3998461 - RNA, 20 nt, Human herpesvirus 7
uugcuauuuaaucuaugcaa

SEQ ID NO: 3998462 - RNA, 18 nt, Human herpesvirus 7
uugcugaaagaacuuuuc

SEQ ID NO: 3998463 - RNA, 14 nt, Human herpesvirus 7
uugcugucuuggag

SEQ ID NO: 3998464 - RNA, 16 nt, Human herpesvirus 7
uugcuguucuugcugg

SEQ ID NO: 3998465 - RNA, 17 nt, Human herpesvirus 7
uugcuuaaaacuuugaa

SEQ ID NO: 3998466 - RNA, 21 nt, Human herpesvirus 7
uuggagucguucuauguauga

SEQ ID NO: 3998467 - RNA, 19 nt, Human herpesvirus 7
uuggguagguuaagccuag

SEQ ID NO: 3998468 - RNA, 20 nt, Human herpesvirus 7
uugguggauccguaacugca

SEQ ID NO: 3998469 - RNA, 19 nt, Human herpesvirus 7
uugguuuuacaaauuaaag

SEQ ID NO: 3998470 - RNA, 19 nt, Human herpesvirus 7
uuguaauuuggcuucuauu

SEQ ID NO: 3998471 - RNA, 21 nt, Human herpesvirus 7
uuguaguuuuugcauauggac

SEQ ID NO: 3998472 - RNA, 23 nt, Human herpesvirus 7
uuguaguuuuugcauauggacuu

SEQ ID NO: 3998473 - RNA, 16 nt, Human herpesvirus 7
uugucauacaaugaau

SEQ ID NO: 3998474 - RNA, 16 nt, Human herpesvirus 7
uugugaaguuugcuga

SEQ ID NO: 3998475 - RNA, 24 nt, Human herpesvirus 7
uuguggaauccuaugacugagaaa

SEQ ID NO: 3998476 - RNA, 23 nt, Human herpesvirus 7
uugugguacaacaaacauuccaa

SEQ ID NO: 3998477 - RNA, 12 nt, Human herpesvirus 7
uuguuaacauga

SEQ ID NO: 3998478 - RNA, 14 nt, Human herpesvirus 7
uuguucaaacucaa

SEQ ID NO: 3998479 - RNA, 12 nt, Human herpesvirus 7
uuuaaaaguuug

SEQ ID NO: 3998480 - RNA, 17 nt, Human herpesvirus 7
uuuaaagaaaagcuugu

SEQ ID NO: 3998481 - RNA, 18 nt, Human herpesvirus 7
uuuaaagaaaagcuugua

SEQ ID NO: 3998482 - RNA, 16 nt, Human herpesvirus 7
uuuaacgauuccaaac

SEQ ID NO: 3998483 - RNA, 14 nt, Human herpesvirus 7
uuuaaguaaauuuc

SEQ ID NO: 3998484 - RNA, 17 nt, Human herpesvirus 7
uuuaaguaaauuucuca

SEQ ID NO: 3998485 - RNA, 21 nt, Human herpesvirus 7
uuuaaucaauggacguuuauu

SEQ ID NO: 3998486 - RNA, 19 nt, Human herpesvirus 7
uuuacaaacauguuccauu

SEQ ID NO: 3998487 - RNA, 16 nt, Human herpesvirus 7
uuuacaaugcagccua

SEQ ID NO: 3998488 - RNA, 22 nt, Human herpesvirus 7
uuuaccgauucuaaauuaaaaa

SEQ ID NO: 3998489 - RNA, 12 nt, Human herpesvirus 7
uuuacuuaaaua

SEQ ID NO: 3998490 - RNA, 14 nt, Human herpesvirus 7
uuuagaccuaucaa

SEQ ID NO: 3998491 - RNA, 21 nt, Human herpesvirus 7
uuuagauuccagucuacauau

SEQ ID NO: 3998492 - RNA, 18 nt, Human herpesvirus 7
uuuauauauggcaauaaa

SEQ ID NO: 3998493 - RNA, 13 nt, Human herpesvirus 7
uuuauccaucaaa

SEQ ID NO: 3998494 - RNA, 21 nt, Human herpesvirus 7
uuuauccaucaaaagucuugu

SEQ ID NO: 3998495 - RNA, 18 nt, Human herpesvirus 7
uuuauuuucuuaacaauu

SEQ ID NO: 3998496 - RNA, 19 nt, Human herpesvirus 7
uuucaagaaggaaaauuuc

SEQ ID NO: 3998497 - RNA, 16 nt, Human herpesvirus 7
uuucauagcacucaua

SEQ ID NO: 3998498 - RNA, 17 nt, Human herpesvirus 7
uuucauauuuagacuuu

SEQ ID NO: 3998499 - RNA, 22 nt, Human herpesvirus 7
uuuccaauagcacuacuagaaa

SEQ ID NO: 3998500 - RNA, 23 nt, Human herpesvirus 7
uuuccaauagcacuacuagaaau

SEQ ID NO: 3998501 - RNA, 14 nt, Human herpesvirus 7
uuuccaugucuugu

SEQ ID NO: 3998502 - RNA, 21 nt, Human herpesvirus 7
uuucgcaacaaucaacauuug

SEQ ID NO: 3998503 - RNA, 20 nt, Human herpesvirus 7
uuucggacacaaauaucacu

SEQ ID NO: 3998504 - RNA, 22 nt, Human herpesvirus 7
uuucuccacuaugccacaaaaa

SEQ ID NO: 3998505 - RNA, 20 nt, Human herpesvirus 7
uuucucgcguuucuucaaag

SEQ ID NO: 3998506 - RNA, 14 nt, Human herpesvirus 7
uuucuggcaauaaa

SEQ ID NO: 3998507 - RNA, 13 nt, Human herpesvirus 7
uuucuuucucauc

SEQ ID NO: 3998508 - RNA, 21 nt, Human herpesvirus 7
uuugaaauaaaggaucucucu

SEQ ID NO: 3998509 - RNA, 18 nt, Human herpesvirus 7
uuugaacggaauaaacaa

SEQ ID NO: 3998510 - RNA, 13 nt, Human herpesvirus 7
uuugaaucuguaa

SEQ ID NO: 3998511 - RNA, 13 nt, Human herpesvirus 7
uuugaauguaugu

SEQ ID NO: 3998512 - RNA, 18 nt, Human herpesvirus 7
uuugacaaucuuggcauu

SEQ ID NO: 3998513 - RNA, 17 nt, Human herpesvirus 7
uuugagcuaaccuuuua

SEQ ID NO: 3998514 - RNA, 21 nt, Human herpesvirus 7
uuaacaugccugcaauaugca

SEQ ID NO: 3998515 - RNA, 24 nt, Human herpesvirus 7
uuaagaaaaguugcuuuucaugcu

SEQ ID NO: 3998516 - RNA, 16 nt, Human herpesvirus 7
uuaagguggaaaucuu

SEQ ID NO: 3998517 - RNA, 14 nt, Human herpesvirus 7
uuaaguagugucug

SEQ ID NO: 3998518 - RNA, 11 nt, Human herpesvirus 7
uuaauaaaagu

SEQ ID NO: 3998519 - RNA, 12 nt, Human herpesvirus 7
uuaauaacagca

SEQ ID NO: 3998520 - RNA, 15 nt, Human herpesvirus 7
uuaauaauauuagua

SEQ ID NO: 3998521 - RNA, 19 nt, Human herpesvirus 7
uuaauacguccaaaaauug

SEQ ID NO: 3998522 - RNA, 16 nt, Human herpesvirus 7
uuaauagaaauuauug

SEQ ID NO: 3998523 - RNA, 12 nt, Human herpesvirus 7
uuaauauuagua

SEQ ID NO: 3998524 - RNA, 20 nt, Human herpesvirus 7
uuaauggaggauucggaagu

SEQ ID NO: 3998525 - RNA, 20 nt, Human herpesvirus 7
uuaauucuaaaaauuauuua

SEQ ID NO: 3998526 - RNA, 22 nt, Human herpesvirus 7
uuaauugagauuauucaaaagc

SEQ ID NO: 3998527 - RNA, 21 nt, Human herpesvirus 7
uuaauuguuuuuuauuuagcu

SEQ ID NO: 3998528 - RNA, 21 nt, Human herpesvirus 7
uuaauuuggaaauuguuugau

SEQ ID NO: 3998529 - RNA, 14 nt, Human herpesvirus 7
uuacaaaaaguaga

SEQ ID NO: 3998530 - RNA, 13 nt, Human herpesvirus 7
uuacaaagaacau

SEQ ID NO: 3998531 - RNA, 23 nt, Human herpesvirus 7
uuacaaauuuuucggauaaaagg

SEQ ID NO: 3998532 - RNA, 15 nt, Human herpesvirus 7
uuacacucuguuacu

SEQ ID NO: 3998533 - RNA, 19 nt, Human herpesvirus 7
uuacacuuggaguuguguu

SEQ ID NO: 3998534 - RNA, 17 nt, Human herpesvirus 7
uuacaugaucuuguaau

SEQ ID NO: 3998535 - RNA, 20 nt, Human herpesvirus 7
acuuuuuguucaguuaauaa

SEQ ID NO: 3998536 - RNA, 19 nt, Human herpesvirus 7
acuuuuuuuacuuaaauau

SEQ ID NO: 3998537 - RNA, 12 nt, Human herpesvirus 7
agaaaaaaaugg

SEQ ID NO: 3998538 - RNA, 12 nt, Human herpesvirus 7
agaaaagcaagu

SEQ ID NO: 3998539 - RNA, 19 nt, Human herpesvirus 7
agaaaaguugaaaauguuu

SEQ ID NO: 3998540 - RNA, 17 nt, Human herpesvirus 7
agaaacaaucccagaaa

SEQ ID NO: 3998541 - RNA, 13 nt, Human herpesvirus 7
agaaacuaauaaa

SEQ ID NO: 3998542 - RNA, 18 nt, Human herpesvirus 7
agaaacuuucuaugauuu

SEQ ID NO: 3998543 - RNA, 17 nt, Human herpesvirus 7
agaaaguccaaagugau

SEQ ID NO: 3998544 - RNA, 20 nt, Human herpesvirus 7
agaaauggaaaccuggagaa

SEQ ID NO: 3998545 - RNA, 15 nt, Human herpesvirus 7
agaaauguuacuuaa

SEQ ID NO: 3998546 - RNA, 13 nt, Human herpesvirus 7
agaacaaguagaa

SEQ ID NO: 3998547 - RNA, 17 nt, Human herpesvirus 7
agaacuuuuguaggaaa

SEQ ID NO: 3998548 - RNA, 16 nt, Human herpesvirus 7
agaaguuuagagacug

SEQ ID NO: 3998549 - RNA, 15 nt, Human herpesvirus 7
agaauacacauuuag

SEQ ID NO: 3998550 - RNA, 17 nt, Human herpesvirus 7
agaaucacauuuuugcu

SEQ ID NO: 3998551 - RNA, 23 nt, Human herpesvirus 7
agaauggcgguuguacuguaauu

SEQ ID NO: 3998552 - RNA, 21 nt, Human herpesvirus 7
agaauguucgcaaauguacaa

SEQ ID NO: 3998553 - RNA, 16 nt, Human herpesvirus 7
agacaccccaaaauca

SEQ ID NO: 3998554 - RNA, 15 nt, Human herpesvirus 7
agacggaacuucuuu

SEQ ID NO: 3998555 - RNA, 22 nt, Human herpesvirus 7
agacuacauaaagguaaaaauu

SEQ ID NO: 3998556 - RNA, 14 nt, Human herpesvirus 7
agagaacuagaaca

SEQ ID NO: 3998557 - RNA, 17 nt, Human herpesvirus 7
agagaauauguuaucau

SEQ ID NO: 3998558 - RNA, 15 nt, Human herpesvirus 7
agagaauuuagauua

SEQ ID NO: 3998559 - RNA, 18 nt, Human herpesvirus 7
agagaucauaauuacauu

SEQ ID NO: 3998560 - RNA, 15 nt, Human herpesvirus 7
agagaugaucuuacu

SEQ ID NO: 3998561 - RNA, 14 nt, Human herpesvirus 7
agagauuaagguga

SEQ ID NO: 3998562 - RNA, 15 nt, Human herpesvirus 7
agagcuuuugcaaag

SEQ ID NO: 3998563 - RNA, 20 nt, Human herpesvirus 7
agaggacuugaaaaauuuuu

SEQ ID NO: 3998564 - RNA, 15 nt, Human herpesvirus 7
agaguauuuaagaac

SEQ ID NO: 3998565 - RNA, 23 nt, Human herpesvirus 7
agagucugugugugcaguguuuu

SEQ ID NO: 3998566 - RNA, 14 nt, Human herpesvirus 7
agauauuauuaaaa

SEQ ID NO: 3998567 - RNA, 17 nt, Human herpesvirus 7
agauauucuaacaaaua

SEQ ID NO: 3998568 - RNA, 14 nt, Human herpesvirus 7
agauauuuugacaa

SEQ ID NO: 3998569 - RNA, 15 nt, Human herpesvirus 7
agaucuugacucaga

SEQ ID NO: 3998570 - RNA, 17 nt, Human herpesvirus 7
agaucuugacucagauu

SEQ ID NO: 3998571 - RNA, 20 nt, Human herpesvirus 7
agaugacauuuuuaccucca

SEQ ID NO: 3998572 - RNA, 17 nt, Human herpesvirus 7
agaugucuaaaaguaca

SEQ ID NO: 3998573 - RNA, 18 nt, Human herpesvirus 7
agauuaccugcauacuuu

SEQ ID NO: 3998574 - RNA, 13 nt, Human herpesvirus 7
agauucuccagaa

SEQ ID NO: 3998575 - RNA, 13 nt, Human herpesvirus 7
agauucuuaauuu

SEQ ID NO: 3998576 - RNA, 19 nt, Human herpesvirus 7
agauucuuaauuuguucaa

SEQ ID NO: 3998577 - RNA, 21 nt, Human herpesvirus 7
agauugaucacuuugcaucaa

SEQ ID NO: 3998578 - RNA, 12 nt, Human herpesvirus 7
agauuucagaau

SEQ ID NO: 3998579 - RNA, 19 nt, Human herpesvirus 7
agauuuuuugaaaaagauu

SEQ ID NO: 3998580 - RNA, 12 nt, Human herpesvirus 7
agcaaaauaugc

SEQ ID NO: 3998581 - RNA, 18 nt, Human herpesvirus 7
agcaacagagaacaccau

SEQ ID NO: 3998582 - RNA, 13 nt, Human herpesvirus 7
agcaauugauuca

SEQ ID NO: 3998583 - RNA, 15 nt, Human herpesvirus 7
agcaccgaaaauggu

SEQ ID NO: 3998584 - RNA, 19 nt, Human herpesvirus 7
agcaucccuauugcaucaa

SEQ ID NO: 3998585 - RNA, 23 nt, Human herpesvirus 7
agcauuugguaaaaaaaauggag

SEQ ID NO: 3998586 - RNA, 18 nt, Human herpesvirus 7
agccacgaugacuuccaa

SEQ ID NO: 3998587 - RNA, 15 nt, Human herpesvirus 7
agccagguauucaaa

SEQ ID NO: 3998588 - RNA, 14 nt, Human herpesvirus 7
agccauaaaaugua

SEQ ID NO: 3998589 - RNA, 16 nt, Human herpesvirus 7
agccauaaaugcuuaa

SEQ ID NO: 3998590 - RNA, 22 nt, Human herpesvirus 7
agccucuaagagcuuuugcaaa

SEQ ID NO: 3998591 - RNA, 22 nt, Human herpesvirus 7
agcgugucaaaaaaaaaacaau

SEQ ID NO: 3998592 - RNA, 13 nt, Human herpesvirus 7
agcuagaaauuga

SEQ ID NO: 3998593 - RNA, 15 nt, Human herpesvirus 7
agcuauguuuaaaug

SEQ ID NO: 3998594 - RNA, 21 nt, Human herpesvirus 7
agcuauuuuuaauaaaaugau

SEQ ID NO: 3998595 - RNA, 15 nt, Human herpesvirus 7
agcuucaaaaauguu

SEQ ID NO: 3998596 - RNA, 17 nt, Human herpesvirus 7
agcuucaaaaauguuua

SEQ ID NO: 3998597 - RNA, 22 nt, Human herpesvirus 7
agcuucuaaaugugcuaaauaa

SEQ ID NO: 3998598 - RNA, 16 nt, Human herpesvirus 7
agcuugaugaaucaaa

SEQ ID NO: 3998599 - RNA, 15 nt, Human herpesvirus 7
agcuugguuuuacaa

SEQ ID NO: 3998600 - RNA, 16 nt, Human herpesvirus 7
agcuuguuaaagaaaa

SEQ ID NO: 3998601 - RNA, 15 nt, Human herpesvirus 7
agcuuucuuuaccga

SEQ ID NO: 3998602 - RNA, 16 nt, Human herpesvirus 7
aggaaauugcuuucua

SEQ ID NO: 3998603 - RNA, 17 nt, Human herpesvirus 7
aggaauucugacuccuu

SEQ ID NO: 3998604 - RNA, 22 nt, Human herpesvirus 7
aggaauugcugucuauuucaau

SEQ ID NO: 3998605 - RNA, 16 nt, Human herpesvirus 7
aggaucuccuggaaag

SEQ ID NO: 3998606 - RNA, 16 nt, Human herpesvirus 7
aggauucggaaguaaa

SEQ ID NO: 3998607 - RNA, 12 nt, Human herpesvirus 7
aggcagaaaugu

SEQ ID NO: 3998608 - RNA, 14 nt, Human herpesvirus 7
aggcagaaaugucu

SEQ ID NO: 3998609 - RNA, 22 nt, Human herpesvirus 7
aggcaucgcauauagcgcuuuu

SEQ ID NO: 3998610 - RNA, 15 nt, Human herpesvirus 7
aggcggacaaauaua

SEQ ID NO: 3998611 - RNA, 23 nt, Human herpesvirus 7
agggauacaaaugcaaauuaaaa

SEQ ID NO: 3998612 - RNA, 13 nt, Human herpesvirus 7
agguacuaucuau

SEQ ID NO: 3998613 - RNA, 16 nt, Human herpesvirus 7
agguugucuguucuca

SEQ ID NO: 3998614 - RNA, 18 nt, Human herpesvirus 7
agguuuaggaaauugcuu

SEQ ID NO: 3998615 - RNA, 16 nt, Human herpesvirus 7
aguauguccaaucaaa

SEQ ID NO: 3998616 - RNA, 12 nt, Human herpesvirus 7
aguauuuaagaa

SEQ ID NO: 3998617 - RNA, 18 nt, Human herpesvirus 7
aguauuuuuuaugaagag

SEQ ID NO: 3998618 - RNA, 14 nt, Human herpesvirus 7
agucaaucugugaa

SEQ ID NO: 3998619 - RNA, 23 nt, Human herpesvirus 7
agucaaucugugaacugauguuu

SEQ ID NO: 3998620 - RNA, 16 nt, Human herpesvirus 7
aguccaauaguaaugu

SEQ ID NO: 3998621 - RNA, 23 nt, Human herpesvirus 7
agucuguagaugcaugcuaauau

SEQ ID NO: 3998622 - RNA, 12 nt, Human herpesvirus 7
agugaacauuug

SEQ ID NO: 3998623 - RNA, 23 nt, Human herpesvirus 7
aguggcuuaaguuuuuaaacuua

SEQ ID NO: 3998624 - RNA, 22 nt, Human herpesvirus 7
aguguaggcaagaaggccacgc

SEQ ID NO: 3998625 - RNA, 15 nt, Human herpesvirus 7
agugucugcccuuuu

SEQ ID NO: 3998626 - RNA, 20 nt, Human herpesvirus 7
agugucuguuguaacagauu

SEQ ID NO: 3998627 - RNA, 13 nt, Human herpesvirus 7
aguguguuaaaug

SEQ ID NO: 3998628 - RNA, 17 nt, Human herpesvirus 7
aguucuuugaaauagug

SEQ ID NO: 3998629 - RNA, 15 nt, Human herpesvirus 7
aguugaaaauguuuu

SEQ ID NO: 3998630 - RNA, 21 nt, Human herpesvirus 7
aguugagcgcauggagcacaa

SEQ ID NO: 3998631 - RNA, 15 nt, Human herpesvirus 7
aguuguacucagaga

SEQ ID NO: 3998632 - RNA, 15 nt, Human herpesvirus 7
aguuuguuucaauau

SEQ ID NO: 3998633 - RNA, 21 nt, Human herpesvirus 7
aguuuuacuuuugagcgcuga

SEQ ID NO: 3998634 - RNA, 13 nt, Human herpesvirus 7
auaaaauguacaa

SEQ ID NO: 3998635 - RNA, 22 nt, Human herpesvirus 7
auaaacuuacucuucucgaaga

SEQ ID NO: 3998636 - RNA, 18 nt, Human herpesvirus 7
auaaauacgcguggaagu

SEQ ID NO: 3998637 - RNA, 12 nt, Human herpesvirus 7
auaaauucugaa

SEQ ID NO: 3998638 - RNA, 14 nt, Human herpesvirus 7
auaaauucugaaau

SEQ ID NO: 3998639 - RNA, 13 nt, Human herpesvirus 7
auaaccaaugcug

SEQ ID NO: 3998640 - RNA, 17 nt, Human herpesvirus 7
auaagcucaaaaaguac

SEQ ID NO: 3998641 - RNA, 19 nt, Human herpesvirus 7
auaaucaaaaaauucuucu

SEQ ID NO: 3998642 - RNA, 21 nt, Human herpesvirus 7
auaaucuuaauguuucugagu

SEQ ID NO: 3998643 - RNA, 13 nt, Human herpesvirus 7
auaaugaaacugu

SEQ ID NO: 3998644 - RNA, 23 nt, Human herpesvirus 7
auaaugucauucguguuaguaga

SEQ ID NO: 3998645 - RNA, 15 nt, Human herpesvirus 7
auaauucacauuuau

SEQ ID NO: 3998646 - RNA, 17 nt, Human herpesvirus 7
auacaggccuguuucuu

SEQ ID NO: 3998647 - RNA, 20 nt, Human herpesvirus 7
auaccucuggcuucagacgu

SEQ ID NO: 3998648 - RNA, 15 nt, Human herpesvirus 7
auacguccaaaaauu

SEQ ID NO: 3998649 - RNA, 18 nt, Human herpesvirus 7
auacuaauagaaaaaugu

SEQ ID NO: 3998650 - RNA, 13 nt, Human herpesvirus 7
cauauuaacaagc

SEQ ID NO: 3998651 - RNA, 17 nt, Human herpesvirus 7
cauauuagaauugggau

SEQ ID NO: 3998652 - RNA, 22 nt, Human herpesvirus 7
caucauguuaaaaaaucaacuu

SEQ ID NO: 3998653 - RNA, 17 nt, Human herpesvirus 7
caucauucuucucggag

SEQ ID NO: 3998654 - RNA, 18 nt, Human herpesvirus 7
cauccugcuaaggcgaaa

SEQ ID NO: 3998655 - RNA, 16 nt, Human herpesvirus 7
caucgguagugucugg

SEQ ID NO: 3998656 - RNA, 20 nt, Human herpesvirus 7
caucuaauugcagacuaauu

SEQ ID NO: 3998657 - RNA, 17 nt, Human herpesvirus 7
caucuuaaaaguacaaa

SEQ ID NO: 3998658 - RNA, 22 nt, Human herpesvirus 7
caucuuaaaaguacaaauguuu

SEQ ID NO: 3998659 - RNA, 19 nt, Human herpesvirus 7
caugaacacugcuucuccc

SEQ ID NO: 3998660 - RNA, 21 nt, Human herpesvirus 7
caugaugaauauaacaaaaaa

SEQ ID NO: 3998661 - RNA, 17 nt, Human herpesvirus 7
caugcaagaaaaaaaug

SEQ ID NO: 3998662 - RNA, 14 nt, Human herpesvirus 7
cauggcuuuucaca

SEQ ID NO: 3998663 - RNA, 18 nt, Human herpesvirus 7
cauggggcauuaauucuu

SEQ ID NO: 3998664 - RNA, 13 nt, Human herpesvirus 7
cauuaauaucaau

SEQ ID NO: 3998665 - RNA, 14 nt, Human herpesvirus 7
cauuauuuguuaaa

SEQ ID NO: 3998666 - RNA, 19 nt, Human herpesvirus 7
cauuccuauuaagcagcuu

SEQ ID NO: 3998667 - RNA, 17 nt, Human herpesvirus 7
cauucuuuucaaugcaa

SEQ ID NO: 3998668 - RNA, 15 nt, Human herpesvirus 7
cauuguacaauuaca

SEQ ID NO: 3998669 - RNA, 12 nt, Human herpesvirus 7
cauuuacaaaaa

SEQ ID NO: 3998670 - RNA, 18 nt, Human herpesvirus 7
cauuuauggaaauaggcg

SEQ ID NO: 3998671 - RNA, 12 nt, Human herpesvirus 7
cauuuguugcuu

SEQ ID NO: 3998672 - RNA, 15 nt, Human herpesvirus 7
cauuuguuguggauu

SEQ ID NO: 3998673 - RNA, 16 nt, Human herpesvirus 7
cauuuuaccaaauaug

SEQ ID NO: 3998674 - RNA, 22 nt, Human herpesvirus 7
cauuuuuacucaauauaaagaa

SEQ ID NO: 3998675 - RNA, 13 nt, Human herpesvirus 7
cauuuuuucugau

SEQ ID NO: 3998676 - RNA, 18 nt, Human herpesvirus 7
ccaaaaucuauauuugau

SEQ ID NO: 3998677 - RNA, 17 nt, Human herpesvirus 7
ccaaaccggccaaugau

SEQ ID NO: 3998678 - RNA, 18 nt, Human herpesvirus 7
ccaagagccggaaagcaa

SEQ ID NO: 3998679 - RNA, 22 nt, Human herpesvirus 7
ccacagauauucuaacaaauac

SEQ ID NO: 3998680 - RNA, 13 nt, Human herpesvirus 7
ccacauuuaaaaa

SEQ ID NO: 3998681 - RNA, 15 nt, Human herpesvirus 7
ccagauuucuggcaa

SEQ ID NO: 3998682 - RNA, 20 nt, Human herpesvirus 7
ccaggaacagauucuccaga

SEQ ID NO: 3998683 - RNA, 13 nt, Human herpesvirus 7
ccauaaaugcuua

SEQ ID NO: 3998684 - RNA, 19 nt, Human herpesvirus 7
ccaugaaaaauaaauacua

SEQ ID NO: 3998685 - RNA, 12 nt, Human herpesvirus 7
cccccagaacuu

SEQ ID NO: 3998686 - RNA, 19 nt, Human herpesvirus 7
cccuggaacguccucugga

SEQ ID NO: 3998687 - RNA, 19 nt, Human herpesvirus 7
ccgcuguacaaugcugucu

SEQ ID NO: 3998688 - RNA, 15 nt, Human herpesvirus 7
ccuguacaaauuucu

SEQ ID NO: 3998689 - RNA, 13 nt, Human herpesvirus 7
ccuuguuugcugg

SEQ ID NO: 3998690 - RNA, 14 nt, Human herpesvirus 7
cgaaaagacaacaa

SEQ ID NO: 3998691 - RNA, 22 nt, Human herpesvirus 7
cgaaagccacuguugaugauuu

SEQ ID NO: 3998692 - RNA, 18 nt, Human herpesvirus 7
cgaaauaauuagaaagcu

SEQ ID NO: 3998693 - RNA, 17 nt, Human herpesvirus 7
cgaaaugaaaagucugu

SEQ ID NO: 3998694 - RNA, 22 nt, Human herpesvirus 7
cgaaucuuuauuauuuacugau

SEQ ID NO: 3998695 - RNA, 17 nt, Human herpesvirus 7
cgaauuggaaaaaaaac

SEQ ID NO: 3998696 - RNA, 23 nt, Human herpesvirus 7
cgagaauaaaucaaccaacauuc

SEQ ID NO: 3998697 - RNA, 18 nt, Human herpesvirus 7
cgauaaaagguguuuuug

SEQ ID NO: 3998698 - RNA, 20 nt, Human herpesvirus 7
cgauagcauuagagcauauu

SEQ ID NO: 3998699 - RNA, 19 nt, Human herpesvirus 7
cgauccucagaauguacac

SEQ ID NO: 3998700 - RNA, 22 nt, Human herpesvirus 7
cgaucuaaagacacuuauuuga

SEQ ID NO: 3998701 - RNA, 17 nt, Human herpesvirus 7
cgcaaggaauaugaaga

SEQ ID NO: 3998702 - RNA, 17 nt, Human herpesvirus 7
cgccuacgcagcaaugu

SEQ ID NO: 3998703 - RNA, 15 nt, Human herpesvirus 7
cgcugaaauuucaug

SEQ ID NO: 3998704 - RNA, 21 nt, Human herpesvirus 7
cggaauggacaaaaauaaagu

SEQ ID NO: 3998705 - RNA, 13 nt, Human herpesvirus 7
cggauaagaacaa

SEQ ID NO: 3998706 - RNA, 23 nt, Human herpesvirus 7
cggauagcggucaucucacuuca

SEQ ID NO: 3998707 - RNA, 13 nt, Human herpesvirus 7
cgggacagauuua

SEQ ID NO: 3998708 - RNA, 15 nt, Human herpesvirus 7
cgggguauguauggc

SEQ ID NO: 3998709 - RNA, 18 nt, Human herpesvirus 7
cgguaacaugucuucaac

SEQ ID NO: 3998710 - RNA, 17 nt, Human herpesvirus 7
cgucuuuugauuuugcc

SEQ ID NO: 3998711 - RNA, 15 nt, Human herpesvirus 7
cguuuauaaacucua

SEQ ID NO: 3998712 - RNA, 21 nt, Human herpesvirus 7
cguuuuaaggaauacaaacug

SEQ ID NO: 3998713 - RNA, 16 nt, Human herpesvirus 7
cuaaaauugacagcac

SEQ ID NO: 3998714 - RNA, 22 nt, Human herpesvirus 7
cuaaagugaacaugacuucaga

SEQ ID NO: 3998715 - RNA, 13 nt, Human herpesvirus 7
cuaaaguggagac

SEQ ID NO: 3998716 - RNA, 17 nt, Human herpesvirus 7
cuaaaugugcuaaauaa

SEQ ID NO: 3998717 - RNA, 14 nt, Human herpesvirus 7
cuaaccaucugcug

SEQ ID NO: 3998718 - RNA, 17 nt, Human herpesvirus 7
cuaagagcuuuugcaaa

SEQ ID NO: 3998719 - RNA, 16 nt, Human herpesvirus 7
cuaagguuugaagagu

SEQ ID NO: 3998720 - RNA, 22 nt, Human herpesvirus 7
cuacguguuuauacaaauuuua

SEQ ID NO: 3998721 - RNA, 14 nt, Human herpesvirus 7
cuagaaaauaguug

SEQ ID NO: 3998722 - RNA, 15 nt, Human herpesvirus 7
cuagaaaauaguugu

SEQ ID NO: 3998723 - RNA, 18 nt, Human herpesvirus 7
cuagaacuguuaaaaucu

SEQ ID NO: 3998724 - RNA, 23 nt, Human herpesvirus 7
cuagacauuuguuuuggauauaa

SEQ ID NO: 3998725 - RNA, 18 nt, Human herpesvirus 7
cuagaguaucuuuucaaa

SEQ ID NO: 3998726 - RNA, 19 nt, Human herpesvirus 7
cuagauugacuaugaauuu

SEQ ID NO: 3998727 - RNA, 23 nt, Human herpesvirus 7
cuagccuauaauucucacagcuu

SEQ ID NO: 3998728 - RNA, 18 nt, Human herpesvirus 7
cuauaaauggaauuuaac

SEQ ID NO: 3998729 - RNA, 22 nt, Human herpesvirus 7
cuaucaaauuuaucucauagcu

SEQ ID NO: 3998730 - RNA, 22 nt, Human herpesvirus 7
cuauccacucuccugaaauaaa

SEQ ID NO: 3998731 - RNA, 20 nt, Human herpesvirus 7
cuauuagauaaugacaaaca

SEQ ID NO: 3998732 - RNA, 18 nt, Human herpesvirus 7
cuauucucauagauuuca

SEQ ID NO: 3998733 - RNA, 14 nt, Human herpesvirus 7
cuauuguucuuuca

SEQ ID NO: 3998734 - RNA, 15 nt, Human herpesvirus 7
cucaaaucaaaguuu

SEQ ID NO: 3998735 - RNA, 14 nt, Human herpesvirus 7
cucguguggccuuc

SEQ ID NO: 3998736 - RNA, 13 nt, Human herpesvirus 7
cucuagaaaaucu

SEQ ID NO: 3998737 - RNA, 16 nt, Human herpesvirus 7
cucuagaacaaacugu

SEQ ID NO: 3998738 - RNA, 21 nt, Human herpesvirus 7
cucuuuuuuuuuauugccuug

SEQ ID NO: 3998739 - RNA, 15 nt, Human herpesvirus 7
cugaaaauaaaagag

SEQ ID NO: 3998740 - RNA, 14 nt, Human herpesvirus 7
cugaaaauugcgua

SEQ ID NO: 3998741 - RNA, 15 nt, Human herpesvirus 7
cugaaauaaacauuu

SEQ ID NO: 3998742 - RNA, 15 nt, Human herpesvirus 7
cugaagcauggauuu

SEQ ID NO: 3998743 - RNA, 20 nt, Human herpesvirus 7
cugaauaauaugcuuucacu

SEQ ID NO: 3998744 - RNA, 19 nt, Human herpesvirus 7
cugaaucaaaauccuggau

SEQ ID NO: 3998745 - RNA, 21 nt, Human herpesvirus 7
cugaaucaaaauccuggauuu

SEQ ID NO: 3998746 - RNA, 21 nt, Human herpesvirus 7
cugacauacgaaucaguucaa

SEQ ID NO: 3998747 - RNA, 17 nt, Human herpesvirus 7
cugacgaaaacugcaac

SEQ ID NO: 3998748 - RNA, 17 nt, Human herpesvirus 7
cugacuucaauuuugaa

SEQ ID NO: 3998749 - RNA, 23 nt, Human herpesvirus 7
cugagaagugggauuaaaaaucu

SEQ ID NO: 3998750 - RNA, 15 nt, Human herpesvirus 7
cugauacgcuuucug

SEQ ID NO: 3998751 - RNA, 12 nt, Human herpesvirus 7
cugcaaagaaaa

SEQ ID NO: 3998752 - RNA, 20 nt, Human herpesvirus 7
cugcaacaaauuaaauacuu

SEQ ID NO: 3998753 - RNA, 21 nt, Human herpesvirus 7
cugcaauaugcauguguaaag

SEQ ID NO: 3998754 - RNA, 23 nt, Human herpesvirus 7
cugcagaaauuuuuaaagagaaa

SEQ ID NO: 3998755 - RNA, 22 nt, Human herpesvirus 7
cugcauuccacuaaaagagaac

SEQ ID NO: 3998756 - RNA, 17 nt, Human herpesvirus 7
cugccucugccucuugg

SEQ ID NO: 3998757 - RNA, 21 nt, Human herpesvirus 7
cugcuggaaagcuugugaaga

SEQ ID NO: 3998758 - RNA, 14 nt, Human herpesvirus 7
cugcuugucucugu

SEQ ID NO: 3998759 - RNA, 13 nt, Human herpesvirus 7
cuggaaagcucau

SEQ ID NO: 3998760 - RNA, 20 nt, Human herpesvirus 7
cuggacacaaucagcauuua

SEQ ID NO: 3998761 - RNA, 17 nt, Human herpesvirus 7
cuggacauuucaagaag

SEQ ID NO: 3998762 - RNA, 23 nt, Human herpesvirus 7
cuggaugaaaacugaauugguaa

SEQ ID NO: 3998763 - RNA, 19 nt, Human herpesvirus 7
cuguugauaaauuuaaaga

SEQ ID NO: 3998764 - RNA, 13 nt, Human herpesvirus 7
auuucuuugcgcu

SEQ ID NO: 3998765 - RNA, 22 nt, Human herpesvirus 7
auuugcagccagaacucaauuu

SEQ ID NO: 3998766 - RNA, 20 nt, Human herpesvirus 7
auuugguauacacuauuuua

SEQ ID NO: 3998767 - RNA, 19 nt, Human herpesvirus 7
auuugguguacuacauauu

SEQ ID NO: 3998768 - RNA, 24 nt, Human herpesvirus 7
auuuguacuucaaaguagccuuca

SEQ ID NO: 3998769 - RNA, 19 nt, Human herpesvirus 7
auuuuaaaagguugacauc

SEQ ID NO: 3998770 - RNA, 13 nt, Human herpesvirus 7
auuuuacaaaaag

SEQ ID NO: 3998771 - RNA, 19 nt, Human herpesvirus 7
auuuuauugcgaaaaugau

SEQ ID NO: 3998772 - RNA, 13 nt, Human herpesvirus 7
auuuuauuuuccc

SEQ ID NO: 3998773 - RNA, 16 nt, Human herpesvirus 7
auuuucuuacacuaug

SEQ ID NO: 3998774 - RNA, 19 nt, Human herpesvirus 7
auuuugugacccugucaca

SEQ ID NO: 3998775 - RNA, 21 nt, Human herpesvirus 7
auuuuucauuuuuuucuuaua

SEQ ID NO: 3998776 - RNA, 14 nt, Human herpesvirus 7
auuuuuuaaagaaa

SEQ ID NO: 3998777 - RNA, 23 nt, Human herpesvirus 7
caaaaaagauuccugaugauaau

SEQ ID NO: 3998778 - RNA, 19 nt, Human herpesvirus 7
caaaaaagguguugauaga

SEQ ID NO: 3998779 - RNA, 23 nt, Human herpesvirus 7
caaaaacguuaccguuuaaugaa

SEQ ID NO: 3998780 - RNA, 12 nt, Human herpesvirus 7
caaaacauuuca

SEQ ID NO: 3998781 - RNA, 19 nt, Human herpesvirus 7
caaaaccguuggaugcacu

SEQ ID NO: 3998782 - RNA, 15 nt, Human herpesvirus 7
caaaagcugcagcug

SEQ ID NO: 3998783 - RNA, 16 nt, Human herpesvirus 7
caaaaucagaaauguu

SEQ ID NO: 3998784 - RNA, 20 nt, Human herpesvirus 7
caaaaucuguagaaaauguu

SEQ ID NO: 3998785 - RNA, 19 nt, Human herpesvirus 7
caaacaaugagcaauucau

SEQ ID NO: 3998786 - RNA, 14 nt, Human herpesvirus 7
caaagaaaaaacua

SEQ ID NO: 3998787 - RNA, 20 nt, Human herpesvirus 7
caaagcuucuacaaacaauu

SEQ ID NO: 3998788 - RNA, 16 nt, Human herpesvirus 7
caaaggaaaaaugcug

SEQ ID NO: 3998789 - RNA, 21 nt, Human herpesvirus 7
caaaggaaaaaugcugcucag

SEQ ID NO: 3998790 - RNA, 21 nt, Human herpesvirus 7
caaauaaacguccauugauua

SEQ ID NO: 3998791 - RNA, 23 nt, Human herpesvirus 7
caaaugugguaaauuugcuugcu

SEQ ID NO: 3998792 - RNA, 17 nt, Human herpesvirus 7
caaauucaaccacagac

SEQ ID NO: 3998793 - RNA, 22 nt, Human herpesvirus 7
caacaacuaaaacuacauuuaa

SEQ ID NO: 3998794 - RNA, 16 nt, Human herpesvirus 7
caacuugaaugagcug

SEQ ID NO: 3998795 - RNA, 18 nt, Human herpesvirus 7
caacuuugugccugaaau

SEQ ID NO: 3998796 - RNA, 15 nt, Human herpesvirus 7
caagaagaugacauu

SEQ ID NO: 3998797 - RNA, 16 nt, Human herpesvirus 7
caagauagcagaauau

SEQ ID NO: 3998798 - RNA, 20 nt, Human herpesvirus 7
caaggaaaaucguguuaagu

SEQ ID NO: 3998799 - RNA, 19 nt, Human herpesvirus 7
caaggggucgcauauugca

SEQ ID NO: 3998800 - RNA, 16 nt, Human herpesvirus 7
caaguagaaaaugcug

SEQ ID NO: 3998801 - RNA, 14 nt, Human herpesvirus 7
caauagaaaacaaa

SEQ ID NO: 3998802 - RNA, 21 nt, Human herpesvirus 7
caauauuuaaaguagcugaau

SEQ ID NO: 3998803 - RNA, 13 nt, Human herpesvirus 7
caaucaaaaacug

SEQ ID NO: 3998804 - RNA, 13 nt, Human herpesvirus 7
caauguaaacgaa

SEQ ID NO: 3998805 - RNA, 17 nt, Human herpesvirus 7
caauguuagaaacaucu

SEQ ID NO: 3998806 - RNA, 20 nt, Human herpesvirus 7
caauuaauucaguuuacugu

SEQ ID NO: 3998807 - RNA, 18 nt, Human herpesvirus 7
caauuuuuaacauuacgu

SEQ ID NO: 3998808 - RNA, 20 nt, Human herpesvirus 7
cacaggauuugggaaaauau

SEQ ID NO: 3998809 - RNA, 19 nt, Human herpesvirus 7
cacagggacguuucuagca

SEQ ID NO: 3998810 - RNA, 15 nt, Human herpesvirus 7
cacaucuucaauguu

SEQ ID NO: 3998811 - RNA, 22 nt, Human herpesvirus 7
cucuugcacaggauuugggaaa

SEQ ID NO: 3998812 - RNA, 18 nt, Human herpesvirus 7
cugaaaacauugcuguuc

SEQ ID NO: 3998813 - RNA, 22 nt, Human herpesvirus 7
cugaaagcgcaaaggaaaaaug

SEQ ID NO: 3998814 - RNA, 16 nt, Human herpesvirus 7
cugaauaauaugcuuu

SEQ ID NO: 3998815 - RNA, 21 nt, Human herpesvirus 7
cugagacggacuuauguccag

SEQ ID NO: 3998816 - RNA, 18 nt, Human herpesvirus 7
cugcaaagaaaaaaaugc

SEQ ID NO: 3998817 - RNA, 22 nt, Human herpesvirus 7
cugcaaagaaaaaaaugcuuag

SEQ ID NO: 3998818 - RNA, 19 nt, Human herpesvirus 7
cugcaaauccaacagaaua

SEQ ID NO: 3998819 - RNA, 20 nt, Human herpesvirus 7
cugcaaauuguaaauucucc

SEQ ID NO: 3998820 - RNA, 22 nt, Human herpesvirus 7
cugcaacuuugugccugaaaua

SEQ ID NO: 3998821 - RNA, 15 nt, Human herpesvirus 7
cugcuugucucuguc

SEQ ID NO: 3998822 - RNA, 16 nt, Human herpesvirus 7
cuggaacguccucugg

SEQ ID NO: 3998823 - RNA, 14 nt, Human herpesvirus 7
cuggaauauuugcu

SEQ ID NO: 3998824 - RNA, 17 nt, Human herpesvirus 7
cugggagcaaugcauga

SEQ ID NO: 3998825 - RNA, 14 nt, Human herpesvirus 7
cugggauagaaaug

SEQ ID NO: 3998826 - RNA, 17 nt, Human herpesvirus 7
cugggauagaaauguaa

SEQ ID NO: 3998827 - RNA, 14 nt, Human herpesvirus 7
cugguugauuugag

SEQ ID NO: 3998828 - RNA, 14 nt, Human herpesvirus 7
cuguaaaauuuaaa

SEQ ID NO: 3998829 - RNA, 21 nt, Human herpesvirus 7
cuguaaccauuuauuuacaga

SEQ ID NO: 3998830 - RNA, 21 nt, Human herpesvirus 7
cuguaaucauauaugcauuau

SEQ ID NO: 3998831 - RNA, 14 nt, Human herpesvirus 7
cuguagacauuucu

SEQ ID NO: 3998832 - RNA, 16 nt, Human herpesvirus 7
cugugaaguacauucc

SEQ ID NO: 3998833 - RNA, 17 nt, Human herpesvirus 7
cugugucaauaaacuua

SEQ ID NO: 3998834 - RNA, 17 nt, Human herpesvirus 7
cuguucccacugggaca

SEQ ID NO: 3998835 - RNA, 15 nt, Human herpesvirus 7
cuuaaaugucaauga

SEQ ID NO: 3998836 - RNA, 21 nt, Human herpesvirus 7
cuuaacuuuuggaaugauaua

SEQ ID NO: 3998837 - RNA, 20 nt, Human herpesvirus 7
cuuaaguuuuuuauacuuuu

SEQ ID NO: 3998838 - RNA, 19 nt, Human herpesvirus 7
cuuacaacuagaaaauaac

SEQ ID NO: 3998839 - RNA, 16 nt, Human herpesvirus 7
cuuacacuauucucua

SEQ ID NO: 3998840 - RNA, 19 nt, Human herpesvirus 7
cuuacagugcucuuugucu

SEQ ID NO: 3998841 - RNA, 15 nt, Human herpesvirus 7
cuuacauuugauuuu

SEQ ID NO: 3998842 - RNA, 22 nt, Human herpesvirus 7
cuuaccgcauaaaucauguuua

SEQ ID NO: 3998843 - RNA, 21 nt, Human herpesvirus 7
cuuagaauauuuauguucaaa

SEQ ID NO: 3998844 - RNA, 18 nt, Human herpesvirus 7
cuuagaugcugaaacauc

SEQ ID NO: 3998845 - RNA, 19 nt, Human herpesvirus 7
cuuagaugcugaaacauca

SEQ ID NO: 3998846 - RNA, 18 nt, Human herpesvirus 7
cuuauaacugugaaaaca

SEQ ID NO: 3998847 - RNA, 23 nt, Human herpesvirus 7
cuucugggaacuagaaaaacacu

SEQ ID NO: 3998848 - RNA, 20 nt, Human herpesvirus 7
cuucuuugugagaaauggaa

SEQ ID NO: 3998849 - RNA, 16 nt, Human herpesvirus 7
cuugacaccaacaucu

SEQ ID NO: 3998850 - RNA, 15 nt, Human herpesvirus 7
cuugcgguagcacua

SEQ ID NO: 3998851 - RNA, 13 nt, Human herpesvirus 7
cuugcuagauucu

SEQ ID NO: 3998852 - RNA, 12 nt, Human herpesvirus 7
cuuguauauacg

SEQ ID NO: 3998853 - RNA, 21 nt, Human herpesvirus 7
cuugugaaaauaacaggaaac

SEQ ID NO: 3998854 - RNA, 14 nt, Human herpesvirus 7
cuuguguugucaua

SEQ ID NO: 3998855 - RNA, 21 nt, Human herpesvirus 7
cuuuaacuggaauuauacacu

SEQ ID NO: 3998856 - RNA, 23 nt, Human herpesvirus 7
cuuuaauggaagaacaacaacua

SEQ ID NO: 3998857 - RNA, 20 nt, Human herpesvirus 7
cuuuagagucugugugugca

SEQ ID NO: 3998858 - RNA, 19 nt, Human herpesvirus 7
cuuuagauagaaauaguug

SEQ ID NO: 3998859 - RNA, 16 nt, Human herpesvirus 7
cuuuauaagcaguuau

SEQ ID NO: 3998860 - RNA, 20 nt, Human herpesvirus 7
cuuucacuacuacaugaaug

SEQ ID NO: 3998861 - RNA, 16 nt, Human herpesvirus 7
cuuucauaacaaagug

SEQ ID NO: 3998862 - RNA, 17 nt, Human herpesvirus 7
cuuucaugcauugcauu

SEQ ID NO: 3998863 - RNA, 14 nt, Human herpesvirus 7
cuuucgcaacaauc

SEQ ID NO: 3998864 - RNA, 18 nt, Human herpesvirus 7
cuuucuauuguaugggaa

SEQ ID NO: 3998865 - RNA, 21 nt, Human herpesvirus 7
cuuucuguuuaaguauguuua

SEQ ID NO: 3998866 - RNA, 11 nt, Human herpesvirus 7
cuuucuuuacc

SEQ ID NO: 3998867 - RNA, 20 nt, Human herpesvirus 7
cuuugaaucuauuaaagaca

SEQ ID NO: 3998868 - RNA, 20 nt, Human herpesvirus 7
cuuugcuaaccacuguguca

SEQ ID NO: 3998869 - RNA, 15 nt, Human herpesvirus 7
cuuuuagaaaucuuu

SEQ ID NO: 3998870 - RNA, 23 nt, Human herpesvirus 7
cuuuucaggcuaugacuuugaau

SEQ ID NO: 3998871 - RNA, 15 nt, Human herpesvirus 7
cuuuucuuucuuaau

SEQ ID NO: 3998872 - RNA, 13 nt, Human herpesvirus 7
cuuuuucuggaau

SEQ ID NO: 3998873 - RNA, 20 nt, Human herpesvirus 7
gaaaaagcaacaaauguuua

SEQ ID NO: 3998874 - RNA, 13 nt, Human herpesvirus 7
gaaaaauuuguua

SEQ ID NO: 3998875 - RNA, 23 nt, Human herpesvirus 7
gaaaacaaaucugauaaauuaca

SEQ ID NO: 3998876 - RNA, 15 nt, Human herpesvirus 7
gaaaacaucagaccu

SEQ ID NO: 3998877 - RNA, 14 nt, Human herpesvirus 7
gaaaacuugauaaa

SEQ ID NO: 3998878 - RNA, 13 nt, Human herpesvirus 7
gaaaagaacuuaa

SEQ ID NO: 3998879 - RNA, 16 nt, Human herpesvirus 7
gaaaauaacaggaaac

SEQ ID NO: 3998880 - RNA, 15 nt, Human herpesvirus 7
gaaaauaacuuuaaa

SEQ ID NO: 3998881 - RNA, 16 nt, Human herpesvirus 7
gaaaauacuacaguua

SEQ ID NO: 3998882 - RNA, 17 nt, Human herpesvirus 7
gaaaaugcauugcuuuu

SEQ ID NO: 3998883 - RNA, 24 nt, Human herpesvirus 7
gaaaauuuauauuugcuugcugaa

SEQ ID NO: 3998884 - RNA, 18 nt, Human herpesvirus 7
gaaacgucccugugacag

SEQ ID NO: 3998885 - RNA, 15 nt, Human herpesvirus 7
gaaagaaaagaugua

SEQ ID NO: 3998886 - RNA, 19 nt, Human herpesvirus 7
gaaagcguuucacugggaa

SEQ ID NO: 3998887 - RNA, 13 nt, Human herpesvirus 7
gaaaguccaaagu

SEQ ID NO: 3998888 - RNA, 17 nt, Human herpesvirus 7
gaaaucaaaaauaccgg

SEQ ID NO: 3998889 - RNA, 21 nt, Human herpesvirus 7
gaaaucuuucaucuucugaau

SEQ ID NO: 3998890 - RNA, 18 nt, Human herpesvirus 7
gaaaugagauuucugaaa

SEQ ID NO: 3998891 - RNA, 21 nt, Human herpesvirus 7
gaaauuaaguuuuucauguau

SEQ ID NO: 3998892 - RNA, 12 nt, Human herpesvirus 7
gaaauuacagua

SEQ ID NO: 3998893 - RNA, 14 nt, Human herpesvirus 7
gaaauuguuaaaaa

SEQ ID NO: 3998894 - RNA, 16 nt, Human herpesvirus 7
gaagaaugcaagccua

SEQ ID NO: 3998895 - RNA, 19 nt, Human herpesvirus 7
gaagacauauuagauuaua

SEQ ID NO: 3998896 - RNA, 16 nt, Human herpesvirus 7
gaaguaauuuaugcuu

SEQ ID NO: 3998897 - RNA, 23 nt, Human herpesvirus 7
gaaguugaucgucuguugaaaca

SEQ ID NO: 3998898 - RNA, 21 nt, Human herpesvirus 7
gaauaucuguggcuuuugcuu

SEQ ID NO: 3998899 - RNA, 21 nt, Human herpesvirus 7
gaauauggaacguuugaaucu

SEQ ID NO: 3998900 - RNA, 16 nt, Human herpesvirus 7
gaaucauuuauuugau

SEQ ID NO: 3998901 - RNA, 16 nt, Human herpesvirus 7
gaaugcucuuuugaaa

SEQ ID NO: 3998902 - RNA, 18 nt, Human herpesvirus 7
gaauuaagguggaaaucu

SEQ ID NO: 3998903 - RNA, 14 nt, Human herpesvirus 7
gaauuaauaaaaca

SEQ ID NO: 3998904 - RNA, 17 nt, Human herpesvirus 7
gaauuaauaaaaguauc

SEQ ID NO: 3998905 - RNA, 15 nt, Human herpesvirus 7
gaauucauuugugaa

SEQ ID NO: 3998906 - RNA, 17 nt, Human herpesvirus 7
gaauuccagauuuucug

SEQ ID NO: 3998907 - RNA, 14 nt, Human herpesvirus 7
gaauuccaggguaa

SEQ ID NO: 3998908 - RNA, 18 nt, Human herpesvirus 7
gacaacaaagcaugaaaa

SEQ ID NO: 3998909 - RNA, 19 nt, Human herpesvirus 7
gacaaggaaccguuugcag

SEQ ID NO: 3998910 - RNA, 20 nt, Human herpesvirus 7
gacaaucuauauaaaauauc

SEQ ID NO: 3998911 - RNA, 18 nt, Human herpesvirus 7
gacacaugcuuacagauc

SEQ ID NO: 3998912 - RNA, 16 nt, Human herpesvirus 7
gacaccaguaugaaau

SEQ ID NO: 3998913 - RNA, 19 nt, Human herpesvirus 7
gacaugcccuuucucguga

SEQ ID NO: 3998914 - RNA, 18 nt, Human herpesvirus 7
gacauuauuagacagaua

SEQ ID NO: 3998915 - RNA, 18 nt, Human herpesvirus 7
gacauuugaaauggguuu

SEQ ID NO: 3998916 - RNA, 20 nt, Human herpesvirus 7
gaccucgacauucuccagug

SEQ ID NO: 3998917 - RNA, 22 nt, Human herpesvirus 7
gacucuuuuuuuuuauugccuu

SEQ ID NO: 3998918 - RNA, 21 nt, Human herpesvirus 7
gacuuaucaaucuauuucuau

SEQ ID NO: 3998919 - RNA, 23 nt, Human herpesvirus 7
gagaauguugagcuaucugauuu

SEQ ID NO: 3998920 - RNA, 17 nt, Human herpesvirus 7
gagauauuauuaaaaaa

SEQ ID NO: 3998921 - RNA, 18 nt, Human herpesvirus 7
gagauuucugaaaaucuc

SEQ ID NO: 3998922 - RNA, 18 nt, Human herpesvirus 7
gaggaaaaccgcacauac

SEQ ID NO: 3998923 - RNA, 12 nt, Human herpesvirus 7
gaggacuugaaa

SEQ ID NO: 3998924 - RNA, 17 nt, Human herpesvirus 7
gagguccaauagaaaac

SEQ ID NO: 3998925 - RNA, 15 nt, Human herpesvirus 7
gaguacaugugucgu

SEQ ID NO: 3998926 - RNA, 14 nt, Human herpesvirus 7
gaguauuuaagaac

SEQ ID NO: 3998927 - RNA, 20 nt, Human herpesvirus 7
guagaauguguuucagcuuu

SEQ ID NO: 3998928 - RNA, 11 nt, Human herpesvirus 7
guagugucugc

SEQ ID NO: 3998929 - RNA, 18 nt, Human herpesvirus 7
guaugguuucauuuggaa

SEQ ID NO: 3998930 - RNA, 23 nt, Human herpesvirus 7
guauuuauuuuuuccaugucaca

SEQ ID NO: 3998931 - RNA, 17 nt, Human herpesvirus 7
gucaaauuuauauuuua

SEQ ID NO: 3998932 - RNA, 17 nt, Human herpesvirus 7
guccaaagugaugaaag

SEQ ID NO: 3998933 - RNA, 23 nt, Human herpesvirus 7
gucggcacacguacaauauuaaa

SEQ ID NO: 3998934 - RNA, 20 nt, Human herpesvirus 7
gucuauuucaauuaaugcau

SEQ ID NO: 3998935 - RNA, 19 nt, Human herpesvirus 7
gucugaaggcugcuuuuuc

SEQ ID NO: 3998936 - RNA, 20 nt, Human herpesvirus 7
gucugauucuuauucuacac

SEQ ID NO: 3998937 - RNA, 17 nt, Human herpesvirus 7
gugaaaacaguguugag

SEQ ID NO: 3998938 - RNA, 14 nt, Human herpesvirus 7
gugaaaauaacagg

SEQ ID NO: 3998939 - RNA, 14 nt, Human herpesvirus 7
gugacuuagaaaaa

SEQ ID NO: 3998940 - RNA, 14 nt, Human herpesvirus 7
gugauugguagaaa

SEQ ID NO: 3998941 - RNA, 14 nt, Human herpesvirus 7
gugauuuuaaauaa

SEQ ID NO: 3998942 - RNA, 23 nt, Human herpesvirus 7
gugcaauuaaaauguacauaacu

SEQ ID NO: 3998943 - RNA, 19 nt, Human herpesvirus 7
gugcagagaugaaggaagc

SEQ ID NO: 3998944 - RNA, 13 nt, Human herpesvirus 7
gugcaucacgaaa

SEQ ID NO: 3998945 - RNA, 19 nt, Human herpesvirus 7
gugccccaaacuguauuug

SEQ ID NO: 3998946 - RNA, 15 nt, Human herpesvirus 7
guggaaauuaaucaa

SEQ ID NO: 3998947 - RNA, 23 nt, Human herpesvirus 7
guuaacaaucuuacaaaaaguag

SEQ ID NO: 3998948 - RNA, 22 nt, Human herpesvirus 7
guuaacccagaagaaacuugaa

SEQ ID NO: 3998949 - RNA, 13 nt, Human herpesvirus 7
guuacauuauuau

SEQ ID NO: 3998950 - RNA, 16 nt, Human herpesvirus 7
guuacccaaaauguaa

SEQ ID NO: 3998951 - RNA, 19 nt, Human herpesvirus 7
guuacccaaaauguaaaau

SEQ ID NO: 3998952 - RNA, 20 nt, Human herpesvirus 7
guucaaccuuuuucugaaaa

SEQ ID NO: 3998953 - RNA, 13 nt, Human herpesvirus 7
guucauaaaccug

SEQ ID NO: 3998954 - RNA, 21 nt, Human herpesvirus 7
guucuaaaaaacaaaaaagug

SEQ ID NO: 3998955 - RNA, 15 nt, Human herpesvirus 7
guugcagcugugaua

SEQ ID NO: 3998956 - RNA, 18 nt, Human herpesvirus 7
guugggaugacaacggua

SEQ ID NO: 3998957 - RNA, 12 nt, Human herpesvirus 7
guuguuaagaau

SEQ ID NO: 3998958 - RNA, 22 nt, Human herpesvirus 7
guuuauuugaacggaauaaaca

SEQ ID NO: 3998959 - RNA, 12 nt, Human herpesvirus 7
guuuccauugcu

SEQ ID NO: 3998960 - RNA, 22 nt, Human herpesvirus 7
guuucuagcaaaauaugcaaaa

SEQ ID NO: 3998961 - RNA, 13 nt, Human herpesvirus 7
guuuuaaaguaug

SEQ ID NO: 3998962 - RNA, 12 nt, Human herpesvirus 7
guuuuauuccca

SEQ ID NO: 3998963 - RNA, 12 nt, Human herpesvirus 7
guuuuucaaaaa

SEQ ID NO: 3998964 - RNA, 13 nt, Human herpesvirus 7
uaaaaaaaaguug

SEQ ID NO: 3998965 - RNA, 11 nt, Human herpesvirus 7
uaaaaacagua

SEQ ID NO: 3998966 - RNA, 19 nt, Human herpesvirus 7
uaaaaacuuuucuuucuua

SEQ ID NO: 3998967 - RNA, 22 nt, Human herpesvirus 7
uaaaaaucucagcucuguaaua

SEQ ID NO: 3998968 - RNA, 14 nt, Human herpesvirus 7
uaaaagcauaugug

SEQ ID NO: 3998969 - RNA, 14 nt, Human herpesvirus 7
uaaaaucaaaugua

SEQ ID NO: 3998970 - RNA, 20 nt, Human herpesvirus 7
uaaaauguacaauuccugaa

SEQ ID NO: 3998971 - RNA, 17 nt, Human herpesvirus 7
uaaaauuaauguaauuu

SEQ ID NO: 3998972 - RNA, 19 nt, Human herpesvirus 7
uaaaauuuauauuaaauga

SEQ ID NO: 3998973 - RNA, 14 nt, Human herpesvirus 7
uaaagaacaucuug

SEQ ID NO: 3998974 - RNA, 17 nt, Human herpesvirus 7
uaaauaccaaaaaccug

SEQ ID NO: 3998975 - RNA, 14 nt, Human herpesvirus 7
uaaaugcuuaaauu

SEQ ID NO: 3998976 - RNA, 16 nt, Human herpesvirus 7
uaaauggcaaauccua

SEQ ID NO: 3998977 - RNA, 17 nt, Human herpesvirus 7
uaaauuaaaaagaaugc

SEQ ID NO: 3998978 - RNA, 14 nt, Human herpesvirus 7
uaaauucugaaaua

SEQ ID NO: 3998979 - RNA, 23 nt, Human herpesvirus 7
uaaauuuugaauguuuacaugua

SEQ ID NO: 3998980 - RNA, 15 nt, Human herpesvirus 7
uaacaagcacacuaa

SEQ ID NO: 3998981 - RNA, 16 nt, Human herpesvirus 7
gaaauaaaagcuuucu

SEQ ID NO: 3998982 - RNA, 17 nt, Human herpesvirus 7
gaaauauaugaauaucu

SEQ ID NO: 3998983 - RNA, 15 nt, Human herpesvirus 7
gaaauggcucuaguu

SEQ ID NO: 3998984 - RNA, 17 nt, Human herpesvirus 7
gaaauucgcaaaauuuc

SEQ ID NO: 3998985 - RNA, 16 nt, Human herpesvirus 7
gaaauuucaaaaauuc

SEQ ID NO: 3998986 - RNA, 14 nt, Human herpesvirus 7
aacaaacauuccaa

SEQ ID NO: 3998987 - RNA, 13 nt, Human herpesvirus 7
aacaaauugugga

SEQ ID NO: 3998988 - RNA, 19 nt, Human herpesvirus 7
aacaaguagaaaaugcugu

SEQ ID NO: 3998989 - RNA, 16 nt, Human herpesvirus 7
aacacucaaaacagaa

SEQ ID NO: 3998990 - RNA, 18 nt, Human herpesvirus 7
aacacuguuuucaguuau

SEQ ID NO: 3998991 - RNA, 16 nt, Human herpesvirus 7
aacagccaaauguggu

SEQ ID NO: 3998992 - RNA, 13 nt, Human herpesvirus 7
aacagcgugucaa

SEQ ID NO: 3998993 - RNA, 21 nt, Human herpesvirus 7
aacagcucuaucgucaucauc

SEQ ID NO: 3998994 - RNA, 14 nt, Human herpesvirus 7
aacaguuaaugugu

SEQ ID NO: 3998995 - RNA, 19 nt, Human herpesvirus 7
aacaucgagauuccaaaga

SEQ ID NO: 3998996 - RNA, 19 nt, Human herpesvirus 7
aacauuaauaucaauuuga

SEQ ID NO: 3998997 - RNA, 17 nt, Human herpesvirus 7
aacauugcuucagaaau

SEQ ID NO: 3998998 - RNA, 15 nt, Human herpesvirus 7
aaccauuuauuuaca

SEQ ID NO: 3998999 - RNA, 12 nt, Human herpesvirus 7
aacuaaguugaa

SEQ ID NO: 3999000 - RNA, 15 nt, Human herpesvirus 7
aacuagaaaauaacu

SEQ ID NO: 3999001 - RNA, 14 nt, Human herpesvirus 7
aacuaggaaacaca

SEQ ID NO: 3999002 - RNA, 16 nt, Human herpesvirus 7
aacucaauaaaaaugu

SEQ ID NO: 3999003 - RNA, 17 nt, Human herpesvirus 7
aacucugucaucaaaau

SEQ ID NO: 3999004 - RNA, 19 nt, Human herpesvirus 7
aacuguacccaaaaauaag

SEQ ID NO: 3999005 - RNA, 16 nt, Human herpesvirus 7
aacugugcaugaaauc

SEQ ID NO: 3999006 - RNA, 14 nt, Human herpesvirus 7
aacuugugaaaaua

SEQ ID NO: 3999007 - RNA, 11 nt, Human herpesvirus 7
aacuuugcuau

SEQ ID NO: 3999008 - RNA, 14 nt, Human herpesvirus 7
aagaauuuggauuu

SEQ ID NO: 3999009 - RNA, 17 nt, Human herpesvirus 7
aagaauuuucugcuuua

SEQ ID NO: 3999010 - RNA, 15 nt, Human herpesvirus 7
aagacacuuauuuga

SEQ ID NO: 3999011 - RNA, 22 nt, Human herpesvirus 7
aagacauaacaaaaaagguguu

SEQ ID NO: 3999012 - RNA, 16 nt, Human herpesvirus 7
aagagcucgauuuacu

SEQ ID NO: 3999013 - RNA, 18 nt, Human herpesvirus 7
aagagucuauugacauaa

SEQ ID NO: 3999014 - RNA, 15 nt, Human herpesvirus 7
aagauuuaacaugug

SEQ ID NO: 3999015 - RNA, 16 nt, Human herpesvirus 7
aagcaauguaugucaa

SEQ ID NO: 3999016 - RNA, 13 nt, Human herpesvirus 7
aagcacauguaca

SEQ ID NO: 3999017 - RNA, 15 nt, Human herpesvirus 7
aagcauaugugagaa

SEQ ID NO: 3999018 - RNA, 14 nt, Human herpesvirus 7
aagcugcagcugaa

SEQ ID NO: 3999019 - RNA, 12 nt, Human herpesvirus 7
aagcuuaaauaa

SEQ ID NO: 3999020 - RNA, 13 nt, Human herpesvirus 7
aagcuugaaaacu

SEQ ID NO: 3999021 - RNA, 19 nt, Human herpesvirus 7
aaggaucauaguaaacacg

SEQ ID NO: 3999022 - RNA, 18 nt, Human herpesvirus 7
aagggaucuuuuuucagu

SEQ ID NO: 3999023 - RNA, 22 nt, Human herpesvirus 7
aaguaaaagagaaaaaauagug

SEQ ID NO: 3999024 - RNA, 18 nt, Human herpesvirus 7
aaguauggaaaaauguua

SEQ ID NO: 3999025 - RNA, 23 nt, Human herpesvirus 7
aagucacaauuacacaaauugau

SEQ ID NO: 3999026 - RNA, 22 nt, Human herpesvirus 7
aagucugugacagauuuaagug

SEQ ID NO: 3999027 - RNA, 22 nt, Human herpesvirus 7
aaguuuuguaacuauaaaugga

SEQ ID NO: 3999028 - RNA, 11 nt, Human herpesvirus 7
aauaaauacua

SEQ ID NO: 3999029 - RNA, 14 nt, Human herpesvirus 7
aauaaauguucuuc

SEQ ID NO: 3999030 - RNA, 13 nt, Human herpesvirus 7
aauaauauaaaag

SEQ ID NO: 3999031 - RNA, 22 nt, Human herpesvirus 7
aauaauuuuuuuuugagugugc

SEQ ID NO: 3999032 - RNA, 23 nt, Human herpesvirus 7
aauagaugucugcauagacagua

SEQ ID NO: 3999033 - RNA, 17 nt, Human herpesvirus 7
aauagcagagaauaugu

SEQ ID NO: 3999034 - RNA, 22 nt, Human herpesvirus 7
aauaguuguguuuuaaaagcua

SEQ ID NO: 3999035 - RNA, 21 nt, Human herpesvirus 7
aauauacuuuagcgcugaaau

SEQ ID NO: 3999036 - RNA, 15 nt, Human herpesvirus 7
aauaucgauuuaaca

SEQ ID NO: 3999037 - RNA, 18 nt, Human herpesvirus 7
aauauggagcagcuuaag

SEQ ID NO: 3999038 - RNA, 22 nt, Human herpesvirus 7
aauauuuugaaaauauauucca

SEQ ID NO: 3999039 - RNA, 22 nt, Human herpesvirus 7
aaucaacagccaucuaauugca

SEQ ID NO: 3999040 - RNA, 15 nt, Human herpesvirus 7
aaucaauccaaauaa

SEQ ID NO: 3999041 - RNA, 14 nt, Human herpesvirus 7
aaucagaaauguua

SEQ ID NO: 3999042 - RNA, 22 nt, Human herpesvirus 7
aaucagcauuuaccauuucgaa

SEQ ID NO: 3999043 - RNA, 13 nt, Human herpesvirus 7
aauccaaguuuua

SEQ ID NO: 3999044 - RNA, 17 nt, Human herpesvirus 7
aauccaaguuuuacaga

SEQ ID NO: 3999045 - RNA, 22 nt, Human herpesvirus 7
aauccaaguuuuacagaaauug

SEQ ID NO: 3999046 - RNA, 16 nt, Human herpesvirus 7
aauccaugacagagaa

SEQ ID NO: 3999047 - RNA, 22 nt, Human herpesvirus 7
aauccguaucuagagaauguac

SEQ ID NO: 3999048 - RNA, 18 nt, Human herpesvirus 7
aaucucagcucuguaaua

SEQ ID NO: 3999049 - RNA, 21 nt, Human herpesvirus 7
aaugaauucuuugcaaucauu

SEQ ID NO: 3999050 - RNA, 14 nt, Human herpesvirus 7
aaugaccacaaccg

SEQ ID NO: 3999051 - RNA, 13 nt, Human herpesvirus 7
aaugagccugaca

SEQ ID NO: 3999052 - RNA, 17 nt, Human herpesvirus 7
aaugcugcucagcuaga

SEQ ID NO: 3999053 - RNA, 21 nt, Human herpesvirus 7
aaugguuuuaaaauagaaaau

SEQ ID NO: 3999054 - RNA, 23 nt, Human herpesvirus 7
aauguaaacgaagaaucauuuau

SEQ ID NO: 3999055 - RNA, 14 nt, Human herpesvirus 7
aauguaugaaaaug

SEQ ID NO: 3999056 - RNA, 16 nt, Human herpesvirus 7
aaugucucuguuccca

SEQ ID NO: 3999057 - RNA, 18 nt, Human herpesvirus 7
aauguuagaaacaucugu

SEQ ID NO: 3999058 - RNA, 16 nt, Human herpesvirus 7
aauguuauuuggaauu

SEQ ID NO: 3999059 - RNA, 16 nt, Human herpesvirus 7
aauguucgcaaaugua

SEQ ID NO: 3999060 - RNA, 15 nt, Human herpesvirus 7
aauuaaauacaaauu

SEQ ID NO: 3999061 - RNA, 18 nt, Human herpesvirus 7
aauuaauguaauuuauga

SEQ ID NO: 3999062 - RNA, 14 nt, Human herpesvirus 7
aauuagcuaaauaa

SEQ ID NO: 3999063 - RNA, 13 nt, Human herpesvirus 7
aauuagugaaaac

SEQ ID NO: 3999064 - RNA, 23 nt, Human herpesvirus 7
aauuauguauaucuuuuuauuga

SEQ ID NO: 3999065 - RNA, 18 nt, Human herpesvirus 7
aauuauguguauaagaau

SEQ ID NO: 3999066 - RNA, 21 nt, Human herpesvirus 7
aauuauuaaucuuuuugccuu

SEQ ID NO: 3999067 - RNA, 19 nt, Human herpesvirus 7
aauuauuagauuccauuua

SEQ ID NO: 3999068 - RNA, 15 nt, Human herpesvirus 7
aauuauuuccagagu

SEQ ID NO: 3999069 - RNA, 14 nt, Human herpesvirus 7
aauucauuguauga

SEQ ID NO: 3999070 - RNA, 20 nt, Human herpesvirus 7
aauuguuugaucaaaaucug

SEQ ID NO: 3999071 - RNA, 23 nt, Human herpesvirus 7
aauuguuuuucuuucuugcauac

SEQ ID NO: 3999072 - RNA, 15 nt, Human herpesvirus 7
aauuucuauuagaua

SEQ ID NO: 3999073 - RNA, 17 nt, Human herpesvirus 7
aauuuucuuagcuuuca

SEQ ID NO: 3999074 - RNA, 13 nt, Human herpesvirus 7
aauuuuuuacugu

SEQ ID NO: 3999075 - RNA, 20 nt, Human herpesvirus 7
acaaaacugcucauauuaac

SEQ ID NO: 3999076 - RNA, 19 nt, Human herpesvirus 7
acaaacauuccaacagcuu

SEQ ID NO: 3999077 - RNA, 21 nt, Human herpesvirus 7
acaaacauuccaacagcuuca

SEQ ID NO: 3999078 - RNA, 19 nt, Human herpesvirus 7
acaaauuggaaauuacugg

SEQ ID NO: 3999079 - RNA, 19 nt, Human herpesvirus 7
acaacaacuaaaacuacau

SEQ ID NO: 3999080 - RNA, 15 nt, Human herpesvirus 7
acaacgacauugaaa

SEQ ID NO: 3999081 - RNA, 19 nt, Human herpesvirus 7
acaagggcaauuguuugau

SEQ ID NO: 3999082 - RNA, 22 nt, Human herpesvirus 7
acaaucgcggggaaaaaaugag

SEQ ID NO: 3999083 - RNA, 17 nt, Human herpesvirus 7
acauauagauaaugaag

SEQ ID NO: 3999084 - RNA, 13 nt, Human herpesvirus 7
acauaucagauuu

SEQ ID NO: 3999085 - RNA, 19 nt, Human herpesvirus 7
acauauuuaauuucucguu

SEQ ID NO: 3999086 - RNA, 19 nt, Human herpesvirus 7
acaucaauuuuaaugugcu

SEQ ID NO: 3999087 - RNA, 13 nt, Human herpesvirus 7
acaucuaugugcu

SEQ ID NO: 3999088 - RNA, 17 nt, Human herpesvirus 7
acaugggauuucuguaa

SEQ ID NO: 3999089 - RNA, 13 nt, Human herpesvirus 7
acauguuuguaaa

SEQ ID NO: 3999090 - RNA, 15 nt, Human herpesvirus 7
acauuaaacagcauu

SEQ ID NO: 3999091 - RNA, 16 nt, Human herpesvirus 7
acauucaacaaagaca

SEQ ID NO: 3999092 - RNA, 15 nt, Human herpesvirus 7
acauuccuugagaaa

SEQ ID NO: 3999093 - RNA, 22 nt, Human herpesvirus 7
acauugugaguuucuacauguu

SEQ ID NO: 3999094 - RNA, 23 nt, Human herpesvirus 7
acauuuaaaaaaaaaaccacaaa

SEQ ID NO: 3999095 - RNA, 18 nt, Human herpesvirus 7
acauuuaugaaaaacaaa

SEQ ID NO: 3999096 - RNA, 20 nt, Human herpesvirus 7
acauuuauuauuuuuaaaaa

SEQ ID NO: 3999097 - RNA, 21 nt, Human herpesvirus 7
acauuucacucauuagaaaca

SEQ ID NO: 3999098 - RNA, 12 nt, Human herpesvirus 7
accaaaaugugg

SEQ ID NO: 3999099 - RNA, 18 nt, Human herpesvirus 7
accaaacuauauugaauu

SEQ ID NO: 3999100 - RNA, 12 nt, Human herpesvirus 7
accauuucugaa

SEQ ID NO: 3999101 - RNA, 17 nt, Human herpesvirus 7
acccagaccgcauaacc

SEQ ID NO: 3999102 - RNA, 18 nt, Human herpesvirus 7
acccuggagagacauaga

SEQ ID NO: 3999103 - RNA, 22 nt, Human herpesvirus 7
accucgacauucuccaguggca

SEQ ID NO: 3999104 - RNA, 22 nt, Human herpesvirus 7
accuguauggaaccuacugaag

SEQ ID NO: 3999105 - RNA, 18 nt, Human herpesvirus 7
accuuacaacaaagaaaa

SEQ ID NO: 3999106 - RNA, 14 nt, Human herpesvirus 7
acgaugauauuguc

SEQ ID NO: 3999107 - RNA, 21 nt, Human herpesvirus 7
acgauuugguguacuacauau

SEQ ID NO: 3999108 - RNA, 22 nt, Human herpesvirus 7
acgcaugcuugcuuugcauaga

SEQ ID NO: 3999109 - RNA, 19 nt, Human herpesvirus 7
acgcuuaauagaaauuauu

SEQ ID NO: 3999110 - RNA, 21 nt, Human herpesvirus 7
acggacaauaacauuuuguau

SEQ ID NO: 3999111 - RNA, 15 nt, Human herpesvirus 7
acggacuuaugucca

SEQ ID NO: 3999112 - RNA, 18 nt, Human herpesvirus 7
acgucuagacauuuguuu

SEQ ID NO: 3999113 - RNA, 14 nt, Human herpesvirus 7
acuaaguugaaauu

SEQ ID NO: 3999114 - RNA, 15 nt, Human herpesvirus 7
acuaauaaaaauuac

SEQ ID NO: 3999115 - RNA, 14 nt, Human herpesvirus 7
acuacauuuaaaaa

SEQ ID NO: 3999116 - RNA, 21 nt, Human herpesvirus 7
acuacuaaucaugaaaacagu

SEQ ID NO: 3999117 - RNA, 21 nt, Human herpesvirus 7
acuagaaaauaacuuuaaauu

SEQ ID NO: 3999118 - RNA, 15 nt, Human herpesvirus 7
acuauguccaaaaau

SEQ ID NO: 3999119 - RNA, 17 nt, Human herpesvirus 7
acuauguccaaaaauuu

SEQ ID NO: 3999120 - RNA, 17 nt, Human herpesvirus 7
acucauacuaauagaaa

SEQ ID NO: 3999121 - RNA, 13 nt, Human herpesvirus 7
acucauugggagu

SEQ ID NO: 3999122 - RNA, 17 nt, Human herpesvirus 7
acuccguuucauuuaaa

SEQ ID NO: 3999123 - RNA, 17 nt, Human herpesvirus 7
acuccuugcauacuuuu

SEQ ID NO: 3999124 - RNA, 18 nt, Human herpesvirus 7
acucggaaccgagaaugu

SEQ ID NO: 3999125 - RNA, 19 nt, Human herpesvirus 7
acucggaaccgagaauguu

SEQ ID NO: 3999126 - RNA, 15 nt, Human herpesvirus 7
acucugaauacguua

SEQ ID NO: 3999127 - RNA, 21 nt, Human herpesvirus 7
acucuucguuugaagagggaa

SEQ ID NO: 3999128 - RNA, 16 nt, Human herpesvirus 7
acugaagcauggauuu

SEQ ID NO: 3999129 - RNA, 20 nt, Human herpesvirus 7
acugaaucugaagaagaguu

SEQ ID NO: 3999130 - RNA, 12 nt, Human herpesvirus 7
acugauguaaaa

SEQ ID NO: 3999131 - RNA, 18 nt, Human herpesvirus 7
acuguaauauaauuauuu

SEQ ID NO: 3999132 - RNA, 15 nt, Human herpesvirus 7
acuguauaaucuuaa

SEQ ID NO: 3999133 - RNA, 15 nt, Human herpesvirus 7
acuguauuuguugau

SEQ ID NO: 3999134 - RNA, 15 nt, Human herpesvirus 7
acugucacuguccaa

SEQ ID NO: 3999135 - RNA, 17 nt, Human herpesvirus 7
acuuaaauauuuuacau

SEQ ID NO: 3999136 - RNA, 16 nt, Human herpesvirus 7
acuuaugauuggagua

SEQ ID NO: 3999137 - RNA, 14 nt, Human herpesvirus 7
acuuuaaauuauua

SEQ ID NO: 3999138 - RNA, 20 nt, Human herpesvirus 7
acuuucuauuguaugggaaa

SEQ ID NO: 3999139 - RNA, 17 nt, Human herpesvirus 7
acuuuuaaauuaaaaga

SEQ ID NO: 3999140 - RNA, 14 nt, Human herpesvirus 7
acuuuuaacuguua

SEQ ID NO: 3999141 - RNA, 15 nt, Human herpesvirus 7
agaaaaucuaccaau

SEQ ID NO: 3999142 - RNA, 14 nt, Human herpesvirus 7
agaaaaucucgaac

SEQ ID NO: 3999143 - RNA, 17 nt, Human herpesvirus 7
agaaaauguuuugauuu

SEQ ID NO: 3999144 - RNA, 15 nt, Human herpesvirus 7
agaaacagcugaaaa

SEQ ID NO: 3999145 - RNA, 17 nt, Human herpesvirus 7
agaaacuaauaaaaauu

SEQ ID NO: 3999146 - RNA, 15 nt, Human herpesvirus 7
agaaaguccaaagug

SEQ ID NO: 3999147 - RNA, 17 nt, Human herpesvirus 7
agaaauaacaaaauugu

SEQ ID NO: 3999148 - RNA, 22 nt, Human herpesvirus 7
agaaaucccaaaaaaaauuagu

SEQ ID NO: 3999149 - RNA, 23 nt, Human herpesvirus 7
agaacaacaacuaaaacuacauu

SEQ ID NO: 3999150 - RNA, 16 nt, Human herpesvirus 7
agaacagaaugauaau

SEQ ID NO: 3999151 - RNA, 19 nt, Human herpesvirus 7
agaacauuuauuuucuuaa

SEQ ID NO: 3999152 - RNA, 17 nt, Human herpesvirus 7
agaacauuuuucuugcu

SEQ ID NO: 3999153 - RNA, 19 nt, Human herpesvirus 7
agaagccacuucuaaauaa

SEQ ID NO: 3999154 - RNA, 18 nt, Human herpesvirus 7
agaauacuacucagaaga

SEQ ID NO: 3999155 - RNA, 23 nt, Human herpesvirus 7
agaauauuuauguucaaauaugc

SEQ ID NO: 3999156 - RNA, 16 nt, Human herpesvirus 7
agaaugcguaacuuug

SEQ ID NO: 3999157 - RNA, 16 nt, Human herpesvirus 7
agaaugcucuuuugaa

SEQ ID NO: 3999158 - RNA, 18 nt, Human herpesvirus 7
agaaugugguaaaaaagu

SEQ ID NO: 3999159 - RNA, 20 nt, Human herpesvirus 7
agaauguugagcuaucugau

SEQ ID NO: 3999160 - RNA, 23 nt, Human herpesvirus 7
agaauguuuauauauaaccgaua

SEQ ID NO: 3999161 - RNA, 20 nt, Human herpesvirus 7
agaauuccaggguaaagaua

SEQ ID NO: 3999162 - RNA, 15 nt, Human herpesvirus 7
agaauugauugaauu

SEQ ID NO: 3999163 - RNA, 14 nt, Human herpesvirus 7
agacagaaugccag

SEQ ID NO: 3999164 - RNA, 16 nt, Human herpesvirus 7
agaccaaauucaucca

SEQ ID NO: 3999165 - RNA, 21 nt, Human herpesvirus 7
agaccaggugacgucuagaca

SEQ ID NO: 3999166 - RNA, 22 nt, Human herpesvirus 7
agacucacuccuugcauacuuu

SEQ ID NO: 3999167 - RNA, 14 nt, Human herpesvirus 7
agagacaagaggac

SEQ ID NO: 3999168 - RNA, 16 nt, Human herpesvirus 7
agagaugaaaaaaauu

SEQ ID NO: 3999169 - RNA, 13 nt, Human herpesvirus 7
agagcauauacaa

SEQ ID NO: 3999170 - RNA, 18 nt, Human herpesvirus 7
agauaaguauaaacaguc

SEQ ID NO: 3999171 - RNA, 22 nt, Human herpesvirus 7
agauagcauuuguuacagcuuu

SEQ ID NO: 3999172 - RNA, 22 nt, Human herpesvirus 7
agauauugaugacguuaucuaa

SEQ ID NO: 3999173 - RNA, 15 nt, Human herpesvirus 7
agaugauaaaaacuu

SEQ ID NO: 3999174 - RNA, 17 nt, Human herpesvirus 7
agauggcacaauuguaa

SEQ ID NO: 3999175 - RNA, 19 nt, Human herpesvirus 7
agauguuuuugauauugua

SEQ ID NO: 3999176 - RNA, 18 nt, Human herpesvirus 7
agauuaauauauuuuccu

SEQ ID NO: 3999177 - RNA, 18 nt, Human herpesvirus 7
agauucggcugaguaaaa

SEQ ID NO: 3999178 - RNA, 17 nt, Human herpesvirus 7
agauuuaauaacaauuu

SEQ ID NO: 3999179 - RNA, 22 nt, Human herpesvirus 7
agcaagugucuuuuauuacucg

SEQ ID NO: 3999180 - RNA, 22 nt, Human herpesvirus 7
agcaauuuuaacgauuccaaac

SEQ ID NO: 3999181 - RNA, 14 nt, Human herpesvirus 7
agcacauguacaga

SEQ ID NO: 3999182 - RNA, 22 nt, Human herpesvirus 7
agcacauguacagacagaaugc

SEQ ID NO: 3999183 - RNA, 21 nt, Human herpesvirus 7
agcacccggcuuaaugaagac

SEQ ID NO: 3999184 - RNA, 17 nt, Human herpesvirus 7
agcagaucucgaacuuc

SEQ ID NO: 3999185 - RNA, 19 nt, Human herpesvirus 7
agcauaugcuggaucuucu

SEQ ID NO: 3999186 - RNA, 16 nt, Human herpesvirus 7
ggugauuguggggcau

SEQ ID NO: 3999187 - RNA, 21 nt, Human herpesvirus 7
gguuaaaaaaaugaauaacua

SEQ ID NO: 3999188 - RNA, 18 nt, Human herpesvirus 7
gguuuugaaauugacaug

SEQ ID NO: 3999189 - RNA, 17 nt, Human herpesvirus 7
guaaaaaaucaagucug

SEQ ID NO: 3999190 - RNA, 17 nt, Human herpesvirus 7
guaaaaaauuacuugcu

SEQ ID NO: 3999191 - RNA, 19 nt, Human herpesvirus 7
guaaaauucgcugaugaaa

SEQ ID NO: 3999192 - RNA, 14 nt, Human herpesvirus 7
guaaagauaauguu

SEQ ID NO: 3999193 - RNA, 15 nt, Human herpesvirus 7
guaagaaaagcaagu

SEQ ID NO: 3999194 - RNA, 17 nt, Human herpesvirus 7
guaaggcagugauuggu

SEQ ID NO: 3999195 - RNA, 14 nt, Human herpesvirus 7
guaauagcuuuaaa

SEQ ID NO: 3999196 - RNA, 20 nt, Human herpesvirus 7
guaauguaagaaaagcaagu

SEQ ID NO: 3999197 - RNA, 13 nt, Human herpesvirus 7
guaauuauuggau

SEQ ID NO: 3999198 - RNA, 17 nt, Human herpesvirus 7
guacaagguguuccuua

SEQ ID NO: 3999199 - RNA, 18 nt, Human herpesvirus 7
guacaauaauuucuauua

SEQ ID NO: 3999200 - RNA, 15 nt, Human herpesvirus 7
guacauuccuugaga

SEQ ID NO: 3999201 - RNA, 13 nt, Human herpesvirus 7
guagaaaugugcg

SEQ ID NO: 3999202 - RNA, 15 nt, Human herpesvirus 7
guauacaacuuuaug

SEQ ID NO: 3999203 - RNA, 20 nt, Human herpesvirus 7
guauuaaaggaaacauuucu

SEQ ID NO: 3999204 - RNA, 17 nt, Human herpesvirus 7
gucacaaaagcuuugau

SEQ ID NO: 3999205 - RNA, 17 nt, Human herpesvirus 7
gucagaacuuuuaaaaa

SEQ ID NO: 3999206 - RNA, 14 nt, Human herpesvirus 7
gucauaaaauuauc

SEQ ID NO: 3999207 - RNA, 22 nt, Human herpesvirus 7
gucaucuuauauuccuuugaaa

SEQ ID NO: 3999208 - RNA, 22 nt, Human herpesvirus 7
gucauugucgugagauuugaaa

SEQ ID NO: 3999209 - RNA, 21 nt, Human herpesvirus 7
gucauuugcaguuauuucuua

SEQ ID NO: 3999210 - RNA, 13 nt, Human herpesvirus 7
guccaagaaauau

SEQ ID NO: 3999211 - RNA, 19 nt, Human herpesvirus 7
gucuaaccccgcucuuuua

SEQ ID NO: 3999212 - RNA, 16 nt, Human herpesvirus 7
gucuaaggaauguggc

SEQ ID NO: 3999213 - RNA, 20 nt, Human herpesvirus 7
gucuacuaugggcuguuuua

SEQ ID NO: 3999214 - RNA, 23 nt, Human herpesvirus 7
gucuguugaaacauagcuagaaa

SEQ ID NO: 3999215 - RNA, 15 nt, Human herpesvirus 7
gugaaaauaaacagg

SEQ ID NO: 3999216 - RNA, 19 nt, Human herpesvirus 7
gugaaacacauucugucuu

SEQ ID NO: 3999217 - RNA, 20 nt, Human herpesvirus 7
gugaagacuacauaaaggua

SEQ ID NO: 3999218 - RNA, 18 nt, Human herpesvirus 7
gugcguacacuguaagcu

SEQ ID NO: 3999219 - RNA, 21 nt, Human herpesvirus 7
guggagcuauacguuuggagc

SEQ ID NO: 3999220 - RNA, 22 nt, Human herpesvirus 7
gugggauuugaaugaacaaaua

SEQ ID NO: 3999221 - RNA, 22 nt, Human herpesvirus 7
guguauuuuuuaaagaaaagcu

SEQ ID NO: 3999222 - RNA, 11 nt, Human herpesvirus 7
gugucuuacaa

SEQ ID NO: 3999223 - RNA, 15 nt, Human herpesvirus 7
gugugucucuagaaa

SEQ ID NO: 3999224 - RNA, 17 nt, Human herpesvirus 7
guuaagaauuccagauu

SEQ ID NO: 3999225 - RNA, 23 nt, Human herpesvirus 7
guuacaucauguuaaaaaaucaa

SEQ ID NO: 3999226 - RNA, 15 nt, Human herpesvirus 7
guuagaauaucugug

SEQ ID NO: 3999227 - RNA, 22 nt, Human herpesvirus 7
guuaucuuaugucugauucuua

SEQ ID NO: 3999228 - RNA, 22 nt, Human herpesvirus 7
guucauauacuucuugccccca

SEQ ID NO: 3999229 - RNA, 17 nt, Human herpesvirus 7
guuccuauaugugaaau

SEQ ID NO: 3999230 - RNA, 13 nt, Human herpesvirus 7
guucuaaauguac

SEQ ID NO: 3999231 - RNA, 15 nt, Human herpesvirus 7
guucuuguuuggaaa

SEQ ID NO: 3999232 - RNA, 14 nt, Human herpesvirus 7
guugaaaauguuuu

SEQ ID NO: 3999233 - RNA, 19 nt, Human herpesvirus 7
guugaaugaggacugcagu

SEQ ID NO: 3999234 - RNA, 14 nt, Human herpesvirus 7
guugaauucguuaa

SEQ ID NO: 3999235 - RNA, 14 nt, Human herpesvirus 7
guugauucucucuc

SEQ ID NO: 3999236 - RNA, 15 nt, Human herpesvirus 7
guugcacuccuagaa

SEQ ID NO: 3999237 - RNA, 15 nt, Human herpesvirus 7
guuuaaguauguuua

SEQ ID NO: 3999238 - RNA, 17 nt, Human herpesvirus 7
guuuauauauaaccgau

SEQ ID NO: 3999239 - RNA, 22 nt, Human herpesvirus 7
guuuccacauccgcaccgacag

SEQ ID NO: 3999240 - RNA, 15 nt, Human herpesvirus 7
guuugcucugaaaaa

SEQ ID NO: 3999241 - RNA, 22 nt, Human herpesvirus 7
guuuggcaacaaacaaauaauu

SEQ ID NO: 3999242 - RNA, 17 nt, Human herpesvirus 7
guuuucugagugcuaaa

SEQ ID NO: 3999243 - RNA, 20 nt, Human herpesvirus 7
guuuugagaguuguggcaaa

SEQ ID NO: 3999244 - RNA, 18 nt, Human herpesvirus 7
guuuuuuauuuagcuaau

SEQ ID NO: 3999245 - RNA, 15 nt, Human herpesvirus 7
uaaaaaaaaaaccac

SEQ ID NO: 3999246 - RNA, 20 nt, Human herpesvirus 7
uaaaaaaaccaggaacagau

SEQ ID NO: 3999247 - RNA, 11 nt, Human herpesvirus 7
uaaaacuguuu

SEQ ID NO: 3999248 - RNA, 17 nt, Human herpesvirus 7
uaaaaucuacuguaauc

SEQ ID NO: 3999249 - RNA, 19 nt, Human herpesvirus 7
uaaaauugacagcaccaau

SEQ ID NO: 3999250 - RNA, 13 nt, Human herpesvirus 7
uaaacauuucaaa

SEQ ID NO: 3999251 - RNA, 16 nt, Human herpesvirus 7
uaaacucacuucuaaa

SEQ ID NO: 3999252 - RNA, 13 nt, Human herpesvirus 7
uaaagcuuucaau

SEQ ID NO: 3999253 - RNA, 23 nt, Human herpesvirus 7
uaaaggaucaaaagcugcagcug

SEQ ID NO: 3999254 - RNA, 13 nt, Human herpesvirus 7
uaaaguuuacuua

SEQ ID NO: 3999255 - RNA, 17 nt, Human herpesvirus 7
uaaaguuuauauuuucu

SEQ ID NO: 3999256 - RNA, 14 nt, Human herpesvirus 7
uaaauaaaaauuug

SEQ ID NO: 3999257 - RNA, 15 nt, Human herpesvirus 7
uaaauaaaaugguug

SEQ ID NO: 3999258 - RNA, 18 nt, Human herpesvirus 7
uaaauauuuuuaaaaucu

SEQ ID NO: 3999259 - RNA, 22 nt, Human herpesvirus 7
uaaaucaguuguuggaaauacc

SEQ ID NO: 3999260 - RNA, 14 nt, Human herpesvirus 7
uaaaucauguuuaa

SEQ ID NO: 3999261 - RNA, 19 nt, Human herpesvirus 7
uaaauuaaaaagaaugcua

SEQ ID NO: 3999262 - RNA, 20 nt, Human herpesvirus 7
uaaauuacgagauauuauua

SEQ ID NO: 3999263 - RNA, 15 nt, Human herpesvirus 7
uaaauucaacaucuu

SEQ ID NO: 3999264 - RNA, 13 nt, Human herpesvirus 7
uaaauuuaaaauu

SEQ ID NO: 3999265 - RNA, 15 nt, Human herpesvirus 7
uaacagguaaauugu

SEQ ID NO: 3999266 - RNA, 13 nt, Human herpesvirus 7
uaacauauguuga

SEQ ID NO: 3999267 - RNA, 17 nt, Human herpesvirus 7
uaacaugccugcaauau

SEQ ID NO: 3999268 - RNA, 18 nt, Human herpesvirus 7
uaacgauuccaaaccuau

SEQ ID NO: 3999269 - RNA, 18 nt, Human herpesvirus 7
uaacggauuuacauuuca

SEQ ID NO: 3999270 - RNA, 18 nt, Human herpesvirus 7
uaacugagaaaaaugaca

SEQ ID NO: 3999271 - RNA, 22 nt, Human herpesvirus 7
uaacugagaaaaaugacaaaac

SEQ ID NO: 3999272 - RNA, 22 nt, Human herpesvirus 7
uaacuuuuuuuuucuuuaguuu

SEQ ID NO: 3999273 - RNA, 12 nt, Human herpesvirus 7
uaagaaacaucu

SEQ ID NO: 3999274 - RNA, 20 nt, Human herpesvirus 7
uaagagacauugaaaaugca

SEQ ID NO: 3999275 - RNA, 17 nt, Human herpesvirus 7
uaagcaaauaaauugug

SEQ ID NO: 3999276 - RNA, 14 nt, Human herpesvirus 7
uaagccagauuuca

SEQ ID NO: 3999277 - RNA, 13 nt, Human herpesvirus 7
uaagcuuuuucuu

SEQ ID NO: 3999278 - RNA, 18 nt, Human herpesvirus 7
uaaggcuguaaaagaaaa

SEQ ID NO: 3999279 - RNA, 22 nt, Human herpesvirus 7
uaaguucaucauguuuguugag

SEQ ID NO: 3999280 - RNA, 14 nt, Human herpesvirus 7
uaauaacaauuuga

SEQ ID NO: 3999281 - RNA, 16 nt, Human herpesvirus 7
uaauaguggugaaauu

SEQ ID NO: 3999282 - RNA, 18 nt, Human herpesvirus 7
uaaucaaggacaugauug

SEQ ID NO: 3999283 - RNA, 15 nt, Human herpesvirus 7
uaauuacuucuuuga

SEQ ID NO: 3999284 - RNA, 23 nt, Human herpesvirus 7
uaauugcagacuaauuacagcua

SEQ ID NO: 3999285 - RNA, 19 nt, Human herpesvirus 7
uaauuugaauuaauucuag

SEQ ID NO: 3999286 - RNA, 18 nt, Human herpesvirus 7
uacaaaaguucuguuuug

SEQ ID NO: 3999287 - RNA, 19 nt, Human herpesvirus 7
uacaauaugacgacuuuga

SEQ ID NO: 3999288 - RNA, 16 nt, Human herpesvirus 7
uacaauuucuggcaau

SEQ ID NO: 3999289 - RNA, 23 nt, Human herpesvirus 7
uacacuaugagauauuuaauggu

SEQ ID NO: 3999290 - RNA, 17 nt, Human herpesvirus 7
cuuuuuccaauagcacu

SEQ ID NO: 3999291 - RNA, 16 nt, Human herpesvirus 7
cuuuuucuggaauguu

SEQ ID NO: 3999292 - RNA, 21 nt, Human herpesvirus 7
gaaaacaaucaauaagccucu

SEQ ID NO: 3999293 - RNA, 20 nt, Human herpesvirus 7
gaaaagaaaaagcaacaaau

SEQ ID NO: 3999294 - RNA, 12 nt, Human herpesvirus 7
gaaaagagaaaa

SEQ ID NO: 3999295 - RNA, 13 nt, Human herpesvirus 7
gaaaauaacagga

SEQ ID NO: 3999296 - RNA, 19 nt, Human herpesvirus 7
gaaaaucuaucaccaagaa

SEQ ID NO: 3999297 - RNA, 16 nt, Human herpesvirus 7
gaaacaaucccagaaa

SEQ ID NO: 3999298 - RNA, 15 nt, Human herpesvirus 7
gaaacgucaggaaaa

SEQ ID NO: 3999299 - RNA, 16 nt, Human herpesvirus 7
gaaacuuccaauaacc

SEQ ID NO: 3999300 - RNA, 15 nt, Human herpesvirus 7
gaaagacaaacuaug

SEQ ID NO: 3999301 - RNA, 21 nt, Human herpesvirus 7
gaaagucagaacauugucaaa

SEQ ID NO: 3999302 - RNA, 17 nt, Human herpesvirus 7
gaaauaaauucaaggaa

SEQ ID NO: 3999303 - RNA, 14 nt, Human herpesvirus 7
gaaaucaaaaaugu

SEQ ID NO: 3999304 - RNA, 22 nt, Human herpesvirus 7
gaaaucugguugauuugagcag

SEQ ID NO: 3999305 - RNA, 17 nt, Human herpesvirus 7
gaaauggguuugggaaa

SEQ ID NO: 3999306 - RNA, 17 nt, Human herpesvirus 7
gaaaugucaagaacuuc

SEQ ID NO: 3999307 - RNA, 17 nt, Human herpesvirus 7
gaaauuaaauacaaauu

SEQ ID NO: 3999308 - RNA, 14 nt, Human herpesvirus 7
gaaauucuguggag

SEQ ID NO: 3999309 - RNA, 17 nt, Human herpesvirus 7
gaacauuugaagauaag

SEQ ID NO: 3999310 - RNA, 13 nt, Human herpesvirus 7
gaacccuggagag

SEQ ID NO: 3999311 - RNA, 22 nt, Human herpesvirus 7
gaacuguuuuaauguauuuuuc

SEQ ID NO: 3999312 - RNA, 18 nt, Human herpesvirus 7
gaacuucagauuuuaguu

SEQ ID NO: 3999313 - RNA, 22 nt, Human herpesvirus 7
gaacuuuuaaaaaagaacuuac

SEQ ID NO: 3999314 - RNA, 13 nt, Human herpesvirus 7
gaagaaaagaaaa

SEQ ID NO: 3999315 - RNA, 15 nt, Human herpesvirus 7
gaagaaugcaagccu

SEQ ID NO: 3999316 - RNA, 20 nt, Human herpesvirus 7
gaagagcuuuuuaaguaaau

SEQ ID NO: 3999317 - RNA, 20 nt, Human herpesvirus 7
gaagaggaguauguugcaua

SEQ ID NO: 3999318 - RNA, 22 nt, Human herpesvirus 7
gaagauuuguuccaaacucgag

SEQ ID NO: 3999319 - RNA, 13 nt, Human herpesvirus 7
gaagcgagauuua

SEQ ID NO: 3999320 - RNA, 19 nt, Human herpesvirus 7
gaagcugacuuugucauga

SEQ ID NO: 3999321 - RNA, 20 nt, Human herpesvirus 7
gaauaaucucaauuaaaaca

SEQ ID NO: 3999322 - RNA, 14 nt, Human herpesvirus 7
gaauagacaucuuc

SEQ ID NO: 3999323 - RNA, 21 nt, Human herpesvirus 7
gaauagguaucuuuacuuuca

SEQ ID NO: 3999324 - RNA, 20 nt, Human herpesvirus 7
gaauaugaagaguucuuguu

SEQ ID NO: 3999325 - RNA, 15 nt, Human herpesvirus 7
gaaucacaacauaua

SEQ ID NO: 3999326 - RNA, 16 nt, Human herpesvirus 7
gaaucagacuaaauau

SEQ ID NO: 3999327 - RNA, 21 nt, Human herpesvirus 7
gaaucauuuguauauucuagu

SEQ ID NO: 3999328 - RNA, 16 nt, Human herpesvirus 7
gaauccgcauuugagg

SEQ ID NO: 3999329 - RNA, 18 nt, Human herpesvirus 7
gaaucuauuuaaaauauu

SEQ ID NO: 3999330 - RNA, 14 nt, Human herpesvirus 7
gaaugaacaaauaa

SEQ ID NO: 3999331 - RNA, 19 nt, Human herpesvirus 7
gaaugauauaaaguuuaua

SEQ ID NO: 3999332 - RNA, 15 nt, Human herpesvirus 7
gaauuguacguucug

SEQ ID NO: 3999333 - RNA, 13 nt, Human herpesvirus 7
gaauuuccagaag

SEQ ID NO: 3999334 - RNA, 21 nt, Human herpesvirus 7
gaauuuuaacacuguuuucag

SEQ ID NO: 3999335 - RNA, 20 nt, Human herpesvirus 7
gaauuuuacaaugcagccua

SEQ ID NO: 3999336 - RNA, 22 nt, Human herpesvirus 7
gacaaagcauacuuuaaaacuu

SEQ ID NO: 3999337 - RNA, 17 nt, Human herpesvirus 7
gacauaacaaaaaaggu

SEQ ID NO: 3999338 - RNA, 11 nt, Human herpesvirus 7
gacauguuucu

SEQ ID NO: 3999339 - RNA, 16 nt, Human herpesvirus 7
gacauuauuagacaga

SEQ ID NO: 3999340 - RNA, 23 nt, Human herpesvirus 7
gacauuucaagaaggaaaauuuc

SEQ ID NO: 3999341 - RNA, 16 nt, Human herpesvirus 7
gacgcuguaugcaaga

SEQ ID NO: 3999342 - RNA, 17 nt, Human herpesvirus 7
gacgcuugcuauuuucu

SEQ ID NO: 3999343 - RNA, 18 nt, Human herpesvirus 7
gacggcauuuaacucaug

SEQ ID NO: 3999344 - RNA, 22 nt, Human herpesvirus 7
gacuaaucacgagaaaaauauu

SEQ ID NO: 3999345 - RNA, 20 nt, Human herpesvirus 7
gacuuaucaaucuauuucua

SEQ ID NO: 3999346 - RNA, 21 nt, Human herpesvirus 7
gacuuccucucguguggccuu

SEQ ID NO: 3999347 - RNA, 16 nt, Human herpesvirus 7
gagaaaguaaaagcua

SEQ ID NO: 3999348 - RNA, 14 nt, Human herpesvirus 7
gagaauuuaaagcu

SEQ ID NO: 3999349 - RNA, 16 nt, Human herpesvirus 7
gagagaauaagcaaau

SEQ ID NO: 3999350 - RNA, 14 nt, Human herpesvirus 7
gagagacaagagga

SEQ ID NO: 3999351 - RNA, 15 nt, Human herpesvirus 7
gagauuccaaagagc

SEQ ID NO: 3999352 - RNA, 11 nt, Human herpesvirus 7
gagguggaaaa

SEQ ID NO: 3999353 - RNA, 16 nt, Human herpesvirus 7
gagucaacacauaucu

SEQ ID NO: 3999354 - RNA, 18 nt, Human herpesvirus 7
gagucucuaaaauuuucu

SEQ ID NO: 3999355 - RNA, 14 nt, Human herpesvirus 7
gauaaaauuuggag

SEQ ID NO: 3999356 - RNA, 13 nt, Human herpesvirus 7
gaucauuugcaug

SEQ ID NO: 3999357 - RNA, 14 nt, Human herpesvirus 7
gauccguaacugca

SEQ ID NO: 3999358 - RNA, 17 nt, Human herpesvirus 7
gaugacuuccaaguuuu

SEQ ID NO: 3999359 - RNA, 17 nt, Human herpesvirus 7
gaugcauuuuuauugca

SEQ ID NO: 3999360 - RNA, 23 nt, Human herpesvirus 7
gauuauaugcaucaaaacauauc

SEQ ID NO: 3999361 - RNA, 14 nt, Human herpesvirus 7
gauuauauucaaau

SEQ ID NO: 3999362 - RNA, 14 nt, Human herpesvirus 7
gauucuaaauuaaa

SEQ ID NO: 3999363 - RNA, 13 nt, Human herpesvirus 7
gauucuccagaaa

SEQ ID NO: 3999364 - RNA, 19 nt, Human herpesvirus 7
gauuucacccuuuguuuga

SEQ ID NO: 3999365 - RNA, 12 nt, Human herpesvirus 7
gauuucuacaau

SEQ ID NO: 3999366 - RNA, 14 nt, Human herpesvirus 7
gcaaauaaauugug

SEQ ID NO: 3999367 - RNA, 19 nt, Human herpesvirus 7
gcaacaaacaaauaauuca

SEQ ID NO: 3999368 - RNA, 15 nt, Human herpesvirus 7
gcaacaaugacuuua

SEQ ID NO: 3999369 - RNA, 16 nt, Human herpesvirus 7
gcaacuuugugccuga

SEQ ID NO: 3999370 - RNA, 10 nt, Human herpesvirus 7
gcaacuuuuc

SEQ ID NO: 3999371 - RNA, 13 nt, Human herpesvirus 7
gcaauaugcucac

SEQ ID NO: 3999372 - RNA, 18 nt, Human herpesvirus 7
gcaauguauauaagcaga

SEQ ID NO: 3999373 - RNA, 20 nt, Human herpesvirus 7
gcacaguauaaucuugugaa

SEQ ID NO: 3999374 - RNA, 22 nt, Human herpesvirus 7
gcacugauaaucaagaaacaug

SEQ ID NO: 3999375 - RNA, 20 nt, Human herpesvirus 7
gcagccagaacucaauuuuu

SEQ ID NO: 3999376 - RNA, 23 nt, Human herpesvirus 7
gcauaaaaaaucuaauuaaucug

SEQ ID NO: 3999377 - RNA, 15 nt, Human herpesvirus 7
gcauauaauaaagga

SEQ ID NO: 3999378 - RNA, 12 nt, Human herpesvirus 7
gcauccaaagaa

SEQ ID NO: 3999379 - RNA, 20 nt, Human herpesvirus 7
gcaugcguaaaaaaucaagu

SEQ ID NO: 3999380 - RNA, 21 nt, Human herpesvirus 7
gcauuauauccaauaaugcau

SEQ ID NO: 3999381 - RNA, 14 nt, Human herpesvirus 7
gcauuccuuggaaa

SEQ ID NO: 3999382 - RNA, 19 nt, Human herpesvirus 7
gcauuccuuggaaaaauga

SEQ ID NO: 3999383 - RNA, 13 nt, Human herpesvirus 7
gccaaugauuuuu

SEQ ID NO: 3999384 - RNA, 13 nt, Human herpesvirus 7
gccaauugaagaa

SEQ ID NO: 3999385 - RNA, 13 nt, Human herpesvirus 7
gccagaaauuaaa

SEQ ID NO: 3999386 - RNA, 17 nt, Human herpesvirus 7
gccagagaaccacguga

SEQ ID NO: 3999387 - RNA, 19 nt, Human herpesvirus 7
gccagauuucauguuuuau

SEQ ID NO: 3999388 - RNA, 16 nt, Human herpesvirus 7
gccagguauucaaaca

SEQ ID NO: 3999389 - RNA, 15 nt, Human herpesvirus 7
gccauaauuugaauu

SEQ ID NO: 3999390 - RNA, 13 nt, Human herpesvirus 7
gccauucuuuuca

SEQ ID NO: 3999391 - RNA, 12 nt, Human herpesvirus 7
gcgaaaaugaua

SEQ ID NO: 3999392 - RNA, 11 nt, Human herpesvirus 7
gcgcugaaaua

SEQ ID NO: 3999393 - RNA, 14 nt, Human herpesvirus 7
gcuagaaucuuguu

SEQ ID NO: 3999394 - RNA, 18 nt, Human herpesvirus 7
gcuauuauaauguaagaa

SEQ ID NO: 3999395 - RNA, 15 nt, Human herpesvirus 7
gcuauucauuucacg

SEQ ID NO: 3999396 - RNA, 12 nt, Human herpesvirus 7
gcucuaaacaaa

SEQ ID NO: 3999397 - RNA, 13 nt, Human herpesvirus 7
gcucucaaucaaa

SEQ ID NO: 3999398 - RNA, 12 nt, Human herpesvirus 7
gcugaagaacau

SEQ ID NO: 3999399 - RNA, 13 nt, Human herpesvirus 7
gcugcaucuuuuc

SEQ ID NO: 3999400 - RNA, 21 nt, Human herpesvirus 7
gcuguucuugcuggcucaagc

SEQ ID NO: 3999401 - RNA, 13 nt, Human herpesvirus 7
gcuuaaaaacagu

SEQ ID NO: 3999402 - RNA, 21 nt, Human herpesvirus 7
gcuuagaauauuuauguucaa

SEQ ID NO: 3999403 - RNA, 14 nt, Human herpesvirus 7
gcuucagaugcuau

SEQ ID NO: 3999404 - RNA, 13 nt, Human herpesvirus 7
gcuuguuaaagaa

SEQ ID NO: 3999405 - RNA, 23 nt, Human herpesvirus 7
gcuuugaucuacauauacuuuua

SEQ ID NO: 3999406 - RNA, 16 nt, Human herpesvirus 7
ucuauuuaaaauauua

SEQ ID NO: 3999407 - RNA, 16 nt, Human herpesvirus 7
ucucagaaguuucaau

SEQ ID NO: 3999408 - RNA, 22 nt, Human herpesvirus 7
ucucauaauaucgguuaucuua

SEQ ID NO: 3999409 - RNA, 14 nt, Human herpesvirus 7
ucucguaauuuaag

SEQ ID NO: 3999410 - RNA, 18 nt, Human herpesvirus 7
ucucuugaggaaaugucu

SEQ ID NO: 3999411 - RNA, 20 nt, Human herpesvirus 7
ucugaguguguuaaaugcga

SEQ ID NO: 3999412 - RNA, 23 nt, Human herpesvirus 7
ucugcacuaucuccuaaaugaau

SEQ ID NO: 3999413 - RNA, 15 nt, Human herpesvirus 7
ucugcuugucucugu

SEQ ID NO: 3999414 - RNA, 18 nt, Human herpesvirus 7
ucuggaaucgaauacagu

SEQ ID NO: 3999415 - RNA, 16 nt, Human herpesvirus 7
ucuggauucaagaaau

SEQ ID NO: 3999416 - RNA, 18 nt, Human herpesvirus 7
ucuguaaaaacuuguuug

SEQ ID NO: 3999417 - RNA, 17 nt, Human herpesvirus 7
ucuguagaaaauguuuu

SEQ ID NO: 3999418 - RNA, 21 nt, Human herpesvirus 7
ucuuaaaaguacaaauguuuu

SEQ ID NO: 3999419 - RNA, 18 nt, Human herpesvirus 7
ucuuaauaaaguuuaauu

SEQ ID NO: 3999420 - RNA, 15 nt, Human herpesvirus 7
ucuuaauuuguucaa

SEQ ID NO: 3999421 - RNA, 17 nt, Human herpesvirus 7
ucuuacagugcucuuug

SEQ ID NO: 3999422 - RNA, 22 nt, Human herpesvirus 7
ucuuacgucuuuucuaccaaca

SEQ ID NO: 3999423 - RNA, 14 nt, Human herpesvirus 7
ucuuauaacaaagu

SEQ ID NO: 3999424 - RNA, 17 nt, Human herpesvirus 7
ucuuaucuccauucuaa

SEQ ID NO: 3999425 - RNA, 23 nt, Human herpesvirus 7
ucuucauaaaaaaaaagggagaa

SEQ ID NO: 3999426 - RNA, 12 nt, Human herpesvirus 7
ucuucuucugag

SEQ ID NO: 3999427 - RNA, 16 nt, Human herpesvirus 7
ucuuggguaauuuuaa

SEQ ID NO: 3999428 - RNA, 22 nt, Human herpesvirus 7
ucuuuaauccguaucuagagaa

SEQ ID NO: 3999429 - RNA, 22 nt, Human herpesvirus 7
ucuuuauaaaggaccaugggaa

SEQ ID NO: 3999430 - RNA, 18 nt, Human herpesvirus 7
ucuuuauuuaagcuucaa

SEQ ID NO: 3999431 - RNA, 20 nt, Human herpesvirus 7
ucuuuauuuaagcuucaaaa

SEQ ID NO: 3999432 - RNA, 20 nt, Human herpesvirus 7
ugaaaaaaucuugcaagcag

SEQ ID NO: 3999433 - RNA, 18 nt, Human herpesvirus 7
ugaaaauguuuuugcuag

SEQ ID NO: 3999434 - RNA, 23 nt, Human herpesvirus 7
ugaaaauuuccuacaaaaguucu

SEQ ID NO: 3999435 - RNA, 18 nt, Human herpesvirus 7
ugaaacauagcuagaaau

SEQ ID NO: 3999436 - RNA, 16 nt, Human herpesvirus 7
ugaaagccgcugccuu

SEQ ID NO: 3999437 - RNA, 13 nt, Human herpesvirus 7
ugaaaucaaaaau

SEQ ID NO: 3999438 - RNA, 15 nt, Human herpesvirus 7
ugaacagaauuuuca

SEQ ID NO: 3999439 - RNA, 23 nt, Human herpesvirus 7
ugaagaagaguugcaacuagaga

SEQ ID NO: 3999440 - RNA, 17 nt, Human herpesvirus 7
ugaagcuaaaauuuuga

SEQ ID NO: 3999441 - RNA, 13 nt, Human herpesvirus 7
ugaauaaaaucua

SEQ ID NO: 3999442 - RNA, 16 nt, Human herpesvirus 7
ugaaucaaauuucaaa

SEQ ID NO: 3999443 - RNA, 14 nt, Human herpesvirus 7
ugacaaauuucagg

SEQ ID NO: 3999444 - RNA, 21 nt, Human herpesvirus 7
ugaguguggugacagaaguaa

SEQ ID NO: 3999445 - RNA, 13 nt, Human herpesvirus 7
ugauaagauuucc

SEQ ID NO: 3999446 - RNA, 13 nt, Human herpesvirus 7
ugauaauuucuau

SEQ ID NO: 3999447 - RNA, 16 nt, Human herpesvirus 7
ugaucuggauucaaga

SEQ ID NO: 3999448 - RNA, 22 nt, Human herpesvirus 7
ugauucuuauucuacacaucuu

SEQ ID NO: 3999449 - RNA, 15 nt, Human herpesvirus 7
ugauuuauauagcaa

SEQ ID NO: 3999450 - RNA, 18 nt, Human herpesvirus 7
ugauuugagcagugauuu

SEQ ID NO: 3999451 - RNA, 17 nt, Human herpesvirus 7
ugcaacucuucuucaga

SEQ ID NO: 3999452 - RNA, 19 nt, Human herpesvirus 7
ugcaacuggcauuccuugg

SEQ ID NO: 3999453 - RNA, 18 nt, Human herpesvirus 7
ugcaauaugcauguguaa

SEQ ID NO: 3999454 - RNA, 18 nt, Human herpesvirus 7
ugcaauuaaaauguacau

SEQ ID NO: 3999455 - RNA, 18 nt, Human herpesvirus 7
ugcagacuaauuacagcu

SEQ ID NO: 3999456 - RNA, 22 nt, Human herpesvirus 7
ugcaucaaaacauaucagauuu

SEQ ID NO: 3999457 - RNA, 13 nt, Human herpesvirus 7
ugcaugaaaucuu

SEQ ID NO: 3999458 - RNA, 23 nt, Human herpesvirus 7
ugcauuuuuauugcaguuuuuua

SEQ ID NO: 3999459 - RNA, 14 nt, Human herpesvirus 7
ugccaaaagcuuga

SEQ ID NO: 3999460 - RNA, 21 nt, Human herpesvirus 7
ugccacguuuuuuucuucaau

SEQ ID NO: 3999461 - RNA, 17 nt, Human herpesvirus 7
ugcguuaaugucucugu

SEQ ID NO: 3999462 - RNA, 21 nt, Human herpesvirus 7
ugcuauuauuaaagcuuucaa

SEQ ID NO: 3999463 - RNA, 19 nt, Human herpesvirus 7
ugcucauguugacgggaaa

SEQ ID NO: 3999464 - RNA, 22 nt, Human herpesvirus 7
ugcuggaucauagagaaaacau

SEQ ID NO: 3999465 - RNA, 13 nt, Human herpesvirus 7
ugcugugagugaa

SEQ ID NO: 3999466 - RNA, 15 nt, Human herpesvirus 7
ugcuuuucaugcuuu

SEQ ID NO: 3999467 - RNA, 16 nt, Human herpesvirus 7
uggaaaaacagaaugu

SEQ ID NO: 3999468 - RNA, 18 nt, Human herpesvirus 7
uggaaaaauaaacaauau

SEQ ID NO: 3999469 - RNA, 17 nt, Human herpesvirus 7
uggaaccuacugaagag

SEQ ID NO: 3999470 - RNA, 18 nt, Human herpesvirus 7
uggaagacgccaauaaau

SEQ ID NO: 3999471 - RNA, 24 nt, Human herpesvirus 7
uggaguauuaccauuuauggaaau

SEQ ID NO: 3999472 - RNA, 19 nt, Human herpesvirus 7
uggaguuagcgaggcauuu

SEQ ID NO: 3999473 - RNA, 15 nt, Human herpesvirus 7
uggauacaaggaaaa

SEQ ID NO: 3999474 - RNA, 14 nt, Human herpesvirus 7
uggauacggcagcg

SEQ ID NO: 3999475 - RNA, 15 nt, Human herpesvirus 7
uggauuucagcauuu

SEQ ID NO: 3999476 - RNA, 23 nt, Human herpesvirus 7
uggcauugaaauucuguggagug

SEQ ID NO: 3999477 - RNA, 22 nt, Human herpesvirus 7
uggguuaacgaaacgcuagaau

SEQ ID NO: 3999478 - RNA, 16 nt, Human herpesvirus 7
uggucagaacaucccu

SEQ ID NO: 3999479 - RNA, 14 nt, Human herpesvirus 7
uggucgagaauaca

SEQ ID NO: 3999480 - RNA, 17 nt, Human herpesvirus 7
ugguguacuacauauua

SEQ ID NO: 3999481 - RNA, 14 nt, Human herpesvirus 7
ugguugugcaauuu

SEQ ID NO: 3999482 - RNA, 21 nt, Human herpesvirus 7
uguaacaacuagcaaacagug

SEQ ID NO: 3999483 - RNA, 18 nt, Human herpesvirus 7
uguaauuucucaaaucuu

SEQ ID NO: 3999484 - RNA, 19 nt, Human herpesvirus 7
uguacaauuacaaaaugua

SEQ ID NO: 3999485 - RNA, 22 nt, Human herpesvirus 7
uguacaauuugcauaauccucu

SEQ ID NO: 3999486 - RNA, 16 nt, Human herpesvirus 7
uguacuuuuuauuguu

SEQ ID NO: 3999487 - RNA, 14 nt, Human herpesvirus 7
uguauacaacuuua

SEQ ID NO: 3999488 - RNA, 22 nt, Human herpesvirus 7
uguauaugcucuagaaaaucua

SEQ ID NO: 3999489 - RNA, 16 nt, Human herpesvirus 7
uguaugaaaaaaacau

SEQ ID NO: 3999490 - RNA, 22 nt, Human herpesvirus 7
uguaugcaagaaaguccaaagu

SEQ ID NO: 3999491 - RNA, 19 nt, Human herpesvirus 7
uguauuaaguguuugcucu

SEQ ID NO: 3999492 - RNA, 23 nt, Human herpesvirus 7
ugucacguguucaggcaacauua

SEQ ID NO: 3999493 - RNA, 13 nt, Human herpesvirus 7
ugucauaaaauua

SEQ ID NO: 3999494 - RNA, 14 nt, Human herpesvirus 7
ugucuauuucaauu

SEQ ID NO: 3999495 - RNA, 21 nt, Human herpesvirus 7
ugucuuaauugccgauuccua

SEQ ID NO: 3999496 - RNA, 18 nt, Human herpesvirus 7
ugucuucggccuugcuga

SEQ ID NO: 3999497 - RNA, 21 nt, Human herpesvirus 7
ugugaacugauguuuggcaac

SEQ ID NO: 3999498 - RNA, 18 nt, Human herpesvirus 7
uguguaaaaaaaaguugu

SEQ ID NO: 3999499 - RNA, 21 nt, Human herpesvirus 7
uguuacaaucgcggggaaaaa

SEQ ID NO: 3999500 - RNA, 23 nt, Human herpesvirus 7
uguuaucauacguuuacaguuuu

SEQ ID NO: 3999501 - RNA, 18 nt, Human herpesvirus 7
uguuauuuuucaugccuu

SEQ ID NO: 3999502 - RNA, 15 nt, Human herpesvirus 7
uguuccacgaucauu

SEQ ID NO: 3999503 - RNA, 11 nt, Human herpesvirus 7
uguugaaauug

SEQ ID NO: 3999504 - RNA, 13 nt, Human herpesvirus 7
uguuugaucaaaa

SEQ ID NO: 3999505 - RNA, 17 nt, Human herpesvirus 7
uuaaaggaaauaaacaa

SEQ ID NO: 3999506 - RNA, 16 nt, Human herpesvirus 7
uuaaaguagcugaauu

SEQ ID NO: 3999507 - RNA, 16 nt, Human herpesvirus 7
uuaaaguauuuauuuu

SEQ ID NO: 3999508 - RNA, 12 nt, Human herpesvirus 7
uuaaauuauuau

SEQ ID NO: 3999509 - RNA, 14 nt, Human herpesvirus 7
uuaaauuauuauua

SEQ ID NO: 3999510 - RNA, 23 nt, Human herpesvirus 7
uuaacaacagccaaaugugguaa

SEQ ID NO: 3999511 - RNA, 21 nt, Human herpesvirus 7
uuaacacguagaaaaaaacaa

SEQ ID NO: 3999512 - RNA, 23 nt, Human herpesvirus 7
uuaacacguagaaaaaaacaaug

SEQ ID NO: 3999513 - RNA, 22 nt, Human herpesvirus 7
uuaacgaaacgcuagaaucuug

SEQ ID NO: 3999514 - RNA, 23 nt, Human herpesvirus 7
uuaacgaaggcaucaagaaacaa

SEQ ID NO: 3999515 - RNA, 20 nt, Human herpesvirus 7
uuaacuauaucaucaucuuu

SEQ ID NO: 3999516 - RNA, 18 nt, Human herpesvirus 7
uuaaguauuuuacaacaa

SEQ ID NO: 3999517 - RNA, 14 nt, Human herpesvirus 7
uuaagugaacuguu

SEQ ID NO: 3999518 - RNA, 23 nt, Human herpesvirus 7
uuaauaaaaagcccaugaacacu

SEQ ID NO: 3999519 - RNA, 17 nt, Human herpesvirus 7
uuaauaauauuaguauu

SEQ ID NO: 3999520 - RNA, 15 nt, Human herpesvirus 7
gcaacacaaauuuag

SEQ ID NO: 3999521 - RNA, 22 nt, Human herpesvirus 7
gcaacuuuaauuaacacucaaa

SEQ ID NO: 3999522 - RNA, 18 nt, Human herpesvirus 7
gcaacuuuucuuaaacau

SEQ ID NO: 3999523 - RNA, 13 nt, Human herpesvirus 7
gcaagccuagaau

SEQ ID NO: 3999524 - RNA, 21 nt, Human herpesvirus 7
gcaauuuucacaauggaaaga

SEQ ID NO: 3999525 - RNA, 17 nt, Human herpesvirus 7
gcaauuuucauaaagau

SEQ ID NO: 3999526 - RNA, 14 nt, Human herpesvirus 7
gcacaaucacguga

SEQ ID NO: 3999527 - RNA, 13 nt, Human herpesvirus 7
gcacuccuagaaa

SEQ ID NO: 3999528 - RNA, 18 nt, Human herpesvirus 7
gcagaaaugucuuuugau

SEQ ID NO: 3999529 - RNA, 21 nt, Human herpesvirus 7
gcagacauugaagauuguuua

SEQ ID NO: 3999530 - RNA, 14 nt, Human herpesvirus 7
gcauacaguuuauu

SEQ ID NO: 3999531 - RNA, 19 nt, Human herpesvirus 7
gcaugaauuaauaaaacaa

SEQ ID NO: 3999532 - RNA, 14 nt, Human herpesvirus 7
gcaugucucauaau

SEQ ID NO: 3999533 - RNA, 17 nt, Human herpesvirus 7
gcauuauuggauaauau

SEQ ID NO: 3999534 - RNA, 18 nt, Human herpesvirus 7
gcauuauuggauaauauc

SEQ ID NO: 3999535 - RNA, 17 nt, Human herpesvirus 7
gcauuauuguauaugau

SEQ ID NO: 3999536 - RNA, 17 nt, Human herpesvirus 7
gcauugcauaucaugau

SEQ ID NO: 3999537 - RNA, 20 nt, Human herpesvirus 7
gccaaaucuaauuuaugaua

SEQ ID NO: 3999538 - RNA, 18 nt, Human herpesvirus 7
gccacgaugacuuccaag

SEQ ID NO: 3999539 - RNA, 19 nt, Human herpesvirus 7
gccagaaauuaaauacaaa

SEQ ID NO: 3999540 - RNA, 17 nt, Human herpesvirus 7
gccuaggauaccaaaca

SEQ ID NO: 3999541 - RNA, 16 nt, Human herpesvirus 7
gccucugccucuuggc

SEQ ID NO: 3999542 - RNA, 22 nt, Human herpesvirus 7
gcgcaaaggaaaaaugcugcuc

SEQ ID NO: 3999543 - RNA, 14 nt, Human herpesvirus 7
gcgcaguguuuaaa

SEQ ID NO: 3999544 - RNA, 16 nt, Human herpesvirus 7
gcgccaaaaaaacaca

SEQ ID NO: 3999545 - RNA, 17 nt, Human herpesvirus 7
gcggaguuugaguuucu

SEQ ID NO: 3999546 - RNA, 15 nt, Human herpesvirus 7
gcggauuaagagaaa

SEQ ID NO: 3999547 - RNA, 22 nt, Human herpesvirus 7
gcuaacgauccaguacuugcau

SEQ ID NO: 3999548 - RNA, 13 nt, Human herpesvirus 7
gcuaucugauuua

SEQ ID NO: 3999549 - RNA, 23 nt, Human herpesvirus 7
gcuauuuaaucuaugcaaagcaa

SEQ ID NO: 3999550 - RNA, 16 nt, Human herpesvirus 7
gcucagcuagaaugug

SEQ ID NO: 3999551 - RNA, 18 nt, Human herpesvirus 7
gcucauuucaucauccga

SEQ ID NO: 3999552 - RNA, 19 nt, Human herpesvirus 7
gcugaauuguacguucuga

SEQ ID NO: 3999553 - RNA, 21 nt, Human herpesvirus 7
gcugguaauaauaguggugaa

SEQ ID NO: 3999554 - RNA, 12 nt, Human herpesvirus 7
gcuguuuggaaa

SEQ ID NO: 3999555 - RNA, 16 nt, Human herpesvirus 7
gcuucaaaaauguuua

SEQ ID NO: 3999556 - RNA, 23 nt, Human herpesvirus 7
gcuugaugaaucaaaauuagacg

SEQ ID NO: 3999557 - RNA, 20 nt, Human herpesvirus 7
gcuugcuuaaaacuuugaaa

SEQ ID NO: 3999558 - RNA, 15 nt, Human herpesvirus 7
gcuuuagaauuagag

SEQ ID NO: 3999559 - RNA, 19 nt, Human herpesvirus 7
gcuuucguuuauaaacucu

SEQ ID NO: 3999560 - RNA, 17 nt, Human herpesvirus 7
ggaaaaaggauuugaag

SEQ ID NO: 3999561 - RNA, 22 nt, Human herpesvirus 7
ggaaauuuucauagcacucaua

SEQ ID NO: 3999562 - RNA, 15 nt, Human herpesvirus 7
ggaagaacaagcaaa

SEQ ID NO: 3999563 - RNA, 16 nt, Human herpesvirus 7
ggacaauuauuuaaac

SEQ ID NO: 3999564 - RNA, 19 nt, Human herpesvirus 7
ggacacaaucagcauuuac

SEQ ID NO: 3999565 - RNA, 14 nt, Human herpesvirus 7
ggacagucaacaaa

SEQ ID NO: 3999566 - RNA, 19 nt, Human herpesvirus 7
ggagacgaugagcaugaaa

SEQ ID NO: 3999567 - RNA, 23 nt, Human herpesvirus 7
ggagcuucauuuuaaaaaagaca

SEQ ID NO: 3999568 - RNA, 16 nt, Human herpesvirus 7
ggaggugcuguuucca

SEQ ID NO: 3999569 - RNA, 23 nt, Human herpesvirus 7
ggagugcgcggauuaagagaaaa

SEQ ID NO: 3999570 - RNA, 12 nt, Human herpesvirus 7
ggcaacaucuuc

SEQ ID NO: 3999571 - RNA, 12 nt, Human herpesvirus 7
ggcgccaaaaaa

SEQ ID NO: 3999572 - RNA, 14 nt, Human herpesvirus 7
ggcucuuaauaauu

SEQ ID NO: 3999573 - RNA, 13 nt, Human herpesvirus 7
gggacaauuauuu

SEQ ID NO: 3999574 - RNA, 16 nt, Human herpesvirus 7
gggcuggagcuuuaaa

SEQ ID NO: 3999575 - RNA, 10 nt, Human herpesvirus 7
ggugaagauc

SEQ ID NO: 3999576 - RNA, 18 nt, Human herpesvirus 7
gguuuuaaaauagaaaau

SEQ ID NO: 3999577 - RNA, 16 nt, Human herpesvirus 7
guaaaagaucuuuuaa

SEQ ID NO: 3999578 - RNA, 19 nt, Human herpesvirus 7
guaaauuuacuugauuuuc

SEQ ID NO: 3999579 - RNA, 23 nt, Human herpesvirus 7
guaacaaaggaucgaucucuguc

SEQ ID NO: 3999580 - RNA, 17 nt, Human herpesvirus 7
guaauauaauuauuuua

SEQ ID NO: 3999581 - RNA, 16 nt, Human herpesvirus 7
guacgagcgauuuaau

SEQ ID NO: 3999582 - RNA, 14 nt, Human herpesvirus 7
guagaaaauguuuu

SEQ ID NO: 3999583 - RNA, 22 nt, Human herpesvirus 7
guagauggcaccaauagaaaac

SEQ ID NO: 3999584 - RNA, 17 nt, Human herpesvirus 7
guagauuuagauuuaaa

SEQ ID NO: 3999585 - RNA, 14 nt, Human herpesvirus 7
guaugaaaaaaaca

SEQ ID NO: 3999586 - RNA, 19 nt, Human herpesvirus 7
guauugccuuucccagaag

SEQ ID NO: 3999587 - RNA, 15 nt, Human herpesvirus 7
gucaaaaaaaauuaa

SEQ ID NO: 3999588 - RNA, 20 nt, Human herpesvirus 7
gucagaacaucccuggacag

SEQ ID NO: 3999589 - RNA, 22 nt, Human herpesvirus 7
gucagaacaucccuggacagag

SEQ ID NO: 3999590 - RNA, 15 nt, Human herpesvirus 7
gucaucacuuaugau

SEQ ID NO: 3999591 - RNA, 15 nt, Human herpesvirus 7
gucaugcuguauguu

SEQ ID NO: 3999592 - RNA, 16 nt, Human herpesvirus 7
gucauuauuuguuaaa

SEQ ID NO: 3999593 - RNA, 18 nt, Human herpesvirus 7
guccagauccaucuguaa

SEQ ID NO: 3999594 - RNA, 20 nt, Human herpesvirus 7
guccuucaauagcagagaau

SEQ ID NO: 3999595 - RNA, 15 nt, Human herpesvirus 7
gucuaaaaauguuuu

SEQ ID NO: 3999596 - RNA, 23 nt, Human herpesvirus 7
gucucagagaacuagaacagcug

SEQ ID NO: 3999597 - RNA, 23 nt, Human herpesvirus 7
gugaacccauagaagaaugcaag

SEQ ID NO: 3999598 - RNA, 18 nt, Human herpesvirus 7
gugaagacuacauaaagg

SEQ ID NO: 3999599 - RNA, 19 nt, Human herpesvirus 7
gugauuguagauggcacca

SEQ ID NO: 3999600 - RNA, 22 nt, Human herpesvirus 7
guggaaaucuuuaauaaaaaca

SEQ ID NO: 3999601 - RNA, 15 nt, Human herpesvirus 7
gugucucuagaaaau

SEQ ID NO: 3999602 - RNA, 12 nt, Human herpesvirus 7
gugugcaaugau

SEQ ID NO: 3999603 - RNA, 15 nt, Human herpesvirus 7
guguguuaaaugcga

SEQ ID NO: 3999604 - RNA, 14 nt, Human herpesvirus 7
guguuguaauaauu

SEQ ID NO: 3999605 - RNA, 15 nt, Human herpesvirus 7
guuaaugucucuguu

SEQ ID NO: 3999606 - RNA, 19 nt, Human herpesvirus 7
guuaauugugguacaacaa

SEQ ID NO: 3999607 - RNA, 15 nt, Human herpesvirus 7
guucuaucucaaaac

SEQ ID NO: 3999608 - RNA, 12 nt, Human herpesvirus 7
guugaaauuaag

SEQ ID NO: 3999609 - RNA, 14 nt, Human herpesvirus 7
guugcugcugucuu

SEQ ID NO: 3999610 - RNA, 12 nt, Human herpesvirus 7
guuguuggaaau

SEQ ID NO: 3999611 - RNA, 15 nt, Human herpesvirus 7
guuuaaaggugguua

SEQ ID NO: 3999612 - RNA, 16 nt, Human herpesvirus 7
guuuacuuauguguua

SEQ ID NO: 3999613 - RNA, 13 nt, Human herpesvirus 7
guuuaugaacaag

SEQ ID NO: 3999614 - RNA, 12 nt, Human herpesvirus 7
guuucaaaaagu

SEQ ID NO: 3999615 - RNA, 17 nt, Human herpesvirus 7
guuuccgcauaaaaaau

SEQ ID NO: 3999616 - RNA, 14 nt, Human herpesvirus 7
guuucuuucuuuua

SEQ ID NO: 3999617 - RNA, 18 nt, Human herpesvirus 7
guuugcgagccugugauc

SEQ ID NO: 3999618 - RNA, 20 nt, Human herpesvirus 7
guuuggaaaaguugaagaaa

SEQ ID NO: 3999619 - RNA, 16 nt, Human herpesvirus 7
guuuuaugacucagac

SEQ ID NO: 3999620 - RNA, 14 nt, Human herpesvirus 7
guuuucuuuguaaa

SEQ ID NO: 3999621 - RNA, 18 nt, Human herpesvirus 7
guuuucuuuguaaaaaug

SEQ ID NO: 3999622 - RNA, 20 nt, Human herpesvirus 7
guuuugaaaagucauuauuu

SEQ ID NO: 3999623 - RNA, 16 nt, Human herpesvirus 7
uaaaaauccuaaauuu

SEQ ID NO: 3999624 - RNA, 14 nt, Human herpesvirus 7
uaaaagguguuuuu

SEQ ID NO: 3999625 - RNA, 15 nt, Human herpesvirus 7
uaaaauagaaaaugu

SEQ ID NO: 3999626 - RNA, 17 nt, Human herpesvirus 7
uaaaccaaauauaugcu

SEQ ID NO: 3999627 - RNA, 17 nt, Human herpesvirus 7
uaaacuugugaaaauaa

SEQ ID NO: 3999628 - RNA, 21 nt, Human herpesvirus 7
uaaagagaaaguaaaagcuau

SEQ ID NO: 3999629 - RNA, 14 nt, Human herpesvirus 7
uaaaggaaacauuu

SEQ ID NO: 3999630 - RNA, 22 nt, Human herpesvirus 7
uaaaguacccgcuuauuaguga

SEQ ID NO: 3999631 - RNA, 14 nt, Human herpesvirus 7
uaaauaauaacaau

SEQ ID NO: 3999632 - RNA, 18 nt, Human herpesvirus 7
uaaauaucccuagaagau

SEQ ID NO: 3999633 - RNA, 19 nt, Human herpesvirus 7
uaaauauuuuuaaaaucua

SEQ ID NO: 3999634 - RNA, 15 nt, Human herpesvirus 7
uaacaaaauuguaag

SEQ ID NO: 3999635 - RNA, 21 nt, Human herpesvirus 7
uguguuggaaacuauucgaaa

SEQ ID NO: 3999636 - RNA, 19 nt, Human herpesvirus 7
uguguuuuaucuaccauca

SEQ ID NO: 3999637 - RNA, 17 nt, Human herpesvirus 7
uguuaaccaaaaugugg

SEQ ID NO: 3999638 - RNA, 20 nt, Human herpesvirus 7
uguucaaucacauacucuau

SEQ ID NO: 3999639 - RNA, 14 nt, Human herpesvirus 7
uguucuaucaagau

SEQ ID NO: 3999640 - RNA, 13 nt, Human herpesvirus 7
uguucuguuuauu

SEQ ID NO: 3999641 - RNA, 18 nt, Human herpesvirus 7
uguugaguacgaaagaau

SEQ ID NO: 3999642 - RNA, 16 nt, Human herpesvirus 7
uguugccuucuaaaac

SEQ ID NO: 3999643 - RNA, 12 nt, Human herpesvirus 7
uguugcuuuuuc

SEQ ID NO: 3999644 - RNA, 19 nt, Human herpesvirus 7
uguuguagguaauuucuua

SEQ ID NO: 3999645 - RNA, 15 nt, Human herpesvirus 7
uguuucuuucuuuua

SEQ ID NO: 3999646 - RNA, 22 nt, Human herpesvirus 7
uguuugaacaaguagugcuaau

SEQ ID NO: 3999647 - RNA, 14 nt, Human herpesvirus 7
uguuuguaaacauu

SEQ ID NO: 3999648 - RNA, 15 nt, Human herpesvirus 7
uguuuuuauuaauuu

SEQ ID NO: 3999649 - RNA, 19 nt, Human herpesvirus 7
uuaaaaaagugauugcaga

SEQ ID NO: 3999650 - RNA, 15 nt, Human herpesvirus 7
uuaaaaugggaaugu

SEQ ID NO: 3999651 - RNA, 16 nt, Human herpesvirus 7
uuaaaauuaaaacuug

SEQ ID NO: 3999652 - RNA, 12 nt, Human herpesvirus 7
uuaaaauuauua

SEQ ID NO: 3999653 - RNA, 22 nt, Human herpesvirus 7
uuaaacaaucuggacauuucaa

SEQ ID NO: 3999654 - RNA, 18 nt, Human herpesvirus 7
uuaaacuugugaaaauaa

SEQ ID NO: 3999655 - RNA, 13 nt, Human herpesvirus 7
uuaaaggaaauaa

SEQ ID NO: 3999656 - RNA, 17 nt, Human herpesvirus 7
uuaaauuauuauuagua

SEQ ID NO: 3999657 - RNA, 19 nt, Human herpesvirus 7
uuaaauuauuauuaguauu

SEQ ID NO: 3999658 - RNA, 18 nt, Human herpesvirus 7
uuaaccagauauuaguuu

SEQ ID NO: 3999659 - RNA, 14 nt, Human herpesvirus 7
uuaagauacauuuu

SEQ ID NO: 3999660 - RNA, 17 nt, Human herpesvirus 7
uuaaggagcuucauuuu

SEQ ID NO: 3999661 - RNA, 23 nt, Human herpesvirus 7
uuaaguaaggaagguacaucuuu

SEQ ID NO: 3999662 - RNA, 21 nt, Human herpesvirus 7
uuaauaaaaaacaaauaacug

SEQ ID NO: 3999663 - RNA, 21 nt, Human herpesvirus 7
uuaauacguccaaaaauugga

SEQ ID NO: 3999664 - RNA, 14 nt, Human herpesvirus 7
uuaauauuaguauu

SEQ ID NO: 3999665 - RNA, 15 nt, Human herpesvirus 7
uuaauggaagaacaa

SEQ ID NO: 3999666 - RNA, 13 nt, Human herpesvirus 7
uuaaugucucugu

SEQ ID NO: 3999667 - RNA, 19 nt, Human herpesvirus 7
uuacaaggugacagagggc

SEQ ID NO: 3999668 - RNA, 21 nt, Human herpesvirus 7
uuacaagucaucgguuuucug

SEQ ID NO: 3999669 - RNA, 21 nt, Human herpesvirus 7
uuacacaaauugauccugcua

SEQ ID NO: 3999670 - RNA, 18 nt, Human herpesvirus 7
uuacacaggaauugcugu

SEQ ID NO: 3999671 - RNA, 16 nt, Human herpesvirus 7
uuacacugauuucuac

SEQ ID NO: 3999672 - RNA, 17 nt, Human herpesvirus 7
uuacagaagaacauuua

SEQ ID NO: 3999673 - RNA, 16 nt, Human herpesvirus 7
uuacauuacuggaugu

SEQ ID NO: 3999674 - RNA, 13 nt, Human herpesvirus 7
uuacauugcaguc

SEQ ID NO: 3999675 - RNA, 23 nt, Human herpesvirus 7
uuacguacauggacauaagaauc

SEQ ID NO: 3999676 - RNA, 14 nt, Human herpesvirus 7
uuacuuucauagcu

SEQ ID NO: 3999677 - RNA, 14 nt, Human herpesvirus 7
uuagaauuuuuucu

SEQ ID NO: 3999678 - RNA, 17 nt, Human herpesvirus 7
uuagacgacgucuucuu

SEQ ID NO: 3999679 - RNA, 18 nt, Human herpesvirus 7
uuagaugcugaaacauca

SEQ ID NO: 3999680 - RNA, 17 nt, Human herpesvirus 7
uuauaaugauguaaugu

SEQ ID NO: 3999681 - RNA, 22 nt, Human herpesvirus 7
uuauaauguaagaaauuuucuu

SEQ ID NO: 3999682 - RNA, 14 nt, Human herpesvirus 7
uuauauuuuaagua

SEQ ID NO: 3999683 - RNA, 17 nt, Human herpesvirus 7
uuaucaaugccuguuuu

SEQ ID NO: 3999684 - RNA, 18 nt, Human herpesvirus 7
uuaucauuucaaauguag

SEQ ID NO: 3999685 - RNA, 14 nt, Human herpesvirus 7
uuaugaugcauuuu

SEQ ID NO: 3999686 - RNA, 18 nt, Human herpesvirus 7
uuauuagugaauuacaga

SEQ ID NO: 3999687 - RNA, 13 nt, Human herpesvirus 7
uuauuauguguac

SEQ ID NO: 3999688 - RNA, 16 nt, Human herpesvirus 7
uucaaaggaaaaauuu

SEQ ID NO: 3999689 - RNA, 12 nt, Human herpesvirus 7
uucaaguuucuu

SEQ ID NO: 3999690 - RNA, 16 nt, Human herpesvirus 7
uucaaucaaauuauac

SEQ ID NO: 3999691 - RNA, 23 nt, Human herpesvirus 7
uucaaucaaauuauaccucagcu

SEQ ID NO: 3999692 - RNA, 14 nt, Human herpesvirus 7
uucaaucuacugua

SEQ ID NO: 3999693 - RNA, 12 nt, Human herpesvirus 7
uucaauugccac

SEQ ID NO: 3999694 - RNA, 15 nt, Human herpesvirus 7
uucagaaaaaccauu

SEQ ID NO: 3999695 - RNA, 14 nt, Human herpesvirus 7
uucagcgugacaga

SEQ ID NO: 3999696 - RNA, 16 nt, Human herpesvirus 7
uucaguaucacuuaaa

SEQ ID NO: 3999697 - RNA, 22 nt, Human herpesvirus 7
uucaucaggacaaucaaacaug

SEQ ID NO: 3999698 - RNA, 15 nt, Human herpesvirus 7
uucauuuuuuucuua

SEQ ID NO: 3999699 - RNA, 15 nt, Human herpesvirus 7
uuccauuucaaaaga

SEQ ID NO: 3999700 - RNA, 20 nt, Human herpesvirus 7
uuccuaaaaaaaaaggaaaa

SEQ ID NO: 3999701 - RNA, 16 nt, Human herpesvirus 7
uuccuucuaaauucuu

SEQ ID NO: 3999702 - RNA, 18 nt, Human herpesvirus 7
uuccuuggaaaaaugaug

SEQ ID NO: 3999703 - RNA, 21 nt, Human herpesvirus 7
uucgagaaaauuuagcaccaa

SEQ ID NO: 3999704 - RNA, 13 nt, Human herpesvirus 7
uucgaucuguaaa

SEQ ID NO: 3999705 - RNA, 14 nt, Human herpesvirus 7
uucgccugaagaga

SEQ ID NO: 3999706 - RNA, 21 nt, Human herpesvirus 7
uucgcuuaccuuuuuguuuuu

SEQ ID NO: 3999707 - RNA, 16 nt, Human herpesvirus 7
uucuagcguuucguua

SEQ ID NO: 3999708 - RNA, 14 nt, Human herpesvirus 7
uucuaggcuucauu

SEQ ID NO: 3999709 - RNA, 23 nt, Human herpesvirus 7
uucugaaauaaacauuucaaaau

SEQ ID NO: 3999710 - RNA, 19 nt, Human herpesvirus 7
uucugagugauuuuucauu

SEQ ID NO: 3999711 - RNA, 20 nt, Human herpesvirus 7
uucuggaucugccucugccu

SEQ ID NO: 3999712 - RNA, 17 nt, Human herpesvirus 7
uucuugauguaacaaag

SEQ ID NO: 3999713 - RNA, 18 nt, Human herpesvirus 7
uucuuugaaauagugucu

SEQ ID NO: 3999714 - RNA, 14 nt, Human herpesvirus 7
uucuuuuucaagau

SEQ ID NO: 3999715 - RNA, 22 nt, Human herpesvirus 7
uugaaaaagcguugguugcuug

SEQ ID NO: 3999716 - RNA, 19 nt, Human herpesvirus 7
uugaaaguaaaaacuuuuc

SEQ ID NO: 3999717 - RNA, 16 nt, Human herpesvirus 7
uugaaauagugucugu

SEQ ID NO: 3999718 - RNA, 15 nt, Human herpesvirus 7
uugaaauucugugga

SEQ ID NO: 3999719 - RNA, 15 nt, Human herpesvirus 7
uugaacagaauuuuc

SEQ ID NO: 3999720 - RNA, 17 nt, Human herpesvirus 7
uugaacuuguuuugacu

SEQ ID NO: 3999721 - RNA, 19 nt, Human herpesvirus 7
uugaauucguuaagcaccg

SEQ ID NO: 3999722 - RNA, 17 nt, Human herpesvirus 7
uugauaaaauuuggaga

SEQ ID NO: 3999723 - RNA, 14 nt, Human herpesvirus 7
uugaucgucuguug

SEQ ID NO: 3999724 - RNA, 16 nt, Human herpesvirus 7
uugaucguguguuacu

SEQ ID NO: 3999725 - RNA, 18 nt, Human herpesvirus 7
uugauuuucaaguuucuu

SEQ ID NO: 3999726 - RNA, 16 nt, Human herpesvirus 7
uugcaguuauuucuua

SEQ ID NO: 3999727 - RNA, 23 nt, Human herpesvirus 7
uugcauauuuugcuagaaacguc

SEQ ID NO: 3999728 - RNA, 9 nt, Human herpesvirus 7
uugccuuca

SEQ ID NO: 3999729 - RNA, 15 nt, Human herpesvirus 7
uugcucauguugacg

SEQ ID NO: 3999730 - RNA, 17 nt, Human herpesvirus 7
uugcugaacucugucau

SEQ ID NO: 3999731 - RNA, 19 nt, Human herpesvirus 7
uugcugguggguuuugaaa

SEQ ID NO: 3999732 - RNA, 16 nt, Human herpesvirus 7
uugcuuaaaaacagua

SEQ ID NO: 3999733 - RNA, 14 nt, Human herpesvirus 7
uugcuuaacuuuug

SEQ ID NO: 3999734 - RNA, 17 nt, Human herpesvirus 7
uuggacuguuagacuuu

SEQ ID NO: 3999735 - RNA, 23 nt, Human herpesvirus 7
uuggaguaaucaauaaaauuaaa

SEQ ID NO: 3999736 - RNA, 19 nt, Human herpesvirus 7
uuggauugauuuucaaguu

SEQ ID NO: 3999737 - RNA, 18 nt, Human herpesvirus 7
uuguaaauucuccaauca

SEQ ID NO: 3999738 - RNA, 22 nt, Human herpesvirus 7
uuguaggaaauuuucauagcac

SEQ ID NO: 3999739 - RNA, 22 nt, Human herpesvirus 7
uuguagguaauuucuuauaauu

SEQ ID NO: 3999740 - RNA, 23 nt, Human herpesvirus 7
uuguaucuaugaaauaaaauuuu

SEQ ID NO: 3999741 - RNA, 20 nt, Human herpesvirus 7
uugucacugcaaauuguaaa

SEQ ID NO: 3999742 - RNA, 18 nt, Human herpesvirus 7
uuguccauuuuauucaaa

SEQ ID NO: 3999743 - RNA, 18 nt, Human herpesvirus 7
uugugaagacuacauaaa

SEQ ID NO: 3999744 - RNA, 18 nt, Human herpesvirus 7
uuguguggcaacaucuuc

SEQ ID NO: 3999745 - RNA, 20 nt, Human herpesvirus 7
uuguuuccgaucuaaagaca

SEQ ID NO: 3999746 - RNA, 18 nt, Human herpesvirus 7
uuguuugcuauuauuaaa

SEQ ID NO: 3999747 - RNA, 17 nt, Human herpesvirus 7
uuuaaaaaagaauuugg

SEQ ID NO: 3999748 - RNA, 16 nt, Human herpesvirus 7
uuuaaagggggaaaga

SEQ ID NO: 3999749 - RNA, 21 nt, Human herpesvirus 7
uuuaaauaaaccuuaaguuuu

SEQ ID NO: 3999750 - RNA, 14 nt, Human herpesvirus 7
ucguuuguguagaa

SEQ ID NO: 3999751 - RNA, 14 nt, Human herpesvirus 7
ucuaaaauuuucuu

SEQ ID NO: 3999752 - RNA, 20 nt, Human herpesvirus 7
ucuaaaguggagacaaucua

SEQ ID NO: 3999753 - RNA, 22 nt, Human herpesvirus 7
ucuacacaucuucaauguucga

SEQ ID NO: 3999754 - RNA, 16 nt, Human herpesvirus 7
ucuacuaaggugucuu

SEQ ID NO: 3999755 - RNA, 17 nt, Human herpesvirus 7
ucuauuagauaaugaca

SEQ ID NO: 3999756 - RNA, 16 nt, Human herpesvirus 7
ucuauuguucuuucaa

SEQ ID NO: 3999757 - RNA, 21 nt, Human herpesvirus 7
ucuauuucaauuaaugcauug

SEQ ID NO: 3999758 - RNA, 17 nt, Human herpesvirus 7
ucucuaaaauuuucuua

SEQ ID NO: 3999759 - RNA, 18 nt, Human herpesvirus 7
ucugccucugccucuugg

SEQ ID NO: 3999760 - RNA, 21 nt, Human herpesvirus 7
ucuggaacuuuuaaauuaaaa

SEQ ID NO: 3999761 - RNA, 14 nt, Human herpesvirus 7
ucuggaucugccuc

SEQ ID NO: 3999762 - RNA, 15 nt, Human herpesvirus 7
ucuggaugaaaacug

SEQ ID NO: 3999763 - RNA, 15 nt, Human herpesvirus 7
ucugugacuuagaaa

SEQ ID NO: 3999764 - RNA, 21 nt, Human herpesvirus 7
ucuguuaguugggcaaacagu

SEQ ID NO: 3999765 - RNA, 18 nt, Human herpesvirus 7
ucuuaaaauauguucaga

SEQ ID NO: 3999766 - RNA, 20 nt, Human herpesvirus 7
ucuuagccagaucguucauu

SEQ ID NO: 3999767 - RNA, 21 nt, Human herpesvirus 7
ucuuaugccagguuuuucaaa

SEQ ID NO: 3999768 - RNA, 14 nt, Human herpesvirus 7
ucuuccgcauuuug

SEQ ID NO: 3999769 - RNA, 17 nt, Human herpesvirus 7
ucuuggaguuugucuca

SEQ ID NO: 3999770 - RNA, 22 nt, Human herpesvirus 7
ucuuucaacugauauaaaugcu

SEQ ID NO: 3999771 - RNA, 17 nt, Human herpesvirus 7
ucuuugacaaaaauguu

SEQ ID NO: 3999772 - RNA, 17 nt, Human herpesvirus 7
ugaaaaaaacacuuugc

SEQ ID NO: 3999773 - RNA, 18 nt, Human herpesvirus 7
ugaaaacuuagugaugac

SEQ ID NO: 3999774 - RNA, 18 nt, Human herpesvirus 7
ugaaaagcccaaacuguu

SEQ ID NO: 3999775 - RNA, 18 nt, Human herpesvirus 7
ugaaaccuucgcaacaau

SEQ ID NO: 3999776 - RNA, 20 nt, Human herpesvirus 7
ugaaaccuucgcaacaauua

SEQ ID NO: 3999777 - RNA, 18 nt, Human herpesvirus 7
ugaaauaaacauuucaaa

SEQ ID NO: 3999778 - RNA, 11 nt, Human herpesvirus 7
ugaaauuguag

SEQ ID NO: 3999779 - RNA, 14 nt, Human herpesvirus 7
ugaacaaauaauga

SEQ ID NO: 3999780 - RNA, 16 nt, Human herpesvirus 7
ugaacaaauaaugagu

SEQ ID NO: 3999781 - RNA, 22 nt, Human herpesvirus 7
ugaacacuuuuacgugacuguc

SEQ ID NO: 3999782 - RNA, 15 nt, Human herpesvirus 7
ugaacucugucauca

SEQ ID NO: 3999783 - RNA, 21 nt, Human herpesvirus 7
ugaagagcuuuuuaaguaaau

SEQ ID NO: 3999784 - RNA, 12 nt, Human herpesvirus 7
ugaaugugcuuu

SEQ ID NO: 3999785 - RNA, 19 nt, Human herpesvirus 7
ugaauuaagguggaaaucu

SEQ ID NO: 3999786 - RNA, 13 nt, Human herpesvirus 7
ugaauuugaaacu

SEQ ID NO: 3999787 - RNA, 14 nt, Human herpesvirus 7
ugacacgacacuga

SEQ ID NO: 3999788 - RNA, 23 nt, Human herpesvirus 7
ugacagacacaugcuuacagauc

SEQ ID NO: 3999789 - RNA, 19 nt, Human herpesvirus 7
ugacauuaguucuggccgu

SEQ ID NO: 3999790 - RNA, 23 nt, Human herpesvirus 7
ugagaauguugagcuaucugauu

SEQ ID NO: 3999791 - RNA, 14 nt, Human herpesvirus 7
ugagcgcugaaaua

SEQ ID NO: 3999792 - RNA, 18 nt, Human herpesvirus 7
ugaggauuuugacaagcg

SEQ ID NO: 3999793 - RNA, 16 nt, Human herpesvirus 7
ugaguguguuaaaugc

SEQ ID NO: 3999794 - RNA, 16 nt, Human herpesvirus 7
ugauaauaagaugugu

SEQ ID NO: 3999795 - RNA, 14 nt, Human herpesvirus 7
ugauaaucaagaaa

SEQ ID NO: 3999796 - RNA, 15 nt, Human herpesvirus 7
ugauaugauuuccug

SEQ ID NO: 3999797 - RNA, 13 nt, Human herpesvirus 7
ugauccuccuugc

SEQ ID NO: 3999798 - RNA, 17 nt, Human herpesvirus 7
ugaugacaacaaagcau

SEQ ID NO: 3999799 - RNA, 22 nt, Human herpesvirus 7
ugaugauuauuauaacuuguaa

SEQ ID NO: 3999800 - RNA, 23 nt, Human herpesvirus 7
ugauguuauacauaaagagaaag

SEQ ID NO: 3999801 - RNA, 14 nt, Human herpesvirus 7
ugauucaacacucg

SEQ ID NO: 3999802 - RNA, 20 nt, Human herpesvirus 7
ugauucgcuaacuuugcuau

SEQ ID NO: 3999803 - RNA, 18 nt, Human herpesvirus 7
ugauugcgaccaaagauc

SEQ ID NO: 3999804 - RNA, 17 nt, Human herpesvirus 7
ugauuuuaaauuuacuu

SEQ ID NO: 3999805 - RNA, 14 nt, Human herpesvirus 7
ugauuuucuuacac

SEQ ID NO: 3999806 - RNA, 19 nt, Human herpesvirus 7
ugauuuuuuaguauucuca

SEQ ID NO: 3999807 - RNA, 18 nt, Human herpesvirus 7
ugcaauuuucacaaugga

SEQ ID NO: 3999808 - RNA, 21 nt, Human herpesvirus 7
ugcacuuagcuaauugagaaa

SEQ ID NO: 3999809 - RNA, 18 nt, Human herpesvirus 7
ugcagaaaaauccaaaau

SEQ ID NO: 3999810 - RNA, 16 nt, Human herpesvirus 7
ugcagucaaagauuuu

SEQ ID NO: 3999811 - RNA, 13 nt, Human herpesvirus 7
ugcaucugaauuu

SEQ ID NO: 3999812 - RNA, 17 nt, Human herpesvirus 7
ugccagguuuuucaaag

SEQ ID NO: 3999813 - RNA, 15 nt, Human herpesvirus 7
ugcccucagaacugu

SEQ ID NO: 3999814 - RNA, 18 nt, Human herpesvirus 7
ugcuaaggcgaaaaacac

SEQ ID NO: 3999815 - RNA, 18 nt, Human herpesvirus 7
ugcuaaggcuaaacucgu

SEQ ID NO: 3999816 - RNA, 19 nt, Human herpesvirus 7
ugcucuuugucuuugcucu

SEQ ID NO: 3999817 - RNA, 23 nt, Human herpesvirus 7
ugcuuacagaucuugcuuuagaa

SEQ ID NO: 3999818 - RNA, 13 nt, Human herpesvirus 7
ugcuucggaauuu

SEQ ID NO: 3999819 - RNA, 18 nt, Human herpesvirus 7
ugcuuguaggcagaaaug

SEQ ID NO: 3999820 - RNA, 14 nt, Human herpesvirus 7
ugcuugugaaggag

SEQ ID NO: 3999821 - RNA, 19 nt, Human herpesvirus 7
ugcuuuuagaaaaucaaaa

SEQ ID NO: 3999822 - RNA, 13 nt, Human herpesvirus 7
uggaaaaacagaa

SEQ ID NO: 3999823 - RNA, 20 nt, Human herpesvirus 7
uggaaaaacagaauguggua

SEQ ID NO: 3999824 - RNA, 16 nt, Human herpesvirus 7
uggaaagcuugugaag

SEQ ID NO: 3999825 - RNA, 16 nt, Human herpesvirus 7
uggaaaugagauuucu

SEQ ID NO: 3999826 - RNA, 21 nt, Human herpesvirus 7
uggaacugaaaacaaugcaga

SEQ ID NO: 3999827 - RNA, 19 nt, Human herpesvirus 7
uggacaaaaauaaaguuua

SEQ ID NO: 3999828 - RNA, 22 nt, Human herpesvirus 7
uggacggcauuuaacucaugcg

SEQ ID NO: 3999829 - RNA, 19 nt, Human herpesvirus 7
uggagauaguucgcaaugg

SEQ ID NO: 3999830 - RNA, 18 nt, Human herpesvirus 7
uggaucguagcaacagag

SEQ ID NO: 3999831 - RNA, 21 nt, Human herpesvirus 7
uggcacauaaguugacaaugu

SEQ ID NO: 3999832 - RNA, 13 nt, Human herpesvirus 7
uggcaccaauaga

SEQ ID NO: 3999833 - RNA, 20 nt, Human herpesvirus 7
uggcagcgauauauuggaaa

SEQ ID NO: 3999834 - RNA, 12 nt, Human herpesvirus 7
ugguaaaaagac

SEQ ID NO: 3999835 - RNA, 13 nt, Human herpesvirus 7
ugguaaugucaua

SEQ ID NO: 3999836 - RNA, 19 nt, Human herpesvirus 7
ugguaauuaauaaacagcg

SEQ ID NO: 3999837 - RNA, 16 nt, Human herpesvirus 7
ugguaccuuagaauca

SEQ ID NO: 3999838 - RNA, 16 nt, Human herpesvirus 7
ugguauugucuacaau

SEQ ID NO: 3999839 - RNA, 16 nt, Human herpesvirus 7
ugguugauuugagcag

SEQ ID NO: 3999840 - RNA, 15 nt, Human herpesvirus 7
ugguuggauuucaau

SEQ ID NO: 3999841 - RNA, 12 nt, Human herpesvirus 7
ugguugugcaau

SEQ ID NO: 3999842 - RNA, 22 nt, Human herpesvirus 7
uguaaccuuggcuguucaaaau

SEQ ID NO: 3999843 - RNA, 20 nt, Human herpesvirus 7
uguaaucaaaauuuuggauu

SEQ ID NO: 3999844 - RNA, 17 nt, Human herpesvirus 7
uguaaugaauaaaaucu

SEQ ID NO: 3999845 - RNA, 17 nt, Human herpesvirus 7
uguacuuuugaucaaaa

SEQ ID NO: 3999846 - RNA, 17 nt, Human herpesvirus 7
uguagaugcaugcuaau

SEQ ID NO: 3999847 - RNA, 24 nt, Human herpesvirus 7
uguauaaaucagaauauuuccagc

SEQ ID NO: 3999848 - RNA, 13 nt, Human herpesvirus 7
uguauaugccugu

SEQ ID NO: 3999849 - RNA, 21 nt, Human herpesvirus 7
uguaugaaauaauagaugucu

SEQ ID NO: 3999850 - RNA, 17 nt, Human herpesvirus 7
uguauugucuuacagca

SEQ ID NO: 3999851 - RNA, 20 nt, Human herpesvirus 7
uguauuuguugaucuucaau

SEQ ID NO: 3999852 - RNA, 10 nt, Human herpesvirus 7
ugucauacaa

SEQ ID NO: 3999853 - RNA, 17 nt, Human herpesvirus 7
uguccaaucaaaaacug

SEQ ID NO: 3999854 - RNA, 17 nt, Human herpesvirus 7
uguccauuuuauucaaa

SEQ ID NO: 3999855 - RNA, 15 nt, Human herpesvirus 7
ugucuaagguuuuua

SEQ ID NO: 3999856 - RNA, 15 nt, Human herpesvirus 7
ugucucauugacaug

SEQ ID NO: 3999857 - RNA, 15 nt, Human herpesvirus 7
ugucuggaacuuuua

SEQ ID NO: 3999858 - RNA, 14 nt, Human herpesvirus 7
ugugaaaauaacag

SEQ ID NO: 3999859 - RNA, 17 nt, Human herpesvirus 7
ugugaaaauaacaggaa

SEQ ID NO: 3999860 - RNA, 14 nt, Human herpesvirus 7
ugugaacugauguu

SEQ ID NO: 3999861 - RNA, 19 nt, Human herpesvirus 7
ugugcaauuuggcucugau

SEQ ID NO: 3999862 - RNA, 17 nt, Human herpesvirus 7
ugugcgaagguugucug

SEQ ID NO: 3999863 - RNA, 17 nt, Human herpesvirus 7
uguggagagauucaaac

SEQ ID NO: 3999864 - RNA, 22 nt, Human herpesvirus 7
uguguuacaugaucuuguaauu

SEQ ID NO: 3999865 - RNA, 21 nt, Human herpesvirus 7
agcauaugugagaaaacauua

SEQ ID NO: 3999866 - RNA, 21 nt, Human herpesvirus 7
agcauuauuguauaugaugac

SEQ ID NO: 3999867 - RNA, 17 nt, Human herpesvirus 7
agccacagauauucuaa

SEQ ID NO: 3999868 - RNA, 22 nt, Human herpesvirus 7
agccugguuuuguucccugcuc

SEQ ID NO: 3999869 - RNA, 18 nt, Human herpesvirus 7
agcgcaaaggaaaaaugc

SEQ ID NO: 3999870 - RNA, 20 nt, Human herpesvirus 7
agcgcaaaggaaaaaugcug

SEQ ID NO: 3999871 - RNA, 18 nt, Human herpesvirus 7
agcuaaaauuuugaaaua

SEQ ID NO: 3999872 - RNA, 13 nt, Human herpesvirus 7
agcucauuucauc

SEQ ID NO: 3999873 - RNA, 20 nt, Human herpesvirus 7
agcuugguuuuacaaauuaa

SEQ ID NO: 3999874 - RNA, 19 nt, Human herpesvirus 7
aggaaacacaauuguauuu

SEQ ID NO: 3999875 - RNA, 23 nt, Human herpesvirus 7
aggaauuucgcgagcugugucca

SEQ ID NO: 3999876 - RNA, 16 nt, Human herpesvirus 7
aggaccaauucuuuua

SEQ ID NO: 3999877 - RNA, 23 nt, Human herpesvirus 7
aggacuuuacacggucuuaucua

SEQ ID NO: 3999878 - RNA, 14 nt, Human herpesvirus 7
aggaucucucuuuc

SEQ ID NO: 3999879 - RNA, 11 nt, Human herpesvirus 7
aggaugaaagu

SEQ ID NO: 3999880 - RNA, 17 nt, Human herpesvirus 7
aggcagcgcuugauaca

SEQ ID NO: 3999881 - RNA, 16 nt, Human herpesvirus 7
aggccuuguaaaguaa

SEQ ID NO: 3999882 - RNA, 17 nt, Human herpesvirus 7
aggcuuuuagaaaucuu

SEQ ID NO: 3999883 - RNA, 18 nt, Human herpesvirus 7
agguaaaaaauaaauaua

SEQ ID NO: 3999884 - RNA, 15 nt, Human herpesvirus 7
agguaagaaaaauuu

SEQ ID NO: 3999885 - RNA, 14 nt, Human herpesvirus 7
aggucacaaaagcu

SEQ ID NO: 3999886 - RNA, 15 nt, Human herpesvirus 7
agguugcuucuucga

SEQ ID NO: 3999887 - RNA, 21 nt, Human herpesvirus 7
agguugcuucuucgagucagu

SEQ ID NO: 3999888 - RNA, 20 nt, Human herpesvirus 7
aguaaagggcugucugaagu

SEQ ID NO: 3999889 - RNA, 22 nt, Human herpesvirus 7
aguaagaagugaguuuuucagu

SEQ ID NO: 3999890 - RNA, 14 nt, Human herpesvirus 7
aguacaaauguuuu

SEQ ID NO: 3999891 - RNA, 14 nt, Human herpesvirus 7
aguacaucuuucua

SEQ ID NO: 3999892 - RNA, 17 nt, Human herpesvirus 7
agucaacacauaucuag

SEQ ID NO: 3999893 - RNA, 18 nt, Human herpesvirus 7
agucaaucacaguugcuu

SEQ ID NO: 3999894 - RNA, 22 nt, Human herpesvirus 7
agucgaaaugaaaagucuguga

SEQ ID NO: 3999895 - RNA, 15 nt, Human herpesvirus 7
agucuaaaaauguuu

SEQ ID NO: 3999896 - RNA, 16 nt, Human herpesvirus 7
agucucaauaguuuua

SEQ ID NO: 3999897 - RNA, 20 nt, Human herpesvirus 7
agugaacaugacuucagaaa

SEQ ID NO: 3999898 - RNA, 16 nt, Human herpesvirus 7
agugauugguagaaau

SEQ ID NO: 3999899 - RNA, 15 nt, Human herpesvirus 7
agugcuaugaaaauu

SEQ ID NO: 3999900 - RNA, 17 nt, Human herpesvirus 7
aguggcuuaaguuuuua

SEQ ID NO: 3999901 - RNA, 21 nt, Human herpesvirus 7
agugucuuuuauuacucgaaa

SEQ ID NO: 3999902 - RNA, 13 nt, Human herpesvirus 7
aguguuuaaaaug

SEQ ID NO: 3999903 - RNA, 16 nt, Human herpesvirus 7
aguguuuaaaauguua

SEQ ID NO: 3999904 - RNA, 15 nt, Human herpesvirus 7
aguuaauuuugcaga

SEQ ID NO: 3999905 - RNA, 23 nt, Human herpesvirus 7
aguuacacugauuuuuuuaauaa

SEQ ID NO: 3999906 - RNA, 16 nt, Human herpesvirus 7
aguucccauuuucaga

SEQ ID NO: 3999907 - RNA, 15 nt, Human herpesvirus 7
aguucguaaaaagaa

SEQ ID NO: 3999908 - RNA, 18 nt, Human herpesvirus 7
aguucuccgcacuaaaac

SEQ ID NO: 3999909 - RNA, 19 nt, Human herpesvirus 7
aguuucugcauacucuugu

SEQ ID NO: 3999910 - RNA, 21 nt, Human herpesvirus 7
aguuugucucauugacauguu

SEQ ID NO: 3999911 - RNA, 20 nt, Human herpesvirus 7
aguuuuggguuuaugaugca

SEQ ID NO: 3999912 - RNA, 19 nt, Human herpesvirus 7
auaaaccguuagagcaguu

SEQ ID NO: 3999913 - RNA, 23 nt, Human herpesvirus 7
auaaauacgcguggaaguguuaa

SEQ ID NO: 3999914 - RNA, 20 nt, Human herpesvirus 7
auaaauuuuucgaucuguaa

SEQ ID NO: 3999915 - RNA, 18 nt, Human herpesvirus 7
auaacaauauuuaaagua

SEQ ID NO: 3999916 - RNA, 16 nt, Human herpesvirus 7
auaacucaaaagacag

SEQ ID NO: 3999917 - RNA, 12 nt, Human herpesvirus 7
auaacugugaaa

SEQ ID NO: 3999918 - RNA, 18 nt, Human herpesvirus 7
auaacuucguaguguaga

SEQ ID NO: 3999919 - RNA, 18 nt, Human herpesvirus 7
auaauaaaaaagauguua

SEQ ID NO: 3999920 - RNA, 12 nt, Human herpesvirus 7
auaauagagcug

SEQ ID NO: 3999921 - RNA, 16 nt, Human herpesvirus 7
auaauagccuuucacu

SEQ ID NO: 3999922 - RNA, 14 nt, Human herpesvirus 7
auaaucaaaaaauu

SEQ ID NO: 3999923 - RNA, 18 nt, Human herpesvirus 7
auaauccucugacauuug

SEQ ID NO: 3999924 - RNA, 21 nt, Human herpesvirus 7
auaaucuugugaaguuugcug

SEQ ID NO: 3999925 - RNA, 15 nt, Human herpesvirus 7
auaauuaugaaaugu

SEQ ID NO: 3999926 - RNA, 16 nt, Human herpesvirus 7
auaauucaaucugcaa

SEQ ID NO: 3999927 - RNA, 14 nt, Human herpesvirus 7
auacagauauuuua

SEQ ID NO: 3999928 - RNA, 14 nt, Human herpesvirus 7
auacauuauaaaug

SEQ ID NO: 3999929 - RNA, 15 nt, Human herpesvirus 7
auacauuauaaaugu

SEQ ID NO: 3999930 - RNA, 15 nt, Human herpesvirus 7
auaccaaacaaaauu

SEQ ID NO: 3999931 - RNA, 13 nt, Human herpesvirus 7
auacgaaaacggu

SEQ ID NO: 3999932 - RNA, 21 nt, Human herpesvirus 7
auacguuauuuuuauuguaaa

SEQ ID NO: 3999933 - RNA, 22 nt, Human herpesvirus 7
auauaaacacuugcuagcugug

SEQ ID NO: 3999934 - RNA, 15 nt, Human herpesvirus 7
auauagaaauuguua

SEQ ID NO: 3999935 - RNA, 15 nt, Human herpesvirus 7
auauaucugauguag

SEQ ID NO: 3999936 - RNA, 22 nt, Human herpesvirus 7
auauauggcaauaaaucuguaa

SEQ ID NO: 3999937 - RNA, 14 nt, Human herpesvirus 7
auaucuaaagugga

SEQ ID NO: 3999938 - RNA, 12 nt, Human herpesvirus 7
auaucuaugaug

SEQ ID NO: 3999939 - RNA, 20 nt, Human herpesvirus 7
auaucuguuuuuuuucucgu

SEQ ID NO: 3999940 - RNA, 21 nt, Human herpesvirus 7
auaucuugcuuagaugcugaa

SEQ ID NO: 3999941 - RNA, 22 nt, Human herpesvirus 7
auaugaaucaaauuucaaacgu

SEQ ID NO: 3999942 - RNA, 16 nt, Human herpesvirus 7
auaugccaaugaacaa

SEQ ID NO: 3999943 - RNA, 19 nt, Human herpesvirus 7
auaugcuggaucuucugcu

SEQ ID NO: 3999944 - RNA, 19 nt, Human herpesvirus 7
auauuagaacgagagacaa

SEQ ID NO: 3999945 - RNA, 16 nt, Human herpesvirus 7
auauuccauuaagcca

SEQ ID NO: 3999946 - RNA, 23 nt, Human herpesvirus 7
auauuuucuacaacuaaaauuga

SEQ ID NO: 3999947 - RNA, 16 nt, Human herpesvirus 7
aucaaauuuaucucau

SEQ ID NO: 3999948 - RNA, 15 nt, Human herpesvirus 7
aucacaaaacucuuc

SEQ ID NO: 3999949 - RNA, 21 nt, Human herpesvirus 7
aucaguacaacgacauugaaa

SEQ ID NO: 3999950 - RNA, 18 nt, Human herpesvirus 7
aucagucaagaacuguga

SEQ ID NO: 3999951 - RNA, 13 nt, Human herpesvirus 7
aucauauaugcau

SEQ ID NO: 3999952 - RNA, 18 nt, Human herpesvirus 7
aucauuagucauacuuua

SEQ ID NO: 3999953 - RNA, 18 nt, Human herpesvirus 7
aucgacaaacagaaaaac

SEQ ID NO: 3999954 - RNA, 13 nt, Human herpesvirus 7
aucuaauugcaga

SEQ ID NO: 3999955 - RNA, 20 nt, Human herpesvirus 7
aucucucuuucuggaguuca

SEQ ID NO: 3999956 - RNA, 12 nt, Human herpesvirus 7
aucugagagaac

SEQ ID NO: 3999957 - RNA, 17 nt, Human herpesvirus 7
aucugauaaaaaaagaa

SEQ ID NO: 3999958 - RNA, 18 nt, Human herpesvirus 7
aucugauuuauauagcaa

SEQ ID NO: 3999959 - RNA, 19 nt, Human herpesvirus 7
aucuggaaucgaauacagu

SEQ ID NO: 3999960 - RNA, 14 nt, Human herpesvirus 7
aucuuaaaauacua

SEQ ID NO: 3999961 - RNA, 18 nt, Human herpesvirus 7
aucuucugaaucugcaaa

SEQ ID NO: 3999962 - RNA, 15 nt, Human herpesvirus 7
aucuuguaauuucuc

SEQ ID NO: 3999963 - RNA, 20 nt, Human herpesvirus 7
aucuuuacuuucauagcuua

SEQ ID NO: 3999964 - RNA, 15 nt, Human herpesvirus 7
aucuuugaaaaucuu

SEQ ID NO: 3999965 - RNA, 22 nt, Human herpesvirus 7
aucuuugaaaaucuugaauaaa

SEQ ID NO: 3999966 - RNA, 22 nt, Human herpesvirus 7
augaaaacuuggaaaacaauca

SEQ ID NO: 3999967 - RNA, 13 nt, Human herpesvirus 7
augaacaaauaau

SEQ ID NO: 3999968 - RNA, 16 nt, Human herpesvirus 7
augaacaaguuucaaa

SEQ ID NO: 3999969 - RNA, 9 nt, Human herpesvirus 7
augaagaua

SEQ ID NO: 3999970 - RNA, 19 nt, Human herpesvirus 7
augaugauuauuauaacuu

SEQ ID NO: 3999971 - RNA, 12 nt, Human herpesvirus 7
augcaaaacaaa

SEQ ID NO: 3999972 - RNA, 20 nt, Human herpesvirus 7
augcaagaaaguccaaagug

SEQ ID NO: 3999973 - RNA, 19 nt, Human herpesvirus 7
augcaaucaacaaaaugac

SEQ ID NO: 3999974 - RNA, 16 nt, Human herpesvirus 7
augcauuggaaaaaug

SEQ ID NO: 3999975 - RNA, 18 nt, Human herpesvirus 7
augccagaaauuaaauac

SEQ ID NO: 3999976 - RNA, 13 nt, Human herpesvirus 7
augcuaaaguuaa

SEQ ID NO: 3999977 - RNA, 22 nt, Human herpesvirus 7
augcuuccuaaaaaaaaaggaa

SEQ ID NO: 3999978 - RNA, 16 nt, Human herpesvirus 7
auggacaaaaauaaag

SEQ ID NO: 3999979 - RNA, 15 nt, Human herpesvirus 7
auggagcagcuuaag

SEQ ID NO: 3999980 - RNA, 15 nt, Human herpesvirus 7
augguugugcaauuu

SEQ ID NO: 3999981 - RNA, 17 nt, Human herpesvirus 7
auguaauuuaaauaauu

SEQ ID NO: 3999982 - RNA, 16 nt, Human herpesvirus 7
caauucaucaggacaa

SEQ ID NO: 3999983 - RNA, 16 nt, Human herpesvirus 7
caauugaguuuacugc

SEQ ID NO: 3999984 - RNA, 17 nt, Human herpesvirus 7
caauuuuaaugugcuua

SEQ ID NO: 3999985 - RNA, 13 nt, Human herpesvirus 7
cacaaauuucuug

SEQ ID NO: 3999986 - RNA, 22 nt, Human herpesvirus 7
cacaacauccagagucucuaaa

SEQ ID NO: 3999987 - RNA, 16 nt, Human herpesvirus 7
cacaauuacacaaauu

SEQ ID NO: 3999988 - RNA, 19 nt, Human herpesvirus 7
cacagaaacgucaggaaaa

SEQ ID NO: 3999989 - RNA, 14 nt, Human herpesvirus 7
cacagaaaucccaa

SEQ ID NO: 3999990 - RNA, 18 nt, Human herpesvirus 7
cacaguugaauaaagauu

SEQ ID NO: 3999991 - RNA, 22 nt, Human herpesvirus 7
cacauuccaaaaucaaguguuu

SEQ ID NO: 3999992 - RNA, 20 nt, Human herpesvirus 7
caccaaaaaauaaaaacaag

SEQ ID NO: 3999993 - RNA, 14 nt, Human herpesvirus 7
caccauuguucaac

SEQ ID NO: 3999994 - RNA, 19 nt, Human herpesvirus 7
cacccagucgucugcucaa

SEQ ID NO: 3999995 - RNA, 23 nt, Human herpesvirus 7
caccgaagcagggaaaaagcaua

SEQ ID NO: 3999996 - RNA, 18 nt, Human herpesvirus 7
cacgaucgucaucuucuc

SEQ ID NO: 3999997 - RNA, 14 nt, Human herpesvirus 7
cacgaugacuucca

SEQ ID NO: 3999998 - RNA, 19 nt, Human herpesvirus 7
cacgcucccauaaaacaag

SEQ ID NO: 3999999 - RNA, 16 nt, Human herpesvirus 7
cacuaauccaugacag

SEQ ID NO: 4000000 - RNA, 22 nt, Human herpesvirus 7
cacuaugccacaaaaaacuuug

SEQ ID NO: 4000001 - RNA, 15 nt, Human herpesvirus 7
cacuauuggacaaaa

SEQ ID NO: 4000002 - RNA, 16 nt, Human herpesvirus 7
cacugcaaauuguaaa

SEQ ID NO: 4000003 - RNA, 17 nt, Human herpesvirus 7
cacugggagcaaugcau

SEQ ID NO: 4000004 - RNA, 15 nt, Human herpesvirus 7
cacuguugaugauuu

SEQ ID NO: 4000005 - RNA, 16 nt, Human herpesvirus 7
cagaaacaccccuugc

SEQ ID NO: 4000006 - RNA, 15 nt, Human herpesvirus 7
cagaacaucugucag

SEQ ID NO: 4000007 - RNA, 20 nt, Human herpesvirus 7
cagaaguaacgcagacuaau

SEQ ID NO: 4000008 - RNA, 18 nt, Human herpesvirus 7
cagaauacuacucagaag

SEQ ID NO: 4000009 - RNA, 19 nt, Human herpesvirus 7
cagaauauuuccagcauca

SEQ ID NO: 4000010 - RNA, 16 nt, Human herpesvirus 7
cagagaacuagaacag

SEQ ID NO: 4000011 - RNA, 14 nt, Human herpesvirus 7
cagauucuccagaa

SEQ ID NO: 4000012 - RNA, 23 nt, Human herpesvirus 7
cagauuucauguuuuaugacuca

SEQ ID NO: 4000013 - RNA, 15 nt, Human herpesvirus 7
cagcguucaaucaaa

SEQ ID NO: 4000014 - RNA, 18 nt, Human herpesvirus 7
cagcuaucucuacaaaca

SEQ ID NO: 4000015 - RNA, 20 nt, Human herpesvirus 7
cagcuucagaugcuauggug

SEQ ID NO: 4000016 - RNA, 15 nt, Human herpesvirus 7
caggcugcaucuuuu

SEQ ID NO: 4000017 - RNA, 17 nt, Human herpesvirus 7
cagggaagaaacagcug

SEQ ID NO: 4000018 - RNA, 21 nt, Human herpesvirus 7
cagggaagaaacagcugaaaa

SEQ ID NO: 4000019 - RNA, 21 nt, Human herpesvirus 7
caggugacgucuagacauuug

SEQ ID NO: 4000020 - RNA, 20 nt, Human herpesvirus 7
caguucaagaaauaaugaag

SEQ ID NO: 4000021 - RNA, 14 nt, Human herpesvirus 7
caguuguuggaaau

SEQ ID NO: 4000022 - RNA, 18 nt, Human herpesvirus 7
caguuucugcauacucuu

SEQ ID NO: 4000023 - RNA, 20 nt, Human herpesvirus 7
cauaaaacaugcaacauaau

SEQ ID NO: 4000024 - RNA, 15 nt, Human herpesvirus 7
cauaaaauguacaau

SEQ ID NO: 4000025 - RNA, 16 nt, Human herpesvirus 7
cauaaauaaaaacaug

SEQ ID NO: 4000026 - RNA, 16 nt, Human herpesvirus 7
cauaauuaugaaaugu

SEQ ID NO: 4000027 - RNA, 19 nt, Human herpesvirus 7
cauacaugcaaucaacaaa

SEQ ID NO: 4000028 - RNA, 14 nt, Human herpesvirus 7
cauacgaaucaguu

SEQ ID NO: 4000029 - RNA, 13 nt, Human herpesvirus 7
cauacuuuacagc

SEQ ID NO: 4000030 - RNA, 18 nt, Human herpesvirus 7
cauagcacucauacuaau

SEQ ID NO: 4000031 - RNA, 15 nt, Human herpesvirus 7
cauauagauaaugaa

SEQ ID NO: 4000032 - RNA, 15 nt, Human herpesvirus 7
cauauauaagagaau

SEQ ID NO: 4000033 - RNA, 17 nt, Human herpesvirus 7
cauccaaaaagaaacuu

SEQ ID NO: 4000034 - RNA, 17 nt, Human herpesvirus 7
caucccugcugauacaa

SEQ ID NO: 4000035 - RNA, 17 nt, Human herpesvirus 7
caugaguacuguuucua

SEQ ID NO: 4000036 - RNA, 22 nt, Human herpesvirus 7
caugauccugguuaaaaaaaug

SEQ ID NO: 4000037 - RNA, 15 nt, Human herpesvirus 7
caugauguuaaagaa

SEQ ID NO: 4000038 - RNA, 13 nt, Human herpesvirus 7
caugcaaaaaaca

SEQ ID NO: 4000039 - RNA, 24 nt, Human herpesvirus 7
caugcgaguuagacgucaacuuga

SEQ ID NO: 4000040 - RNA, 18 nt, Human herpesvirus 7
caugggauuucuguaaaa

SEQ ID NO: 4000041 - RNA, 14 nt, Human herpesvirus 7
caugucacauaaug

SEQ ID NO: 4000042 - RNA, 20 nt, Human herpesvirus 7
cauguuaaaaaaucaacuug

SEQ ID NO: 4000043 - RNA, 19 nt, Human herpesvirus 7
cauuacuggauguauaaau

SEQ ID NO: 4000044 - RNA, 13 nt, Human herpesvirus 7
cauuaugagauuu

SEQ ID NO: 4000045 - RNA, 19 nt, Human herpesvirus 7
cauuaugagauuugccugc

SEQ ID NO: 4000046 - RNA, 13 nt, Human herpesvirus 7
cauuauuauuuga

SEQ ID NO: 4000047 - RNA, 19 nt, Human herpesvirus 7
cauuccguuuuaaauagug

SEQ ID NO: 4000048 - RNA, 15 nt, Human herpesvirus 7
cauugaaaaugcauu

SEQ ID NO: 4000049 - RNA, 16 nt, Human herpesvirus 7
cauugaaaaugcauug

SEQ ID NO: 4000050 - RNA, 16 nt, Human herpesvirus 7
cauugaaaucauuuug

SEQ ID NO: 4000051 - RNA, 14 nt, Human herpesvirus 7
cauugaaauucugu

SEQ ID NO: 4000052 - RNA, 19 nt, Human herpesvirus 7
cauugcagucaaagauuuu

SEQ ID NO: 4000053 - RNA, 18 nt, Human herpesvirus 7
cauuuaaaaaaucugaau

SEQ ID NO: 4000054 - RNA, 19 nt, Human herpesvirus 7
cauuuauuuucuuaacaau

SEQ ID NO: 4000055 - RNA, 22 nt, Human herpesvirus 7
cauuucaaaaucagaaauguua

SEQ ID NO: 4000056 - RNA, 19 nt, Human herpesvirus 7
cauuucauuccaaaauaca

SEQ ID NO: 4000057 - RNA, 14 nt, Human herpesvirus 7
cauuuccgagacag

SEQ ID NO: 4000058 - RNA, 20 nt, Human herpesvirus 7
cauuuguacuucaaaguagc

SEQ ID NO: 4000059 - RNA, 16 nt, Human herpesvirus 7
cauuuuguuuugcaau

SEQ ID NO: 4000060 - RNA, 20 nt, Human herpesvirus 7
ccaaaaguuguuaagaaucu

SEQ ID NO: 4000061 - RNA, 14 nt, Human herpesvirus 7
ccaagcuuaaauaa

SEQ ID NO: 4000062 - RNA, 16 nt, Human herpesvirus 7
ccaccauuucugaaac

SEQ ID NO: 4000063 - RNA, 13 nt, Human herpesvirus 7
ccaccguugggaa

SEQ ID NO: 4000064 - RNA, 19 nt, Human herpesvirus 7
ccacuaugccacaaaaaac

SEQ ID NO: 4000065 - RNA, 22 nt, Human herpesvirus 7
ccaggaacagauucuccagaaa

SEQ ID NO: 4000066 - RNA, 20 nt, Human herpesvirus 7
ccauuguguuaaaaauauca

SEQ ID NO: 4000067 - RNA, 17 nt, Human herpesvirus 7
ccauuuccucuggaaaa

SEQ ID NO: 4000068 - RNA, 19 nt, Human herpesvirus 7
ccgaagagggacuuuuaua

SEQ ID NO: 4000069 - RNA, 14 nt, Human herpesvirus 7
ccgcguuggugugu

SEQ ID NO: 4000070 - RNA, 20 nt, Human herpesvirus 7
ccgguuaaaaugggaauguu

SEQ ID NO: 4000071 - RNA, 18 nt, Human herpesvirus 7
ccguuuugaaaagucauu

SEQ ID NO: 4000072 - RNA, 20 nt, Human herpesvirus 7
ccuacgcagcaauguauaua

SEQ ID NO: 4000073 - RNA, 21 nt, Human herpesvirus 7
ccucagaacuguuuuaaugua

SEQ ID NO: 4000074 - RNA, 21 nt, Human herpesvirus 7
ccugguuuuguucccugcucg

SEQ ID NO: 4000075 - RNA, 17 nt, Human herpesvirus 7
ccugucuugaccuggag

SEQ ID NO: 4000076 - RNA, 18 nt, Human herpesvirus 7
ccuuauauuaaaaaccac

SEQ ID NO: 4000077 - RNA, 16 nt, Human herpesvirus 7
ccuucuaaauucuuua

SEQ ID NO: 4000078 - RNA, 22 nt, Human herpesvirus 7
ccuuuuauugguagauuuucua

SEQ ID NO: 4000079 - RNA, 18 nt, Human herpesvirus 7
cgaaaaugguauuuugcg

SEQ ID NO: 4000080 - RNA, 16 nt, Human herpesvirus 7
cgacauuauaaaagau

SEQ ID NO: 4000081 - RNA, 15 nt, Human herpesvirus 7
cgagaaaacacgaca

SEQ ID NO: 4000082 - RNA, 13 nt, Human herpesvirus 7
cgagauuccaaag

SEQ ID NO: 4000083 - RNA, 23 nt, Human herpesvirus 7
cgaggaagcuuucguaaucauuc

SEQ ID NO: 4000084 - RNA, 22 nt, Human herpesvirus 7
cgaguguaaucuagaacuguua

SEQ ID NO: 4000085 - RNA, 23 nt, Human herpesvirus 7
cgauguauuacuacuaacaugga

SEQ ID NO: 4000086 - RNA, 23 nt, Human herpesvirus 7
cgcagucuaaaaguaaagggaaa

SEQ ID NO: 4000087 - RNA, 20 nt, Human herpesvirus 7
cgcuguugguuaugcacauc

SEQ ID NO: 4000088 - RNA, 12 nt, Human herpesvirus 7
cgcuuucucaag

SEQ ID NO: 4000089 - RNA, 14 nt, Human herpesvirus 7
cggacuuaugucca

SEQ ID NO: 4000090 - RNA, 16 nt, Human herpesvirus 7
cgguaacaugucuuca

SEQ ID NO: 4000091 - RNA, 11 nt, Human herpesvirus 7
cgguuaaucuu

SEQ ID NO: 4000092 - RNA, 19 nt, Human herpesvirus 7
cguaacgaauaaaaaguuu

SEQ ID NO: 4000093 - RNA, 13 nt, Human herpesvirus 7
cguaacugugacg

SEQ ID NO: 4000094 - RNA, 14 nt, Human herpesvirus 7
cguaaguuguuaua

SEQ ID NO: 4000095 - RNA, 22 nt, Human herpesvirus 7
auguacgaacuaagaaaaaaac

SEQ ID NO: 4000096 - RNA, 17 nt, Human herpesvirus 7
auguaugguuucauuug

SEQ ID NO: 4000097 - RNA, 16 nt, Human herpesvirus 7
augucuaaaaguacag

SEQ ID NO: 4000098 - RNA, 22 nt, Human herpesvirus 7
augucugcauagacaguaaugc

SEQ ID NO: 4000099 - RNA, 18 nt, Human herpesvirus 7
augucuuguuaucuccac

SEQ ID NO: 4000100 - RNA, 15 nt, Human herpesvirus 7
augugcacauuccaa

SEQ ID NO: 4000101 - RNA, 18 nt, Human herpesvirus 7
augugcuuauaucuuaua

SEQ ID NO: 4000102 - RNA, 19 nt, Human herpesvirus 7
auguugacgggaaaaagga

SEQ ID NO: 4000103 - RNA, 21 nt, Human herpesvirus 7
auuaaacaaucuggacauuuc

SEQ ID NO: 4000104 - RNA, 19 nt, Human herpesvirus 7
auuaaacagcauuuucucu

SEQ ID NO: 4000105 - RNA, 22 nt, Human herpesvirus 7
auuaacagcuccaagcuuaaau

SEQ ID NO: 4000106 - RNA, 23 nt, Human herpesvirus 7
auuaauuuccacguuuuuuagcu

SEQ ID NO: 4000107 - RNA, 14 nt, Human herpesvirus 7
auuacauugcaguc

SEQ ID NO: 4000108 - RNA, 17 nt, Human herpesvirus 7
auuagagcauauuccau

SEQ ID NO: 4000109 - RNA, 16 nt, Human herpesvirus 7
auuauaacuuguaauu

SEQ ID NO: 4000110 - RNA, 18 nt, Human herpesvirus 7
auuauauucaaauaaggg

SEQ ID NO: 4000111 - RNA, 22 nt, Human herpesvirus 7
auuaucgcaauuaauucaguuu

SEQ ID NO: 4000112 - RNA, 19 nt, Human herpesvirus 7
auuaucgcguuuucaugcu

SEQ ID NO: 4000113 - RNA, 13 nt, Human herpesvirus 7
auuaugauguuuc

SEQ ID NO: 4000114 - RNA, 14 nt, Human herpesvirus 7
auuauuuuuaaaaa

SEQ ID NO: 4000115 - RNA, 18 nt, Human herpesvirus 7
auuccuauuaagcagcuu

SEQ ID NO: 4000116 - RNA, 21 nt, Human herpesvirus 7
auuccugcuugcacaaagauc

SEQ ID NO: 4000117 - RNA, 16 nt, Human herpesvirus 7
auuccuuggaaaaaug

SEQ ID NO: 4000118 - RNA, 12 nt, Human herpesvirus 7
auucgaugucag

SEQ ID NO: 4000119 - RNA, 16 nt, Human herpesvirus 7
auucuaaaaauuauuu

SEQ ID NO: 4000120 - RNA, 15 nt, Human herpesvirus 7
auucuaaauuaaaaa

SEQ ID NO: 4000121 - RNA, 23 nt, Human herpesvirus 7
auucucaaaaaugauaugacaug

SEQ ID NO: 4000122 - RNA, 16 nt, Human herpesvirus 7
auucuuuucaaugcaa

SEQ ID NO: 4000123 - RNA, 22 nt, Human herpesvirus 7
auugcaguaaauuugagcuuug

SEQ ID NO: 4000124 - RNA, 20 nt, Human herpesvirus 7
auuggauaauaucaguacaa

SEQ ID NO: 4000125 - RNA, 16 nt, Human herpesvirus 7
auuggcauuauucuuc

SEQ ID NO: 4000126 - RNA, 19 nt, Human herpesvirus 7
auuguacaauuacaaaaug

SEQ ID NO: 4000127 - RNA, 14 nt, Human herpesvirus 7
auugucuacaauuu

SEQ ID NO: 4000128 - RNA, 15 nt, Human herpesvirus 7
auuuaaaauuaauaa

SEQ ID NO: 4000129 - RNA, 20 nt, Human herpesvirus 7
auuuaccuuuaauugauauu

SEQ ID NO: 4000130 - RNA, 12 nt, Human herpesvirus 7
auuuacuugauu

SEQ ID NO: 4000131 - RNA, 21 nt, Human herpesvirus 7
auuuaguacuuuuucuggaau

SEQ ID NO: 4000132 - RNA, 21 nt, Human herpesvirus 7
auuuaugcgguaagaaaaauc

SEQ ID NO: 4000133 - RNA, 15 nt, Human herpesvirus 7
auuuauugaugucaa

SEQ ID NO: 4000134 - RNA, 19 nt, Human herpesvirus 7
auuucaaaaucagaaaugu

SEQ ID NO: 4000135 - RNA, 15 nt, Human herpesvirus 7
auuucagcuggaauu

SEQ ID NO: 4000136 - RNA, 18 nt, Human herpesvirus 7
auuuccucuggaaaaggg

SEQ ID NO: 4000137 - RNA, 21 nt, Human herpesvirus 7
auuuccucuggaaaagggaga

SEQ ID NO: 4000138 - RNA, 23 nt, Human herpesvirus 7
auuuccugcaauaauaaacauug

SEQ ID NO: 4000139 - RNA, 16 nt, Human herpesvirus 7
auuucuaaauaugaug

SEQ ID NO: 4000140 - RNA, 22 nt, Human herpesvirus 7
auuucuaaauaugaugaaacuu

SEQ ID NO: 4000141 - RNA, 11 nt, Human herpesvirus 7
auuucuguaaa

SEQ ID NO: 4000142 - RNA, 13 nt, Human herpesvirus 7
auuucugucaucu

SEQ ID NO: 4000143 - RNA, 21 nt, Human herpesvirus 7
auuuggauugauuuucaaguu

SEQ ID NO: 4000144 - RNA, 19 nt, Human herpesvirus 7
auuuggcuucuauuauaga

SEQ ID NO: 4000145 - RNA, 14 nt, Human herpesvirus 7
auuuguucaaaaua

SEQ ID NO: 4000146 - RNA, 19 nt, Human herpesvirus 7
auuuguuuaagacauuauu

SEQ ID NO: 4000147 - RNA, 16 nt, Human herpesvirus 7
auuuuaaauuuacuua

SEQ ID NO: 4000148 - RNA, 14 nt, Human herpesvirus 7
auuuuaacacuguu

SEQ ID NO: 4000149 - RNA, 19 nt, Human herpesvirus 7
auuuuacaaaaagaauuga

SEQ ID NO: 4000150 - RNA, 13 nt, Human herpesvirus 7
auuuucagaaaag

SEQ ID NO: 4000151 - RNA, 15 nt, Human herpesvirus 7
auuuuccauucauuu

SEQ ID NO: 4000152 - RNA, 14 nt, Human herpesvirus 7
auuuucguaucugu

SEQ ID NO: 4000153 - RNA, 22 nt, Human herpesvirus 7
auuuugccguugaguugcugcu

SEQ ID NO: 4000154 - RNA, 21 nt, Human herpesvirus 7
auuuugggcugacuuaauuga

SEQ ID NO: 4000155 - RNA, 12 nt, Human herpesvirus 7
auuuuguuuugc

SEQ ID NO: 4000156 - RNA, 14 nt, Human herpesvirus 7
auuuuuaaagagaa

SEQ ID NO: 4000157 - RNA, 22 nt, Human herpesvirus 7
auuuuuagcucuaaacaaacaa

SEQ ID NO: 4000158 - RNA, 17 nt, Human herpesvirus 7
auuuuuauuguaaagga

SEQ ID NO: 4000159 - RNA, 19 nt, Human herpesvirus 7
auuuuuuaaagaaaagcuu

SEQ ID NO: 4000160 - RNA, 23 nt, Human herpesvirus 7
auuuuuuucuuauaaauaaaaug

SEQ ID NO: 4000161 - RNA, 19 nt, Human herpesvirus 7
auuuuuuuuagaaaugguu

SEQ ID NO: 4000162 - RNA, 11 nt, Human herpesvirus 7
caaaaaaccau

SEQ ID NO: 4000163 - RNA, 15 nt, Human herpesvirus 7
caaaaaauucuucua

SEQ ID NO: 4000164 - RNA, 22 nt, Human herpesvirus 7
caaaacugcaaauccaacagaa

SEQ ID NO: 4000165 - RNA, 14 nt, Human herpesvirus 7
caaaagccacagau

SEQ ID NO: 4000166 - RNA, 12 nt, Human herpesvirus 7
caaaagcuuacu

SEQ ID NO: 4000167 - RNA, 21 nt, Human herpesvirus 7
caaaaguauaacauugcuuca

SEQ ID NO: 4000168 - RNA, 18 nt, Human herpesvirus 7
caaaagucgagaaaacac

SEQ ID NO: 4000169 - RNA, 12 nt, Human herpesvirus 7
caaaauagcaca

SEQ ID NO: 4000170 - RNA, 18 nt, Human herpesvirus 7
caaaauauuuaucugcau

SEQ ID NO: 4000171 - RNA, 19 nt, Human herpesvirus 7
caaaaugacaaaaagguug

SEQ ID NO: 4000172 - RNA, 15 nt, Human herpesvirus 7
caaaauuauaacuuu

SEQ ID NO: 4000173 - RNA, 24 nt, Human herpesvirus 7
caaaauucaacgucuuacuuggaa

SEQ ID NO: 4000174 - RNA, 21 nt, Human herpesvirus 7
caaaauucugcuugucucugu

SEQ ID NO: 4000175 - RNA, 22 nt, Human herpesvirus 7
caaaccuauccacucuccugaa

SEQ ID NO: 4000176 - RNA, 17 nt, Human herpesvirus 7
caaacucaauaaagauu

SEQ ID NO: 4000177 - RNA, 22 nt, Human herpesvirus 7
caaagaaaaaaggaugaaagug

SEQ ID NO: 4000178 - RNA, 12 nt, Human herpesvirus 7
caaaguagccuu

SEQ ID NO: 4000179 - RNA, 22 nt, Human herpesvirus 7
caaaucaaaaugagauuuuucc

SEQ ID NO: 4000180 - RNA, 19 nt, Human herpesvirus 7
caaauguuuuaauuuggaa

SEQ ID NO: 4000181 - RNA, 14 nt, Human herpesvirus 7
caaauuaaagcgag

SEQ ID NO: 4000182 - RNA, 16 nt, Human herpesvirus 7
caaauucaaccacaga

SEQ ID NO: 4000183 - RNA, 22 nt, Human herpesvirus 7
caacauuuguguguaugugcag

SEQ ID NO: 4000184 - RNA, 21 nt, Human herpesvirus 7
caaccuguacucgacucugaa

SEQ ID NO: 4000185 - RNA, 23 nt, Human herpesvirus 7
caaccuuuuaaaaucaaauguaa

SEQ ID NO: 4000186 - RNA, 23 nt, Human herpesvirus 7
caacgauaugguuugaaaaccau

SEQ ID NO: 4000187 - RNA, 20 nt, Human herpesvirus 7
caacgucuuacuuggaaaca

SEQ ID NO: 4000188 - RNA, 21 nt, Human herpesvirus 7
caacuagagaagccacuucua

SEQ ID NO: 4000189 - RNA, 13 nt, Human herpesvirus 7
caacucuuccuuu

SEQ ID NO: 4000190 - RNA, 13 nt, Human herpesvirus 7
caagaaacauguu

SEQ ID NO: 4000191 - RNA, 19 nt, Human herpesvirus 7
caagaaggaaaauuucauu

SEQ ID NO: 4000192 - RNA, 18 nt, Human herpesvirus 7
caagaaggccacgcugua

SEQ ID NO: 4000193 - RNA, 16 nt, Human herpesvirus 7
caagauaagcaauaca

SEQ ID NO: 4000194 - RNA, 20 nt, Human herpesvirus 7
caagguuuaaaacauuuaca

SEQ ID NO: 4000195 - RNA, 22 nt, Human herpesvirus 7
caaguagugcuaauauuccuuu

SEQ ID NO: 4000196 - RNA, 20 nt, Human herpesvirus 7
caagucaucgguuuucugag

SEQ ID NO: 4000197 - RNA, 14 nt, Human herpesvirus 7
caaguuuuacagaa

SEQ ID NO: 4000198 - RNA, 16 nt, Human herpesvirus 7
caauaaaagauuuaaa

SEQ ID NO: 4000199 - RNA, 20 nt, Human herpesvirus 7
caauaaaguuuuguaacuau

SEQ ID NO: 4000200 - RNA, 17 nt, Human herpesvirus 7
caauaaaucuguaaaau

SEQ ID NO: 4000201 - RNA, 12 nt, Human herpesvirus 7
caauacaugaau

SEQ ID NO: 4000202 - RNA, 17 nt, Human herpesvirus 7
caauagaaaacauuaua

SEQ ID NO: 4000203 - RNA, 17 nt, Human herpesvirus 7
caauauagaguaccaau

SEQ ID NO: 4000204 - RNA, 12 nt, Human herpesvirus 7
caauauauugaa

SEQ ID NO: 4000205 - RNA, 22 nt, Human herpesvirus 7
caaucaacaaaaugacaaaaag

SEQ ID NO: 4000206 - RNA, 15 nt, Human herpesvirus 7
caaucccagaaauuu

SEQ ID NO: 4000207 - RNA, 13 nt, Human herpesvirus 7
caaucuauuucua

SEQ ID NO: 4000208 - RNA, 22 nt, Human herpesvirus 7
caaugagacagcaacugugcau

SEQ ID NO: 4000209 - RNA, 19 nt, Human herpesvirus 7
caaugauaauaagaugugu

SEQ ID NO: 4000210 - RNA, 16 nt, Human herpesvirus 7
caaugcauuggaaaaa

SEQ ID NO: 4000211 - RNA, 21 nt, Human herpesvirus 7
uuugaucuacauauacuuuua

SEQ ID NO: 4000212 - RNA, 16 nt, Human herpesvirus 7
uuugcugagucucugg

SEQ ID NO: 4000213 - RNA, 22 nt, Human herpesvirus 7
uuuggaaaacaacauacauauu

SEQ ID NO: 4000214 - RNA, 16 nt, Human herpesvirus 7
uuuggcaacucuuccu

SEQ ID NO: 4000215 - RNA, 16 nt, Human herpesvirus 7
uuugggaaacaucuuu

SEQ ID NO: 4000216 - RNA, 21 nt, Human herpesvirus 7
uuugggaugucuuaggaguuu

SEQ ID NO: 4000217 - RNA, 19 nt, Human herpesvirus 7
uuugucuuacgucuuuucu

SEQ ID NO: 4000218 - RNA, 15 nt, Human herpesvirus 7
uuugugcugugucaa

SEQ ID NO: 4000219 - RNA, 13 nt, Human herpesvirus 7
uuuuaaacuaagu

SEQ ID NO: 4000220 - RNA, 16 nt, Human herpesvirus 7
uuuuaauaugugaaaa

SEQ ID NO: 4000221 - RNA, 22 nt, Human herpesvirus 7
uuuuauucagacaaguaaaagc

SEQ ID NO: 4000222 - RNA, 13 nt, Human herpesvirus 7
uuuuauuucuaau

SEQ ID NO: 4000223 - RNA, 23 nt, Human herpesvirus 7
uuuucaaguuucuucuggguuaa

SEQ ID NO: 4000224 - RNA, 21 nt, Human herpesvirus 7
uuuucaugguauuuguuagaa

SEQ ID NO: 4000225 - RNA, 14 nt, Human herpesvirus 7
uuuucggauaaaag

SEQ ID NO: 4000226 - RNA, 23 nt, Human herpesvirus 7
uuuucuucuucuuuuuuugaacu

SEQ ID NO: 4000227 - RNA, 19 nt, Human herpesvirus 7
uuuugauccgauuuaucaa

SEQ ID NO: 4000228 - RNA, 11 nt, Human herpesvirus 7
uuuugccuuca

SEQ ID NO: 4000229 - RNA, 13 nt, Human herpesvirus 7
uuuuuaugaagau

SEQ ID NO: 4000230 - RNA, 16 nt, Human herpesvirus 7
uuuuuaugugguuaaa

SEQ ID NO: 4000231 - RNA, 13 nt, Human herpesvirus 7
uuuuuuguucaaa

SEQ ID NO: 4000232 - RNA, 12 nt, Human herpesvirus 7
aaaaaaacacag

SEQ ID NO: 4000233 - RNA, 11 nt, Human herpesvirus 7
aaaaaacacuu

SEQ ID NO: 4000234 - RNA, 11 nt, Human herpesvirus 7
aaaaaauggag

SEQ ID NO: 4000235 - RNA, 13 nt, Human herpesvirus 7
aaaaacaaaaaag

SEQ ID NO: 4000236 - RNA, 18 nt, Human herpesvirus 7
aaaaaccugaaaaacaug

SEQ ID NO: 4000237 - RNA, 18 nt, Human herpesvirus 7
aaaaaggccuuguaaagu

SEQ ID NO: 4000238 - RNA, 12 nt, Human herpesvirus 7
aaaaauaauaaa

SEQ ID NO: 4000239 - RNA, 20 nt, Human herpesvirus 7
aaaaauguuuacaaacaugu

SEQ ID NO: 4000240 - RNA, 16 nt, Human herpesvirus 7
aaaacaaacuaugucc

SEQ ID NO: 4000241 - RNA, 13 nt, Human herpesvirus 7
aaaacacaguaua

SEQ ID NO: 4000242 - RNA, 13 nt, Human herpesvirus 7
aaaacuugccauc

SEQ ID NO: 4000243 - RNA, 19 nt, Human herpesvirus 7
aaaagaauugauugaauuu

SEQ ID NO: 4000244 - RNA, 17 nt, Human herpesvirus 7
aaaagcuaaaaaacgug

SEQ ID NO: 4000245 - RNA, 18 nt, Human herpesvirus 7
aaaaguuguuaagaaucu

SEQ ID NO: 4000246 - RNA, 15 nt, Human herpesvirus 7
aaaauaaacauguug

SEQ ID NO: 4000247 - RNA, 17 nt, Human herpesvirus 7
aaaauaaauucugaaau

SEQ ID NO: 4000248 - RNA, 23 nt, Human herpesvirus 7
aaaauacaauagugaacaugugc

SEQ ID NO: 4000249 - RNA, 15 nt, Human herpesvirus 7
aaaauaucuucugaa

SEQ ID NO: 4000250 - RNA, 16 nt, Human herpesvirus 7
aaaaucaaaacauuuc

SEQ ID NO: 4000251 - RNA, 17 nt, Human herpesvirus 7
aaaaucaagucugaagg

SEQ ID NO: 4000252 - RNA, 22 nt, Human herpesvirus 7
aaaaucagaaauguuacuuaag

SEQ ID NO: 4000253 - RNA, 20 nt, Human herpesvirus 7
aaaauccuggauuucagcau

SEQ ID NO: 4000254 - RNA, 17 nt, Human herpesvirus 7
aaaaucucgaacagucc

SEQ ID NO: 4000255 - RNA, 19 nt, Human herpesvirus 7
aaaauguuuuuguuucuga

SEQ ID NO: 4000256 - RNA, 13 nt, Human herpesvirus 7
aaacaaacucugc

SEQ ID NO: 4000257 - RNA, 16 nt, Human herpesvirus 7
aaacacuugcuagcug

SEQ ID NO: 4000258 - RNA, 17 nt, Human herpesvirus 7
aaacaggcauuuaagaa

SEQ ID NO: 4000259 - RNA, 18 nt, Human herpesvirus 7
aaacaugggauuucugua

SEQ ID NO: 4000260 - RNA, 22 nt, Human herpesvirus 7
aaacgcuaaccaucugcuggaa

SEQ ID NO: 4000261 - RNA, 19 nt, Human herpesvirus 7
aaacuaaagaaaaaaaaag

SEQ ID NO: 4000262 - RNA, 22 nt, Human herpesvirus 7
aaacuauucgaaaauaucuucu

SEQ ID NO: 4000263 - RNA, 18 nt, Human herpesvirus 7
aaacuuagugaugaccac

SEQ ID NO: 4000264 - RNA, 21 nt, Human herpesvirus 7
aaacuugugaaaauaacagga

SEQ ID NO: 4000265 - RNA, 22 nt, Human herpesvirus 7
aaagaaaaagcaacaaauguuu

SEQ ID NO: 4000266 - RNA, 21 nt, Human herpesvirus 7
aaagacgcuugcuauuuucuu

SEQ ID NO: 4000267 - RNA, 20 nt, Human herpesvirus 7
aaagauuaaaaaaaaaagaa

SEQ ID NO: 4000268 - RNA, 21 nt, Human herpesvirus 7
aaagcauacuuuaaaacuuug

SEQ ID NO: 4000269 - RNA, 14 nt, Human herpesvirus 7
aaagcgagcuuucu

SEQ ID NO: 4000270 - RNA, 20 nt, Human herpesvirus 7
aaaggaucucucuuucugga

SEQ ID NO: 4000271 - RNA, 21 nt, Human herpesvirus 7
aaaguagaggccgaaaaucua

SEQ ID NO: 4000272 - RNA, 14 nt, Human herpesvirus 7
aaaguccaaaguga

SEQ ID NO: 4000273 - RNA, 17 nt, Human herpesvirus 7
aaagucuaagguuugaa

SEQ ID NO: 4000274 - RNA, 20 nt, Human herpesvirus 7
aaagugaucaaaauuaaugu

SEQ ID NO: 4000275 - RNA, 13 nt, Human herpesvirus 7
aaaguugaaaaug

SEQ ID NO: 4000276 - RNA, 16 nt, Human herpesvirus 7
aaaguugaaaauguuu

SEQ ID NO: 4000277 - RNA, 19 nt, Human herpesvirus 7
aaaguuuauagaacaagua

SEQ ID NO: 4000278 - RNA, 22 nt, Human herpesvirus 7
aaauaauccauuccuguguucu

SEQ ID NO: 4000279 - RNA, 20 nt, Human herpesvirus 7
aaauagaguuuaauuguacu

SEQ ID NO: 4000280 - RNA, 18 nt, Human herpesvirus 7
aaauauaugcuuuauuua

SEQ ID NO: 4000281 - RNA, 23 nt, Human herpesvirus 7
aaauauguggcacauaaguugac

SEQ ID NO: 4000282 - RNA, 17 nt, Human herpesvirus 7
aaaucuguagaaaaugu

SEQ ID NO: 4000283 - RNA, 15 nt, Human herpesvirus 7
aaaucuuuaagaaug

SEQ ID NO: 4000284 - RNA, 14 nt, Human herpesvirus 7
aaaugcauugcuuu

SEQ ID NO: 4000285 - RNA, 16 nt, Human herpesvirus 7
aaaugguauuuugcgu

SEQ ID NO: 4000286 - RNA, 18 nt, Human herpesvirus 7
aaauguaauuuaaauaau

SEQ ID NO: 4000287 - RNA, 18 nt, Human herpesvirus 7
aaauguguaacaauugag

SEQ ID NO: 4000288 - RNA, 14 nt, Human herpesvirus 7
aaauguuuuugcua

SEQ ID NO: 4000289 - RNA, 15 nt, Human herpesvirus 7
aaauuaaauacaaau

SEQ ID NO: 4000290 - RNA, 12 nt, Human herpesvirus 7
aaauuaaauacu

SEQ ID NO: 4000291 - RNA, 14 nt, Human herpesvirus 7
aaauuaauguaauu

SEQ ID NO: 4000292 - RNA, 22 nt, Human herpesvirus 7
aaauuauuaauauuaguauugu

SEQ ID NO: 4000293 - RNA, 16 nt, Human herpesvirus 7
aaauuauuauuaguau

SEQ ID NO: 4000294 - RNA, 20 nt, Human herpesvirus 7
aaauuccuccugaaaauuug

SEQ ID NO: 4000295 - RNA, 19 nt, Human herpesvirus 7
aaauucgcaaaauuucauu

SEQ ID NO: 4000296 - RNA, 20 nt, Human herpesvirus 7
aaauucuuuaauaaaaaaca

SEQ ID NO: 4000297 - RNA, 15 nt, Human herpesvirus 7
aaauugaaauauuua

SEQ ID NO: 4000298 - RNA, 21 nt, Human herpesvirus 7
aaauuuagcaccaacugaauu

SEQ ID NO: 4000299 - RNA, 18 nt, Human herpesvirus 7
aaauuuuggauuguguaa

SEQ ID NO: 4000300 - RNA, 14 nt, Human herpesvirus 7
aaauuuuuagcucu

SEQ ID NO: 4000301 - RNA, 18 nt, Human herpesvirus 7
aacaacuagcaaacagug

SEQ ID NO: 4000302 - RNA, 17 nt, Human herpesvirus 7
aacaaucuuacaaaaag

SEQ ID NO: 4000303 - RNA, 11 nt, Human herpesvirus 7
aacaaugacuu

SEQ ID NO: 4000304 - RNA, 21 nt, Human herpesvirus 7
aacacguagaaaaaaacaaug

SEQ ID NO: 4000305 - RNA, 20 nt, Human herpesvirus 7
aacagauuuuauuucagcuc

SEQ ID NO: 4000306 - RNA, 23 nt, Human herpesvirus 7
aacagauuuuauuucagcuccau

SEQ ID NO: 4000307 - RNA, 15 nt, Human herpesvirus 7
aacaguuuuuaaaau

SEQ ID NO: 4000308 - RNA, 13 nt, Human herpesvirus 7
aacauauguugau

SEQ ID NO: 4000309 - RNA, 19 nt, Human herpesvirus 7
aacaucuuucauaacaaag

SEQ ID NO: 4000310 - RNA, 20 nt, Human herpesvirus 7
aacaugauugguaaaaaauu

SEQ ID NO: 4000311 - RNA, 21 nt, Human herpesvirus 7
aacauuccaacagcuucagau

SEQ ID NO: 4000312 - RNA, 12 nt, Human herpesvirus 7
aacauugugagu

SEQ ID NO: 4000313 - RNA, 12 nt, Human herpesvirus 7
aacauuucagau

SEQ ID NO: 4000314 - RNA, 17 nt, Human herpesvirus 7
aaccaauuaauauuaau

SEQ ID NO: 4000315 - RNA, 15 nt, Human herpesvirus 7
cgugaacaaauacug

SEQ ID NO: 4000316 - RNA, 21 nt, Human herpesvirus 7
cgugagggggacaauuauuua

SEQ ID NO: 4000317 - RNA, 22 nt, Human herpesvirus 7
cguuauuauguguacacuuuug

SEQ ID NO: 4000318 - RNA, 20 nt, Human herpesvirus 7
cguucuauguaugaaaaaaa

SEQ ID NO: 4000319 - RNA, 19 nt, Human herpesvirus 7
cguuggggauguucuauuc

SEQ ID NO: 4000320 - RNA, 19 nt, Human herpesvirus 7
cguuggucgagaauacaca

SEQ ID NO: 4000321 - RNA, 13 nt, Human herpesvirus 7
cguuguuuguccu

SEQ ID NO: 4000322 - RNA, 23 nt, Human herpesvirus 7
cguuucucuguagauauuuugac

SEQ ID NO: 4000323 - RNA, 17 nt, Human herpesvirus 7
cuaacaaaaaaauaccu

SEQ ID NO: 4000324 - RNA, 22 nt, Human herpesvirus 7
cuaaccaucugcuggaaauuug

SEQ ID NO: 4000325 - RNA, 22 nt, Human herpesvirus 7
cuaacuauaauagccuuucacu

SEQ ID NO: 4000326 - RNA, 20 nt, Human herpesvirus 7
cuaauagaaaaauguacaau

SEQ ID NO: 4000327 - RNA, 19 nt, Human herpesvirus 7
cuaaugguuggauuucaau

SEQ ID NO: 4000328 - RNA, 21 nt, Human herpesvirus 7
cuaauuuuggcgaaacaauac

SEQ ID NO: 4000329 - RNA, 18 nt, Human herpesvirus 7
cuacaauuucuggcaaua

SEQ ID NO: 4000330 - RNA, 20 nt, Human herpesvirus 7
cuacaauuucuggcaauaaa

SEQ ID NO: 4000331 - RNA, 19 nt, Human herpesvirus 7
cuacauauggacaaauuug

SEQ ID NO: 4000332 - RNA, 16 nt, Human herpesvirus 7
cuagaaaaacacuagc

SEQ ID NO: 4000333 - RNA, 23 nt, Human herpesvirus 7
cuagauguuuuugauauuguacu

SEQ ID NO: 4000334 - RNA, 17 nt, Human herpesvirus 7
cuagcaccgaaaauggu

SEQ ID NO: 4000335 - RNA, 20 nt, Human herpesvirus 7
cuagcguuucguuaacccag

SEQ ID NO: 4000336 - RNA, 16 nt, Human herpesvirus 7
cuaggauaccaaacaa

SEQ ID NO: 4000337 - RNA, 14 nt, Human herpesvirus 7
cuauaaauggaauu

SEQ ID NO: 4000338 - RNA, 22 nt, Human herpesvirus 7
cuaucacaaccuggauguaaug

SEQ ID NO: 4000339 - RNA, 23 nt, Human herpesvirus 7
cuaucuccuaaaugaauuuuaag

SEQ ID NO: 4000340 - RNA, 24 nt, Human herpesvirus 7
cuauuaaauauuuagagucgucuu

SEQ ID NO: 4000341 - RNA, 14 nt, Human herpesvirus 7
cuauucuauuucaa

SEQ ID NO: 4000342 - RNA, 18 nt, Human herpesvirus 7
cuauugaaaauuuauuga

SEQ ID NO: 4000343 - RNA, 15 nt, Human herpesvirus 7
cucaaaacaaacucu

SEQ ID NO: 4000344 - RNA, 21 nt, Human herpesvirus 7
cucaacgacaaacuuugcaac

SEQ ID NO: 4000345 - RNA, 20 nt, Human herpesvirus 7
cucaaguagccgaaaaagaa

SEQ ID NO: 4000346 - RNA, 22 nt, Human herpesvirus 7
cucaauaguuuuacaaagaaca

SEQ ID NO: 4000347 - RNA, 22 nt, Human herpesvirus 7
cucaauuuuucgcugaagaaca

SEQ ID NO: 4000348 - RNA, 22 nt, Human herpesvirus 7
cucgaauuacguuauauauuua

SEQ ID NO: 4000349 - RNA, 15 nt, Human herpesvirus 7
cucuacuuaauggag

SEQ ID NO: 4000350 - RNA, 14 nt, Human herpesvirus 7
cucucucuauuaca

SEQ ID NO: 4000351 - RNA, 14 nt, Human herpesvirus 7
cucucuuucuggag

SEQ ID NO: 4000352 - RNA, 22 nt, Human herpesvirus 7
cucugccagucucuaaacuucu

SEQ ID NO: 4000353 - RNA, 20 nt, Human herpesvirus 7
cucuugaggaaaugucuuug

SEQ ID NO: 4000354 - RNA, 15 nt, Human herpesvirus 7
cugaaaaacaugagu

SEQ ID NO: 4000355 - RNA, 22 nt, Human herpesvirus 7
cugaacgcagacacaauggaac

SEQ ID NO: 4000356 - RNA, 14 nt, Human herpesvirus 7
cugaaucaaaaucc

SEQ ID NO: 4000357 - RNA, 19 nt, Human herpesvirus 7
cugaauuguacguucugaa

SEQ ID NO: 4000358 - RNA, 21 nt, Human herpesvirus 7
cugacagucacguaaaagugu

SEQ ID NO: 4000359 - RNA, 21 nt, Human herpesvirus 7
cugacuccuuuuuuucugcuc

SEQ ID NO: 4000360 - RNA, 20 nt, Human herpesvirus 7
cugacuuaauugauugcacu

SEQ ID NO: 4000361 - RNA, 18 nt, Human herpesvirus 7
cugagacgauaugaauuu

SEQ ID NO: 4000362 - RNA, 19 nt, Human herpesvirus 7
cugagagaaccugaaagaa

SEQ ID NO: 4000363 - RNA, 22 nt, Human herpesvirus 7
cugagagaauaaguucaucaug

SEQ ID NO: 4000364 - RNA, 19 nt, Human herpesvirus 7
cugauaaauacucaugaag

SEQ ID NO: 4000365 - RNA, 14 nt, Human herpesvirus 7
cugauauaaaugcu

SEQ ID NO: 4000366 - RNA, 23 nt, Human herpesvirus 7
cugaucuaaaguauggaaaaaug

SEQ ID NO: 4000367 - RNA, 18 nt, Human herpesvirus 7
cugcagcugaaagcgcaa

SEQ ID NO: 4000368 - RNA, 19 nt, Human herpesvirus 7
cugccagucucuaaacuuc

SEQ ID NO: 4000369 - RNA, 16 nt, Human herpesvirus 7
cugccucugccucuug

SEQ ID NO: 4000370 - RNA, 16 nt, Human herpesvirus 7
cugcuggaaagcuugu

SEQ ID NO: 4000371 - RNA, 17 nt, Human herpesvirus 7
cuggauucaagaaauca

SEQ ID NO: 4000372 - RNA, 14 nt, Human herpesvirus 7
cuggcucaagcaca

SEQ ID NO: 4000373 - RNA, 22 nt, Human herpesvirus 7
cuggcucuuuacaaaauucaac

SEQ ID NO: 4000374 - RNA, 18 nt, Human herpesvirus 7
cugggaaaaaaaaaucac

SEQ ID NO: 4000375 - RNA, 15 nt, Human herpesvirus 7
cugggaacuagaaaa

SEQ ID NO: 4000376 - RNA, 17 nt, Human herpesvirus 7
cuguaucuccaaaguuu

SEQ ID NO: 4000377 - RNA, 14 nt, Human herpesvirus 7
cugucuauuucaau

SEQ ID NO: 4000378 - RNA, 14 nt, Human herpesvirus 7
cuguguauuucuua

SEQ ID NO: 4000379 - RNA, 11 nt, Human herpesvirus 7
cuguuaagaau

SEQ ID NO: 4000380 - RNA, 20 nt, Human herpesvirus 7
cuguuagaggauuaaaacaa

SEQ ID NO: 4000381 - RNA, 23 nt, Human herpesvirus 7
cuguuaguugggcaaacaguuuu

SEQ ID NO: 4000382 - RNA, 13 nt, Human herpesvirus 7
cuguugccagaaa

SEQ ID NO: 4000383 - RNA, 11 nt, Human herpesvirus 7
cuuacagugaa

SEQ ID NO: 4000384 - RNA, 12 nt, Human herpesvirus 7
cuuacagugaag

SEQ ID NO: 4000385 - RNA, 19 nt, Human herpesvirus 7
cuuacuuuuaauucuucua

SEQ ID NO: 4000386 - RNA, 22 nt, Human herpesvirus 7
cuuagaaaaacgcuaaccaucu

SEQ ID NO: 4000387 - RNA, 22 nt, Human herpesvirus 7
cuucaauagcagagaauauguu

SEQ ID NO: 4000388 - RNA, 19 nt, Human herpesvirus 7
cuucaauaugcuuaguuuu

SEQ ID NO: 4000389 - RNA, 20 nt, Human herpesvirus 7
cuucaauucaccaauuucua

SEQ ID NO: 4000390 - RNA, 20 nt, Human herpesvirus 7
cuugaaugagcugacagagg

SEQ ID NO: 4000391 - RNA, 22 nt, Human herpesvirus 7
cuugaauuccgauuuaagugaa

SEQ ID NO: 4000392 - RNA, 17 nt, Human herpesvirus 7
cuugccaaaagcuugaa

SEQ ID NO: 4000393 - RNA, 14 nt, Human herpesvirus 7
cuugcuuugaaaaa

SEQ ID NO: 4000394 - RNA, 16 nt, Human herpesvirus 7
cuugcuuugcauagau

SEQ ID NO: 4000395 - RNA, 23 nt, Human herpesvirus 7
cuuuaauaaaaaacaaauaacug

SEQ ID NO: 4000396 - RNA, 24 nt, Human herpesvirus 7
cuuuacagcugagacgauaugaau

SEQ ID NO: 4000397 - RNA, 16 nt, Human herpesvirus 7
cuuuacuuucauagcu

SEQ ID NO: 4000398 - RNA, 14 nt, Human herpesvirus 7
cuuuauaugucaaa

SEQ ID NO: 4000399 - RNA, 15 nt, Human herpesvirus 7
cuuucguuuucuaaa

SEQ ID NO: 4000400 - RNA, 16 nt, Human herpesvirus 7
cuuugaaaaaaacacu

SEQ ID NO: 4000401 - RNA, 18 nt, Human herpesvirus 7
cuuugaaucuauuaaaga

SEQ ID NO: 4000402 - RNA, 17 nt, Human herpesvirus 7
cuuugacaaaaauguua

SEQ ID NO: 4000403 - RNA, 11 nt, Human herpesvirus 7
cuuugacaaag

SEQ ID NO: 4000404 - RNA, 17 nt, Human herpesvirus 7
cuuugucacuuaaagaa

SEQ ID NO: 4000405 - RNA, 18 nt, Human herpesvirus 7
cuuugucaugacuggaca

SEQ ID NO: 4000406 - RNA, 18 nt, Human herpesvirus 7
cuuuucaaugcaacuuua

SEQ ID NO: 4000407 - RNA, 20 nt, Human herpesvirus 7
cuuuucuuaaacaugauuua

SEQ ID NO: 4000408 - RNA, 22 nt, Human herpesvirus 7
cuuuugcgggaaaaaacgucua

SEQ ID NO: 4000409 - RNA, 17 nt, Human herpesvirus 7
gaaaaaaacaaaaucua

SEQ ID NO: 4000410 - RNA, 17 nt, Human herpesvirus 7
gaaaaaaauuaugugua

SEQ ID NO: 4000411 - RNA, 15 nt, Human herpesvirus 7
gaaaaaauaaauucu

SEQ ID NO: 4000412 - RNA, 16 nt, Human herpesvirus 7
gaaaacgcgauaaugu

SEQ ID NO: 4000413 - RNA, 18 nt, Human herpesvirus 7
gaaaacugcaacuuugug

SEQ ID NO: 4000414 - RNA, 18 nt, Human herpesvirus 7
gaaaagcaacuuuucuua

SEQ ID NO: 4000415 - RNA, 19 nt, Human herpesvirus 7
gaaaaguugaagaaaucuu

SEQ ID NO: 4000416 - RNA, 21 nt, Human herpesvirus 7
gaaaauauauuccaacucaau

SEQ ID NO: 4000417 - RNA, 20 nt, Human herpesvirus 7
gaaaaucuccuugauaagau

SEQ ID NO: 4000418 - RNA, 23 nt, Human herpesvirus 7
gaaaauggagcauuauuggauaa

SEQ ID NO: 4000419 - RNA, 12 nt, Human herpesvirus 7
gaaacaaauugu

SEQ ID NO: 4000420 - RNA, 21 nt, Human herpesvirus 7
gaaacaucuuuauauguguuc

SEQ ID NO: 4000421 - RNA, 16 nt, Human herpesvirus 7
gaaacgucccugugac

SEQ ID NO: 4000422 - RNA, 18 nt, Human herpesvirus 7
gaaacuacgucaccaccg

SEQ ID NO: 4000423 - RNA, 20 nt, Human herpesvirus 7
gaaacucaucauugaagaaa

SEQ ID NO: 4000424 - RNA, 22 nt, Human herpesvirus 7
gaaaguaaaaacuuuucuuucu

SEQ ID NO: 4000425 - RNA, 19 nt, Human herpesvirus 7
ggcaacaaacaaauaauuc

SEQ ID NO: 4000426 - RNA, 22 nt, Human herpesvirus 7
ggcaacaguucaaaaaaagaag

SEQ ID NO: 4000427 - RNA, 16 nt, Human herpesvirus 7
gggcuacgaaugggaa

SEQ ID NO: 4000428 - RNA, 22 nt, Human herpesvirus 7
gguaaacucacuucuaaaagcu

SEQ ID NO: 4000429 - RNA, 17 nt, Human herpesvirus 7
gguaaauccuucguaac

SEQ ID NO: 4000430 - RNA, 11 nt, Human herpesvirus 7
gguaaauugua

SEQ ID NO: 4000431 - RNA, 17 nt, Human herpesvirus 7
ggucucuuucuaaaaag

SEQ ID NO: 4000432 - RNA, 16 nt, Human herpesvirus 7
cacauuaucuugacag

SEQ ID NO: 4000433 - RNA, 15 nt, Human herpesvirus 7
caccgugagaaauuu

SEQ ID NO: 4000434 - RNA, 21 nt, Human herpesvirus 7
cacguguucaggcaacauuaa

SEQ ID NO: 4000435 - RNA, 21 nt, Human herpesvirus 7
cacuaacuacagcuuuuggaa

SEQ ID NO: 4000436 - RNA, 21 nt, Human herpesvirus 7
cacuaucuccuaaaugaauuu

SEQ ID NO: 4000437 - RNA, 12 nt, Human herpesvirus 7
cacuguuguagg

SEQ ID NO: 4000438 - RNA, 13 nt, Human herpesvirus 7
cagaaaucccaaa

SEQ ID NO: 4000439 - RNA, 20 nt, Human herpesvirus 7
cagaaauuauacuagcagau

SEQ ID NO: 4000440 - RNA, 15 nt, Human herpesvirus 7
cagaauuuccagaag

SEQ ID NO: 4000441 - RNA, 16 nt, Human herpesvirus 7
cagacaccgucauuuc

SEQ ID NO: 4000442 - RNA, 13 nt, Human herpesvirus 7
cagacagcuguau

SEQ ID NO: 4000443 - RNA, 16 nt, Human herpesvirus 7
cagaccuaacaaaaaa

SEQ ID NO: 4000444 - RNA, 22 nt, Human herpesvirus 7
cagagaucauaauuacauugca

SEQ ID NO: 4000445 - RNA, 16 nt, Human herpesvirus 7
cagauacccacggacg

SEQ ID NO: 4000446 - RNA, 18 nt, Human herpesvirus 7
cagauucuccagaaauua

SEQ ID NO: 4000447 - RNA, 20 nt, Human herpesvirus 7
cagauucuccgcuuuuggau

SEQ ID NO: 4000448 - RNA, 24 nt, Human herpesvirus 7
cagauugaaauuccauacaaagaa

SEQ ID NO: 4000449 - RNA, 16 nt, Human herpesvirus 7
cagcaacugugcauga

SEQ ID NO: 4000450 - RNA, 24 nt, Human herpesvirus 7
cagcaauguauauaagcagacacc

SEQ ID NO: 4000451 - RNA, 16 nt, Human herpesvirus 7
cagcaauuuuaacgau

SEQ ID NO: 4000452 - RNA, 16 nt, Human herpesvirus 7
cagcacaaaugucuua

SEQ ID NO: 4000453 - RNA, 16 nt, Human herpesvirus 7
cagcagccuacuuuac

SEQ ID NO: 4000454 - RNA, 17 nt, Human herpesvirus 7
cagccaucuaauugcag

SEQ ID NO: 4000455 - RNA, 15 nt, Human herpesvirus 7
cagcuagauugacua

SEQ ID NO: 4000456 - RNA, 18 nt, Human herpesvirus 7
caggaaaaagcagacauu

SEQ ID NO: 4000457 - RNA, 16 nt, Human herpesvirus 7
cagucccagauaauua

SEQ ID NO: 4000458 - RNA, 21 nt, Human herpesvirus 7
cagucugaaagccgcugccuu

SEQ ID NO: 4000459 - RNA, 17 nt, Human herpesvirus 7
caguguuuaaaauguua

SEQ ID NO: 4000460 - RNA, 19 nt, Human herpesvirus 7
caguuauuucuuauuggag

SEQ ID NO: 4000461 - RNA, 17 nt, Human herpesvirus 7
cauaauuaugaaauguu

SEQ ID NO: 4000462 - RNA, 13 nt, Human herpesvirus 7
cauacaaugaauu

SEQ ID NO: 4000463 - RNA, 15 nt, Human herpesvirus 7
cauaguaaacacgua

SEQ ID NO: 4000464 - RNA, 23 nt, Human herpesvirus 7
cauauuaacaagcacacuaaaaa

SEQ ID NO: 4000465 - RNA, 13 nt, Human herpesvirus 7
cauauuuugcuag

SEQ ID NO: 4000466 - RNA, 16 nt, Human herpesvirus 7
cauauuuugcuagaaa

SEQ ID NO: 4000467 - RNA, 19 nt, Human herpesvirus 7
cauauuuuuaaauuugucu

SEQ ID NO: 4000468 - RNA, 23 nt, Human herpesvirus 7
caucaaaagucuuguuuuuugga

SEQ ID NO: 4000469 - RNA, 14 nt, Human herpesvirus 7
caucaggaaucuuu

SEQ ID NO: 4000470 - RNA, 23 nt, Human herpesvirus 7
caucgaagaaauucgaaacacuu

SEQ ID NO: 4000471 - RNA, 13 nt, Human herpesvirus 7
caucuaugugcuc

SEQ ID NO: 4000472 - RNA, 15 nt, Human herpesvirus 7
caucucuguggcugu

SEQ ID NO: 4000473 - RNA, 17 nt, Human herpesvirus 7
caucuuuuugaacagaa

SEQ ID NO: 4000474 - RNA, 18 nt, Human herpesvirus 7
caugaucuuguaauuucu

SEQ ID NO: 4000475 - RNA, 16 nt, Human herpesvirus 7
caugauuucaauaauc

SEQ ID NO: 4000476 - RNA, 14 nt, Human herpesvirus 7
caugcaaaaaacag

SEQ ID NO: 4000477 - RNA, 16 nt, Human herpesvirus 7
cauggagcacaauuac

SEQ ID NO: 4000478 - RNA, 17 nt, Human herpesvirus 7
cauuagagcauauucca

SEQ ID NO: 4000479 - RNA, 20 nt, Human herpesvirus 7
cauuagcauugaaaucauuu

SEQ ID NO: 4000480 - RNA, 16 nt, Human herpesvirus 7
cauuccacuaaaagag

SEQ ID NO: 4000481 - RNA, 16 nt, Human herpesvirus 7
cauugcuucagaaaua

SEQ ID NO: 4000482 - RNA, 15 nt, Human herpesvirus 7
cauuuaaaaaaucug

SEQ ID NO: 4000483 - RNA, 24 nt, Human herpesvirus 7
cauuucaaaaucagaaauguuacu

SEQ ID NO: 4000484 - RNA, 15 nt, Human herpesvirus 7
cauuugcuucuucua

SEQ ID NO: 4000485 - RNA, 20 nt, Human herpesvirus 7
cauuuuauucaaagcuucua

SEQ ID NO: 4000486 - RNA, 15 nt, Human herpesvirus 7
ccaaaaucaaaaaac

SEQ ID NO: 4000487 - RNA, 22 nt, Human herpesvirus 7
ccaaaaucaaguguuucuuuga

SEQ ID NO: 4000488 - RNA, 21 nt, Human herpesvirus 7
ccaaauaaacguccauugauu

SEQ ID NO: 4000489 - RNA, 13 nt, Human herpesvirus 7
ccaaauauaugcu

SEQ ID NO: 4000490 - RNA, 22 nt, Human herpesvirus 7
ccaacugaccagagauguuuua

SEQ ID NO: 4000491 - RNA, 17 nt, Human herpesvirus 7
ccaauagaaaacaaauc

SEQ ID NO: 4000492 - RNA, 17 nt, Human herpesvirus 7
ccacucuggaaauguca

SEQ ID NO: 4000493 - RNA, 17 nt, Human herpesvirus 7
ccagaaauuaaauacaa

SEQ ID NO: 4000494 - RNA, 15 nt, Human herpesvirus 7
ccaucacaaaacucu

SEQ ID NO: 4000495 - RNA, 17 nt, Human herpesvirus 7
cccuggaacguccucug

SEQ ID NO: 4000496 - RNA, 21 nt, Human herpesvirus 7
acaauguguuaaauaaagagu

SEQ ID NO: 4000497 - RNA, 14 nt, Human herpesvirus 7
acaauuguauuuca

SEQ ID NO: 4000498 - RNA, 14 nt, Human herpesvirus 7
acaauuugcauaau

SEQ ID NO: 4000499 - RNA, 19 nt, Human herpesvirus 7
acacaagguacauuuugca

SEQ ID NO: 4000500 - RNA, 17 nt, Human herpesvirus 7
acacguagacugagacg

SEQ ID NO: 4000501 - RNA, 16 nt, Human herpesvirus 7
acacuagcuuucuguu

SEQ ID NO: 4000502 - RNA, 22 nt, Human herpesvirus 7
acacuauuggacaaaagacugu

SEQ ID NO: 4000503 - RNA, 19 nt, Human herpesvirus 7
acagaaauugaugaagaca

SEQ ID NO: 4000504 - RNA, 12 nt, Human herpesvirus 7
acagcugagacg

SEQ ID NO: 4000505 - RNA, 16 nt, Human herpesvirus 7
acagucauuugcaguu

SEQ ID NO: 4000506 - RNA, 14 nt, Human herpesvirus 7
acagucugaaagcc

SEQ ID NO: 4000507 - RNA, 16 nt, Human herpesvirus 7
acaguuuuuuaauaca

SEQ ID NO: 4000508 - RNA, 20 nt, Human herpesvirus 7
acaguuuuuuaauacaaaau

SEQ ID NO: 4000509 - RNA, 16 nt, Human herpesvirus 7
acauaauccaaaccgg

SEQ ID NO: 4000510 - RNA, 20 nt, Human herpesvirus 7
ugaaaaagccauaaaaugua

SEQ ID NO: 4000511 - RNA, 23 nt, Human herpesvirus 7
ugaaaacauuagcauugaaauca

SEQ ID NO: 4000512 - RNA, 20 nt, Human herpesvirus 7
ugaaaaucuugaauaaauuu

SEQ ID NO: 4000513 - RNA, 17 nt, Human herpesvirus 7
ugaaauaagaugcuuaa

SEQ ID NO: 4000514 - RNA, 20 nt, Human herpesvirus 7
ugaaauuguaguuuuugcau

SEQ ID NO: 4000515 - RNA, 18 nt, Human herpesvirus 7
ugaacaaguagugcuaau

SEQ ID NO: 4000516 - RNA, 15 nt, Human herpesvirus 7
ugaacaaguuucaaa

SEQ ID NO: 4000517 - RNA, 20 nt, Human herpesvirus 7
ugaaggugucuauuaaaugc

SEQ ID NO: 4000518 - RNA, 14 nt, Human herpesvirus 7
ugaaguuugcugaa

SEQ ID NO: 4000519 - RNA, 13 nt, Human herpesvirus 7
ugaaugaacaaau

SEQ ID NO: 4000520 - RNA, 23 nt, Human herpesvirus 7
ugaauuaucgcaauuaauucagu

SEQ ID NO: 4000521 - RNA, 18 nt, Human herpesvirus 7
ugacaccguuuugaaaag

SEQ ID NO: 4000522 - RNA, 14 nt, Human herpesvirus 7
ugacaucaauaaau

SEQ ID NO: 4000523 - RNA, 21 nt, Human herpesvirus 7
ugauaaauacucaugaaggau

SEQ ID NO: 4000524 - RNA, 20 nt, Human herpesvirus 7
ugauacaggccuguuucuug

SEQ ID NO: 4000525 - RNA, 14 nt, Human herpesvirus 7
ugauauaaaugcuu

SEQ ID NO: 4000526 - RNA, 21 nt, Human herpesvirus 7
ugaucaaaaucuguagaaaau

SEQ ID NO: 4000527 - RNA, 20 nt, Human herpesvirus 7
ugauuguauuugucucugug

SEQ ID NO: 4000528 - RNA, 15 nt, Human herpesvirus 7
ugauuuuuuaaaugu

SEQ ID NO: 4000529 - RNA, 16 nt, Human herpesvirus 7
ugauuuuuuauuccca

SEQ ID NO: 4000530 - RNA, 13 nt, Human herpesvirus 7
ugcaaaacaaaau

SEQ ID NO: 4000531 - RNA, 19 nt, Human herpesvirus 7
ugcaacuuuaauuaacacu

SEQ ID NO: 4000532 - RNA, 20 nt, Human herpesvirus 7
ugcaacuuugugccugaaau

SEQ ID NO: 4000533 - RNA, 17 nt, Human herpesvirus 7
ugcagaccguaaaacaa

SEQ ID NO: 4000534 - RNA, 20 nt, Human herpesvirus 7
ugcaggcuagaaguuuagag

SEQ ID NO: 4000535 - RNA, 22 nt, Human herpesvirus 7
ugcaguguuuuuuucugguaaa

SEQ ID NO: 4000536 - RNA, 18 nt, Human herpesvirus 7
ugcauacucuuguugacu

SEQ ID NO: 4000537 - RNA, 15 nt, Human herpesvirus 7
ugcauauuuugcuag

SEQ ID NO: 4000538 - RNA, 12 nt, Human herpesvirus 7
ugcaucgaauuu

SEQ ID NO: 4000539 - RNA, 20 nt, Human herpesvirus 7
ugccaccgggacagauuuag

SEQ ID NO: 4000540 - RNA, 14 nt, Human herpesvirus 7
ugccauuacugauc

SEQ ID NO: 4000541 - RNA, 24 nt, Human herpesvirus 7
ugccgccauguauugucuuacagc

SEQ ID NO: 4000542 - RNA, 20 nt, Human herpesvirus 7
ugccuuucccagaagaaugg

SEQ ID NO: 4000543 - RNA, 15 nt, Human herpesvirus 7
ugcguuacuucuguc

SEQ ID NO: 4000544 - RNA, 15 nt, Human herpesvirus 7
ugcucaucaaauaag

SEQ ID NO: 4000545 - RNA, 16 nt, Human herpesvirus 7
ugcugauccgccgaca

SEQ ID NO: 4000546 - RNA, 13 nt, Human herpesvirus 7
ugcuggaaaacau

SEQ ID NO: 4000547 - RNA, 19 nt, Human herpesvirus 7
ugcuggaaaacauuucaga

SEQ ID NO: 4000548 - RNA, 15 nt, Human herpesvirus 7
ugcugucuauuucaa

SEQ ID NO: 4000549 - RNA, 19 nt, Human herpesvirus 7
ugcuuaaaaacaguaauuu

SEQ ID NO: 4000550 - RNA, 14 nt, Human herpesvirus 7
ugcuuaaggacagg

SEQ ID NO: 4000551 - RNA, 22 nt, Human herpesvirus 7
ugcuuguaggcagaaaugucuu

SEQ ID NO: 4000552 - RNA, 14 nt, Human herpesvirus 7
ugcuuuguugucau

SEQ ID NO: 4000553 - RNA, 13 nt, Human herpesvirus 7
uggaaaacaacau

SEQ ID NO: 4000554 - RNA, 18 nt, Human herpesvirus 7
uggaaagaagaagauuuu

SEQ ID NO: 4000555 - RNA, 15 nt, Human herpesvirus 7
uggaaaucaaaauuc

SEQ ID NO: 4000556 - RNA, 19 nt, Human herpesvirus 7
uggacagagacaaccaucg

SEQ ID NO: 4000557 - RNA, 17 nt, Human herpesvirus 7
uggacauuucaagaagg

SEQ ID NO: 4000558 - RNA, 20 nt, Human herpesvirus 7
uggauucaagaaaucagauu

SEQ ID NO: 4000559 - RNA, 16 nt, Human herpesvirus 7
uggauuuucuguaauc

SEQ ID NO: 4000560 - RNA, 19 nt, Human herpesvirus 7
uggcaaauccuauaaaagc

SEQ ID NO: 4000561 - RNA, 19 nt, Human herpesvirus 7
uggcgccaaaaaaacacag

SEQ ID NO: 4000562 - RNA, 22 nt, Human herpesvirus 7
uggucagaacaucccuggacag

SEQ ID NO: 4000563 - RNA, 15 nt, Human herpesvirus 7
ugguuauccaaguuu

SEQ ID NO: 4000564 - RNA, 22 nt, Human herpesvirus 7
uguacagauuucauauuuagac

SEQ ID NO: 4000565 - RNA, 19 nt, Human herpesvirus 7
uguaccacgaauaucguug

SEQ ID NO: 4000566 - RNA, 22 nt, Human herpesvirus 7
uguaucuucaagcucuugaaga

SEQ ID NO: 4000567 - RNA, 14 nt, Human herpesvirus 7
uguaugguuucauu

SEQ ID NO: 4000568 - RNA, 13 nt, Human herpesvirus 7
uguauguugaagu

SEQ ID NO: 4000569 - RNA, 14 nt, Human herpesvirus 7
uguauguugaaguu

SEQ ID NO: 4000570 - RNA, 13 nt, Human herpesvirus 7
uguauuaaagaag

SEQ ID NO: 4000571 - RNA, 19 nt, Human herpesvirus 7
uguauuuguugaucuucaa

SEQ ID NO: 4000572 - RNA, 12 nt, Human herpesvirus 7
ugucaggaagca

SEQ ID NO: 4000573 - RNA, 17 nt, Human herpesvirus 7
ugucaggcucauuucaa

SEQ ID NO: 4000574 - RNA, 14 nt, Human herpesvirus 7
ugucaucaaaauuu

SEQ ID NO: 4000575 - RNA, 17 nt, Human herpesvirus 7
uguccagccaaaaucua

SEQ ID NO: 4000576 - RNA, 16 nt, Human herpesvirus 7
ugucuauuaaaugcgu

SEQ ID NO: 4000577 - RNA, 18 nt, Human herpesvirus 7
ugucugauucuuauucua

SEQ ID NO: 4000578 - RNA, 17 nt, Human herpesvirus 7
ugucuuacaacuagaaa

SEQ ID NO: 4000579 - RNA, 12 nt, Human herpesvirus 7
ugucuuggaaga

SEQ ID NO: 4000580 - RNA, 14 nt, Human herpesvirus 7
ugugacccugucac

SEQ ID NO: 4000581 - RNA, 16 nt, Human herpesvirus 7
ugugacuucauaucug

SEQ ID NO: 4000582 - RNA, 17 nt, Human herpesvirus 7
ugugcagagaugaagga

SEQ ID NO: 4000583 - RNA, 21 nt, Human herpesvirus 7
uguguauuuuuuaaagaaaag

SEQ ID NO: 4000584 - RNA, 12 nt, Human herpesvirus 7
ugugucuuacaa

SEQ ID NO: 4000585 - RNA, 14 nt, Human herpesvirus 7
uguuaaauaaagag

SEQ ID NO: 4000586 - RNA, 17 nt, Human herpesvirus 7
uguuaaggagcuucauu

SEQ ID NO: 4000587 - RNA, 17 nt, Human herpesvirus 7
uguuacaugaucuugua

SEQ ID NO: 4000588 - RNA, 13 nt, Human herpesvirus 7
uguuacccaaaau

SEQ ID NO: 4000589 - RNA, 20 nt, Human herpesvirus 7
uguucuaucaagauaagcaa

SEQ ID NO: 4000590 - RNA, 17 nt, Human herpesvirus 7
uguugagucgaaugcau

SEQ ID NO: 4000591 - RNA, 21 nt, Human herpesvirus 7
uguuguagguaauuucuuaua

SEQ ID NO: 4000592 - RNA, 20 nt, Human herpesvirus 7
uguuucuuugaaucuauuaa

SEQ ID NO: 4000593 - RNA, 22 nt, Human herpesvirus 7
uguuugaucaaaaucuguagaa

SEQ ID NO: 4000594 - RNA, 14 nt, Human herpesvirus 7
uguuuugcauauuu

SEQ ID NO: 4000595 - RNA, 13 nt, Human herpesvirus 7
uuaaaaaaaugaa

SEQ ID NO: 4000596 - RNA, 15 nt, Human herpesvirus 7
uuaaaaaccacagag

SEQ ID NO: 4000597 - RNA, 20 nt, Human herpesvirus 7
uuaaaaguacaaauguuuua

SEQ ID NO: 4000598 - RNA, 15 nt, Human herpesvirus 7
uuaaaauacuaauca

SEQ ID NO: 4000599 - RNA, 12 nt, Human herpesvirus 7
uuaaaauauguu

SEQ ID NO: 4000600 - RNA, 15 nt, Human herpesvirus 7
uuaaaauauuagaac

SEQ ID NO: 4000601 - RNA, 16 nt, Human herpesvirus 7
uuaaagauguuucuuu

SEQ ID NO: 4000602 - RNA, 19 nt, Human herpesvirus 7
uuaaaggaaacauuucuaa

SEQ ID NO: 4000603 - RNA, 15 nt, Human herpesvirus 7
uuaaauagugaauca

SEQ ID NO: 4000604 - RNA, 12 nt, Human herpesvirus 7
uuaaaugucaau

SEQ ID NO: 4000605 - RNA, 20 nt, Human herpesvirus 7
uuaaauuuuucgcugucuuu

SEQ ID NO: 4000606 - RNA, 17 nt, Human herpesvirus 7
uacagaaauugaugaag

SEQ ID NO: 4000607 - RNA, 13 nt, Human herpesvirus 7
uacagaagaacau

SEQ ID NO: 4000608 - RNA, 16 nt, Human herpesvirus 7
uacagacagaaugcca

SEQ ID NO: 4000609 - RNA, 18 nt, Human herpesvirus 7
uacagcauauaucuuuga

SEQ ID NO: 4000610 - RNA, 13 nt, Human herpesvirus 7
uaccaauaaaagg

SEQ ID NO: 4000611 - RNA, 12 nt, Human herpesvirus 7
uacgguuuucag

SEQ ID NO: 4000612 - RNA, 13 nt, Human herpesvirus 7
uacgucaucccug

SEQ ID NO: 4000613 - RNA, 24 nt, Human herpesvirus 7
uacgugaguguuguaacaacuagc

SEQ ID NO: 4000614 - RNA, 16 nt, Human herpesvirus 7
uacucagaagacauau

SEQ ID NO: 4000615 - RNA, 18 nt, Human herpesvirus 7
uagaaaaacacuagcuuu

SEQ ID NO: 4000616 - RNA, 17 nt, Human herpesvirus 7
uagaaaaugcuguuuuu

SEQ ID NO: 4000617 - RNA, 20 nt, Human herpesvirus 7
uagaacagcugaaacucauc

SEQ ID NO: 4000618 - RNA, 19 nt, Human herpesvirus 7
uagaacuugcgaauacuug

SEQ ID NO: 4000619 - RNA, 16 nt, Human herpesvirus 7
uagaugcauccaaaga

SEQ ID NO: 4000620 - RNA, 22 nt, Human herpesvirus 7
uagauuuggaugacauuuugga

SEQ ID NO: 4000621 - RNA, 22 nt, Human herpesvirus 7
uagauuuuuugaaaaagauuua

SEQ ID NO: 4000622 - RNA, 13 nt, Human herpesvirus 7
uaggauagcuuga

SEQ ID NO: 4000623 - RNA, 13 nt, Human herpesvirus 7
uaggcuucuucua

SEQ ID NO: 4000624 - RNA, 12 nt, Human herpesvirus 7
uaggggaagaau

SEQ ID NO: 4000625 - RNA, 15 nt, Human herpesvirus 7
uaggggaagaaucaa

SEQ ID NO: 4000626 - RNA, 16 nt, Human herpesvirus 7
uagucauccaauauca

SEQ ID NO: 4000627 - RNA, 19 nt, Human herpesvirus 7
uaguucugaaaucaaaaau

SEQ ID NO: 4000628 - RNA, 20 nt, Human herpesvirus 7
uauaaaacgugugaaaacaa

SEQ ID NO: 4000629 - RNA, 12 nt, Human herpesvirus 7
uauacaacuuua

SEQ ID NO: 4000630 - RNA, 17 nt, Human herpesvirus 7
uauacauguaacuguuu

SEQ ID NO: 4000631 - RNA, 16 nt, Human herpesvirus 7
uauauaaguccuucaa

SEQ ID NO: 4000632 - RNA, 15 nt, Human herpesvirus 7
uauaugaaauuucaa

SEQ ID NO: 4000633 - RNA, 19 nt, Human herpesvirus 7
uauaugaaucaaauuucaa

SEQ ID NO: 4000634 - RNA, 12 nt, Human herpesvirus 7
uauauuaaucuu

SEQ ID NO: 4000635 - RNA, 21 nt, Human herpesvirus 7
uauauuacuacgguuuucaga

SEQ ID NO: 4000636 - RNA, 13 nt, Human herpesvirus 7
uaucaaaauucca

SEQ ID NO: 4000637 - RNA, 14 nt, Human herpesvirus 7
uaucaucaucuuuu

SEQ ID NO: 4000638 - RNA, 15 nt, Human herpesvirus 7
uaucaugauuauaua

SEQ ID NO: 4000639 - RNA, 16 nt, Human herpesvirus 7
uaucgcgaaacagcgu

SEQ ID NO: 4000640 - RNA, 17 nt, Human herpesvirus 7
uaucucauagcuuaaaa

SEQ ID NO: 4000641 - RNA, 12 nt, Human herpesvirus 7
uaucugugacuu

SEQ ID NO: 4000642 - RNA, 16 nt, Human herpesvirus 7
uaucuguggcuuuugc

SEQ ID NO: 4000643 - RNA, 12 nt, Human herpesvirus 7
uaugacucagac

SEQ ID NO: 4000644 - RNA, 18 nt, Human herpesvirus 7
uaugauuuuuuaaaugug

SEQ ID NO: 4000645 - RNA, 14 nt, Human herpesvirus 7
uaugcaugcaauuu

SEQ ID NO: 4000646 - RNA, 13 nt, Human herpesvirus 7
uaugcuaagaaag

SEQ ID NO: 4000647 - RNA, 14 nt, Human herpesvirus 7
uauggacuccugua

SEQ ID NO: 4000648 - RNA, 17 nt, Human herpesvirus 7
uauggauacaaggaaaa

SEQ ID NO: 4000649 - RNA, 20 nt, Human herpesvirus 7
uaugguuucauuuggaagau

SEQ ID NO: 4000650 - RNA, 14 nt, Human herpesvirus 7
uaugguuugaaaac

SEQ ID NO: 4000651 - RNA, 13 nt, Human herpesvirus 7
uauuaaaaaccac

SEQ ID NO: 4000652 - RNA, 20 nt, Human herpesvirus 7
uauuacucgaaauuuaaaaa

SEQ ID NO: 4000653 - RNA, 14 nt, Human herpesvirus 7
uauuauuaaagcuu

SEQ ID NO: 4000654 - RNA, 20 nt, Human herpesvirus 7
uauugaauguggaauuaaau

SEQ ID NO: 4000655 - RNA, 16 nt, Human herpesvirus 7
uauuguaucuaugaaa

SEQ ID NO: 4000656 - RNA, 21 nt, Human herpesvirus 7
uauuuaagcuucaaaaauguu

SEQ ID NO: 4000657 - RNA, 22 nt, Human herpesvirus 7
uauuugucggugaauguagaag

SEQ ID NO: 4000658 - RNA, 13 nt, Human herpesvirus 7
uauuuuacauauu

SEQ ID NO: 4000659 - RNA, 17 nt, Human herpesvirus 7
uauuuugauaauuuaca

SEQ ID NO: 4000660 - RNA, 20 nt, Human herpesvirus 7
ucaaaaaaaaaacaauccac

SEQ ID NO: 4000661 - RNA, 15 nt, Human herpesvirus 7
ucaaaacauaucaga

SEQ ID NO: 4000662 - RNA, 21 nt, Human herpesvirus 7
ucaaacaauugcccuuguguu

SEQ ID NO: 4000663 - RNA, 14 nt, Human herpesvirus 7
ucaaagugugcccg

SEQ ID NO: 4000664 - RNA, 22 nt, Human herpesvirus 7
ucaaauauauauuaagaaauaa

SEQ ID NO: 4000665 - RNA, 20 nt, Human herpesvirus 7
ucaacacaauuuucacaucu

SEQ ID NO: 4000666 - RNA, 17 nt, Human herpesvirus 7
ucaacuugcagaggacc

SEQ ID NO: 4000667 - RNA, 23 nt, Human herpesvirus 7
ucaaggggucgcauauugcaauu

SEQ ID NO: 4000668 - RNA, 23 nt, Human herpesvirus 7
ucaauaaaugguuuuauuucaca

SEQ ID NO: 4000669 - RNA, 18 nt, Human herpesvirus 7
ucaauaacgaauuauuua

SEQ ID NO: 4000670 - RNA, 22 nt, Human herpesvirus 7
ucaauaguuuuacaaagaacau

SEQ ID NO: 4000671 - RNA, 19 nt, Human herpesvirus 7
ucaauuuauccuaagcuuu

SEQ ID NO: 4000672 - RNA, 23 nt, Human herpesvirus 7
ucacagauaaaaauuuauuuucu

SEQ ID NO: 4000673 - RNA, 21 nt, Human herpesvirus 7
ucacagcuagauugacuauga

SEQ ID NO: 4000674 - RNA, 21 nt, Human herpesvirus 7
ucacaguugcuugugaaggag

SEQ ID NO: 4000675 - RNA, 13 nt, Human herpesvirus 7
ucacauugucacu

SEQ ID NO: 4000676 - RNA, 14 nt, Human herpesvirus 7
ucagaacuguuuua

SEQ ID NO: 4000677 - RNA, 15 nt, Human herpesvirus 7
ucagaauagacaucu

SEQ ID NO: 4000678 - RNA, 14 nt, Human herpesvirus 7
ucagauugaaauuc

SEQ ID NO: 4000679 - RNA, 13 nt, Human herpesvirus 7
ucagcucuguaau

SEQ ID NO: 4000680 - RNA, 14 nt, Human herpesvirus 7
ucaggaucuccugg

SEQ ID NO: 4000681 - RNA, 13 nt, Human herpesvirus 7
ucaguuaucaagu

SEQ ID NO: 4000682 - RNA, 15 nt, Human herpesvirus 7
ucauaaucaucuuuc

SEQ ID NO: 4000683 - RNA, 15 nt, Human herpesvirus 7
ucaucaaaauuuuaa

SEQ ID NO: 4000684 - RNA, 21 nt, Human herpesvirus 7
ucaucccaaaccaugauguua

SEQ ID NO: 4000685 - RNA, 17 nt, Human herpesvirus 7
ucaucucacuucagaag

SEQ ID NO: 4000686 - RNA, 15 nt, Human herpesvirus 7
ucaugaaaacagugg

SEQ ID NO: 4000687 - RNA, 20 nt, Human herpesvirus 7
ucaugaacacaacauccaga

SEQ ID NO: 4000688 - RNA, 19 nt, Human herpesvirus 7
ucaugacuggacacaauca

SEQ ID NO: 4000689 - RNA, 18 nt, Human herpesvirus 7
ucauuaucaccacaauuu

SEQ ID NO: 4000690 - RNA, 14 nt, Human herpesvirus 7
ucauugugugucuu

SEQ ID NO: 4000691 - RNA, 22 nt, Human herpesvirus 7
ucauuuaauuggcaacacaaau

SEQ ID NO: 4000692 - RNA, 15 nt, Human herpesvirus 7
ucauuuguauauucu

SEQ ID NO: 4000693 - RNA, 22 nt, Human herpesvirus 7
uccaaagaaaaaaggaugaaag

SEQ ID NO: 4000694 - RNA, 16 nt, Human herpesvirus 7
uccaaucauaauuuuc

SEQ ID NO: 4000695 - RNA, 20 nt, Human herpesvirus 7
uccagcaaagacuugcaaag

SEQ ID NO: 4000696 - RNA, 22 nt, Human herpesvirus 7
uccaguacgucuugcuguuugu

SEQ ID NO: 4000697 - RNA, 17 nt, Human herpesvirus 7
uccauuuccucaauuuu

SEQ ID NO: 4000698 - RNA, 19 nt, Human herpesvirus 7
uccuaacuauaauagccuu

SEQ ID NO: 4000699 - RNA, 15 nt, Human herpesvirus 7
uccuuucguuuucaa

SEQ ID NO: 4000700 - RNA, 17 nt, Human herpesvirus 7
ucgaacccuggagagac

SEQ ID NO: 4000701 - RNA, 21 nt, Human herpesvirus 7
ucgaacccuggagagacauag

SEQ ID NO: 4000702 - RNA, 16 nt, Human herpesvirus 7
ucgacuuccucucgug

SEQ ID NO: 4000703 - RNA, 15 nt, Human herpesvirus 7
ucgauauacauguaa

SEQ ID NO: 4000704 - RNA, 18 nt, Human herpesvirus 7
ucgauuagguaauagcuu

SEQ ID NO: 4000705 - RNA, 23 nt, Human herpesvirus 7
ucguuuuuauuuuuuucugaaau

SEQ ID NO: 4000706 - RNA, 15 nt, Human herpesvirus 7
ucguuuuuggcaaaa

SEQ ID NO: 4000707 - RNA, 23 nt, Human herpesvirus 7
ucuaaaaauguuuuuguuucuga

SEQ ID NO: 4000708 - RNA, 16 nt, Human herpesvirus 7
ucuaaauaugaugaaa

SEQ ID NO: 4000709 - RNA, 20 nt, Human herpesvirus 7
ucuaauuaaucugcauauaa

SEQ ID NO: 4000710 - RNA, 23 nt, Human herpesvirus 7
ucuacacaaacgaguuucaaaau

SEQ ID NO: 4000711 - RNA, 20 nt, Human herpesvirus 7
ucuaucaaggucuuucaugc

SEQ ID NO: 4000712 - RNA, 15 nt, Human herpesvirus 7
ucuauuaaauauuua

SEQ ID NO: 4000713 - RNA, 18 nt, Human herpesvirus 7
ucuauuaaauauuuagag

SEQ ID NO: 4000714 - RNA, 15 nt, Human herpesvirus 7
ucuauuacacaggaa

SEQ ID NO: 4000715 - RNA, 22 nt, Human herpesvirus 7
ucuauuauuucuacacaaacga

SEQ ID NO: 4000716 - RNA, 15 nt, Human herpesvirus 7
ucucaaaacaaacuc

SEQ ID NO: 4000717 - RNA, 18 nt, Human herpesvirus 7
ucucaaucaaaaucuugu

SEQ ID NO: 4000718 - RNA, 18 nt, Human herpesvirus 7
ucucaauuaaaacaucuc

SEQ ID NO: 4000719 - RNA, 19 nt, Human herpesvirus 7
ucuccgugucacugucacu

SEQ ID NO: 4000720 - RNA, 19 nt, Human herpesvirus 7
ucuccuugauaagauuucc

SEQ ID NO: 4000721 - RNA, 15 nt, Human herpesvirus 7
aaauuacuugcuaug

SEQ ID NO: 4000722 - RNA, 19 nt, Human herpesvirus 7
aaauuauuauuaguauugu

SEQ ID NO: 4000723 - RNA, 21 nt, Human herpesvirus 7
aaauuauuauuaguauuguaa

SEQ ID NO: 4000724 - RNA, 23 nt, Human herpesvirus 7
aaauucuucagguuguugucauu

SEQ ID NO: 4000725 - RNA, 15 nt, Human herpesvirus 7
aaauugguucagcgu

SEQ ID NO: 4000726 - RNA, 15 nt, Human herpesvirus 7
aaauuuaaauacuga

SEQ ID NO: 4000727 - RNA, 15 nt, Human herpesvirus 7
aacaaacuguaccca

SEQ ID NO: 4000728 - RNA, 22 nt, Human herpesvirus 7
aacaaagauugaagcacacacg

SEQ ID NO: 4000729 - RNA, 22 nt, Human herpesvirus 7
aacaaagugcauaaauaauaac

SEQ ID NO: 4000730 - RNA, 18 nt, Human herpesvirus 7
aacaacagcagcugcuaa

SEQ ID NO: 4000731 - RNA, 14 nt, Human herpesvirus 7
aacaauauagagua

SEQ ID NO: 4000732 - RNA, 15 nt, Human herpesvirus 7
aacaauauuuaaagu

SEQ ID NO: 4000733 - RNA, 19 nt, Human herpesvirus 7
aacaccccuugcagaaacu

SEQ ID NO: 4000734 - RNA, 16 nt, Human herpesvirus 7
aacagagaacaccaua

SEQ ID NO: 4000735 - RNA, 14 nt, Human herpesvirus 7
aacaguucaaaaaa

SEQ ID NO: 4000736 - RNA, 22 nt, Human herpesvirus 7
aacauaaaaacuaaguuuugca

SEQ ID NO: 4000737 - RNA, 18 nt, Human herpesvirus 7
aacaugaguacuguuucu

SEQ ID NO: 4000738 - RNA, 13 nt, Human herpesvirus 7
aacauugcuucag

SEQ ID NO: 4000739 - RNA, 14 nt, Human herpesvirus 7
aacauugucaaaga

SEQ ID NO: 4000740 - RNA, 13 nt, Human herpesvirus 7
aacauuuguugcu

SEQ ID NO: 4000741 - RNA, 16 nt, Human herpesvirus 7
aaccacaaaaaucaaa

SEQ ID NO: 4000742 - RNA, 20 nt, Human herpesvirus 7
aaccaugaaaaauaaauacu

SEQ ID NO: 4000743 - RNA, 14 nt, Human herpesvirus 7
aaccgauacagauc

SEQ ID NO: 4000744 - RNA, 18 nt, Human herpesvirus 7
aaccgccauucuuuucaa

SEQ ID NO: 4000745 - RNA, 21 nt, Human herpesvirus 7
aaccuggauguaaugaauaaa

SEQ ID NO: 4000746 - RNA, 21 nt, Human herpesvirus 7
aaccuguacucgacucugaau

SEQ ID NO: 4000747 - RNA, 19 nt, Human herpesvirus 7
aacgauaugguuugaaaac

SEQ ID NO: 4000748 - RNA, 19 nt, Human herpesvirus 7
aacgucaggaaaaaaacgu

SEQ ID NO: 4000749 - RNA, 16 nt, Human herpesvirus 7
aacgugugaaaacaau

SEQ ID NO: 4000750 - RNA, 22 nt, Human herpesvirus 7
aacguuaccguuuaaugaaaaa

SEQ ID NO: 4000751 - RNA, 20 nt, Human herpesvirus 7
aacuaagcauauugaagauc

SEQ ID NO: 4000752 - RNA, 18 nt, Human herpesvirus 7
aacuaaguuuugcauuuu

SEQ ID NO: 4000753 - RNA, 16 nt, Human herpesvirus 7
aacucuuccuguuaau

SEQ ID NO: 4000754 - RNA, 19 nt, Human herpesvirus 7
aacugagaaaaaugacaaa

SEQ ID NO: 4000755 - RNA, 15 nt, Human herpesvirus 7
aacugcaaauccaac

SEQ ID NO: 4000756 - RNA, 22 nt, Human herpesvirus 7
aacugugcaugaaaucuugaau

SEQ ID NO: 4000757 - RNA, 21 nt, Human herpesvirus 7
aacuguuaaaaucuguucccc

SEQ ID NO: 4000758 - RNA, 23 nt, Human herpesvirus 7
aacuguuacaguuaaagacggaa

SEQ ID NO: 4000759 - RNA, 14 nt, Human herpesvirus 7
aacuuugcaacaaa

SEQ ID NO: 4000760 - RNA, 16 nt, Human herpesvirus 7
aacuuugcaacaaaau

SEQ ID NO: 4000761 - RNA, 12 nt, Human herpesvirus 7
aagaaauuuucu

SEQ ID NO: 4000762 - RNA, 21 nt, Human herpesvirus 7
aagaacauuaauaucaauuug

SEQ ID NO: 4000763 - RNA, 13 nt, Human herpesvirus 7
aagaacugugaag

SEQ ID NO: 4000764 - RNA, 14 nt, Human herpesvirus 7
aagaacuuacauuu

SEQ ID NO: 4000765 - RNA, 15 nt, Human herpesvirus 7
aagaaugcucuuuug

SEQ ID NO: 4000766 - RNA, 19 nt, Human herpesvirus 7
aagaauuuggauagauaca

SEQ ID NO: 4000767 - RNA, 19 nt, Human herpesvirus 7
aagacaccccaaaaucaaa

SEQ ID NO: 4000768 - RNA, 19 nt, Human herpesvirus 7
aagacacuuauuugauuau

SEQ ID NO: 4000769 - RNA, 15 nt, Human herpesvirus 7
aagacauuauuugcu

SEQ ID NO: 4000770 - RNA, 16 nt, Human herpesvirus 7
aagagacugucauaau

SEQ ID NO: 4000771 - RNA, 19 nt, Human herpesvirus 7
aagagccaaauauggagac

SEQ ID NO: 4000772 - RNA, 18 nt, Human herpesvirus 7
aagagguaaguguaagcu

SEQ ID NO: 4000773 - RNA, 19 nt, Human herpesvirus 7
aagauucuagcguuucguu

SEQ ID NO: 4000774 - RNA, 15 nt, Human herpesvirus 7
aagauugcuugcacu

SEQ ID NO: 4000775 - RNA, 16 nt, Human herpesvirus 7
aagauuuaacaugugu

SEQ ID NO: 4000776 - RNA, 21 nt, Human herpesvirus 7
aagcaacuuuucuuaaacaug

SEQ ID NO: 4000777 - RNA, 13 nt, Human herpesvirus 7
aagcacaaaucaa

SEQ ID NO: 4000778 - RNA, 16 nt, Human herpesvirus 7
aagcugcagcugaaag

SEQ ID NO: 4000779 - RNA, 23 nt, Human herpesvirus 7
aagcugcauguguacuaaagcca

SEQ ID NO: 4000780 - RNA, 22 nt, Human herpesvirus 7
aagcuugugaagacuacauaaa

SEQ ID NO: 4000781 - RNA, 22 nt, Human herpesvirus 7
aagcuuuugcgagaaaauacua

SEQ ID NO: 4000782 - RNA, 16 nt, Human herpesvirus 7
aaggaaaauuucauuu

SEQ ID NO: 4000783 - RNA, 22 nt, Human herpesvirus 7
aaggaaauuaguucuugugacg

SEQ ID NO: 4000784 - RNA, 22 nt, Human herpesvirus 7
aaggauuugcguaauggauuua

SEQ ID NO: 4000785 - RNA, 16 nt, Human herpesvirus 7
aagguuuaaaacauuu

SEQ ID NO: 4000786 - RNA, 18 nt, Human herpesvirus 7
aagugaacaugacuucag

SEQ ID NO: 4000787 - RNA, 11 nt, Human herpesvirus 7
aagugugcccg

SEQ ID NO: 4000788 - RNA, 22 nt, Human herpesvirus 7
aaguuaaaagaucuuuuacaga

SEQ ID NO: 4000789 - RNA, 15 nt, Human herpesvirus 7
aaguuagcgaaucau

SEQ ID NO: 4000790 - RNA, 16 nt, Human herpesvirus 7
aaguuuuacagaaauu

SEQ ID NO: 4000791 - RNA, 13 nt, Human herpesvirus 7
aaguuuucuuaua

SEQ ID NO: 4000792 - RNA, 13 nt, Human herpesvirus 7
aauaaacaggaac

SEQ ID NO: 4000793 - RNA, 19 nt, Human herpesvirus 7
aauaaaggaaagacaaacu

SEQ ID NO: 4000794 - RNA, 22 nt, Human herpesvirus 7
aauaaauuuuucgaucuguaaa

SEQ ID NO: 4000795 - RNA, 17 nt, Human herpesvirus 7
aauaaguccgugugcaa

SEQ ID NO: 4000796 - RNA, 15 nt, Human herpesvirus 7
aauacaugaauuauc

SEQ ID NO: 4000797 - RNA, 19 nt, Human herpesvirus 7
aauaccaugaaaaauauga

SEQ ID NO: 4000798 - RNA, 23 nt, Human herpesvirus 7
aauaguuuuacaaagaacaugua

SEQ ID NO: 4000799 - RNA, 20 nt, Human herpesvirus 7
aauaucuuuuucaaauggau

SEQ ID NO: 4000800 - RNA, 16 nt, Human herpesvirus 7
aauaugcaugcaauuu

SEQ ID NO: 4000801 - RNA, 16 nt, Human herpesvirus 7
aauaugcauguguaaa

SEQ ID NO: 4000802 - RNA, 19 nt, Human herpesvirus 7
aauauguagcaucucugug

SEQ ID NO: 4000803 - RNA, 14 nt, Human herpesvirus 7
aauaugugaaaaua

SEQ ID NO: 4000804 - RNA, 14 nt, Human herpesvirus 7
aauauuauaucuaa

SEQ ID NO: 4000805 - RNA, 19 nt, Human herpesvirus 7
aauauuuaaaguagcugaa

SEQ ID NO: 4000806 - RNA, 13 nt, Human herpesvirus 7
aauauuuaugccu

SEQ ID NO: 4000807 - RNA, 19 nt, Human herpesvirus 7
aaucaaaaaauaauuccuu

SEQ ID NO: 4000808 - RNA, 14 nt, Human herpesvirus 7
aaucaacaaaauga

SEQ ID NO: 4000809 - RNA, 16 nt, Human herpesvirus 7
aaucaacaaaaugaca

SEQ ID NO: 4000810 - RNA, 20 nt, Human herpesvirus 7
aaucaagacgcuguaugcaa

SEQ ID NO: 4000811 - RNA, 17 nt, Human herpesvirus 7
aaucaagucugaaggcu

SEQ ID NO: 4000812 - RNA, 16 nt, Human herpesvirus 7
aaucaugaaaacagug

SEQ ID NO: 4000813 - RNA, 17 nt, Human herpesvirus 7
aaucauguuuaagaaaa

SEQ ID NO: 4000814 - RNA, 18 nt, Human herpesvirus 7
aaucauuuuuaaaaauaa

SEQ ID NO: 4000815 - RNA, 13 nt, Human herpesvirus 7
aaucgagaauaaa

SEQ ID NO: 4000816 - RNA, 17 nt, Human herpesvirus 7
aaucgauaaacuuuguc

SEQ ID NO: 4000817 - RNA, 16 nt, Human herpesvirus 7
aaucuauauaaaauau

SEQ ID NO: 4000818 - RNA, 21 nt, Human herpesvirus 7
aaucuauauuugauugaucgu

SEQ ID NO: 4000819 - RNA, 17 nt, Human herpesvirus 7
aaucuaugcaaagcaag

SEQ ID NO: 4000820 - RNA, 18 nt, Human herpesvirus 7
aaucuggacauuucaaga

SEQ ID NO: 4000821 - RNA, 20 nt, Human herpesvirus 7
aaucuuuuauaaauaguuuc

SEQ ID NO: 4000822 - RNA, 14 nt, Human herpesvirus 7
aaucuuuuuugaac

SEQ ID NO: 4000823 - RNA, 19 nt, Human herpesvirus 7
aaugaauuuuaaguggaau

SEQ ID NO: 4000824 - RNA, 19 nt, Human herpesvirus 7
aaugaccgcaugugaaaau

SEQ ID NO: 4000825 - RNA, 14 nt, Human herpesvirus 7
aaugagauuucuga

SEQ ID NO: 4000826 - RNA, 21 nt, Human herpesvirus 7
aaugagauuuuucccaaaaua

SEQ ID NO: 4000827 - RNA, 14 nt, Human herpesvirus 7
aaugcaucugaauu

SEQ ID NO: 4000828 - RNA, 17 nt, Human herpesvirus 7
aauguagacguaguguc

SEQ ID NO: 4000829 - RNA, 15 nt, Human herpesvirus 7
aaugucagaguuuaa

SEQ ID NO: 4000830 - RNA, 14 nt, Human herpesvirus 7
aaugucucuguucc

SEQ ID NO: 4000831 - RNA, 20 nt, Human herpesvirus 7
aaugugucuuacaacuagaa

SEQ ID NO: 4000832 - RNA, 23 nt, Human herpesvirus 7
aaugugucuuacaacuagaaaau

SEQ ID NO: 4000833 - RNA, 15 nt, Human herpesvirus 7
aauguugcaaauguu

SEQ ID NO: 4000834 - RNA, 14 nt, Human herpesvirus 7
aauuaauaaaagua

SEQ ID NO: 4000835 - RNA, 21 nt, Human herpesvirus 7
aauuacaguacaaccgccauu

SEQ ID NO: 4000836 - RNA, 19 nt, Human herpesvirus 7
acuucuuugacaaaaaugu

SEQ ID NO: 4000837 - RNA, 13 nt, Human herpesvirus 7
acuugaaaaauuu

SEQ ID NO: 4000838 - RNA, 19 nt, Human herpesvirus 7
acuugaauagguaucuuua

SEQ ID NO: 4000839 - RNA, 21 nt, Human herpesvirus 7
acuugaauagguaucuuuacu

SEQ ID NO: 4000840 - RNA, 14 nt, Human herpesvirus 7
acuuguaauuuuug

SEQ ID NO: 4000841 - RNA, 23 nt, Human herpesvirus 7
acuuguuuugacuuauggugugg

SEQ ID NO: 4000842 - RNA, 18 nt, Human herpesvirus 7
acuuucuugaagaaauug

SEQ ID NO: 4000843 - RNA, 16 nt, Human herpesvirus 7
acuuugccaaugccaa

SEQ ID NO: 4000844 - RNA, 16 nt, Human herpesvirus 7
agaaaaaaacaaugaa

SEQ ID NO: 4000845 - RNA, 14 nt, Human herpesvirus 7
agaaaaauauuuaa

SEQ ID NO: 4000846 - RNA, 17 nt, Human herpesvirus 7
agaaaaguugaaaaugu

SEQ ID NO: 4000847 - RNA, 18 nt, Human herpesvirus 7
agaaauuaugaaaagcuu

SEQ ID NO: 4000848 - RNA, 19 nt, Human herpesvirus 7
agaacagcugaaacucauc

SEQ ID NO: 4000849 - RNA, 18 nt, Human herpesvirus 7
agaacuaggaaacacaau

SEQ ID NO: 4000850 - RNA, 19 nt, Human herpesvirus 7
agaacuugcgaauacuugu

SEQ ID NO: 4000851 - RNA, 20 nt, Human herpesvirus 7
agaacuuuuguaggaaauuu

SEQ ID NO: 4000852 - RNA, 19 nt, Human herpesvirus 7
agaagcuugcuagauucua

SEQ ID NO: 4000853 - RNA, 15 nt, Human herpesvirus 7
agaauauaaaaaauu

SEQ ID NO: 4000854 - RNA, 19 nt, Human herpesvirus 7
agaaucagacuaaauaugg

SEQ ID NO: 4000855 - RNA, 19 nt, Human herpesvirus 7
agaaucauuuguauauucu

SEQ ID NO: 4000856 - RNA, 23 nt, Human herpesvirus 7
agaauggcgaguuacauuucacu

SEQ ID NO: 4000857 - RNA, 15 nt, Human herpesvirus 7
agaauuagagugcuu

SEQ ID NO: 4000858 - RNA, 22 nt, Human herpesvirus 7
agaauuuggauagauacauuau

SEQ ID NO: 4000859 - RNA, 23 nt, Human herpesvirus 7
agacacggaguuuuuacucugug

SEQ ID NO: 4000860 - RNA, 20 nt, Human herpesvirus 7
agacaucuuccacaaaaauu

SEQ ID NO: 4000861 - RNA, 17 nt, Human herpesvirus 7
agacauugaaaaugcau

SEQ ID NO: 4000862 - RNA, 16 nt, Human herpesvirus 7
agacauugaagauugu

SEQ ID NO: 4000863 - RNA, 20 nt, Human herpesvirus 7
agacuaaauauggagcagcu

SEQ ID NO: 4000864 - RNA, 21 nt, Human herpesvirus 7
agacuaaauauggagcagcuu

SEQ ID NO: 4000865 - RNA, 14 nt, Human herpesvirus 7
agaguauacaaaag

SEQ ID NO: 4000866 - RNA, 22 nt, Human herpesvirus 7
agagucugugugugcaguguuu

SEQ ID NO: 4000867 - RNA, 21 nt, Human herpesvirus 7
agauaaaaauuuauuuucuaa

SEQ ID NO: 4000868 - RNA, 17 nt, Human herpesvirus 7
agauaauauagaugcag

SEQ ID NO: 4000869 - RNA, 22 nt, Human herpesvirus 7
agauauuuuaauucuaaaaauu

SEQ ID NO: 4000870 - RNA, 21 nt, Human herpesvirus 7
agaucauaauuacauugcagu

SEQ ID NO: 4000871 - RNA, 13 nt, Human herpesvirus 7
agaugcaugcuaa

SEQ ID NO: 4000872 - RNA, 19 nt, Human herpesvirus 7
agauguguuggaaacuauu

SEQ ID NO: 4000873 - RNA, 18 nt, Human herpesvirus 7
agauuauacaaauccaag

SEQ ID NO: 4000874 - RNA, 20 nt, Human herpesvirus 7
agauuauucaaaagcuaaaa

SEQ ID NO: 4000875 - RNA, 18 nt, Human herpesvirus 7
agauucuccagaaauuau

SEQ ID NO: 4000876 - RNA, 20 nt, Human herpesvirus 7
agauuuaaaguaagaaugga

SEQ ID NO: 4000877 - RNA, 16 nt, Human herpesvirus 7
agauuugacaaaacaa

SEQ ID NO: 4000878 - RNA, 14 nt, Human herpesvirus 7
agcaaaucugaaaa

SEQ ID NO: 4000879 - RNA, 17 nt, Human herpesvirus 7
agcaauacauucucaaa

SEQ ID NO: 4000880 - RNA, 18 nt, Human herpesvirus 7
agcaauacauucucaaaa

SEQ ID NO: 4000881 - RNA, 22 nt, Human herpesvirus 7
agcaccaaaaaauaaaaacaag

SEQ ID NO: 4000882 - RNA, 14 nt, Human herpesvirus 7
agcacuacuagaaa

SEQ ID NO: 4000883 - RNA, 22 nt, Human herpesvirus 7
agcauauaucuuugauuacucg

SEQ ID NO: 4000884 - RNA, 21 nt, Human herpesvirus 7
agcauugaaaucauuuugcug

SEQ ID NO: 4000885 - RNA, 20 nt, Human herpesvirus 7
agcgcuuuuuaaaaaaucua

SEQ ID NO: 4000886 - RNA, 23 nt, Human herpesvirus 7
agcuauuauaauguaagaaauuu

SEQ ID NO: 4000887 - RNA, 12 nt, Human herpesvirus 7
agcucaaaaagu

SEQ ID NO: 4000888 - RNA, 18 nt, Human herpesvirus 7
agcuccaagcuuaaauaa

SEQ ID NO: 4000889 - RNA, 18 nt, Human herpesvirus 7
agcucuaaacaaacaaug

SEQ ID NO: 4000890 - RNA, 23 nt, Human herpesvirus 7
agcugcauguguacuaaagccaa

SEQ ID NO: 4000891 - RNA, 15 nt, Human herpesvirus 7
agcuuaaaaaauaca

SEQ ID NO: 4000892 - RNA, 16 nt, Human herpesvirus 7
agcuucaaaaauguuu

SEQ ID NO: 4000893 - RNA, 14 nt, Human herpesvirus 7
agcuucuaaaugug

SEQ ID NO: 4000894 - RNA, 17 nt, Human herpesvirus 7
aggaaauugcuuucuaa

SEQ ID NO: 4000895 - RNA, 20 nt, Human herpesvirus 7
aggaagguacaucuuucgua

SEQ ID NO: 4000896 - RNA, 11 nt, Human herpesvirus 7
aggaauugcug

SEQ ID NO: 4000897 - RNA, 18 nt, Human herpesvirus 7
aggccguuuaugaacaag

SEQ ID NO: 4000898 - RNA, 14 nt, Human herpesvirus 7
agggauuucuucuu

SEQ ID NO: 4000899 - RNA, 19 nt, Human herpesvirus 7
aggggucgcauauugcaau

SEQ ID NO: 4000900 - RNA, 17 nt, Human herpesvirus 7
agguuacguguucauuu

SEQ ID NO: 4000901 - RNA, 20 nt, Human herpesvirus 7
agguuuguuuuuuggcauua

SEQ ID NO: 4000902 - RNA, 20 nt, Human herpesvirus 7
aguaaagauuuaacugauaa

SEQ ID NO: 4000903 - RNA, 17 nt, Human herpesvirus 7
aguaaagggaaaaacuu

SEQ ID NO: 4000904 - RNA, 16 nt, Human herpesvirus 7
aguagccgaaaaagaa

SEQ ID NO: 4000905 - RNA, 14 nt, Human herpesvirus 7
aguagugcuaauau

SEQ ID NO: 4000906 - RNA, 16 nt, Human herpesvirus 7
aguauuuaagaacaga

SEQ ID NO: 4000907 - RNA, 16 nt, Human herpesvirus 7
agucaagaacugugaa

SEQ ID NO: 4000908 - RNA, 19 nt, Human herpesvirus 7
agucacaauuacacaaauu

SEQ ID NO: 4000909 - RNA, 18 nt, Human herpesvirus 7
agucagaacauugucaaa

SEQ ID NO: 4000910 - RNA, 20 nt, Human herpesvirus 7
agugaagcuugcuuaaaacu

SEQ ID NO: 4000911 - RNA, 18 nt, Human herpesvirus 7
agugaaugauuuugacau

SEQ ID NO: 4000912 - RNA, 14 nt, Human herpesvirus 7
agugaauuacagau

SEQ ID NO: 4000913 - RNA, 12 nt, Human herpesvirus 7
agugaugaaagu

SEQ ID NO: 4000914 - RNA, 17 nt, Human herpesvirus 7
agugauugguagaaaug

SEQ ID NO: 4000915 - RNA, 20 nt, Human herpesvirus 7
agugcgcggauuaagagaaa

SEQ ID NO: 4000916 - RNA, 15 nt, Human herpesvirus 7
agugucuaagguuuu

SEQ ID NO: 4000917 - RNA, 11 nt, Human herpesvirus 7
aguuaaaagau

SEQ ID NO: 4000918 - RNA, 19 nt, Human herpesvirus 7
aguuauaugaaauuucaaa

SEQ ID NO: 4000919 - RNA, 15 nt, Human herpesvirus 7
aguucaaaaaaagaa

SEQ ID NO: 4000920 - RNA, 14 nt, Human herpesvirus 7
aguuccacgucaau

SEQ ID NO: 4000921 - RNA, 21 nt, Human herpesvirus 7
aguuuuacaaagaacauguag

SEQ ID NO: 4000922 - RNA, 18 nt, Human herpesvirus 7
auaaaaagauauacauaa

SEQ ID NO: 4000923 - RNA, 23 nt, Human herpesvirus 7
auaaaaauuacucaugaagcugu

SEQ ID NO: 4000924 - RNA, 22 nt, Human herpesvirus 7
auaaaacgugugaaaacaauua

SEQ ID NO: 4000925 - RNA, 13 nt, Human herpesvirus 7
auaaauaaaaugu

SEQ ID NO: 4000926 - RNA, 18 nt, Human herpesvirus 7
auaaauguucuucuguaa

SEQ ID NO: 4000927 - RNA, 20 nt, Human herpesvirus 7
auaacaaagugcgaaacgug

SEQ ID NO: 4000928 - RNA, 13 nt, Human herpesvirus 7
auaacuuuaaauu

SEQ ID NO: 4000929 - RNA, 18 nt, Human herpesvirus 7
auaauaaaggaaagacaa

SEQ ID NO: 4000930 - RNA, 14 nt, Human herpesvirus 7
auaauaagaugugu

SEQ ID NO: 4000931 - RNA, 17 nt, Human herpesvirus 7
auaaucaagaaacaugu

SEQ ID NO: 4000932 - RNA, 15 nt, Human herpesvirus 7
auaaucaucuuucuu

SEQ ID NO: 4000933 - RNA, 13 nt, Human herpesvirus 7
auaauuuaaaauu

SEQ ID NO: 4000934 - RNA, 14 nt, Human herpesvirus 7
auaauuuaaaauua

SEQ ID NO: 4000935 - RNA, 22 nt, Human herpesvirus 7
auacaaauuuaagagacauuga

SEQ ID NO: 4000936 - RNA, 18 nt, Human herpesvirus 7
auacauucucaaaaauga

SEQ ID NO: 4000937 - RNA, 13 nt, Human herpesvirus 7
auaccuguaugga

SEQ ID NO: 4000938 - RNA, 12 nt, Human herpesvirus 7
auagaagaggac

SEQ ID NO: 4000939 - RNA, 12 nt, Human herpesvirus 7
auagaguuuaau

SEQ ID NO: 4000940 - RNA, 17 nt, Human herpesvirus 7
auagcuuaaaaaauaca

SEQ ID NO: 4000941 - RNA, 15 nt, Human herpesvirus 7
auaguugguuaauaa

SEQ ID NO: 4000942 - RNA, 15 nt, Human herpesvirus 7
auauaaaagaaacuu

SEQ ID NO: 4000943 - RNA, 14 nt, Human herpesvirus 7
auauaacaaaaaac

SEQ ID NO: 4000944 - RNA, 18 nt, Human herpesvirus 7
auauaugcauuauaucca

SEQ ID NO: 4000945 - RNA, 20 nt, Human herpesvirus 7
auauaugucauagugggaac

SEQ ID NO: 4000946 - RNA, 13 nt, Human herpesvirus 7
auaucuaugaugc

SEQ ID NO: 4000947 - RNA, 22 nt, Human herpesvirus 7
auaucucuguuuugucucuuua

SEQ ID NO: 4000948 - RNA, 17 nt, Human herpesvirus 7
auaugcaaaacaaaaua

SEQ ID NO: 4000949 - RNA, 11 nt, Human herpesvirus 7
auauuaaauga

SEQ ID NO: 4000950 - RNA, 18 nt, Human herpesvirus 7
auauugaaggugucuauu

SEQ ID NO: 4000951 - RNA, 15 nt, Human herpesvirus 7
caaacgaguuucaaa

SEQ ID NO: 4000952 - RNA, 22 nt, Human herpesvirus 7
caaacguaaugcaaaauagauu

SEQ ID NO: 4000953 - RNA, 14 nt, Human herpesvirus 7
caaagacuugcaaa

SEQ ID NO: 4000954 - RNA, 15 nt, Human herpesvirus 7
caaagauugaagcac

SEQ ID NO: 4000955 - RNA, 22 nt, Human herpesvirus 7
caaaggaucgaucucugucaaa

SEQ ID NO: 4000956 - RNA, 13 nt, Human herpesvirus 7
caaagugaugaaa

SEQ ID NO: 4000957 - RNA, 17 nt, Human herpesvirus 7
caaauaugcauggagaa

SEQ ID NO: 4000958 - RNA, 12 nt, Human herpesvirus 7
caaaucaaaguu

SEQ ID NO: 4000959 - RNA, 16 nt, Human herpesvirus 7
caaaucaaugugaagu

SEQ ID NO: 4000960 - RNA, 18 nt, Human herpesvirus 7
caaaucugauaaauuaca

SEQ ID NO: 4000961 - RNA, 20 nt, Human herpesvirus 7
caaauguuuuaauuuggaaa

SEQ ID NO: 4000962 - RNA, 14 nt, Human herpesvirus 7
caaauuaaauacuu

SEQ ID NO: 4000963 - RNA, 18 nt, Human herpesvirus 7
caaauuccuccugaaaau

SEQ ID NO: 4000964 - RNA, 18 nt, Human herpesvirus 7
caaauugauccugcuauu

SEQ ID NO: 4000965 - RNA, 15 nt, Human herpesvirus 7
caaauuuauauuuua

SEQ ID NO: 4000966 - RNA, 14 nt, Human herpesvirus 7
caacagccaaaugu

SEQ ID NO: 4000967 - RNA, 10 nt, Human herpesvirus 7
caacaucuuu

SEQ ID NO: 4000968 - RNA, 16 nt, Human herpesvirus 7
caacauucuugucaac

SEQ ID NO: 4000969 - RNA, 15 nt, Human herpesvirus 7
caaccacagacacac

SEQ ID NO: 4000970 - RNA, 14 nt, Human herpesvirus 7
caacuucaacauac

SEQ ID NO: 4000971 - RNA, 13 nt, Human herpesvirus 7
caagaacugugaa

SEQ ID NO: 4000972 - RNA, 14 nt, Human herpesvirus 7
caagauccuuaucc

SEQ ID NO: 4000973 - RNA, 14 nt, Human herpesvirus 7
caaggggcauuuuu

SEQ ID NO: 4000974 - RNA, 16 nt, Human herpesvirus 7
caaggugacagagggc

SEQ ID NO: 4000975 - RNA, 19 nt, Human herpesvirus 7
caagguucuaaaaauucug

SEQ ID NO: 4000976 - RNA, 15 nt, Human herpesvirus 7
caaguuaauuuugca

SEQ ID NO: 4000977 - RNA, 14 nt, Human herpesvirus 7
caauaaauuuugaa

SEQ ID NO: 4000978 - RNA, 18 nt, Human herpesvirus 7
caauagguuccacacagg

SEQ ID NO: 4000979 - RNA, 20 nt, Human herpesvirus 7
caauauauugaaggugucua

SEQ ID NO: 4000980 - RNA, 23 nt, Human herpesvirus 7
caauauguagcaucucuguggcu

SEQ ID NO: 4000981 - RNA, 22 nt, Human herpesvirus 7
caauauuuaaaguagcugaauu

SEQ ID NO: 4000982 - RNA, 22 nt, Human herpesvirus 7
caaucaaacauguaaucaaaau

SEQ ID NO: 4000983 - RNA, 20 nt, Human herpesvirus 7
caaucacgugauuaagauuc

SEQ ID NO: 4000984 - RNA, 19 nt, Human herpesvirus 7
caaucugugaacugauguu

SEQ ID NO: 4000985 - RNA, 14 nt, Human herpesvirus 7
caaugcaaacuucu

SEQ ID NO: 4000986 - RNA, 22 nt, Human herpesvirus 7
caauugcccuuguguugucaua

SEQ ID NO: 4000987 - RNA, 18 nt, Human herpesvirus 7
caauuguuaguuaugacg

SEQ ID NO: 4000988 - RNA, 12 nt, Human herpesvirus 7
caauuuaucaau

SEQ ID NO: 4000989 - RNA, 13 nt, Human herpesvirus 7
caauuucacagac

SEQ ID NO: 4000990 - RNA, 14 nt, Human herpesvirus 7
cacaauuacacaaa

SEQ ID NO: 4000991 - RNA, 23 nt, Human herpesvirus 7
caccaaaaaauaaaaacaagcuu

SEQ ID NO: 4000992 - RNA, 15 nt, Human herpesvirus 7
caccacaauuuuaac

SEQ ID NO: 4000993 - RNA, 19 nt, Human herpesvirus 7
caccccaaaaucaaaaaac

SEQ ID NO: 4000994 - RNA, 20 nt, Human herpesvirus 7
cacccuuuguuugagacaau

SEQ ID NO: 4000995 - RNA, 15 nt, Human herpesvirus 7
cacguccaagaaaua

SEQ ID NO: 4000996 - RNA, 22 nt, Human herpesvirus 7
cacgugccgcguuuuaaaauug

SEQ ID NO: 4000997 - RNA, 18 nt, Human herpesvirus 7
cacguucuaaaaaacaaa

SEQ ID NO: 4000998 - RNA, 15 nt, Human herpesvirus 7
cacguuuugcaaagu

SEQ ID NO: 4000999 - RNA, 14 nt, Human herpesvirus 7
cacuaaaagagaac

SEQ ID NO: 4001000 - RNA, 13 nt, Human herpesvirus 7
cacuagcuuucug

SEQ ID NO: 4001001 - RNA, 15 nt, Human herpesvirus 7
cacucuccugaaaua

SEQ ID NO: 4001002 - RNA, 19 nt, Human herpesvirus 7
cagaaauaacaaaauugua

SEQ ID NO: 4001003 - RNA, 17 nt, Human herpesvirus 7
cagaacauugucaaaga

SEQ ID NO: 4001004 - RNA, 19 nt, Human herpesvirus 7
cagacagcuguauaucuau

SEQ ID NO: 4001005 - RNA, 16 nt, Human herpesvirus 7
cagaccguaaaacaau

SEQ ID NO: 4001006 - RNA, 21 nt, Human herpesvirus 7
cagacgaauuucuuugcgcug

SEQ ID NO: 4001007 - RNA, 12 nt, Human herpesvirus 7
cagagaugaaaa

SEQ ID NO: 4001008 - RNA, 15 nt, Human herpesvirus 7
cagagggcauuugua

SEQ ID NO: 4001009 - RNA, 13 nt, Human herpesvirus 7
cagaguuuaaagu

SEQ ID NO: 4001010 - RNA, 15 nt, Human herpesvirus 7
cagaguuuaaaguaa

SEQ ID NO: 4001011 - RNA, 22 nt, Human herpesvirus 7
cagaguuuaaaguaaaauuaau

SEQ ID NO: 4001012 - RNA, 21 nt, Human herpesvirus 7
cagauaaaaauuuauuuucua

SEQ ID NO: 4001013 - RNA, 13 nt, Human herpesvirus 7
cagaucucgaacu

SEQ ID NO: 4001014 - RNA, 14 nt, Human herpesvirus 7
cagaucuugcuuua

SEQ ID NO: 4001015 - RNA, 20 nt, Human herpesvirus 7
cagcacuuuuuugcguugcu

SEQ ID NO: 4001016 - RNA, 17 nt, Human herpesvirus 7
cagcugugauauuuggu

SEQ ID NO: 4001017 - RNA, 10 nt, Human herpesvirus 7
caggaagcaa

SEQ ID NO: 4001018 - RNA, 17 nt, Human herpesvirus 7
caggaagcacaaaucaa

SEQ ID NO: 4001019 - RNA, 20 nt, Human herpesvirus 7
caggcauuuaagaauuuaau

SEQ ID NO: 4001020 - RNA, 16 nt, Human herpesvirus 7
cagggagguuucuugc

SEQ ID NO: 4001021 - RNA, 23 nt, Human herpesvirus 7
caguaacuacaggcuuacacuau

SEQ ID NO: 4001022 - RNA, 17 nt, Human herpesvirus 7
caguauuuuuuaugaag

SEQ ID NO: 4001023 - RNA, 15 nt, Human herpesvirus 7
cagucaagaacugug

SEQ ID NO: 4001024 - RNA, 23 nt, Human herpesvirus 7
cagucugaaagccgcugccuucg

SEQ ID NO: 4001025 - RNA, 12 nt, Human herpesvirus 7
cagucuguaaac

SEQ ID NO: 4001026 - RNA, 16 nt, Human herpesvirus 7
cagugaguggaagcag

SEQ ID NO: 4001027 - RNA, 15 nt, Human herpesvirus 7
caguguuuaaaaugu

SEQ ID NO: 4001028 - RNA, 18 nt, Human herpesvirus 7
caguuguuggaaauaccg

SEQ ID NO: 4001029 - RNA, 23 nt, Human herpesvirus 7
caguuuguuguaugugaaaagaa

SEQ ID NO: 4001030 - RNA, 13 nt, Human herpesvirus 7
cauaaaauguaca

SEQ ID NO: 4001031 - RNA, 15 nt, Human herpesvirus 7
cauagcuagaaauug

SEQ ID NO: 4001032 - RNA, 21 nt, Human herpesvirus 7
cauaggaaucgcaguguucau

SEQ ID NO: 4001033 - RNA, 18 nt, Human herpesvirus 7
cauaugcuggaucuucug

SEQ ID NO: 4001034 - RNA, 16 nt, Human herpesvirus 7
cauauuaacaagcaca

SEQ ID NO: 4001035 - RNA, 13 nt, Human herpesvirus 7
caucccuggacag

SEQ ID NO: 4001036 - RNA, 14 nt, Human herpesvirus 7
caucgaagaaauuc

SEQ ID NO: 4001037 - RNA, 20 nt, Human herpesvirus 7
caucgaauuuuacaaugcag

SEQ ID NO: 4001038 - RNA, 16 nt, Human herpesvirus 7
caucguaaaaaaugua

SEQ ID NO: 4001039 - RNA, 15 nt, Human herpesvirus 7
caucuucucuauacc

SEQ ID NO: 4001040 - RNA, 16 nt, Human herpesvirus 7
caucuugagaaauaug

SEQ ID NO: 4001041 - RNA, 19 nt, Human herpesvirus 7
caugaauuaauaaaacaaa

SEQ ID NO: 4001042 - RNA, 19 nt, Human herpesvirus 7
caugacuucagaaaaacca

SEQ ID NO: 4001043 - RNA, 18 nt, Human herpesvirus 7
caugauguuaaagaacaa

SEQ ID NO: 4001044 - RNA, 18 nt, Human herpesvirus 7
caugauuauguuuucugc

SEQ ID NO: 4001045 - RNA, 22 nt, Human herpesvirus 7
caugauugguaaaaaauuacuu

SEQ ID NO: 4001046 - RNA, 19 nt, Human herpesvirus 7
caugcgauaucugacuggu

SEQ ID NO: 4001047 - RNA, 22 nt, Human herpesvirus 7
caugggauuucuguaaaaacuu

SEQ ID NO: 4001048 - RNA, 14 nt, Human herpesvirus 7
cauguauugucuua

SEQ ID NO: 4001049 - RNA, 23 nt, Human herpesvirus 7
caugucucucgcaacuucugaua

SEQ ID NO: 4001050 - RNA, 18 nt, Human herpesvirus 7
cauguguacuaaagccaa

SEQ ID NO: 4001051 - RNA, 21 nt, Human herpesvirus 7
cauguuucaagaauggcugau

SEQ ID NO: 4001052 - RNA, 16 nt, Human herpesvirus 7
cauuaaacagcauuuu

SEQ ID NO: 4001053 - RNA, 19 nt, Human herpesvirus 7
cauuaauaucaauuugaau

SEQ ID NO: 4001054 - RNA, 17 nt, Human herpesvirus 7
cauugaauauaaguuuu

SEQ ID NO: 4001055 - RNA, 20 nt, Human herpesvirus 7
cauuuaaaaaaaaaaccaca

SEQ ID NO: 4001056 - RNA, 18 nt, Human herpesvirus 7
cauuuaaaugugucuucc

SEQ ID NO: 4001057 - RNA, 22 nt, Human herpesvirus 7
cauuucaagaaggaaaauuuca

SEQ ID NO: 4001058 - RNA, 21 nt, Human herpesvirus 7
cauuucaucauccgaaucugu

SEQ ID NO: 4001059 - RNA, 22 nt, Human herpesvirus 7
cauuuccucuggaaaagggaga

SEQ ID NO: 4001060 - RNA, 14 nt, Human herpesvirus 7
cauuuguuuuggau

SEQ ID NO: 4001061 - RNA, 19 nt, Human herpesvirus 7
ccaaaaucaaguguuucuu

SEQ ID NO: 4001062 - RNA, 17 nt, Human herpesvirus 7
ccaaaaucuauauuuga

SEQ ID NO: 4001063 - RNA, 19 nt, Human herpesvirus 7
ccaaaauguaaaccaaauu

SEQ ID NO: 4001064 - RNA, 18 nt, Human herpesvirus 7
ccacacucauauuuuuca

SEQ ID NO: 4001065 - RNA, 14 nt, Human herpesvirus 7
ccacuucuaaauaa

SEQ ID NO: 4001066 - RNA, 12 nt, Human herpesvirus 7
aaaaaaaaccac

SEQ ID NO: 4001067 - RNA, 21 nt, Human herpesvirus 7
aaaaaagugauugcagauugu

SEQ ID NO: 4001068 - RNA, 22 nt, Human herpesvirus 7
aaaaaccuuuuuuccauauucc

SEQ ID NO: 4001069 - RNA, 23 nt, Human herpesvirus 7
aaaaagauuuaauaacaauuuga

SEQ ID NO: 4001070 - RNA, 14 nt, Human herpesvirus 7
aaaaagcagacauu

SEQ ID NO: 4001071 - RNA, 18 nt, Human herpesvirus 7
aaaaagugauugcagauu

SEQ ID NO: 4001072 - RNA, 18 nt, Human herpesvirus 7
aaaaaugaggauaauaaa

SEQ ID NO: 4001073 - RNA, 14 nt, Human herpesvirus 7
aaaacaacauacau

SEQ ID NO: 4001074 - RNA, 21 nt, Human herpesvirus 7
aaaacaauuaagaaucauuug

SEQ ID NO: 4001075 - RNA, 16 nt, Human herpesvirus 7
aaaacacguccaagaa

SEQ ID NO: 4001076 - RNA, 22 nt, Human herpesvirus 7
aaaacacguccaagaaauaugc

SEQ ID NO: 4001077 - RNA, 15 nt, Human herpesvirus 7
aaaacaucagaccua

SEQ ID NO: 4001078 - RNA, 23 nt, Human herpesvirus 7
aaaacggucugagacggacuuau

SEQ ID NO: 4001079 - RNA, 15 nt, Human herpesvirus 7
aaaacucaauguaaa

SEQ ID NO: 4001080 - RNA, 18 nt, Human herpesvirus 7
aaaacuccguuucauuua

SEQ ID NO: 4001081 - RNA, 19 nt, Human herpesvirus 7
aaaacuuugauuugagaaa

SEQ ID NO: 4001082 - RNA, 18 nt, Human herpesvirus 7
aaaagacaccuuucuuaa

SEQ ID NO: 4001083 - RNA, 16 nt, Human herpesvirus 7
aaaagcaacaaauguu

SEQ ID NO: 4001084 - RNA, 15 nt, Human herpesvirus 7
aaaagccauaaaaug

SEQ ID NO: 4001085 - RNA, 14 nt, Human herpesvirus 7
aaaagcugcagcug

SEQ ID NO: 4001086 - RNA, 12 nt, Human herpesvirus 7
aaaaguguucaa

SEQ ID NO: 4001087 - RNA, 18 nt, Human herpesvirus 7
aaaauaaauucugaaaua

SEQ ID NO: 4001088 - RNA, 14 nt, Human herpesvirus 7
aaaauacuaaucaa

SEQ ID NO: 4001089 - RNA, 12 nt, Human herpesvirus 7
aaaauagccgau

SEQ ID NO: 4001090 - RNA, 23 nt, Human herpesvirus 7
aaaauaugaguguggugacagaa

SEQ ID NO: 4001091 - RNA, 19 nt, Human herpesvirus 7
aaaaucaaaaaacacgucc

SEQ ID NO: 4001092 - RNA, 12 nt, Human herpesvirus 7
aaaaucaaaugu

SEQ ID NO: 4001093 - RNA, 13 nt, Human herpesvirus 7
aaaaucagaaaug

SEQ ID NO: 4001094 - RNA, 18 nt, Human herpesvirus 7
aaaaucuguagaaaaugu

SEQ ID NO: 4001095 - RNA, 20 nt, Human herpesvirus 7
aaaaugauaugacauggcca

SEQ ID NO: 4001096 - RNA, 13 nt, Human herpesvirus 7
aaaauguaucuua

SEQ ID NO: 4001097 - RNA, 24 nt, Human herpesvirus 7
aaaauuauaauaacaaacgauuug

SEQ ID NO: 4001098 - RNA, 22 nt, Human herpesvirus 7
aaaauucaacgucuuacuugga

SEQ ID NO: 4001099 - RNA, 15 nt, Human herpesvirus 7
aaaauuuuagacgca

SEQ ID NO: 4001100 - RNA, 13 nt, Human herpesvirus 7
aaacaacauaucg

SEQ ID NO: 4001101 - RNA, 14 nt, Human herpesvirus 7
aaacagcauuuucu

SEQ ID NO: 4001102 - RNA, 13 nt, Human herpesvirus 7
aaacagcugaaaa

SEQ ID NO: 4001103 - RNA, 13 nt, Human herpesvirus 7
aaacauucuaaau

SEQ ID NO: 4001104 - RNA, 22 nt, Human herpesvirus 7
aaacauuucaaaaucagaaaug

SEQ ID NO: 4001105 - RNA, 16 nt, Human herpesvirus 7
aaacucacaauguuuu

SEQ ID NO: 4001106 - RNA, 20 nt, Human herpesvirus 7
aaacucacuucuaaaagcug

SEQ ID NO: 4001107 - RNA, 22 nt, Human herpesvirus 7
aaacugaauugguaauguuacu

SEQ ID NO: 4001108 - RNA, 13 nt, Human herpesvirus 7
aaacuguuuguaa

SEQ ID NO: 4001109 - RNA, 18 nt, Human herpesvirus 7
aaacuguuuguaaggcca

SEQ ID NO: 4001110 - RNA, 12 nt, Human herpesvirus 7
aaacuuugaaau

SEQ ID NO: 4001111 - RNA, 19 nt, Human herpesvirus 7
aaagaaaaagcaacaaaug

SEQ ID NO: 4001112 - RNA, 22 nt, Human herpesvirus 7
aaagaugauuggauuuucugua

SEQ ID NO: 4001113 - RNA, 16 nt, Human herpesvirus 7
aaagauguuucuuucu

SEQ ID NO: 4001114 - RNA, 20 nt, Human herpesvirus 7
aaagauuuaaaguaagaaug

SEQ ID NO: 4001115 - RNA, 15 nt, Human herpesvirus 7
aaagccgcugccuuc

SEQ ID NO: 4001116 - RNA, 20 nt, Human herpesvirus 7
aaagcuuuggcagcuagccu

SEQ ID NO: 4001117 - RNA, 17 nt, Human herpesvirus 7
aaaggaaaaauuucuuc

SEQ ID NO: 4001118 - RNA, 15 nt, Human herpesvirus 7
aaaggaugaaagugc

SEQ ID NO: 4001119 - RNA, 22 nt, Human herpesvirus 7
aaaggugguuacauauccaaug

SEQ ID NO: 4001120 - RNA, 22 nt, Human herpesvirus 7
aaagucagaacauugucaaaga

SEQ ID NO: 4001121 - RNA, 15 nt, Human herpesvirus 7
aaagugauugcagau

SEQ ID NO: 4001122 - RNA, 13 nt, Human herpesvirus 7
aaauaaacaauau

SEQ ID NO: 4001123 - RNA, 18 nt, Human herpesvirus 7
aaauaagaaaccagcuuu

SEQ ID NO: 4001124 - RNA, 15 nt, Human herpesvirus 7
aaauaauauuuuacc

SEQ ID NO: 4001125 - RNA, 11 nt, Human herpesvirus 7
aaauagcaaag

SEQ ID NO: 4001126 - RNA, 14 nt, Human herpesvirus 7
aaauaucuucugaa

SEQ ID NO: 4001127 - RNA, 15 nt, Human herpesvirus 7
aaauaucuucugaac

SEQ ID NO: 4001128 - RNA, 14 nt, Human herpesvirus 7
aaauaugaauugau

SEQ ID NO: 4001129 - RNA, 20 nt, Human herpesvirus 7
aaaucacagcauuauuguau

SEQ ID NO: 4001130 - RNA, 16 nt, Human herpesvirus 7
aaaucaguuguuggaa

SEQ ID NO: 4001131 - RNA, 22 nt, Human herpesvirus 7
aaaucuauuuuauccguuaaug

SEQ ID NO: 4001132 - RNA, 20 nt, Human herpesvirus 7
aaaugcgauacuaguuuauu

SEQ ID NO: 4001133 - RNA, 18 nt, Human herpesvirus 7
aaauguacaauuugcaua

SEQ ID NO: 4001134 - RNA, 16 nt, Human herpesvirus 7
aaauguguaacaauug

SEQ ID NO: 4001135 - RNA, 13 nt, Human herpesvirus 7
aaauguuuugauu

SEQ ID NO: 4001136 - RNA, 15 nt, Human herpesvirus 7
aaauuaaaaagaaug

SEQ ID NO: 4001137 - RNA, 22 nt, Human herpesvirus 7
aaauuaaagcgagcuuucuuua

SEQ ID NO: 4001138 - RNA, 19 nt, Human herpesvirus 7
aaauuaauaauauuaguau

SEQ ID NO: 4001139 - RNA, 12 nt, Human herpesvirus 7
aauuauuuccag

SEQ ID NO: 4001140 - RNA, 19 nt, Human herpesvirus 7
aauucauuugugaaauuga

SEQ ID NO: 4001141 - RNA, 14 nt, Human herpesvirus 7
aauuccugcuugca

SEQ ID NO: 4001142 - RNA, 13 nt, Human herpesvirus 7
aauucgaaaugaa

SEQ ID NO: 4001143 - RNA, 14 nt, Human herpesvirus 7
aauucgcugaugaa

SEQ ID NO: 4001144 - RNA, 23 nt, Human herpesvirus 7
aauucuauuuuaaaaaccaugaa

SEQ ID NO: 4001145 - RNA, 20 nt, Human herpesvirus 7
aauucuuuaauaaaaaacaa

SEQ ID NO: 4001146 - RNA, 13 nt, Human herpesvirus 7
aauugagaaauuu

SEQ ID NO: 4001147 - RNA, 21 nt, Human herpesvirus 7
aauugguuuucgguguguaaa

SEQ ID NO: 4001148 - RNA, 12 nt, Human herpesvirus 7
aauuuaaauacu

SEQ ID NO: 4001149 - RNA, 17 nt, Human herpesvirus 7
aauuuaagagacauuga

SEQ ID NO: 4001150 - RNA, 20 nt, Human herpesvirus 7
aauuuaagagacauugaaaa

SEQ ID NO: 4001151 - RNA, 21 nt, Human herpesvirus 7
aauuuacuugauuuucuuaca

SEQ ID NO: 4001152 - RNA, 21 nt, Human herpesvirus 7
aauuucaaacguaaugcaaaa

SEQ ID NO: 4001153 - RNA, 22 nt, Human herpesvirus 7
aauuuccgaccugagaugauaa

SEQ ID NO: 4001154 - RNA, 18 nt, Human herpesvirus 7
aauuugagcuuugacaaa

SEQ ID NO: 4001155 - RNA, 16 nt, Human herpesvirus 7
aauuugaugaaauugu

SEQ ID NO: 4001156 - RNA, 13 nt, Human herpesvirus 7
aauuuuaaaacug

SEQ ID NO: 4001157 - RNA, 16 nt, Human herpesvirus 7
aauuuuagauuuuacg

SEQ ID NO: 4001158 - RNA, 17 nt, Human herpesvirus 7
aauuuuccauucauuuc

SEQ ID NO: 4001159 - RNA, 15 nt, Human herpesvirus 7
aauuuugauuccugu

SEQ ID NO: 4001160 - RNA, 20 nt, Human herpesvirus 7
aauuuuguaagaaacaucua

SEQ ID NO: 4001161 - RNA, 17 nt, Human herpesvirus 7
aauuuuucgaucuguaa

SEQ ID NO: 4001162 - RNA, 22 nt, Human herpesvirus 7
acaaaaaaauaccucuggcuuc

SEQ ID NO: 4001163 - RNA, 10 nt, Human herpesvirus 7
acaaaacaag

SEQ ID NO: 4001164 - RNA, 14 nt, Human herpesvirus 7
acaaaagucgagaa

SEQ ID NO: 4001165 - RNA, 11 nt, Human herpesvirus 7
acaaagaacau

SEQ ID NO: 4001166 - RNA, 21 nt, Human herpesvirus 7
acaaagaacauguaguacaau

SEQ ID NO: 4001167 - RNA, 18 nt, Human herpesvirus 7
acaaagauccucugagaa

SEQ ID NO: 4001168 - RNA, 21 nt, Human herpesvirus 7
acaaauaccaugaaaaauaug

SEQ ID NO: 4001169 - RNA, 18 nt, Human herpesvirus 7
acaaauaucacuggcaau

SEQ ID NO: 4001170 - RNA, 17 nt, Human herpesvirus 7
acaagacagaaaugaau

SEQ ID NO: 4001171 - RNA, 22 nt, Human herpesvirus 7
acaagaugcgaguccaaaaguu

SEQ ID NO: 4001172 - RNA, 20 nt, Human herpesvirus 7
acaagcacacuaaaaaagag

SEQ ID NO: 4001173 - RNA, 15 nt, Human herpesvirus 7
acaaggacgaaucua

SEQ ID NO: 4001174 - RNA, 17 nt, Human herpesvirus 7
acaaucuuacaaaaagu

SEQ ID NO: 4001175 - RNA, 23 nt, Human herpesvirus 7
acaaugguguuaacaaucuuaca

SEQ ID NO: 4001176 - RNA, 20 nt, Human herpesvirus 7
acacuauuggacaaaagacu

SEQ ID NO: 4001177 - RNA, 22 nt, Human herpesvirus 7
acacuuggaguuguguucuuua

SEQ ID NO: 4001178 - RNA, 22 nt, Human herpesvirus 7
acagaauacuacucagaagaca

SEQ ID NO: 4001179 - RNA, 21 nt, Human herpesvirus 7
acagaaugugguaaaaaaguu

SEQ ID NO: 4001180 - RNA, 12 nt, Human herpesvirus 7
acagacagaaug

SEQ ID NO: 4001181 - RNA, 14 nt, Human herpesvirus 7
acagacagaaugcc

SEQ ID NO: 4001182 - RNA, 14 nt, Human herpesvirus 7
acagagacaaccau

SEQ ID NO: 4001183 - RNA, 18 nt, Human herpesvirus 7
acagauucuccagaaauu

SEQ ID NO: 4001184 - RNA, 20 nt, Human herpesvirus 7
acaggcugcaucuuuucagu

SEQ ID NO: 4001185 - RNA, 14 nt, Human herpesvirus 7
acagugcuguacuu

SEQ ID NO: 4001186 - RNA, 15 nt, Human herpesvirus 7
acaguugcuugugaa

SEQ ID NO: 4001187 - RNA, 20 nt, Human herpesvirus 7
acaguuuggggcacaaaaua

SEQ ID NO: 4001188 - RNA, 17 nt, Human herpesvirus 7
acauacgugcuuagacu

SEQ ID NO: 4001189 - RNA, 16 nt, Human herpesvirus 7
acaucaauuuuaaugu

SEQ ID NO: 4001190 - RNA, 19 nt, Human herpesvirus 7
acaucuuccacaaaaauuu

SEQ ID NO: 4001191 - RNA, 16 nt, Human herpesvirus 7
acauuccucauggcca

SEQ ID NO: 4001192 - RNA, 20 nt, Human herpesvirus 7
accaaaaaccugaaaaacau

SEQ ID NO: 4001193 - RNA, 17 nt, Human herpesvirus 7
accaaauauaugcuuua

SEQ ID NO: 4001194 - RNA, 15 nt, Human herpesvirus 7
accagauuucuggca

SEQ ID NO: 4001195 - RNA, 16 nt, Human herpesvirus 7
accaucugcuggaaau

SEQ ID NO: 4001196 - RNA, 22 nt, Human herpesvirus 7
accauguuuuaccgugucuucu

SEQ ID NO: 4001197 - RNA, 18 nt, Human herpesvirus 7
acccaugggcacauuugu

SEQ ID NO: 4001198 - RNA, 12 nt, Human herpesvirus 7
accgauaaaagg

SEQ ID NO: 4001199 - RNA, 19 nt, Human herpesvirus 7
accgauuauauucaaauaa

SEQ ID NO: 4001200 - RNA, 20 nt, Human herpesvirus 7
accgcagauccaucuuugaa

SEQ ID NO: 4001201 - RNA, 17 nt, Human herpesvirus 7
accgccaccuucuuaua

SEQ ID NO: 4001202 - RNA, 16 nt, Human herpesvirus 7
accguggacuuucuug

SEQ ID NO: 4001203 - RNA, 17 nt, Human herpesvirus 7
accgugucuucugggaa

SEQ ID NO: 4001204 - RNA, 20 nt, Human herpesvirus 7
accuuuuaaaaucaaaugua

SEQ ID NO: 4001205 - RNA, 15 nt, Human herpesvirus 7
acgaaauaauuagaa

SEQ ID NO: 4001206 - RNA, 11 nt, Human herpesvirus 7
acgaauuauuu

SEQ ID NO: 4001207 - RNA, 21 nt, Human herpesvirus 7
acgcagacuaaucacgagaaa

SEQ ID NO: 4001208 - RNA, 19 nt, Human herpesvirus 7
acgcccacucuggaaaugu

SEQ ID NO: 4001209 - RNA, 15 nt, Human herpesvirus 7
acgcgggguuaaaaa

SEQ ID NO: 4001210 - RNA, 20 nt, Human herpesvirus 7
acgcucucaaucaaaaucuu

SEQ ID NO: 4001211 - RNA, 19 nt, Human herpesvirus 7
acgcuuucugaauugcauc

SEQ ID NO: 4001212 - RNA, 13 nt, Human herpesvirus 7
acggaacuucuuu

SEQ ID NO: 4001213 - RNA, 20 nt, Human herpesvirus 7
acggcucuaacauuaaaacu

SEQ ID NO: 4001214 - RNA, 14 nt, Human herpesvirus 7
acguagaaaaaaac

SEQ ID NO: 4001215 - RNA, 16 nt, Human herpesvirus 7
acguccauugauuaaa

SEQ ID NO: 4001216 - RNA, 21 nt, Human herpesvirus 7
acguccauuuccucaauuuuu

SEQ ID NO: 4001217 - RNA, 15 nt, Human herpesvirus 7
acgucuacauuuaaa

SEQ ID NO: 4001218 - RNA, 23 nt, Human herpesvirus 7
acgucuuacuuggaaacaaauug

SEQ ID NO: 4001219 - RNA, 21 nt, Human herpesvirus 7
acgucuugcuguuugucaucg

SEQ ID NO: 4001220 - RNA, 19 nt, Human herpesvirus 7
acgucuuuuaagcuucgcu

SEQ ID NO: 4001221 - RNA, 15 nt, Human herpesvirus 7
acgugcuuagacuua

SEQ ID NO: 4001222 - RNA, 20 nt, Human herpesvirus 7
acguucuuggucauuaaaaa

SEQ ID NO: 4001223 - RNA, 14 nt, Human herpesvirus 7
acguuucaaaucaa

SEQ ID NO: 4001224 - RNA, 16 nt, Human herpesvirus 7
acguuuccauuaaaaa

SEQ ID NO: 4001225 - RNA, 15 nt, Human herpesvirus 7
acguuucuagcaaaa

SEQ ID NO: 4001226 - RNA, 14 nt, Human herpesvirus 7
acguuuuugcagag

SEQ ID NO: 4001227 - RNA, 16 nt, Human herpesvirus 7
acuaagcauauugaag

SEQ ID NO: 4001228 - RNA, 19 nt, Human herpesvirus 7
acuaauccaugacagagaa

SEQ ID NO: 4001229 - RNA, 15 nt, Human herpesvirus 7
acuacaugaauggau

SEQ ID NO: 4001230 - RNA, 17 nt, Human herpesvirus 7
acuacuaacauggaaau

SEQ ID NO: 4001231 - RNA, 16 nt, Human herpesvirus 7
acuauucgaaaauauc

SEQ ID NO: 4001232 - RNA, 21 nt, Human herpesvirus 7
acuauuuaaguauuuuacaac

SEQ ID NO: 4001233 - RNA, 14 nt, Human herpesvirus 7
acuauuugacuggg

SEQ ID NO: 4001234 - RNA, 22 nt, Human herpesvirus 7
acuauuugacuggguaggaaaa

SEQ ID NO: 4001235 - RNA, 19 nt, Human herpesvirus 7
acucagagaucauaauuac

SEQ ID NO: 4001236 - RNA, 16 nt, Human herpesvirus 7
acucgaggcuuaaaau

SEQ ID NO: 4001237 - RNA, 22 nt, Human herpesvirus 7
acugauuuuuaaacuugugaaa

SEQ ID NO: 4001238 - RNA, 21 nt, Human herpesvirus 7
acugcaaauccaacagaauac

SEQ ID NO: 4001239 - RNA, 20 nt, Human herpesvirus 7
acugcgcuuggcaaacaguc

SEQ ID NO: 4001240 - RNA, 21 nt, Human herpesvirus 7
acugcuucucccauucaauaa

SEQ ID NO: 4001241 - RNA, 22 nt, Human herpesvirus 7
acugcuucucccauucaauaau

SEQ ID NO: 4001242 - RNA, 21 nt, Human herpesvirus 7
acuggaauuauacacugugaa

SEQ ID NO: 4001243 - RNA, 22 nt, Human herpesvirus 7
acuggauguauaaaucagaaua

SEQ ID NO: 4001244 - RNA, 20 nt, Human herpesvirus 7
acugugcaugaaaucuugaa

SEQ ID NO: 4001245 - RNA, 20 nt, Human herpesvirus 7
acuguuagaggauuaaaaca

SEQ ID NO: 4001246 - RNA, 15 nt, Human herpesvirus 7
acuguuguagguaau

SEQ ID NO: 4001247 - RNA, 20 nt, Human herpesvirus 7
acuguuuuucaaaaacguua

SEQ ID NO: 4001248 - RNA, 17 nt, Human herpesvirus 7
acuuacuguuuacacau

SEQ ID NO: 4001249 - RNA, 19 nt, Human herpesvirus 7
acuuacuuguguugugaaa

SEQ ID NO: 4001250 - RNA, 16 nt, Human herpesvirus 7
acuuauuauaucuuaa

SEQ ID NO: 4001251 - RNA, 19 nt, Human herpesvirus 7
acuuauuccagauaugaca

SEQ ID NO: 4001252 - RNA, 16 nt, Human herpesvirus 7
acuucugauaucuuaa

SEQ ID NO: 4001253 - RNA, 14 nt, Human herpesvirus 7
auauuuaauuucuc

SEQ ID NO: 4001254 - RNA, 13 nt, Human herpesvirus 7
auauuuuacauau

SEQ ID NO: 4001255 - RNA, 13 nt, Human herpesvirus 7
aucaaauuucaaa

SEQ ID NO: 4001256 - RNA, 18 nt, Human herpesvirus 7
aucaagccacgaugacuu

SEQ ID NO: 4001257 - RNA, 21 nt, Human herpesvirus 7
aucagaauauuuccagcauca

SEQ ID NO: 4001258 - RNA, 16 nt, Human herpesvirus 7
aucagacaauuucaca

SEQ ID NO: 4001259 - RNA, 16 nt, Human herpesvirus 7
aucaggaaucuuuuuu

SEQ ID NO: 4001260 - RNA, 18 nt, Human herpesvirus 7
aucauaauuacauugcag

SEQ ID NO: 4001261 - RNA, 20 nt, Human herpesvirus 7
auccaaaaagaaacuuucua

SEQ ID NO: 4001262 - RNA, 20 nt, Human herpesvirus 7
auccaaguuuuacagaaauu

SEQ ID NO: 4001263 - RNA, 19 nt, Human herpesvirus 7
auccacgcgggguuaaaaa

SEQ ID NO: 4001264 - RNA, 23 nt, Human herpesvirus 7
auccagaacauuuauuuucuuaa

SEQ ID NO: 4001265 - RNA, 19 nt, Human herpesvirus 7
auccaucuuugaaaaucuu

SEQ ID NO: 4001266 - RNA, 15 nt, Human herpesvirus 7
aucccuggacagaga

SEQ ID NO: 4001267 - RNA, 14 nt, Human herpesvirus 7
aucgacaaacagaa

SEQ ID NO: 4001268 - RNA, 14 nt, Human herpesvirus 7
aucgauuaaaucuu

SEQ ID NO: 4001269 - RNA, 13 nt, Human herpesvirus 7
aucgcucaacuua

SEQ ID NO: 4001270 - RNA, 14 nt, Human herpesvirus 7
aucgguuuucugag

SEQ ID NO: 4001271 - RNA, 14 nt, Human herpesvirus 7
aucguguuaagucg

SEQ ID NO: 4001272 - RNA, 20 nt, Human herpesvirus 7
aucuaauuaaucugcauaua

SEQ ID NO: 4001273 - RNA, 21 nt, Human herpesvirus 7
aucuaccccgauccucagaau

SEQ ID NO: 4001274 - RNA, 18 nt, Human herpesvirus 7
aucuaccgcgaugaaaac

SEQ ID NO: 4001275 - RNA, 17 nt, Human herpesvirus 7
aucucauagcuuaaaaa

SEQ ID NO: 4001276 - RNA, 15 nt, Human herpesvirus 7
aucucucuuucugga

SEQ ID NO: 4001277 - RNA, 22 nt, Human herpesvirus 7
aucugcaaagaaaaaaaugcuu

SEQ ID NO: 4001278 - RNA, 18 nt, Human herpesvirus 7
aucuggagaacaauuaga

SEQ ID NO: 4001279 - RNA, 18 nt, Human herpesvirus 7
aucuguaaaauuuaaaua

SEQ ID NO: 4001280 - RNA, 16 nt, Human herpesvirus 7
aucuguagaaaauguu

SEQ ID NO: 4001281 - RNA, 15 nt, Human herpesvirus 7
aucugucuucuuauu

SEQ ID NO: 4001282 - RNA, 22 nt, Human herpesvirus 7
aucuuguaauuucucaaaucuu

SEQ ID NO: 4001283 - RNA, 15 nt, Human herpesvirus 7
augaacaaauaauga

SEQ ID NO: 4001284 - RNA, 21 nt, Human herpesvirus 7
augaacaaguuucaaaaagug

SEQ ID NO: 4001285 - RNA, 21 nt, Human herpesvirus 7
augaagauaucuuaucuggag

SEQ ID NO: 4001286 - RNA, 19 nt, Human herpesvirus 7
augaagcuguacaacaguc

SEQ ID NO: 4001287 - RNA, 14 nt, Human herpesvirus 7
augagauuucugaa

SEQ ID NO: 4001288 - RNA, 21 nt, Human herpesvirus 7
augauugguaaaaaauuacuu

SEQ ID NO: 4001289 - RNA, 22 nt, Human herpesvirus 7
augauuuuucugcuuaaaugua

SEQ ID NO: 4001290 - RNA, 22 nt, Human herpesvirus 7
augauuuuuuaaaugugucuua

SEQ ID NO: 4001291 - RNA, 17 nt, Human herpesvirus 7
augcagaaaaauccaaa

SEQ ID NO: 4001292 - RNA, 16 nt, Human herpesvirus 7
augcuauuaaaugauu

SEQ ID NO: 4001293 - RNA, 14 nt, Human herpesvirus 7
augcucgauauaca

SEQ ID NO: 4001294 - RNA, 15 nt, Human herpesvirus 7
augcucgauauacau

SEQ ID NO: 4001295 - RNA, 18 nt, Human herpesvirus 7
auggaaaguuuauagaac

SEQ ID NO: 4001296 - RNA, 16 nt, Human herpesvirus 7
auggacggcauuuaac

SEQ ID NO: 4001297 - RNA, 22 nt, Human herpesvirus 7
auggauucaaucuacuguacuu

SEQ ID NO: 4001298 - RNA, 23 nt, Human herpesvirus 7
auggcauuacuacaguggaugcu

SEQ ID NO: 4001299 - RNA, 13 nt, Human herpesvirus 7
augggaauuacag

SEQ ID NO: 4001300 - RNA, 16 nt, Human herpesvirus 7
augggauuucuguaaa

SEQ ID NO: 4001301 - RNA, 13 nt, Human herpesvirus 7
augguuugaaaac

SEQ ID NO: 4001302 - RNA, 21 nt, Human herpesvirus 7
augguuuuaaaauagaaaaug

SEQ ID NO: 4001303 - RNA, 18 nt, Human herpesvirus 7
auguaaccugaauuaaaa

SEQ ID NO: 4001304 - RNA, 17 nt, Human herpesvirus 7
auguaauguugcaaaug

SEQ ID NO: 4001305 - RNA, 19 nt, Human herpesvirus 7
auguacugcucaucaaaua

SEQ ID NO: 4001306 - RNA, 13 nt, Human herpesvirus 7
auguauauaagca

SEQ ID NO: 4001307 - RNA, 21 nt, Human herpesvirus 7
augucaggaaaaaauugaaaa

SEQ ID NO: 4001308 - RNA, 13 nt, Human herpesvirus 7
augucuucaacuu

SEQ ID NO: 4001309 - RNA, 14 nt, Human herpesvirus 7
augugaaaaugaug

SEQ ID NO: 4001310 - RNA, 15 nt, Human herpesvirus 7
auguucaaauaugca

SEQ ID NO: 4001311 - RNA, 14 nt, Human herpesvirus 7
auguuuacauguaa

SEQ ID NO: 4001312 - RNA, 14 nt, Human herpesvirus 7
auuaaauacaaauu

SEQ ID NO: 4001313 - RNA, 23 nt, Human herpesvirus 7
auuaacauuaaccacaacuguga

SEQ ID NO: 4001314 - RNA, 22 nt, Human herpesvirus 7
auuagaaacaaucccagaaauu

SEQ ID NO: 4001315 - RNA, 17 nt, Human herpesvirus 7
auuauguccauaaaaca

SEQ ID NO: 4001316 - RNA, 15 nt, Human herpesvirus 7
auuauguuuucugcu

SEQ ID NO: 4001317 - RNA, 21 nt, Human herpesvirus 7
auuauuuccagaguaugaauu

SEQ ID NO: 4001318 - RNA, 18 nt, Human herpesvirus 7
auuauuuugauuggaaau

SEQ ID NO: 4001319 - RNA, 16 nt, Human herpesvirus 7
auuauuuuuaaaaaug

SEQ ID NO: 4001320 - RNA, 16 nt, Human herpesvirus 7
auucaaauaagggaua

SEQ ID NO: 4001321 - RNA, 16 nt, Human herpesvirus 7
auucaauaaaaagaua

SEQ ID NO: 4001322 - RNA, 21 nt, Human herpesvirus 7
auucacauaccuguauggaac

SEQ ID NO: 4001323 - RNA, 18 nt, Human herpesvirus 7
auucauuuguuuaagaca

SEQ ID NO: 4001324 - RNA, 23 nt, Human herpesvirus 7
auuccaaaaucaaguguuucuuu

SEQ ID NO: 4001325 - RNA, 15 nt, Human herpesvirus 7
auuccaacucaauga

SEQ ID NO: 4001326 - RNA, 14 nt, Human herpesvirus 7
auuccauuuaaaug

SEQ ID NO: 4001327 - RNA, 13 nt, Human herpesvirus 7
auucuaaaaauua

SEQ ID NO: 4001328 - RNA, 13 nt, Human herpesvirus 7
auucuagcguuuc

SEQ ID NO: 4001329 - RNA, 15 nt, Human herpesvirus 7
auucucgcuucaaag

SEQ ID NO: 4001330 - RNA, 16 nt, Human herpesvirus 7
auugaagauuguuuaa

SEQ ID NO: 4001331 - RNA, 15 nt, Human herpesvirus 7
auugcgaaaaugaua

SEQ ID NO: 4001332 - RNA, 23 nt, Human herpesvirus 7
auugcugauccgccgacaagaaa

SEQ ID NO: 4001333 - RNA, 23 nt, Human herpesvirus 7
auugcuucagaaauaacaaaauu

SEQ ID NO: 4001334 - RNA, 16 nt, Human herpesvirus 7
auugcuugcacuguaa

SEQ ID NO: 4001335 - RNA, 19 nt, Human herpesvirus 7
auuguaaaaauaaagacau

SEQ ID NO: 4001336 - RNA, 16 nt, Human herpesvirus 7
auuguaauaauuuaaa

SEQ ID NO: 4001337 - RNA, 15 nt, Human herpesvirus 7
auuguacauuuuacc

SEQ ID NO: 4001338 - RNA, 20 nt, Human herpesvirus 7
auugugaguuucuacauguu

SEQ ID NO: 4001339 - RNA, 14 nt, Human herpesvirus 7
auuuaaaaaaggaa

SEQ ID NO: 4001340 - RNA, 15 nt, Human herpesvirus 7
auuuaaaaaaggaaa

SEQ ID NO: 4001341 - RNA, 21 nt, Human herpesvirus 7
auuuaaacagcguucaaucaa

SEQ ID NO: 4001342 - RNA, 22 nt, Human herpesvirus 7
auuuaacaaagugcauaaauaa

SEQ ID NO: 4001343 - RNA, 22 nt, Human herpesvirus 7
auuuaggacuuuacacggucuu

SEQ ID NO: 4001344 - RNA, 15 nt, Human herpesvirus 7
auuuauauuaaauga

SEQ ID NO: 4001345 - RNA, 20 nt, Human herpesvirus 7
auuuaucaggugcucuaaau

SEQ ID NO: 4001346 - RNA, 20 nt, Human herpesvirus 7
auuuaugcuuuaacuggaau

SEQ ID NO: 4001347 - RNA, 14 nt, Human herpesvirus 7
auuuauugcuuaac

SEQ ID NO: 4001348 - RNA, 22 nt, Human herpesvirus 7
auuucaaaagaaaaaaucuuua

SEQ ID NO: 4001349 - RNA, 19 nt, Human herpesvirus 7
auuucaagaaggaaaauuu

SEQ ID NO: 4001350 - RNA, 19 nt, Human herpesvirus 7
auuucacccuuuguuugag

SEQ ID NO: 4001351 - RNA, 20 nt, Human herpesvirus 7
auuuccguuguuaaaaauua

SEQ ID NO: 4001352 - RNA, 21 nt, Human herpesvirus 7
auuucguuuucuuuggguaca

SEQ ID NO: 4001353 - RNA, 18 nt, Human herpesvirus 7
auuucuaauagacaaauu

SEQ ID NO: 4001354 - RNA, 17 nt, Human herpesvirus 7
auuucuguaaaaacuug

SEQ ID NO: 4001355 - RNA, 17 nt, Human herpesvirus 7
auuucugucuuugcaag

SEQ ID NO: 4001356 - RNA, 18 nt, Human herpesvirus 7
auuugaagauaaguauaa

SEQ ID NO: 4001357 - RNA, 24 nt, Human herpesvirus 7
auuugcagcuucuaaaugugcuaa

SEQ ID NO: 4001358 - RNA, 13 nt, Human herpesvirus 7
auuuguguaaaua

SEQ ID NO: 4001359 - RNA, 19 nt, Human herpesvirus 7
auuuuaaugugcuuauuua

SEQ ID NO: 4001360 - RNA, 15 nt, Human herpesvirus 7
auuuuacaaaaagaa

SEQ ID NO: 4001361 - RNA, 14 nt, Human herpesvirus 7
auuuuacaaugcag

SEQ ID NO: 4001362 - RNA, 14 nt, Human herpesvirus 7
auuuuauuucagcu

SEQ ID NO: 4001363 - RNA, 22 nt, Human herpesvirus 7
auuuugaagagcguguuuugag

SEQ ID NO: 4001364 - RNA, 22 nt, Human herpesvirus 7
auuuuggauuguguaauuauug

SEQ ID NO: 4001365 - RNA, 21 nt, Human herpesvirus 7
auuuugugccccaaacuguau

SEQ ID NO: 4001366 - RNA, 12 nt, Human herpesvirus 7
auuuuucauuua

SEQ ID NO: 4001367 - RNA, 23 nt, Human herpesvirus 7
ggaaacuauucgaaaauaucuuc

SEQ ID NO: 4001368 - RNA, 19 nt, Human herpesvirus 7
ggaaaugucuuugucauga

SEQ ID NO: 4001369 - RNA, 14 nt, Human herpesvirus 7
ggaacguuggggau

SEQ ID NO: 4001370 - RNA, 16 nt, Human herpesvirus 7
ggaagacaucgaagaa

SEQ ID NO: 4001371 - RNA, 17 nt, Human herpesvirus 7
ggagaaagcuguuucca

SEQ ID NO: 4001372 - RNA, 18 nt, Human herpesvirus 7
ggagaauucuguacccau

SEQ ID NO: 4001373 - RNA, 20 nt, Human herpesvirus 7
ggagacgaugagcaugaaaa

SEQ ID NO: 4001374 - RNA, 17 nt, Human herpesvirus 7
ggagauaguucgcaaug

SEQ ID NO: 4001375 - RNA, 21 nt, Human herpesvirus 7
ggaguuugucucauugacaug

SEQ ID NO: 4001376 - RNA, 17 nt, Human herpesvirus 7
ggauacggcagcggaag

SEQ ID NO: 4001377 - RNA, 11 nt, Human herpesvirus 7
ggaucucucuu

SEQ ID NO: 4001378 - RNA, 14 nt, Human herpesvirus 7
ggcaaaagauuuaa

SEQ ID NO: 4001379 - RNA, 20 nt, Human herpesvirus 7
ggcaauagauuacgcacaaa

SEQ ID NO: 4001380 - RNA, 15 nt, Human herpesvirus 7
ggcuaacagugggaa

SEQ ID NO: 4001381 - RNA, 18 nt, Human herpesvirus 7
ggcuagaaguuuagagac

SEQ ID NO: 4001382 - RNA, 19 nt, Human herpesvirus 7
ggcucuaacauuaaaacua

SEQ ID NO: 4001383 - RNA, 19 nt, Human herpesvirus 7
ggcuuaagcagcagacaag

SEQ ID NO: 4001384 - RNA, 13 nt, Human herpesvirus 7
ggcuuagaauauu

SEQ ID NO: 4001385 - RNA, 17 nt, Human herpesvirus 7
gggaaaaaggauuugaa

SEQ ID NO: 4001386 - RNA, 19 nt, Human herpesvirus 7
gggcacaccaagauuuuaa

SEQ ID NO: 4001387 - RNA, 20 nt, Human herpesvirus 7
ggggucugacuucaauuuug

SEQ ID NO: 4001388 - RNA, 21 nt, Human herpesvirus 7
gguaagaaaaaucauuuuuaa

SEQ ID NO: 4001389 - RNA, 19 nt, Human herpesvirus 7
gguaucacuuccuguccaa

SEQ ID NO: 4001390 - RNA, 14 nt, Human herpesvirus 7
ggucacguucuaaa

SEQ ID NO: 4001391 - RNA, 13 nt, Human herpesvirus 7
gguugucuguucu

SEQ ID NO: 4001392 - RNA, 22 nt, Human herpesvirus 7
guaaacucacuucuaaaagcug

SEQ ID NO: 4001393 - RNA, 14 nt, Human herpesvirus 7
guaacuuucaucug

SEQ ID NO: 4001394 - RNA, 20 nt, Human herpesvirus 7
guaagaaacaucuaugugcu

SEQ ID NO: 4001395 - RNA, 19 nt, Human herpesvirus 7
guaauaauuuaaaauuaau

SEQ ID NO: 4001396 - RNA, 22 nt, Human herpesvirus 7
guaaugaauaaaaucuauuuua

SEQ ID NO: 4001397 - RNA, 20 nt, Human herpesvirus 7
guacauuuuaccaaauaugu

SEQ ID NO: 4001398 - RNA, 15 nt, Human herpesvirus 7
guacuguaauuucuc

SEQ ID NO: 4001399 - RNA, 14 nt, Human herpesvirus 7
guacuguugcuaau

SEQ ID NO: 4001400 - RNA, 15 nt, Human herpesvirus 7
guacuguuucuagua

SEQ ID NO: 4001401 - RNA, 17 nt, Human herpesvirus 7
guagaaaaaaacaauga

SEQ ID NO: 4001402 - RNA, 15 nt, Human herpesvirus 7
guaggauugaaagua

SEQ ID NO: 4001403 - RNA, 20 nt, Human herpesvirus 7
guaucaugaaccauguuuua

SEQ ID NO: 4001404 - RNA, 15 nt, Human herpesvirus 7
guaucuagagaaugu

SEQ ID NO: 4001405 - RNA, 14 nt, Human herpesvirus 7
guaucuaugaaaua

SEQ ID NO: 4001406 - RNA, 18 nt, Human herpesvirus 7
guauuuguugaucuucaa

SEQ ID NO: 4001407 - RNA, 19 nt, Human herpesvirus 7
gucagaacaucccuggaca

SEQ ID NO: 4001408 - RNA, 18 nt, Human herpesvirus 7
gucaggaucuccuggaaa

SEQ ID NO: 4001409 - RNA, 16 nt, Human herpesvirus 7
gucaucccaauaccgu

SEQ ID NO: 4001410 - RNA, 17 nt, Human herpesvirus 7
guccccuucgcugcugu

SEQ ID NO: 4001411 - RNA, 16 nt, Human herpesvirus 7
gucuaagucaauuaaa

SEQ ID NO: 4001412 - RNA, 14 nt, Human herpesvirus 7
gucuacaauuucug

SEQ ID NO: 4001413 - RNA, 16 nt, Human herpesvirus 7
gucuacaauuucuggc

SEQ ID NO: 4001414 - RNA, 13 nt, Human herpesvirus 7
gucuuacagugcu

SEQ ID NO: 4001415 - RNA, 15 nt, Human herpesvirus 7
gucuuacuuggaaac

SEQ ID NO: 4001416 - RNA, 17 nt, Human herpesvirus 7
gucuuugucaugaugaa

SEQ ID NO: 4001417 - RNA, 15 nt, Human herpesvirus 7
gugaaacaauguuua

SEQ ID NO: 4001418 - RNA, 23 nt, Human herpesvirus 7
gugaacuguuacaguuaaagacg

SEQ ID NO: 4001419 - RNA, 22 nt, Human herpesvirus 7
gugagaaauggaaaccuggaga

SEQ ID NO: 4001420 - RNA, 17 nt, Human herpesvirus 7
gugauguacugcucauc

SEQ ID NO: 4001421 - RNA, 14 nt, Human herpesvirus 7
gugcugucuugcuu

SEQ ID NO: 4001422 - RNA, 15 nt, Human herpesvirus 7
gugcuuccucuggau

SEQ ID NO: 4001423 - RNA, 13 nt, Human herpesvirus 7
guggaaacggcug

SEQ ID NO: 4001424 - RNA, 16 nt, Human herpesvirus 7
guggcuuuugcuuucc

SEQ ID NO: 4001425 - RNA, 20 nt, Human herpesvirus 7
gugggacuugauaauguuuc

SEQ ID NO: 4001426 - RNA, 22 nt, Human herpesvirus 7
guguccagauaauauagaugca

SEQ ID NO: 4001427 - RNA, 20 nt, Human herpesvirus 7
gugucuuacaacuagaaaau

SEQ ID NO: 4001428 - RNA, 18 nt, Human herpesvirus 7
guuaaaaagaauguauua

SEQ ID NO: 4001429 - RNA, 13 nt, Human herpesvirus 7
guuaaagauguuu

SEQ ID NO: 4001430 - RNA, 12 nt, Human herpesvirus 7
guuaacauaugu

SEQ ID NO: 4001431 - RNA, 20 nt, Human herpesvirus 7
guuauaugaaauuucaaaaa

SEQ ID NO: 4001432 - RNA, 19 nt, Human herpesvirus 7
guucaggucucuuucuaaa

SEQ ID NO: 4001433 - RNA, 14 nt, Human herpesvirus 7
guuccuaaauaauu

SEQ ID NO: 4001434 - RNA, 14 nt, Human herpesvirus 7
guucguaacaaauu

SEQ ID NO: 4001435 - RNA, 22 nt, Human herpesvirus 7
guugaucgucuguugaaacaua

SEQ ID NO: 4001436 - RNA, 20 nt, Human herpesvirus 7
guugcacuccuagaaacacg

SEQ ID NO: 4001437 - RNA, 17 nt, Human herpesvirus 7
guugccagaaaucuggu

SEQ ID NO: 4001438 - RNA, 16 nt, Human herpesvirus 7
guugcuaguaugucag

SEQ ID NO: 4001439 - RNA, 21 nt, Human herpesvirus 7
guugcuucuucgagucaguua

SEQ ID NO: 4001440 - RNA, 21 nt, Human herpesvirus 7
guuggcaauuguaaaaauaaa

SEQ ID NO: 4001441 - RNA, 13 nt, Human herpesvirus 7
guuguacucagag

SEQ ID NO: 4001442 - RNA, 17 nt, Human herpesvirus 7
guuuagugauagaguac

SEQ ID NO: 4001443 - RNA, 18 nt, Human herpesvirus 7
guuucuuuuucauuaacu

SEQ ID NO: 4001444 - RNA, 12 nt, Human herpesvirus 7
guuugaauaucu

SEQ ID NO: 4001445 - RNA, 14 nt, Human herpesvirus 7
guuuuaaagcugau

SEQ ID NO: 4001446 - RNA, 21 nt, Human herpesvirus 7
guuuuaauugagauuauucaa

SEQ ID NO: 4001447 - RNA, 14 nt, Human herpesvirus 7
guuuucaugcucau

SEQ ID NO: 4001448 - RNA, 16 nt, Human herpesvirus 7
guuuucugagugcuaa

SEQ ID NO: 4001449 - RNA, 16 nt, Human herpesvirus 7
uaaaaaaaauaaauuu

SEQ ID NO: 4001450 - RNA, 12 nt, Human herpesvirus 7
uaaaaacaaugg

SEQ ID NO: 4001451 - RNA, 20 nt, Human herpesvirus 7
uaaaaacuaaguuuugcauu

SEQ ID NO: 4001452 - RNA, 14 nt, Human herpesvirus 7
uaaaaaugauuuuu

SEQ ID NO: 4001453 - RNA, 22 nt, Human herpesvirus 7
uaaaacuuugauuugagaaauu

SEQ ID NO: 4001454 - RNA, 17 nt, Human herpesvirus 7
uaaaaguacaaauguuu

SEQ ID NO: 4001455 - RNA, 16 nt, Human herpesvirus 7
uaaaauagaaaauguc

SEQ ID NO: 4001456 - RNA, 17 nt, Human herpesvirus 7
uaaaauagaaaauguca

SEQ ID NO: 4001457 - RNA, 19 nt, Human herpesvirus 7
uaaaaugguugugcaauuu

SEQ ID NO: 4001458 - RNA, 21 nt, Human herpesvirus 7
uaaaauguacauaacucuauc

SEQ ID NO: 4001459 - RNA, 20 nt, Human herpesvirus 7
uaaaauuaucggaaauuuug

SEQ ID NO: 4001460 - RNA, 14 nt, Human herpesvirus 7
uaaacaaacaauga

SEQ ID NO: 4001461 - RNA, 20 nt, Human herpesvirus 7
uaaacacuugcuagcuguga

SEQ ID NO: 4001462 - RNA, 22 nt, Human herpesvirus 7
uaaacacuugcuagcugugaua

SEQ ID NO: 4001463 - RNA, 18 nt, Human herpesvirus 7
uaaacguuuaguuaacau

SEQ ID NO: 4001464 - RNA, 13 nt, Human herpesvirus 7
uaaacuugugaaa

SEQ ID NO: 4001465 - RNA, 15 nt, Human herpesvirus 7
uaaagacaugaauca

SEQ ID NO: 4001466 - RNA, 18 nt, Human herpesvirus 7
uaaauaaaaaaaauugaa

SEQ ID NO: 4001467 - RNA, 17 nt, Human herpesvirus 7
uaaaucagaauauuucc

SEQ ID NO: 4001468 - RNA, 12 nt, Human herpesvirus 7
uaaaugauuuua

SEQ ID NO: 4001469 - RNA, 17 nt, Human herpesvirus 7
uaaaugauuuuaaauuu

SEQ ID NO: 4001470 - RNA, 16 nt, Human herpesvirus 7
uaaauucaacaucuuu

SEQ ID NO: 4001471 - RNA, 19 nt, Human herpesvirus 7
uaaauucuaauauguauga

SEQ ID NO: 4001472 - RNA, 17 nt, Human herpesvirus 7
uaaauuuaaaauuuaua

SEQ ID NO: 4001473 - RNA, 20 nt, Human herpesvirus 7
uaacaaaaaagguguugaua

SEQ ID NO: 4001474 - RNA, 22 nt, Human herpesvirus 7
uaacaacuagcaaacagugcug

SEQ ID NO: 4001475 - RNA, 22 nt, Human herpesvirus 7
uaacacuguuuucaguuaugau

SEQ ID NO: 4001476 - RNA, 19 nt, Human herpesvirus 7
uaacauauguugauucucu

SEQ ID NO: 4001477 - RNA, 23 nt, Human herpesvirus 7
uaaccaaaaugugggauguaucc

SEQ ID NO: 4001478 - RNA, 19 nt, Human herpesvirus 7
uaacgaauuuuuccaugug

SEQ ID NO: 4001479 - RNA, 23 nt, Human herpesvirus 7
uaacgugagggggacaauuauuu

SEQ ID NO: 4001480 - RNA, 22 nt, Human herpesvirus 7
uaacucauaauuaugaaauguu

SEQ ID NO: 4001481 - RNA, 17 nt, Human herpesvirus 7
uaacucugccagucucu

SEQ ID NO: 4001482 - RNA, 16 nt, Human herpesvirus 7
uuaauagucauuuuca

SEQ ID NO: 4001483 - RNA, 23 nt, Human herpesvirus 7
uuaaugcuuugucuuacgucuuu

SEQ ID NO: 4001484 - RNA, 21 nt, Human herpesvirus 7
uuaaugguaccuuagaaucac

SEQ ID NO: 4001485 - RNA, 12 nt, Human herpesvirus 7
uuaauuaucuac

SEQ ID NO: 4001486 - RNA, 13 nt, Human herpesvirus 7
uuaauuccuuugg

SEQ ID NO: 4001487 - RNA, 14 nt, Human herpesvirus 7
uuaauugugcaucu

SEQ ID NO: 4001488 - RNA, 11 nt, Human herpesvirus 7
uuacaacaaua

SEQ ID NO: 4001489 - RNA, 14 nt, Human herpesvirus 7
uuacagauugcuug

SEQ ID NO: 4001490 - RNA, 19 nt, Human herpesvirus 7
uuacagauuuuauuaaaag

SEQ ID NO: 4001491 - RNA, 16 nt, Human herpesvirus 7
uuaccccaaacgccuu

SEQ ID NO: 4001492 - RNA, 15 nt, Human herpesvirus 7
uuaccgguacauuua

SEQ ID NO: 4001493 - RNA, 23 nt, Human herpesvirus 7
uuacuauuugacuggguaggaaa

SEQ ID NO: 4001494 - RNA, 19 nt, Human herpesvirus 7
uuagaacaauuaucucaga

SEQ ID NO: 4001495 - RNA, 19 nt, Human herpesvirus 7
uuagacgacgucuucuucu

SEQ ID NO: 4001496 - RNA, 14 nt, Human herpesvirus 7
uuagacuuuuuucu

SEQ ID NO: 4001497 - RNA, 15 nt, Human herpesvirus 7
uuagauuuaaaacaa

SEQ ID NO: 4001498 - RNA, 16 nt, Human herpesvirus 7
uuaggggaagaaucaa

SEQ ID NO: 4001499 - RNA, 14 nt, Human herpesvirus 7
uuagugaaaacuug

SEQ ID NO: 4001500 - RNA, 16 nt, Human herpesvirus 7
uuauaauagaaauuaa

SEQ ID NO: 4001501 - RNA, 15 nt, Human herpesvirus 7
uuauacacugugaaa

SEQ ID NO: 4001502 - RNA, 17 nt, Human herpesvirus 7
uuauaugaaauuucaaa

SEQ ID NO: 4001503 - RNA, 19 nt, Human herpesvirus 7
uuauccaaguuuuaacaau

SEQ ID NO: 4001504 - RNA, 15 nt, Human herpesvirus 7
uuaucucauagcuua

SEQ ID NO: 4001505 - RNA, 17 nt, Human herpesvirus 7
uuaugagauuugccugc

SEQ ID NO: 4001506 - RNA, 18 nt, Human herpesvirus 7
uuaugcaaacucacuaau

SEQ ID NO: 4001507 - RNA, 14 nt, Human herpesvirus 7
uuauguauaucuuu

SEQ ID NO: 4001508 - RNA, 17 nt, Human herpesvirus 7
uuauguccgcuuacaag

SEQ ID NO: 4001509 - RNA, 23 nt, Human herpesvirus 7
uuauguccgcuuacaagaugcga

SEQ ID NO: 4001510 - RNA, 17 nt, Human herpesvirus 7
uuauuuacccacauuuu

SEQ ID NO: 4001511 - RNA, 14 nt, Human herpesvirus 7
uuauuuugauugga

SEQ ID NO: 4001512 - RNA, 20 nt, Human herpesvirus 7
uucaacugauauaaaugcuu

SEQ ID NO: 4001513 - RNA, 15 nt, Human herpesvirus 7
uucaauuaaugcauu

SEQ ID NO: 4001514 - RNA, 15 nt, Human herpesvirus 7
uucaauuguccauuu

SEQ ID NO: 4001515 - RNA, 16 nt, Human herpesvirus 7
uucaauuucugucuuu

SEQ ID NO: 4001516 - RNA, 17 nt, Human herpesvirus 7
uucacccuuuguuugag

SEQ ID NO: 4001517 - RNA, 22 nt, Human herpesvirus 7
uucagaaaauaaaaguaaaaac

SEQ ID NO: 4001518 - RNA, 19 nt, Human herpesvirus 7
uucagaaauaacaaaauug

SEQ ID NO: 4001519 - RNA, 15 nt, Human herpesvirus 7
uucaguaaauucuuc

SEQ ID NO: 4001520 - RNA, 19 nt, Human herpesvirus 7
uuccaaaaucaaguguuuc

SEQ ID NO: 4001521 - RNA, 21 nt, Human herpesvirus 7
uuccacgaucauuccguuuuu

SEQ ID NO: 4001522 - RNA, 20 nt, Human herpesvirus 7
uuccagauaugacaaauuuc

SEQ ID NO: 4001523 - RNA, 23 nt, Human herpesvirus 7
uuccauauuccugcaaaacuugg

SEQ ID NO: 4001524 - RNA, 23 nt, Human herpesvirus 7
uuccaucaucacgucaugcugua

SEQ ID NO: 4001525 - RNA, 15 nt, Human herpesvirus 7
uuccaucucacuuau

SEQ ID NO: 4001526 - RNA, 13 nt, Human herpesvirus 7
uuccucuggaaaa

SEQ ID NO: 4001527 - RNA, 22 nt, Human herpesvirus 7
uucgcaaauguacaauuugcau

SEQ ID NO: 4001528 - RNA, 15 nt, Human herpesvirus 7
uucgcugaagaacau

SEQ ID NO: 4001529 - RNA, 14 nt, Human herpesvirus 7
uucuaaaucacuag

SEQ ID NO: 4001530 - RNA, 18 nt, Human herpesvirus 7
uucuacuugggaguguuu

SEQ ID NO: 4001531 - RNA, 13 nt, Human herpesvirus 7
uucuccaugcaua

SEQ ID NO: 4001532 - RNA, 13 nt, Human herpesvirus 7
uucugaauaaaag

SEQ ID NO: 4001533 - RNA, 18 nt, Human herpesvirus 7
uucugcuaauucuggaaa

SEQ ID NO: 4001534 - RNA, 18 nt, Human herpesvirus 7
uucugguuucuguugacu

SEQ ID NO: 4001535 - RNA, 11 nt, Human herpesvirus 7
uucuuaauuug

SEQ ID NO: 4001536 - RNA, 23 nt, Human herpesvirus 7
uucuucaaagucuaagguuugaa

SEQ ID NO: 4001537 - RNA, 23 nt, Human herpesvirus 7
uucuucgucuaagucaauuaaag

SEQ ID NO: 4001538 - RNA, 15 nt, Human herpesvirus 7
uucuucuguaaaaga

SEQ ID NO: 4001539 - RNA, 16 nt, Human herpesvirus 7
uugaaauuguaguuuu

SEQ ID NO: 4001540 - RNA, 15 nt, Human herpesvirus 7
uugaagaaauuguga

SEQ ID NO: 4001541 - RNA, 13 nt, Human herpesvirus 7
uugaauaaauuuu

SEQ ID NO: 4001542 - RNA, 16 nt, Human herpesvirus 7
uugaauagguaucuuu

SEQ ID NO: 4001543 - RNA, 15 nt, Human herpesvirus 7
uugaauauaaguuuu

SEQ ID NO: 4001544 - RNA, 17 nt, Human herpesvirus 7
uugacaaugucaauaau

SEQ ID NO: 4001545 - RNA, 14 nt, Human herpesvirus 7
uugauaaaauuugg

SEQ ID NO: 4001546 - RNA, 13 nt, Human herpesvirus 7
uugaucaaaaucu

SEQ ID NO: 4001547 - RNA, 12 nt, Human herpesvirus 7
uugccagaaauc

SEQ ID NO: 4001548 - RNA, 19 nt, Human herpesvirus 7
uugcgcuguugguuaugca

SEQ ID NO: 4001549 - RNA, 22 nt, Human herpesvirus 7
uugcuauuauuaaagcuuucaa

SEQ ID NO: 4001550 - RNA, 11 nt, Human herpesvirus 7
uugcuguuuuu

SEQ ID NO: 4001551 - RNA, 16 nt, Human herpesvirus 7
uuggaaaaaaaacggg

SEQ ID NO: 4001552 - RNA, 16 nt, Human herpesvirus 7
uuggaaacaaauugug

SEQ ID NO: 4001553 - RNA, 19 nt, Human herpesvirus 7
uuggagagauagcauuugu

SEQ ID NO: 4001554 - RNA, 16 nt, Human herpesvirus 7
uuggauuguguaauua

SEQ ID NO: 4001555 - RNA, 15 nt, Human herpesvirus 7
uugguaaucugcucg

SEQ ID NO: 4001556 - RNA, 22 nt, Human herpesvirus 7
uugguguguuacaucauguuaa

SEQ ID NO: 4001557 - RNA, 17 nt, Human herpesvirus 7
uuguacauuuuaccaaa

SEQ ID NO: 4001558 - RNA, 13 nt, Human herpesvirus 7
uuguacuucugug

SEQ ID NO: 4001559 - RNA, 15 nt, Human herpesvirus 7
uugugaaaauaacag

SEQ ID NO: 4001560 - RNA, 22 nt, Human herpesvirus 7
uugugacccugucacacuuauu

SEQ ID NO: 4001561 - RNA, 17 nt, Human herpesvirus 7
uuguguggcaacaucuu

SEQ ID NO: 4001562 - RNA, 24 nt, Human herpesvirus 7
uuguuaggccaguucuaucucaaa

SEQ ID NO: 4001563 - RNA, 16 nt, Human herpesvirus 7
uuguuccugugugcaa

SEQ ID NO: 4001564 - RNA, 12 nt, Human herpesvirus 7
uuguuuaagaca

SEQ ID NO: 4001565 - RNA, 22 nt, Human herpesvirus 7
uuguuugcugguggguuuugaa

SEQ ID NO: 4001566 - RNA, 24 nt, Human herpesvirus 7
uuguuuugcauauuuugcuagaaa

SEQ ID NO: 4001567 - RNA, 15 nt, Human herpesvirus 7
uuuaaaaaaucugaa

SEQ ID NO: 4001568 - RNA, 14 nt, Human herpesvirus 7
uuuaaaacaauuuc

SEQ ID NO: 4001569 - RNA, 18 nt, Human herpesvirus 7
uuuaaaacuuauguacuc

SEQ ID NO: 4001570 - RNA, 23 nt, Human herpesvirus 7
uuuaaacagcguucaaucaaauu

SEQ ID NO: 4001571 - RNA, 13 nt, Human herpesvirus 7
uuuaacaugugua

SEQ ID NO: 4001572 - RNA, 15 nt, Human herpesvirus 7
uuuaacgauuccaaa

SEQ ID NO: 4001573 - RNA, 18 nt, Human herpesvirus 7
uuuaacuuuuuuuuucuu

SEQ ID NO: 4001574 - RNA, 16 nt, Human herpesvirus 7
uuuaagugaacuguua

SEQ ID NO: 4001575 - RNA, 19 nt, Human herpesvirus 7
uuuacaaagaacauguagu

SEQ ID NO: 4001576 - RNA, 23 nt, Human herpesvirus 7
uuuacaaagaacauguaguacaa

SEQ ID NO: 4001577 - RNA, 16 nt, Human herpesvirus 7
uuuacuugaucuaauu

SEQ ID NO: 4001578 - RNA, 19 nt, Human herpesvirus 7
uuuagagucugugugugca

SEQ ID NO: 4001579 - RNA, 14 nt, Human herpesvirus 7
uuuagauuuaaaac

SEQ ID NO: 4001580 - RNA, 16 nt, Human herpesvirus 7
uuuaucauuucaaaug

SEQ ID NO: 4001581 - RNA, 18 nt, Human herpesvirus 7
uuuauuuagaaguggcuu

SEQ ID NO: 4001582 - RNA, 19 nt, Human herpesvirus 7
uuucaaauagaguuuaauu

SEQ ID NO: 4001583 - RNA, 18 nt, Human herpesvirus 7
uuucaauugguuguucaa

SEQ ID NO: 4001584 - RNA, 16 nt, Human herpesvirus 7
uuucagaaaauaaaag

SEQ ID NO: 4001585 - RNA, 20 nt, Human herpesvirus 7
uuucgaacuugucaccuauu

SEQ ID NO: 4001586 - RNA, 21 nt, Human herpesvirus 7
uuucuggaauguugguuuaua

SEQ ID NO: 4001587 - RNA, 20 nt, Human herpesvirus 7
uuucuuagaucgaacuguua

SEQ ID NO: 4001588 - RNA, 23 nt, Human herpesvirus 7
uuugacaaucuuggcauugaaau

SEQ ID NO: 4001589 - RNA, 20 nt, Human herpesvirus 7
uuugauaagacugaagacaa

SEQ ID NO: 4001590 - RNA, 15 nt, Human herpesvirus 7
uuugcuucuucuaau

SEQ ID NO: 4001591 - RNA, 12 nt, Human herpesvirus 7
uuugcuugcuga

SEQ ID NO: 4001592 - RNA, 15 nt, Human herpesvirus 7
uuuguaugucuacaa

SEQ ID NO: 4001593 - RNA, 23 nt, Human herpesvirus 7
uuuuaauaugugaaaauaaacag

SEQ ID NO: 4001594 - RNA, 17 nt, Human herpesvirus 7
uuuucaaguuucuucug

SEQ ID NO: 4001595 - RNA, 17 nt, Human herpesvirus 7
uuuucaaugcaacuuua

SEQ ID NO: 4001596 - RNA, 21 nt, Human herpesvirus 7
uuuugcuacuauacucuugca

SEQ ID NO: 4001597 - RNA, 13 nt, Human herpesvirus 7
uaacaaauuggaa

SEQ ID NO: 4001598 - RNA, 21 nt, Human herpesvirus 7
uaacaucuuuuuuauauuucu

SEQ ID NO: 4001599 - RNA, 15 nt, Human herpesvirus 7
uaacaugucuucaac

SEQ ID NO: 4001600 - RNA, 16 nt, Human herpesvirus 7
uaaccaaaauguggga

SEQ ID NO: 4001601 - RNA, 15 nt, Human herpesvirus 7
uaacuguuuuucaaa

SEQ ID NO: 4001602 - RNA, 13 nt, Human herpesvirus 7
uaagaaaaauuug

SEQ ID NO: 4001603 - RNA, 15 nt, Human herpesvirus 7
uaagaugcuuaagga

SEQ ID NO: 4001604 - RNA, 21 nt, Human herpesvirus 7
uaagcauacuuucgcaacaau

SEQ ID NO: 4001605 - RNA, 16 nt, Human herpesvirus 7
uaaggccaaagguaaa

SEQ ID NO: 4001606 - RNA, 23 nt, Human herpesvirus 7
uaagggauaucuuaaaaacaaug

SEQ ID NO: 4001607 - RNA, 15 nt, Human herpesvirus 7
uaaguaaauuuacuu

SEQ ID NO: 4001608 - RNA, 16 nt, Human herpesvirus 7
uaaguagguaagaaaa

SEQ ID NO: 4001609 - RNA, 19 nt, Human herpesvirus 7
uaauaaaggaaagacaaac

SEQ ID NO: 4001610 - RNA, 17 nt, Human herpesvirus 7
uaauacaaaauaaagcc

SEQ ID NO: 4001611 - RNA, 16 nt, Human herpesvirus 7
uaauacuccuuuccug

SEQ ID NO: 4001612 - RNA, 13 nt, Human herpesvirus 7
uaauccauuccug

SEQ ID NO: 4001613 - RNA, 15 nt, Human herpesvirus 7
uaaucuuaauguuuc

SEQ ID NO: 4001614 - RNA, 15 nt, Human herpesvirus 7
uaaugcgguuuugua

SEQ ID NO: 4001615 - RNA, 16 nt, Human herpesvirus 7
uaaugcugugauuuuc

SEQ ID NO: 4001616 - RNA, 19 nt, Human herpesvirus 7
uaauguuuuuuucauacau

SEQ ID NO: 4001617 - RNA, 23 nt, Human herpesvirus 7
uaauuauucggugucuucuugca

SEQ ID NO: 4001618 - RNA, 17 nt, Human herpesvirus 7
uaauuccgggagaaagc

SEQ ID NO: 4001619 - RNA, 14 nt, Human herpesvirus 7
uaauugcagcuucg

SEQ ID NO: 4001620 - RNA, 17 nt, Human herpesvirus 7
uaauuucucaaaucuuu

SEQ ID NO: 4001621 - RNA, 15 nt, Human herpesvirus 7
uaauuuuuuuuugag

SEQ ID NO: 4001622 - RNA, 23 nt, Human herpesvirus 7
uacaaauguuuuaauuuggaaau

SEQ ID NO: 4001623 - RNA, 22 nt, Human herpesvirus 7
uacaaauuuuucggauaaaagg

SEQ ID NO: 4001624 - RNA, 22 nt, Human herpesvirus 7
uacaacuuuauggaacaugaaa

SEQ ID NO: 4001625 - RNA, 14 nt, Human herpesvirus 7
uacaauuccugaaa

SEQ ID NO: 4001626 - RNA, 20 nt, Human herpesvirus 7
uacacaggaauugcugucua

SEQ ID NO: 4001627 - RNA, 14 nt, Human herpesvirus 7
uacacucuguuacu

SEQ ID NO: 4001628 - RNA, 16 nt, Human herpesvirus 7
uacagcauauaucuuu

SEQ ID NO: 4001629 - RNA, 13 nt, Human herpesvirus 7
uacaguaaauugc

SEQ ID NO: 4001630 - RNA, 18 nt, Human herpesvirus 7
uacauguuuaacaaacaa

SEQ ID NO: 4001631 - RNA, 17 nt, Human herpesvirus 7
uacauuaaacagcauuu

SEQ ID NO: 4001632 - RNA, 13 nt, Human herpesvirus 7
uacauuuugcaau

SEQ ID NO: 4001633 - RNA, 18 nt, Human herpesvirus 7
uaccgguuaaaaugggaa

SEQ ID NO: 4001634 - RNA, 15 nt, Human herpesvirus 7
uacgaacgcuuaaua

SEQ ID NO: 4001635 - RNA, 22 nt, Human herpesvirus 7
uacgaaugccaucuauaaacau

SEQ ID NO: 4001636 - RNA, 18 nt, Human herpesvirus 7
uacuacgguuuucagaaa

SEQ ID NO: 4001637 - RNA, 18 nt, Human herpesvirus 7
uacuuauguguuacauga

SEQ ID NO: 4001638 - RNA, 14 nt, Human herpesvirus 7
uacuuucauagcuu

SEQ ID NO: 4001639 - RNA, 14 nt, Human herpesvirus 7
uacuuuuaaaauug

SEQ ID NO: 4001640 - RNA, 23 nt, Human herpesvirus 7
uagaaaauaacuuuaaauuauua

SEQ ID NO: 4001641 - RNA, 12 nt, Human herpesvirus 7
uagaaauuaaaa

SEQ ID NO: 4001642 - RNA, 19 nt, Human herpesvirus 7
uagaacaaguagaaaaugc

SEQ ID NO: 4001643 - RNA, 21 nt, Human herpesvirus 7
uagaacaaguagaaaaugcug

SEQ ID NO: 4001644 - RNA, 17 nt, Human herpesvirus 7
uagaagaaugcaagccu

SEQ ID NO: 4001645 - RNA, 14 nt, Human herpesvirus 7
uagagaaaacauug

SEQ ID NO: 4001646 - RNA, 13 nt, Human herpesvirus 7
uagagagaaacua

SEQ ID NO: 4001647 - RNA, 19 nt, Human herpesvirus 7
uagcuuucaugauuucaau

SEQ ID NO: 4001648 - RNA, 21 nt, Human herpesvirus 7
uaguaaaccuucgugugucuc

SEQ ID NO: 4001649 - RNA, 14 nt, Human herpesvirus 7
uagucugcguuacu

SEQ ID NO: 4001650 - RNA, 17 nt, Human herpesvirus 7
uaguuaguguucuucua

SEQ ID NO: 4001651 - RNA, 15 nt, Human herpesvirus 7
uauaaaagaaacuuu

SEQ ID NO: 4001652 - RNA, 13 nt, Human herpesvirus 7
uauaaucacgaaa

SEQ ID NO: 4001653 - RNA, 15 nt, Human herpesvirus 7
uauacaaaagacaua

SEQ ID NO: 4001654 - RNA, 18 nt, Human herpesvirus 7
uauacuuauuauaucuua

SEQ ID NO: 4001655 - RNA, 23 nt, Human herpesvirus 7
uauagaacaaguagaaaaugcug

SEQ ID NO: 4001656 - RNA, 20 nt, Human herpesvirus 7
uauauuccaacucaaugaau

SEQ ID NO: 4001657 - RNA, 19 nt, Human herpesvirus 7
uauccacucuccugaaaua

SEQ ID NO: 4001658 - RNA, 15 nt, Human herpesvirus 7
uauccaguacgucuu

SEQ ID NO: 4001659 - RNA, 19 nt, Human herpesvirus 7
uaucuccgugacaaagcau

SEQ ID NO: 4001660 - RNA, 16 nt, Human herpesvirus 7
uaucuuuacuuucaua

SEQ ID NO: 4001661 - RNA, 17 nt, Human herpesvirus 7
uaugaauugaaauuucu

SEQ ID NO: 4001662 - RNA, 14 nt, Human herpesvirus 7
uaugcaagaaaguc

SEQ ID NO: 4001663 - RNA, 22 nt, Human herpesvirus 7
uaugcuuccuaaaaaaaaagga

SEQ ID NO: 4001664 - RNA, 15 nt, Human herpesvirus 7
uauggacaaauuugg

SEQ ID NO: 4001665 - RNA, 22 nt, Human herpesvirus 7
uaugugaaaauaaacaggaacu

SEQ ID NO: 4001666 - RNA, 13 nt, Human herpesvirus 7
uauguucaaauau

SEQ ID NO: 4001667 - RNA, 19 nt, Human herpesvirus 7
uauuaauacguccaaaaau

SEQ ID NO: 4001668 - RNA, 16 nt, Human herpesvirus 7
uauuaauuuggugaag

SEQ ID NO: 4001669 - RNA, 14 nt, Human herpesvirus 7
uauucuauuucaac

SEQ ID NO: 4001670 - RNA, 16 nt, Human herpesvirus 7
uauuucuaauagacaa

SEQ ID NO: 4001671 - RNA, 22 nt, Human herpesvirus 7
uauuuugauuggaaaucaaaau

SEQ ID NO: 4001672 - RNA, 20 nt, Human herpesvirus 7
ucaaaaaauaauuccuucua

SEQ ID NO: 4001673 - RNA, 17 nt, Human herpesvirus 7
ucaaaacagaacuuuug

SEQ ID NO: 4001674 - RNA, 13 nt, Human herpesvirus 7
ucaaaaguauaac

SEQ ID NO: 4001675 - RNA, 18 nt, Human herpesvirus 7
ucaaaaucagaaauguua

SEQ ID NO: 4001676 - RNA, 19 nt, Human herpesvirus 7
ucaaaaucuguagaaaaug

SEQ ID NO: 4001677 - RNA, 12 nt, Human herpesvirus 7
ucaaaauuccau

SEQ ID NO: 4001678 - RNA, 22 nt, Human herpesvirus 7
ucaaaauucugcuugucucugu

SEQ ID NO: 4001679 - RNA, 17 nt, Human herpesvirus 7
ucaagaucgauuaaauc

SEQ ID NO: 4001680 - RNA, 18 nt, Human herpesvirus 7
ucaauaaaugguuuuauu

SEQ ID NO: 4001681 - RNA, 19 nt, Human herpesvirus 7
ucaauaugcaugcaauuuu

SEQ ID NO: 4001682 - RNA, 18 nt, Human herpesvirus 7
ucaauuaaugcauuggaa

SEQ ID NO: 4001683 - RNA, 20 nt, Human herpesvirus 7
ucaauuugaauauugcuagu

SEQ ID NO: 4001684 - RNA, 19 nt, Human herpesvirus 7
ucaauuuuucgcugaagaa

SEQ ID NO: 4001685 - RNA, 22 nt, Human herpesvirus 7
ucacaacauauagauaaugaag

SEQ ID NO: 4001686 - RNA, 13 nt, Human herpesvirus 7
ucacacaaugccu

SEQ ID NO: 4001687 - RNA, 15 nt, Human herpesvirus 7
ucacaucuagaguau

SEQ ID NO: 4001688 - RNA, 21 nt, Human herpesvirus 7
ucacugggaaguauguuucau

SEQ ID NO: 4001689 - RNA, 15 nt, Human herpesvirus 7
ucagaacauugucaa

SEQ ID NO: 4001690 - RNA, 13 nt, Human herpesvirus 7
ucagcauuuacca

SEQ ID NO: 4001691 - RNA, 15 nt, Human herpesvirus 7
ucaggaaucuuuuuu

SEQ ID NO: 4001692 - RNA, 18 nt, Human herpesvirus 7
ucaggacaaucaaacaug

SEQ ID NO: 4001693 - RNA, 14 nt, Human herpesvirus 7
ucagucaacuuuuu

SEQ ID NO: 4001694 - RNA, 18 nt, Human herpesvirus 7
ucauaauuaugaaauguu

SEQ ID NO: 4001695 - RNA, 16 nt, Human herpesvirus 7
ucauaucugacauuca

SEQ ID NO: 4001696 - RNA, 17 nt, Human herpesvirus 7
ucaucaauguuuucauu

SEQ ID NO: 4001697 - RNA, 13 nt, Human herpesvirus 7
ucauccaaaaaga

SEQ ID NO: 4001698 - RNA, 16 nt, Human herpesvirus 7
ucaucgguuuucugag

SEQ ID NO: 4001699 - RNA, 11 nt, Human herpesvirus 7
ucaugaaggau

SEQ ID NO: 4001700 - RNA, 14 nt, Human herpesvirus 7
uccagagucucuaa

SEQ ID NO: 4001701 - RNA, 21 nt, Human herpesvirus 7
uccaucaaaagucuuguuuuu

SEQ ID NO: 4001702 - RNA, 17 nt, Human herpesvirus 7
uccauuaagccagauuu

SEQ ID NO: 4001703 - RNA, 16 nt, Human herpesvirus 7
uccauucgguuuucaa

SEQ ID NO: 4001704 - RNA, 16 nt, Human herpesvirus 7
uccauugauuaaaaac

SEQ ID NO: 4001705 - RNA, 15 nt, Human herpesvirus 7
ucccagaaauuucaa

SEQ ID NO: 4001706 - RNA, 16 nt, Human herpesvirus 7
uccgaaucuguuggag

SEQ ID NO: 4001707 - RNA, 12 nt, Human herpesvirus 7
uccuauaaaagc

SEQ ID NO: 4001708 - RNA, 18 nt, Human herpesvirus 7
uccuguccagucuguaaa

SEQ ID NO: 4001709 - RNA, 14 nt, Human herpesvirus 7
uccuguucauguuu

SEQ ID NO: 4001710 - RNA, 14 nt, Human herpesvirus 7
uccuucuaccucuu

SEQ ID NO: 4001711 - RNA, 19 nt, Human herpesvirus 7
ucguaucugugacuuagaa

SEQ ID NO: 4001712 - RNA, 16 nt, Human herpesvirus 7
ucgugugucucuagaa

SEQ ID NO: 4001713 - RNA, 12 nt, Human herpesvirus 7
aaaaaaaaaaca

SEQ ID NO: 4001714 - RNA, 12 nt, Human herpesvirus 7
aaaaagaaugcu

SEQ ID NO: 4001715 - RNA, 17 nt, Human herpesvirus 7
aaaaagccauaaaaugu

SEQ ID NO: 4001716 - RNA, 15 nt, Human herpesvirus 7
aaaacagaacuuuug

SEQ ID NO: 4001717 - RNA, 20 nt, Human herpesvirus 7
aaaacguggaaauuaaucaa

SEQ ID NO: 4001718 - RNA, 13 nt, Human herpesvirus 7
aaaagaauuuucu

SEQ ID NO: 4001719 - RNA, 14 nt, Human herpesvirus 7
aaaagagaaaaugu

SEQ ID NO: 4001720 - RNA, 21 nt, Human herpesvirus 7
aaaagauguuacccaaaaugu

SEQ ID NO: 4001721 - RNA, 18 nt, Human herpesvirus 7
aaaagccauaaaauguac

SEQ ID NO: 4001722 - RNA, 22 nt, Human herpesvirus 7
aaaagcugcauguguacuaaag

SEQ ID NO: 4001723 - RNA, 20 nt, Human herpesvirus 7
aaaagcuuacucuuucugac

SEQ ID NO: 4001724 - RNA, 19 nt, Human herpesvirus 7
aaaaguucuuugaaauagu

SEQ ID NO: 4001725 - RNA, 15 nt, Human herpesvirus 7
aaaaguugaaaaugu

SEQ ID NO: 4001726 - RNA, 15 nt, Human herpesvirus 7
aaaauacaacuucua

SEQ ID NO: 4001727 - RNA, 12 nt, Human herpesvirus 7
aaaauccuggau

SEQ ID NO: 4001728 - RNA, 13 nt, Human herpesvirus 7
aaaaugauaugac

SEQ ID NO: 4001729 - RNA, 15 nt, Human herpesvirus 7
aaaauguuuaaauua

SEQ ID NO: 4001730 - RNA, 13 nt, Human herpesvirus 7
aaaauugaaaaga

SEQ ID NO: 4001731 - RNA, 15 nt, Human herpesvirus 7
aaaauuucauaucua

SEQ ID NO: 4001732 - RNA, 19 nt, Human herpesvirus 7
aaaauuuccuacaaaaguu

SEQ ID NO: 4001733 - RNA, 23 nt, Human herpesvirus 7
aaaauuuccuacaaaaguucugu

SEQ ID NO: 4001734 - RNA, 14 nt, Human herpesvirus 7
aaacaaacaaugag

SEQ ID NO: 4001735 - RNA, 17 nt, Human herpesvirus 7
aaacaagacagaaauga

SEQ ID NO: 4001736 - RNA, 19 nt, Human herpesvirus 7
aaacaaucuggacauuuca

SEQ ID NO: 4001737 - RNA, 24 nt, Human herpesvirus 7
aaacaauugcccuuguguugucau

SEQ ID NO: 4001738 - RNA, 22 nt, Human herpesvirus 7
aaacaccccuugcagaaacugg

SEQ ID NO: 4001739 - RNA, 21 nt, Human herpesvirus 7
aaacaguagaacgagaaaacu

SEQ ID NO: 4001740 - RNA, 12 nt, Human herpesvirus 7
aaacaucuguuu

SEQ ID NO: 4001741 - RNA, 14 nt, Human herpesvirus 7
aaacauguaaucaa

SEQ ID NO: 4001742 - RNA, 18 nt, Human herpesvirus 7
aaacauuagcauugaaau

SEQ ID NO: 4001743 - RNA, 16 nt, Human herpesvirus 7
aaacauuauauuccca

SEQ ID NO: 4001744 - RNA, 20 nt, Human herpesvirus 7
aaaccacaaaaaucaaagua

SEQ ID NO: 4001745 - RNA, 23 nt, Human herpesvirus 7
aaaccuauccacucuccugaaau

SEQ ID NO: 4001746 - RNA, 17 nt, Human herpesvirus 7
aaacgaagaaucauuua

SEQ ID NO: 4001747 - RNA, 17 nt, Human herpesvirus 7
aaacggugauuguagau

SEQ ID NO: 4001748 - RNA, 22 nt, Human herpesvirus 7
aaacuucugauuggucguugcu

SEQ ID NO: 4001749 - RNA, 21 nt, Human herpesvirus 7
aaagacagagucaaucuguga

SEQ ID NO: 4001750 - RNA, 12 nt, Human herpesvirus 7
aaagacggaauu

SEQ ID NO: 4001751 - RNA, 18 nt, Human herpesvirus 7
aaagauuaaaaaaaaaag

SEQ ID NO: 4001752 - RNA, 16 nt, Human herpesvirus 7
aaagcaaaagccacag

SEQ ID NO: 4001753 - RNA, 15 nt, Human herpesvirus 7
aaagcucauuucauc

SEQ ID NO: 4001754 - RNA, 21 nt, Human herpesvirus 7
aaagcuuguauauacggaaug

SEQ ID NO: 4001755 - RNA, 23 nt, Human herpesvirus 7
aaaggaucucucuuucuggaguu

SEQ ID NO: 4001756 - RNA, 15 nt, Human herpesvirus 7
aaaggauuugaaggu

SEQ ID NO: 4001757 - RNA, 12 nt, Human herpesvirus 7
aaaguacaaaug

SEQ ID NO: 4001758 - RNA, 13 nt, Human herpesvirus 7
aaaguacaaaugu

SEQ ID NO: 4001759 - RNA, 14 nt, Human herpesvirus 7
aaaguacaaauguu

SEQ ID NO: 4001760 - RNA, 14 nt, Human herpesvirus 7
aaaguaugcuuugu

SEQ ID NO: 4001761 - RNA, 15 nt, Human herpesvirus 7
aaagucagaacauug

SEQ ID NO: 4001762 - RNA, 21 nt, Human herpesvirus 7
aaagugaacaugacuucagaa

SEQ ID NO: 4001763 - RNA, 17 nt, Human herpesvirus 7
aaagugacggaaguacu

SEQ ID NO: 4001764 - RNA, 14 nt, Human herpesvirus 7
aaaguugggaugac

SEQ ID NO: 4001765 - RNA, 13 nt, Human herpesvirus 7
aaauaaacaggaa

SEQ ID NO: 4001766 - RNA, 19 nt, Human herpesvirus 7
aaauaaacauguugaaaga

SEQ ID NO: 4001767 - RNA, 14 nt, Human herpesvirus 7
aaauaaaguuuacu

SEQ ID NO: 4001768 - RNA, 13 nt, Human herpesvirus 7
aaauaauaacaau

SEQ ID NO: 4001769 - RNA, 13 nt, Human herpesvirus 7
aaauaccaugaaa

SEQ ID NO: 4001770 - RNA, 15 nt, Human herpesvirus 7
aaauauuuagagucg

SEQ ID NO: 4001771 - RNA, 17 nt, Human herpesvirus 7
aaauauuuuacauauua

SEQ ID NO: 4001772 - RNA, 16 nt, Human herpesvirus 7
aaaucaaaacauuuca

SEQ ID NO: 4001773 - RNA, 18 nt, Human herpesvirus 7
aaaucacugcucaaauca

SEQ ID NO: 4001774 - RNA, 16 nt, Human herpesvirus 7
aaaucauguuuaagaa

SEQ ID NO: 4001775 - RNA, 22 nt, Human herpesvirus 7
aauuguacguucugaaacaguc

SEQ ID NO: 4001776 - RNA, 18 nt, Human herpesvirus 7
aauuguaguuuuugcaua

SEQ ID NO: 4001777 - RNA, 11 nt, Human herpesvirus 7
aauuguuugau

SEQ ID NO: 4001778 - RNA, 20 nt, Human herpesvirus 7
aauuguuugauuaauuucca

SEQ ID NO: 4001779 - RNA, 22 nt, Human herpesvirus 7
aauuguuuuucuuucuugcaua

SEQ ID NO: 4001780 - RNA, 16 nt, Human herpesvirus 7
aauuuaaagauugcuu

SEQ ID NO: 4001781 - RNA, 18 nt, Human herpesvirus 7
aauuuagcaccaacugaa

SEQ ID NO: 4001782 - RNA, 22 nt, Human herpesvirus 7
aauuuaugcuuuaacuggaauu

SEQ ID NO: 4001783 - RNA, 17 nt, Human herpesvirus 7
aauuucacacaaugccu

SEQ ID NO: 4001784 - RNA, 19 nt, Human herpesvirus 7
aauuucuaaauaugaugaa

SEQ ID NO: 4001785 - RNA, 21 nt, Human herpesvirus 7
aauuugcagcuucuaaaugug

SEQ ID NO: 4001786 - RNA, 14 nt, Human herpesvirus 7
aauuuggaaauugu

SEQ ID NO: 4001787 - RNA, 22 nt, Human herpesvirus 7
aauuuugauuccugucuugacc

SEQ ID NO: 4001788 - RNA, 23 nt, Human herpesvirus 7
aauuuuucgcugucuuuaacuga

SEQ ID NO: 4001789 - RNA, 18 nt, Human herpesvirus 7
aauuuuucggauaaaagg

SEQ ID NO: 4001790 - RNA, 15 nt, Human herpesvirus 7
acaaaauguauacaa

SEQ ID NO: 4001791 - RNA, 13 nt, Human herpesvirus 7
acaaacuggauau

SEQ ID NO: 4001792 - RNA, 21 nt, Human herpesvirus 7
acaaauaauucaaaaacuauc

SEQ ID NO: 4001793 - RNA, 12 nt, Human herpesvirus 7
acaaauacaguu

SEQ ID NO: 4001794 - RNA, 23 nt, Human herpesvirus 7
acaaauuaugcguuaaugucucu

SEQ ID NO: 4001795 - RNA, 15 nt, Human herpesvirus 7
acaacagccaaaugu

SEQ ID NO: 4001796 - RNA, 21 nt, Human herpesvirus 7
acaaccauuuuuucccagaga

SEQ ID NO: 4001797 - RNA, 12 nt, Human herpesvirus 7
acaacucaauaa

SEQ ID NO: 4001798 - RNA, 20 nt, Human herpesvirus 7
acaacuuuauggaacaugaa

SEQ ID NO: 4001799 - RNA, 16 nt, Human herpesvirus 7
acaagguuuaaaacau

SEQ ID NO: 4001800 - RNA, 18 nt, Human herpesvirus 7
acaagguuuaaaacauuu

SEQ ID NO: 4001801 - RNA, 19 nt, Human herpesvirus 7
acaagguuuaaaacauuua

SEQ ID NO: 4001802 - RNA, 21 nt, Human herpesvirus 7
acaaucgauugcaguugaauu

SEQ ID NO: 4001803 - RNA, 21 nt, Human herpesvirus 7
acaauuugaagaggagaauuc

SEQ ID NO: 4001804 - RNA, 18 nt, Human herpesvirus 7
acaccccaugcaagaaaa

SEQ ID NO: 4001805 - RNA, 18 nt, Human herpesvirus 7
acaccgcaaacauuuuga

SEQ ID NO: 4001806 - RNA, 18 nt, Human herpesvirus 7
acacuauuggacaaaaga

SEQ ID NO: 4001807 - RNA, 21 nt, Human herpesvirus 7
acacuuuaaccgcaaaagcca

SEQ ID NO: 4001808 - RNA, 17 nt, Human herpesvirus 7
acagaccuauguguuua

SEQ ID NO: 4001809 - RNA, 14 nt, Human herpesvirus 7
acagagaacaccau

SEQ ID NO: 4001810 - RNA, 14 nt, Human herpesvirus 7
acagauaaaaauuu

SEQ ID NO: 4001811 - RNA, 20 nt, Human herpesvirus 7
acagaucuugcuuuagaaca

SEQ ID NO: 4001812 - RNA, 22 nt, Human herpesvirus 7
acagaucuugcuuuagaacaau

SEQ ID NO: 4001813 - RNA, 21 nt, Human herpesvirus 7
acagcaaauucacgcucucaa

SEQ ID NO: 4001814 - RNA, 23 nt, Human herpesvirus 7
acagcaccaauccuuuuaaaacc

SEQ ID NO: 4001815 - RNA, 14 nt, Human herpesvirus 7
acagcucaaaagua

SEQ ID NO: 4001816 - RNA, 20 nt, Human herpesvirus 7
acauaaagguaaaaauuuga

SEQ ID NO: 4001817 - RNA, 15 nt, Human herpesvirus 7
acauaaucauggaaa

SEQ ID NO: 4001818 - RNA, 15 nt, Human herpesvirus 7
acauagcuagaaauu

SEQ ID NO: 4001819 - RNA, 16 nt, Human herpesvirus 7
acauauagauaaugaa

SEQ ID NO: 4001820 - RNA, 13 nt, Human herpesvirus 7
acaucauguuaaa

SEQ ID NO: 4001821 - RNA, 13 nt, Human herpesvirus 7
acaugaucuugua

SEQ ID NO: 4001822 - RNA, 16 nt, Human herpesvirus 7
acauucagaaaaaauc

SEQ ID NO: 4001823 - RNA, 23 nt, Human herpesvirus 7
acauucuccaguggcaguacuac

SEQ ID NO: 4001824 - RNA, 14 nt, Human herpesvirus 7
acauuuaaaaaauc

SEQ ID NO: 4001825 - RNA, 21 nt, Human herpesvirus 7
acauuucagaugacaacucaa

SEQ ID NO: 4001826 - RNA, 19 nt, Human herpesvirus 7
acauuucauuccaaaauac

SEQ ID NO: 4001827 - RNA, 21 nt, Human herpesvirus 7
acauuucauuccaaaauacaa

SEQ ID NO: 4001828 - RNA, 18 nt, Human herpesvirus 7
acauuuuaauaugugaaa

SEQ ID NO: 4001829 - RNA, 15 nt, Human herpesvirus 7
accacaacugugaca

SEQ ID NO: 4001830 - RNA, 19 nt, Human herpesvirus 7
accaugaaaaauaaauacu

SEQ ID NO: 4001831 - RNA, 15 nt, Human herpesvirus 7
accaugaaaaauaug

SEQ ID NO: 4001832 - RNA, 15 nt, Human herpesvirus 7
accauugcugauccg

SEQ ID NO: 4001833 - RNA, 14 nt, Human herpesvirus 7
accauuucugaaac

SEQ ID NO: 4001834 - RNA, 23 nt, Human herpesvirus 7
accauuucugaaaccuucgcaac

SEQ ID NO: 4001835 - RNA, 21 nt, Human herpesvirus 7
accgaagcagggaaaaagcau

SEQ ID NO: 4001836 - RNA, 18 nt, Human herpesvirus 7
accgacaauauaaaagaa

SEQ ID NO: 4001837 - RNA, 12 nt, Human herpesvirus 7
accgauuacugu

SEQ ID NO: 4001838 - RNA, 16 nt, Human herpesvirus 7
accgcaugugaaaaug

SEQ ID NO: 4001839 - RNA, 16 nt, Human herpesvirus 7
accgguuaaaauggga

SEQ ID NO: 4001840 - RNA, 17 nt, Human herpesvirus 7
accgguuaaaaugggaa

SEQ ID NO: 4001841 - RNA, 15 nt, Human herpesvirus 7
accgucauuuaauug

SEQ ID NO: 4001842 - RNA, 13 nt, Human herpesvirus 7
accguuugcagcc

SEQ ID NO: 4001843 - RNA, 14 nt, Human herpesvirus 7
accuguauggaacc

SEQ ID NO: 4001844 - RNA, 22 nt, Human herpesvirus 7
acgaauaaaaaguuuuugagua

SEQ ID NO: 4001845 - RNA, 16 nt, Human herpesvirus 7
acgagcgauuuaaugu

SEQ ID NO: 4001846 - RNA, 13 nt, Human herpesvirus 7
acgcauucaaugg

SEQ ID NO: 4001847 - RNA, 19 nt, Human herpesvirus 7
acgccaaaucuaauuuaug

SEQ ID NO: 4001848 - RNA, 19 nt, Human herpesvirus 7
acgcucucaaucaaaaucu

SEQ ID NO: 4001849 - RNA, 16 nt, Human herpesvirus 7
acgucaggaaaaaaac

SEQ ID NO: 4001850 - RNA, 19 nt, Human herpesvirus 7
acgucaugcggaagaacaa

SEQ ID NO: 4001851 - RNA, 21 nt, Human herpesvirus 7
acguccaagaaauaugcuucc

SEQ ID NO: 4001852 - RNA, 20 nt, Human herpesvirus 7
acgugagggggacaauuauu

SEQ ID NO: 4001853 - RNA, 16 nt, Human herpesvirus 7
acguuuauuuggauug

SEQ ID NO: 4001854 - RNA, 18 nt, Human herpesvirus 7
acuaaaacuacauuuaaa

SEQ ID NO: 4001855 - RNA, 16 nt, Human herpesvirus 7
acuaaagcuacagcuu

SEQ ID NO: 4001856 - RNA, 22 nt, Human herpesvirus 7
acuaacauuuuaauaugugaaa

SEQ ID NO: 4001857 - RNA, 17 nt, Human herpesvirus 7
acuaagaaaaaaacaaa

SEQ ID NO: 4001858 - RNA, 16 nt, Human herpesvirus 7
acuaauaaaaauuacu

SEQ ID NO: 4001859 - RNA, 19 nt, Human herpesvirus 7
acuacauuuaaaaaaucug

SEQ ID NO: 4001860 - RNA, 21 nt, Human herpesvirus 7
acuacauuuaaaaaaucugaa

SEQ ID NO: 4001861 - RNA, 13 nt, Human herpesvirus 7
acuauaaauggaa

SEQ ID NO: 4001862 - RNA, 18 nt, Human herpesvirus 7
acuaucuccuaaaugaau

SEQ ID NO: 4001863 - RNA, 19 nt, Human herpesvirus 7
acuaucuccuaaaugaauu

SEQ ID NO: 4001864 - RNA, 16 nt, Human herpesvirus 7
acucauaauagagcug

SEQ ID NO: 4001865 - RNA, 18 nt, Human herpesvirus 7
acuccauucgguuuucaa

SEQ ID NO: 4001866 - RNA, 20 nt, Human herpesvirus 7
acuccguuucauuuaaaagg

SEQ ID NO: 4001867 - RNA, 23 nt, Human herpesvirus 7
acucggucuuuuuauuucuaaua

SEQ ID NO: 4001868 - RNA, 13 nt, Human herpesvirus 7
acucuccugaaau

SEQ ID NO: 4001869 - RNA, 21 nt, Human herpesvirus 7
acucuggguccggaaguugag

SEQ ID NO: 4001870 - RNA, 23 nt, Human herpesvirus 7
acucuucuuugugagaaauggaa

SEQ ID NO: 4001871 - RNA, 17 nt, Human herpesvirus 7
acugagacgagcaucua

SEQ ID NO: 4001872 - RNA, 16 nt, Human herpesvirus 7
acugauauaaaugcuu

SEQ ID NO: 4001873 - RNA, 22 nt, Human herpesvirus 7
acuguaauauaauuauuuuaaa

SEQ ID NO: 4001874 - RNA, 22 nt, Human herpesvirus 7
acuguauuuguugaucuucaau

SEQ ID NO: 4001875 - RNA, 15 nt, Human herpesvirus 7
acuguccaacacaag

SEQ ID NO: 4001876 - RNA, 19 nt, Human herpesvirus 7
acuuaaggcggacaaauau

SEQ ID NO: 4001877 - RNA, 14 nt, Human herpesvirus 7
acuuacuguuuaca

SEQ ID NO: 4001878 - RNA, 16 nt, Human herpesvirus 7
acuuacuguuuacaca

SEQ ID NO: 4001879 - RNA, 19 nt, Human herpesvirus 7
acuuauuauaucuuaauaa

SEQ ID NO: 4001880 - RNA, 21 nt, Human herpesvirus 7
acuuauuccagauaugacaaa

SEQ ID NO: 4001881 - RNA, 17 nt, Human herpesvirus 7
acuucaacauacagcau

SEQ ID NO: 4001882 - RNA, 18 nt, Human herpesvirus 7
acuucuuugacaaaaaug

SEQ ID NO: 4001883 - RNA, 13 nt, Human herpesvirus 7
acuuguugaaaua

SEQ ID NO: 4001884 - RNA, 12 nt, Human herpesvirus 7
acuuguuuugac

SEQ ID NO: 4001885 - RNA, 11 nt, Human herpesvirus 7
acuuugaaauc

SEQ ID NO: 4001886 - RNA, 12 nt, Human herpesvirus 7
acuuuuaaauaa

SEQ ID NO: 4001887 - RNA, 17 nt, Human herpesvirus 7
acuuuuaacuguuaaag

SEQ ID NO: 4001888 - RNA, 15 nt, Human herpesvirus 7
acuuuuuauaauaau

SEQ ID NO: 4001889 - RNA, 22 nt, Human herpesvirus 7
auacugauguaaaauuaauuca

SEQ ID NO: 4001890 - RNA, 18 nt, Human herpesvirus 7
auagaaauuauuguacau

SEQ ID NO: 4001891 - RNA, 22 nt, Human herpesvirus 7
auagaacgcuuauucgacacua

SEQ ID NO: 4001892 - RNA, 15 nt, Human herpesvirus 7
auagacacauuuauc

SEQ ID NO: 4001893 - RNA, 22 nt, Human herpesvirus 7
auagacugauacgcuuucugaa

SEQ ID NO: 4001894 - RNA, 16 nt, Human herpesvirus 7
auagcaggaagcacaa

SEQ ID NO: 4001895 - RNA, 22 nt, Human herpesvirus 7
auagucuacuaaggugucuucg

SEQ ID NO: 4001896 - RNA, 20 nt, Human herpesvirus 7
auaguuugguuauccaaguu

SEQ ID NO: 4001897 - RNA, 13 nt, Human herpesvirus 7
auauaaaaaauuu

SEQ ID NO: 4001898 - RNA, 15 nt, Human herpesvirus 7
auauaacaaaaaacg

SEQ ID NO: 4001899 - RNA, 15 nt, Human herpesvirus 7
auauaauaaaucguu

SEQ ID NO: 4001900 - RNA, 15 nt, Human herpesvirus 7
auauacauguaacug

SEQ ID NO: 4001901 - RNA, 22 nt, Human herpesvirus 7
auauacggaauggacaaaaaua

SEQ ID NO: 4001902 - RNA, 17 nt, Human herpesvirus 7
auauauaagagaauugc

SEQ ID NO: 4001903 - RNA, 11 nt, Human herpesvirus 7
auauaugaauc

SEQ ID NO: 4001904 - RNA, 20 nt, Human herpesvirus 7
auaugacuuguugaauuuuu

SEQ ID NO: 4001905 - RNA, 17 nt, Human herpesvirus 7
auaugcaucaaaacaua

SEQ ID NO: 4001906 - RNA, 20 nt, Human herpesvirus 7
auaugcauguguaaagccaa

SEQ ID NO: 4001907 - RNA, 21 nt, Human herpesvirus 7
auaugcuagaagacugcaacc

SEQ ID NO: 4001908 - RNA, 16 nt, Human herpesvirus 7
auaugcuuccuaaaaa

SEQ ID NO: 4001909 - RNA, 19 nt, Human herpesvirus 7
auauuaaaaaccacagagg

SEQ ID NO: 4001910 - RNA, 19 nt, Human herpesvirus 7
auauugucauaaaauuauc

SEQ ID NO: 4001911 - RNA, 18 nt, Human herpesvirus 7
auauuuaaggcuguaaaa

SEQ ID NO: 4001912 - RNA, 16 nt, Human herpesvirus 7
auauuugcuugcugaa

SEQ ID NO: 4001913 - RNA, 14 nt, Human herpesvirus 7
aucaaaaaauaauu

SEQ ID NO: 4001914 - RNA, 12 nt, Human herpesvirus 7
aucaaaaaauuu

SEQ ID NO: 4001915 - RNA, 13 nt, Human herpesvirus 7
aucaaaaacugaa

SEQ ID NO: 4001916 - RNA, 14 nt, Human herpesvirus 7
aucaaaacauauca

SEQ ID NO: 4001917 - RNA, 19 nt, Human herpesvirus 7
aucaaaauccuggauuuca

SEQ ID NO: 4001918 - RNA, 15 nt, Human herpesvirus 7
aucaaauuauaccuc

SEQ ID NO: 4001919 - RNA, 16 nt, Human herpesvirus 7
aucaaauuuugauucc

SEQ ID NO: 4001920 - RNA, 15 nt, Human herpesvirus 7
aucaaggucuuucau

SEQ ID NO: 4001921 - RNA, 21 nt, Human herpesvirus 7
aucaccaaagaguauacaaaa

SEQ ID NO: 4001922 - RNA, 22 nt, Human herpesvirus 7
aucaucuuaaaaguacaaaugu

SEQ ID NO: 4001923 - RNA, 18 nt, Human herpesvirus 7
aucaugaaaacaguggga

SEQ ID NO: 4001924 - RNA, 14 nt, Human herpesvirus 7
aucauuaaaaugau

SEQ ID NO: 4001925 - RNA, 23 nt, Human herpesvirus 7
auccaaguuuuaacaaucuaagg

SEQ ID NO: 4001926 - RNA, 16 nt, Human herpesvirus 7
auccgcugaacgcaga

SEQ ID NO: 4001927 - RNA, 13 nt, Human herpesvirus 7
aucgaguucugac

SEQ ID NO: 4001928 - RNA, 14 nt, Human herpesvirus 7
aucgcuuucucaag

SEQ ID NO: 4001929 - RNA, 13 nt, Human herpesvirus 7
aucggaaauuuug

SEQ ID NO: 4001930 - RNA, 11 nt, Human herpesvirus 7
aucuaauuaau

SEQ ID NO: 4001931 - RNA, 22 nt, Human herpesvirus 7
aucuacauccuuaaauuuuaca

SEQ ID NO: 4001932 - RNA, 22 nt, Human herpesvirus 7
aucuaccccgauccucagaaug

SEQ ID NO: 4001933 - RNA, 18 nt, Human herpesvirus 7
aucuagcuuguuaaagaa

SEQ ID NO: 4001934 - RNA, 23 nt, Human herpesvirus 7
aucuaggucuuccacuguuguag

SEQ ID NO: 4001935 - RNA, 13 nt, Human herpesvirus 7
aucuaugaaauaa

SEQ ID NO: 4001936 - RNA, 12 nt, Human herpesvirus 7
aucuauuaaaua

SEQ ID NO: 4001937 - RNA, 14 nt, Human herpesvirus 7
aucuguagaaaaug

SEQ ID NO: 4001938 - RNA, 20 nt, Human herpesvirus 7
aucuuaaaaguacaaauguu

SEQ ID NO: 4001939 - RNA, 23 nt, Human herpesvirus 7
aucuuccacaaaaauuuaauagu

SEQ ID NO: 4001940 - RNA, 21 nt, Human herpesvirus 7
aucuugagaaauaugaauuga

SEQ ID NO: 4001941 - RNA, 20 nt, Human herpesvirus 7
aucuugugaaguuugcugaa

SEQ ID NO: 4001942 - RNA, 14 nt, Human herpesvirus 7
aucuuuaacgguaa

SEQ ID NO: 4001943 - RNA, 19 nt, Human herpesvirus 7
aucuuuaucuuugucacuu

SEQ ID NO: 4001944 - RNA, 17 nt, Human herpesvirus 7
aucuuuauugguaauua

SEQ ID NO: 4001945 - RNA, 16 nt, Human herpesvirus 7
aucuuucguauugccu

SEQ ID NO: 4001946 - RNA, 19 nt, Human herpesvirus 7
aucuuugucacuuaaagaa

SEQ ID NO: 4001947 - RNA, 13 nt, Human herpesvirus 7
augaaaaaaauua

SEQ ID NO: 4001948 - RNA, 17 nt, Human herpesvirus 7
augaaaaaaauuaugug

SEQ ID NO: 4001949 - RNA, 14 nt, Human herpesvirus 7
augaaacuuccaau

SEQ ID NO: 4001950 - RNA, 15 nt, Human herpesvirus 7
augaaaucuugaauu

SEQ ID NO: 4001951 - RNA, 16 nt, Human herpesvirus 7
augaagacagcucaaa

SEQ ID NO: 4001952 - RNA, 17 nt, Human herpesvirus 7
augaaucaaauuucaaa

SEQ ID NO: 4001953 - RNA, 18 nt, Human herpesvirus 7
augaauuaauaaaacaaa

SEQ ID NO: 4001954 - RNA, 20 nt, Human herpesvirus 7
augaauugaaauuucuaaau

SEQ ID NO: 4001955 - RNA, 21 nt, Human herpesvirus 7
augacaacucaauaaaaaugu

SEQ ID NO: 4001956 - RNA, 23 nt, Human herpesvirus 7
augacacgacacugaaugucaac

SEQ ID NO: 4001957 - RNA, 20 nt, Human herpesvirus 7
augaguauaccuacgacuau

SEQ ID NO: 4001958 - RNA, 24 nt, Human herpesvirus 7
augaucuccguugaaagcguuuca

SEQ ID NO: 4001959 - RNA, 22 nt, Human herpesvirus 7
augauuagcgcgugaacaaaua

SEQ ID NO: 4001960 - RNA, 16 nt, Human herpesvirus 7
augauuuuuuaaaugu

SEQ ID NO: 4001961 - RNA, 16 nt, Human herpesvirus 7
augcauauuugaacau

SEQ ID NO: 4001962 - RNA, 16 nt, Human herpesvirus 7
augccagaaauuaaau

SEQ ID NO: 4001963 - RNA, 19 nt, Human herpesvirus 7
augccaucuauaaacauuc

SEQ ID NO: 4001964 - RNA, 15 nt, Human herpesvirus 7
augcugauuccuucu

SEQ ID NO: 4001965 - RNA, 23 nt, Human herpesvirus 7
augcuuccuaaaaaaaaaggaaa

SEQ ID NO: 4001966 - RNA, 13 nt, Human herpesvirus 7
augcuuuaacugg

SEQ ID NO: 4001967 - RNA, 16 nt, Human herpesvirus 7
augcuuuaacuggaau

SEQ ID NO: 4001968 - RNA, 19 nt, Human herpesvirus 7
auggaacugaaaacaaugc

SEQ ID NO: 4001969 - RNA, 12 nt, Human herpesvirus 7
auggaagaacaa

SEQ ID NO: 4001970 - RNA, 20 nt, Human herpesvirus 7
auggacggcauuuaacucau

SEQ ID NO: 4001971 - RNA, 20 nt, Human herpesvirus 7
auggccaucgcuuucucaag

SEQ ID NO: 4001972 - RNA, 18 nt, Human herpesvirus 7
auguaaucaaaauuuugg

SEQ ID NO: 4001973 - RNA, 15 nt, Human herpesvirus 7
augucagaguuuaaa

SEQ ID NO: 4001974 - RNA, 18 nt, Human herpesvirus 7
auguccaaucaaaaacug

SEQ ID NO: 4001975 - RNA, 22 nt, Human herpesvirus 7
augucucuugaagaacaacaug

SEQ ID NO: 4001976 - RNA, 13 nt, Human herpesvirus 7
augugcuuuuuuc

SEQ ID NO: 4001977 - RNA, 22 nt, Human herpesvirus 7
auguggucuggucuucauauuu

SEQ ID NO: 4001978 - RNA, 17 nt, Human herpesvirus 7
augugugugguaaggca

SEQ ID NO: 4001979 - RNA, 18 nt, Human herpesvirus 7
augugugugguaaggcag

SEQ ID NO: 4001980 - RNA, 21 nt, Human herpesvirus 7
auguuaaaggaucaaaagcug

SEQ ID NO: 4001981 - RNA, 21 nt, Human herpesvirus 7
auguuacuauaugaaaacagc

SEQ ID NO: 4001982 - RNA, 17 nt, Human herpesvirus 7
auguuauacauaaagag

SEQ ID NO: 4001983 - RNA, 19 nt, Human herpesvirus 7
auguuccuuauauuaaaaa

SEQ ID NO: 4001984 - RNA, 15 nt, Human herpesvirus 7
auguugcaaauguuc

SEQ ID NO: 4001985 - RNA, 19 nt, Human herpesvirus 7
auguugccuucuaaaacag

SEQ ID NO: 4001986 - RNA, 20 nt, Human herpesvirus 7
auguuucaucaauguuuuca

SEQ ID NO: 4001987 - RNA, 22 nt, Human herpesvirus 7
auguuucuggaucugccucugc

SEQ ID NO: 4001988 - RNA, 19 nt, Human herpesvirus 7
auguuuuaccgugucuucu

SEQ ID NO: 4001989 - RNA, 20 nt, Human herpesvirus 7
auguuuuuccuaugauacaa

SEQ ID NO: 4001990 - RNA, 17 nt, Human herpesvirus 7
auuaaaugauuuuaaau

SEQ ID NO: 4001991 - RNA, 16 nt, Human herpesvirus 7
auuaauauauuuuccu

SEQ ID NO: 4001992 - RNA, 12 nt, Human herpesvirus 7
auuacacaggaa

SEQ ID NO: 4001993 - RNA, 14 nt, Human herpesvirus 7
auuacauccugcua

SEQ ID NO: 4001994 - RNA, 15 nt, Human herpesvirus 7
auuaguauuguaaua

SEQ ID NO: 4001995 - RNA, 20 nt, Human herpesvirus 7
auuagucauacuuuacagcu

SEQ ID NO: 4001996 - RNA, 13 nt, Human herpesvirus 7
auuagugccugca

SEQ ID NO: 4001997 - RNA, 16 nt, Human herpesvirus 7
auuauaaauguaacuu

SEQ ID NO: 4001998 - RNA, 17 nt, Human herpesvirus 7
auuauaaauguaacuuu

SEQ ID NO: 4001999 - RNA, 14 nt, Human herpesvirus 7
auuaucaccacaau

SEQ ID NO: 4002000 - RNA, 23 nt, Human herpesvirus 7
auuauguauaucuuuuuauugaa

SEQ ID NO: 4002001 - RNA, 16 nt, Human herpesvirus 7
auuauguguacacuuu

SEQ ID NO: 4002002 - RNA, 22 nt, Human herpesvirus 7
auucaaauaagggauaucuuaa

SEQ ID NO: 4002003 - RNA, 23 nt, Human herpesvirus 8 [Kaposi`s sarcoma-associated h
cagguaugaccggcuuguuuaua

SEQ ID NO: 4002004 - RNA, 18 nt, Human herpesvirus 8 [Kaposi`s sarcoma-associated h
caggucgcagagaccucu

SEQ ID NO: 4002005 - RNA, 16 nt, Human herpesvirus 8 [Kaposi`s sarcoma-associated h
caguauuaugccaggg

SEQ ID NO: 4002006 - RNA, 21 nt, Human herpesvirus 8 [Kaposi`s sarcoma-associated h
cauauacagguguccaagacu

SEQ ID NO: 4002007 - RNA, 21 nt, Human herpesvirus 8 [Kaposi`s sarcoma-associated h
caucaacaggagggcagcugu

SEQ ID NO: 4002008 - RNA, 16 nt, Human herpesvirus 8 [Kaposi`s sarcoma-associated h
caucccgccugcgguc

SEQ ID NO: 4002009 - RNA, 20 nt, Human herpesvirus 8 [Kaposi`s sarcoma-associated h
cauccgcgagccauucaucg

SEQ ID NO: 4002010 - RNA, 15 nt, Human herpesvirus 8 [Kaposi`s sarcoma-associated h
cauccuaggugacug

SEQ ID NO: 4002011 - RNA, 23 nt, Human herpesvirus 8 [Kaposi`s sarcoma-associated h
caucugcugucuaguggagaggg

SEQ ID NO: 4002012 - RNA, 20 nt, Human herpesvirus 8 [Kaposi`s sarcoma-associated h
caugcaggcaguccaagguc

SEQ ID NO: 4002013 - RNA, 21 nt, Human herpesvirus 8 [Kaposi`s sarcoma-associated h
caugccaucuuugggcuagug

SEQ ID NO: 4002014 - RNA, 17 nt, Human herpesvirus 8 [Kaposi`s sarcoma-associated h
caugcgucgccguagug

SEQ ID NO: 4002015 - RNA, 20 nt, Human herpesvirus 8 [Kaposi`s sarcoma-associated h
cauugccacccagcuacugg

SEQ ID NO: 4002016 - RNA, 24 nt, Human herpesvirus 8 [Kaposi`s sarcoma-associated h
cauugugugguuuggcagucacuu

SEQ ID NO: 4002017 - RNA, 24 nt, Human herpesvirus 8 [Kaposi`s sarcoma-associated h
cauuugcgugcaaaaugugcuuug

SEQ ID NO: 4002018 - RNA, 19 nt, Human herpesvirus 8 [Kaposi`s sarcoma-associated h
ccaagagcgagugugccuc

SEQ ID NO: 4002019 - RNA, 19 nt, Human herpesvirus 8 [Kaposi`s sarcoma-associated h
ccaauuaauuggagcucuu

SEQ ID NO: 4002020 - RNA, 15 nt, Human herpesvirus 8 [Kaposi`s sarcoma-associated h
ccacaucggugccuu

SEQ ID NO: 4002021 - RNA, 19 nt, Human herpesvirus 8 [Kaposi`s sarcoma-associated h
ccaccguggaguugccugu

SEQ ID NO: 4002022 - RNA, 17 nt, Human herpesvirus 8 [Kaposi`s sarcoma-associated h
ccacggcgcuguacagu

SEQ ID NO: 4002023 - RNA, 14 nt, Human herpesvirus 8 [Kaposi`s sarcoma-associated h
ccagaggacagggu

SEQ ID NO: 4002024 - RNA, 18 nt, Human herpesvirus 8 [Kaposi`s sarcoma-associated h
ccagauaccccugcaccu

SEQ ID NO: 4002025 - RNA, 23 nt, Human herpesvirus 8 [Kaposi`s sarcoma-associated h
ccagccugaaacgucgcccaaau

SEQ ID NO: 4002026 - RNA, 17 nt, Human herpesvirus 8 [Kaposi`s sarcoma-associated h
ccagcuccuauugcaac

SEQ ID NO: 4002027 - RNA, 23 nt, Human herpesvirus 8 [Kaposi`s sarcoma-associated h
ccagggaagaugaaggacacggg

SEQ ID NO: 4002028 - RNA, 16 nt, Human herpesvirus 8 [Kaposi`s sarcoma-associated h
ccaguguguuucugug

SEQ ID NO: 4002029 - RNA, 14 nt, Human herpesvirus 8 [Kaposi`s sarcoma-associated h
ccaugaaagguggu

SEQ ID NO: 4002030 - RNA, 15 nt, Human herpesvirus 8 [Kaposi`s sarcoma-associated h
ccaugagccucccuu

SEQ ID NO: 4002031 - RNA, 19 nt, Human herpesvirus 8 [Kaposi`s sarcoma-associated h
ccauggcagcccagccucu

SEQ ID NO: 4002032 - RNA, 20 nt, Human herpesvirus 8 [Kaposi`s sarcoma-associated h
ccauggcagcccagccucug

SEQ ID NO: 4002033 - RNA, 17 nt, Human herpesvirus 8 [Kaposi`s sarcoma-associated h
ccauuuuuuacggacaa

SEQ ID NO: 4002034 - RNA, 18 nt, Human herpesvirus 8 [Kaposi`s sarcoma-associated h
cccaauguuaauguucuc

SEQ ID NO: 4002035 - RNA, 21 nt, Human herpesvirus 8 [Kaposi`s sarcoma-associated h
cccacguggugcugccuagga

SEQ ID NO: 4002036 - RNA, 14 nt, Human herpesvirus 8 [Kaposi`s sarcoma-associated h
cccagacgacccca

SEQ ID NO: 4002037 - RNA, 17 nt, Human herpesvirus 8 [Kaposi`s sarcoma-associated h
ccccaagcggggagaag

SEQ ID NO: 4002038 - RNA, 24 nt, Human herpesvirus 8 [Kaposi`s sarcoma-associated h
ccccgggcguggugccggaugcag

SEQ ID NO: 4002039 - RNA, 12 nt, Human herpesvirus 8 [Kaposi`s sarcoma-associated h
cccgccucugaa

SEQ ID NO: 4002040 - RNA, 13 nt, Human herpesvirus 8 [Kaposi`s sarcoma-associated h
cccggauuccucc

SEQ ID NO: 4002041 - RNA, 15 nt, Human herpesvirus 8 [Kaposi`s sarcoma-associated h
cccggcaacacugga

SEQ ID NO: 4002042 - RNA, 13 nt, Human herpesvirus 8 [Kaposi`s sarcoma-associated h
cccuagccaugga

SEQ ID NO: 4002043 - RNA, 19 nt, Human herpesvirus 8 [Kaposi`s sarcoma-associated h
cccucuucuguugccaggc

SEQ ID NO: 4002044 - RNA, 23 nt, Human herpesvirus 8 [Kaposi`s sarcoma-associated h
cccucuuggcuguuacaauaaag

SEQ ID NO: 4002045 - RNA, 19 nt, Human herpesvirus 8 [Kaposi`s sarcoma-associated h
cccuuacgccccugguggg

SEQ ID NO: 4002046 - RNA, 18 nt, Human herpesvirus 8 [Kaposi`s sarcoma-associated h
cccuuaucagcucacugu

SEQ ID NO: 4002047 - RNA, 15 nt, Human herpesvirus 8 [Kaposi`s sarcoma-associated h
ccgacaaccggcugg

SEQ ID NO: 4002048 - RNA, 19 nt, Human herpesvirus 8 [Kaposi`s sarcoma-associated h
ccgacugugccccuggaaa

SEQ ID NO: 4002049 - RNA, 11 nt, Human herpesvirus 8 [Kaposi`s sarcoma-associated h
ccgagccacaa

SEQ ID NO: 4002050 - RNA, 18 nt, Human herpesvirus 8 [Kaposi`s sarcoma-associated h
ccgagccacaaaguacau

SEQ ID NO: 4002051 - RNA, 16 nt, Human herpesvirus 8 [Kaposi`s sarcoma-associated h
ccgcaggccagccacc

SEQ ID NO: 4002052 - RNA, 14 nt, Human herpesvirus 8 [Kaposi`s sarcoma-associated h
ccgcauuaaagcac

SEQ ID NO: 4002053 - RNA, 23 nt, Human herpesvirus 8 [Kaposi`s sarcoma-associated h
ccggacucgucuacccugccacu

SEQ ID NO: 4002054 - RNA, 18 nt, Human herpesvirus 8 [Kaposi`s sarcoma-associated h
ccggaugcagggccuggc

SEQ ID NO: 4002055 - RNA, 22 nt, Human herpesvirus 8 [Kaposi`s sarcoma-associated h
ccggcgacugcgcagaacagua

SEQ ID NO: 4002056 - RNA, 12 nt, Human herpesvirus 8 [Kaposi`s sarcoma-associated h
ccguggucauug

SEQ ID NO: 4002057 - RNA, 18 nt, Human herpesvirus 8 [Kaposi`s sarcoma-associated h
ccgugguucaucagccuc

SEQ ID NO: 4002058 - RNA, 21 nt, Human herpesvirus 8 [Kaposi`s sarcoma-associated h
ccguguuuuucuggucgcugc

SEQ ID NO: 4002059 - RNA, 19 nt, Human herpesvirus 8 [Kaposi`s sarcoma-associated h
ccuaggugggugugcauuu

SEQ ID NO: 4002060 - RNA, 15 nt, Human herpesvirus 8 [Kaposi`s sarcoma-associated h
ccugcugcagcugga

SEQ ID NO: 4002061 - RNA, 12 nt, Human herpesvirus 8 [Kaposi`s sarcoma-associated h
ccugggccaggc

SEQ ID NO: 4002062 - RNA, 13 nt, Human herpesvirus 8 [Kaposi`s sarcoma-associated h
ccuggugaggaag

SEQ ID NO: 4002063 - RNA, 13 nt, Human herpesvirus 8 [Kaposi`s sarcoma-associated h
ccugucgaggaag

SEQ ID NO: 4002064 - RNA, 20 nt, Human herpesvirus 8 [Kaposi`s sarcoma-associated h
ccugucgaggaagaaauggg

SEQ ID NO: 4002065 - RNA, 18 nt, Human herpesvirus 8 [Kaposi`s sarcoma-associated h
ccuuaagaaaguggauaa

SEQ ID NO: 4002066 - RNA, 21 nt, Human herpesvirus 8 [Kaposi`s sarcoma-associated h
cgaacagaagacccagaaaau

SEQ ID NO: 4002067 - RNA, 16 nt, Human herpesvirus 8 [Kaposi`s sarcoma-associated h
cgaauaaaacaggaag

SEQ ID NO: 4002068 - RNA, 14 nt, Human herpesvirus 8 [Kaposi`s sarcoma-associated h
cgacagcucgggcg

SEQ ID NO: 4002069 - RNA, 13 nt, Human herpesvirus 8 [Kaposi`s sarcoma-associated h
cgacaugugcuuu

SEQ ID NO: 4002070 - RNA, 18 nt, Human herpesvirus 8 [Kaposi`s sarcoma-associated h
cgaccccagccccuuggu

SEQ ID NO: 4002071 - RNA, 18 nt, Human herpesvirus 8 [Kaposi`s sarcoma-associated h
cgagcaccucagaaagug

SEQ ID NO: 4002072 - RNA, 20 nt, Human herpesvirus 8 [Kaposi`s sarcoma-associated h
cgagcucaugcccacccugu

SEQ ID NO: 4002073 - RNA, 18 nt, Human herpesvirus 8 [Kaposi`s sarcoma-associated h
cgcaugguugcaacagac

SEQ ID NO: 4002074 - RNA, 21 nt, Human herpesvirus 8 [Kaposi`s sarcoma-associated h
cgccauuuuuguggcugccug

SEQ ID NO: 4002075 - RNA, 16 nt, Human herpesvirus 8 [Kaposi`s sarcoma-associated h
cgccccuggugggaca

SEQ ID NO: 4002076 - RNA, 16 nt, Human herpesvirus 8 [Kaposi`s sarcoma-associated h
cgccgcaaggagcagc

SEQ ID NO: 4002077 - RNA, 22 nt, Human herpesvirus 8 [Kaposi`s sarcoma-associated h
cgccuggagcagcgccagugga

SEQ ID NO: 4002078 - RNA, 16 nt, Human herpesvirus 8 [Kaposi`s sarcoma-associated h
cgcgaccucccacggg

SEQ ID NO: 4002079 - RNA, 16 nt, Human herpesvirus 8 [Kaposi`s sarcoma-associated h
cgcggauaggcugggg

SEQ ID NO: 4002080 - RNA, 19 nt, Human herpesvirus 8 [Kaposi`s sarcoma-associated h
cggaaguuggccuccagca

SEQ ID NO: 4002081 - RNA, 12 nt, Human herpesvirus 8 [Kaposi`s sarcoma-associated h
cggacauuuugu

SEQ ID NO: 4002082 - RNA, 15 nt, Human herpesvirus 8 [Kaposi`s sarcoma-associated h
cggagccggaagaua

SEQ ID NO: 4002083 - RNA, 20 nt, Human herpesvirus 8 [Kaposi`s sarcoma-associated h
cggauccggagggaaggaag

SEQ ID NO: 4002084 - RNA, 21 nt, Human herpesvirus 8 [Kaposi`s sarcoma-associated h
cggccgcaaucaugccugugg

SEQ ID NO: 4002085 - RNA, 17 nt, Human herpesvirus 8 [Kaposi`s sarcoma-associated h
cgggacguuggcggcga

SEQ ID NO: 4002086 - RNA, 14 nt, Human herpesvirus 8 [Kaposi`s sarcoma-associated h
cgggcugcgccagc

SEQ ID NO: 4002087 - RNA, 21 nt, Human herpesvirus 8 [Kaposi`s sarcoma-associated h
cggguugggucgcugcaccug

SEQ ID NO: 4002088 - RNA, 14 nt, Human herpesvirus 8 [Kaposi`s sarcoma-associated h
cgguggugugccug

SEQ ID NO: 4002089 - RNA, 17 nt, Human herpesvirus 8 [Kaposi`s sarcoma-associated h
cguaagaggacccaggg

SEQ ID NO: 4002090 - RNA, 14 nt, Human herpesvirus 8 [Kaposi`s sarcoma-associated h
cguacaaggccaug

SEQ ID NO: 4002091 - RNA, 14 nt, Human herpesvirus 8 [Kaposi`s sarcoma-associated h
cguaggcgaagaga

SEQ ID NO: 4002092 - RNA, 14 nt, Human herpesvirus 8 [Kaposi`s sarcoma-associated h
cguccgacaugugc

SEQ ID NO: 4002093 - RNA, 14 nt, Human herpesvirus 8 [Kaposi`s sarcoma-associated h
cgucgacagagcca

SEQ ID NO: 4002094 - RNA, 20 nt, Human herpesvirus 8 [Kaposi`s sarcoma-associated h
cgucugugaagucucccugc

SEQ ID NO: 4002095 - RNA, 11 nt, Human herpesvirus 8 [Kaposi`s sarcoma-associated h
cgucuucccac

SEQ ID NO: 4002096 - RNA, 16 nt, Human herpesvirus 8 [Kaposi`s sarcoma-associated h
cgugcuacuuacagca

SEQ ID NO: 4002097 - RNA, 15 nt, Human herpesvirus 8 [Kaposi`s sarcoma-associated h
cgugucuagacaaua

SEQ ID NO: 4002098 - RNA, 19 nt, Human herpesvirus 8 [Kaposi`s sarcoma-associated h
cguguguuuggugguguca

SEQ ID NO: 4002099 - RNA, 16 nt, Human herpesvirus 8 [Kaposi`s sarcoma-associated h
cguugacauguggagc

SEQ ID NO: 4002100 - RNA, 15 nt, Human herpesvirus 8 [Kaposi`s sarcoma-associated h
cguuuaguguggauc

SEQ ID NO: 4002101 - RNA, 16 nt, Human herpesvirus 8 [Kaposi`s sarcoma-associated h
cguuuuuuuauuuggg

SEQ ID NO: 4002102 - RNA, 14 nt, Human herpesvirus 8 [Kaposi`s sarcoma-associated h
cuaaucaggguaga

SEQ ID NO: 4002103 - RNA, 15 nt, Human herpesvirus 8 [Kaposi`s sarcoma-associated h
cuaaucuggcaugua

SEQ ID NO: 4002104 - RNA, 22 nt, Human herpesvirus 8 [Kaposi`s sarcoma-associated h
cuacagggaaguuucagagccu

SEQ ID NO: 4002105 - RNA, 15 nt, Human herpesvirus 8 [Kaposi`s sarcoma-associated h
cuacggaucaugcuc

SEQ ID NO: 4002106 - RNA, 22 nt, Human herpesvirus 8 [Kaposi`s sarcoma-associated h
cuagcggcgagauuggaggcac

SEQ ID NO: 4002107 - RNA, 17 nt, Human herpesvirus 8 [Kaposi`s sarcoma-associated h
cuaugggaaugugccua

SEQ ID NO: 4002108 - RNA, 14 nt, Human herpesvirus 8 [Kaposi`s sarcoma-associated h
cuaugggugaccac

SEQ ID NO: 4002109 - RNA, 20 nt, Human herpesvirus 8 [Kaposi`s sarcoma-associated h
cuauuugccguccuguggac

SEQ ID NO: 4002110 - RNA, 18 nt, Human herpesvirus 8 [Kaposi`s sarcoma-associated h
cucaaccggucgcagugg

SEQ ID NO: 4002111 - RNA, 19 nt, Human herpesvirus 8 [Kaposi`s sarcoma-associated h
cucaagcaacaugcccuuu

SEQ ID NO: 4002112 - RNA, 18 nt, Human herpesvirus 8 [Kaposi`s sarcoma-associated h
cucaugauuacagaguca

SEQ ID NO: 4002113 - RNA, 17 nt, Human herpesvirus 8 [Kaposi`s sarcoma-associated h
cucgaaagcuucaucgu

SEQ ID NO: 4002114 - RNA, 16 nt, Human herpesvirus 8 [Kaposi`s sarcoma-associated h
cucgcaugaauacccu

SEQ ID NO: 4002115 - RNA, 18 nt, Human herpesvirus 8 [Kaposi`s sarcoma-associated h
cucgccucccaacaugua

SEQ ID NO: 4002116 - RNA, 14 nt, Human herpesvirus 8 [Kaposi`s sarcoma-associated h
cucgcuacacggag

SEQ ID NO: 4002117 - RNA, 18 nt, Human herpesvirus 8 [Kaposi`s sarcoma-associated h
cucgggcgcggcgagccc

SEQ ID NO: 4002118 - RNA, 14 nt, Human herpesvirus 8 [Kaposi`s sarcoma-associated h
cucgugugcccuuc

SEQ ID NO: 4002119 - RNA, 17 nt, Human herpesvirus 8 [Kaposi`s sarcoma-associated h
cucuacagguaggccac

SEQ ID NO: 4002120 - RNA, 21 nt, Human herpesvirus 8 [Kaposi`s sarcoma-associated h
cucuaucagcugcagccagga

SEQ ID NO: 4002121 - RNA, 21 nt, Human herpesvirus 8 [Kaposi`s sarcoma-associated h
cucuccggcgguggcggccau

SEQ ID NO: 4002122 - RNA, 17 nt, Human herpesvirus 8 [Kaposi`s sarcoma-associated h
cucuuggcuguuacaau

SEQ ID NO: 4002123 - RNA, 16 nt, Human herpesvirus 8 [Kaposi`s sarcoma-associated h
cugaucucagaggccc

SEQ ID NO: 4002124 - RNA, 21 nt, Human herpesvirus 8 [Kaposi`s sarcoma-associated h
cugaugcucuggccacguugg

SEQ ID NO: 4002125 - RNA, 19 nt, Human herpesvirus 8 [Kaposi`s sarcoma-associated h
cugcaauguacugccauga

SEQ ID NO: 4002126 - RNA, 12 nt, Human herpesvirus 8 [Kaposi`s sarcoma-associated h
cugcagccagga

SEQ ID NO: 4002127 - RNA, 16 nt, Human herpesvirus 8 [Kaposi`s sarcoma-associated h
cugcccugguucuaau

SEQ ID NO: 4002128 - RNA, 17 nt, Human herpesvirus 8 [Kaposi`s sarcoma-associated h
cugcuauuuuucaucug

SEQ ID NO: 4002129 - RNA, 19 nt, Human herpesvirus 8 [Kaposi`s sarcoma-associated h
cugcucuaaauagaacagg

SEQ ID NO: 4002130 - RNA, 23 nt, Human herpesvirus 8 [Kaposi`s sarcoma-associated h
cuggacaaugggaucgaacagaa

SEQ ID NO: 4002131 - RNA, 19 nt, Human herpesvirus 8 [Kaposi`s sarcoma-associated h
cuggauggguuaacagugg

SEQ ID NO: 4002132 - RNA, 12 nt, Human herpesvirus 8 [Kaposi`s sarcoma-associated h
cuggcagggugg

SEQ ID NO: 4002133 - RNA, 19 nt, Human herpesvirus 8 [Kaposi`s sarcoma-associated h
cuggcagggugggaggaag

SEQ ID NO: 4002134 - RNA, 18 nt, Human herpesvirus 8 [Kaposi`s sarcoma-associated h
cuggccugugcccaaauc

SEQ ID NO: 4002135 - RNA, 12 nt, Human herpesvirus 8 [Kaposi`s sarcoma-associated h
cuggcuggcgcu

SEQ ID NO: 4002136 - RNA, 19 nt, Human herpesvirus 8 [Kaposi`s sarcoma-associated h
cugggcgaagaagcgcacc

SEQ ID NO: 4002137 - RNA, 15 nt, Human herpesvirus 8 [Kaposi`s sarcoma-associated h
cuggugggacacacg

SEQ ID NO: 4002138 - RNA, 17 nt, Human herpesvirus 8 [Kaposi`s sarcoma-associated h
cugucagauuucucuau

SEQ ID NO: 4002139 - RNA, 16 nt, Human herpesvirus 8 [Kaposi`s sarcoma-associated h
cugucuacagucacua

SEQ ID NO: 4002140 - RNA, 15 nt, Human herpesvirus 8 [Kaposi`s sarcoma-associated h
cuguucucgccugga

SEQ ID NO: 4002141 - RNA, 15 nt, Human herpesvirus 8 [Kaposi`s sarcoma-associated h
cuguugaaugugauc

SEQ ID NO: 4002142 - RNA, 15 nt, Human herpesvirus 8 [Kaposi`s sarcoma-associated h
cuguuuccagugacc

SEQ ID NO: 4002143 - RNA, 17 nt, Human herpesvirus 8 [Kaposi`s sarcoma-associated h
cuuaguuacgcagaccc

SEQ ID NO: 4002144 - RNA, 19 nt, Human herpesvirus 8 [Kaposi`s sarcoma-associated h
cuucaucguggugcccugc

SEQ ID NO: 4002145 - RNA, 12 nt, Human herpesvirus 8 [Kaposi`s sarcoma-associated h
cuucuguuugaa

SEQ ID NO: 4002146 - RNA, 17 nt, Human herpesvirus 8 [Kaposi`s sarcoma-associated h
cuugauaaucuccugga

SEQ ID NO: 4002147 - RNA, 23 nt, Human herpesvirus 8 [Kaposi`s sarcoma-associated h
cuugcgucuucaccuucuggcuu

SEQ ID NO: 4002148 - RNA, 21 nt, Human herpesvirus 8 [Kaposi`s sarcoma-associated h
cuuggcgcuuagccugccucu

SEQ ID NO: 4002149 - RNA, 20 nt, Human herpesvirus 8 [Kaposi`s sarcoma-associated h
cuuggugugcugauguugua

SEQ ID NO: 4002150 - RNA, 23 nt, Human herpesvirus 8 [Kaposi`s sarcoma-associated h
cuuuacagaucuagcggcgacua

SEQ ID NO: 4002151 - RNA, 23 nt, Human herpesvirus 8 [Kaposi`s sarcoma-associated h
gaaaauggcacacgguuacuagc

SEQ ID NO: 4002152 - RNA, 18 nt, Human herpesvirus 8 [Kaposi`s sarcoma-associated h
gaaacaaagcacuggcug

SEQ ID NO: 4002153 - RNA, 20 nt, Human herpesvirus 8 [Kaposi`s sarcoma-associated h
gaaacuggguguaagcugua

SEQ ID NO: 4002154 - RNA, 23 nt, Human herpesvirus 8 [Kaposi`s sarcoma-associated h
gaacggacaauucugagaaagau

SEQ ID NO: 4002155 - RNA, 20 nt, Human herpesvirus 8 [Kaposi`s sarcoma-associated h
gaacugucgagacaugucac

SEQ ID NO: 4002156 - RNA, 16 nt, Human herpesvirus 8 [Kaposi`s sarcoma-associated h
gaagcaguuucaggac

SEQ ID NO: 4002157 - RNA, 17 nt, Human herpesvirus 8 [Kaposi`s sarcoma-associated h
gaagucucuuggacaag

SEQ ID NO: 4002158 - RNA, 21 nt, Human herpesvirus 8 [Kaposi`s sarcoma-associated h
gaaguucauauucccaccucc

SEQ ID NO: 4002159 - RNA, 22 nt, Human herpesvirus 8 [Kaposi`s sarcoma-associated h
gaauaaaauacguacagaaaac

SEQ ID NO: 4002160 - RNA, 22 nt, Human herpesvirus 8 [Kaposi`s sarcoma-associated h
guuuugcacuauaaauaucauu

SEQ ID NO: 4002161 - RNA, 13 nt, Human herpesvirus 8 [Kaposi`s sarcoma-associated h
guuuugcccugcc

SEQ ID NO: 4002162 - RNA, 19 nt, Human herpesvirus 8 [Kaposi`s sarcoma-associated h
uaaaacggccaaagcaaag

SEQ ID NO: 4002163 - RNA, 16 nt, Human herpesvirus 8 [Kaposi`s sarcoma-associated h
uaaacccacagcccau

SEQ ID NO: 4002164 - RNA, 18 nt, Human herpesvirus 8 [Kaposi`s sarcoma-associated h
uaacaugcaacccucuac

SEQ ID NO: 4002165 - RNA, 17 nt, Human herpesvirus 8 [Kaposi`s sarcoma-associated h
uaacccgcccucgggac

SEQ ID NO: 4002166 - RNA, 20 nt, Human herpesvirus 8 [Kaposi`s sarcoma-associated h
uaacgagguuacugccagac

SEQ ID NO: 4002167 - RNA, 18 nt, Human herpesvirus 8 [Kaposi`s sarcoma-associated h
uaacuguuuacugcuguu

SEQ ID NO: 4002168 - RNA, 17 nt, Human herpesvirus 8 [Kaposi`s sarcoma-associated h
uaacuuuauuacaggua

SEQ ID NO: 4002169 - RNA, 19 nt, Human herpesvirus 8 [Kaposi`s sarcoma-associated h
uaagacaaacaugugggcu

SEQ ID NO: 4002170 - RNA, 18 nt, Human herpesvirus 8 [Kaposi`s sarcoma-associated h
uaauguguuuuauguuua

SEQ ID NO: 4002171 - RNA, 21 nt, Human herpesvirus 8 [Kaposi`s sarcoma-associated h
uacaaauguuuuaugcaaaau

SEQ ID NO: 4002172 - RNA, 21 nt, Human herpesvirus 8 [Kaposi`s sarcoma-associated h
uacaauaaagccgagccacaa

SEQ ID NO: 4002173 - RNA, 14 nt, Human herpesvirus 8 [Kaposi`s sarcoma-associated h
uacaugugucuauc

SEQ ID NO: 4002174 - RNA, 13 nt, Human herpesvirus 8 [Kaposi`s sarcoma-associated h
uacgcguguggga

SEQ ID NO: 4002175 - RNA, 14 nt, Human herpesvirus 8 [Kaposi`s sarcoma-associated h
uacgucccucuugg

SEQ ID NO: 4002176 - RNA, 12 nt, Human herpesvirus 8 [Kaposi`s sarcoma-associated h
uacuagcaccac

SEQ ID NO: 4002177 - RNA, 14 nt, Human herpesvirus 8 [Kaposi`s sarcoma-associated h
uacucaaaugggaa

SEQ ID NO: 4002178 - RNA, 13 nt, Human herpesvirus 8 [Kaposi`s sarcoma-associated h
uacugcuguuacc

SEQ ID NO: 4002179 - RNA, 21 nt, Human herpesvirus 8 [Kaposi`s sarcoma-associated h
uagaucuggauacacuacuua

SEQ ID NO: 4002180 - RNA, 17 nt, Human herpesvirus 8 [Kaposi`s sarcoma-associated h
uagcuaugcccaccguc

SEQ ID NO: 4002181 - RNA, 19 nt, Human herpesvirus 8 [Kaposi`s sarcoma-associated h
uaggccaauacugcccaag

SEQ ID NO: 4002182 - RNA, 16 nt, Human herpesvirus 8 [Kaposi`s sarcoma-associated h
uaggcccaugugggcu

SEQ ID NO: 4002183 - RNA, 13 nt, Human herpesvirus 8 [Kaposi`s sarcoma-associated h
uaguagucagagu

SEQ ID NO: 4002184 - RNA, 18 nt, Human herpesvirus 8 [Kaposi`s sarcoma-associated h
uagucagagucugaaccc

SEQ ID NO: 4002185 - RNA, 23 nt, Human herpesvirus 8 [Kaposi`s sarcoma-associated h
uagugggguggcgcgccacaguc

SEQ ID NO: 4002186 - RNA, 14 nt, Human herpesvirus 8 [Kaposi`s sarcoma-associated h
uaugaaaauacagg

SEQ ID NO: 4002187 - RNA, 19 nt, Human herpesvirus 8 [Kaposi`s sarcoma-associated h
uaugucauuuuuacuuuua

SEQ ID NO: 4002188 - RNA, 21 nt, Human herpesvirus 8 [Kaposi`s sarcoma-associated h
uauuuugaugguguuggacac

SEQ ID NO: 4002189 - RNA, 21 nt, Human herpesvirus 8 [Kaposi`s sarcoma-associated h
ucaaccgucuccgccagggac

SEQ ID NO: 4002190 - RNA, 16 nt, Human herpesvirus 8 [Kaposi`s sarcoma-associated h
ucacccgagccacauc

SEQ ID NO: 4002191 - RNA, 20 nt, Human herpesvirus 8 [Kaposi`s sarcoma-associated h
ucaccggaggaaugguggac

SEQ ID NO: 4002192 - RNA, 14 nt, Human herpesvirus 8 [Kaposi`s sarcoma-associated h
ucaccggggagcuu

SEQ ID NO: 4002193 - RNA, 17 nt, Human herpesvirus 8 [Kaposi`s sarcoma-associated h
ucacgcacuuggcccug

SEQ ID NO: 4002194 - RNA, 16 nt, Human herpesvirus 8 [Kaposi`s sarcoma-associated h
ucacuaguauuguguu

SEQ ID NO: 4002195 - RNA, 14 nt, Human herpesvirus 8 [Kaposi`s sarcoma-associated h
ucacuccauucccg

SEQ ID NO: 4002196 - RNA, 22 nt, Human herpesvirus 8 [Kaposi`s sarcoma-associated h
uccaccgccgcgcaugguguau

SEQ ID NO: 4002197 - RNA, 17 nt, Human herpesvirus 8 [Kaposi`s sarcoma-associated h
uccaccucuuucaucac

SEQ ID NO: 4002198 - RNA, 13 nt, Human herpesvirus 8 [Kaposi`s sarcoma-associated h
uccaugcaggcag

SEQ ID NO: 4002199 - RNA, 21 nt, Human herpesvirus 8 [Kaposi`s sarcoma-associated h
uccgcggaaguaugucguggg

SEQ ID NO: 4002200 - RNA, 22 nt, Human herpesvirus 8 [Kaposi`s sarcoma-associated h
uccuccgggcucacuaguauug

SEQ ID NO: 4002201 - RNA, 19 nt, Human herpesvirus 8 [Kaposi`s sarcoma-associated h
uccuccuaaacguguucau

SEQ ID NO: 4002202 - RNA, 20 nt, Human herpesvirus 8 [Kaposi`s sarcoma-associated h
uccucuaguuuucgggugau

SEQ ID NO: 4002203 - RNA, 22 nt, Human herpesvirus 8 [Kaposi`s sarcoma-associated h
uccucuaucagcugcagccagg

SEQ ID NO: 4002204 - RNA, 19 nt, Human herpesvirus 8 [Kaposi`s sarcoma-associated h
uccuggaugguuccccaga

SEQ ID NO: 4002205 - RNA, 18 nt, Human herpesvirus 8 [Kaposi`s sarcoma-associated h
uccugugauuucucugug

SEQ ID NO: 4002206 - RNA, 13 nt, Human herpesvirus 8 [Kaposi`s sarcoma-associated h
uccugugggcuaa

SEQ ID NO: 4002207 - RNA, 17 nt, Human herpesvirus 8 [Kaposi`s sarcoma-associated h
ucggaaggcacaacucu

SEQ ID NO: 4002208 - RNA, 24 nt, Human herpesvirus 8 [Kaposi`s sarcoma-associated h
ucggauuuugauaugugugcccaa

SEQ ID NO: 4002209 - RNA, 15 nt, Human herpesvirus 8 [Kaposi`s sarcoma-associated h
ucgguucaaccugga

SEQ ID NO: 4002210 - RNA, 23 nt, Human herpesvirus 8 [Kaposi`s sarcoma-associated h
ucguaggccaauacugcccaagu

SEQ ID NO: 4002211 - RNA, 20 nt, Human herpesvirus 8 [Kaposi`s sarcoma-associated h
ucguguucaucgcugcccca

SEQ ID NO: 4002212 - RNA, 20 nt, Human herpesvirus 8 [Kaposi`s sarcoma-associated h
ucuauccaagugcacacucg

SEQ ID NO: 4002213 - RNA, 12 nt, Human herpesvirus 8 [Kaposi`s sarcoma-associated h
ucuccugcucau

SEQ ID NO: 4002214 - RNA, 14 nt, Human herpesvirus 8 [Kaposi`s sarcoma-associated h
ucucgccuggagca

SEQ ID NO: 4002215 - RNA, 19 nt, Human herpesvirus 8 [Kaposi`s sarcoma-associated h
ucugaaacuaccagccauc

SEQ ID NO: 4002216 - RNA, 11 nt, Human herpesvirus 8 [Kaposi`s sarcoma-associated h
ucugguggugg

SEQ ID NO: 4002217 - RNA, 19 nt, Human herpesvirus 8 [Kaposi`s sarcoma-associated h
ucuuacuaagagaacagca

SEQ ID NO: 4002218 - RNA, 22 nt, Human herpesvirus 8 [Kaposi`s sarcoma-associated h
ucuugcgccauuuuuguggcug

SEQ ID NO: 4002219 - RNA, 14 nt, Human herpesvirus 8 [Kaposi`s sarcoma-associated h
ugaaagcaauaaag

SEQ ID NO: 4002220 - RNA, 16 nt, Human herpesvirus 8 [Kaposi`s sarcoma-associated h
ugaaccccguguggga

SEQ ID NO: 4002221 - RNA, 21 nt, Human herpesvirus 8 [Kaposi`s sarcoma-associated h
ugacgcgugucccuuauuuca

SEQ ID NO: 4002222 - RNA, 23 nt, Human herpesvirus 8 [Kaposi`s sarcoma-associated h
ugacgggguaucgccgccagagg

SEQ ID NO: 4002223 - RNA, 22 nt, Human herpesvirus 8 [Kaposi`s sarcoma-associated h
ugacuaggaggaagagcacugu

SEQ ID NO: 4002224 - RNA, 11 nt, Human herpesvirus 8 [Kaposi`s sarcoma-associated h
ugagccagaau

SEQ ID NO: 4002225 - RNA, 12 nt, Human herpesvirus 8 [Kaposi`s sarcoma-associated h
ugagggugagug

SEQ ID NO: 4002226 - RNA, 17 nt, Human herpesvirus 8 [Kaposi`s sarcoma-associated h
ugaguuccacacagauu

SEQ ID NO: 4002227 - RNA, 18 nt, Human herpesvirus 8 [Kaposi`s sarcoma-associated h
ugcaaccugcugcagcug

SEQ ID NO: 4002228 - RNA, 12 nt, Human herpesvirus 8 [Kaposi`s sarcoma-associated h
ugcagccaggaa

SEQ ID NO: 4002229 - RNA, 16 nt, Human herpesvirus 8 [Kaposi`s sarcoma-associated h
ugcaugcucggcaaca

SEQ ID NO: 4002230 - RNA, 22 nt, Human herpesvirus 8 [Kaposi`s sarcoma-associated h
ugccagugggguugggguccag

SEQ ID NO: 4002231 - RNA, 18 nt, Human herpesvirus 8 [Kaposi`s sarcoma-associated h
ugcccuccugggccaggc

SEQ ID NO: 4002232 - RNA, 21 nt, Human herpesvirus 8 [Kaposi`s sarcoma-associated h
ugccgucgucgagcacuccug

SEQ ID NO: 4002233 - RNA, 20 nt, Human herpesvirus 8 [Kaposi`s sarcoma-associated h
ugcgauagggggaugagcca

SEQ ID NO: 4002234 - RNA, 22 nt, Human herpesvirus 8 [Kaposi`s sarcoma-associated h
ugcggguugggucgcugcaccu

SEQ ID NO: 4002235 - RNA, 15 nt, Human herpesvirus 8 [Kaposi`s sarcoma-associated h
ugcgugaacccucac

SEQ ID NO: 4002236 - RNA, 19 nt, Human herpesvirus 8 [Kaposi`s sarcoma-associated h
ugcuaggauucgugcagcc

SEQ ID NO: 4002237 - RNA, 15 nt, Human herpesvirus 8 [Kaposi`s sarcoma-associated h
ugcugaccacggcac

SEQ ID NO: 4002238 - RNA, 18 nt, Human herpesvirus 8 [Kaposi`s sarcoma-associated h
ugcuuccaauugaaggag

SEQ ID NO: 4002239 - RNA, 19 nt, Human herpesvirus 8 [Kaposi`s sarcoma-associated h
acgccaggagcuagcuucc

SEQ ID NO: 4002240 - RNA, 17 nt, Human herpesvirus 8 [Kaposi`s sarcoma-associated h
acgccgauagggcggcc

SEQ ID NO: 4002241 - RNA, 17 nt, Human herpesvirus 8 [Kaposi`s sarcoma-associated h
acgccggcaucguggaa

SEQ ID NO: 4002242 - RNA, 16 nt, Human herpesvirus 8 [Kaposi`s sarcoma-associated h
acgcggauaggcuggg

SEQ ID NO: 4002243 - RNA, 15 nt, Human herpesvirus 8 [Kaposi`s sarcoma-associated h
acgcguuaagaagcc

SEQ ID NO: 4002244 - RNA, 23 nt, Human herpesvirus 8 [Kaposi`s sarcoma-associated h
acgcucaccauccccugguggcu

SEQ ID NO: 4002245 - RNA, 23 nt, Human herpesvirus 8 [Kaposi`s sarcoma-associated h
acgcugucccgugcccaggccgc

SEQ ID NO: 4002246 - RNA, 14 nt, Human herpesvirus 8 [Kaposi`s sarcoma-associated h
acggaucaggcggg

SEQ ID NO: 4002247 - RNA, 21 nt, Human herpesvirus 8 [Kaposi`s sarcoma-associated h
acguggcugaugcucuggcca

SEQ ID NO: 4002248 - RNA, 13 nt, Human herpesvirus 8 [Kaposi`s sarcoma-associated h
acguggugcugcc

SEQ ID NO: 4002249 - RNA, 15 nt, Human herpesvirus 8 [Kaposi`s sarcoma-associated h
acguuagcuucagcu

SEQ ID NO: 4002250 - RNA, 19 nt, Human herpesvirus 8 [Kaposi`s sarcoma-associated h
acguuagcuucagcuucag

SEQ ID NO: 4002251 - RNA, 14 nt, Human herpesvirus 8 [Kaposi`s sarcoma-associated h
acuaaaaaggccac

SEQ ID NO: 4002252 - RNA, 13 nt, Human herpesvirus 8 [Kaposi`s sarcoma-associated h
acuaccagccauc

SEQ ID NO: 4002253 - RNA, 19 nt, Human herpesvirus 8 [Kaposi`s sarcoma-associated h
acuagaauuggagcacuuu

SEQ ID NO: 4002254 - RNA, 18 nt, Human herpesvirus 8 [Kaposi`s sarcoma-associated h
acuaguagucagagucug

SEQ ID NO: 4002255 - RNA, 17 nt, Human herpesvirus 8 [Kaposi`s sarcoma-associated h
acucagcugccaaggca

SEQ ID NO: 4002256 - RNA, 13 nt, Human herpesvirus 8 [Kaposi`s sarcoma-associated h
acucccucaagca

SEQ ID NO: 4002257 - RNA, 17 nt, Human herpesvirus 8 [Kaposi`s sarcoma-associated h
acucguucacacucuuu

SEQ ID NO: 4002258 - RNA, 15 nt, Human herpesvirus 8 [Kaposi`s sarcoma-associated h
acucuucgcugauga

SEQ ID NO: 4002259 - RNA, 21 nt, Human herpesvirus 8 [Kaposi`s sarcoma-associated h
acugcuaggauucgugcagcc

SEQ ID NO: 4002260 - RNA, 18 nt, Human herpesvirus 8 [Kaposi`s sarcoma-associated h
acugcuuguucaggagcu

SEQ ID NO: 4002261 - RNA, 17 nt, Human herpesvirus 8 [Kaposi`s sarcoma-associated h
acugugaaguuuacauu

SEQ ID NO: 4002262 - RNA, 15 nt, Human herpesvirus 8 [Kaposi`s sarcoma-associated h
acuguucuccacgua

SEQ ID NO: 4002263 - RNA, 20 nt, Human herpesvirus 8 [Kaposi`s sarcoma-associated h
acuuaacgugucugaaugug

SEQ ID NO: 4002264 - RNA, 18 nt, Human herpesvirus 8 [Kaposi`s sarcoma-associated h
acuucaccuccagacucu

SEQ ID NO: 4002265 - RNA, 13 nt, Human herpesvirus 8 [Kaposi`s sarcoma-associated h
acuuuauuacagg

SEQ ID NO: 4002266 - RNA, 13 nt, Human herpesvirus 8 [Kaposi`s sarcoma-associated h
agaaaacugucuc

SEQ ID NO: 4002267 - RNA, 12 nt, Human herpesvirus 8 [Kaposi`s sarcoma-associated h
agaacaugcugg

SEQ ID NO: 4002268 - RNA, 22 nt, Human herpesvirus 8 [Kaposi`s sarcoma-associated h
agaaggguggguggggaugggu

SEQ ID NO: 4002269 - RNA, 14 nt, Human herpesvirus 8 [Kaposi`s sarcoma-associated h
agaauggcgugcca

SEQ ID NO: 4002270 - RNA, 13 nt, Human herpesvirus 8 [Kaposi`s sarcoma-associated h
agacaaacacugu

SEQ ID NO: 4002271 - RNA, 18 nt, Human herpesvirus 8 [Kaposi`s sarcoma-associated h
agacuaaaaaggccaccg

SEQ ID NO: 4002272 - RNA, 13 nt, Human herpesvirus 8 [Kaposi`s sarcoma-associated h
agacuuucuaaag

SEQ ID NO: 4002273 - RNA, 12 nt, Human herpesvirus 8 [Kaposi`s sarcoma-associated h
agagccagccug

SEQ ID NO: 4002274 - RNA, 13 nt, Human herpesvirus 8 [Kaposi`s sarcoma-associated h
agagguuggucug

SEQ ID NO: 4002275 - RNA, 20 nt, Human herpesvirus 8 [Kaposi`s sarcoma-associated h
agauaacggugucuaacugc

SEQ ID NO: 4002276 - RNA, 22 nt, Human herpesvirus 8 [Kaposi`s sarcoma-associated h
agauaaucuaaauauucucuau

SEQ ID NO: 4002277 - RNA, 14 nt, Human herpesvirus 8 [Kaposi`s sarcoma-associated h
agauaggagaaauc

SEQ ID NO: 4002278 - RNA, 20 nt, Human herpesvirus 8 [Kaposi`s sarcoma-associated h
agaugaauaugauccuguag

SEQ ID NO: 4002279 - RNA, 14 nt, Human herpesvirus 8 [Kaposi`s sarcoma-associated h
agaugagcaugacu

SEQ ID NO: 4002280 - RNA, 23 nt, Human herpesvirus 8 [Kaposi`s sarcoma-associated h
agcacacugugugguugguggug

SEQ ID NO: 4002281 - RNA, 16 nt, Human herpesvirus 8 [Kaposi`s sarcoma-associated h
agcauaugcugccaag

SEQ ID NO: 4002282 - RNA, 17 nt, Human herpesvirus 8 [Kaposi`s sarcoma-associated h
agcauugucuuaaguac

SEQ ID NO: 4002283 - RNA, 15 nt, Human herpesvirus 8 [Kaposi`s sarcoma-associated h
agccacaaaguacau

SEQ ID NO: 4002284 - RNA, 22 nt, Human herpesvirus 8 [Kaposi`s sarcoma-associated h
agccuaacccacgucacaucac

SEQ ID NO: 4002285 - RNA, 22 nt, Human herpesvirus 8 [Kaposi`s sarcoma-associated h
agccugcaguguggggauuaug

SEQ ID NO: 4002286 - RNA, 20 nt, Human herpesvirus 8 [Kaposi`s sarcoma-associated h
agcgcgcucugucgcucuuc

SEQ ID NO: 4002287 - RNA, 20 nt, Human herpesvirus 8 [Kaposi`s sarcoma-associated h
agcgugucgcccgucacugg

SEQ ID NO: 4002288 - RNA, 22 nt, Human herpesvirus 8 [Kaposi`s sarcoma-associated h
agcguucguguucaucgcugcc

SEQ ID NO: 4002289 - RNA, 15 nt, Human herpesvirus 8 [Kaposi`s sarcoma-associated h
agcuauaggacagaa

SEQ ID NO: 4002290 - RNA, 21 nt, Human herpesvirus 8 [Kaposi`s sarcoma-associated h
agcuccuauugcaacugacca

SEQ ID NO: 4002291 - RNA, 19 nt, Human herpesvirus 8 [Kaposi`s sarcoma-associated h
agcuuaccgcuacuguggg

SEQ ID NO: 4002292 - RNA, 15 nt, Human herpesvirus 8 [Kaposi`s sarcoma-associated h
aggaccuuucugcug

SEQ ID NO: 4002293 - RNA, 16 nt, Human herpesvirus 8 [Kaposi`s sarcoma-associated h
aggacucacugggggu

SEQ ID NO: 4002294 - RNA, 22 nt, Human herpesvirus 8 [Kaposi`s sarcoma-associated h
aggagaaaucccauuugauaua

SEQ ID NO: 4002295 - RNA, 13 nt, Human herpesvirus 8 [Kaposi`s sarcoma-associated h
aggaggagggcag

SEQ ID NO: 4002296 - RNA, 20 nt, Human herpesvirus 8 [Kaposi`s sarcoma-associated h
aggaguggacuuucuccgug

SEQ ID NO: 4002297 - RNA, 16 nt, Human herpesvirus 8 [Kaposi`s sarcoma-associated h
aggauguguguaacuu

SEQ ID NO: 4002298 - RNA, 12 nt, Human herpesvirus 8 [Kaposi`s sarcoma-associated h
aggauuucucgc

SEQ ID NO: 4002299 - RNA, 18 nt, Human herpesvirus 8 [Kaposi`s sarcoma-associated h
aggccaccauuccucucc

SEQ ID NO: 4002300 - RNA, 12 nt, Human herpesvirus 8 [Kaposi`s sarcoma-associated h
aggccugugccc

SEQ ID NO: 4002301 - RNA, 14 nt, Human herpesvirus 8 [Kaposi`s sarcoma-associated h
aggcgccugcgucu

SEQ ID NO: 4002302 - RNA, 18 nt, Human herpesvirus 8 [Kaposi`s sarcoma-associated h
aggcggggaggagggggu

SEQ ID NO: 4002303 - RNA, 13 nt, Human herpesvirus 8 [Kaposi`s sarcoma-associated h
agggaauggccuc

SEQ ID NO: 4002304 - RNA, 16 nt, Human herpesvirus 8 [Kaposi`s sarcoma-associated h
agggcuaugauugcuu

SEQ ID NO: 4002305 - RNA, 16 nt, Human herpesvirus 8 [Kaposi`s sarcoma-associated h
agggucgggugggacg

SEQ ID NO: 4002306 - RNA, 17 nt, Human herpesvirus 8 [Kaposi`s sarcoma-associated h
agggugcggugcugccc

SEQ ID NO: 4002307 - RNA, 16 nt, Human herpesvirus 8 [Kaposi`s sarcoma-associated h
agguccccggaagagu

SEQ ID NO: 4002308 - RNA, 16 nt, Human herpesvirus 8 [Kaposi`s sarcoma-associated h
aggucuccgagcacug

SEQ ID NO: 4002309 - RNA, 17 nt, Human herpesvirus 8 [Kaposi`s sarcoma-associated h
agguugaaagccggggu

SEQ ID NO: 4002310 - RNA, 23 nt, Human herpesvirus 8 [Kaposi`s sarcoma-associated h
aguaagacaaacaugugggcuuc

SEQ ID NO: 4002311 - RNA, 16 nt, Human herpesvirus 8 [Kaposi`s sarcoma-associated h
aguauuaugccaggga

SEQ ID NO: 4002312 - RNA, 20 nt, Human herpesvirus 8 [Kaposi`s sarcoma-associated h
agucugaaccccguguggga

SEQ ID NO: 4002313 - RNA, 13 nt, Human herpesvirus 8 [Kaposi`s sarcoma-associated h
agucuucuuguca

SEQ ID NO: 4002314 - RNA, 16 nt, Human herpesvirus 8 [Kaposi`s sarcoma-associated h
agugcucuuccuccua

SEQ ID NO: 4002315 - RNA, 12 nt, Human herpesvirus 8 [Kaposi`s sarcoma-associated h
auaaaacaggaa

SEQ ID NO: 4002316 - RNA, 17 nt, Human herpesvirus 8 [Kaposi`s sarcoma-associated h
auaaagcgcgaacaaga

SEQ ID NO: 4002317 - RNA, 14 nt, Human herpesvirus 8 [Kaposi`s sarcoma-associated h
auaacauuuuguaa

SEQ ID NO: 4002318 - RNA, 19 nt, Human herpesvirus 8 [Kaposi`s sarcoma-associated h
caagcuugagcuuuucaaa

SEQ ID NO: 4002319 - RNA, 20 nt, Human herpesvirus 8 [Kaposi`s sarcoma-associated h
caagcuugagcuuuucaaag

SEQ ID NO: 4002320 - RNA, 10 nt, Human herpesvirus 8 [Kaposi`s sarcoma-associated h
caaggcccug

SEQ ID NO: 4002321 - RNA, 13 nt, Human herpesvirus 8 [Kaposi`s sarcoma-associated h
caaggcgggccag

SEQ ID NO: 4002322 - RNA, 15 nt, Human herpesvirus 8 [Kaposi`s sarcoma-associated h
caauaaacccacagc

SEQ ID NO: 4002323 - RNA, 20 nt, Human herpesvirus 8 [Kaposi`s sarcoma-associated h
caauacuuaagucccugaag

SEQ ID NO: 4002324 - RNA, 15 nt, Human herpesvirus 8 [Kaposi`s sarcoma-associated h
caauagcgcugucau

SEQ ID NO: 4002325 - RNA, 14 nt, Human herpesvirus 8 [Kaposi`s sarcoma-associated h
cacaaaacugccaa

SEQ ID NO: 4002326 - RNA, 22 nt, Human herpesvirus 8 [Kaposi`s sarcoma-associated h
cacagagucuacgugccagugg

SEQ ID NO: 4002327 - RNA, 16 nt, Human herpesvirus 8 [Kaposi`s sarcoma-associated h
cacagucgagccgcca

SEQ ID NO: 4002328 - RNA, 22 nt, Human herpesvirus 8 [Kaposi`s sarcoma-associated h
cacauuuccacccaccuacuuc

SEQ ID NO: 4002329 - RNA, 16 nt, Human herpesvirus 8 [Kaposi`s sarcoma-associated h
caccgaaccaggcaac

SEQ ID NO: 4002330 - RNA, 20 nt, Human herpesvirus 8 [Kaposi`s sarcoma-associated h
cacgacauuucgccaauuau

SEQ ID NO: 4002331 - RNA, 18 nt, Human herpesvirus 8 [Kaposi`s sarcoma-associated h
cacgcccgggggccagga

SEQ ID NO: 4002332 - RNA, 17 nt, Human herpesvirus 8 [Kaposi`s sarcoma-associated h
cacggaaggcaguggag

SEQ ID NO: 4002333 - RNA, 17 nt, Human herpesvirus 8 [Kaposi`s sarcoma-associated h
cacggugcacugaagcg

SEQ ID NO: 4002334 - RNA, 20 nt, Human herpesvirus 8 [Kaposi`s sarcoma-associated h
cacgguggcccugccuagug

SEQ ID NO: 4002335 - RNA, 15 nt, Human herpesvirus 8 [Kaposi`s sarcoma-associated h
cagaagagcauuuuu

SEQ ID NO: 4002336 - RNA, 17 nt, Human herpesvirus 8 [Kaposi`s sarcoma-associated h
cagaguccgccaucacc

SEQ ID NO: 4002337 - RNA, 16 nt, Human herpesvirus 8 [Kaposi`s sarcoma-associated h
cagaugaucccgccuu

SEQ ID NO: 4002338 - RNA, 14 nt, Human herpesvirus 8 [Kaposi`s sarcoma-associated h
caggccaagaucca

SEQ ID NO: 4002339 - RNA, 18 nt, Human herpesvirus 8 [Kaposi`s sarcoma-associated h
caggccaagauccaaccc

SEQ ID NO: 4002340 - RNA, 22 nt, Human herpesvirus 8 [Kaposi`s sarcoma-associated h
caggccaagauccaacccagca

SEQ ID NO: 4002341 - RNA, 19 nt, Human herpesvirus 8 [Kaposi`s sarcoma-associated h
caggcccucuucuguugcc

SEQ ID NO: 4002342 - RNA, 14 nt, Human herpesvirus 8 [Kaposi`s sarcoma-associated h
caguaaugcugccc

SEQ ID NO: 4002343 - RNA, 17 nt, Human herpesvirus 8 [Kaposi`s sarcoma-associated h
caguauuaugccaggga

SEQ ID NO: 4002344 - RNA, 19 nt, Human herpesvirus 8 [Kaposi`s sarcoma-associated h
cagucuaucgucuccagau

SEQ ID NO: 4002345 - RNA, 16 nt, Human herpesvirus 8 [Kaposi`s sarcoma-associated h
cagugaguccuggccc

SEQ ID NO: 4002346 - RNA, 17 nt, Human herpesvirus 8 [Kaposi`s sarcoma-associated h
cagugaguccuggcccc

SEQ ID NO: 4002347 - RNA, 17 nt, Human herpesvirus 8 [Kaposi`s sarcoma-associated h
cauauggcgcaggaguc

SEQ ID NO: 4002348 - RNA, 11 nt, Human herpesvirus 8 [Kaposi`s sarcoma-associated h
caucagagaug

SEQ ID NO: 4002349 - RNA, 11 nt, Human herpesvirus 8 [Kaposi`s sarcoma-associated h
caucagcggca

SEQ ID NO: 4002350 - RNA, 16 nt, Human herpesvirus 8 [Kaposi`s sarcoma-associated h
caucgcucaaacucau

SEQ ID NO: 4002351 - RNA, 14 nt, Human herpesvirus 8 [Kaposi`s sarcoma-associated h
caugaugcagagag

SEQ ID NO: 4002352 - RNA, 14 nt, Human herpesvirus 8 [Kaposi`s sarcoma-associated h
caugccgucagggc

SEQ ID NO: 4002353 - RNA, 19 nt, Human herpesvirus 8 [Kaposi`s sarcoma-associated h
caugcucucaccgcacccc

SEQ ID NO: 4002354 - RNA, 16 nt, Human herpesvirus 8 [Kaposi`s sarcoma-associated h
cauggcaaaaaacacu

SEQ ID NO: 4002355 - RNA, 19 nt, Human herpesvirus 8 [Kaposi`s sarcoma-associated h
cauggcuuacaacuauuuc

SEQ ID NO: 4002356 - RNA, 21 nt, Human herpesvirus 8 [Kaposi`s sarcoma-associated h
caugggaccguguguggcugu

SEQ ID NO: 4002357 - RNA, 20 nt, Human herpesvirus 8 [Kaposi`s sarcoma-associated h
caugucuguccggacauuuu

SEQ ID NO: 4002358 - RNA, 14 nt, Human herpesvirus 8 [Kaposi`s sarcoma-associated h
cauuaaaaggacau

SEQ ID NO: 4002359 - RNA, 19 nt, Human herpesvirus 8 [Kaposi`s sarcoma-associated h
ccaagaucuuccagucucc

SEQ ID NO: 4002360 - RNA, 17 nt, Human herpesvirus 8 [Kaposi`s sarcoma-associated h
ccaaucacgggaggcuu

SEQ ID NO: 4002361 - RNA, 13 nt, Human herpesvirus 8 [Kaposi`s sarcoma-associated h
ccacagcaucccc

SEQ ID NO: 4002362 - RNA, 20 nt, Human herpesvirus 8 [Kaposi`s sarcoma-associated h
ccacaggacaagcugaugug

SEQ ID NO: 4002363 - RNA, 18 nt, Human herpesvirus 8 [Kaposi`s sarcoma-associated h
ccacauaauuggaugggg

SEQ ID NO: 4002364 - RNA, 19 nt, Human herpesvirus 8 [Kaposi`s sarcoma-associated h
ccacauuucccccaucguc

SEQ ID NO: 4002365 - RNA, 12 nt, Human herpesvirus 8 [Kaposi`s sarcoma-associated h
ccacgcuaugug

SEQ ID NO: 4002366 - RNA, 16 nt, Human herpesvirus 8 [Kaposi`s sarcoma-associated h
ccacggugcacugaag

SEQ ID NO: 4002367 - RNA, 13 nt, Human herpesvirus 8 [Kaposi`s sarcoma-associated h
ccacgguggcccu

SEQ ID NO: 4002368 - RNA, 17 nt, Human herpesvirus 8 [Kaposi`s sarcoma-associated h
ccacguggugcugccua

SEQ ID NO: 4002369 - RNA, 15 nt, Human herpesvirus 8 [Kaposi`s sarcoma-associated h
ccagaaugaaggaca

SEQ ID NO: 4002370 - RNA, 17 nt, Human herpesvirus 8 [Kaposi`s sarcoma-associated h
ccagauuuaagauuaag

SEQ ID NO: 4002371 - RNA, 13 nt, Human herpesvirus 8 [Kaposi`s sarcoma-associated h
ccagcaaagcaca

SEQ ID NO: 4002372 - RNA, 17 nt, Human herpesvirus 8 [Kaposi`s sarcoma-associated h
ccagccgcgcgaccucc

SEQ ID NO: 4002373 - RNA, 15 nt, Human herpesvirus 8 [Kaposi`s sarcoma-associated h
ccaggaaguucaaug

SEQ ID NO: 4002374 - RNA, 23 nt, Human herpesvirus 8 [Kaposi`s sarcoma-associated h
ccaggccaccauuccucuccgca

SEQ ID NO: 4002375 - RNA, 17 nt, Human herpesvirus 8 [Kaposi`s sarcoma-associated h
ccaguauuaugccaggg

SEQ ID NO: 4002376 - RNA, 18 nt, Human herpesvirus 8 [Kaposi`s sarcoma-associated h
ccagugccucagcaacug

SEQ ID NO: 4002377 - RNA, 15 nt, Human herpesvirus 8 [Kaposi`s sarcoma-associated h
ccagugggguugggg

SEQ ID NO: 4002378 - RNA, 19 nt, Human herpesvirus 8 [Kaposi`s sarcoma-associated h
ccauccccccaccccucau

SEQ ID NO: 4002379 - RNA, 14 nt, Human herpesvirus 8 [Kaposi`s sarcoma-associated h
ccauccgcgagcca

SEQ ID NO: 4002380 - RNA, 17 nt, Human herpesvirus 8 [Kaposi`s sarcoma-associated h
ccaugggugcuggugug

SEQ ID NO: 4002381 - RNA, 12 nt, Human herpesvirus 8 [Kaposi`s sarcoma-associated h
ccaugguaccau

SEQ ID NO: 4002382 - RNA, 22 nt, Human herpesvirus 8 [Kaposi`s sarcoma-associated h
ccauuuuccaaggccugugccc

SEQ ID NO: 4002383 - RNA, 22 nt, Human herpesvirus 8 [Kaposi`s sarcoma-associated h
cccagugaguccuggcccccgg

SEQ ID NO: 4002384 - RNA, 14 nt, Human herpesvirus 8 [Kaposi`s sarcoma-associated h
cccauagccaucca

SEQ ID NO: 4002385 - RNA, 13 nt, Human herpesvirus 8 [Kaposi`s sarcoma-associated h
cccaugugggcuu

SEQ ID NO: 4002386 - RNA, 15 nt, Human herpesvirus 8 [Kaposi`s sarcoma-associated h
cccgauggcccuuca

SEQ ID NO: 4002387 - RNA, 16 nt, Human herpesvirus 8 [Kaposi`s sarcoma-associated h
cccgugauccaggagc

SEQ ID NO: 4002388 - RNA, 17 nt, Human herpesvirus 8 [Kaposi`s sarcoma-associated h
cccgugcguuugcagug

SEQ ID NO: 4002389 - RNA, 18 nt, Human herpesvirus 8 [Kaposi`s sarcoma-associated h
cccguuguggcaccugag

SEQ ID NO: 4002390 - RNA, 13 nt, Human herpesvirus 8 [Kaposi`s sarcoma-associated h
cccuagaagccac

SEQ ID NO: 4002391 - RNA, 22 nt, Human herpesvirus 8 [Kaposi`s sarcoma-associated h
cccugaaaugaucguccacgga

SEQ ID NO: 4002392 - RNA, 21 nt, Human herpesvirus 8 [Kaposi`s sarcoma-associated h
cccuucauaccgggucugugc

SEQ ID NO: 4002393 - RNA, 16 nt, Human herpesvirus 8 [Kaposi`s sarcoma-associated h
ccgaggacacgccauc

SEQ ID NO: 4002394 - RNA, 23 nt, Human herpesvirus 8 [Kaposi`s sarcoma-associated h
ccggguuguuugugggacacggu

SEQ ID NO: 4002395 - RNA, 18 nt, Human herpesvirus 8 [Kaposi`s sarcoma-associated h
ccgucagggcccacggug

SEQ ID NO: 4002396 - RNA, 17 nt, Human herpesvirus 8 [Kaposi`s sarcoma-associated h
ccuaaguggauuuccuu

SEQ ID NO: 4002397 - RNA, 21 nt, Human herpesvirus 8 [Kaposi`s sarcoma-associated h
cuggugaggaagcaucugguc

SEQ ID NO: 4002398 - RNA, 18 nt, Human herpesvirus 8 [Kaposi`s sarcoma-associated h
cugguggaacaugcugcc

SEQ ID NO: 4002399 - RNA, 18 nt, Human herpesvirus 8 [Kaposi`s sarcoma-associated h
cugucaaccuccuccggg

SEQ ID NO: 4002400 - RNA, 16 nt, Human herpesvirus 8 [Kaposi`s sarcoma-associated h
cugugaagucucccug

SEQ ID NO: 4002401 - RNA, 15 nt, Human herpesvirus 8 [Kaposi`s sarcoma-associated h
cugugaaguuuacau

SEQ ID NO: 4002402 - RNA, 16 nt, Human herpesvirus 8 [Kaposi`s sarcoma-associated h
cuguucuaccagguag

SEQ ID NO: 4002403 - RNA, 16 nt, Human herpesvirus 8 [Kaposi`s sarcoma-associated h
cuuacaacuauuuccu

SEQ ID NO: 4002404 - RNA, 19 nt, Human herpesvirus 8 [Kaposi`s sarcoma-associated h
cuucauucucuccacuaga

SEQ ID NO: 4002405 - RNA, 21 nt, Human herpesvirus 8 [Kaposi`s sarcoma-associated h
cuuccucuaaggcccccacca

SEQ ID NO: 4002406 - RNA, 18 nt, Human herpesvirus 8 [Kaposi`s sarcoma-associated h
cuugauaaucuccuggag

SEQ ID NO: 4002407 - RNA, 22 nt, Human herpesvirus 8 [Kaposi`s sarcoma-associated h
cuuuaucaugugaacaauaaac

SEQ ID NO: 4002408 - RNA, 14 nt, Human herpesvirus 8 [Kaposi`s sarcoma-associated h
cuuugcagccaggu

SEQ ID NO: 4002409 - RNA, 15 nt, Human herpesvirus 8 [Kaposi`s sarcoma-associated h
cuuugcagugucuau

SEQ ID NO: 4002410 - RNA, 12 nt, Human herpesvirus 8 [Kaposi`s sarcoma-associated h
cuuuuauugugg

SEQ ID NO: 4002411 - RNA, 21 nt, Human herpesvirus 8 [Kaposi`s sarcoma-associated h
gaaaacagucuguaaagaaag

SEQ ID NO: 4002412 - RNA, 17 nt, Human herpesvirus 8 [Kaposi`s sarcoma-associated h
gaaccagaaucaguggu

SEQ ID NO: 4002413 - RNA, 12 nt, Human herpesvirus 8 [Kaposi`s sarcoma-associated h
gaacggacaauu

SEQ ID NO: 4002414 - RNA, 18 nt, Human herpesvirus 8 [Kaposi`s sarcoma-associated h
gaagcaaagugucucacc

SEQ ID NO: 4002415 - RNA, 12 nt, Human herpesvirus 8 [Kaposi`s sarcoma-associated h
gaagcccuugag

SEQ ID NO: 4002416 - RNA, 17 nt, Human herpesvirus 8 [Kaposi`s sarcoma-associated h
gaagccgagcucgggac

SEQ ID NO: 4002417 - RNA, 13 nt, Human herpesvirus 8 [Kaposi`s sarcoma-associated h
gaagcgaaaagcc

SEQ ID NO: 4002418 - RNA, 20 nt, Human herpesvirus 8 [Kaposi`s sarcoma-associated h
gaagcggguuggacuggcag

SEQ ID NO: 4002419 - RNA, 15 nt, Human herpesvirus 8 [Kaposi`s sarcoma-associated h
gaaucaaugugguuc

SEQ ID NO: 4002420 - RNA, 23 nt, Human herpesvirus 8 [Kaposi`s sarcoma-associated h
gaaugaagugcaaccugcugcag

SEQ ID NO: 4002421 - RNA, 23 nt, Human herpesvirus 8 [Kaposi`s sarcoma-associated h
gaaugguaccauggcaaaaaaca

SEQ ID NO: 4002422 - RNA, 20 nt, Human herpesvirus 8 [Kaposi`s sarcoma-associated h
gaauuguuauccggcagcaa

SEQ ID NO: 4002423 - RNA, 15 nt, Human herpesvirus 8 [Kaposi`s sarcoma-associated h
gacaaaugugugggu

SEQ ID NO: 4002424 - RNA, 19 nt, Human herpesvirus 8 [Kaposi`s sarcoma-associated h
gacacugauguguuuggga

SEQ ID NO: 4002425 - RNA, 21 nt, Human herpesvirus 8 [Kaposi`s sarcoma-associated h
gacagggcuaugauugcuucu

SEQ ID NO: 4002426 - RNA, 15 nt, Human herpesvirus 8 [Kaposi`s sarcoma-associated h
gacccuagucacucc

SEQ ID NO: 4002427 - RNA, 13 nt, Human herpesvirus 8 [Kaposi`s sarcoma-associated h
gaccucccacggg

SEQ ID NO: 4002428 - RNA, 15 nt, Human herpesvirus 8 [Kaposi`s sarcoma-associated h
gaccugucgaggaag

SEQ ID NO: 4002429 - RNA, 19 nt, Human herpesvirus 8 [Kaposi`s sarcoma-associated h
gacgauguucaggaggaag

SEQ ID NO: 4002430 - RNA, 21 nt, Human herpesvirus 8 [Kaposi`s sarcoma-associated h
gacgcaucgucgcgccuggcg

SEQ ID NO: 4002431 - RNA, 13 nt, Human herpesvirus 8 [Kaposi`s sarcoma-associated h
gacucucaagcag

SEQ ID NO: 4002432 - RNA, 18 nt, Human herpesvirus 8 [Kaposi`s sarcoma-associated h
gacuggugcgcacaggcc

SEQ ID NO: 4002433 - RNA, 13 nt, Human herpesvirus 8 [Kaposi`s sarcoma-associated h
gagaacagcacau

SEQ ID NO: 4002434 - RNA, 18 nt, Human herpesvirus 8 [Kaposi`s sarcoma-associated h
gagagcuggagggcacag

SEQ ID NO: 4002435 - RNA, 20 nt, Human herpesvirus 8 [Kaposi`s sarcoma-associated h
gagcauuuuucccuccugca

SEQ ID NO: 4002436 - RNA, 23 nt, Human herpesvirus 8 [Kaposi`s sarcoma-associated h
gagccgcgcuuuuuaacuucuga

SEQ ID NO: 4002437 - RNA, 14 nt, Human herpesvirus 8 [Kaposi`s sarcoma-associated h
gagccuucacggca

SEQ ID NO: 4002438 - RNA, 15 nt, Human herpesvirus 8 [Kaposi`s sarcoma-associated h
gagcgagugugccuc

SEQ ID NO: 4002439 - RNA, 16 nt, Human herpesvirus 8 [Kaposi`s sarcoma-associated h
gagcggacgccauuug

SEQ ID NO: 4002440 - RNA, 12 nt, Human herpesvirus 8 [Kaposi`s sarcoma-associated h
gaggauggugcu

SEQ ID NO: 4002441 - RNA, 15 nt, Human herpesvirus 8 [Kaposi`s sarcoma-associated h
gaggcuaggugccca

SEQ ID NO: 4002442 - RNA, 12 nt, Human herpesvirus 8 [Kaposi`s sarcoma-associated h
gagggaucccag

SEQ ID NO: 4002443 - RNA, 21 nt, Human herpesvirus 8 [Kaposi`s sarcoma-associated h
gagggcuccucgucuguguca

SEQ ID NO: 4002444 - RNA, 18 nt, Human herpesvirus 8 [Kaposi`s sarcoma-associated h
gaguccauggcaguggac

SEQ ID NO: 4002445 - RNA, 23 nt, Human herpesvirus 8 [Kaposi`s sarcoma-associated h
gagugucaguaaaauaaaauaca

SEQ ID NO: 4002446 - RNA, 16 nt, Human herpesvirus 8 [Kaposi`s sarcoma-associated h
gauaaucuccuggaga

SEQ ID NO: 4002447 - RNA, 21 nt, Human herpesvirus 8 [Kaposi`s sarcoma-associated h
gaucucagaggcccauauuac

SEQ ID NO: 4002448 - RNA, 19 nt, Human herpesvirus 8 [Kaposi`s sarcoma-associated h
gauuugccccauggggauc

SEQ ID NO: 4002449 - RNA, 16 nt, Human herpesvirus 8 [Kaposi`s sarcoma-associated h
gcaaccugcugcagcu

SEQ ID NO: 4002450 - RNA, 14 nt, Human herpesvirus 8 [Kaposi`s sarcoma-associated h
gcaaggcgggccag

SEQ ID NO: 4002451 - RNA, 14 nt, Human herpesvirus 8 [Kaposi`s sarcoma-associated h
gcaauaaagacaaa

SEQ ID NO: 4002452 - RNA, 14 nt, Human herpesvirus 8 [Kaposi`s sarcoma-associated h
gcacacagacacaa

SEQ ID NO: 4002453 - RNA, 21 nt, Human herpesvirus 8 [Kaposi`s sarcoma-associated h
gcaccaagguaggccagcugc

SEQ ID NO: 4002454 - RNA, 17 nt, Human herpesvirus 8 [Kaposi`s sarcoma-associated h
gcacuauaaauaucauu

SEQ ID NO: 4002455 - RNA, 13 nt, Human herpesvirus 8 [Kaposi`s sarcoma-associated h
gcacuuuuggaaa

SEQ ID NO: 4002456 - RNA, 15 nt, Human herpesvirus 8 [Kaposi`s sarcoma-associated h
gcagacgaccccccg

SEQ ID NO: 4002457 - RNA, 18 nt, Human herpesvirus 8 [Kaposi`s sarcoma-associated h
gcagcaguagacgcaggc

SEQ ID NO: 4002458 - RNA, 19 nt, Human herpesvirus 8 [Kaposi`s sarcoma-associated h
gcagccagguaacaaagcc

SEQ ID NO: 4002459 - RNA, 23 nt, Human herpesvirus 8 [Kaposi`s sarcoma-associated h
gcagugcacgcaccaggauccag

SEQ ID NO: 4002460 - RNA, 14 nt, Human herpesvirus 8 [Kaposi`s sarcoma-associated h
gcaguggacacagu

SEQ ID NO: 4002461 - RNA, 13 nt, Human herpesvirus 8 [Kaposi`s sarcoma-associated h
gcagugugcagua

SEQ ID NO: 4002462 - RNA, 18 nt, Human herpesvirus 8 [Kaposi`s sarcoma-associated h
gcaguguuugcugcugua

SEQ ID NO: 4002463 - RNA, 23 nt, Human herpesvirus 8 [Kaposi`s sarcoma-associated h
gcauccuaucgcacagacacgag

SEQ ID NO: 4002464 - RNA, 22 nt, Human herpesvirus 8 [Kaposi`s sarcoma-associated h
gcaucgucgcgccuggcgugau

SEQ ID NO: 4002465 - RNA, 20 nt, Human herpesvirus 8 [Kaposi`s sarcoma-associated h
gcaugugguuaagcuuugca

SEQ ID NO: 4002466 - RNA, 17 nt, Human herpesvirus 8 [Kaposi`s sarcoma-associated h
gcauuuuucccuccugc

SEQ ID NO: 4002467 - RNA, 15 nt, Human herpesvirus 8 [Kaposi`s sarcoma-associated h
gccaacccucagugu

SEQ ID NO: 4002468 - RNA, 23 nt, Human herpesvirus 8 [Kaposi`s sarcoma-associated h
gccacagucgagccgccaggaac

SEQ ID NO: 4002469 - RNA, 16 nt, Human herpesvirus 8 [Kaposi`s sarcoma-associated h
gccaccgagaaggaag

SEQ ID NO: 4002470 - RNA, 16 nt, Human herpesvirus 8 [Kaposi`s sarcoma-associated h
gccacguggagccaac

SEQ ID NO: 4002471 - RNA, 19 nt, Human herpesvirus 8 [Kaposi`s sarcoma-associated h
gccagaaagacacaugaga

SEQ ID NO: 4002472 - RNA, 14 nt, Human herpesvirus 8 [Kaposi`s sarcoma-associated h
gccagauccuccac

SEQ ID NO: 4002473 - RNA, 19 nt, Human herpesvirus 8 [Kaposi`s sarcoma-associated h
gccagcaaccccucuggau

SEQ ID NO: 4002474 - RNA, 21 nt, Human herpesvirus 8 [Kaposi`s sarcoma-associated h
gccauggcggggcggcugugg

SEQ ID NO: 4002475 - RNA, 17 nt, Human herpesvirus 8 [Kaposi`s sarcoma-associated h
gccauucgcaccaggac

SEQ ID NO: 4002476 - RNA, 20 nt, Human herpesvirus 8 [Kaposi`s sarcoma-associated h
gucgccgguagcugccuggu

SEQ ID NO: 4002477 - RNA, 15 nt, Human herpesvirus 8 [Kaposi`s sarcoma-associated h
gucgcuggcgcaggc

SEQ ID NO: 4002478 - RNA, 14 nt, Human herpesvirus 8 [Kaposi`s sarcoma-associated h
gucuaccugccgga

SEQ ID NO: 4002479 - RNA, 21 nt, Human herpesvirus 8 [Kaposi`s sarcoma-associated h
gucuagcacacacgaugaaga

SEQ ID NO: 4002480 - RNA, 17 nt, Human herpesvirus 8 [Kaposi`s sarcoma-associated h
gugacggugacauugca

SEQ ID NO: 4002481 - RNA, 13 nt, Human herpesvirus 8 [Kaposi`s sarcoma-associated h
gugagagaccccg

SEQ ID NO: 4002482 - RNA, 17 nt, Human herpesvirus 8 [Kaposi`s sarcoma-associated h
gugagagaccccgugau

SEQ ID NO: 4002483 - RNA, 20 nt, Human herpesvirus 8 [Kaposi`s sarcoma-associated h
gugagccuaacccacgucac

SEQ ID NO: 4002484 - RNA, 13 nt, Human herpesvirus 8 [Kaposi`s sarcoma-associated h
gugaucucuggag

SEQ ID NO: 4002485 - RNA, 16 nt, Human herpesvirus 8 [Kaposi`s sarcoma-associated h
guggagcacgaagaca

SEQ ID NO: 4002486 - RNA, 15 nt, Human herpesvirus 8 [Kaposi`s sarcoma-associated h
guggaugagaggguu

SEQ ID NO: 4002487 - RNA, 18 nt, Human herpesvirus 8 [Kaposi`s sarcoma-associated h
guggauuuccuuucugag

SEQ ID NO: 4002488 - RNA, 14 nt, Human herpesvirus 8 [Kaposi`s sarcoma-associated h
guggauuuuaugga

SEQ ID NO: 4002489 - RNA, 23 nt, Human herpesvirus 8 [Kaposi`s sarcoma-associated h
gugguagagaccgacgccaucaa

SEQ ID NO: 4002490 - RNA, 23 nt, Human herpesvirus 8 [Kaposi`s sarcoma-associated h
gugucauugccacccagcuacug

SEQ ID NO: 4002491 - RNA, 22 nt, Human herpesvirus 8 [Kaposi`s sarcoma-associated h
guuagcgccaccguguggcugc

SEQ ID NO: 4002492 - RNA, 13 nt, Human herpesvirus 8 [Kaposi`s sarcoma-associated h
guucaucagccuc

SEQ ID NO: 4002493 - RNA, 15 nt, Human herpesvirus 8 [Kaposi`s sarcoma-associated h
guucccaugagccuc

SEQ ID NO: 4002494 - RNA, 21 nt, Human herpesvirus 8 [Kaposi`s sarcoma-associated h
guugagagucagagaauacag

SEQ ID NO: 4002495 - RNA, 18 nt, Human herpesvirus 8 [Kaposi`s sarcoma-associated h
guugcugauuacgaaaag

SEQ ID NO: 4002496 - RNA, 21 nt, Human herpesvirus 8 [Kaposi`s sarcoma-associated h
guuguagugguggcagaaaau

SEQ ID NO: 4002497 - RNA, 16 nt, Human herpesvirus 8 [Kaposi`s sarcoma-associated h
guuucgucgauuucac

SEQ ID NO: 4002498 - RNA, 17 nt, Human herpesvirus 8 [Kaposi`s sarcoma-associated h
uaaaagagagaauuaga

SEQ ID NO: 4002499 - RNA, 18 nt, Human herpesvirus 8 [Kaposi`s sarcoma-associated h
uaaaagccugguccaggc

SEQ ID NO: 4002500 - RNA, 21 nt, Human herpesvirus 8 [Kaposi`s sarcoma-associated h
uaaacagccuuggugcuaggc

SEQ ID NO: 4002501 - RNA, 22 nt, Human herpesvirus 8 [Kaposi`s sarcoma-associated h
uaaacauacguuuugaacaaug

SEQ ID NO: 4002502 - RNA, 18 nt, Human herpesvirus 8 [Kaposi`s sarcoma-associated h
uaaagauuaacugucuac

SEQ ID NO: 4002503 - RNA, 21 nt, Human herpesvirus 8 [Kaposi`s sarcoma-associated h
uaacauaauuguaauguguuu

SEQ ID NO: 4002504 - RNA, 19 nt, Human herpesvirus 8 [Kaposi`s sarcoma-associated h
uaaccagcuacgcacugag

SEQ ID NO: 4002505 - RNA, 20 nt, Human herpesvirus 8 [Kaposi`s sarcoma-associated h
uaacccgcuccgccacgcag

SEQ ID NO: 4002506 - RNA, 23 nt, Human herpesvirus 8 [Kaposi`s sarcoma-associated h
uaagaguuccccgggaacggaca

SEQ ID NO: 4002507 - RNA, 15 nt, Human herpesvirus 8 [Kaposi`s sarcoma-associated h
uaagauaaucuaaau

SEQ ID NO: 4002508 - RNA, 16 nt, Human herpesvirus 8 [Kaposi`s sarcoma-associated h
uaagauuauaaugggu

SEQ ID NO: 4002509 - RNA, 17 nt, Human herpesvirus 8 [Kaposi`s sarcoma-associated h
uaaucuaaauauucucu

SEQ ID NO: 4002510 - RNA, 13 nt, Human herpesvirus 8 [Kaposi`s sarcoma-associated h
uaaugcagacaga

SEQ ID NO: 4002511 - RNA, 23 nt, Human herpesvirus 8 [Kaposi`s sarcoma-associated h
uacauccaaauuaugcaguaucu

SEQ ID NO: 4002512 - RNA, 16 nt, Human herpesvirus 8 [Kaposi`s sarcoma-associated h
uacgaggcaauugcca

SEQ ID NO: 4002513 - RNA, 16 nt, Human herpesvirus 8 [Kaposi`s sarcoma-associated h
uacguauuagacguac

SEQ ID NO: 4002514 - RNA, 19 nt, Human herpesvirus 8 [Kaposi`s sarcoma-associated h
uacgucccucuuggcuguu

SEQ ID NO: 4002515 - RNA, 21 nt, Human herpesvirus 8 [Kaposi`s sarcoma-associated h
uacuagugagcccggaggagg

SEQ ID NO: 4002516 - RNA, 15 nt, Human herpesvirus 8 [Kaposi`s sarcoma-associated h
uacugguaccagaga

SEQ ID NO: 4002517 - RNA, 13 nt, Human herpesvirus 8 [Kaposi`s sarcoma-associated h
uacuguccauuac

SEQ ID NO: 4002518 - RNA, 19 nt, Human herpesvirus 8 [Kaposi`s sarcoma-associated h
uacugugaaguuuacauua

SEQ ID NO: 4002519 - RNA, 20 nt, Human herpesvirus 8 [Kaposi`s sarcoma-associated h
uagaugcgcuggaagagaau

SEQ ID NO: 4002520 - RNA, 15 nt, Human herpesvirus 8 [Kaposi`s sarcoma-associated h
uagcagaguguccag

SEQ ID NO: 4002521 - RNA, 21 nt, Human herpesvirus 8 [Kaposi`s sarcoma-associated h
uagcagcugucccggauccag

SEQ ID NO: 4002522 - RNA, 18 nt, Human herpesvirus 8 [Kaposi`s sarcoma-associated h
uagcagucgccaguuuuu

SEQ ID NO: 4002523 - RNA, 16 nt, Human herpesvirus 8 [Kaposi`s sarcoma-associated h
uaggauucgugcagcc

SEQ ID NO: 4002524 - RNA, 11 nt, Human herpesvirus 8 [Kaposi`s sarcoma-associated h
uaggugucaag

SEQ ID NO: 4002525 - RNA, 15 nt, Human herpesvirus 8 [Kaposi`s sarcoma-associated h
uaucagcugcagcca

SEQ ID NO: 4002526 - RNA, 18 nt, Human herpesvirus 8 [Kaposi`s sarcoma-associated h
uaugcaugugucugugcc

SEQ ID NO: 4002527 - RNA, 19 nt, Human herpesvirus 8 [Kaposi`s sarcoma-associated h
uaugucuguguuuuguaaa

SEQ ID NO: 4002528 - RNA, 12 nt, Human herpesvirus 8 [Kaposi`s sarcoma-associated h
uauuaaagggac

SEQ ID NO: 4002529 - RNA, 16 nt, Human herpesvirus 8 [Kaposi`s sarcoma-associated h
uauuaggguggauagg

SEQ ID NO: 4002530 - RNA, 22 nt, Human herpesvirus 8 [Kaposi`s sarcoma-associated h
uauuuauuuuuuacuacaggua

SEQ ID NO: 4002531 - RNA, 17 nt, Human herpesvirus 8 [Kaposi`s sarcoma-associated h
ucaccgcgguccauuag

SEQ ID NO: 4002532 - RNA, 22 nt, Human herpesvirus 8 [Kaposi`s sarcoma-associated h
ucacggacuuuauuauagaugc

SEQ ID NO: 4002533 - RNA, 21 nt, Human herpesvirus 8 [Kaposi`s sarcoma-associated h
ucagcaguguuugcugcugua

SEQ ID NO: 4002534 - RNA, 13 nt, Human herpesvirus 8 [Kaposi`s sarcoma-associated h
ucagcugcagcca

SEQ ID NO: 4002535 - RNA, 14 nt, Human herpesvirus 8 [Kaposi`s sarcoma-associated h
ucaggucugucacu

SEQ ID NO: 4002536 - RNA, 14 nt, Human herpesvirus 8 [Kaposi`s sarcoma-associated h
ucaguguccagcca

SEQ ID NO: 4002537 - RNA, 18 nt, Human herpesvirus 8 [Kaposi`s sarcoma-associated h
ucaucgccgccgccaaac

SEQ ID NO: 4002538 - RNA, 13 nt, Human herpesvirus 8 [Kaposi`s sarcoma-associated h
uccaggagcgacu

SEQ ID NO: 4002539 - RNA, 22 nt, Human herpesvirus 8 [Kaposi`s sarcoma-associated h
uccaguagauuuaguacguggu

SEQ ID NO: 4002540 - RNA, 16 nt, Human herpesvirus 8 [Kaposi`s sarcoma-associated h
ucccacgaugggaacu

SEQ ID NO: 4002541 - RNA, 13 nt, Human herpesvirus 8 [Kaposi`s sarcoma-associated h
uccccaauuucag

SEQ ID NO: 4002542 - RNA, 23 nt, Human herpesvirus 8 [Kaposi`s sarcoma-associated h
uccgaggaucugugugugaagca

SEQ ID NO: 4002543 - RNA, 19 nt, Human herpesvirus 8 [Kaposi`s sarcoma-associated h
uccuacccuacuccccugu

SEQ ID NO: 4002544 - RNA, 14 nt, Human herpesvirus 8 [Kaposi`s sarcoma-associated h
uccuucgcacuucu

SEQ ID NO: 4002545 - RNA, 22 nt, Human herpesvirus 8 [Kaposi`s sarcoma-associated h
ucgagggcauacccguggcuca

SEQ ID NO: 4002546 - RNA, 21 nt, Human herpesvirus 8 [Kaposi`s sarcoma-associated h
ucgcaggccgaauaccucgug

SEQ ID NO: 4002547 - RNA, 15 nt, Human herpesvirus 8 [Kaposi`s sarcoma-associated h
ucgcccgccugugug

SEQ ID NO: 4002548 - RNA, 18 nt, Human herpesvirus 8 [Kaposi`s sarcoma-associated h
ucgcgacagacugccucc

SEQ ID NO: 4002549 - RNA, 21 nt, Human herpesvirus 8 [Kaposi`s sarcoma-associated h
ucgcugcaccuggaccccgcg

SEQ ID NO: 4002550 - RNA, 16 nt, Human herpesvirus 8 [Kaposi`s sarcoma-associated h
ucggcagccucuaccc

SEQ ID NO: 4002551 - RNA, 20 nt, Human herpesvirus 8 [Kaposi`s sarcoma-associated h
ucuagcauaugcugccaaga

SEQ ID NO: 4002552 - RNA, 12 nt, Human herpesvirus 8 [Kaposi`s sarcoma-associated h
ucucuucucuac

SEQ ID NO: 4002553 - RNA, 21 nt, Human herpesvirus 8 [Kaposi`s sarcoma-associated h
ucugggauagugucuggcugg

SEQ ID NO: 4002554 - RNA, 14 nt, Human herpesvirus 8 [Kaposi`s sarcoma-associated h
ccuagaugcgcugg

SEQ ID NO: 4002555 - RNA, 13 nt, Human herpesvirus 8 [Kaposi`s sarcoma-associated h
ccuaucgcacaga

SEQ ID NO: 4002556 - RNA, 14 nt, Human herpesvirus 8 [Kaposi`s sarcoma-associated h
ccuaucgcacagac

SEQ ID NO: 4002557 - RNA, 20 nt, Human herpesvirus 8 [Kaposi`s sarcoma-associated h
ccuauggcgcaagcacuuuu

SEQ ID NO: 4002558 - RNA, 17 nt, Human herpesvirus 8 [Kaposi`s sarcoma-associated h
ccucagaaaguggauug

SEQ ID NO: 4002559 - RNA, 19 nt, Human herpesvirus 8 [Kaposi`s sarcoma-associated h
ccucccaacauguaaauug

SEQ ID NO: 4002560 - RNA, 15 nt, Human herpesvirus 8 [Kaposi`s sarcoma-associated h
ccuccugggccaggc

SEQ ID NO: 4002561 - RNA, 13 nt, Human herpesvirus 8 [Kaposi`s sarcoma-associated h
ccucgcaagcuug

SEQ ID NO: 4002562 - RNA, 17 nt, Human herpesvirus 8 [Kaposi`s sarcoma-associated h
ccucgucgacagagcca

SEQ ID NO: 4002563 - RNA, 20 nt, Human herpesvirus 8 [Kaposi`s sarcoma-associated h
ccugaggugcucuucccaca

SEQ ID NO: 4002564 - RNA, 11 nt, Human herpesvirus 8 [Kaposi`s sarcoma-associated h
ccugccagggg

SEQ ID NO: 4002565 - RNA, 14 nt, Human herpesvirus 8 [Kaposi`s sarcoma-associated h
ccugcugcagcugg

SEQ ID NO: 4002566 - RNA, 21 nt, Human herpesvirus 8 [Kaposi`s sarcoma-associated h
ccuggagcagacgugcccaga

SEQ ID NO: 4002567 - RNA, 12 nt, Human herpesvirus 8 [Kaposi`s sarcoma-associated h
ccuucacagugc

SEQ ID NO: 4002568 - RNA, 15 nt, Human herpesvirus 8 [Kaposi`s sarcoma-associated h
ccuucgaggccaggc

SEQ ID NO: 4002569 - RNA, 22 nt, Human herpesvirus 8 [Kaposi`s sarcoma-associated h
ccuucuggcuuggcgcuuagcc

SEQ ID NO: 4002570 - RNA, 17 nt, Human herpesvirus 8 [Kaposi`s sarcoma-associated h
cgaaugguaccauggca

SEQ ID NO: 4002571 - RNA, 11 nt, Human herpesvirus 8 [Kaposi`s sarcoma-associated h
cgacaaaguga

SEQ ID NO: 4002572 - RNA, 19 nt, Human herpesvirus 8 [Kaposi`s sarcoma-associated h
cgacugggccaccaagauc

SEQ ID NO: 4002573 - RNA, 14 nt, Human herpesvirus 8 [Kaposi`s sarcoma-associated h
cgagacuuggcaga

SEQ ID NO: 4002574 - RNA, 14 nt, Human herpesvirus 8 [Kaposi`s sarcoma-associated h
cgagcuaggagugg

SEQ ID NO: 4002575 - RNA, 13 nt, Human herpesvirus 8 [Kaposi`s sarcoma-associated h
cgauuacaggaaa

SEQ ID NO: 4002576 - RNA, 21 nt, Human herpesvirus 8 [Kaposi`s sarcoma-associated h
cgcaccugguaagcagggcgg

SEQ ID NO: 4002577 - RNA, 22 nt, Human herpesvirus 8 [Kaposi`s sarcoma-associated h
cgcagaacaguacccacgaaau

SEQ ID NO: 4002578 - RNA, 17 nt, Human herpesvirus 8 [Kaposi`s sarcoma-associated h
cgccaccuagcgggcac

SEQ ID NO: 4002579 - RNA, 12 nt, Human herpesvirus 8 [Kaposi`s sarcoma-associated h
cgccccucuugg

SEQ ID NO: 4002580 - RNA, 21 nt, Human herpesvirus 8 [Kaposi`s sarcoma-associated h
cgccgaggacacgccaucgcc

SEQ ID NO: 4002581 - RNA, 20 nt, Human herpesvirus 8 [Kaposi`s sarcoma-associated h
cgccggagagcgucaucugc

SEQ ID NO: 4002582 - RNA, 12 nt, Human herpesvirus 8 [Kaposi`s sarcoma-associated h
cgcggaccucaa

SEQ ID NO: 4002583 - RNA, 19 nt, Human herpesvirus 8 [Kaposi`s sarcoma-associated h
cgcggaccucaaagaagag

SEQ ID NO: 4002584 - RNA, 22 nt, Human herpesvirus 8 [Kaposi`s sarcoma-associated h
cgcgguuguuuacgcagggugc

SEQ ID NO: 4002585 - RNA, 21 nt, Human herpesvirus 8 [Kaposi`s sarcoma-associated h
cgcugccagucacgcacuugg

SEQ ID NO: 4002586 - RNA, 15 nt, Human herpesvirus 8 [Kaposi`s sarcoma-associated h
cggaaacugggcacg

SEQ ID NO: 4002587 - RNA, 21 nt, Human herpesvirus 8 [Kaposi`s sarcoma-associated h
cggaagauugguguccagaca

SEQ ID NO: 4002588 - RNA, 12 nt, Human herpesvirus 8 [Kaposi`s sarcoma-associated h
cggacgccagga

SEQ ID NO: 4002589 - RNA, 13 nt, Human herpesvirus 8 [Kaposi`s sarcoma-associated h
cggacggagccgg

SEQ ID NO: 4002590 - RNA, 23 nt, Human herpesvirus 8 [Kaposi`s sarcoma-associated h
cggcacacuacucccccuccuca

SEQ ID NO: 4002591 - RNA, 14 nt, Human herpesvirus 8 [Kaposi`s sarcoma-associated h
cggcgagcccgugu

SEQ ID NO: 4002592 - RNA, 16 nt, Human herpesvirus 8 [Kaposi`s sarcoma-associated h
cggcuccguccuggug

SEQ ID NO: 4002593 - RNA, 12 nt, Human herpesvirus 8 [Kaposi`s sarcoma-associated h
cgggacuucugg

SEQ ID NO: 4002594 - RNA, 13 nt, Human herpesvirus 8 [Kaposi`s sarcoma-associated h
cgggcuacguggu

SEQ ID NO: 4002595 - RNA, 14 nt, Human herpesvirus 8 [Kaposi`s sarcoma-associated h
cggugaaacagaua

SEQ ID NO: 4002596 - RNA, 19 nt, Human herpesvirus 8 [Kaposi`s sarcoma-associated h
cggugaacguccccgcguc

SEQ ID NO: 4002597 - RNA, 18 nt, Human herpesvirus 8 [Kaposi`s sarcoma-associated h
cggugcaugugacccggc

SEQ ID NO: 4002598 - RNA, 15 nt, Human herpesvirus 8 [Kaposi`s sarcoma-associated h
cguaaaccucgggcc

SEQ ID NO: 4002599 - RNA, 16 nt, Human herpesvirus 8 [Kaposi`s sarcoma-associated h
cgugacacuacuaaug

SEQ ID NO: 4002600 - RNA, 17 nt, Human herpesvirus 8 [Kaposi`s sarcoma-associated h
cgugcaggucgcagaga

SEQ ID NO: 4002601 - RNA, 12 nt, Human herpesvirus 8 [Kaposi`s sarcoma-associated h
cguguccaggaa

SEQ ID NO: 4002602 - RNA, 20 nt, Human herpesvirus 8 [Kaposi`s sarcoma-associated h
cuaagaauccccuucucucu

SEQ ID NO: 4002603 - RNA, 19 nt, Human herpesvirus 8 [Kaposi`s sarcoma-associated h
cuaauauuaaccauagugu

SEQ ID NO: 4002604 - RNA, 21 nt, Human herpesvirus 8 [Kaposi`s sarcoma-associated h
cuacgaaaaucuggcaugcug

SEQ ID NO: 4002605 - RNA, 13 nt, Human herpesvirus 8 [Kaposi`s sarcoma-associated h
cuacgagguuggg

SEQ ID NO: 4002606 - RNA, 18 nt, Human herpesvirus 8 [Kaposi`s sarcoma-associated h
cuacuaauguaaccuaaa

SEQ ID NO: 4002607 - RNA, 16 nt, Human herpesvirus 8 [Kaposi`s sarcoma-associated h
cuacuaugucccaaag

SEQ ID NO: 4002608 - RNA, 18 nt, Human herpesvirus 8 [Kaposi`s sarcoma-associated h
cuacucccccuccucaga

SEQ ID NO: 4002609 - RNA, 19 nt, Human herpesvirus 8 [Kaposi`s sarcoma-associated h
cuagaacuaaccacucaua

SEQ ID NO: 4002610 - RNA, 13 nt, Human herpesvirus 8 [Kaposi`s sarcoma-associated h
cuagacaauaaag

SEQ ID NO: 4002611 - RNA, 19 nt, Human herpesvirus 8 [Kaposi`s sarcoma-associated h
cuaucagcugcagccagga

SEQ ID NO: 4002612 - RNA, 15 nt, Human herpesvirus 8 [Kaposi`s sarcoma-associated h
cucaucauuucugaa

SEQ ID NO: 4002613 - RNA, 21 nt, Human herpesvirus 8 [Kaposi`s sarcoma-associated h
cuccacguagacggggagcug

SEQ ID NO: 4002614 - RNA, 18 nt, Human herpesvirus 8 [Kaposi`s sarcoma-associated h
cucccccuuuuuccuccc

SEQ ID NO: 4002615 - RNA, 13 nt, Human herpesvirus 8 [Kaposi`s sarcoma-associated h
cucccucacaaug

SEQ ID NO: 4002616 - RNA, 14 nt, Human herpesvirus 8 [Kaposi`s sarcoma-associated h
cuccgccagggacg

SEQ ID NO: 4002617 - RNA, 21 nt, Human herpesvirus 8 [Kaposi`s sarcoma-associated h
cuccggacucgucuacccugc

SEQ ID NO: 4002618 - RNA, 17 nt, Human herpesvirus 8 [Kaposi`s sarcoma-associated h
cucgcuguccuggagga

SEQ ID NO: 4002619 - RNA, 22 nt, Human herpesvirus 8 [Kaposi`s sarcoma-associated h
cugcaaaauaaagucugagugg

SEQ ID NO: 4002620 - RNA, 18 nt, Human herpesvirus 8 [Kaposi`s sarcoma-associated h
cugcaccucgccgcaaag

SEQ ID NO: 4002621 - RNA, 16 nt, Human herpesvirus 8 [Kaposi`s sarcoma-associated h
cugcaggggagcacac

SEQ ID NO: 4002622 - RNA, 21 nt, Human herpesvirus 8 [Kaposi`s sarcoma-associated h
cugcaguuaucaacccuacuc

SEQ ID NO: 4002623 - RNA, 17 nt, Human herpesvirus 8 [Kaposi`s sarcoma-associated h
cugcccucaaauucuca

SEQ ID NO: 4002624 - RNA, 19 nt, Human herpesvirus 8 [Kaposi`s sarcoma-associated h
cugcgcagaacaguaccca

SEQ ID NO: 4002625 - RNA, 22 nt, Human herpesvirus 8 [Kaposi`s sarcoma-associated h
cugcgcagaacaguacccacga

SEQ ID NO: 4002626 - RNA, 22 nt, Human herpesvirus 8 [Kaposi`s sarcoma-associated h
cugcgcauuuccugcccugguu

SEQ ID NO: 4002627 - RNA, 13 nt, Human herpesvirus 8 [Kaposi`s sarcoma-associated h
cugcugcagcugg

SEQ ID NO: 4002628 - RNA, 12 nt, Human herpesvirus 8 [Kaposi`s sarcoma-associated h
cuggacacuaaa

SEQ ID NO: 4002629 - RNA, 20 nt, Human herpesvirus 8 [Kaposi`s sarcoma-associated h
cuggcaugcugggauuuaga

SEQ ID NO: 4002630 - RNA, 21 nt, Human herpesvirus 8 [Kaposi`s sarcoma-associated h
cugggacuugauaaucuccug

SEQ ID NO: 4002631 - RNA, 23 nt, Human herpesvirus 8 [Kaposi`s sarcoma-associated h
cugggcguccacauggcagcuga

SEQ ID NO: 4002632 - RNA, 20 nt, Human herpesvirus 8 [Kaposi`s sarcoma-associated h
cugggguccgauugcuucau

SEQ ID NO: 4002633 - RNA, 22 nt, Human herpesvirus 8 [Kaposi`s sarcoma-associated h
gcccacuauuaugccgaacagg

SEQ ID NO: 4002634 - RNA, 17 nt, Human herpesvirus 8 [Kaposi`s sarcoma-associated h
gcccggagacuaucagg

SEQ ID NO: 4002635 - RNA, 21 nt, Human herpesvirus 8 [Kaposi`s sarcoma-associated h
gcccugguucuaaucuuaguc

SEQ ID NO: 4002636 - RNA, 15 nt, Human herpesvirus 8 [Kaposi`s sarcoma-associated h
gccguacauggagcg

SEQ ID NO: 4002637 - RNA, 17 nt, Human herpesvirus 8 [Kaposi`s sarcoma-associated h
gccguguugcgcgcugg

SEQ ID NO: 4002638 - RNA, 23 nt, Human herpesvirus 8 [Kaposi`s sarcoma-associated h
gccguguugcgcgcuggcucaga

SEQ ID NO: 4002639 - RNA, 21 nt, Human herpesvirus 8 [Kaposi`s sarcoma-associated h
gccuagugggguggcgcgcca

SEQ ID NO: 4002640 - RNA, 18 nt, Human herpesvirus 8 [Kaposi`s sarcoma-associated h
gccucgagggcggccagu

SEQ ID NO: 4002641 - RNA, 18 nt, Human herpesvirus 8 [Kaposi`s sarcoma-associated h
gccuggagcagcgccagu

SEQ ID NO: 4002642 - RNA, 14 nt, Human herpesvirus 8 [Kaposi`s sarcoma-associated h
gccuucgcacccca

SEQ ID NO: 4002643 - RNA, 23 nt, Human herpesvirus 8 [Kaposi`s sarcoma-associated h
gcgaugcauaucguugacaugug

SEQ ID NO: 4002644 - RNA, 17 nt, Human herpesvirus 8 [Kaposi`s sarcoma-associated h
gcgcagcuuuccuguga

SEQ ID NO: 4002645 - RNA, 20 nt, Human herpesvirus 8 [Kaposi`s sarcoma-associated h
gcgcaggagucagagcagug

SEQ ID NO: 4002646 - RNA, 13 nt, Human herpesvirus 8 [Kaposi`s sarcoma-associated h
gcgcggaccuguu

SEQ ID NO: 4002647 - RNA, 19 nt, Human herpesvirus 8 [Kaposi`s sarcoma-associated h
gcgcguaugggaacacaau

SEQ ID NO: 4002648 - RNA, 14 nt, Human herpesvirus 8 [Kaposi`s sarcoma-associated h
gcgcuggcucagac

SEQ ID NO: 4002649 - RNA, 20 nt, Human herpesvirus 8 [Kaposi`s sarcoma-associated h
gcggaccuguucuaccaggu

SEQ ID NO: 4002650 - RNA, 20 nt, Human herpesvirus 8 [Kaposi`s sarcoma-associated h
gcggagaggggguggugcga

SEQ ID NO: 4002651 - RNA, 18 nt, Human herpesvirus 8 [Kaposi`s sarcoma-associated h
gcggggacggggggugag

SEQ ID NO: 4002652 - RNA, 15 nt, Human herpesvirus 8 [Kaposi`s sarcoma-associated h
gcggugcugcccagg

SEQ ID NO: 4002653 - RNA, 18 nt, Human herpesvirus 8 [Kaposi`s sarcoma-associated h
gcgucuucuauacaugcc

SEQ ID NO: 4002654 - RNA, 12 nt, Human herpesvirus 8 [Kaposi`s sarcoma-associated h
gcgugcuucugu

SEQ ID NO: 4002655 - RNA, 15 nt, Human herpesvirus 8 [Kaposi`s sarcoma-associated h
gcuaaccaccacagu

SEQ ID NO: 4002656 - RNA, 17 nt, Human herpesvirus 8 [Kaposi`s sarcoma-associated h
gcuaacuugccggacag

SEQ ID NO: 4002657 - RNA, 15 nt, Human herpesvirus 8 [Kaposi`s sarcoma-associated h
gcuacaaauguuuua

SEQ ID NO: 4002658 - RNA, 21 nt, Human herpesvirus 8 [Kaposi`s sarcoma-associated h
gcuacguacccaauguuaaug

SEQ ID NO: 4002659 - RNA, 15 nt, Human herpesvirus 8 [Kaposi`s sarcoma-associated h
gcuagauuaaauuaa

SEQ ID NO: 4002660 - RNA, 20 nt, Human herpesvirus 8 [Kaposi`s sarcoma-associated h
gcucagcgaugccgacaagg

SEQ ID NO: 4002661 - RNA, 17 nt, Human herpesvirus 8 [Kaposi`s sarcoma-associated h
gcucaucggacaggacg

SEQ ID NO: 4002662 - RNA, 14 nt, Human herpesvirus 8 [Kaposi`s sarcoma-associated h
gcuccucgagcgug

SEQ ID NO: 4002663 - RNA, 18 nt, Human herpesvirus 8 [Kaposi`s sarcoma-associated h
gcucgagaacugucgaga

SEQ ID NO: 4002664 - RNA, 20 nt, Human herpesvirus 8 [Kaposi`s sarcoma-associated h
gcucgagaacugucgagaca

SEQ ID NO: 4002665 - RNA, 14 nt, Human herpesvirus 8 [Kaposi`s sarcoma-associated h
gcucucgcugcuca

SEQ ID NO: 4002666 - RNA, 13 nt, Human herpesvirus 8 [Kaposi`s sarcoma-associated h
gcugcagccagga

SEQ ID NO: 4002667 - RNA, 17 nt, Human herpesvirus 8 [Kaposi`s sarcoma-associated h
gcugccacugccacgga

SEQ ID NO: 4002668 - RNA, 20 nt, Human herpesvirus 8 [Kaposi`s sarcoma-associated h
gcugccccaaaaggcgaggc

SEQ ID NO: 4002669 - RNA, 18 nt, Human herpesvirus 8 [Kaposi`s sarcoma-associated h
gcugucccgugcccaggc

SEQ ID NO: 4002670 - RNA, 18 nt, Human herpesvirus 8 [Kaposi`s sarcoma-associated h
gcuguucucgccuggagc

SEQ ID NO: 4002671 - RNA, 14 nt, Human herpesvirus 8 [Kaposi`s sarcoma-associated h
gcuuauaccggccu

SEQ ID NO: 4002672 - RNA, 18 nt, Human herpesvirus 8 [Kaposi`s sarcoma-associated h
ggaagcauccggacugag

SEQ ID NO: 4002673 - RNA, 12 nt, Human herpesvirus 8 [Kaposi`s sarcoma-associated h
ggacaccacauu

SEQ ID NO: 4002674 - RNA, 22 nt, Human herpesvirus 8 [Kaposi`s sarcoma-associated h
ggacgcggccuucgucaugcac

SEQ ID NO: 4002675 - RNA, 13 nt, Human herpesvirus 8 [Kaposi`s sarcoma-associated h
ggacuggcagggu

SEQ ID NO: 4002676 - RNA, 14 nt, Human herpesvirus 8 [Kaposi`s sarcoma-associated h
ggagaacaugcugg

SEQ ID NO: 4002677 - RNA, 14 nt, Human herpesvirus 8 [Kaposi`s sarcoma-associated h
ggagccguccacca

SEQ ID NO: 4002678 - RNA, 15 nt, Human herpesvirus 8 [Kaposi`s sarcoma-associated h
ggagcuguggggcag

SEQ ID NO: 4002679 - RNA, 12 nt, Human herpesvirus 8 [Kaposi`s sarcoma-associated h
ggagggcagcug

SEQ ID NO: 4002680 - RNA, 19 nt, Human herpesvirus 8 [Kaposi`s sarcoma-associated h
ggaucaucugcagacccuu

SEQ ID NO: 4002681 - RNA, 20 nt, Human herpesvirus 8 [Kaposi`s sarcoma-associated h
ggaucuucucauucagagac

SEQ ID NO: 4002682 - RNA, 14 nt, Human herpesvirus 8 [Kaposi`s sarcoma-associated h
ggauucgugcagcc

SEQ ID NO: 4002683 - RNA, 23 nt, Human herpesvirus 8 [Kaposi`s sarcoma-associated h
ggauuuaucuaccuuagaagacc

SEQ ID NO: 4002684 - RNA, 22 nt, Human herpesvirus 8 [Kaposi`s sarcoma-associated h
ggcaucguggaacgcacaggua

SEQ ID NO: 4002685 - RNA, 16 nt, Human herpesvirus 8 [Kaposi`s sarcoma-associated h
ggccaggcaccuguug

SEQ ID NO: 4002686 - RNA, 21 nt, Human herpesvirus 8 [Kaposi`s sarcoma-associated h
ggccauccgcgagccauucau

SEQ ID NO: 4002687 - RNA, 17 nt, Human herpesvirus 8 [Kaposi`s sarcoma-associated h
ggcgcagcagcugcuug

SEQ ID NO: 4002688 - RNA, 18 nt, Human herpesvirus 8 [Kaposi`s sarcoma-associated h
ggcggugcaugugacccg

SEQ ID NO: 4002689 - RNA, 22 nt, Human herpesvirus 8 [Kaposi`s sarcoma-associated h
ggcuagauuaaauuaaggggga

SEQ ID NO: 4002690 - RNA, 17 nt, Human herpesvirus 8 [Kaposi`s sarcoma-associated h
ggcucaucggacaggac

SEQ ID NO: 4002691 - RNA, 23 nt, Human herpesvirus 8 [Kaposi`s sarcoma-associated h
ggcuguuacaauaaagcugagcc

SEQ ID NO: 4002692 - RNA, 15 nt, Human herpesvirus 8 [Kaposi`s sarcoma-associated h
gggaaggaagggcgg

SEQ ID NO: 4002693 - RNA, 17 nt, Human herpesvirus 8 [Kaposi`s sarcoma-associated h
gggacagucuaaaaaag

SEQ ID NO: 4002694 - RNA, 21 nt, Human herpesvirus 8 [Kaposi`s sarcoma-associated h
gggaggcauguuuagggcucg

SEQ ID NO: 4002695 - RNA, 19 nt, Human herpesvirus 8 [Kaposi`s sarcoma-associated h
gggauggaggaagagggau

SEQ ID NO: 4002696 - RNA, 17 nt, Human herpesvirus 8 [Kaposi`s sarcoma-associated h
gggccaugacaacugcc

SEQ ID NO: 4002697 - RNA, 16 nt, Human herpesvirus 8 [Kaposi`s sarcoma-associated h
gggggaugagccagaa

SEQ ID NO: 4002698 - RNA, 22 nt, Human herpesvirus 8 [Kaposi`s sarcoma-associated h
gguagcaaaugaaaagcuucug

SEQ ID NO: 4002699 - RNA, 15 nt, Human herpesvirus 8 [Kaposi`s sarcoma-associated h
ggucgguucacugcu

SEQ ID NO: 4002700 - RNA, 13 nt, Human herpesvirus 8 [Kaposi`s sarcoma-associated h
gguuacugccaga

SEQ ID NO: 4002701 - RNA, 20 nt, Human herpesvirus 8 [Kaposi`s sarcoma-associated h
gguuagggucgggugggacg

SEQ ID NO: 4002702 - RNA, 18 nt, Human herpesvirus 8 [Kaposi`s sarcoma-associated h
gguugcauagggcuuuga

SEQ ID NO: 4002703 - RNA, 17 nt, Human herpesvirus 8 [Kaposi`s sarcoma-associated h
guaccaccaagaaggaa

SEQ ID NO: 4002704 - RNA, 17 nt, Human herpesvirus 8 [Kaposi`s sarcoma-associated h
guagaggggguggaaaa

SEQ ID NO: 4002705 - RNA, 22 nt, Human herpesvirus 8 [Kaposi`s sarcoma-associated h
guagggcuuuacccucuggccu

SEQ ID NO: 4002706 - RNA, 15 nt, Human herpesvirus 8 [Kaposi`s sarcoma-associated h
guauaugacuacugu

SEQ ID NO: 4002707 - RNA, 13 nt, Human herpesvirus 8 [Kaposi`s sarcoma-associated h
guaucuuaaagcg

SEQ ID NO: 4002708 - RNA, 23 nt, Human herpesvirus 8 [Kaposi`s sarcoma-associated h
guauuagaggguggacagugccu

SEQ ID NO: 4002709 - RNA, 16 nt, Human herpesvirus 8 [Kaposi`s sarcoma-associated h
guauuaugccagggaa

SEQ ID NO: 4002710 - RNA, 19 nt, Human herpesvirus 8 [Kaposi`s sarcoma-associated h
gucaugcacgguauagaga

SEQ ID NO: 4002711 - RNA, 15 nt, Human herpesvirus 8 [Kaposi`s sarcoma-associated h
guccgauugcuucau

SEQ ID NO: 4002712 - RNA, 15 nt, Human herpesvirus 8 [Kaposi`s sarcoma-associated h
ucuguguccuccucu

SEQ ID NO: 4002713 - RNA, 13 nt, Human herpesvirus 8 [Kaposi`s sarcoma-associated h
ucuguuacuggca

SEQ ID NO: 4002714 - RNA, 17 nt, Human herpesvirus 8 [Kaposi`s sarcoma-associated h
ucuguuacuggcaccua

SEQ ID NO: 4002715 - RNA, 17 nt, Human herpesvirus 8 [Kaposi`s sarcoma-associated h
ucuuagucuuacuguca

SEQ ID NO: 4002716 - RNA, 14 nt, Human herpesvirus 8 [Kaposi`s sarcoma-associated h
ucuuggcuguuaca

SEQ ID NO: 4002717 - RNA, 14 nt, Human herpesvirus 8 [Kaposi`s sarcoma-associated h
ucuuuauugcuuuc

SEQ ID NO: 4002718 - RNA, 15 nt, Human herpesvirus 8 [Kaposi`s sarcoma-associated h
ugaacguccccgcgu

SEQ ID NO: 4002719 - RNA, 16 nt, Human herpesvirus 8 [Kaposi`s sarcoma-associated h
ugaaugcuuccgcgac

SEQ ID NO: 4002720 - RNA, 14 nt, Human herpesvirus 8 [Kaposi`s sarcoma-associated h
ugaccaacaggcug

SEQ ID NO: 4002721 - RNA, 15 nt, Human herpesvirus 8 [Kaposi`s sarcoma-associated h
ugacgcccugggugu

SEQ ID NO: 4002722 - RNA, 19 nt, Human herpesvirus 8 [Kaposi`s sarcoma-associated h
ugagagcuggagggcacag

SEQ ID NO: 4002723 - RNA, 15 nt, Human herpesvirus 8 [Kaposi`s sarcoma-associated h
ugagauagccacaua

SEQ ID NO: 4002724 - RNA, 16 nt, Human herpesvirus 8 [Kaposi`s sarcoma-associated h
ugagugggacaucauu

SEQ ID NO: 4002725 - RNA, 21 nt, Human herpesvirus 8 [Kaposi`s sarcoma-associated h
ugauuugauacagggacagau

SEQ ID NO: 4002726 - RNA, 12 nt, Human herpesvirus 8 [Kaposi`s sarcoma-associated h
ugauuuuccagg

SEQ ID NO: 4002727 - RNA, 18 nt, Human herpesvirus 8 [Kaposi`s sarcoma-associated h
ugcaaagcuuaaccacau

SEQ ID NO: 4002728 - RNA, 15 nt, Human herpesvirus 8 [Kaposi`s sarcoma-associated h
ugcaaccugcugcag

SEQ ID NO: 4002729 - RNA, 17 nt, Human herpesvirus 8 [Kaposi`s sarcoma-associated h
ugcaauacccuguuuca

SEQ ID NO: 4002730 - RNA, 13 nt, Human herpesvirus 8 [Kaposi`s sarcoma-associated h
ugcagccagguaa

SEQ ID NO: 4002731 - RNA, 14 nt, Human herpesvirus 8 [Kaposi`s sarcoma-associated h
ugcagugugcagua

SEQ ID NO: 4002732 - RNA, 13 nt, Human herpesvirus 8 [Kaposi`s sarcoma-associated h
ugcauauggacug

SEQ ID NO: 4002733 - RNA, 21 nt, Human herpesvirus 8 [Kaposi`s sarcoma-associated h
ugcaugcaauacccuguuuca

SEQ ID NO: 4002734 - RNA, 19 nt, Human herpesvirus 8 [Kaposi`s sarcoma-associated h
ugccaccguuuacaaaaua

SEQ ID NO: 4002735 - RNA, 23 nt, Human herpesvirus 8 [Kaposi`s sarcoma-associated h
ugcccacuguuguggaaagcucc

SEQ ID NO: 4002736 - RNA, 17 nt, Human herpesvirus 8 [Kaposi`s sarcoma-associated h
ugccuucgaggccaggc

SEQ ID NO: 4002737 - RNA, 22 nt, Human herpesvirus 8 [Kaposi`s sarcoma-associated h
uggaggcacauaaggaacagau

SEQ ID NO: 4002738 - RNA, 14 nt, Human herpesvirus 8 [Kaposi`s sarcoma-associated h
uggauggggcaugg

SEQ ID NO: 4002739 - RNA, 21 nt, Human herpesvirus 8 [Kaposi`s sarcoma-associated h
uggcaagaaauccgagcaccu

SEQ ID NO: 4002740 - RNA, 11 nt, Human herpesvirus 8 [Kaposi`s sarcoma-associated h
uggcaugcugg

SEQ ID NO: 4002741 - RNA, 12 nt, Human herpesvirus 8 [Kaposi`s sarcoma-associated h
uggcgccaccuu

SEQ ID NO: 4002742 - RNA, 19 nt, Human herpesvirus 8 [Kaposi`s sarcoma-associated h
uggcgcggaaacugggcac

SEQ ID NO: 4002743 - RNA, 13 nt, Human herpesvirus 8 [Kaposi`s sarcoma-associated h
uggcgucaucuga

SEQ ID NO: 4002744 - RNA, 14 nt, Human herpesvirus 8 [Kaposi`s sarcoma-associated h
uggcgugccagugg

SEQ ID NO: 4002745 - RNA, 12 nt, Human herpesvirus 8 [Kaposi`s sarcoma-associated h
uggcuguuacaa

SEQ ID NO: 4002746 - RNA, 22 nt, Human herpesvirus 8 [Kaposi`s sarcoma-associated h
ugggcuucauuaugcaugcaau

SEQ ID NO: 4002747 - RNA, 15 nt, Human herpesvirus 8 [Kaposi`s sarcoma-associated h
ugggggauccacuca

SEQ ID NO: 4002748 - RNA, 19 nt, Human herpesvirus 8 [Kaposi`s sarcoma-associated h
ugggucuaucuggaaaaca

SEQ ID NO: 4002749 - RNA, 22 nt, Human herpesvirus 8 [Kaposi`s sarcoma-associated h
uggguguuaugcaccgugcagg

SEQ ID NO: 4002750 - RNA, 20 nt, Human herpesvirus 8 [Kaposi`s sarcoma-associated h
ugguggacggcuccguccug

SEQ ID NO: 4002751 - RNA, 12 nt, Human herpesvirus 8 [Kaposi`s sarcoma-associated h
uguaaaaaacuu

SEQ ID NO: 4002752 - RNA, 21 nt, Human herpesvirus 8 [Kaposi`s sarcoma-associated h
ugucacaaauuuuaacagcca

SEQ ID NO: 4002753 - RNA, 16 nt, Human herpesvirus 8 [Kaposi`s sarcoma-associated h
ugucccgugcccaggc

SEQ ID NO: 4002754 - RNA, 19 nt, Human herpesvirus 8 [Kaposi`s sarcoma-associated h
ugucgcaggccgaauaccu

SEQ ID NO: 4002755 - RNA, 13 nt, Human herpesvirus 8 [Kaposi`s sarcoma-associated h
ugucugauucuua

SEQ ID NO: 4002756 - RNA, 13 nt, Human herpesvirus 8 [Kaposi`s sarcoma-associated h
ugugugaagcagu

SEQ ID NO: 4002757 - RNA, 21 nt, Human herpesvirus 8 [Kaposi`s sarcoma-associated h
uuaacgugucugaauguggaa

SEQ ID NO: 4002758 - RNA, 21 nt, Human herpesvirus 8 [Kaposi`s sarcoma-associated h
uuaacuucaccuccagacucu

SEQ ID NO: 4002759 - RNA, 13 nt, Human herpesvirus 8 [Kaposi`s sarcoma-associated h
uuaggggcacccu

SEQ ID NO: 4002760 - RNA, 17 nt, Human herpesvirus 8 [Kaposi`s sarcoma-associated h
uuaucuuugcagugucu

SEQ ID NO: 4002761 - RNA, 21 nt, Human herpesvirus 8 [Kaposi`s sarcoma-associated h
uuccaagagcgagugugccuc

SEQ ID NO: 4002762 - RNA, 13 nt, Human herpesvirus 8 [Kaposi`s sarcoma-associated h
uuccucuugcgcu

SEQ ID NO: 4002763 - RNA, 22 nt, Human herpesvirus 8 [Kaposi`s sarcoma-associated h
uucuaaucuuagucuuacuguc

SEQ ID NO: 4002764 - RNA, 20 nt, Human herpesvirus 8 [Kaposi`s sarcoma-associated h
uugaaaaaaaauaaacauac

SEQ ID NO: 4002765 - RNA, 19 nt, Human herpesvirus 8 [Kaposi`s sarcoma-associated h
uugagaagcaguuucagga

SEQ ID NO: 4002766 - RNA, 17 nt, Human herpesvirus 8 [Kaposi`s sarcoma-associated h
uugcacucagaacauaa

SEQ ID NO: 4002767 - RNA, 13 nt, Human herpesvirus 8 [Kaposi`s sarcoma-associated h
uugcagugugcag

SEQ ID NO: 4002768 - RNA, 14 nt, Human herpesvirus 8 [Kaposi`s sarcoma-associated h
uuggagaaacagug

SEQ ID NO: 4002769 - RNA, 18 nt, Human herpesvirus 8 [Kaposi`s sarcoma-associated h
uuggcguuuaccugcacu

SEQ ID NO: 4002770 - RNA, 17 nt, Human herpesvirus 8 [Kaposi`s sarcoma-associated h
uuggcuguuacaauaaa

SEQ ID NO: 4002771 - RNA, 16 nt, Human herpesvirus 8 [Kaposi`s sarcoma-associated h
uugggauucacucagc

SEQ ID NO: 4002772 - RNA, 14 nt, Human herpesvirus 8 [Kaposi`s sarcoma-associated h
uugugaagcauuuu

SEQ ID NO: 4002773 - RNA, 19 nt, Human herpesvirus 8 [Kaposi`s sarcoma-associated h
uugugcucgacggagacac

SEQ ID NO: 4002774 - RNA, 20 nt, Human herpesvirus 8 [Kaposi`s sarcoma-associated h
uuguuaugggagggaguaua

SEQ ID NO: 4002775 - RNA, 13 nt, Human herpesvirus 8 [Kaposi`s sarcoma-associated h
uuuacuugcagca

SEQ ID NO: 4002776 - RNA, 12 nt, Human herpesvirus 8 [Kaposi`s sarcoma-associated h
cgccccuggugg

SEQ ID NO: 4002777 - RNA, 15 nt, Human herpesvirus 8 [Kaposi`s sarcoma-associated h
cgcggauaggcuggg

SEQ ID NO: 4002778 - RNA, 18 nt, Human herpesvirus 8 [Kaposi`s sarcoma-associated h
cgcggugucaaccaggcc

SEQ ID NO: 4002779 - RNA, 14 nt, Human herpesvirus 8 [Kaposi`s sarcoma-associated h
cgcugcgcauggcu

SEQ ID NO: 4002780 - RNA, 15 nt, Human herpesvirus 8 [Kaposi`s sarcoma-associated h
cgcugcgucucccuc

SEQ ID NO: 4002781 - RNA, 19 nt, Human herpesvirus 8 [Kaposi`s sarcoma-associated h
cgcugucccgugcccaggc

SEQ ID NO: 4002782 - RNA, 17 nt, Human herpesvirus 8 [Kaposi`s sarcoma-associated h
cggaaacugggcacgga

SEQ ID NO: 4002783 - RNA, 19 nt, Human herpesvirus 8 [Kaposi`s sarcoma-associated h
cggaucaugcucucaccgc

SEQ ID NO: 4002784 - RNA, 11 nt, Human herpesvirus 8 [Kaposi`s sarcoma-associated h
cggcagcaccu

SEQ ID NO: 4002785 - RNA, 19 nt, Human herpesvirus 8 [Kaposi`s sarcoma-associated h
cggcgcaaaaacagcugga

SEQ ID NO: 4002786 - RNA, 12 nt, Human herpesvirus 8 [Kaposi`s sarcoma-associated h
cggcgcgccugu

SEQ ID NO: 4002787 - RNA, 21 nt, Human herpesvirus 8 [Kaposi`s sarcoma-associated h
cggcgucaccgacaccaucuc

SEQ ID NO: 4002788 - RNA, 15 nt, Human herpesvirus 8 [Kaposi`s sarcoma-associated h
cgggagaaccaugcc

SEQ ID NO: 4002789 - RNA, 22 nt, Human herpesvirus 8 [Kaposi`s sarcoma-associated h
cgggagcuucggaaagcacugg

SEQ ID NO: 4002790 - RNA, 19 nt, Human herpesvirus 8 [Kaposi`s sarcoma-associated h
cggggauggacgcggccuu

SEQ ID NO: 4002791 - RNA, 12 nt, Human herpesvirus 8 [Kaposi`s sarcoma-associated h
cgggggccagga

SEQ ID NO: 4002792 - RNA, 14 nt, Human herpesvirus 8 [Kaposi`s sarcoma-associated h
cgggguuuccaggg

SEQ ID NO: 4002793 - RNA, 13 nt, Human herpesvirus 8 [Kaposi`s sarcoma-associated h
cgguagcugccug

SEQ ID NO: 4002794 - RNA, 18 nt, Human herpesvirus 8 [Kaposi`s sarcoma-associated h
cgguaguugugcuuccug

SEQ ID NO: 4002795 - RNA, 13 nt, Human herpesvirus 8 [Kaposi`s sarcoma-associated h
cggucgccagggu

SEQ ID NO: 4002796 - RNA, 21 nt, Human herpesvirus 8 [Kaposi`s sarcoma-associated h
cggugaccacgcacuauagug

SEQ ID NO: 4002797 - RNA, 15 nt, Human herpesvirus 8 [Kaposi`s sarcoma-associated h
cggugcugcccagga

SEQ ID NO: 4002798 - RNA, 16 nt, Human herpesvirus 8 [Kaposi`s sarcoma-associated h
gcggucagaguggugg

SEQ ID NO: 4002799 - RNA, 17 nt, Human herpesvirus 8 [Kaposi`s sarcoma-associated h
gcguccacauggcagcu

SEQ ID NO: 4002800 - RNA, 12 nt, Human herpesvirus 8 [Kaposi`s sarcoma-associated h
gcgucuuggggg

SEQ ID NO: 4002801 - RNA, 16 nt, Human herpesvirus 8 [Kaposi`s sarcoma-associated h
gcuaggauucgugcag

SEQ ID NO: 4002802 - RNA, 14 nt, Human herpesvirus 8 [Kaposi`s sarcoma-associated h
gcuauaggacagaa

SEQ ID NO: 4002803 - RNA, 13 nt, Human herpesvirus 8 [Kaposi`s sarcoma-associated h
gcucccgugcguu

SEQ ID NO: 4002804 - RNA, 15 nt, Human herpesvirus 8 [Kaposi`s sarcoma-associated h
gcucucgcugcucag

SEQ ID NO: 4002805 - RNA, 12 nt, Human herpesvirus 8 [Kaposi`s sarcoma-associated h
gcugcagccagg

SEQ ID NO: 4002806 - RNA, 14 nt, Human herpesvirus 8 [Kaposi`s sarcoma-associated h
gcugcagccaggaa

SEQ ID NO: 4002807 - RNA, 15 nt, Human herpesvirus 8 [Kaposi`s sarcoma-associated h
gcugcagccaggaag

SEQ ID NO: 4002808 - RNA, 16 nt, Human herpesvirus 8 [Kaposi`s sarcoma-associated h
gcugcagcuggacugg

SEQ ID NO: 4002809 - RNA, 13 nt, Human herpesvirus 8 [Kaposi`s sarcoma-associated h
gcugcucagacag

SEQ ID NO: 4002810 - RNA, 16 nt, Human herpesvirus 8 [Kaposi`s sarcoma-associated h
gcugucccgugcccag

SEQ ID NO: 4002811 - RNA, 13 nt, Human herpesvirus 8 [Kaposi`s sarcoma-associated h
gcuguggcaccaa

SEQ ID NO: 4002812 - RNA, 16 nt, Human herpesvirus 8 [Kaposi`s sarcoma-associated h
ggaagucgguggggau

SEQ ID NO: 4002813 - RNA, 20 nt, Human herpesvirus 8 [Kaposi`s sarcoma-associated h
ggaauacguccgucgguagc

SEQ ID NO: 4002814 - RNA, 17 nt, Human herpesvirus 8 [Kaposi`s sarcoma-associated h
ggacaauugucggauuu

SEQ ID NO: 4002815 - RNA, 17 nt, Human herpesvirus 8 [Kaposi`s sarcoma-associated h
ggacacugaacccuggg

SEQ ID NO: 4002816 - RNA, 20 nt, Human herpesvirus 8 [Kaposi`s sarcoma-associated h
ggacccagggugccuuggac

SEQ ID NO: 4002817 - RNA, 23 nt, Human herpesvirus 8 [Kaposi`s sarcoma-associated h
ggacuugauaaucuccuggagaa

SEQ ID NO: 4002818 - RNA, 23 nt, Human herpesvirus 8 [Kaposi`s sarcoma-associated h
ggagugcugaccacggcacagga

SEQ ID NO: 4002819 - RNA, 13 nt, Human herpesvirus 8 [Kaposi`s sarcoma-associated h
ggauccacucagg

SEQ ID NO: 4002820 - RNA, 20 nt, Human herpesvirus 8 [Kaposi`s sarcoma-associated h
ggaucgaacagaagacccag

SEQ ID NO: 4002821 - RNA, 21 nt, Human herpesvirus 8 [Kaposi`s sarcoma-associated h
ggaucucuaacgauacccaug

SEQ ID NO: 4002822 - RNA, 19 nt, Human herpesvirus 8 [Kaposi`s sarcoma-associated h
ggaugcacaguauagggau

SEQ ID NO: 4002823 - RNA, 13 nt, Human herpesvirus 8 [Kaposi`s sarcoma-associated h
ggcaccauggcca

SEQ ID NO: 4002824 - RNA, 18 nt, Human herpesvirus 8 [Kaposi`s sarcoma-associated h
aaaauaacgggggaugga

SEQ ID NO: 4002825 - RNA, 18 nt, Human herpesvirus 8 [Kaposi`s sarcoma-associated h
aaacguguccugccaggg

SEQ ID NO: 4002826 - RNA, 16 nt, Human herpesvirus 8 [Kaposi`s sarcoma-associated h
aaacuaaucaguguua

SEQ ID NO: 4002827 - RNA, 22 nt, Human herpesvirus 8 [Kaposi`s sarcoma-associated h
aaagcagcgcccacugguguau

SEQ ID NO: 4002828 - RNA, 14 nt, Human herpesvirus 8 [Kaposi`s sarcoma-associated h
aaagcugagccaca

SEQ ID NO: 4002829 - RNA, 15 nt, Human herpesvirus 8 [Kaposi`s sarcoma-associated h
aaagcugagccacaa

SEQ ID NO: 4002830 - RNA, 20 nt, Human herpesvirus 8 [Kaposi`s sarcoma-associated h
aacauauguuaaacacgucg

SEQ ID NO: 4002831 - RNA, 15 nt, Human herpesvirus 8 [Kaposi`s sarcoma-associated h
aacaugcaacaagca

SEQ ID NO: 4002832 - RNA, 18 nt, Human herpesvirus 8 [Kaposi`s sarcoma-associated h
aacggcuagcguacucuc

SEQ ID NO: 4002833 - RNA, 17 nt, Human herpesvirus 8 [Kaposi`s sarcoma-associated h
aacuaaacauuaccaau

SEQ ID NO: 4002834 - RNA, 21 nt, Human herpesvirus 8 [Kaposi`s sarcoma-associated h
aacugucuccagaagagcauu

SEQ ID NO: 4002835 - RNA, 17 nt, Human herpesvirus 8 [Kaposi`s sarcoma-associated h
aagaggacccagggugc

SEQ ID NO: 4002836 - RNA, 21 nt, Human herpesvirus 8 [Kaposi`s sarcoma-associated h
aagcauccggacugagauuuc

SEQ ID NO: 4002837 - RNA, 14 nt, Human herpesvirus 8 [Kaposi`s sarcoma-associated h
aagccgagccacaa

SEQ ID NO: 4002838 - RNA, 16 nt, Human herpesvirus 8 [Kaposi`s sarcoma-associated h
aaggacauuguauaac

SEQ ID NO: 4002839 - RNA, 22 nt, Human herpesvirus 8 [Kaposi`s sarcoma-associated h
aaggcuacgugaguuacaugga

SEQ ID NO: 4002840 - RNA, 23 nt, Human herpesvirus 8 [Kaposi`s sarcoma-associated h
aagggccaagcuacuggccuggc

SEQ ID NO: 4002841 - RNA, 17 nt, Human herpesvirus 8 [Kaposi`s sarcoma-associated h
aagguaggccagcugcg

SEQ ID NO: 4002842 - RNA, 16 nt, Human herpesvirus 8 [Kaposi`s sarcoma-associated h
aaggucaccuggccca

SEQ ID NO: 4002843 - RNA, 18 nt, Human herpesvirus 8 [Kaposi`s sarcoma-associated h
aauauaacagcaacaugu

SEQ ID NO: 4002844 - RNA, 13 nt, Human herpesvirus 8 [Kaposi`s sarcoma-associated h
aaucuccuggaga

SEQ ID NO: 4002845 - RNA, 17 nt, Human herpesvirus 8 [Kaposi`s sarcoma-associated h
aaucuggcaugcuggga

SEQ ID NO: 4002846 - RNA, 10 nt, Human herpesvirus 8 [Kaposi`s sarcoma-associated h
aaugugacaa

SEQ ID NO: 4002847 - RNA, 15 nt, Human herpesvirus 8 [Kaposi`s sarcoma-associated h
aauguuuuggucucu

SEQ ID NO: 4002848 - RNA, 12 nt, Human herpesvirus 8 [Kaposi`s sarcoma-associated h
acaaaccaaauu

SEQ ID NO: 4002849 - RNA, 19 nt, Human herpesvirus 8 [Kaposi`s sarcoma-associated h
acaacuuguccggagcugc

SEQ ID NO: 4002850 - RNA, 11 nt, Human herpesvirus 8 [Kaposi`s sarcoma-associated h
acaauaaagcu

SEQ ID NO: 4002851 - RNA, 16 nt, Human herpesvirus 8 [Kaposi`s sarcoma-associated h
acaauagggauacugu

SEQ ID NO: 4002852 - RNA, 15 nt, Human herpesvirus 8 [Kaposi`s sarcoma-associated h
acacacacaaagaca

SEQ ID NO: 4002853 - RNA, 17 nt, Human herpesvirus 8 [Kaposi`s sarcoma-associated h
acacauuugucuuuauu

SEQ ID NO: 4002854 - RNA, 21 nt, Human herpesvirus 8 [Kaposi`s sarcoma-associated h
acaccauucuuuuauuuauca

SEQ ID NO: 4002855 - RNA, 15 nt, Human herpesvirus 8 [Kaposi`s sarcoma-associated h
acacggaaggcagug

SEQ ID NO: 4002856 - RNA, 17 nt, Human herpesvirus 8 [Kaposi`s sarcoma-associated h
acacuaaaagucuggcc

SEQ ID NO: 4002857 - RNA, 19 nt, Human herpesvirus 8 [Kaposi`s sarcoma-associated h
acacuguggauuuuaugga

SEQ ID NO: 4002858 - RNA, 17 nt, Human herpesvirus 8 [Kaposi`s sarcoma-associated h
acacuuccaccuccccu

SEQ ID NO: 4002859 - RNA, 15 nt, Human herpesvirus 8 [Kaposi`s sarcoma-associated h
acagacgacugggcc

SEQ ID NO: 4002860 - RNA, 22 nt, Human herpesvirus 8 [Kaposi`s sarcoma-associated h
acagccuuggugcuaggcaguc

SEQ ID NO: 4002861 - RNA, 19 nt, Human herpesvirus 8 [Kaposi`s sarcoma-associated h
acagucuguaaagaaagua

SEQ ID NO: 4002862 - RNA, 19 nt, Human herpesvirus 8 [Kaposi`s sarcoma-associated h
acauaauccccggcagcac

SEQ ID NO: 4002863 - RNA, 21 nt, Human herpesvirus 8 [Kaposi`s sarcoma-associated h
acauagugacuguagacaguu

SEQ ID NO: 4002864 - RNA, 23 nt, Human herpesvirus 8 [Kaposi`s sarcoma-associated h
acauauugguauaugacuacugu

SEQ ID NO: 4002865 - RNA, 20 nt, Human herpesvirus 8 [Kaposi`s sarcoma-associated h
acaucuguguacaaaccaaa

SEQ ID NO: 4002866 - RNA, 20 nt, Human herpesvirus 8 [Kaposi`s sarcoma-associated h
acauugaggaccuugucaca

SEQ ID NO: 4002867 - RNA, 12 nt, Human herpesvirus 8 [Kaposi`s sarcoma-associated h
accaaaccuggu

SEQ ID NO: 4002868 - RNA, 20 nt, Human herpesvirus 8 [Kaposi`s sarcoma-associated h
accacauuuccacccaccua

SEQ ID NO: 4002869 - RNA, 21 nt, Human herpesvirus 8 [Kaposi`s sarcoma-associated h
accacucuuuaucaugugaac

SEQ ID NO: 4002870 - RNA, 21 nt, Human herpesvirus 8 [Kaposi`s sarcoma-associated h
accagagcgacgcgggucuca

SEQ ID NO: 4002871 - RNA, 21 nt, Human herpesvirus 8 [Kaposi`s sarcoma-associated h
accaggcaacacaagggugaa

SEQ ID NO: 4002872 - RNA, 10 nt, Human herpesvirus 8 [Kaposi`s sarcoma-associated h
accaguaaag

SEQ ID NO: 4002873 - RNA, 19 nt, Human herpesvirus 8 [Kaposi`s sarcoma-associated h
accccagccccuugguucc

SEQ ID NO: 4002874 - RNA, 13 nt, Human herpesvirus 8 [Kaposi`s sarcoma-associated h
acccgagccacau

SEQ ID NO: 4002875 - RNA, 16 nt, Human herpesvirus 8 [Kaposi`s sarcoma-associated h
acccuacuuagugaaa

SEQ ID NO: 4002876 - RNA, 14 nt, Human herpesvirus 8 [Kaposi`s sarcoma-associated h
acccugauuagcac

SEQ ID NO: 4002877 - RNA, 17 nt, Human herpesvirus 8 [Kaposi`s sarcoma-associated h
acccugccaaaugccca

SEQ ID NO: 4002878 - RNA, 18 nt, Human herpesvirus 8 [Kaposi`s sarcoma-associated h
accggaguagugcaagug

SEQ ID NO: 4002879 - RNA, 15 nt, Human herpesvirus 8 [Kaposi`s sarcoma-associated h
accggcaucugcaag

SEQ ID NO: 4002880 - RNA, 18 nt, Human herpesvirus 8 [Kaposi`s sarcoma-associated h
accgucgcacccggccgc

SEQ ID NO: 4002881 - RNA, 21 nt, Human herpesvirus 8 [Kaposi`s sarcoma-associated h
accugccggacacugaacccu

SEQ ID NO: 4002882 - RNA, 17 nt, Human herpesvirus 8 [Kaposi`s sarcoma-associated h
acgagguugggaagagg

SEQ ID NO: 4002883 - RNA, 21 nt, Human herpesvirus 8 [Kaposi`s sarcoma-associated h
acgauguacuugaacagggca

SEQ ID NO: 4002884 - RNA, 17 nt, Human herpesvirus 8 [Kaposi`s sarcoma-associated h
acgcguuaagaagccac

SEQ ID NO: 4002885 - RNA, 20 nt, Human herpesvirus 8 [Kaposi`s sarcoma-associated h
acgcguuaucuccugcucau

SEQ ID NO: 4002886 - RNA, 17 nt, Human herpesvirus 8 [Kaposi`s sarcoma-associated h
acggccaccgagaagga

SEQ ID NO: 4002887 - RNA, 20 nt, Human herpesvirus 8 [Kaposi`s sarcoma-associated h
acggugucguguaugccaau

SEQ ID NO: 4002888 - RNA, 16 nt, Human herpesvirus 8 [Kaposi`s sarcoma-associated h
acgugcaccagcucag

SEQ ID NO: 4002889 - RNA, 13 nt, Human herpesvirus 8 [Kaposi`s sarcoma-associated h
acuacagguauac

SEQ ID NO: 4002890 - RNA, 21 nt, Human herpesvirus 8 [Kaposi`s sarcoma-associated h
acuaugggugaccacauaauu

SEQ ID NO: 4002891 - RNA, 23 nt, Human herpesvirus 8 [Kaposi`s sarcoma-associated h
acucuguguccuccucugaguuu

SEQ ID NO: 4002892 - RNA, 15 nt, Human herpesvirus 8 [Kaposi`s sarcoma-associated h
acugaacccugggug

SEQ ID NO: 4002893 - RNA, 13 nt, Human herpesvirus 8 [Kaposi`s sarcoma-associated h
acugaucacugcg

SEQ ID NO: 4002894 - RNA, 13 nt, Human herpesvirus 8 [Kaposi`s sarcoma-associated h
acugcccuccauc

SEQ ID NO: 4002895 - RNA, 16 nt, Human herpesvirus 8 [Kaposi`s sarcoma-associated h
acuuaacuguuuacug

SEQ ID NO: 4002896 - RNA, 14 nt, Human herpesvirus 8 [Kaposi`s sarcoma-associated h
agaauacagugcua

SEQ ID NO: 4002897 - RNA, 17 nt, Human herpesvirus 8 [Kaposi`s sarcoma-associated h
agacaaacaugugggcu

SEQ ID NO: 4002898 - RNA, 20 nt, Human herpesvirus 8 [Kaposi`s sarcoma-associated h
agacauagugacuguagaca

SEQ ID NO: 4002899 - RNA, 19 nt, Human herpesvirus 8 [Kaposi`s sarcoma-associated h
agacggucuuuaggggcac

SEQ ID NO: 4002900 - RNA, 14 nt, Human herpesvirus 8 [Kaposi`s sarcoma-associated h
agagaagagaccac

SEQ ID NO: 4002901 - RNA, 14 nt, Human herpesvirus 8 [Kaposi`s sarcoma-associated h
agagacccugggcg

SEQ ID NO: 4002902 - RNA, 13 nt, Human herpesvirus 8 [Kaposi`s sarcoma-associated h
agagccagccugg

SEQ ID NO: 4002903 - RNA, 12 nt, Human herpesvirus 8 [Kaposi`s sarcoma-associated h
agauagccacau

SEQ ID NO: 4002904 - RNA, 14 nt, Human herpesvirus 8 [Kaposi`s sarcoma-associated h
agauggguccguau

SEQ ID NO: 4002905 - RNA, 18 nt, Human herpesvirus 8 [Kaposi`s sarcoma-associated h
agcacuuuuugaagcccu

SEQ ID NO: 4002906 - RNA, 15 nt, Human herpesvirus 8 [Kaposi`s sarcoma-associated h
agcagacgugcccag

SEQ ID NO: 4002907 - RNA, 19 nt, Human herpesvirus 8 [Kaposi`s sarcoma-associated h
agccagguaacaaagccgc

SEQ ID NO: 4002908 - RNA, 13 nt, Human herpesvirus 8 [Kaposi`s sarcoma-associated h
agccgccaggaac

SEQ ID NO: 4002909 - RNA, 19 nt, Human herpesvirus 8 [Kaposi`s sarcoma-associated h
agccgcgcuuuuuaacuuc

SEQ ID NO: 4002910 - RNA, 17 nt, Human herpesvirus 8 [Kaposi`s sarcoma-associated h
agccgcuugcugauaua

SEQ ID NO: 4002911 - RNA, 18 nt, Human herpesvirus 8 [Kaposi`s sarcoma-associated h
agcgggguuuccagggaa

SEQ ID NO: 4002912 - RNA, 14 nt, Human herpesvirus 8 [Kaposi`s sarcoma-associated h
agcugcagccagga

SEQ ID NO: 4002913 - RNA, 14 nt, Human herpesvirus 8 [Kaposi`s sarcoma-associated h
aggaagcauccgga

SEQ ID NO: 4002914 - RNA, 18 nt, Human herpesvirus 8 [Kaposi`s sarcoma-associated h
aggcgcugaaaagggaac

SEQ ID NO: 4002915 - RNA, 22 nt, Human herpesvirus 8 [Kaposi`s sarcoma-associated h
agggaaguuucagagccuucac

SEQ ID NO: 4002916 - RNA, 19 nt, Human herpesvirus 8 [Kaposi`s sarcoma-associated h
agggcaugaggcuggaccu

SEQ ID NO: 4002917 - RNA, 21 nt, Human herpesvirus 8 [Kaposi`s sarcoma-associated h
aggggaguaggguaggaaggg

SEQ ID NO: 4002918 - RNA, 14 nt, Human herpesvirus 8 [Kaposi`s sarcoma-associated h
aggguaacucugaa

SEQ ID NO: 4002919 - RNA, 23 nt, Human herpesvirus 8 [Kaposi`s sarcoma-associated h
agggugccuuggacggacggcac

SEQ ID NO: 4002920 - RNA, 19 nt, Human herpesvirus 8 [Kaposi`s sarcoma-associated h
agggugcgaaggaccugau

SEQ ID NO: 4002921 - RNA, 18 nt, Human herpesvirus 8 [Kaposi`s sarcoma-associated h
agguucacuugggagcug

SEQ ID NO: 4002922 - RNA, 20 nt, Human herpesvirus 8 [Kaposi`s sarcoma-associated h
agguuguaacacaaaagcaa

SEQ ID NO: 4002923 - RNA, 20 nt, Human herpesvirus 8 [Kaposi`s sarcoma-associated h
agucacgcacuuggcccuga

SEQ ID NO: 4002924 - RNA, 20 nt, Human herpesvirus 8 [Kaposi`s sarcoma-associated h
agucgccgguagcugccugg

SEQ ID NO: 4002925 - RNA, 24 nt, Human herpesvirus 8 [Kaposi`s sarcoma-associated h
agucgggacucgcgcaugcgugaa

SEQ ID NO: 4002926 - RNA, 19 nt, Human herpesvirus 8 [Kaposi`s sarcoma-associated h
agugcacacucgcuguccu

SEQ ID NO: 4002927 - RNA, 12 nt, Human herpesvirus 8 [Kaposi`s sarcoma-associated h
agugccuggcau

SEQ ID NO: 4002928 - RNA, 13 nt, Human herpesvirus 8 [Kaposi`s sarcoma-associated h
aguggaguggugu

SEQ ID NO: 4002929 - RNA, 23 nt, Human herpesvirus 8 [Kaposi`s sarcoma-associated h
agugguuauuuuuuuccuaggcg

SEQ ID NO: 4002930 - RNA, 16 nt, Human herpesvirus 8 [Kaposi`s sarcoma-associated h
aguuaaagcugucacu

SEQ ID NO: 4002931 - RNA, 22 nt, Human herpesvirus 8 [Kaposi`s sarcoma-associated h
aguugaucgauuucuguauaca

SEQ ID NO: 4002932 - RNA, 16 nt, Human herpesvirus 8 [Kaposi`s sarcoma-associated h
aguuucagagccuuca

SEQ ID NO: 4002933 - RNA, 15 nt, Human herpesvirus 8 [Kaposi`s sarcoma-associated h
auaaaaugggccaug

SEQ ID NO: 4002934 - RNA, 23 nt, Human herpesvirus 8 [Kaposi`s sarcoma-associated h
auaaacagccuuggugcuaggca

SEQ ID NO: 4002935 - RNA, 13 nt, Human herpesvirus 8 [Kaposi`s sarcoma-associated h
auacaaaaacaca

SEQ ID NO: 4002936 - RNA, 17 nt, Human herpesvirus 8 [Kaposi`s sarcoma-associated h
auacccuggaucaggga

SEQ ID NO: 4002937 - RNA, 12 nt, Human herpesvirus 8 [Kaposi`s sarcoma-associated h
auacuuggcaag

SEQ ID NO: 4002938 - RNA, 13 nt, Human herpesvirus 8 [Kaposi`s sarcoma-associated h
auagcgcucugcc

SEQ ID NO: 4002939 - RNA, 18 nt, Human herpesvirus 8 [Kaposi`s sarcoma-associated h
auagggggaugagccaga

SEQ ID NO: 4002940 - RNA, 12 nt, Human herpesvirus 8 [Kaposi`s sarcoma-associated h
auauaaugugaa

SEQ ID NO: 4002941 - RNA, 17 nt, Human herpesvirus 8 [Kaposi`s sarcoma-associated h
aucacgccauaccccug

SEQ ID NO: 4002942 - RNA, 14 nt, Human herpesvirus 8 [Kaposi`s sarcoma-associated h
aucagaacaguggu

SEQ ID NO: 4002943 - RNA, 16 nt, Human herpesvirus 8 [Kaposi`s sarcoma-associated h
aucaggagggucaaug

SEQ ID NO: 4002944 - RNA, 12 nt, Human herpesvirus 8 [Kaposi`s sarcoma-associated h
aucaucgguagc

SEQ ID NO: 4002945 - RNA, 19 nt, Human herpesvirus 8 [Kaposi`s sarcoma-associated h
aucugcugucuaguggaga

SEQ ID NO: 4002946 - RNA, 19 nt, Human herpesvirus 8 [Kaposi`s sarcoma-associated h
aucugguugacacccugga

SEQ ID NO: 4002947 - RNA, 18 nt, Human herpesvirus 8 [Kaposi`s sarcoma-associated h
aucuuugcagugucuaug

SEQ ID NO: 4002948 - RNA, 15 nt, Human herpesvirus 8 [Kaposi`s sarcoma-associated h
augacaacugccaca

SEQ ID NO: 4002949 - RNA, 18 nt, Human herpesvirus 8 [Kaposi`s sarcoma-associated h
augacaccccucccucgc

SEQ ID NO: 4002950 - RNA, 14 nt, Human herpesvirus 8 [Kaposi`s sarcoma-associated h
augacagggaagug

SEQ ID NO: 4002951 - RNA, 20 nt, Human herpesvirus 8 [Kaposi`s sarcoma-associated h
augcagcagcgugacacuac

SEQ ID NO: 4002952 - RNA, 19 nt, Human herpesvirus 8 [Kaposi`s sarcoma-associated h
augcccaacuucaucacau

SEQ ID NO: 4002953 - RNA, 22 nt, Human herpesvirus 8 [Kaposi`s sarcoma-associated h
augccuacaccguauuguuaug

SEQ ID NO: 4002954 - RNA, 17 nt, Human herpesvirus 8 [Kaposi`s sarcoma-associated h
augcucaggucugucac

SEQ ID NO: 4002955 - RNA, 17 nt, Human herpesvirus 8 [Kaposi`s sarcoma-associated h
auggccggcacgcggug

SEQ ID NO: 4002956 - RNA, 15 nt, Human herpesvirus 8 [Kaposi`s sarcoma-associated h
augggugugugccag

SEQ ID NO: 4002957 - RNA, 11 nt, Human herpesvirus 8 [Kaposi`s sarcoma-associated h
auguaaauugg

SEQ ID NO: 4002958 - RNA, 21 nt, Human herpesvirus 8 [Kaposi`s sarcoma-associated h
augucucgugacggugacauu

SEQ ID NO: 4002959 - RNA, 21 nt, Human herpesvirus 8 [Kaposi`s sarcoma-associated h
augucuuuccgugucuccuug

SEQ ID NO: 4002960 - RNA, 14 nt, Human herpesvirus 8 [Kaposi`s sarcoma-associated h
augugacugaacau

SEQ ID NO: 4002961 - RNA, 16 nt, Human herpesvirus 8 [Kaposi`s sarcoma-associated h
auuaaagcacucggug

SEQ ID NO: 4002962 - RNA, 14 nt, Human herpesvirus 8 [Kaposi`s sarcoma-associated h
auuaacaaacaagg

SEQ ID NO: 4002963 - RNA, 14 nt, Human herpesvirus 8 [Kaposi`s sarcoma-associated h
auuaagggggaagg

SEQ ID NO: 4002964 - RNA, 21 nt, Human herpesvirus 8 [Kaposi`s sarcoma-associated h
auuaugguuccguucuccuuc

SEQ ID NO: 4002965 - RNA, 14 nt, Human herpesvirus 8 [Kaposi`s sarcoma-associated h
auugacuguggaga

SEQ ID NO: 4002966 - RNA, 13 nt, Human herpesvirus 8 [Kaposi`s sarcoma-associated h
auugccaccucug

SEQ ID NO: 4002967 - RNA, 11 nt, Human herpesvirus 8 [Kaposi`s sarcoma-associated h
ugauagcugga

SEQ ID NO: 4002968 - RNA, 20 nt, Human herpesvirus 8 [Kaposi`s sarcoma-associated h
ugauuaaagggggugguauu

SEQ ID NO: 4002969 - RNA, 22 nt, Human herpesvirus 8 [Kaposi`s sarcoma-associated h
ugcaacccucuacucuuccggg

SEQ ID NO: 4002970 - RNA, 17 nt, Human herpesvirus 8 [Kaposi`s sarcoma-associated h
ugcacauuuucagauau

SEQ ID NO: 4002971 - RNA, 21 nt, Human herpesvirus 8 [Kaposi`s sarcoma-associated h
ugcagggcgcugcucuuguca

SEQ ID NO: 4002972 - RNA, 19 nt, Human herpesvirus 8 [Kaposi`s sarcoma-associated h
ugccaacgaccugaugcag

SEQ ID NO: 4002973 - RNA, 18 nt, Human herpesvirus 8 [Kaposi`s sarcoma-associated h
ugccauggagaauaucca

SEQ ID NO: 4002974 - RNA, 19 nt, Human herpesvirus 8 [Kaposi`s sarcoma-associated h
ugcccucccaaagaguguc

SEQ ID NO: 4002975 - RNA, 19 nt, Human herpesvirus 8 [Kaposi`s sarcoma-associated h
ugcccugguugacacaaug

SEQ ID NO: 4002976 - RNA, 13 nt, Human herpesvirus 8 [Kaposi`s sarcoma-associated h
ugccugggugcug

SEQ ID NO: 4002977 - RNA, 14 nt, Human herpesvirus 8 [Kaposi`s sarcoma-associated h
ugccugguggagca

SEQ ID NO: 4002978 - RNA, 17 nt, Human herpesvirus 8 [Kaposi`s sarcoma-associated h
ugcgcgucagcaguguu

SEQ ID NO: 4002979 - RNA, 17 nt, Human herpesvirus 8 [Kaposi`s sarcoma-associated h
ugcgguauuugcagaca

SEQ ID NO: 4002980 - RNA, 15 nt, Human herpesvirus 8 [Kaposi`s sarcoma-associated h
ugcucagacagauuc

SEQ ID NO: 4002981 - RNA, 17 nt, Human herpesvirus 8 [Kaposi`s sarcoma-associated h
ugcucuuccuccuaguc

SEQ ID NO: 4002982 - RNA, 22 nt, Human herpesvirus 8 [Kaposi`s sarcoma-associated h
uggaggaagcauccggacugag

SEQ ID NO: 4002983 - RNA, 21 nt, Human herpesvirus 8 [Kaposi`s sarcoma-associated h
uggaugaccaacaggcugucc

SEQ ID NO: 4002984 - RNA, 23 nt, Human herpesvirus 8 [Kaposi`s sarcoma-associated h
uggcaccugaggugcucuuccca

SEQ ID NO: 4002985 - RNA, 13 nt, Human herpesvirus 8 [Kaposi`s sarcoma-associated h
uggcagcgcacca

SEQ ID NO: 4002986 - RNA, 12 nt, Human herpesvirus 8 [Kaposi`s sarcoma-associated h
uggcaugcuggg

SEQ ID NO: 4002987 - RNA, 18 nt, Human herpesvirus 8 [Kaposi`s sarcoma-associated h
uggcauuugucagaaguu

SEQ ID NO: 4002988 - RNA, 18 nt, Human herpesvirus 8 [Kaposi`s sarcoma-associated h
uggcccgucuguauacgu

SEQ ID NO: 4002989 - RNA, 21 nt, Human herpesvirus 8 [Kaposi`s sarcoma-associated h
uggcccugauaugcauguguc

SEQ ID NO: 4002990 - RNA, 12 nt, Human herpesvirus 8 [Kaposi`s sarcoma-associated h
uggcggccaugg

SEQ ID NO: 4002991 - RNA, 17 nt, Human herpesvirus 8 [Kaposi`s sarcoma-associated h
uggcguggaggccagga

SEQ ID NO: 4002992 - RNA, 18 nt, Human herpesvirus 8 [Kaposi`s sarcoma-associated h
uggcuucuauaagcaccu

SEQ ID NO: 4002993 - RNA, 20 nt, Human herpesvirus 8 [Kaposi`s sarcoma-associated h
ugggagcggguugucuacau

SEQ ID NO: 4002994 - RNA, 23 nt, Human herpesvirus 8 [Kaposi`s sarcoma-associated h
ugggccgugguucaucagccuca

SEQ ID NO: 4002995 - RNA, 22 nt, Human herpesvirus 8 [Kaposi`s sarcoma-associated h
uggggcuacacaucauaaagua

SEQ ID NO: 4002996 - RNA, 21 nt, Human herpesvirus 8 [Kaposi`s sarcoma-associated h
uggguguaagcuguacauaau

SEQ ID NO: 4002997 - RNA, 13 nt, Human herpesvirus 8 [Kaposi`s sarcoma-associated h
auuggagcucuua

SEQ ID NO: 4002998 - RNA, 14 nt, Human herpesvirus 8 [Kaposi`s sarcoma-associated h
auuuaauaaacacu

SEQ ID NO: 4002999 - RNA, 23 nt, Human herpesvirus 8 [Kaposi`s sarcoma-associated h
auuuacgguggugugccuggugg

SEQ ID NO: 4003000 - RNA, 19 nt, Human herpesvirus 8 [Kaposi`s sarcoma-associated h
auuuauuuuuuacuacagg

SEQ ID NO: 4003001 - RNA, 19 nt, Human herpesvirus 8 [Kaposi`s sarcoma-associated h
auuucucuaucuaucucug

SEQ ID NO: 4003002 - RNA, 17 nt, Human herpesvirus 8 [Kaposi`s sarcoma-associated h
caaaauucgcagggaga

SEQ ID NO: 4003003 - RNA, 18 nt, Human herpesvirus 8 [Kaposi`s sarcoma-associated h
caaacacaggcggagagc

SEQ ID NO: 4003004 - RNA, 15 nt, Human herpesvirus 8 [Kaposi`s sarcoma-associated h
caaaccccauggcag

SEQ ID NO: 4003005 - RNA, 17 nt, Human herpesvirus 8 [Kaposi`s sarcoma-associated h
caaaguauauuaguguu

SEQ ID NO: 4003006 - RNA, 15 nt, Human herpesvirus 8 [Kaposi`s sarcoma-associated h
caaaugauauuuuga

SEQ ID NO: 4003007 - RNA, 21 nt, Human herpesvirus 8 [Kaposi`s sarcoma-associated h
caaauggcguccgcucuccca

SEQ ID NO: 4003008 - RNA, 18 nt, Human herpesvirus 8 [Kaposi`s sarcoma-associated h
caacccacacuggcccaa

SEQ ID NO: 4003009 - RNA, 19 nt, Human herpesvirus 8 [Kaposi`s sarcoma-associated h
caaccgucuccgccaggga

SEQ ID NO: 4003010 - RNA, 22 nt, Human herpesvirus 8 [Kaposi`s sarcoma-associated h
caagccagucguacgcggccac

SEQ ID NO: 4003011 - RNA, 17 nt, Human herpesvirus 8 [Kaposi`s sarcoma-associated h
caaggcgcggacaggca

SEQ ID NO: 4003012 - RNA, 22 nt, Human herpesvirus 8 [Kaposi`s sarcoma-associated h
caauauaacagcaacauguuua

SEQ ID NO: 4003013 - RNA, 19 nt, Human herpesvirus 8 [Kaposi`s sarcoma-associated h
caaucucucauagacuuuc

SEQ ID NO: 4003014 - RNA, 14 nt, Human herpesvirus 8 [Kaposi`s sarcoma-associated h
caauugacugugga

SEQ ID NO: 4003015 - RNA, 15 nt, Human herpesvirus 8 [Kaposi`s sarcoma-associated h
cacagauuguggcau

SEQ ID NO: 4003016 - RNA, 23 nt, Human herpesvirus 8 [Kaposi`s sarcoma-associated h
cacagcaugccgucagggcccac

SEQ ID NO: 4003017 - RNA, 14 nt, Human herpesvirus 8 [Kaposi`s sarcoma-associated h
caccaagaaggaau

SEQ ID NO: 4003018 - RNA, 14 nt, Human herpesvirus 8 [Kaposi`s sarcoma-associated h
caccacgccacaac

SEQ ID NO: 4003019 - RNA, 21 nt, Human herpesvirus 8 [Kaposi`s sarcoma-associated h
cacccaccuacuuccagggcc

SEQ ID NO: 4003020 - RNA, 20 nt, Human herpesvirus 8 [Kaposi`s sarcoma-associated h
cacccuauccaucagucagg

SEQ ID NO: 4003021 - RNA, 20 nt, Human herpesvirus 8 [Kaposi`s sarcoma-associated h
caccgucgccaaacaggcgc

SEQ ID NO: 4003022 - RNA, 16 nt, Human herpesvirus 8 [Kaposi`s sarcoma-associated h
caccucuacagagggc

SEQ ID NO: 4003023 - RNA, 14 nt, Human herpesvirus 8 [Kaposi`s sarcoma-associated h
caccuggcccaaac

SEQ ID NO: 4003024 - RNA, 23 nt, Human herpesvirus 8 [Kaposi`s sarcoma-associated h
cacuauauaaccuggcugccagg

SEQ ID NO: 4003025 - RNA, 22 nt, Human herpesvirus 8 [Kaposi`s sarcoma-associated h
cacucgaggggugacaccuuuc

SEQ ID NO: 4003026 - RNA, 19 nt, Human herpesvirus 8 [Kaposi`s sarcoma-associated h
cacucgcuguccuggagga

SEQ ID NO: 4003027 - RNA, 19 nt, Human herpesvirus 8 [Kaposi`s sarcoma-associated h
cacuuccucuaucagcugc

SEQ ID NO: 4003028 - RNA, 22 nt, Human herpesvirus 8 [Kaposi`s sarcoma-associated h
cagaagagcauuuuucccuccu

SEQ ID NO: 4003029 - RNA, 23 nt, Human herpesvirus 8 [Kaposi`s sarcoma-associated h
cagacgacaaaacgcacacgaau

SEQ ID NO: 4003030 - RNA, 19 nt, Human herpesvirus 8 [Kaposi`s sarcoma-associated h
cagacgugcccagacacca

SEQ ID NO: 4003031 - RNA, 14 nt, Human herpesvirus 8 [Kaposi`s sarcoma-associated h
cagagucugaaccc

SEQ ID NO: 4003032 - RNA, 18 nt, Human herpesvirus 8 [Kaposi`s sarcoma-associated h
cagaguuuuaugggcuca

SEQ ID NO: 4003033 - RNA, 12 nt, Human herpesvirus 8 [Kaposi`s sarcoma-associated h
cagcaaagcaca

SEQ ID NO: 4003034 - RNA, 13 nt, Human herpesvirus 8 [Kaposi`s sarcoma-associated h
cagcaacugcguc

SEQ ID NO: 4003035 - RNA, 17 nt, Human herpesvirus 8 [Kaposi`s sarcoma-associated h
cagcagcaagcacagaa

SEQ ID NO: 4003036 - RNA, 13 nt, Human herpesvirus 8 [Kaposi`s sarcoma-associated h
cagcaucccccaa

SEQ ID NO: 4003037 - RNA, 23 nt, Human herpesvirus 8 [Kaposi`s sarcoma-associated h
cagccacaucagcuuggcgaccu

SEQ ID NO: 4003038 - RNA, 21 nt, Human herpesvirus 8 [Kaposi`s sarcoma-associated h
cagccgcgcgaccucccacgg

SEQ ID NO: 4003039 - RNA, 15 nt, Human herpesvirus 8 [Kaposi`s sarcoma-associated h
cagcgaaaccccccu

SEQ ID NO: 4003040 - RNA, 24 nt, Human herpesvirus 8 [Kaposi`s sarcoma-associated h
cagcgcgacggaaguuggccucca

SEQ ID NO: 4003041 - RNA, 17 nt, Human herpesvirus 8 [Kaposi`s sarcoma-associated h
cagcugcagccaggaag

SEQ ID NO: 4003042 - RNA, 20 nt, Human herpesvirus 8 [Kaposi`s sarcoma-associated h
caggcgccuaugacuaggag

SEQ ID NO: 4003043 - RNA, 18 nt, Human herpesvirus 8 [Kaposi`s sarcoma-associated h
caggcuguccucgcaagc

SEQ ID NO: 4003044 - RNA, 17 nt, Human herpesvirus 8 [Kaposi`s sarcoma-associated h
cagggcacccuccccca

SEQ ID NO: 4003045 - RNA, 14 nt, Human herpesvirus 8 [Kaposi`s sarcoma-associated h
cagggccuggccuc

SEQ ID NO: 4003046 - RNA, 17 nt, Human herpesvirus 8 [Kaposi`s sarcoma-associated h
cagucgagccgccagga

SEQ ID NO: 4003047 - RNA, 21 nt, Human herpesvirus 8 [Kaposi`s sarcoma-associated h
caguguaucccccacaggaca

SEQ ID NO: 4003048 - RNA, 16 nt, Human herpesvirus 8 [Kaposi`s sarcoma-associated h
caguuaaucuuuauug

SEQ ID NO: 4003049 - RNA, 12 nt, Human herpesvirus 8 [Kaposi`s sarcoma-associated h
cauaauccccgg

SEQ ID NO: 4003050 - RNA, 23 nt, Human herpesvirus 8 [Kaposi`s sarcoma-associated h
cauaauuggauggggcaugggca

SEQ ID NO: 4003051 - RNA, 15 nt, Human herpesvirus 8 [Kaposi`s sarcoma-associated h
cauauugguauauga

SEQ ID NO: 4003052 - RNA, 16 nt, Human herpesvirus 8 [Kaposi`s sarcoma-associated h
caucauaaaguacuuu

SEQ ID NO: 4003053 - RNA, 24 nt, Human herpesvirus 8 [Kaposi`s sarcoma-associated h
caucauaaaguacuuuuccauggc

SEQ ID NO: 4003054 - RNA, 20 nt, Human herpesvirus 8 [Kaposi`s sarcoma-associated h
guguacaaaaaaaacauagu

SEQ ID NO: 4003055 - RNA, 16 nt, Human herpesvirus 8 [Kaposi`s sarcoma-associated h
gugucgccagugccug

SEQ ID NO: 4003056 - RNA, 17 nt, Human herpesvirus 8 [Kaposi`s sarcoma-associated h
guuaagcuuugcagcca

SEQ ID NO: 4003057 - RNA, 15 nt, Human herpesvirus 8 [Kaposi`s sarcoma-associated h
guucacuugggagcu

SEQ ID NO: 4003058 - RNA, 20 nt, Human herpesvirus 8 [Kaposi`s sarcoma-associated h
guucgaccaccccugcaccu

SEQ ID NO: 4003059 - RNA, 16 nt, Human herpesvirus 8 [Kaposi`s sarcoma-associated h
guuuaccugcacucca

SEQ ID NO: 4003060 - RNA, 23 nt, Human herpesvirus 8 [Kaposi`s sarcoma-associated h
guuuauaaugccaauauaucagc

SEQ ID NO: 4003061 - RNA, 17 nt, Human herpesvirus 8 [Kaposi`s sarcoma-associated h
guuucuaaagcacgcca

SEQ ID NO: 4003062 - RNA, 20 nt, Human herpesvirus 8 [Kaposi`s sarcoma-associated h
guuucugaucccuaaggguc

SEQ ID NO: 4003063 - RNA, 14 nt, Human herpesvirus 8 [Kaposi`s sarcoma-associated h
uaaacgacagcucg

SEQ ID NO: 4003064 - RNA, 18 nt, Human herpesvirus 8 [Kaposi`s sarcoma-associated h
uaaagagggaucccaggc

SEQ ID NO: 4003065 - RNA, 20 nt, Human herpesvirus 8 [Kaposi`s sarcoma-associated h
uaaagagggaucccaggcag

SEQ ID NO: 4003066 - RNA, 16 nt, Human herpesvirus 8 [Kaposi`s sarcoma-associated h
uaaaguacuuuuccau

SEQ ID NO: 4003067 - RNA, 17 nt, Human herpesvirus 8 [Kaposi`s sarcoma-associated h
uaaaguacuuuuccaug

SEQ ID NO: 4003068 - RNA, 20 nt, Human herpesvirus 8 [Kaposi`s sarcoma-associated h
uaaccgcaaagauaagccaa

SEQ ID NO: 4003069 - RNA, 21 nt, Human herpesvirus 8 [Kaposi`s sarcoma-associated h
uaacgagcgucgauggcccug

SEQ ID NO: 4003070 - RNA, 23 nt, Human herpesvirus 8 [Kaposi`s sarcoma-associated h
uaacucacguagccuuucucuaa

SEQ ID NO: 4003071 - RNA, 15 nt, Human herpesvirus 8 [Kaposi`s sarcoma-associated h
uaagcuuugcagcca

SEQ ID NO: 4003072 - RNA, 15 nt, Human herpesvirus 8 [Kaposi`s sarcoma-associated h
uaaugguguguuuau

SEQ ID NO: 4003073 - RNA, 22 nt, Human herpesvirus 8 [Kaposi`s sarcoma-associated h
uacaagcgaucacgacggauuu

SEQ ID NO: 4003074 - RNA, 14 nt, Human herpesvirus 8 [Kaposi`s sarcoma-associated h
uacauaacacacac

SEQ ID NO: 4003075 - RNA, 16 nt, Human herpesvirus 8 [Kaposi`s sarcoma-associated h
uacucguugcacacag

SEQ ID NO: 4003076 - RNA, 21 nt, Human herpesvirus 8 [Kaposi`s sarcoma-associated h
uagagacuggcggguggcuca

SEQ ID NO: 4003077 - RNA, 20 nt, Human herpesvirus 8 [Kaposi`s sarcoma-associated h
uagagcgacugcuggcuuca

SEQ ID NO: 4003078 - RNA, 19 nt, Human herpesvirus 8 [Kaposi`s sarcoma-associated h
uagcacacacgaugaagag

SEQ ID NO: 4003079 - RNA, 15 nt, Human herpesvirus 8 [Kaposi`s sarcoma-associated h
uagcuucagcuucag

SEQ ID NO: 4003080 - RNA, 15 nt, Human herpesvirus 8 [Kaposi`s sarcoma-associated h
uauagugguuuacau

SEQ ID NO: 4003081 - RNA, 13 nt, Human herpesvirus 8 [Kaposi`s sarcoma-associated h
uaucaaagaaagg

SEQ ID NO: 4003082 - RNA, 18 nt, Human herpesvirus 8 [Kaposi`s sarcoma-associated h
uaucaggcuagugcugua

SEQ ID NO: 4003083 - RNA, 17 nt, Human herpesvirus 8 [Kaposi`s sarcoma-associated h
ucucgcugcucagacag

SEQ ID NO: 4003084 - RNA, 15 nt, Human herpesvirus 8 [Kaposi`s sarcoma-associated h
ucucgguacugcgca

SEQ ID NO: 4003085 - RNA, 20 nt, Human herpesvirus 8 [Kaposi`s sarcoma-associated h
ucugccgaagucagugccac

SEQ ID NO: 4003086 - RNA, 19 nt, Human herpesvirus 8 [Kaposi`s sarcoma-associated h
ucugcgcgucagcaguguu

SEQ ID NO: 4003087 - RNA, 17 nt, Human herpesvirus 8 [Kaposi`s sarcoma-associated h
ucuggccugugcccaaa

SEQ ID NO: 4003088 - RNA, 14 nt, Human herpesvirus 8 [Kaposi`s sarcoma-associated h
ucuuccuccauccc

SEQ ID NO: 4003089 - RNA, 16 nt, Human herpesvirus 8 [Kaposi`s sarcoma-associated h
ucuucuguugccaggc

SEQ ID NO: 4003090 - RNA, 17 nt, Human herpesvirus 8 [Kaposi`s sarcoma-associated h
ugaaugugaucacggag

SEQ ID NO: 4003091 - RNA, 23 nt, Human herpesvirus 8 [Kaposi`s sarcoma-associated h
ugacaaucuggauguguaucuua

SEQ ID NO: 4003092 - RNA, 19 nt, Human herpesvirus 8 [Kaposi`s sarcoma-associated h
ugacuuuuuaaaggggacg

SEQ ID NO: 4003093 - RNA, 17 nt, Human herpesvirus 8 [Kaposi`s sarcoma-associated h
ugagagacugcaggcca

SEQ ID NO: 4003094 - RNA, 16 nt, Human herpesvirus 8 [Kaposi`s sarcoma-associated h
ugagcgcgcucugucg

SEQ ID NO: 4003095 - RNA, 16 nt, Human herpesvirus 8 [Kaposi`s sarcoma-associated h
ugaggccaagugcauu

SEQ ID NO: 4003096 - RNA, 16 nt, Human herpesvirus 8 [Kaposi`s sarcoma-associated h
ugaggccaauggauuc

SEQ ID NO: 4003097 - RNA, 23 nt, Human herpesvirus 8 [Kaposi`s sarcoma-associated h
ugagggaguguuuuuugccaugg

SEQ ID NO: 4003098 - RNA, 23 nt, Human herpesvirus 8 [Kaposi`s sarcoma-associated h
ugagguggcgcggaaacugggca

SEQ ID NO: 4003099 - RNA, 17 nt, Human herpesvirus 8 [Kaposi`s sarcoma-associated h
ugauaugcaugugucug

SEQ ID NO: 4003100 - RNA, 23 nt, Human herpesvirus 8 [Kaposi`s sarcoma-associated h
ugaugguguuggacaccaccguc

SEQ ID NO: 4003101 - RNA, 15 nt, Human herpesvirus 8 [Kaposi`s sarcoma-associated h
ugauuuuccagggac

SEQ ID NO: 4003102 - RNA, 13 nt, Human herpesvirus 8 [Kaposi`s sarcoma-associated h
ugcagugugcagu

SEQ ID NO: 4003103 - RNA, 16 nt, Human herpesvirus 8 [Kaposi`s sarcoma-associated h
ugcauagggcuuugau

SEQ ID NO: 4003104 - RNA, 17 nt, Human herpesvirus 8 [Kaposi`s sarcoma-associated h
ugccaauaacccgcccu

SEQ ID NO: 4003105 - RNA, 19 nt, Human herpesvirus 8 [Kaposi`s sarcoma-associated h
ugcgaacuugcucuuuuca

SEQ ID NO: 4003106 - RNA, 19 nt, Human herpesvirus 8 [Kaposi`s sarcoma-associated h
ugcgcgcuggcucagacac

SEQ ID NO: 4003107 - RNA, 18 nt, Human herpesvirus 8 [Kaposi`s sarcoma-associated h
ugcggugcugcccaggac

SEQ ID NO: 4003108 - RNA, 15 nt, Human herpesvirus 8 [Kaposi`s sarcoma-associated h
ugcugccacugccac

SEQ ID NO: 4003109 - RNA, 18 nt, Human herpesvirus 8 [Kaposi`s sarcoma-associated h
ugcuggaucccagugccu

SEQ ID NO: 4003110 - RNA, 14 nt, Human herpesvirus 8 [Kaposi`s sarcoma-associated h
ugcuucuguuugaa

SEQ ID NO: 4003111 - RNA, 16 nt, Human herpesvirus 8 [Kaposi`s sarcoma-associated h
uggaaagcuccucgag

SEQ ID NO: 4003112 - RNA, 16 nt, Human herpesvirus 8 [Kaposi`s sarcoma-associated h
uggaauauaaugugaa

SEQ ID NO: 4003113 - RNA, 17 nt, Human herpesvirus 8 [Kaposi`s sarcoma-associated h
uggaggaagagggaugg

SEQ ID NO: 4003114 - RNA, 22 nt, Human herpesvirus 8 [Kaposi`s sarcoma-associated h
uggauuuucacuauggggucag

SEQ ID NO: 4003115 - RNA, 18 nt, Human herpesvirus 8 [Kaposi`s sarcoma-associated h
uggccacccuggggacug

SEQ ID NO: 4003116 - RNA, 20 nt, Human herpesvirus 8 [Kaposi`s sarcoma-associated h
uggcccaaacuagcagagac

SEQ ID NO: 4003117 - RNA, 18 nt, Human herpesvirus 8 [Kaposi`s sarcoma-associated h
uggccggcacgcgguguc

SEQ ID NO: 4003118 - RNA, 15 nt, Human herpesvirus 8 [Kaposi`s sarcoma-associated h
uggccugugcccaaa

SEQ ID NO: 4003119 - RNA, 21 nt, Human herpesvirus 8 [Kaposi`s sarcoma-associated h
uggcgcaggagucagagcagu

SEQ ID NO: 4003120 - RNA, 13 nt, Human herpesvirus 8 [Kaposi`s sarcoma-associated h
uggcgccaugggu

SEQ ID NO: 4003121 - RNA, 14 nt, Human herpesvirus 8 [Kaposi`s sarcoma-associated h
uggcgcgccacagu

SEQ ID NO: 4003122 - RNA, 15 nt, Human herpesvirus 8 [Kaposi`s sarcoma-associated h
uggcucagacaccgu

SEQ ID NO: 4003123 - RNA, 15 nt, Human herpesvirus 8 [Kaposi`s sarcoma-associated h
uggcugccuggacag

SEQ ID NO: 4003124 - RNA, 15 nt, Human herpesvirus 8 [Kaposi`s sarcoma-associated h
ugggagcugucccac

SEQ ID NO: 4003125 - RNA, 20 nt, Human herpesvirus 8 [Kaposi`s sarcoma-associated h
ugggccaugacaacugccac

SEQ ID NO: 4003126 - RNA, 21 nt, Human herpesvirus 8 [Kaposi`s sarcoma-associated h
uggggguggggggaggaggaa

SEQ ID NO: 4003127 - RNA, 19 nt, Human herpesvirus 8 [Kaposi`s sarcoma-associated h
uggggguuggguggggaga

SEQ ID NO: 4003128 - RNA, 14 nt, Human herpesvirus 8 [Kaposi`s sarcoma-associated h
uguaagcugcuggu

SEQ ID NO: 4003129 - RNA, 13 nt, Human herpesvirus 8 [Kaposi`s sarcoma-associated h
uguagauaauuga

SEQ ID NO: 4003130 - RNA, 20 nt, Human herpesvirus 8 [Kaposi`s sarcoma-associated h
uguccucauuagucgggacu

SEQ ID NO: 4003131 - RNA, 21 nt, Human herpesvirus 8 [Kaposi`s sarcoma-associated h
ugugggaaacguguccugcca

SEQ ID NO: 4003132 - RNA, 13 nt, Human herpesvirus 8 [Kaposi`s sarcoma-associated h
uguguagguuguu

SEQ ID NO: 4003133 - RNA, 16 nt, Human herpesvirus 8 [Kaposi`s sarcoma-associated h
uguuaucuuugcagug

SEQ ID NO: 4003134 - RNA, 18 nt, Human herpesvirus 8 [Kaposi`s sarcoma-associated h
uguuaucuuugcaguguc

SEQ ID NO: 4003135 - RNA, 23 nt, Human herpesvirus 8 [Kaposi`s sarcoma-associated h
uuaacagccacgacguggcccac

SEQ ID NO: 4003136 - RNA, 20 nt, Human herpesvirus 8 [Kaposi`s sarcoma-associated h
uuaaccggcuuguacaguga

SEQ ID NO: 4003137 - RNA, 21 nt, Human herpesvirus 8 [Kaposi`s sarcoma-associated h
uuaagagugccacuaaaaccg

SEQ ID NO: 4003138 - RNA, 22 nt, Human herpesvirus 8 [Kaposi`s sarcoma-associated h
uuacauuuucucgugugcccuu

SEQ ID NO: 4003139 - RNA, 20 nt, Human herpesvirus 8 [Kaposi`s sarcoma-associated h
uuaccgcuacugugggugca

SEQ ID NO: 4003140 - RNA, 17 nt, Human herpesvirus 8 [Kaposi`s sarcoma-associated h
uuacuaagagaacagca

SEQ ID NO: 4003141 - RNA, 17 nt, Human herpesvirus 8 [Kaposi`s sarcoma-associated h
uuagauggcacagaguc

SEQ ID NO: 4003142 - RNA, 20 nt, Human herpesvirus 8 [Kaposi`s sarcoma-associated h
uuagccugcaguguggggau

SEQ ID NO: 4003143 - RNA, 23 nt, Human herpesvirus 8 [Kaposi`s sarcoma-associated h
uuauacaaacaacauaaacauua

SEQ ID NO: 4003144 - RNA, 18 nt, Human herpesvirus 8 [Kaposi`s sarcoma-associated h
uuauuaaaagcauugucu

SEQ ID NO: 4003145 - RNA, 17 nt, Human herpesvirus 8 [Kaposi`s sarcoma-associated h
uuccuuuuuucaaaagu

SEQ ID NO: 4003146 - RNA, 16 nt, Human herpesvirus 8 [Kaposi`s sarcoma-associated h
uucuuuauucugucaa

SEQ ID NO: 4003147 - RNA, 12 nt, Human herpesvirus 8 [Kaposi`s sarcoma-associated h
uugauugugacu

SEQ ID NO: 4003148 - RNA, 13 nt, Human herpesvirus 8 [Kaposi`s sarcoma-associated h
uugcgauugcuca

SEQ ID NO: 4003149 - RNA, 19 nt, Human herpesvirus 8 [Kaposi`s sarcoma-associated h
uuggaguuaaagcugucac

SEQ ID NO: 4003150 - RNA, 20 nt, Human herpesvirus 8 [Kaposi`s sarcoma-associated h
uuguauaaccgugcuacuua

SEQ ID NO: 4003151 - RNA, 19 nt, Human herpesvirus 8 [Kaposi`s sarcoma-associated h
uuuaaaagacucuagauaa

SEQ ID NO: 4003152 - RNA, 12 nt, Human herpesvirus 8 [Kaposi`s sarcoma-associated h
uuuaauaaacac

SEQ ID NO: 4003153 - RNA, 16 nt, Human herpesvirus 8 [Kaposi`s sarcoma-associated h
uuuagacugcgugcau

SEQ ID NO: 4003154 - RNA, 19 nt, Human herpesvirus 8 [Kaposi`s sarcoma-associated h
uuuguaaugaauaacuuua

SEQ ID NO: 4003155 - RNA, 14 nt, Human herpesvirus 8 [Kaposi`s sarcoma-associated h
uuuuguugugagca

SEQ ID NO: 4003156 - RNA, 21 nt, Human herpesvirus 8 [Kaposi`s sarcoma-associated h
gauucuuuuaaucuguuuauu

SEQ ID NO: 4003157 - RNA, 12 nt, Human herpesvirus 8 [Kaposi`s sarcoma-associated h
gcaaaacacaaa

SEQ ID NO: 4003158 - RNA, 12 nt, Human herpesvirus 8 [Kaposi`s sarcoma-associated h
gcaagcacagaa

SEQ ID NO: 4003159 - RNA, 19 nt, Human herpesvirus 8 [Kaposi`s sarcoma-associated h
gcacaacauuaaacacaua

SEQ ID NO: 4003160 - RNA, 23 nt, Human herpesvirus 8 [Kaposi`s sarcoma-associated h
gcaccuguguacaauacgccuuc

SEQ ID NO: 4003161 - RNA, 16 nt, Human herpesvirus 8 [Kaposi`s sarcoma-associated h
gcaccuuaaacacaac

SEQ ID NO: 4003162 - RNA, 14 nt, Human herpesvirus 8 [Kaposi`s sarcoma-associated h
gcacgguauagaga

SEQ ID NO: 4003163 - RNA, 21 nt, Human herpesvirus 8 [Kaposi`s sarcoma-associated h
gcacggugaacguccccgcgu

SEQ ID NO: 4003164 - RNA, 14 nt, Human herpesvirus 8 [Kaposi`s sarcoma-associated h
gcacuccaagccag

SEQ ID NO: 4003165 - RNA, 17 nt, Human herpesvirus 8 [Kaposi`s sarcoma-associated h
gcagccucuacccugcc

SEQ ID NO: 4003166 - RNA, 15 nt, Human herpesvirus 8 [Kaposi`s sarcoma-associated h
gcagcgccaguggau

SEQ ID NO: 4003167 - RNA, 23 nt, Human herpesvirus 8 [Kaposi`s sarcoma-associated h
gcaguagcccgccgcaaggagca

SEQ ID NO: 4003168 - RNA, 18 nt, Human herpesvirus 8 [Kaposi`s sarcoma-associated h
gcaguaguaaacgacagc

SEQ ID NO: 4003169 - RNA, 22 nt, Human herpesvirus 8 [Kaposi`s sarcoma-associated h
gcaguggaccgcgagacaucag

SEQ ID NO: 4003170 - RNA, 15 nt, Human herpesvirus 8 [Kaposi`s sarcoma-associated h
gcauaauaaaacaaa

SEQ ID NO: 4003171 - RNA, 17 nt, Human herpesvirus 8 [Kaposi`s sarcoma-associated h
gcauaauaaaacaaaua

SEQ ID NO: 4003172 - RNA, 15 nt, Human herpesvirus 8 [Kaposi`s sarcoma-associated h
gcaugccgucagggc

SEQ ID NO: 4003173 - RNA, 15 nt, Human herpesvirus 8 [Kaposi`s sarcoma-associated h
gcaugguugcaacag

SEQ ID NO: 4003174 - RNA, 20 nt, Human herpesvirus 8 [Kaposi`s sarcoma-associated h
gcauuuggacacaacaugca

SEQ ID NO: 4003175 - RNA, 20 nt, Human herpesvirus 8 [Kaposi`s sarcoma-associated h
gccaccgucgccgcuccgca

SEQ ID NO: 4003176 - RNA, 15 nt, Human herpesvirus 8 [Kaposi`s sarcoma-associated h
gccaggacucacugg

SEQ ID NO: 4003177 - RNA, 16 nt, Human herpesvirus 8 [Kaposi`s sarcoma-associated h
gccaugacaacugcca

SEQ ID NO: 4003178 - RNA, 22 nt, Human herpesvirus 8 [Kaposi`s sarcoma-associated h
gccauuuuuguggcugccugga

SEQ ID NO: 4003179 - RNA, 24 nt, Human herpesvirus 8 [Kaposi`s sarcoma-associated h
gcccgccgcaaggagcagccugca

SEQ ID NO: 4003180 - RNA, 18 nt, Human herpesvirus 8 [Kaposi`s sarcoma-associated h
gcccucgggacuucugga

SEQ ID NO: 4003181 - RNA, 15 nt, Human herpesvirus 8 [Kaposi`s sarcoma-associated h
gccggcaccauggcc

SEQ ID NO: 4003182 - RNA, 14 nt, Human herpesvirus 8 [Kaposi`s sarcoma-associated h
gccgggugaggcca

SEQ ID NO: 4003183 - RNA, 13 nt, Human herpesvirus 8 [Kaposi`s sarcoma-associated h
gccucccaacaug

SEQ ID NO: 4003184 - RNA, 17 nt, Human herpesvirus 8 [Kaposi`s sarcoma-associated h
gccucucaucauuucug

SEQ ID NO: 4003185 - RNA, 18 nt, Human herpesvirus 8 [Kaposi`s sarcoma-associated h
gccugcgucuacugcugc

SEQ ID NO: 4003186 - RNA, 22 nt, Human herpesvirus 8 [Kaposi`s sarcoma-associated h
gccuuggaagauauguugugcg

SEQ ID NO: 4003187 - RNA, 23 nt, Human herpesvirus 8 [Kaposi`s sarcoma-associated h
gcgacggaaguuggccuccagca

SEQ ID NO: 4003188 - RNA, 23 nt, Human herpesvirus 8 [Kaposi`s sarcoma-associated h
gcgcagauuugugcggcgcagca

SEQ ID NO: 4003189 - RNA, 17 nt, Human herpesvirus 8 [Kaposi`s sarcoma-associated h
gcgccacagucgagccg

SEQ ID NO: 4003190 - RNA, 23 nt, Human herpesvirus 8 [Kaposi`s sarcoma-associated h
gcggcccagcgucgucgauggga

SEQ ID NO: 4003191 - RNA, 14 nt, Human herpesvirus 8 [Kaposi`s sarcoma-associated h
gcggccuuuucugg

SEQ ID NO: 4003192 - RNA, 17 nt, Human herpesvirus 8 [Kaposi`s sarcoma-associated h
gcggcuaggcacccgga

SEQ ID NO: 4003193 - RNA, 17 nt, Human herpesvirus 8 [Kaposi`s sarcoma-associated h
gcguaugggaacacaau

SEQ ID NO: 4003194 - RNA, 17 nt, Human herpesvirus 8 [Kaposi`s sarcoma-associated h
gcgugucucagggagca

SEQ ID NO: 4003195 - RNA, 16 nt, Human herpesvirus 8 [Kaposi`s sarcoma-associated h
gcguuuaccugcacuc

SEQ ID NO: 4003196 - RNA, 19 nt, Human herpesvirus 8 [Kaposi`s sarcoma-associated h
gcuacugcuuguucaggag

SEQ ID NO: 4003197 - RNA, 16 nt, Human herpesvirus 8 [Kaposi`s sarcoma-associated h
gcugaugaucgccacc

SEQ ID NO: 4003198 - RNA, 18 nt, Human herpesvirus 8 [Kaposi`s sarcoma-associated h
gcugcaauguacugccau

SEQ ID NO: 4003199 - RNA, 16 nt, Human herpesvirus 8 [Kaposi`s sarcoma-associated h
gcuggucccgugguca

SEQ ID NO: 4003200 - RNA, 15 nt, Human herpesvirus 8 [Kaposi`s sarcoma-associated h
gcuucauuaugcaug

SEQ ID NO: 4003201 - RNA, 22 nt, Human herpesvirus 8 [Kaposi`s sarcoma-associated h
gcuugcacgccaacccucagug

SEQ ID NO: 4003202 - RNA, 15 nt, Human herpesvirus 8 [Kaposi`s sarcoma-associated h
gcuuugcagccaggu

SEQ ID NO: 4003203 - RNA, 19 nt, Human herpesvirus 8 [Kaposi`s sarcoma-associated h
ggaaauggggaacacagaa

SEQ ID NO: 4003204 - RNA, 20 nt, Human herpesvirus 8 [Kaposi`s sarcoma-associated h
ggaagggggcucccugggga

SEQ ID NO: 4003205 - RNA, 17 nt, Human herpesvirus 8 [Kaposi`s sarcoma-associated h
ggaaguaugucguggga

SEQ ID NO: 4003206 - RNA, 20 nt, Human herpesvirus 8 [Kaposi`s sarcoma-associated h
ggaccucaaagaagaggugg

SEQ ID NO: 4003207 - RNA, 19 nt, Human herpesvirus 8 [Kaposi`s sarcoma-associated h
ggaccucgucuagcacaca

SEQ ID NO: 4003208 - RNA, 22 nt, Human herpesvirus 8 [Kaposi`s sarcoma-associated h
ggaccuuacgauggaagaccua

SEQ ID NO: 4003209 - RNA, 20 nt, Human herpesvirus 8 [Kaposi`s sarcoma-associated h
ggacuuucuccgugagaugg

SEQ ID NO: 4003210 - RNA, 19 nt, Human herpesvirus 8 [Kaposi`s sarcoma-associated h
ggagccggcccugacagag

SEQ ID NO: 4003211 - RNA, 14 nt, Human herpesvirus 8 [Kaposi`s sarcoma-associated h
ggaggagggcaggu

SEQ ID NO: 4003212 - RNA, 15 nt, Human herpesvirus 8 [Kaposi`s sarcoma-associated h
ggagucagagcagug

SEQ ID NO: 4003213 - RNA, 14 nt, Human herpesvirus 8 [Kaposi`s sarcoma-associated h
ggauaggcuggggg

SEQ ID NO: 4003214 - RNA, 18 nt, Human herpesvirus 8 [Kaposi`s sarcoma-associated h
ggauagugucuggcuggc

SEQ ID NO: 4003215 - RNA, 19 nt, Human herpesvirus 8 [Kaposi`s sarcoma-associated h
ggauguaaguccggccacc

SEQ ID NO: 4003216 - RNA, 17 nt, Human herpesvirus 8 [Kaposi`s sarcoma-associated h
ggcagcaauauuaaagg

SEQ ID NO: 4003217 - RNA, 13 nt, Human herpesvirus 8 [Kaposi`s sarcoma-associated h
ggcagucaaaugg

SEQ ID NO: 4003218 - RNA, 19 nt, Human herpesvirus 8 [Kaposi`s sarcoma-associated h
ggccagagguuugaggcgc

SEQ ID NO: 4003219 - RNA, 21 nt, Human herpesvirus 8 [Kaposi`s sarcoma-associated h
ggccagagguuugaggcgcug

SEQ ID NO: 4003220 - RNA, 22 nt, Human herpesvirus 8 [Kaposi`s sarcoma-associated h
ggccagagguuugaggcgcuga

SEQ ID NO: 4003221 - RNA, 21 nt, Human herpesvirus 8 [Kaposi`s sarcoma-associated h
ggccaggcccugcauccggca

SEQ ID NO: 4003222 - RNA, 17 nt, Human herpesvirus 8 [Kaposi`s sarcoma-associated h
ggcgagcccguguggga

SEQ ID NO: 4003223 - RNA, 16 nt, Human herpesvirus 8 [Kaposi`s sarcoma-associated h
ggcggccgcuaagaaa

SEQ ID NO: 4003224 - RNA, 23 nt, Human herpesvirus 8 [Kaposi`s sarcoma-associated h
ggcuacacaucauaaaguacuuu

SEQ ID NO: 4003225 - RNA, 17 nt, Human herpesvirus 8 [Kaposi`s sarcoma-associated h
ggcugaugcucuggcca

SEQ ID NO: 4003226 - RNA, 15 nt, Human herpesvirus 8 [Kaposi`s sarcoma-associated h
ggcugccuggacagu

SEQ ID NO: 4003227 - RNA, 21 nt, Human herpesvirus 8 [Kaposi`s sarcoma-associated h
gggacuugauaaucuccugga

SEQ ID NO: 4003228 - RNA, 14 nt, Human herpesvirus 8 [Kaposi`s sarcoma-associated h
gggccuggccucga

SEQ ID NO: 4003229 - RNA, 16 nt, Human herpesvirus 8 [Kaposi`s sarcoma-associated h
gggccuucgcacccca

SEQ ID NO: 4003230 - RNA, 22 nt, Human herpesvirus 8 [Kaposi`s sarcoma-associated h
gggcguccacauggcagcugaa

SEQ ID NO: 4003231 - RNA, 18 nt, Human herpesvirus 8 [Kaposi`s sarcoma-associated h
gggcuguucucgccugga

SEQ ID NO: 4003232 - RNA, 12 nt, Human herpesvirus 8 [Kaposi`s sarcoma-associated h
gggugcacugag

SEQ ID NO: 4003233 - RNA, 12 nt, Human herpesvirus 8 [Kaposi`s sarcoma-associated h
gguggcauuugu

SEQ ID NO: 4003234 - RNA, 12 nt, Human herpesvirus 8 [Kaposi`s sarcoma-associated h
ggugggugggga

SEQ ID NO: 4003235 - RNA, 11 nt, Human herpesvirus 8 [Kaposi`s sarcoma-associated h
gguugguggug

SEQ ID NO: 4003236 - RNA, 16 nt, Human herpesvirus 8 [Kaposi`s sarcoma-associated h
gguuuccuagccagau

SEQ ID NO: 4003237 - RNA, 15 nt, Human herpesvirus 8 [Kaposi`s sarcoma-associated h
guaagaggacccagg

SEQ ID NO: 4003238 - RNA, 21 nt, Human herpesvirus 8 [Kaposi`s sarcoma-associated h
guaaugcugccccuagaccug

SEQ ID NO: 4003239 - RNA, 13 nt, Human herpesvirus 8 [Kaposi`s sarcoma-associated h
guaauguguuuua

SEQ ID NO: 4003240 - RNA, 16 nt, Human herpesvirus 8 [Kaposi`s sarcoma-associated h
guacacagaugugacu

SEQ ID NO: 4003241 - RNA, 16 nt, Human herpesvirus 8 [Kaposi`s sarcoma-associated h
guagcuaugcccaccg

SEQ ID NO: 4003242 - RNA, 18 nt, Human herpesvirus 8 [Kaposi`s sarcoma-associated h
gucagagaauacagugcu

SEQ ID NO: 4003243 - RNA, 21 nt, Human herpesvirus 8 [Kaposi`s sarcoma-associated h
gucagguucacuugggagcug

SEQ ID NO: 4003244 - RNA, 20 nt, Human herpesvirus 8 [Kaposi`s sarcoma-associated h
guccaaagcuuacgaggaca

SEQ ID NO: 4003245 - RNA, 17 nt, Human herpesvirus 8 [Kaposi`s sarcoma-associated h
guccauggcaguggaca

SEQ ID NO: 4003246 - RNA, 13 nt, Human herpesvirus 8 [Kaposi`s sarcoma-associated h
gucccacugcugc

SEQ ID NO: 4003247 - RNA, 15 nt, Human herpesvirus 8 [Kaposi`s sarcoma-associated h
guccgacaugugcuu

SEQ ID NO: 4003248 - RNA, 13 nt, Human herpesvirus 8 [Kaposi`s sarcoma-associated h
gucgacagagcca

SEQ ID NO: 4003249 - RNA, 16 nt, Human herpesvirus 8 [Kaposi`s sarcoma-associated h
gucgccgaggaccuca

SEQ ID NO: 4003250 - RNA, 19 nt, Human herpesvirus 8 [Kaposi`s sarcoma-associated h
gucuacuucgcuaacugua

SEQ ID NO: 4003251 - RNA, 17 nt, Human herpesvirus 8 [Kaposi`s sarcoma-associated h
gucucccuucgugcccc

SEQ ID NO: 4003252 - RNA, 15 nt, Human herpesvirus 8 [Kaposi`s sarcoma-associated h
gucuccgccagggac

SEQ ID NO: 4003253 - RNA, 17 nt, Human herpesvirus 8 [Kaposi`s sarcoma-associated h
gucugcuuuugcgcagg

SEQ ID NO: 4003254 - RNA, 13 nt, Human herpesvirus 8 [Kaposi`s sarcoma-associated h
gugacccggccug

SEQ ID NO: 4003255 - RNA, 23 nt, Human herpesvirus 8 [Kaposi`s sarcoma-associated h
gugcaggaaauagcccuggggga

SEQ ID NO: 4003256 - RNA, 17 nt, Human herpesvirus 8 [Kaposi`s sarcoma-associated h
gugccugggugcugucc

SEQ ID NO: 4003257 - RNA, 13 nt, Human herpesvirus 8 [Kaposi`s sarcoma-associated h
guggaccgugugu

SEQ ID NO: 4003258 - RNA, 18 nt, Human herpesvirus 8 [Kaposi`s sarcoma-associated h
guggauccgcaaugucag

SEQ ID NO: 4003259 - RNA, 21 nt, Human herpesvirus 8 [Kaposi`s sarcoma-associated h
guguugguuacacuaaccaca

SEQ ID NO: 4003260 - RNA, 19 nt, Human herpesvirus 8 [Kaposi`s sarcoma-associated h
guuaagcuuugcagccagg

SEQ ID NO: 4003261 - RNA, 16 nt, Human herpesvirus 8 [Kaposi`s sarcoma-associated h
guuaugggugugugcc

SEQ ID NO: 4003262 - RNA, 22 nt, Human herpesvirus 8 [Kaposi`s sarcoma-associated h
guucauauucccaccuccaccu

SEQ ID NO: 4003263 - RNA, 21 nt, Human herpesvirus 8 [Kaposi`s sarcoma-associated h
guuuauaacaaugaaacgaca

SEQ ID NO: 4003264 - RNA, 12 nt, Human herpesvirus 8 [Kaposi`s sarcoma-associated h
guuugagucuuu

SEQ ID NO: 4003265 - RNA, 23 nt, Human herpesvirus 8 [Kaposi`s sarcoma-associated h
uaaaagacucuagauaaaugggu

SEQ ID NO: 4003266 - RNA, 19 nt, Human herpesvirus 8 [Kaposi`s sarcoma-associated h
uaaaagcauugucuuaagu

SEQ ID NO: 4003267 - RNA, 15 nt, Human herpesvirus 8 [Kaposi`s sarcoma-associated h
uaaaagguuuccugu

SEQ ID NO: 4003268 - RNA, 14 nt, Human herpesvirus 8 [Kaposi`s sarcoma-associated h
uaaaggagggauuu

SEQ ID NO: 4003269 - RNA, 16 nt, Human herpesvirus 8 [Kaposi`s sarcoma-associated h
uaagccucaacgggca

SEQ ID NO: 4003270 - RNA, 21 nt, Human herpesvirus 8 [Kaposi`s sarcoma-associated h
uacaauaaagcugagccacaa

SEQ ID NO: 4003271 - RNA, 18 nt, Human herpesvirus 8 [Kaposi`s sarcoma-associated h
uacacagccaauguuuuu

SEQ ID NO: 4003272 - RNA, 17 nt, Human herpesvirus 8 [Kaposi`s sarcoma-associated h
uacagugaguggcugua

SEQ ID NO: 4003273 - RNA, 20 nt, Human herpesvirus 8 [Kaposi`s sarcoma-associated h
uacccuuccuacccuacucc

SEQ ID NO: 4003274 - RNA, 15 nt, Human herpesvirus 8 [Kaposi`s sarcoma-associated h
uaccucccuuugucu

SEQ ID NO: 4003275 - RNA, 21 nt, Human herpesvirus 8 [Kaposi`s sarcoma-associated h
uacggaagggggcucccuggg

SEQ ID NO: 4003276 - RNA, 23 nt, Human herpesvirus 8 [Kaposi`s sarcoma-associated h
uacgucccucuuggcuguuacaa

SEQ ID NO: 4003277 - RNA, 13 nt, Human herpesvirus 8 [Kaposi`s sarcoma-associated h
uagaccucacccc

SEQ ID NO: 4003278 - RNA, 17 nt, Human herpesvirus 8 [Kaposi`s sarcoma-associated h
uagcguuggcuagucau

SEQ ID NO: 4003279 - RNA, 20 nt, Human herpesvirus 8 [Kaposi`s sarcoma-associated h
uaggaaacacggcccgccuc

SEQ ID NO: 4003280 - RNA, 15 nt, Human herpesvirus 8 [Kaposi`s sarcoma-associated h
uaguucaacugcauu

SEQ ID NO: 4003281 - RNA, 17 nt, Human herpesvirus 8 [Kaposi`s sarcoma-associated h
uauaauggauggcuaug

SEQ ID NO: 4003282 - RNA, 16 nt, Human herpesvirus 8 [Kaposi`s sarcoma-associated h
uauagcagcugucccg

SEQ ID NO: 4003283 - RNA, 15 nt, Human herpesvirus 8 [Kaposi`s sarcoma-associated h
uaugggcuuguacau

SEQ ID NO: 4003284 - RNA, 23 nt, Human herpesvirus 8 [Kaposi`s sarcoma-associated h
ucaccgugccuucgaggccaggc

SEQ ID NO: 4003285 - RNA, 20 nt, Human herpesvirus 8 [Kaposi`s sarcoma-associated h
ucacggccguguuuuucugg

SEQ ID NO: 4003286 - RNA, 16 nt, Human herpesvirus 8 [Kaposi`s sarcoma-associated h
ucagaaaagggcaugu

SEQ ID NO: 4003287 - RNA, 17 nt, Human herpesvirus 8 [Kaposi`s sarcoma-associated h
ucagagagacccugggc

SEQ ID NO: 4003288 - RNA, 18 nt, Human herpesvirus 8 [Kaposi`s sarcoma-associated h
ucagggugccggaguuca

SEQ ID NO: 4003289 - RNA, 19 nt, Human herpesvirus 8 [Kaposi`s sarcoma-associated h
ucaucguggugcccugccc

SEQ ID NO: 4003290 - RNA, 17 nt, Human herpesvirus 8 [Kaposi`s sarcoma-associated h
ucaucuacuuuggacag

SEQ ID NO: 4003291 - RNA, 18 nt, Human herpesvirus 8 [Kaposi`s sarcoma-associated h
uccacccauccuccucag

SEQ ID NO: 4003292 - RNA, 14 nt, Human herpesvirus 8 [Kaposi`s sarcoma-associated h
ucccacccacacau

SEQ ID NO: 4003293 - RNA, 14 nt, Human herpesvirus 8 [Kaposi`s sarcoma-associated h
ucccagcaauaaac

SEQ ID NO: 4003294 - RNA, 15 nt, Human herpesvirus 8 [Kaposi`s sarcoma-associated h
ucccagugccucagc

SEQ ID NO: 4003295 - RNA, 15 nt, Human herpesvirus 8 [Kaposi`s sarcoma-associated h
uccccggcagcaccu

SEQ ID NO: 4003296 - RNA, 15 nt, Human herpesvirus 8 [Kaposi`s sarcoma-associated h
ucccgagacccccag

SEQ ID NO: 4003297 - RNA, 14 nt, Human herpesvirus 8 [Kaposi`s sarcoma-associated h
ucccgugcccaggc

SEQ ID NO: 4003298 - RNA, 18 nt, Human herpesvirus 8 [Kaposi`s sarcoma-associated h
ucccuucgugccccagcg

SEQ ID NO: 4003299 - RNA, 17 nt, Human herpesvirus 8 [Kaposi`s sarcoma-associated h
uccgcaaugucagguuc

SEQ ID NO: 4003300 - RNA, 19 nt, Human herpesvirus 8 [Kaposi`s sarcoma-associated h
uccgcacagacgacugggc

SEQ ID NO: 4003301 - RNA, 14 nt, Human herpesvirus 8 [Kaposi`s sarcoma-associated h
uccucaaacauggg

SEQ ID NO: 4003302 - RNA, 13 nt, Human herpesvirus 8 [Kaposi`s sarcoma-associated h
uccucuugcgcua

SEQ ID NO: 4003303 - RNA, 15 nt, Human herpesvirus 8 [Kaposi`s sarcoma-associated h
uccugcauuuggaca

SEQ ID NO: 4003304 - RNA, 16 nt, Human herpesvirus 8 [Kaposi`s sarcoma-associated h
uccugucuaaaaucag

SEQ ID NO: 4003305 - RNA, 23 nt, Human herpesvirus 8 [Kaposi`s sarcoma-associated h
ucgaaaaaaauaaugcagacaga

SEQ ID NO: 4003306 - RNA, 20 nt, Human herpesvirus 8 [Kaposi`s sarcoma-associated h
ucgcaagggcgucugugccu

SEQ ID NO: 4003307 - RNA, 18 nt, Human herpesvirus 8 [Kaposi`s sarcoma-associated h
ucgcacguuagaaacccc

SEQ ID NO: 4003308 - RNA, 22 nt, Human herpesvirus 8 [Kaposi`s sarcoma-associated h
ucgcgcgaacacguaccugacc

SEQ ID NO: 4003309 - RNA, 22 nt, Human herpesvirus 8 [Kaposi`s sarcoma-associated h
ucgugcuuacccacccccuucu

SEQ ID NO: 4003310 - RNA, 23 nt, Human herpesvirus 8 [Kaposi`s sarcoma-associated h
ucguugacauguggagccacugg

SEQ ID NO: 4003311 - RNA, 13 nt, Human herpesvirus 8 [Kaposi`s sarcoma-associated h
ucuacgugcccuu

SEQ ID NO: 4003312 - RNA, 17 nt, Human herpesvirus 8 [Kaposi`s sarcoma-associated h
ucucacccaauacuuaa

SEQ ID NO: 4003313 - RNA, 15 nt, Human herpesvirus 8 [Kaposi`s sarcoma-associated h
cuggagacggggaag

SEQ ID NO: 4003314 - RNA, 19 nt, Human herpesvirus 8 [Kaposi`s sarcoma-associated h
cugggagauuggguuggga

SEQ ID NO: 4003315 - RNA, 20 nt, Human herpesvirus 8 [Kaposi`s sarcoma-associated h
cugggccacaaaacugccaa

SEQ ID NO: 4003316 - RNA, 13 nt, Human herpesvirus 8 [Kaposi`s sarcoma-associated h
cugguaccagaga

SEQ ID NO: 4003317 - RNA, 20 nt, Human herpesvirus 8 [Kaposi`s sarcoma-associated h
cugguggaacaugcugccac

SEQ ID NO: 4003318 - RNA, 17 nt, Human herpesvirus 8 [Kaposi`s sarcoma-associated h
cugguucaggauuucga

SEQ ID NO: 4003319 - RNA, 13 nt, Human herpesvirus 8 [Kaposi`s sarcoma-associated h
cuguaaaacacug

SEQ ID NO: 4003320 - RNA, 15 nt, Human herpesvirus 8 [Kaposi`s sarcoma-associated h
cuguaugacugcccu

SEQ ID NO: 4003321 - RNA, 14 nt, Human herpesvirus 8 [Kaposi`s sarcoma-associated h
cugucagauuuaca

SEQ ID NO: 4003322 - RNA, 11 nt, Human herpesvirus 8 [Kaposi`s sarcoma-associated h
cugugcccaaa

SEQ ID NO: 4003323 - RNA, 20 nt, Human herpesvirus 8 [Kaposi`s sarcoma-associated h
cugugcccccuuaauccuua

SEQ ID NO: 4003324 - RNA, 16 nt, Human herpesvirus 8 [Kaposi`s sarcoma-associated h
cuguuacaauaaagcc

SEQ ID NO: 4003325 - RNA, 19 nt, Human herpesvirus 8 [Kaposi`s sarcoma-associated h
cuguuugcuuaauaaauug

SEQ ID NO: 4003326 - RNA, 20 nt, Human herpesvirus 8 [Kaposi`s sarcoma-associated h
cuuacuaagagaacagcaca

SEQ ID NO: 4003327 - RNA, 15 nt, Human herpesvirus 8 [Kaposi`s sarcoma-associated h
cuuauaacagugcuc

SEQ ID NO: 4003328 - RNA, 13 nt, Human herpesvirus 8 [Kaposi`s sarcoma-associated h
cuuauuaaaagca

SEQ ID NO: 4003329 - RNA, 18 nt, Human herpesvirus 8 [Kaposi`s sarcoma-associated h
cuuggcguuuaccugcac

SEQ ID NO: 4003330 - RNA, 16 nt, Human herpesvirus 8 [Kaposi`s sarcoma-associated h
cuuucaucacuuccag

SEQ ID NO: 4003331 - RNA, 15 nt, Human herpesvirus 8 [Kaposi`s sarcoma-associated h
cuuuuuaacuucuga

SEQ ID NO: 4003332 - RNA, 21 nt, Human herpesvirus 8 [Kaposi`s sarcoma-associated h
gaaacugcucucgcugcucag

SEQ ID NO: 4003333 - RNA, 14 nt, Human herpesvirus 8 [Kaposi`s sarcoma-associated h
gaacaucagagaug

SEQ ID NO: 4003334 - RNA, 19 nt, Human herpesvirus 8 [Kaposi`s sarcoma-associated h
gaagaaaaggaugcacaac

SEQ ID NO: 4003335 - RNA, 13 nt, Human herpesvirus 8 [Kaposi`s sarcoma-associated h
gaagaugaagaug

SEQ ID NO: 4003336 - RNA, 23 nt, Human herpesvirus 8 [Kaposi`s sarcoma-associated h
gaaucgaacaauaauaaaaacau

SEQ ID NO: 4003337 - RNA, 22 nt, Human herpesvirus 8 [Kaposi`s sarcoma-associated h
gaauguggaauauaaugugaaa

SEQ ID NO: 4003338 - RNA, 20 nt, Human herpesvirus 8 [Kaposi`s sarcoma-associated h
gacaaacacuguggauuuua

SEQ ID NO: 4003339 - RNA, 20 nt, Human herpesvirus 8 [Kaposi`s sarcoma-associated h
gacaaaugugugggugggaa

SEQ ID NO: 4003340 - RNA, 16 nt, Human herpesvirus 8 [Kaposi`s sarcoma-associated h
gacaccauucuuuuau

SEQ ID NO: 4003341 - RNA, 20 nt, Human herpesvirus 8 [Kaposi`s sarcoma-associated h
gacaccgucgccaaacaggc

SEQ ID NO: 4003342 - RNA, 23 nt, Human herpesvirus 8 [Kaposi`s sarcoma-associated h
gacagggguguuaggucuggugg

SEQ ID NO: 4003343 - RNA, 14 nt, Human herpesvirus 8 [Kaposi`s sarcoma-associated h
gacauguggagcca

SEQ ID NO: 4003344 - RNA, 23 nt, Human herpesvirus 8 [Kaposi`s sarcoma-associated h
gaccacauaauuggauggggcau

SEQ ID NO: 4003345 - RNA, 18 nt, Human herpesvirus 8 [Kaposi`s sarcoma-associated h
gaccccgauaugcaccuc

SEQ ID NO: 4003346 - RNA, 20 nt, Human herpesvirus 8 [Kaposi`s sarcoma-associated h
gaccccgauaugcaccucca

SEQ ID NO: 4003347 - RNA, 13 nt, Human herpesvirus 8 [Kaposi`s sarcoma-associated h
gacccuagucacu

SEQ ID NO: 4003348 - RNA, 20 nt, Human herpesvirus 8 [Kaposi`s sarcoma-associated h
gaccuaaccgcaaagauaag

SEQ ID NO: 4003349 - RNA, 15 nt, Human herpesvirus 8 [Kaposi`s sarcoma-associated h
gaccugaugcaggcc

SEQ ID NO: 4003350 - RNA, 16 nt, Human herpesvirus 8 [Kaposi`s sarcoma-associated h
gacgaggaugaggaag

SEQ ID NO: 4003351 - RNA, 23 nt, Human herpesvirus 8 [Kaposi`s sarcoma-associated h
gacgccauuugcgugcaaaaugu

SEQ ID NO: 4003352 - RNA, 17 nt, Human herpesvirus 8 [Kaposi`s sarcoma-associated h
gacugggucuaucugga

SEQ ID NO: 4003353 - RNA, 12 nt, Human herpesvirus 8 [Kaposi`s sarcoma-associated h
gagagacugcag

SEQ ID NO: 4003354 - RNA, 16 nt, Human herpesvirus 8 [Kaposi`s sarcoma-associated h
gagcacacuguguggu

SEQ ID NO: 4003355 - RNA, 17 nt, Human herpesvirus 8 [Kaposi`s sarcoma-associated h
gagcgagugugccuccu

SEQ ID NO: 4003356 - RNA, 22 nt, Human herpesvirus 8 [Kaposi`s sarcoma-associated h
gagcuguuacccugcucuggac

SEQ ID NO: 4003357 - RNA, 15 nt, Human herpesvirus 8 [Kaposi`s sarcoma-associated h
gagggaauggccucc

SEQ ID NO: 4003358 - RNA, 20 nt, Human herpesvirus 8 [Kaposi`s sarcoma-associated h
gagggcuguucucgccugga

SEQ ID NO: 4003359 - RNA, 24 nt, Human herpesvirus 8 [Kaposi`s sarcoma-associated h
gagggcuguucucgccuggagcag

SEQ ID NO: 4003360 - RNA, 17 nt, Human herpesvirus 8 [Kaposi`s sarcoma-associated h
gaguccauggcagugga

SEQ ID NO: 4003361 - RNA, 21 nt, Human herpesvirus 8 [Kaposi`s sarcoma-associated h
gagugggcggaaguacuggga

SEQ ID NO: 4003362 - RNA, 20 nt, Human herpesvirus 8 [Kaposi`s sarcoma-associated h
gauaauugagcgcugugcuu

SEQ ID NO: 4003363 - RNA, 22 nt, Human herpesvirus 8 [Kaposi`s sarcoma-associated h
gauaauugagcgcugugcuuuu

SEQ ID NO: 4003364 - RNA, 14 nt, Human herpesvirus 8 [Kaposi`s sarcoma-associated h
gauacacuacuuau

SEQ ID NO: 4003365 - RNA, 16 nt, Human herpesvirus 8 [Kaposi`s sarcoma-associated h
gauacugaucacugcg

SEQ ID NO: 4003366 - RNA, 17 nt, Human herpesvirus 8 [Kaposi`s sarcoma-associated h
gaucaacacuucguccc

SEQ ID NO: 4003367 - RNA, 20 nt, Human herpesvirus 8 [Kaposi`s sarcoma-associated h
gaucucccaauuacaggaga

SEQ ID NO: 4003368 - RNA, 12 nt, Human herpesvirus 8 [Kaposi`s sarcoma-associated h
gaugagccagaa

SEQ ID NO: 4003369 - RNA, 13 nt, Human herpesvirus 8 [Kaposi`s sarcoma-associated h
gauguuuuccagc

SEQ ID NO: 4003370 - RNA, 13 nt, Human herpesvirus 8 [Kaposi`s sarcoma-associated h
gauucugacagac

SEQ ID NO: 4003371 - RNA, 12 nt, Human herpesvirus 8 [Kaposi`s sarcoma-associated h
auaauggauggc

SEQ ID NO: 4003372 - RNA, 16 nt, Human herpesvirus 8 [Kaposi`s sarcoma-associated h
auaauggauggcuaug

SEQ ID NO: 4003373 - RNA, 15 nt, Human herpesvirus 8 [Kaposi`s sarcoma-associated h
auacaagacaacuaa

SEQ ID NO: 4003374 - RNA, 13 nt, Human herpesvirus 8 [Kaposi`s sarcoma-associated h
auacaugagagac

SEQ ID NO: 4003375 - RNA, 15 nt, Human herpesvirus 8 [Kaposi`s sarcoma-associated h
auagcuacaaauguu

SEQ ID NO: 4003376 - RNA, 24 nt, Human herpesvirus 8 [Kaposi`s sarcoma-associated h
auccacaggaagcgaaaagccugc

SEQ ID NO: 4003377 - RNA, 17 nt, Human herpesvirus 8 [Kaposi`s sarcoma-associated h
auccuuugggccguggu

SEQ ID NO: 4003378 - RNA, 20 nt, Human herpesvirus 8 [Kaposi`s sarcoma-associated h
aucgccguguugcgcgcugg

SEQ ID NO: 4003379 - RNA, 12 nt, Human herpesvirus 8 [Kaposi`s sarcoma-associated h
aucggcuugcac

SEQ ID NO: 4003380 - RNA, 14 nt, Human herpesvirus 8 [Kaposi`s sarcoma-associated h
aucuagacugcuag

SEQ ID NO: 4003381 - RNA, 16 nt, Human herpesvirus 8 [Kaposi`s sarcoma-associated h
aucuaucucugguggu

SEQ ID NO: 4003382 - RNA, 17 nt, Human herpesvirus 8 [Kaposi`s sarcoma-associated h
aucuaucucugguggug

SEQ ID NO: 4003383 - RNA, 14 nt, Human herpesvirus 8 [Kaposi`s sarcoma-associated h
aucuggcaugcugg

SEQ ID NO: 4003384 - RNA, 22 nt, Human herpesvirus 8 [Kaposi`s sarcoma-associated h
augaaaaguguucccaaaaaac

SEQ ID NO: 4003385 - RNA, 15 nt, Human herpesvirus 8 [Kaposi`s sarcoma-associated h
augaguuccacacag

SEQ ID NO: 4003386 - RNA, 18 nt, Human herpesvirus 8 [Kaposi`s sarcoma-associated h
augcuagcgugucugaaa

SEQ ID NO: 4003387 - RNA, 15 nt, Human herpesvirus 8 [Kaposi`s sarcoma-associated h
auggaccucugucuu

SEQ ID NO: 4003388 - RNA, 22 nt, Human herpesvirus 8 [Kaposi`s sarcoma-associated h
auggcaguggacacagucuggg

SEQ ID NO: 4003389 - RNA, 20 nt, Human herpesvirus 8 [Kaposi`s sarcoma-associated h
auggcccacggggacaugga

SEQ ID NO: 4003390 - RNA, 16 nt, Human herpesvirus 8 [Kaposi`s sarcoma-associated h
auggguuaacagugga

SEQ ID NO: 4003391 - RNA, 13 nt, Human herpesvirus 8 [Kaposi`s sarcoma-associated h
augguauggcgcu

SEQ ID NO: 4003392 - RNA, 22 nt, Human herpesvirus 8 [Kaposi`s sarcoma-associated h
augucauuuuuacuuuuacaag

SEQ ID NO: 4003393 - RNA, 23 nt, Human herpesvirus 8 [Kaposi`s sarcoma-associated h
auuccucuccgcauuaaagcacu

SEQ ID NO: 4003394 - RNA, 18 nt, Human herpesvirus 8 [Kaposi`s sarcoma-associated h
auucggagaacaugcugg

SEQ ID NO: 4003395 - RNA, 19 nt, Human herpesvirus 8 [Kaposi`s sarcoma-associated h
auucuacuuaaaauagcuc

SEQ ID NO: 4003396 - RNA, 19 nt, Human herpesvirus 8 [Kaposi`s sarcoma-associated h
auuggaggcacauaaggaa

SEQ ID NO: 4003397 - RNA, 17 nt, Human herpesvirus 8 [Kaposi`s sarcoma-associated h
auuuccugcugucuauc

SEQ ID NO: 4003398 - RNA, 17 nt, Human herpesvirus 8 [Kaposi`s sarcoma-associated h
auuucuuuuugccagag

SEQ ID NO: 4003399 - RNA, 15 nt, Human herpesvirus 8 [Kaposi`s sarcoma-associated h
auuuuucaucugaaa

SEQ ID NO: 4003400 - RNA, 16 nt, Human herpesvirus 8 [Kaposi`s sarcoma-associated h
auuuuuuuccuaggcg

SEQ ID NO: 4003401 - RNA, 16 nt, Human herpesvirus 8 [Kaposi`s sarcoma-associated h
caaaauaccugucgcu

SEQ ID NO: 4003402 - RNA, 19 nt, Human herpesvirus 8 [Kaposi`s sarcoma-associated h
caaacuucggaauuuccua

SEQ ID NO: 4003403 - RNA, 23 nt, Human herpesvirus 8 [Kaposi`s sarcoma-associated h
caacauguaaauuggccacugca

SEQ ID NO: 4003404 - RNA, 23 nt, Human herpesvirus 8 [Kaposi`s sarcoma-associated h
caacccacgccgucacagucgcc

SEQ ID NO: 4003405 - RNA, 21 nt, Human herpesvirus 8 [Kaposi`s sarcoma-associated h
caacuauuuccuuuuuucaaa

SEQ ID NO: 4003406 - RNA, 23 nt, Human herpesvirus 8 [Kaposi`s sarcoma-associated h
caacuauuuccuuuuuucaaaag

SEQ ID NO: 4003407 - RNA, 16 nt, Human herpesvirus 8 [Kaposi`s sarcoma-associated h
caagaucuuccagucu

SEQ ID NO: 4003408 - RNA, 18 nt, Human herpesvirus 8 [Kaposi`s sarcoma-associated h
caagcagcaaacggagac

SEQ ID NO: 4003409 - RNA, 20 nt, Human herpesvirus 8 [Kaposi`s sarcoma-associated h
caauagggauacuguuuaua

SEQ ID NO: 4003410 - RNA, 21 nt, Human herpesvirus 8 [Kaposi`s sarcoma-associated h
caauuuauuaagcaaacagua

SEQ ID NO: 4003411 - RNA, 23 nt, Human herpesvirus 8 [Kaposi`s sarcoma-associated h
cacacguagggcuuuacccucug

SEQ ID NO: 4003412 - RNA, 11 nt, Human herpesvirus 8 [Kaposi`s sarcoma-associated h
cacacuggccc

SEQ ID NO: 4003413 - RNA, 21 nt, Human herpesvirus 8 [Kaposi`s sarcoma-associated h
cacagaaacucccccaaccuc

SEQ ID NO: 4003414 - RNA, 22 nt, Human herpesvirus 8 [Kaposi`s sarcoma-associated h
cacaguguaucccccacaggac

SEQ ID NO: 4003415 - RNA, 22 nt, Human herpesvirus 8 [Kaposi`s sarcoma-associated h
cacauacacuagacuggcucug

SEQ ID NO: 4003416 - RNA, 20 nt, Human herpesvirus 8 [Kaposi`s sarcoma-associated h
cacauccgcugccaccugcg

SEQ ID NO: 4003417 - RNA, 14 nt, Human herpesvirus 8 [Kaposi`s sarcoma-associated h
cacaucugcugucu

SEQ ID NO: 4003418 - RNA, 20 nt, Human herpesvirus 8 [Kaposi`s sarcoma-associated h
caccaagguaggccagcugc

SEQ ID NO: 4003419 - RNA, 14 nt, Human herpesvirus 8 [Kaposi`s sarcoma-associated h
caccacaucugcug

SEQ ID NO: 4003420 - RNA, 14 nt, Human herpesvirus 8 [Kaposi`s sarcoma-associated h
caccgucuggcugg

SEQ ID NO: 4003421 - RNA, 16 nt, Human herpesvirus 8 [Kaposi`s sarcoma-associated h
caccuagcgggcacaa

SEQ ID NO: 4003422 - RNA, 15 nt, Human herpesvirus 8 [Kaposi`s sarcoma-associated h
caccugaggugcucu

SEQ ID NO: 4003423 - RNA, 13 nt, Human herpesvirus 8 [Kaposi`s sarcoma-associated h
caccuucuggcuu

SEQ ID NO: 4003424 - RNA, 16 nt, Human herpesvirus 8 [Kaposi`s sarcoma-associated h
cacgucgcucuuuacu

SEQ ID NO: 4003425 - RNA, 22 nt, Human herpesvirus 8 [Kaposi`s sarcoma-associated h
cacuauggggucaggguggacg

SEQ ID NO: 4003426 - RNA, 17 nt, Human herpesvirus 8 [Kaposi`s sarcoma-associated h
cacucagguguuuucca

SEQ ID NO: 4003427 - RNA, 20 nt, Human herpesvirus 8 [Kaposi`s sarcoma-associated h
cagacucuguguccuccucu

SEQ ID NO: 4003428 - RNA, 21 nt, Human herpesvirus 8 [Kaposi`s sarcoma-associated h
cagagcacccugaaacuccag

SEQ ID NO: 4003429 - RNA, 17 nt, Human herpesvirus 8 [Kaposi`s sarcoma-associated h
cagagcagugcucccgu

SEQ ID NO: 4003430 - RNA, 23 nt, Human herpesvirus 8 [Kaposi`s sarcoma-associated h
cagagccuucacggcacacuacu

SEQ ID NO: 4003431 - RNA, 16 nt, Human herpesvirus 8 [Kaposi`s sarcoma-associated h
cagagucuacgugcca

SEQ ID NO: 4003432 - RNA, 19 nt, Human herpesvirus 8 [Kaposi`s sarcoma-associated h
cagauccuccacagagccu

SEQ ID NO: 4003433 - RNA, 18 nt, Human herpesvirus 8 [Kaposi`s sarcoma-associated h
cagcaauaaacccacagc

SEQ ID NO: 4003434 - RNA, 19 nt, Human herpesvirus 8 [Kaposi`s sarcoma-associated h
cagcacauaugucucccuu

SEQ ID NO: 4003435 - RNA, 15 nt, Human herpesvirus 8 [Kaposi`s sarcoma-associated h
cagcaguagacgcag

SEQ ID NO: 4003436 - RNA, 17 nt, Human herpesvirus 8 [Kaposi`s sarcoma-associated h
cagcaguagacgcaggc

SEQ ID NO: 4003437 - RNA, 20 nt, Human herpesvirus 8 [Kaposi`s sarcoma-associated h
cagcauggccuuuuuaagac

SEQ ID NO: 4003438 - RNA, 22 nt, Human herpesvirus 8 [Kaposi`s sarcoma-associated h
cagccaccguaacuucaccgug

SEQ ID NO: 4003439 - RNA, 16 nt, Human herpesvirus 8 [Kaposi`s sarcoma-associated h
cagccggucgccaggg

SEQ ID NO: 4003440 - RNA, 17 nt, Human herpesvirus 8 [Kaposi`s sarcoma-associated h
cagccggucgccagggu

SEQ ID NO: 4003441 - RNA, 20 nt, Human herpesvirus 8 [Kaposi`s sarcoma-associated h
cagccucacggacaacgcca

SEQ ID NO: 4003442 - RNA, 21 nt, Human herpesvirus 8 [Kaposi`s sarcoma-associated h
cagccucacggacaacgccau

SEQ ID NO: 4003443 - RNA, 15 nt, Human herpesvirus 8 [Kaposi`s sarcoma-associated h
cagcugcagccagga

SEQ ID NO: 4003444 - RNA, 13 nt, Human herpesvirus 8 [Kaposi`s sarcoma-associated h
caggcgccuauga

SEQ ID NO: 4003445 - RNA, 17 nt, Human herpesvirus 8 [Kaposi`s sarcoma-associated h
cagggcagcgugucgcc

SEQ ID NO: 4003446 - RNA, 17 nt, Human herpesvirus 8 [Kaposi`s sarcoma-associated h
cagggcaugaggcugga

SEQ ID NO: 4003447 - RNA, 21 nt, Human herpesvirus 8 [Kaposi`s sarcoma-associated h
cagggcaugaggcuggaccuc

SEQ ID NO: 4003448 - RNA, 18 nt, Human herpesvirus 8 [Kaposi`s sarcoma-associated h
cagggugcggugcugccc

SEQ ID NO: 4003449 - RNA, 17 nt, Human herpesvirus 8 [Kaposi`s sarcoma-associated h
agcgccaccguguggcu

SEQ ID NO: 4003450 - RNA, 22 nt, Human herpesvirus 8 [Kaposi`s sarcoma-associated h
agcgccuagaaaguuuccucuu

SEQ ID NO: 4003451 - RNA, 22 nt, Human herpesvirus 8 [Kaposi`s sarcoma-associated h
agcguagaugaaugucucaaac

SEQ ID NO: 4003452 - RNA, 17 nt, Human herpesvirus 8 [Kaposi`s sarcoma-associated h
agcucaucaaugggaga

SEQ ID NO: 4003453 - RNA, 18 nt, Human herpesvirus 8 [Kaposi`s sarcoma-associated h
agcucaucaaugggagaa

SEQ ID NO: 4003454 - RNA, 16 nt, Human herpesvirus 8 [Kaposi`s sarcoma-associated h
agcuuugcagccaggu

SEQ ID NO: 4003455 - RNA, 21 nt, Human herpesvirus 8 [Kaposi`s sarcoma-associated h
aggaacagauuauuuuccuuc

SEQ ID NO: 4003456 - RNA, 19 nt, Human herpesvirus 8 [Kaposi`s sarcoma-associated h
aggaccuuacgauggaaga

SEQ ID NO: 4003457 - RNA, 22 nt, Human herpesvirus 8 [Kaposi`s sarcoma-associated h
aggaccuuucugcugcaucacg

SEQ ID NO: 4003458 - RNA, 20 nt, Human herpesvirus 8 [Kaposi`s sarcoma-associated h
aggaucugugugugaagcag

SEQ ID NO: 4003459 - RNA, 14 nt, Human herpesvirus 8 [Kaposi`s sarcoma-associated h
aggcuggaccuccu

SEQ ID NO: 4003460 - RNA, 22 nt, Human herpesvirus 8 [Kaposi`s sarcoma-associated h
agggcggaaaaauaaauuuucc

SEQ ID NO: 4003461 - RNA, 20 nt, Human herpesvirus 8 [Kaposi`s sarcoma-associated h
agggcucguucaaugcaugu

SEQ ID NO: 4003462 - RNA, 21 nt, Human herpesvirus 8 [Kaposi`s sarcoma-associated h
aggggcagacccaaaaaggac

SEQ ID NO: 4003463 - RNA, 16 nt, Human herpesvirus 8 [Kaposi`s sarcoma-associated h
agggggaugagccaga

SEQ ID NO: 4003464 - RNA, 20 nt, Human herpesvirus 8 [Kaposi`s sarcoma-associated h
aggguuuauagaagagccug

SEQ ID NO: 4003465 - RNA, 19 nt, Human herpesvirus 8 [Kaposi`s sarcoma-associated h
aggucgcagagaccucuug

SEQ ID NO: 4003466 - RNA, 19 nt, Human herpesvirus 8 [Kaposi`s sarcoma-associated h
aggugccgucgucgagcac

SEQ ID NO: 4003467 - RNA, 15 nt, Human herpesvirus 8 [Kaposi`s sarcoma-associated h
aguccagccacggcc

SEQ ID NO: 4003468 - RNA, 18 nt, Human herpesvirus 8 [Kaposi`s sarcoma-associated h
agucuaaggccagcgaga

SEQ ID NO: 4003469 - RNA, 18 nt, Human herpesvirus 8 [Kaposi`s sarcoma-associated h
agucugaaccccgugugg

SEQ ID NO: 4003470 - RNA, 18 nt, Human herpesvirus 8 [Kaposi`s sarcoma-associated h
aguguuaucuuugcagug

SEQ ID NO: 4003471 - RNA, 14 nt, Human herpesvirus 8 [Kaposi`s sarcoma-associated h
auaaaagagagaau

SEQ ID NO: 4003472 - RNA, 20 nt, Human herpesvirus 8 [Kaposi`s sarcoma-associated h
auaaaauacgcgugugggaa

SEQ ID NO: 4003473 - RNA, 16 nt, Human herpesvirus 8 [Kaposi`s sarcoma-associated h
auaaagccgagccaca

SEQ ID NO: 4003474 - RNA, 16 nt, Human herpesvirus 8 [Kaposi`s sarcoma-associated h
auaaagcugagccaca

SEQ ID NO: 4003475 - RNA, 18 nt, Human herpesvirus 8 [Kaposi`s sarcoma-associated h
auaaucuaaauauucucu

SEQ ID NO: 4003476 - RNA, 19 nt, Human herpesvirus 8 [Kaposi`s sarcoma-associated h
auacaaacaacauaaacau

SEQ ID NO: 4003477 - RNA, 22 nt, Human herpesvirus 8 [Kaposi`s sarcoma-associated h
auacauugugagggaguguuuu

SEQ ID NO: 4003478 - RNA, 21 nt, Human herpesvirus 8 [Kaposi`s sarcoma-associated h
auacgguguaggcauuuugua

SEQ ID NO: 4003479 - RNA, 17 nt, Human herpesvirus 8 [Kaposi`s sarcoma-associated h
auacuuugcgugucuag

SEQ ID NO: 4003480 - RNA, 14 nt, Human herpesvirus 8 [Kaposi`s sarcoma-associated h
auagccgccgggag

SEQ ID NO: 4003481 - RNA, 13 nt, Human herpesvirus 8 [Kaposi`s sarcoma-associated h
aucaaagaaaggu

SEQ ID NO: 4003482 - RNA, 17 nt, Human herpesvirus 8 [Kaposi`s sarcoma-associated h
aucaauaaagagaccaa

SEQ ID NO: 4003483 - RNA, 18 nt, Human herpesvirus 8 [Kaposi`s sarcoma-associated h
aucaaucugagaaaaguu

SEQ ID NO: 4003484 - RNA, 17 nt, Human herpesvirus 8 [Kaposi`s sarcoma-associated h
aucagcugcagccagga

SEQ ID NO: 4003485 - RNA, 18 nt, Human herpesvirus 8 [Kaposi`s sarcoma-associated h
aucccccacaggacaagc

SEQ ID NO: 4003486 - RNA, 14 nt, Human herpesvirus 8 [Kaposi`s sarcoma-associated h
aucgccgccagcaa

SEQ ID NO: 4003487 - RNA, 23 nt, Human herpesvirus 8 [Kaposi`s sarcoma-associated h
aucuccggacuacauccaaauua

SEQ ID NO: 4003488 - RNA, 16 nt, Human herpesvirus 8 [Kaposi`s sarcoma-associated h
aucucgguacugcgca

SEQ ID NO: 4003489 - RNA, 15 nt, Human herpesvirus 8 [Kaposi`s sarcoma-associated h
aucugguccuaagag

SEQ ID NO: 4003490 - RNA, 18 nt, Human herpesvirus 8 [Kaposi`s sarcoma-associated h
aucuuagucuuacuguca

SEQ ID NO: 4003491 - RNA, 23 nt, Human herpesvirus 8 [Kaposi`s sarcoma-associated h
augaauaacuuuauuacagguau

SEQ ID NO: 4003492 - RNA, 19 nt, Human herpesvirus 8 [Kaposi`s sarcoma-associated h
augaccaacaggcuguccu

SEQ ID NO: 4003493 - RNA, 17 nt, Human herpesvirus 8 [Kaposi`s sarcoma-associated h
augagugaaaaggaagc

SEQ ID NO: 4003494 - RNA, 16 nt, Human herpesvirus 8 [Kaposi`s sarcoma-associated h
augcucaggucuguca

SEQ ID NO: 4003495 - RNA, 21 nt, Human herpesvirus 8 [Kaposi`s sarcoma-associated h
auggccuccacccaccaagcu

SEQ ID NO: 4003496 - RNA, 13 nt, Human herpesvirus 8 [Kaposi`s sarcoma-associated h
auggcguccgcuc

SEQ ID NO: 4003497 - RNA, 19 nt, Human herpesvirus 8 [Kaposi`s sarcoma-associated h
auggcuucuauaagcaccu

SEQ ID NO: 4003498 - RNA, 16 nt, Human herpesvirus 8 [Kaposi`s sarcoma-associated h
augggucaugcgucgc

SEQ ID NO: 4003499 - RNA, 19 nt, Human herpesvirus 8 [Kaposi`s sarcoma-associated h
auguaccuggcguccagcu

SEQ ID NO: 4003500 - RNA, 19 nt, Human herpesvirus 8 [Kaposi`s sarcoma-associated h
auguccugauuuuccaggg

SEQ ID NO: 4003501 - RNA, 19 nt, Human herpesvirus 8 [Kaposi`s sarcoma-associated h
augucuguguuuuguaaac

SEQ ID NO: 4003502 - RNA, 13 nt, Human herpesvirus 8 [Kaposi`s sarcoma-associated h
auguguguaacuu

SEQ ID NO: 4003503 - RNA, 22 nt, Human herpesvirus 8 [Kaposi`s sarcoma-associated h
auguuuauuuuuuuucaaacag

SEQ ID NO: 4003504 - RNA, 15 nt, Human herpesvirus 8 [Kaposi`s sarcoma-associated h
auuaacauccacagg

SEQ ID NO: 4003505 - RNA, 14 nt, Human herpesvirus 8 [Kaposi`s sarcoma-associated h
auuaauaaccauga

SEQ ID NO: 4003506 - RNA, 16 nt, Human herpesvirus 8 [Kaposi`s sarcoma-associated h
auuagaagaaaaggau

SEQ ID NO: 4003507 - RNA, 19 nt, Human herpesvirus 8 [Kaposi`s sarcoma-associated h
auuaguguuauaagaaauu

SEQ ID NO: 4003508 - RNA, 14 nt, Human herpesvirus 8 [Kaposi`s sarcoma-associated h
auuauugcaccauu

SEQ ID NO: 4003509 - RNA, 18 nt, Human herpesvirus 8 [Kaposi`s sarcoma-associated h
auucaugccuuucuguaa

SEQ ID NO: 4003510 - RNA, 16 nt, Human herpesvirus 8 [Kaposi`s sarcoma-associated h
auucccaaacacauca

SEQ ID NO: 4003511 - RNA, 16 nt, Human herpesvirus 8 [Kaposi`s sarcoma-associated h
auugugucaaccaggg

SEQ ID NO: 4003512 - RNA, 22 nt, Human herpesvirus 8 [Kaposi`s sarcoma-associated h
auuuauuuuuuacuacagguau

SEQ ID NO: 4003513 - RNA, 23 nt, Human herpesvirus 8 [Kaposi`s sarcoma-associated h
auuucucgccucccaacauguaa

SEQ ID NO: 4003514 - RNA, 14 nt, Human herpesvirus 8 [Kaposi`s sarcoma-associated h
auuuuauggacauu

SEQ ID NO: 4003515 - RNA, 12 nt, Human herpesvirus 8 [Kaposi`s sarcoma-associated h
caaaaacacaau

SEQ ID NO: 4003516 - RNA, 16 nt, Human herpesvirus 8 [Kaposi`s sarcoma-associated h
caaacuucggaauuuc

SEQ ID NO: 4003517 - RNA, 14 nt, Human herpesvirus 8 [Kaposi`s sarcoma-associated h
caaagccguuccca

SEQ ID NO: 4003518 - RNA, 20 nt, Human herpesvirus 8 [Kaposi`s sarcoma-associated h
caaagugagguggcauuugu

SEQ ID NO: 4003519 - RNA, 19 nt, Human herpesvirus 8 [Kaposi`s sarcoma-associated h
caaaugauauuuugauggu

SEQ ID NO: 4003520 - RNA, 21 nt, Human herpesvirus 8 [Kaposi`s sarcoma-associated h
caacaauagggauacuguuua

SEQ ID NO: 4003521 - RNA, 14 nt, Human herpesvirus 8 [Kaposi`s sarcoma-associated h
caacauuaaacaca

SEQ ID NO: 4003522 - RNA, 16 nt, Human herpesvirus 8 [Kaposi`s sarcoma-associated h
caaccuggcaagcagu

SEQ ID NO: 4003523 - RNA, 16 nt, Human herpesvirus 8 [Kaposi`s sarcoma-associated h
caacgccaugcagcgg

SEQ ID NO: 4003524 - RNA, 19 nt, Human herpesvirus 8 [Kaposi`s sarcoma-associated h
caacuucaucacauccccg

SEQ ID NO: 4003525 - RNA, 17 nt, Human herpesvirus 8 [Kaposi`s sarcoma-associated h
caagcuacuggccuggc

SEQ ID NO: 4003526 - RNA, 20 nt, Human herpesvirus 8 [Kaposi`s sarcoma-associated h
caagcuguuggcgcuuugcu

SEQ ID NO: 4003527 - RNA, 22 nt, Human herpesvirus 8 [Kaposi`s sarcoma-associated h
cauccacgcggauaggcugggg

SEQ ID NO: 4003528 - RNA, 15 nt, Human herpesvirus 8 [Kaposi`s sarcoma-associated h
cauccauuauagcac

SEQ ID NO: 4003529 - RNA, 14 nt, Human herpesvirus 8 [Kaposi`s sarcoma-associated h
caucgccgccagca

SEQ ID NO: 4003530 - RNA, 16 nt, Human herpesvirus 8 [Kaposi`s sarcoma-associated h
caucguggugcccugc

SEQ ID NO: 4003531 - RNA, 16 nt, Human herpesvirus 8 [Kaposi`s sarcoma-associated h
caucucgguacugcgc

SEQ ID NO: 4003532 - RNA, 18 nt, Human herpesvirus 8 [Kaposi`s sarcoma-associated h
caucucgguacugcgcau

SEQ ID NO: 4003533 - RNA, 22 nt, Human herpesvirus 8 [Kaposi`s sarcoma-associated h
caugcccuccugggccaggcac

SEQ ID NO: 4003534 - RNA, 12 nt, Human herpesvirus 8 [Kaposi`s sarcoma-associated h
caugccugugga

SEQ ID NO: 4003535 - RNA, 13 nt, Human herpesvirus 8 [Kaposi`s sarcoma-associated h
caugccuguggau

SEQ ID NO: 4003536 - RNA, 20 nt, Human herpesvirus 8 [Kaposi`s sarcoma-associated h
caugcugccacugccacgga

SEQ ID NO: 4003537 - RNA, 23 nt, Human herpesvirus 8 [Kaposi`s sarcoma-associated h
caugcuggaucccagugccucag

SEQ ID NO: 4003538 - RNA, 16 nt, Human herpesvirus 8 [Kaposi`s sarcoma-associated h
cauguaaauuggccac

SEQ ID NO: 4003539 - RNA, 21 nt, Human herpesvirus 8 [Kaposi`s sarcoma-associated h
caugugcuuuugcuuggcgcu

SEQ ID NO: 4003540 - RNA, 14 nt, Human herpesvirus 8 [Kaposi`s sarcoma-associated h
cauucccgguccca

SEQ ID NO: 4003541 - RNA, 18 nt, Human herpesvirus 8 [Kaposi`s sarcoma-associated h
cauucguaagaggaccca

SEQ ID NO: 4003542 - RNA, 13 nt, Human herpesvirus 8 [Kaposi`s sarcoma-associated h
cauuuuguaauga

SEQ ID NO: 4003543 - RNA, 23 nt, Human herpesvirus 8 [Kaposi`s sarcoma-associated h
ccaacauguaaauuggccacugc

SEQ ID NO: 4003544 - RNA, 19 nt, Human herpesvirus 8 [Kaposi`s sarcoma-associated h
ccaacuucaucacaucccc

SEQ ID NO: 4003545 - RNA, 22 nt, Human herpesvirus 8 [Kaposi`s sarcoma-associated h
ccaagaucuuccagucuccaga

SEQ ID NO: 4003546 - RNA, 16 nt, Human herpesvirus 8 [Kaposi`s sarcoma-associated h
ccaaggccugugccca

SEQ ID NO: 4003547 - RNA, 13 nt, Human herpesvirus 8 [Kaposi`s sarcoma-associated h
ccacaaaguacau

SEQ ID NO: 4003548 - RNA, 22 nt, Human herpesvirus 8 [Kaposi`s sarcoma-associated h
accauccccccaccccucauuu

SEQ ID NO: 4003549 - RNA, 21 nt, Human herpesvirus 8 [Kaposi`s sarcoma-associated h
acccugcucuggacaauggga

SEQ ID NO: 4003550 - RNA, 15 nt, Human herpesvirus 8 [Kaposi`s sarcoma-associated h
accggcuuguacagu

SEQ ID NO: 4003551 - RNA, 22 nt, Human herpesvirus 8 [Kaposi`s sarcoma-associated h
accguuuggcccacguggugcu

SEQ ID NO: 4003552 - RNA, 22 nt, Human herpesvirus 8 [Kaposi`s sarcoma-associated h
accuaacugcguccgguggcaa

SEQ ID NO: 4003553 - RNA, 20 nt, Human herpesvirus 8 [Kaposi`s sarcoma-associated h
accucgaugggauauuuccu

SEQ ID NO: 4003554 - RNA, 21 nt, Human herpesvirus 8 [Kaposi`s sarcoma-associated h
accugaggugcucuucccaca

SEQ ID NO: 4003555 - RNA, 17 nt, Human herpesvirus 8 [Kaposi`s sarcoma-associated h
acgcaccgcaagcagca

SEQ ID NO: 4003556 - RNA, 12 nt, Human herpesvirus 8 [Kaposi`s sarcoma-associated h
acgcacugagcg

SEQ ID NO: 4003557 - RNA, 21 nt, Human herpesvirus 8 [Kaposi`s sarcoma-associated h
acgcagacccggcaacacugg

SEQ ID NO: 4003558 - RNA, 19 nt, Human herpesvirus 8 [Kaposi`s sarcoma-associated h
acgcugcaauguacugcca

SEQ ID NO: 4003559 - RNA, 19 nt, Human herpesvirus 8 [Kaposi`s sarcoma-associated h
acggaggauccuagguggg

SEQ ID NO: 4003560 - RNA, 17 nt, Human herpesvirus 8 [Kaposi`s sarcoma-associated h
acggccaguuauaugca

SEQ ID NO: 4003561 - RNA, 17 nt, Human herpesvirus 8 [Kaposi`s sarcoma-associated h
acggcguguuuugccug

SEQ ID NO: 4003562 - RNA, 14 nt, Human herpesvirus 8 [Kaposi`s sarcoma-associated h
acgucccucuuggc

SEQ ID NO: 4003563 - RNA, 22 nt, Human herpesvirus 8 [Kaposi`s sarcoma-associated h
acgugcguggggguuggguggc

SEQ ID NO: 4003564 - RNA, 19 nt, Human herpesvirus 8 [Kaposi`s sarcoma-associated h
acuagaguccaaccuggca

SEQ ID NO: 4003565 - RNA, 17 nt, Human herpesvirus 8 [Kaposi`s sarcoma-associated h
acucugcaagcuguugg

SEQ ID NO: 4003566 - RNA, 12 nt, Human herpesvirus 8 [Kaposi`s sarcoma-associated h
acugcagcacua

SEQ ID NO: 4003567 - RNA, 14 nt, Human herpesvirus 8 [Kaposi`s sarcoma-associated h
acuggaacgccaug

SEQ ID NO: 4003568 - RNA, 15 nt, Human herpesvirus 8 [Kaposi`s sarcoma-associated h
acugggccaccaaga

SEQ ID NO: 4003569 - RNA, 12 nt, Human herpesvirus 8 [Kaposi`s sarcoma-associated h
acuuacagcaug

SEQ ID NO: 4003570 - RNA, 14 nt, Human herpesvirus 8 [Kaposi`s sarcoma-associated h
acuucgcuaacugu

SEQ ID NO: 4003571 - RNA, 17 nt, Human herpesvirus 8 [Kaposi`s sarcoma-associated h
acuuugcccuaaaugug

SEQ ID NO: 4003572 - RNA, 14 nt, Human herpesvirus 8 [Kaposi`s sarcoma-associated h
agaaaugaucaugu

SEQ ID NO: 4003573 - RNA, 20 nt, Human herpesvirus 8 [Kaposi`s sarcoma-associated h
agaauggcgugccaguggag

SEQ ID NO: 4003574 - RNA, 22 nt, Human herpesvirus 8 [Kaposi`s sarcoma-associated h
agacauucguaagaggacccag

SEQ ID NO: 4003575 - RNA, 21 nt, Human herpesvirus 8 [Kaposi`s sarcoma-associated h
agaccccgauaugcaccucca

SEQ ID NO: 4003576 - RNA, 15 nt, Human herpesvirus 8 [Kaposi`s sarcoma-associated h
agacgcgcaaagggg

SEQ ID NO: 4003577 - RNA, 17 nt, Human herpesvirus 8 [Kaposi`s sarcoma-associated h
agagcguagaugaaugu

SEQ ID NO: 4003578 - RNA, 22 nt, Human herpesvirus 8 [Kaposi`s sarcoma-associated h
agaguuccccgggaacggacaa

SEQ ID NO: 4003579 - RNA, 23 nt, Human herpesvirus 8 [Kaposi`s sarcoma-associated h
agauuggguugggaggugacccu

SEQ ID NO: 4003580 - RNA, 13 nt, Human herpesvirus 8 [Kaposi`s sarcoma-associated h
agauuuaagauua

SEQ ID NO: 4003581 - RNA, 22 nt, Human herpesvirus 8 [Kaposi`s sarcoma-associated h
agcaaucggguuugauagcaga

SEQ ID NO: 4003582 - RNA, 18 nt, Human herpesvirus 8 [Kaposi`s sarcoma-associated h
agcacgaagacaugguga

SEQ ID NO: 4003583 - RNA, 18 nt, Human herpesvirus 8 [Kaposi`s sarcoma-associated h
agcacuccuguuagcaca

SEQ ID NO: 4003584 - RNA, 20 nt, Human herpesvirus 8 [Kaposi`s sarcoma-associated h
agcacuccuguuagcacauu

SEQ ID NO: 4003585 - RNA, 17 nt, Human herpesvirus 8 [Kaposi`s sarcoma-associated h
agcauccggacugagau

SEQ ID NO: 4003586 - RNA, 18 nt, Human herpesvirus 8 [Kaposi`s sarcoma-associated h
agcaugacuuccccgucu

SEQ ID NO: 4003587 - RNA, 19 nt, Human herpesvirus 8 [Kaposi`s sarcoma-associated h
agcauuuuaaaaugcguuu

SEQ ID NO: 4003588 - RNA, 17 nt, Human herpesvirus 8 [Kaposi`s sarcoma-associated h
agcccgauggcccuuca

SEQ ID NO: 4003589 - RNA, 20 nt, Human herpesvirus 8 [Kaposi`s sarcoma-associated h
agcccuguuucugugccccc

SEQ ID NO: 4003590 - RNA, 16 nt, Human herpesvirus 8 [Kaposi`s sarcoma-associated h
agccucuguacaugga

SEQ ID NO: 4003591 - RNA, 22 nt, Human herpesvirus 8 [Kaposi`s sarcoma-associated h
agcggcaccacaucugcugucu

SEQ ID NO: 4003592 - RNA, 15 nt, Human herpesvirus 8 [Kaposi`s sarcoma-associated h
agcgucaucugcgaa

SEQ ID NO: 4003593 - RNA, 19 nt, Human herpesvirus 8 [Kaposi`s sarcoma-associated h
agcguuggcuagucauggc

SEQ ID NO: 4003594 - RNA, 20 nt, Human herpesvirus 8 [Kaposi`s sarcoma-associated h
agcugcugguucaggauuuc

SEQ ID NO: 4003595 - RNA, 20 nt, Human herpesvirus 8 [Kaposi`s sarcoma-associated h
agcuguuacccugcucugga

SEQ ID NO: 4003596 - RNA, 17 nt, Human herpesvirus 8 [Kaposi`s sarcoma-associated h
agcuuaaccacaugcau

SEQ ID NO: 4003597 - RNA, 17 nt, Human herpesvirus 8 [Kaposi`s sarcoma-associated h
agcuuugcagccaggua

SEQ ID NO: 4003598 - RNA, 19 nt, Human herpesvirus 8 [Kaposi`s sarcoma-associated h
aggaagcauccggacugag

SEQ ID NO: 4003599 - RNA, 21 nt, Human herpesvirus 8 [Kaposi`s sarcoma-associated h
aggaagugucgggaggcaugu

SEQ ID NO: 4003600 - RNA, 15 nt, Human herpesvirus 8 [Kaposi`s sarcoma-associated h
aggaaugcauaugga

SEQ ID NO: 4003601 - RNA, 20 nt, Human herpesvirus 8 [Kaposi`s sarcoma-associated h
caccaagccucccgugauug

SEQ ID NO: 4003602 - RNA, 16 nt, Human herpesvirus 8 [Kaposi`s sarcoma-associated h
caccacaucugcuguc

SEQ ID NO: 4003603 - RNA, 21 nt, Human herpesvirus 8 [Kaposi`s sarcoma-associated h
caccacgcccgggggccagga

SEQ ID NO: 4003604 - RNA, 17 nt, Human herpesvirus 8 [Kaposi`s sarcoma-associated h
caccauuccucuccgca

SEQ ID NO: 4003605 - RNA, 20 nt, Human herpesvirus 8 [Kaposi`s sarcoma-associated h
cacccuauuggucacaucuc

SEQ ID NO: 4003606 - RNA, 16 nt, Human herpesvirus 8 [Kaposi`s sarcoma-associated h
cacgcacuuggcccug

SEQ ID NO: 4003607 - RNA, 16 nt, Human herpesvirus 8 [Kaposi`s sarcoma-associated h
cacgccauaccccugg

SEQ ID NO: 4003608 - RNA, 17 nt, Human herpesvirus 8 [Kaposi`s sarcoma-associated h
cacuagcagaaaacugu

SEQ ID NO: 4003609 - RNA, 16 nt, Human herpesvirus 8 [Kaposi`s sarcoma-associated h
cacucuacgcggcuag

SEQ ID NO: 4003610 - RNA, 15 nt, Human herpesvirus 8 [Kaposi`s sarcoma-associated h
cagaaccgaugguuu

SEQ ID NO: 4003611 - RNA, 14 nt, Human herpesvirus 8 [Kaposi`s sarcoma-associated h
cagacaccaaagac

SEQ ID NO: 4003612 - RNA, 18 nt, Human herpesvirus 8 [Kaposi`s sarcoma-associated h
cagacaguuaccauucau

SEQ ID NO: 4003613 - RNA, 22 nt, Human herpesvirus 8 [Kaposi`s sarcoma-associated h
cagacccggcaacacuggacac

SEQ ID NO: 4003614 - RNA, 18 nt, Human herpesvirus 8 [Kaposi`s sarcoma-associated h
cagacgaccccagccccu

SEQ ID NO: 4003615 - RNA, 14 nt, Human herpesvirus 8 [Kaposi`s sarcoma-associated h
cagacgguccaaag

SEQ ID NO: 4003616 - RNA, 18 nt, Human herpesvirus 8 [Kaposi`s sarcoma-associated h
cagagguuugaggcgcug

SEQ ID NO: 4003617 - RNA, 18 nt, Human herpesvirus 8 [Kaposi`s sarcoma-associated h
cagaguccgccaucacca

SEQ ID NO: 4003618 - RNA, 20 nt, Human herpesvirus 8 [Kaposi`s sarcoma-associated h
cagcagcugcuuggcgccca

SEQ ID NO: 4003619 - RNA, 21 nt, Human herpesvirus 8 [Kaposi`s sarcoma-associated h
cagcccagccucuguacaugg

SEQ ID NO: 4003620 - RNA, 15 nt, Human herpesvirus 8 [Kaposi`s sarcoma-associated h
cagcuacgcacugag

SEQ ID NO: 4003621 - RNA, 24 nt, Human herpesvirus 8 [Kaposi`s sarcoma-associated h
cagcuccuauugcaacugaccaug

SEQ ID NO: 4003622 - RNA, 14 nt, Human herpesvirus 8 [Kaposi`s sarcoma-associated h
caggagucagagca

SEQ ID NO: 4003623 - RNA, 14 nt, Human herpesvirus 8 [Kaposi`s sarcoma-associated h
caggcaucggcagc

SEQ ID NO: 4003624 - RNA, 19 nt, Human herpesvirus 8 [Kaposi`s sarcoma-associated h
cagggucucauccgcggca

SEQ ID NO: 4003625 - RNA, 16 nt, Human herpesvirus 8 [Kaposi`s sarcoma-associated h
cagguaaaacggccaa

SEQ ID NO: 4003626 - RNA, 18 nt, Human herpesvirus 8 [Kaposi`s sarcoma-associated h
caggucugucacuagaau

SEQ ID NO: 4003627 - RNA, 14 nt, Human herpesvirus 8 [Kaposi`s sarcoma-associated h
cagguggaggcuug

SEQ ID NO: 4003628 - RNA, 19 nt, Human herpesvirus 8 [Kaposi`s sarcoma-associated h
cagucgagccgccaggaac

SEQ ID NO: 4003629 - RNA, 12 nt, Human herpesvirus 8 [Kaposi`s sarcoma-associated h
cagugugcagua

SEQ ID NO: 4003630 - RNA, 19 nt, Human herpesvirus 8 [Kaposi`s sarcoma-associated h
caguguuaucuuugcagug

SEQ ID NO: 4003631 - RNA, 16 nt, Human herpesvirus 8 [Kaposi`s sarcoma-associated h
cauacgucccucuugg

SEQ ID NO: 4003632 - RNA, 14 nt, Human herpesvirus 8 [Kaposi`s sarcoma-associated h
cauccgcugccacc

SEQ ID NO: 4003633 - RNA, 22 nt, Human herpesvirus 8 [Kaposi`s sarcoma-associated h
caucuacccugauuagcacugu

SEQ ID NO: 4003634 - RNA, 16 nt, Human herpesvirus 8 [Kaposi`s sarcoma-associated h
caucucucacacccug

SEQ ID NO: 4003635 - RNA, 19 nt, Human herpesvirus 8 [Kaposi`s sarcoma-associated h
caugauuugauacagggac

SEQ ID NO: 4003636 - RNA, 21 nt, Human herpesvirus 8 [Kaposi`s sarcoma-associated h
caugcucaucuacccugauua

SEQ ID NO: 4003637 - RNA, 16 nt, Human herpesvirus 8 [Kaposi`s sarcoma-associated h
cauggaauuguauaga

SEQ ID NO: 4003638 - RNA, 23 nt, Human herpesvirus 8 [Kaposi`s sarcoma-associated h
caugucgcacacuuccaccuccc

SEQ ID NO: 4003639 - RNA, 13 nt, Human herpesvirus 8 [Kaposi`s sarcoma-associated h
caugugggcuuca

SEQ ID NO: 4003640 - RNA, 11 nt, Human herpesvirus 8 [Kaposi`s sarcoma-associated h
caugugucuau

SEQ ID NO: 4003641 - RNA, 13 nt, Human herpesvirus 8 [Kaposi`s sarcoma-associated h
cauuccucuccgc

SEQ ID NO: 4003642 - RNA, 15 nt, Human herpesvirus 8 [Kaposi`s sarcoma-associated h
cauucgugugguuug

SEQ ID NO: 4003643 - RNA, 23 nt, Human herpesvirus 8 [Kaposi`s sarcoma-associated h
cauucgugugguuugggagagcg

SEQ ID NO: 4003644 - RNA, 15 nt, Human herpesvirus 8 [Kaposi`s sarcoma-associated h
cauuuccacccaccu

SEQ ID NO: 4003645 - RNA, 21 nt, Human herpesvirus 8 [Kaposi`s sarcoma-associated h
cauuugcgugcaaaaugugcu

SEQ ID NO: 4003646 - RNA, 19 nt, Human herpesvirus 8 [Kaposi`s sarcoma-associated h
ccaaacucgggaucggaaa

SEQ ID NO: 4003647 - RNA, 18 nt, Human herpesvirus 8 [Kaposi`s sarcoma-associated h
ccaaaugcccagaaugaa

SEQ ID NO: 4003648 - RNA, 13 nt, Human herpesvirus 8 [Kaposi`s sarcoma-associated h
ccaacuugcgucu

SEQ ID NO: 4003649 - RNA, 15 nt, Human herpesvirus 8 [Kaposi`s sarcoma-associated h
ccacaaaacugccaa

SEQ ID NO: 4003650 - RNA, 15 nt, Human herpesvirus 8 [Kaposi`s sarcoma-associated h
ccacauggcagcuga

SEQ ID NO: 4003651 - RNA, 15 nt, Human herpesvirus 8 [Kaposi`s sarcoma-associated h
ccaccacgccacaac

SEQ ID NO: 4003652 - RNA, 15 nt, Human herpesvirus 8 [Kaposi`s sarcoma-associated h
ccacccagcuacugg

SEQ ID NO: 4003653 - RNA, 18 nt, Human herpesvirus 8 [Kaposi`s sarcoma-associated h
ccaccgcaacggcggugu

SEQ ID NO: 4003654 - RNA, 14 nt, Human herpesvirus 8 [Kaposi`s sarcoma-associated h
ccaccuacacccgg

SEQ ID NO: 4003655 - RNA, 23 nt, Human herpesvirus 8 [Kaposi`s sarcoma-associated h
ccacuacggucccguugucccuc

SEQ ID NO: 4003656 - RNA, 19 nt, Human herpesvirus 8 [Kaposi`s sarcoma-associated h
ccagaguuuuaugggcuca

SEQ ID NO: 4003657 - RNA, 20 nt, Human herpesvirus 8 [Kaposi`s sarcoma-associated h
ccagauccuccacagagccu

SEQ ID NO: 4003658 - RNA, 19 nt, Human herpesvirus 8 [Kaposi`s sarcoma-associated h
ccagcaauaaacccacagc

SEQ ID NO: 4003659 - RNA, 15 nt, Human herpesvirus 8 [Kaposi`s sarcoma-associated h
ccaggacggagccgu

SEQ ID NO: 4003660 - RNA, 14 nt, Human herpesvirus 8 [Kaposi`s sarcoma-associated h
ccaggauccagacu

SEQ ID NO: 4003661 - RNA, 14 nt, Human herpesvirus 8 [Kaposi`s sarcoma-associated h
ccagggaaacaugc

SEQ ID NO: 4003662 - RNA, 21 nt, Human herpesvirus 8 [Kaposi`s sarcoma-associated h
ccagguaggucaccgggucaa

SEQ ID NO: 4003663 - RNA, 18 nt, Human herpesvirus 8 [Kaposi`s sarcoma-associated h
ccaguagauuuaguacgu

SEQ ID NO: 4003664 - RNA, 21 nt, Human herpesvirus 8 [Kaposi`s sarcoma-associated h
ccagucacgcacuuggcccug

SEQ ID NO: 4003665 - RNA, 15 nt, Human herpesvirus 8 [Kaposi`s sarcoma-associated h
ccagugaguccuggc

SEQ ID NO: 4003666 - RNA, 17 nt, Human herpesvirus 8 [Kaposi`s sarcoma-associated h
ccagugccucagcaacu

SEQ ID NO: 4003667 - RNA, 14 nt, Human herpesvirus 8 [Kaposi`s sarcoma-associated h
ccauagcagucgcc

SEQ ID NO: 4003668 - RNA, 22 nt, Human herpesvirus 8 [Kaposi`s sarcoma-associated h
ccauccccggcguccucucaug

SEQ ID NO: 4003669 - RNA, 18 nt, Human herpesvirus 8 [Kaposi`s sarcoma-associated h
ccauggcagcccagccuc

SEQ ID NO: 4003670 - RNA, 18 nt, Human herpesvirus 8 [Kaposi`s sarcoma-associated h
ccauuugauauauggaaa

SEQ ID NO: 4003671 - RNA, 21 nt, Human herpesvirus 8 [Kaposi`s sarcoma-associated h
ccauuuuuguggcugccugga

SEQ ID NO: 4003672 - RNA, 18 nt, Human herpesvirus 8 [Kaposi`s sarcoma-associated h
cccaauuaauuggagcuc

SEQ ID NO: 4003673 - RNA, 17 nt, Human herpesvirus 8 [Kaposi`s sarcoma-associated h
cccacguggugcugccu

SEQ ID NO: 4003674 - RNA, 14 nt, Human herpesvirus 8 [Kaposi`s sarcoma-associated h
cccagcgacucuca

SEQ ID NO: 4003675 - RNA, 12 nt, Human herpesvirus 8 [Kaposi`s sarcoma-associated h
ccccgugaaguu

SEQ ID NO: 4003676 - RNA, 19 nt, Human herpesvirus 8 [Kaposi`s sarcoma-associated h
cccguacaaggccauggcg

SEQ ID NO: 4003677 - RNA, 17 nt, Human herpesvirus 8 [Kaposi`s sarcoma-associated h
cccucuacucuuccggg

SEQ ID NO: 4003678 - RNA, 22 nt, Human herpesvirus 8 [Kaposi`s sarcoma-associated h
ccgaaugcguucuccugcauac

SEQ ID NO: 4003679 - RNA, 21 nt, Human herpesvirus 8 [Kaposi`s sarcoma-associated h
ccgagaaacacugugaggcaa

SEQ ID NO: 4003680 - RNA, 17 nt, Human herpesvirus 8 [Kaposi`s sarcoma-associated h
aggaccaccggcaggca

SEQ ID NO: 4003681 - RNA, 18 nt, Human herpesvirus 8 [Kaposi`s sarcoma-associated h
aggaccucgucuagcaca

SEQ ID NO: 4003682 - RNA, 13 nt, Human herpesvirus 8 [Kaposi`s sarcoma-associated h
aggagggcagcug

SEQ ID NO: 4003683 - RNA, 22 nt, Human herpesvirus 8 [Kaposi`s sarcoma-associated h
aggagggcagguuaacguuucc

SEQ ID NO: 4003684 - RNA, 13 nt, Human herpesvirus 8 [Kaposi`s sarcoma-associated h
aggagucagagca

SEQ ID NO: 4003685 - RNA, 12 nt, Human herpesvirus 8 [Kaposi`s sarcoma-associated h
aggaguggcuga

SEQ ID NO: 4003686 - RNA, 20 nt, Human herpesvirus 8 [Kaposi`s sarcoma-associated h
aggaucggaucuuuuacaau

SEQ ID NO: 4003687 - RNA, 17 nt, Human herpesvirus 8 [Kaposi`s sarcoma-associated h
aggcaucggcagccucu

SEQ ID NO: 4003688 - RNA, 12 nt, Human herpesvirus 8 [Kaposi`s sarcoma-associated h
aggccaggaccc

SEQ ID NO: 4003689 - RNA, 23 nt, Human herpesvirus 8 [Kaposi`s sarcoma-associated h
aggcccucuucuguugccaggcg

SEQ ID NO: 4003690 - RNA, 17 nt, Human herpesvirus 8 [Kaposi`s sarcoma-associated h
aggggcagacccaaaaa

SEQ ID NO: 4003691 - RNA, 20 nt, Human herpesvirus 8 [Kaposi`s sarcoma-associated h
aggggcagacccaaaaagga

SEQ ID NO: 4003692 - RNA, 18 nt, Human herpesvirus 8 [Kaposi`s sarcoma-associated h
agguauguuuuuaccagu

SEQ ID NO: 4003693 - RNA, 22 nt, Human herpesvirus 8 [Kaposi`s sarcoma-associated h
aggugccgucgucgagcacucc

SEQ ID NO: 4003694 - RNA, 20 nt, Human herpesvirus 8 [Kaposi`s sarcoma-associated h
aggugguucuauauccacca

SEQ ID NO: 4003695 - RNA, 17 nt, Human herpesvirus 8 [Kaposi`s sarcoma-associated h
aggugucugcgggacaa

SEQ ID NO: 4003696 - RNA, 14 nt, Human herpesvirus 8 [Kaposi`s sarcoma-associated h
aguacgugguaagg

SEQ ID NO: 4003697 - RNA, 17 nt, Human herpesvirus 8 [Kaposi`s sarcoma-associated h
aguauagugguuuacau

SEQ ID NO: 4003698 - RNA, 18 nt, Human herpesvirus 8 [Kaposi`s sarcoma-associated h
agucgccgguagcugccu

SEQ ID NO: 4003699 - RNA, 13 nt, Human herpesvirus 8 [Kaposi`s sarcoma-associated h
agugaccugcugu

SEQ ID NO: 4003700 - RNA, 18 nt, Human herpesvirus 8 [Kaposi`s sarcoma-associated h
aguggcugaucucagagg

SEQ ID NO: 4003701 - RNA, 18 nt, Human herpesvirus 8 [Kaposi`s sarcoma-associated h
agugggguugggguccag

SEQ ID NO: 4003702 - RNA, 17 nt, Human herpesvirus 8 [Kaposi`s sarcoma-associated h
aguguuaucuuugcagu

SEQ ID NO: 4003703 - RNA, 23 nt, Human herpesvirus 8 [Kaposi`s sarcoma-associated h
aguugccugugggguuucuggga

SEQ ID NO: 4003704 - RNA, 13 nt, Human herpesvirus 8 [Kaposi`s sarcoma-associated h
auaacagcaacau

SEQ ID NO: 4003705 - RNA, 12 nt, Human herpesvirus 8 [Kaposi`s sarcoma-associated h
auaacagugcuc

SEQ ID NO: 4003706 - RNA, 12 nt, Human herpesvirus 8 [Kaposi`s sarcoma-associated h
auaacuucuggg

SEQ ID NO: 4003707 - RNA, 18 nt, Human herpesvirus 8 [Kaposi`s sarcoma-associated h
auaagagcacacugugug

SEQ ID NO: 4003708 - RNA, 19 nt, Human herpesvirus 8 [Kaposi`s sarcoma-associated h
auagacuuaaaaugucucg

SEQ ID NO: 4003709 - RNA, 15 nt, Human herpesvirus 8 [Kaposi`s sarcoma-associated h
auagugugcguuucu

SEQ ID NO: 4003710 - RNA, 15 nt, Human herpesvirus 8 [Kaposi`s sarcoma-associated h
auauaauuaucacgg

SEQ ID NO: 4003711 - RNA, 22 nt, Human herpesvirus 8 [Kaposi`s sarcoma-associated h
auaugcaccguuuccacacagg

SEQ ID NO: 4003712 - RNA, 20 nt, Human herpesvirus 8 [Kaposi`s sarcoma-associated h
auaugggcuuguacaugugu

SEQ ID NO: 4003713 - RNA, 19 nt, Human herpesvirus 8 [Kaposi`s sarcoma-associated h
aucaggcuagugcuguaau

SEQ ID NO: 4003714 - RNA, 23 nt, Human herpesvirus 8 [Kaposi`s sarcoma-associated h
aucccccccgcaggccagccacc

SEQ ID NO: 4003715 - RNA, 23 nt, Human herpesvirus 8 [Kaposi`s sarcoma-associated h
aucguaggccaauacugcccaag

SEQ ID NO: 4003716 - RNA, 18 nt, Human herpesvirus 8 [Kaposi`s sarcoma-associated h
aucguugacauguggagc

SEQ ID NO: 4003717 - RNA, 12 nt, Human herpesvirus 8 [Kaposi`s sarcoma-associated h
aucuccuggaga

SEQ ID NO: 4003718 - RNA, 22 nt, Human herpesvirus 8 [Kaposi`s sarcoma-associated h
aucucgaaaaaaauaaugcaga

SEQ ID NO: 4003719 - RNA, 15 nt, Human herpesvirus 8 [Kaposi`s sarcoma-associated h
augaauacccuggau

SEQ ID NO: 4003720 - RNA, 17 nt, Human herpesvirus 8 [Kaposi`s sarcoma-associated h
augaggccaagugcauu

SEQ ID NO: 4003721 - RNA, 20 nt, Human herpesvirus 8 [Kaposi`s sarcoma-associated h
augcaugugucugugcccug

SEQ ID NO: 4003722 - RNA, 20 nt, Human herpesvirus 8 [Kaposi`s sarcoma-associated h
augccgcguuagcagccaug

SEQ ID NO: 4003723 - RNA, 18 nt, Human herpesvirus 8 [Kaposi`s sarcoma-associated h
augcucaggucugucacu

SEQ ID NO: 4003724 - RNA, 18 nt, Human herpesvirus 8 [Kaposi`s sarcoma-associated h
augcucaucuacccugau

SEQ ID NO: 4003725 - RNA, 11 nt, Human herpesvirus 8 [Kaposi`s sarcoma-associated h
augcucucacc

SEQ ID NO: 4003726 - RNA, 14 nt, Human herpesvirus 8 [Kaposi`s sarcoma-associated h
auggcaacugccaa

SEQ ID NO: 4003727 - RNA, 15 nt, Human herpesvirus 8 [Kaposi`s sarcoma-associated h
auggcgucaucugau

SEQ ID NO: 4003728 - RNA, 23 nt, Human herpesvirus 8 [Kaposi`s sarcoma-associated h
augguaccauggcaaaaaacacu

SEQ ID NO: 4003729 - RNA, 17 nt, Human herpesvirus 8 [Kaposi`s sarcoma-associated h
auguaaauuggccacug

SEQ ID NO: 4003730 - RNA, 18 nt, Human herpesvirus 8 [Kaposi`s sarcoma-associated h
auguacuugaacagggca

SEQ ID NO: 4003731 - RNA, 19 nt, Human herpesvirus 8 [Kaposi`s sarcoma-associated h
augucacgucgcucuuuac

SEQ ID NO: 4003732 - RNA, 16 nt, Human herpesvirus 8 [Kaposi`s sarcoma-associated h
auguccugauuuucca

SEQ ID NO: 4003733 - RNA, 17 nt, Human herpesvirus 8 [Kaposi`s sarcoma-associated h
auguguguaacuuuuuc

SEQ ID NO: 4003734 - RNA, 20 nt, Human herpesvirus 8 [Kaposi`s sarcoma-associated h
auuaaacgacaaagugauuc

SEQ ID NO: 4003735 - RNA, 18 nt, Human herpesvirus 8 [Kaposi`s sarcoma-associated h
auuagugacauacaugag

SEQ ID NO: 4003736 - RNA, 19 nt, Human herpesvirus 8 [Kaposi`s sarcoma-associated h
auugcaacugaccauguuc

SEQ ID NO: 4003737 - RNA, 15 nt, Human herpesvirus 8 [Kaposi`s sarcoma-associated h
auuggagcacuuuug

SEQ ID NO: 4003738 - RNA, 16 nt, Human herpesvirus 8 [Kaposi`s sarcoma-associated h
auuuauugcauggcau

SEQ ID NO: 4003739 - RNA, 23 nt, Human herpesvirus 8 [Kaposi`s sarcoma-associated h
auuuuccaaggccugugcccaac

SEQ ID NO: 4003740 - RNA, 17 nt, Human herpesvirus 8 [Kaposi`s sarcoma-associated h
auuuuuuacuacaggua

SEQ ID NO: 4003741 - RNA, 19 nt, Human herpesvirus 8 [Kaposi`s sarcoma-associated h
caaaccuggugaggaagca

SEQ ID NO: 4003742 - RNA, 15 nt, Human herpesvirus 8 [Kaposi`s sarcoma-associated h
caaauaaaccagaca

SEQ ID NO: 4003743 - RNA, 20 nt, Human herpesvirus 8 [Kaposi`s sarcoma-associated h
caacaugcccuuuucugaaa

SEQ ID NO: 4003744 - RNA, 21 nt, Human herpesvirus 8 [Kaposi`s sarcoma-associated h
caacccagcaugccugcgcug

SEQ ID NO: 4003745 - RNA, 23 nt, Human herpesvirus 8 [Kaposi`s sarcoma-associated h
caacgaccugaugcaggccaccc

SEQ ID NO: 4003746 - RNA, 20 nt, Human herpesvirus 8 [Kaposi`s sarcoma-associated h
caagauccaacccagcaugc

SEQ ID NO: 4003747 - RNA, 17 nt, Human herpesvirus 8 [Kaposi`s sarcoma-associated h
caagcaaccggagcguu

SEQ ID NO: 4003748 - RNA, 20 nt, Human herpesvirus 8 [Kaposi`s sarcoma-associated h
caauaacgaagguauguuuu

SEQ ID NO: 4003749 - RNA, 14 nt, Human herpesvirus 8 [Kaposi`s sarcoma-associated h
caauacugcccaag

SEQ ID NO: 4003750 - RNA, 20 nt, Human herpesvirus 8 [Kaposi`s sarcoma-associated h
caauauaacagcaacauguu

SEQ ID NO: 4003751 - RNA, 18 nt, Human herpesvirus 8 [Kaposi`s sarcoma-associated h
caaucucuuacuucgcau

SEQ ID NO: 4003752 - RNA, 18 nt, Human herpesvirus 8 [Kaposi`s sarcoma-associated h
caaucuggauguguaucu

SEQ ID NO: 4003753 - RNA, 21 nt, Human herpesvirus 8 [Kaposi`s sarcoma-associated h
caaugggaucgaacagaagac

SEQ ID NO: 4003754 - RNA, 15 nt, Human herpesvirus 8 [Kaposi`s sarcoma-associated h
caauguacugccaug

SEQ ID NO: 4003755 - RNA, 17 nt, Human herpesvirus 8 [Kaposi`s sarcoma-associated h
cacagacgacugggcca

SEQ ID NO: 4003756 - RNA, 16 nt, Human herpesvirus 8 [Kaposi`s sarcoma-associated h
cacauauggcgcagga

SEQ ID NO: 4003757 - RNA, 22 nt, Human herpesvirus 8 [Kaposi`s sarcoma-associated h
cacauccccggauuccuccgca

SEQ ID NO: 4003758 - RNA, 22 nt, Human herpesvirus 8 [Kaposi`s sarcoma-associated h
cuagcagaaaacugucuccaga

SEQ ID NO: 4003759 - RNA, 18 nt, Human herpesvirus 8 [Kaposi`s sarcoma-associated h
cuagcguacaugugacug

SEQ ID NO: 4003760 - RNA, 22 nt, Human herpesvirus 8 [Kaposi`s sarcoma-associated h
cuauaaacagccuuggugcuag

SEQ ID NO: 4003761 - RNA, 23 nt, Human herpesvirus 8 [Kaposi`s sarcoma-associated h
cucaagcauugaguuugccgagc

SEQ ID NO: 4003762 - RNA, 12 nt, Human herpesvirus 8 [Kaposi`s sarcoma-associated h
cucacugagugg

SEQ ID NO: 4003763 - RNA, 17 nt, Human herpesvirus 8 [Kaposi`s sarcoma-associated h
cucagacaccgucgcca

SEQ ID NO: 4003764 - RNA, 21 nt, Human herpesvirus 8 [Kaposi`s sarcoma-associated h
cuccagacucuucgcugauga

SEQ ID NO: 4003765 - RNA, 19 nt, Human herpesvirus 8 [Kaposi`s sarcoma-associated h
cucccggaaacggacgcca

SEQ ID NO: 4003766 - RNA, 18 nt, Human herpesvirus 8 [Kaposi`s sarcoma-associated h
cucccuucgugccccagc

SEQ ID NO: 4003767 - RNA, 22 nt, Human herpesvirus 8 [Kaposi`s sarcoma-associated h
cucuaucagcugcagccaggaa

SEQ ID NO: 4003768 - RNA, 18 nt, Human herpesvirus 8 [Kaposi`s sarcoma-associated h
cucuuggcguuuaccugc

SEQ ID NO: 4003769 - RNA, 15 nt, Human herpesvirus 8 [Kaposi`s sarcoma-associated h
cucuuggcuguuaca

SEQ ID NO: 4003770 - RNA, 19 nt, Human herpesvirus 8 [Kaposi`s sarcoma-associated h
cugaaacgucgcccaaauc

SEQ ID NO: 4003771 - RNA, 11 nt, Human herpesvirus 8 [Kaposi`s sarcoma-associated h
cugagccacaa

SEQ ID NO: 4003772 - RNA, 14 nt, Human herpesvirus 8 [Kaposi`s sarcoma-associated h
cugauuagcacugu

SEQ ID NO: 4003773 - RNA, 21 nt, Human herpesvirus 8 [Kaposi`s sarcoma-associated h
cugcagcuggacuggagucag

SEQ ID NO: 4003774 - RNA, 23 nt, Human herpesvirus 8 [Kaposi`s sarcoma-associated h
cugccgcucggagauugccaccg

SEQ ID NO: 4003775 - RNA, 13 nt, Human herpesvirus 8 [Kaposi`s sarcoma-associated h
cugccuaggaccu

SEQ ID NO: 4003776 - RNA, 14 nt, Human herpesvirus 8 [Kaposi`s sarcoma-associated h
cuggaauggaucug

SEQ ID NO: 4003777 - RNA, 22 nt, Human herpesvirus 8 [Kaposi`s sarcoma-associated h
cuggagaaggguggguggggau

SEQ ID NO: 4003778 - RNA, 18 nt, Human herpesvirus 8 [Kaposi`s sarcoma-associated h
ccgcaaggagcagccugc

SEQ ID NO: 4003779 - RNA, 17 nt, Human herpesvirus 8 [Kaposi`s sarcoma-associated h
ccgcguuagcagccaug

SEQ ID NO: 4003780 - RNA, 19 nt, Human herpesvirus 8 [Kaposi`s sarcoma-associated h
ccggacugagauuucccua

SEQ ID NO: 4003781 - RNA, 20 nt, Human herpesvirus 8 [Kaposi`s sarcoma-associated h
ccggaugcagggccuggccu

SEQ ID NO: 4003782 - RNA, 21 nt, Human herpesvirus 8 [Kaposi`s sarcoma-associated h
ccgucgccaaacaggcgcaga

SEQ ID NO: 4003783 - RNA, 13 nt, Human herpesvirus 8 [Kaposi`s sarcoma-associated h
ccgugaugggcca

SEQ ID NO: 4003784 - RNA, 13 nt, Human herpesvirus 8 [Kaposi`s sarcoma-associated h
ccguguggcugca

SEQ ID NO: 4003785 - RNA, 18 nt, Human herpesvirus 8 [Kaposi`s sarcoma-associated h
ccguucccaugagccucc

SEQ ID NO: 4003786 - RNA, 22 nt, Human herpesvirus 8 [Kaposi`s sarcoma-associated h
ccuaauaaacuggccgcauuug

SEQ ID NO: 4003787 - RNA, 20 nt, Human herpesvirus 8 [Kaposi`s sarcoma-associated h
ccuacgcguuaagaagccac

SEQ ID NO: 4003788 - RNA, 21 nt, Human herpesvirus 8 [Kaposi`s sarcoma-associated h
ccuacgcguuaagaagccacu

SEQ ID NO: 4003789 - RNA, 17 nt, Human herpesvirus 8 [Kaposi`s sarcoma-associated h
ccuagaaaguuuccucu

SEQ ID NO: 4003790 - RNA, 16 nt, Human herpesvirus 8 [Kaposi`s sarcoma-associated h
ccucaacccacacugg

SEQ ID NO: 4003791 - RNA, 22 nt, Human herpesvirus 8 [Kaposi`s sarcoma-associated h
ccucgucgacagagccagccug

SEQ ID NO: 4003792 - RNA, 16 nt, Human herpesvirus 8 [Kaposi`s sarcoma-associated h
ccucgucuagcacaca

SEQ ID NO: 4003793 - RNA, 21 nt, Human herpesvirus 8 [Kaposi`s sarcoma-associated h
ccucuaucagcugcagccagg

SEQ ID NO: 4003794 - RNA, 20 nt, Human herpesvirus 8 [Kaposi`s sarcoma-associated h
ccucuggccugugcccaaau

SEQ ID NO: 4003795 - RNA, 19 nt, Human herpesvirus 8 [Kaposi`s sarcoma-associated h
ccugaagucccgaugccac

SEQ ID NO: 4003796 - RNA, 16 nt, Human herpesvirus 8 [Kaposi`s sarcoma-associated h
ccugauaugcaugugu

SEQ ID NO: 4003797 - RNA, 20 nt, Human herpesvirus 8 [Kaposi`s sarcoma-associated h
ccugcccucaaauucucaca

SEQ ID NO: 4003798 - RNA, 11 nt, Human herpesvirus 8 [Kaposi`s sarcoma-associated h
ccugugcauuc

SEQ ID NO: 4003799 - RNA, 20 nt, Human herpesvirus 8 [Kaposi`s sarcoma-associated h
ccuucgcaccccauccaccg

SEQ ID NO: 4003800 - RNA, 15 nt, Human herpesvirus 8 [Kaposi`s sarcoma-associated h
cgaaagcuaugguuu

SEQ ID NO: 4003801 - RNA, 23 nt, Human herpesvirus 8 [Kaposi`s sarcoma-associated h
cgaaagcuucaucguggugcccu

SEQ ID NO: 4003802 - RNA, 20 nt, Human herpesvirus 8 [Kaposi`s sarcoma-associated h
cgaacagguugccauggaga

SEQ ID NO: 4003803 - RNA, 12 nt, Human herpesvirus 8 [Kaposi`s sarcoma-associated h
cgaagcaaagug

SEQ ID NO: 4003804 - RNA, 21 nt, Human herpesvirus 8 [Kaposi`s sarcoma-associated h
cgaaguguugauccuggggcg

SEQ ID NO: 4003805 - RNA, 15 nt, Human herpesvirus 8 [Kaposi`s sarcoma-associated h
cgaaugugccagcag

SEQ ID NO: 4003806 - RNA, 22 nt, Human herpesvirus 8 [Kaposi`s sarcoma-associated h
cgacaaggacuuuuauagauuu

SEQ ID NO: 4003807 - RNA, 16 nt, Human herpesvirus 8 [Kaposi`s sarcoma-associated h
cgacacgauguuuucc

SEQ ID NO: 4003808 - RNA, 19 nt, Human herpesvirus 8 [Kaposi`s sarcoma-associated h
cgacacgauguuuuccagc

SEQ ID NO: 4003809 - RNA, 19 nt, Human herpesvirus 8 [Kaposi`s sarcoma-associated h
cgagcucaugcccacccug

SEQ ID NO: 4003810 - RNA, 12 nt, Human herpesvirus 8 [Kaposi`s sarcoma-associated h
cgagcucgggac

SEQ ID NO: 4003811 - RNA, 19 nt, Human herpesvirus 8 [Kaposi`s sarcoma-associated h
cgauauguccuucacuuug

SEQ ID NO: 4003812 - RNA, 23 nt, Human herpesvirus 8 [Kaposi`s sarcoma-associated h
cgaugaagagagaaugcuuccaa

SEQ ID NO: 4003813 - RNA, 22 nt, Human herpesvirus 8 [Kaposi`s sarcoma-associated h
cgauguccugauuuuccaggga

SEQ ID NO: 4003814 - RNA, 17 nt, Human herpesvirus 8 [Kaposi`s sarcoma-associated h
cgcaccgcaagcagcaa

SEQ ID NO: 4003815 - RNA, 17 nt, Human herpesvirus 8 [Kaposi`s sarcoma-associated h
cgcagauaucgacgcgg

SEQ ID NO: 4003816 - RNA, 11 nt, Human herpesvirus 8 [Kaposi`s sarcoma-associated h
cgccagacagc

SEQ ID NO: 4003817 - RNA, 16 nt, Human herpesvirus 8 [Kaposi`s sarcoma-associated h
cgccagcgucgccucc

SEQ ID NO: 4003818 - RNA, 16 nt, Human herpesvirus 8 [Kaposi`s sarcoma-associated h
cgccauuuuuguggcu

SEQ ID NO: 4003819 - RNA, 22 nt, Human herpesvirus 8 [Kaposi`s sarcoma-associated h
cgccauuuuuguggcugccugg

SEQ ID NO: 4003820 - RNA, 20 nt, Human herpesvirus 8 [Kaposi`s sarcoma-associated h
cgccgcggaaacucggucag

SEQ ID NO: 4003821 - RNA, 17 nt, Human herpesvirus 8 [Kaposi`s sarcoma-associated h
cgccgguagcugccugg

SEQ ID NO: 4003822 - RNA, 22 nt, Human herpesvirus 8 [Kaposi`s sarcoma-associated h
cgccgguguaugacccugagcu

SEQ ID NO: 4003823 - RNA, 13 nt, Human herpesvirus 8 [Kaposi`s sarcoma-associated h
cgcuccgccacgc

SEQ ID NO: 4003824 - RNA, 12 nt, Human herpesvirus 8 [Kaposi`s sarcoma-associated h
cgcucugugccc

SEQ ID NO: 4003825 - RNA, 23 nt, Human herpesvirus 8 [Kaposi`s sarcoma-associated h
cgcuggaagagaauggagaggag

SEQ ID NO: 4003826 - RNA, 18 nt, Human herpesvirus 8 [Kaposi`s sarcoma-associated h
cggaauggcucacggacu

SEQ ID NO: 4003827 - RNA, 17 nt, Human herpesvirus 8 [Kaposi`s sarcoma-associated h
cggagugccggcuggcc

SEQ ID NO: 4003828 - RNA, 13 nt, Human herpesvirus 8 [Kaposi`s sarcoma-associated h
cggaugacaggga

SEQ ID NO: 4003829 - RNA, 15 nt, Human herpesvirus 8 [Kaposi`s sarcoma-associated h
cggaugacagggaag

SEQ ID NO: 4003830 - RNA, 21 nt, Human herpesvirus 8 [Kaposi`s sarcoma-associated h
cggcaacacuggacacuaaaa

SEQ ID NO: 4003831 - RNA, 21 nt, Human herpesvirus 8 [Kaposi`s sarcoma-associated h
cggcacacuacucccccuccu

SEQ ID NO: 4003832 - RNA, 18 nt, Human herpesvirus 8 [Kaposi`s sarcoma-associated h
cggcaggcgugagaggca

SEQ ID NO: 4003833 - RNA, 22 nt, Human herpesvirus 8 [Kaposi`s sarcoma-associated h
cggcccaccgcguguucgaggg

SEQ ID NO: 4003834 - RNA, 22 nt, Human herpesvirus 8 [Kaposi`s sarcoma-associated h
cgggacaauugucggauuuuga

SEQ ID NO: 4003835 - RNA, 21 nt, Human herpesvirus 8 [Kaposi`s sarcoma-associated h
cggggagcgggguuuccaggg

SEQ ID NO: 4003836 - RNA, 19 nt, Human herpesvirus 8 [Kaposi`s sarcoma-associated h
cgggguccacggcgauguc

SEQ ID NO: 4003837 - RNA, 15 nt, Human herpesvirus 8 [Kaposi`s sarcoma-associated h
cgguggguggcuugg

SEQ ID NO: 4003838 - RNA, 17 nt, Human herpesvirus 8 [Kaposi`s sarcoma-associated h
cgguuuacuugcagcag

SEQ ID NO: 4003839 - RNA, 22 nt, Human herpesvirus 8 [Kaposi`s sarcoma-associated h
cgucaagaccgagcguauucuc

SEQ ID NO: 4003840 - RNA, 15 nt, Human herpesvirus 8 [Kaposi`s sarcoma-associated h
cgucagcagcaagca

SEQ ID NO: 4003841 - RNA, 17 nt, Human herpesvirus 8 [Kaposi`s sarcoma-associated h
cguccaguucccccaca

SEQ ID NO: 4003842 - RNA, 14 nt, Human herpesvirus 8 [Kaposi`s sarcoma-associated h
cgucgccuuaccau

SEQ ID NO: 4003843 - RNA, 21 nt, Human herpesvirus 8 [Kaposi`s sarcoma-associated h
cgucugccgaagucagugcca

SEQ ID NO: 4003844 - RNA, 17 nt, Human herpesvirus 8 [Kaposi`s sarcoma-associated h
cgucuugaccucuccgg

SEQ ID NO: 4003845 - RNA, 19 nt, Human herpesvirus 8 [Kaposi`s sarcoma-associated h
cgugccuucgaggccaggc

SEQ ID NO: 4003846 - RNA, 17 nt, Human herpesvirus 8 [Kaposi`s sarcoma-associated h
cguggaguugccugugg

SEQ ID NO: 4003847 - RNA, 15 nt, Human herpesvirus 8 [Kaposi`s sarcoma-associated h
cguggaugagagggu

SEQ ID NO: 4003848 - RNA, 16 nt, Human herpesvirus 8 [Kaposi`s sarcoma-associated h
cguggcgaucgucccc

SEQ ID NO: 4003849 - RNA, 19 nt, Human herpesvirus 8 [Kaposi`s sarcoma-associated h
cguguuugggcaaaacaca

SEQ ID NO: 4003850 - RNA, 13 nt, Human herpesvirus 8 [Kaposi`s sarcoma-associated h
cguuuccauauga

SEQ ID NO: 4003851 - RNA, 20 nt, Human herpesvirus 8 [Kaposi`s sarcoma-associated h
cuaaacguguucauaccuca

SEQ ID NO: 4003852 - RNA, 19 nt, Human herpesvirus 8 [Kaposi`s sarcoma-associated h
cuaacggguaacugcaugc

SEQ ID NO: 4003853 - RNA, 14 nt, Human herpesvirus 8 [Kaposi`s sarcoma-associated h
cuaccgucuaccug

SEQ ID NO: 4003854 - RNA, 17 nt, Human herpesvirus 8 [Kaposi`s sarcoma-associated h
cuagaauuggagcacuu

SEQ ID NO: 4003855 - RNA, 20 nt, Human herpesvirus 8 [Kaposi`s sarcoma-associated h
cuagaauuggagcacuuuug

SEQ ID NO: 4003856 - RNA, 14 nt, Human herpesvirus 8 [Kaposi`s sarcoma-associated h
gcggauaggcuggg

SEQ ID NO: 4003857 - RNA, 21 nt, Human herpesvirus 8 [Kaposi`s sarcoma-associated h
gcggccacgaauucgaggaca

SEQ ID NO: 4003858 - RNA, 18 nt, Human herpesvirus 8 [Kaposi`s sarcoma-associated h
gcggggacguucaccgug

SEQ ID NO: 4003859 - RNA, 12 nt, Human herpesvirus 8 [Kaposi`s sarcoma-associated h
gcggugcugccc

SEQ ID NO: 4003860 - RNA, 13 nt, Human herpesvirus 8 [Kaposi`s sarcoma-associated h
gcguguugggaca

SEQ ID NO: 4003861 - RNA, 11 nt, Human herpesvirus 8 [Kaposi`s sarcoma-associated h
gcguugugaag

SEQ ID NO: 4003862 - RNA, 15 nt, Human herpesvirus 8 [Kaposi`s sarcoma-associated h
gcucugcgugcugga

SEQ ID NO: 4003863 - RNA, 16 nt, Human herpesvirus 8 [Kaposi`s sarcoma-associated h
gcucugcgugcuggag

SEQ ID NO: 4003864 - RNA, 13 nt, Human herpesvirus 8 [Kaposi`s sarcoma-associated h
gcucugcugccug

SEQ ID NO: 4003865 - RNA, 14 nt, Human herpesvirus 8 [Kaposi`s sarcoma-associated h
gcugaucucagagg

SEQ ID NO: 4003866 - RNA, 13 nt, Human herpesvirus 8 [Kaposi`s sarcoma-associated h
gcugcagcuggac

SEQ ID NO: 4003867 - RNA, 12 nt, Human herpesvirus 8 [Kaposi`s sarcoma-associated h
gcuggacccacg

SEQ ID NO: 4003868 - RNA, 16 nt, Human herpesvirus 8 [Kaposi`s sarcoma-associated h
gcuggagggcacagau

SEQ ID NO: 4003869 - RNA, 16 nt, Human herpesvirus 8 [Kaposi`s sarcoma-associated h
gcugucauugaggaag

SEQ ID NO: 4003870 - RNA, 14 nt, Human herpesvirus 8 [Kaposi`s sarcoma-associated h
gcuguccaccuuaa

SEQ ID NO: 4003871 - RNA, 21 nt, Human herpesvirus 8 [Kaposi`s sarcoma-associated h
gcugucuaguggagagggcca

SEQ ID NO: 4003872 - RNA, 15 nt, Human herpesvirus 8 [Kaposi`s sarcoma-associated h
gcuuggcgaccucaa

SEQ ID NO: 4003873 - RNA, 23 nt, Human herpesvirus 8 [Kaposi`s sarcoma-associated h
gcuuuccugugauuucucugugc

SEQ ID NO: 4003874 - RNA, 14 nt, Human herpesvirus 8 [Kaposi`s sarcoma-associated h
gcuuugcagccagg

SEQ ID NO: 4003875 - RNA, 19 nt, Human herpesvirus 8 [Kaposi`s sarcoma-associated h
ggaagaugaagaugaagaa

SEQ ID NO: 4003876 - RNA, 20 nt, Human herpesvirus 8 [Kaposi`s sarcoma-associated h
ggacacuaaaagucuggccc

SEQ ID NO: 4003877 - RNA, 23 nt, Human herpesvirus 8 [Kaposi`s sarcoma-associated h
ggacagcaacacccagcuagcag

SEQ ID NO: 4003878 - RNA, 12 nt, Human herpesvirus 8 [Kaposi`s sarcoma-associated h
ggacagcuuuca

SEQ ID NO: 4003879 - RNA, 17 nt, Human herpesvirus 8 [Kaposi`s sarcoma-associated h
ggacauggacaggggug

SEQ ID NO: 4003880 - RNA, 18 nt, Human herpesvirus 8 [Kaposi`s sarcoma-associated h
ggacucugguacgcaagg

SEQ ID NO: 4003881 - RNA, 16 nt, Human herpesvirus 8 [Kaposi`s sarcoma-associated h
ggaguccauggcagug

SEQ ID NO: 4003882 - RNA, 12 nt, Human herpesvirus 8 [Kaposi`s sarcoma-associated h
ggcaugggcacc

SEQ ID NO: 4003883 - RNA, 17 nt, Human herpesvirus 8 [Kaposi`s sarcoma-associated h
ggccauucuaggagacg

SEQ ID NO: 4003884 - RNA, 14 nt, Human herpesvirus 8 [Kaposi`s sarcoma-associated h
ggcccgagaaacac

SEQ ID NO: 4003885 - RNA, 13 nt, Human herpesvirus 8 [Kaposi`s sarcoma-associated h
ggccgcauuuggc

SEQ ID NO: 4003886 - RNA, 14 nt, Human herpesvirus 8 [Kaposi`s sarcoma-associated h
ggcgagauuggagg

SEQ ID NO: 4003887 - RNA, 17 nt, Human herpesvirus 8 [Kaposi`s sarcoma-associated h
ggcgcaggcgaucgccg

SEQ ID NO: 4003888 - RNA, 17 nt, Human herpesvirus 8 [Kaposi`s sarcoma-associated h
ggcgcggaaacugggca

SEQ ID NO: 4003889 - RNA, 13 nt, Human herpesvirus 8 [Kaposi`s sarcoma-associated h
ggcgcucagggug

SEQ ID NO: 4003890 - RNA, 16 nt, Human herpesvirus 8 [Kaposi`s sarcoma-associated h
ggcggguggcucacau

SEQ ID NO: 4003891 - RNA, 11 nt, Human herpesvirus 8 [Kaposi`s sarcoma-associated h
ggcguguccag

SEQ ID NO: 4003892 - RNA, 20 nt, Human herpesvirus 8 [Kaposi`s sarcoma-associated h
ggcuccuggguagcuaugcc

SEQ ID NO: 4003893 - RNA, 12 nt, Human herpesvirus 8 [Kaposi`s sarcoma-associated h
ggcuguggcacc

SEQ ID NO: 4003894 - RNA, 11 nt, Human herpesvirus 8 [Kaposi`s sarcoma-associated h
ggcuguuacaa

SEQ ID NO: 4003895 - RNA, 23 nt, Human herpesvirus 8 [Kaposi`s sarcoma-associated h
ggcuguuacaauaaagccgagcc

SEQ ID NO: 4003896 - RNA, 22 nt, Human herpesvirus 8 [Kaposi`s sarcoma-associated h
gggccagagguuugaggcgcug

SEQ ID NO: 4003897 - RNA, 23 nt, Human herpesvirus 8 [Kaposi`s sarcoma-associated h
gggccuuggaguuaaagcuguca

SEQ ID NO: 4003898 - RNA, 16 nt, Human herpesvirus 8 [Kaposi`s sarcoma-associated h
ggggaagucaugcuca

SEQ ID NO: 4003899 - RNA, 14 nt, Human herpesvirus 8 [Kaposi`s sarcoma-associated h
ggguggacagugcc

SEQ ID NO: 4003900 - RNA, 21 nt, Human herpesvirus 8 [Kaposi`s sarcoma-associated h
gguaaccagcuacgcacugag

SEQ ID NO: 4003901 - RNA, 15 nt, Human herpesvirus 8 [Kaposi`s sarcoma-associated h
gguagauugacugga

SEQ ID NO: 4003902 - RNA, 15 nt, Human herpesvirus 8 [Kaposi`s sarcoma-associated h
gguaggccagcugcg

SEQ ID NO: 4003903 - RNA, 23 nt, Human herpesvirus 8 [Kaposi`s sarcoma-associated h
ggucccacugcugcgauccagag

SEQ ID NO: 4003904 - RNA, 18 nt, Human herpesvirus 8 [Kaposi`s sarcoma-associated h
ggugaucuuaggccagga

SEQ ID NO: 4003905 - RNA, 21 nt, Human herpesvirus 8 [Kaposi`s sarcoma-associated h
ggugucaagucucaugcuuua

SEQ ID NO: 4003906 - RNA, 19 nt, Human herpesvirus 8 [Kaposi`s sarcoma-associated h
gguguguugaaggacggau

SEQ ID NO: 4003907 - RNA, 15 nt, Human herpesvirus 8 [Kaposi`s sarcoma-associated h
gguuccagugcgcuc

SEQ ID NO: 4003908 - RNA, 16 nt, Human herpesvirus 8 [Kaposi`s sarcoma-associated h
gguuccguucuccuuc

SEQ ID NO: 4003909 - RNA, 22 nt, Human herpesvirus 8 [Kaposi`s sarcoma-associated h
gguugacuuuuuaaaggggacg

SEQ ID NO: 4003910 - RNA, 20 nt, Human herpesvirus 8 [Kaposi`s sarcoma-associated h
guacauuaaaaggacauugu

SEQ ID NO: 4003911 - RNA, 16 nt, Human herpesvirus 8 [Kaposi`s sarcoma-associated h
guacgacgcaggcguc

SEQ ID NO: 4003912 - RNA, 18 nt, Human herpesvirus 8 [Kaposi`s sarcoma-associated h
gucaaccagauuuaagau

SEQ ID NO: 4003913 - RNA, 23 nt, Human herpesvirus 8 [Kaposi`s sarcoma-associated h
gucagguuacuggacguggccag

SEQ ID NO: 4003914 - RNA, 22 nt, Human herpesvirus 8 [Kaposi`s sarcoma-associated h
gucaucucuaaucgaguacccc

SEQ ID NO: 4003915 - RNA, 14 nt, Human herpesvirus 8 [Kaposi`s sarcoma-associated h
gucuacccugccac

SEQ ID NO: 4003916 - RNA, 15 nt, Human herpesvirus 8 [Kaposi`s sarcoma-associated h
gucucccugcgugga

SEQ ID NO: 4003917 - RNA, 15 nt, Human herpesvirus 8 [Kaposi`s sarcoma-associated h
gucugaaacgggaca

SEQ ID NO: 4003918 - RNA, 14 nt, Human herpesvirus 8 [Kaposi`s sarcoma-associated h
gucugugcccugcg

SEQ ID NO: 4003919 - RNA, 22 nt, Human herpesvirus 8 [Kaposi`s sarcoma-associated h
gucuguguuuuguaaacugaug

SEQ ID NO: 4003920 - RNA, 19 nt, Human herpesvirus 8 [Kaposi`s sarcoma-associated h
gucuuuccgugucuccuug

SEQ ID NO: 4003921 - RNA, 13 nt, Human herpesvirus 8 [Kaposi`s sarcoma-associated h
gugaaguucauau

SEQ ID NO: 4003922 - RNA, 23 nt, Human herpesvirus 8 [Kaposi`s sarcoma-associated h
gugauuggucuuauaacagugcu

SEQ ID NO: 4003923 - RNA, 21 nt, Human herpesvirus 8 [Kaposi`s sarcoma-associated h
gugcguuugcagugugcagua

SEQ ID NO: 4003924 - RNA, 16 nt, Human herpesvirus 8 [Kaposi`s sarcoma-associated h
gugcuuuaaugcggag

SEQ ID NO: 4003925 - RNA, 14 nt, Human herpesvirus 8 [Kaposi`s sarcoma-associated h
gugcuuugcuggag

SEQ ID NO: 4003926 - RNA, 23 nt, Human herpesvirus 8 [Kaposi`s sarcoma-associated h
guggcaacauacauuuuucugaa

SEQ ID NO: 4003927 - RNA, 12 nt, Human herpesvirus 8 [Kaposi`s sarcoma-associated h
guggugugccug

SEQ ID NO: 4003928 - RNA, 20 nt, Human herpesvirus 8 [Kaposi`s sarcoma-associated h
guguaucccccacaggacaa

SEQ ID NO: 4003929 - RNA, 18 nt, Human herpesvirus 8 [Kaposi`s sarcoma-associated h
guguuuuuugccauggua

SEQ ID NO: 4003930 - RNA, 15 nt, Human herpesvirus 8 [Kaposi`s sarcoma-associated h
guuaucuuugcagug

SEQ ID NO: 4003931 - RNA, 13 nt, Human herpesvirus 8 [Kaposi`s sarcoma-associated h
guuccacggcgug

SEQ ID NO: 4003932 - RNA, 13 nt, Human herpesvirus 8 [Kaposi`s sarcoma-associated h
guugacagggacg

SEQ ID NO: 4003933 - RNA, 19 nt, Human herpesvirus 8 [Kaposi`s sarcoma-associated h
guuguaaacuauauauaag

SEQ ID NO: 4003934 - RNA, 15 nt, Human herpesvirus 8 [Kaposi`s sarcoma-associated h
guuuaccugcacucc

SEQ ID NO: 4003935 - RNA, 19 nt, Human herpesvirus 8 [Kaposi`s sarcoma-associated h
uaucaggggaaccacggcg

SEQ ID NO: 4003936 - RNA, 20 nt, Human herpesvirus 8 [Kaposi`s sarcoma-associated h
uaucuucaaggcccuguacu

SEQ ID NO: 4003937 - RNA, 22 nt, Human herpesvirus 8 [Kaposi`s sarcoma-associated h
uauugcuuucaaauaaaacggu

SEQ ID NO: 4003938 - RNA, 23 nt, Human herpesvirus 8 [Kaposi`s sarcoma-associated h
ucaaggucuuuaacgccugcacc

SEQ ID NO: 4003939 - RNA, 23 nt, Human herpesvirus 8 [Kaposi`s sarcoma-associated h
ucaaugggagaaccaaccucucc

SEQ ID NO: 4003940 - RNA, 22 nt, Human herpesvirus 8 [Kaposi`s sarcoma-associated h
ucacaaauuuuaacagccacga

SEQ ID NO: 4003941 - RNA, 14 nt, Human herpesvirus 8 [Kaposi`s sarcoma-associated h
ucagagucugaacc

SEQ ID NO: 4003942 - RNA, 22 nt, Human herpesvirus 8 [Kaposi`s sarcoma-associated h
ucagcauauacagguguccaag

SEQ ID NO: 4003943 - RNA, 13 nt, Human herpesvirus 8 [Kaposi`s sarcoma-associated h
ucaggucugucac

SEQ ID NO: 4003944 - RNA, 22 nt, Human herpesvirus 8 [Kaposi`s sarcoma-associated h
ucauccuaggugacugggagau

SEQ ID NO: 4003945 - RNA, 17 nt, Human herpesvirus 8 [Kaposi`s sarcoma-associated h
ucaucguggugcccugc

SEQ ID NO: 4003946 - RNA, 21 nt, Human herpesvirus 8 [Kaposi`s sarcoma-associated h
ucauguaccuggcguccagcu

SEQ ID NO: 4003947 - RNA, 19 nt, Human herpesvirus 8 [Kaposi`s sarcoma-associated h
uccaagacuaaaaaggcca

SEQ ID NO: 4003948 - RNA, 21 nt, Human herpesvirus 8 [Kaposi`s sarcoma-associated h
uccacagagccuaccccaacu

SEQ ID NO: 4003949 - RNA, 15 nt, Human herpesvirus 8 [Kaposi`s sarcoma-associated h
uccacccaguuugag

SEQ ID NO: 4003950 - RNA, 17 nt, Human herpesvirus 8 [Kaposi`s sarcoma-associated h
uccacccuaauacauaa

SEQ ID NO: 4003951 - RNA, 14 nt, Human herpesvirus 8 [Kaposi`s sarcoma-associated h
ucccacgugcacca

SEQ ID NO: 4003952 - RNA, 11 nt, Human herpesvirus 8 [Kaposi`s sarcoma-associated h
ucccacugcug

SEQ ID NO: 4003953 - RNA, 22 nt, Human herpesvirus 8 [Kaposi`s sarcoma-associated h
ucccagggugcgaaggaccuga

SEQ ID NO: 4003954 - RNA, 19 nt, Human herpesvirus 8 [Kaposi`s sarcoma-associated h
ucccccacacccccaggau

SEQ ID NO: 4003955 - RNA, 15 nt, Human herpesvirus 8 [Kaposi`s sarcoma-associated h
ucccgaugccacugu

SEQ ID NO: 4003956 - RNA, 18 nt, Human herpesvirus 8 [Kaposi`s sarcoma-associated h
ucccgugcguuugcagug

SEQ ID NO: 4003957 - RNA, 22 nt, Human herpesvirus 8 [Kaposi`s sarcoma-associated h
uccgucauucacccgagccaca

SEQ ID NO: 4003958 - RNA, 16 nt, Human herpesvirus 8 [Kaposi`s sarcoma-associated h
uccuccggugacugga

SEQ ID NO: 4003959 - RNA, 21 nt, Human herpesvirus 8 [Kaposi`s sarcoma-associated h
uccucgcgucggccaccgcgg

SEQ ID NO: 4003960 - RNA, 22 nt, Human herpesvirus 8 [Kaposi`s sarcoma-associated h
uccuuacuugguaacucccuca

SEQ ID NO: 4003961 - RNA, 21 nt, Human herpesvirus 8 [Kaposi`s sarcoma-associated h
ucgccaacggacgcgccacuc

SEQ ID NO: 4003962 - RNA, 12 nt, Human herpesvirus 8 [Kaposi`s sarcoma-associated h
ucgcccacggaa

SEQ ID NO: 4003963 - RNA, 18 nt, Human herpesvirus 8 [Kaposi`s sarcoma-associated h
ucgcccgucacuggaugu

SEQ ID NO: 4003964 - RNA, 14 nt, Human herpesvirus 8 [Kaposi`s sarcoma-associated h
ucgccgcuccgcac

SEQ ID NO: 4003965 - RNA, 23 nt, Human herpesvirus 8 [Kaposi`s sarcoma-associated h
ucggacaggacgcggccauccgc

SEQ ID NO: 4003966 - RNA, 15 nt, Human herpesvirus 8 [Kaposi`s sarcoma-associated h
ucgggggaucuugua

SEQ ID NO: 4003967 - RNA, 16 nt, Human herpesvirus 8 [Kaposi`s sarcoma-associated h
ucguugaucuucuuga

SEQ ID NO: 4003968 - RNA, 14 nt, Human herpesvirus 8 [Kaposi`s sarcoma-associated h
ucuacccugccacu

SEQ ID NO: 4003969 - RNA, 16 nt, Human herpesvirus 8 [Kaposi`s sarcoma-associated h
ucuaguggagagggcc

SEQ ID NO: 4003970 - RNA, 12 nt, Human herpesvirus 8 [Kaposi`s sarcoma-associated h
ucuauguuuccu

SEQ ID NO: 4003971 - RNA, 17 nt, Human herpesvirus 8 [Kaposi`s sarcoma-associated h
ucucccuucgugcccca

SEQ ID NO: 4003972 - RNA, 18 nt, Human herpesvirus 8 [Kaposi`s sarcoma-associated h
ucugugucacuccccgag

SEQ ID NO: 4003973 - RNA, 21 nt, Human herpesvirus 8 [Kaposi`s sarcoma-associated h
ucuugauguuuaaauuuuugg

SEQ ID NO: 4003974 - RNA, 20 nt, Human herpesvirus 8 [Kaposi`s sarcoma-associated h
ugaaagcaggacguccaggc

SEQ ID NO: 4003975 - RNA, 14 nt, Human herpesvirus 8 [Kaposi`s sarcoma-associated h
ugaacagggcauga

SEQ ID NO: 4003976 - RNA, 16 nt, Human herpesvirus 8 [Kaposi`s sarcoma-associated h
ugacuccggggagcug

SEQ ID NO: 4003977 - RNA, 18 nt, Human herpesvirus 8 [Kaposi`s sarcoma-associated h
ugacucuguauuugggac

SEQ ID NO: 4003978 - RNA, 22 nt, Human herpesvirus 8 [Kaposi`s sarcoma-associated h
ugacugccacggccgccuuugu

SEQ ID NO: 4003979 - RNA, 23 nt, Human herpesvirus 8 [Kaposi`s sarcoma-associated h
ugagccacaaacgccccucuugg

SEQ ID NO: 4003980 - RNA, 13 nt, Human herpesvirus 8 [Kaposi`s sarcoma-associated h
ugagccagaauga

SEQ ID NO: 4003981 - RNA, 15 nt, Human herpesvirus 8 [Kaposi`s sarcoma-associated h
ugagcgcugugcuuu

SEQ ID NO: 4003982 - RNA, 17 nt, Human herpesvirus 8 [Kaposi`s sarcoma-associated h
ugauaccguaguccccu

SEQ ID NO: 4003983 - RNA, 22 nt, Human herpesvirus 8 [Kaposi`s sarcoma-associated h
ggcagaaaauggcacacgguua

SEQ ID NO: 4003984 - RNA, 21 nt, Human herpesvirus 8 [Kaposi`s sarcoma-associated h
ggccaacaucaacaggagggc

SEQ ID NO: 4003985 - RNA, 17 nt, Human herpesvirus 8 [Kaposi`s sarcoma-associated h
ggccacauacgcucgcc

SEQ ID NO: 4003986 - RNA, 22 nt, Human herpesvirus 8 [Kaposi`s sarcoma-associated h
ggccacgaauucgaggacacgc

SEQ ID NO: 4003987 - RNA, 20 nt, Human herpesvirus 8 [Kaposi`s sarcoma-associated h
ggcgacaggcgcguauggga

SEQ ID NO: 4003988 - RNA, 21 nt, Human herpesvirus 8 [Kaposi`s sarcoma-associated h
ggcgagauuggaggcacauaa

SEQ ID NO: 4003989 - RNA, 20 nt, Human herpesvirus 8 [Kaposi`s sarcoma-associated h
ggcgcgccacagucgagccg

SEQ ID NO: 4003990 - RNA, 19 nt, Human herpesvirus 8 [Kaposi`s sarcoma-associated h
ggcgcgccugucgacaggc

SEQ ID NO: 4003991 - RNA, 17 nt, Human herpesvirus 8 [Kaposi`s sarcoma-associated h
ggcggcuguggcaccaa

SEQ ID NO: 4003992 - RNA, 13 nt, Human herpesvirus 8 [Kaposi`s sarcoma-associated h
ggcggggcggcug

SEQ ID NO: 4003993 - RNA, 15 nt, Human herpesvirus 8 [Kaposi`s sarcoma-associated h
ggcguccgcucuccc

SEQ ID NO: 4003994 - RNA, 21 nt, Human herpesvirus 8 [Kaposi`s sarcoma-associated h
ggcuugcacgccaacccucag

SEQ ID NO: 4003995 - RNA, 16 nt, Human herpesvirus 8 [Kaposi`s sarcoma-associated h
gggacgugcgggccaa

SEQ ID NO: 4003996 - RNA, 11 nt, Human herpesvirus 8 [Kaposi`s sarcoma-associated h
gggcaaaacac

SEQ ID NO: 4003997 - RNA, 18 nt, Human herpesvirus 8 [Kaposi`s sarcoma-associated h
gggcacccuauccaucag

SEQ ID NO: 4003998 - RNA, 19 nt, Human herpesvirus 8 [Kaposi`s sarcoma-associated h
gggcgauucgaucccgcaa

SEQ ID NO: 4003999 - RNA, 18 nt, Human herpesvirus 8 [Kaposi`s sarcoma-associated h
gggcuuguacaugugucu

SEQ ID NO: 4004000 - RNA, 21 nt, Human herpesvirus 8 [Kaposi`s sarcoma-associated h
gggugacaccuuucagacguc

SEQ ID NO: 4004001 - RNA, 17 nt, Human herpesvirus 8 [Kaposi`s sarcoma-associated h
ggucucucuugcugguc

SEQ ID NO: 4004002 - RNA, 14 nt, Human herpesvirus 8 [Kaposi`s sarcoma-associated h
ggugcguugugaag

SEQ ID NO: 4004003 - RNA, 22 nt, Human herpesvirus 8 [Kaposi`s sarcoma-associated h
gguggcucgcaugaauacccug

SEQ ID NO: 4004004 - RNA, 12 nt, Human herpesvirus 8 [Kaposi`s sarcoma-associated h
ggugggugugca

SEQ ID NO: 4004005 - RNA, 13 nt, Human herpesvirus 8 [Kaposi`s sarcoma-associated h
gguguucugucaa

SEQ ID NO: 4004006 - RNA, 14 nt, Human herpesvirus 8 [Kaposi`s sarcoma-associated h
gguuccccguccac

SEQ ID NO: 4004007 - RNA, 14 nt, Human herpesvirus 8 [Kaposi`s sarcoma-associated h
guaaagaaaguaga

SEQ ID NO: 4004008 - RNA, 18 nt, Human herpesvirus 8 [Kaposi`s sarcoma-associated h
guaaauuuaggaaacacg

SEQ ID NO: 4004009 - RNA, 14 nt, Human herpesvirus 8 [Kaposi`s sarcoma-associated h
guaagaggacccag

SEQ ID NO: 4004010 - RNA, 20 nt, Human herpesvirus 8 [Kaposi`s sarcoma-associated h
guacugcgcauuuccugccc

SEQ ID NO: 4004011 - RNA, 15 nt, Human herpesvirus 8 [Kaposi`s sarcoma-associated h
guagacggggagcug

SEQ ID NO: 4004012 - RNA, 16 nt, Human herpesvirus 8 [Kaposi`s sarcoma-associated h
gucaaccagauuuaag

SEQ ID NO: 4004013 - RNA, 17 nt, Human herpesvirus 8 [Kaposi`s sarcoma-associated h
gucacaguucagauggc

SEQ ID NO: 4004014 - RNA, 22 nt, Human herpesvirus 8 [Kaposi`s sarcoma-associated h
gucaugggaccguguguggcug

SEQ ID NO: 4004015 - RNA, 12 nt, Human herpesvirus 8 [Kaposi`s sarcoma-associated h
guccaggccucu

SEQ ID NO: 4004016 - RNA, 23 nt, Human herpesvirus 8 [Kaposi`s sarcoma-associated h
guccccaauuucaguacuccuuc

SEQ ID NO: 4004017 - RNA, 20 nt, Human herpesvirus 8 [Kaposi`s sarcoma-associated h
guccugauuuuccagggaca

SEQ ID NO: 4004018 - RNA, 18 nt, Human herpesvirus 8 [Kaposi`s sarcoma-associated h
gucgacagagccagccug

SEQ ID NO: 4004019 - RNA, 16 nt, Human herpesvirus 8 [Kaposi`s sarcoma-associated h
gucgcucuucaguuau

SEQ ID NO: 4004020 - RNA, 22 nt, Human herpesvirus 8 [Kaposi`s sarcoma-associated h
gucuacaggggcuugacagagu

SEQ ID NO: 4004021 - RNA, 21 nt, Human herpesvirus 8 [Kaposi`s sarcoma-associated h
gucucaggugucugcgggaca

SEQ ID NO: 4004022 - RNA, 15 nt, Human herpesvirus 8 [Kaposi`s sarcoma-associated h
gucuuauaacagugc

SEQ ID NO: 4004023 - RNA, 17 nt, Human herpesvirus 8 [Kaposi`s sarcoma-associated h
gucuuuauugcuuucaa

SEQ ID NO: 4004024 - RNA, 16 nt, Human herpesvirus 8 [Kaposi`s sarcoma-associated h
gugacgugacgcccug

SEQ ID NO: 4004025 - RNA, 17 nt, Human herpesvirus 8 [Kaposi`s sarcoma-associated h
gugcccaaaucuguccu

SEQ ID NO: 4004026 - RNA, 15 nt, Human herpesvirus 8 [Kaposi`s sarcoma-associated h
gugcgcgguguggca

SEQ ID NO: 4004027 - RNA, 20 nt, Human herpesvirus 8 [Kaposi`s sarcoma-associated h
gugcucuucccacacccggc

SEQ ID NO: 4004028 - RNA, 13 nt, Human herpesvirus 8 [Kaposi`s sarcoma-associated h
guggacaccacau

SEQ ID NO: 4004029 - RNA, 12 nt, Human herpesvirus 8 [Kaposi`s sarcoma-associated h
guggcaccugag

SEQ ID NO: 4004030 - RNA, 21 nt, Human herpesvirus 8 [Kaposi`s sarcoma-associated h
guggcccgucuguauacguga

SEQ ID NO: 4004031 - RNA, 23 nt, Human herpesvirus 8 [Kaposi`s sarcoma-associated h
guggcuuuugccuaaaaagaugc

SEQ ID NO: 4004032 - RNA, 16 nt, Human herpesvirus 8 [Kaposi`s sarcoma-associated h
ugguauauugguccag

SEQ ID NO: 4004033 - RNA, 18 nt, Human herpesvirus 8 [Kaposi`s sarcoma-associated h
ugguugauugugacuauu

SEQ ID NO: 4004034 - RNA, 17 nt, Human herpesvirus 8 [Kaposi`s sarcoma-associated h
uguaaaacacuguuugg

SEQ ID NO: 4004035 - RNA, 20 nt, Human herpesvirus 8 [Kaposi`s sarcoma-associated h
uguaaaucgggccacuuugc

SEQ ID NO: 4004036 - RNA, 15 nt, Human herpesvirus 8 [Kaposi`s sarcoma-associated h
uguaccuagcccugu

SEQ ID NO: 4004037 - RNA, 14 nt, Human herpesvirus 8 [Kaposi`s sarcoma-associated h
uguaugacugcccu

SEQ ID NO: 4004038 - RNA, 19 nt, Human herpesvirus 8 [Kaposi`s sarcoma-associated h
uguccccugcaaugcaagg

SEQ ID NO: 4004039 - RNA, 20 nt, Human herpesvirus 8 [Kaposi`s sarcoma-associated h
ugucugcguuccacaaacac

SEQ ID NO: 4004040 - RNA, 21 nt, Human herpesvirus 8 [Kaposi`s sarcoma-associated h
ugugaaugucagacacacacu

SEQ ID NO: 4004041 - RNA, 16 nt, Human herpesvirus 8 [Kaposi`s sarcoma-associated h
ugugcggcgcagcagc

SEQ ID NO: 4004042 - RNA, 15 nt, Human herpesvirus 8 [Kaposi`s sarcoma-associated h
ugugguaagaaggaa

SEQ ID NO: 4004043 - RNA, 20 nt, Human herpesvirus 8 [Kaposi`s sarcoma-associated h
uguguauccuagaaugaagu

SEQ ID NO: 4004044 - RNA, 16 nt, Human herpesvirus 8 [Kaposi`s sarcoma-associated h
uuaagaagccacuugu

SEQ ID NO: 4004045 - RNA, 15 nt, Human herpesvirus 8 [Kaposi`s sarcoma-associated h
uuaagacaaacacug

SEQ ID NO: 4004046 - RNA, 17 nt, Human herpesvirus 8 [Kaposi`s sarcoma-associated h
uuaagcgccaagccauu

SEQ ID NO: 4004047 - RNA, 19 nt, Human herpesvirus 8 [Kaposi`s sarcoma-associated h
uuaaguacauuaaaaggac

SEQ ID NO: 4004048 - RNA, 14 nt, Human herpesvirus 8 [Kaposi`s sarcoma-associated h
uuaauaaauugcuu

SEQ ID NO: 4004049 - RNA, 13 nt, Human herpesvirus 8 [Kaposi`s sarcoma-associated h
uuaauuggagcuc

SEQ ID NO: 4004050 - RNA, 19 nt, Human herpesvirus 8 [Kaposi`s sarcoma-associated h
uuacauuugacaacacgca

SEQ ID NO: 4004051 - RNA, 12 nt, Human herpesvirus 8 [Kaposi`s sarcoma-associated h
uuacuugcagca

SEQ ID NO: 4004052 - RNA, 19 nt, Human herpesvirus 8 [Kaposi`s sarcoma-associated h
uuagauaguguugagguaa

SEQ ID NO: 4004053 - RNA, 15 nt, Human herpesvirus 8 [Kaposi`s sarcoma-associated h
uuauaacagugcucu

SEQ ID NO: 4004054 - RNA, 21 nt, Human herpesvirus 8 [Kaposi`s sarcoma-associated h
uuaugaggucggauacuuauu

SEQ ID NO: 4004055 - RNA, 17 nt, Human herpesvirus 8 [Kaposi`s sarcoma-associated h
uucaagagggccaguuu

SEQ ID NO: 4004056 - RNA, 20 nt, Human herpesvirus 8 [Kaposi`s sarcoma-associated h
uucacccgagccacaucguc

SEQ ID NO: 4004057 - RNA, 22 nt, Human herpesvirus 8 [Kaposi`s sarcoma-associated h
uucccaaacacaucaguguccu

SEQ ID NO: 4004058 - RNA, 13 nt, Human herpesvirus 8 [Kaposi`s sarcoma-associated h
uucccccaucguc

SEQ ID NO: 4004059 - RNA, 16 nt, Human herpesvirus 8 [Kaposi`s sarcoma-associated h
uucggacgcuauuugu

SEQ ID NO: 4004060 - RNA, 16 nt, Human herpesvirus 8 [Kaposi`s sarcoma-associated h
uucguaagaggaccca

SEQ ID NO: 4004061 - RNA, 20 nt, Human herpesvirus 8 [Kaposi`s sarcoma-associated h
uucugaaacagaaacugcuc

SEQ ID NO: 4004062 - RNA, 22 nt, Human herpesvirus 8 [Kaposi`s sarcoma-associated h
uugcaccaagcacaacauuaaa

SEQ ID NO: 4004063 - RNA, 12 nt, Human herpesvirus 8 [Kaposi`s sarcoma-associated h
uugcauugcucu

SEQ ID NO: 4004064 - RNA, 20 nt, Human herpesvirus 8 [Kaposi`s sarcoma-associated h
uugccgagcccguuguggca

SEQ ID NO: 4004065 - RNA, 20 nt, Human herpesvirus 8 [Kaposi`s sarcoma-associated h
uuggaguuaaagcugucacu

SEQ ID NO: 4004066 - RNA, 14 nt, Human herpesvirus 8 [Kaposi`s sarcoma-associated h
uuggcgagaagccc

SEQ ID NO: 4004067 - RNA, 15 nt, Human herpesvirus 8 [Kaposi`s sarcoma-associated h
uuguggaccuccgcc

SEQ ID NO: 4004068 - RNA, 14 nt, Human herpesvirus 8 [Kaposi`s sarcoma-associated h
uuguggcugccugg

SEQ ID NO: 4004069 - RNA, 16 nt, Human herpesvirus 8 [Kaposi`s sarcoma-associated h
uuuacggacaauacug

SEQ ID NO: 4004070 - RNA, 18 nt, Human herpesvirus 8 [Kaposi`s sarcoma-associated h
uuuucaaaugagugaaaa

SEQ ID NO: 4004071 - RNA, 16 nt, Human herpesvirus 8 [Kaposi`s sarcoma-associated h
aaaauguuuacugggu

SEQ ID NO: 4004072 - RNA, 16 nt, Human herpesvirus 8 [Kaposi`s sarcoma-associated h
aaacaugcccuccugg

SEQ ID NO: 4004073 - RNA, 20 nt, Human herpesvirus 8 [Kaposi`s sarcoma-associated h
aaacgccccucuuggcuguu

SEQ ID NO: 4004074 - RNA, 14 nt, Human herpesvirus 8 [Kaposi`s sarcoma-associated h
aaagccgagccaca

SEQ ID NO: 4004075 - RNA, 15 nt, Human herpesvirus 8 [Kaposi`s sarcoma-associated h
aaagccgagccacaa

SEQ ID NO: 4004076 - RNA, 19 nt, Human herpesvirus 8 [Kaposi`s sarcoma-associated h
aacacagucacaguucaga

SEQ ID NO: 4004077 - RNA, 14 nt, Human herpesvirus 8 [Kaposi`s sarcoma-associated h
aacagaagacccag

SEQ ID NO: 4004078 - RNA, 22 nt, Human herpesvirus 8 [Kaposi`s sarcoma-associated h
aacccgcccucgggacuucugg

SEQ ID NO: 4004079 - RNA, 18 nt, Human herpesvirus 8 [Kaposi`s sarcoma-associated h
aacgcacaucagcggcac

SEQ ID NO: 4004080 - RNA, 16 nt, Human herpesvirus 8 [Kaposi`s sarcoma-associated h
aacuuuauuacaggua

SEQ ID NO: 4004081 - RNA, 17 nt, Human herpesvirus 8 [Kaposi`s sarcoma-associated h
aagaaauccgagcaccu

SEQ ID NO: 4004082 - RNA, 16 nt, Human herpesvirus 8 [Kaposi`s sarcoma-associated h
aagcacauuuugcacg

SEQ ID NO: 4004083 - RNA, 17 nt, Human herpesvirus 8 [Kaposi`s sarcoma-associated h
aagcuuugcagccaggu

SEQ ID NO: 4004084 - RNA, 14 nt, Human herpesvirus 8 [Kaposi`s sarcoma-associated h
aaggcaacaccggc

SEQ ID NO: 4004085 - RNA, 23 nt, Human herpesvirus 8 [Kaposi`s sarcoma-associated h
aaggcacaacucuacugcacaaa

SEQ ID NO: 4004086 - RNA, 22 nt, Human herpesvirus 8 [Kaposi`s sarcoma-associated h
aagucagugccacaauuucauu

SEQ ID NO: 4004087 - RNA, 17 nt, Human herpesvirus 8 [Kaposi`s sarcoma-associated h
aaguccgucaaccagau

SEQ ID NO: 4004088 - RNA, 13 nt, Human herpesvirus 8 [Kaposi`s sarcoma-associated h
aagucggcucugg

SEQ ID NO: 4004089 - RNA, 16 nt, Human herpesvirus 8 [Kaposi`s sarcoma-associated h
aagucucccugcgugg

SEQ ID NO: 4004090 - RNA, 15 nt, Human herpesvirus 8 [Kaposi`s sarcoma-associated h
aagucucuuggacaa

SEQ ID NO: 4004091 - RNA, 22 nt, Human herpesvirus 8 [Kaposi`s sarcoma-associated h
aaguggugaucuuaggccagga

SEQ ID NO: 4004092 - RNA, 14 nt, Human herpesvirus 8 [Kaposi`s sarcoma-associated h
aaguuucaaagucg

SEQ ID NO: 4004093 - RNA, 18 nt, Human herpesvirus 8 [Kaposi`s sarcoma-associated h
aauacccccaaaaugucc

SEQ ID NO: 4004094 - RNA, 22 nt, Human herpesvirus 8 [Kaposi`s sarcoma-associated h
aaucuguuuauuguuuuugaac

SEQ ID NO: 4004095 - RNA, 15 nt, Human herpesvirus 8 [Kaposi`s sarcoma-associated h
aaugcagcaguagac

SEQ ID NO: 4004096 - RNA, 13 nt, Human herpesvirus 8 [Kaposi`s sarcoma-associated h
aaugugccagcag

SEQ ID NO: 4004097 - RNA, 17 nt, Human herpesvirus 8 [Kaposi`s sarcoma-associated h
aauguuuguaauuuccu

SEQ ID NO: 4004098 - RNA, 13 nt, Human herpesvirus 8 [Kaposi`s sarcoma-associated h
acaaaaacacaau

SEQ ID NO: 4004099 - RNA, 16 nt, Human herpesvirus 8 [Kaposi`s sarcoma-associated h
acaaauguuuuaugca

SEQ ID NO: 4004100 - RNA, 18 nt, Human herpesvirus 8 [Kaposi`s sarcoma-associated h
acaaugugucuguggcua

SEQ ID NO: 4004101 - RNA, 15 nt, Human herpesvirus 8 [Kaposi`s sarcoma-associated h
acacccuggaugggu

SEQ ID NO: 4004102 - RNA, 21 nt, Human herpesvirus 8 [Kaposi`s sarcoma-associated h
acaggacccauuaacuuuccu

SEQ ID NO: 4004103 - RNA, 15 nt, Human herpesvirus 8 [Kaposi`s sarcoma-associated h
acagguaugaccggc

SEQ ID NO: 4004104 - RNA, 17 nt, Human herpesvirus 8 [Kaposi`s sarcoma-associated h
acagugccugggugcug

SEQ ID NO: 4004105 - RNA, 21 nt, Human herpesvirus 8 [Kaposi`s sarcoma-associated h
acaguugugaucucuggagac

SEQ ID NO: 4004106 - RNA, 13 nt, Human herpesvirus 8 [Kaposi`s sarcoma-associated h
acauaaaauuucu

SEQ ID NO: 4004107 - RNA, 14 nt, Human herpesvirus 8 [Kaposi`s sarcoma-associated h
acauccgcugccac

SEQ ID NO: 4004108 - RNA, 22 nt, Human herpesvirus 8 [Kaposi`s sarcoma-associated h
acaugagagacugcaggccauc

SEQ ID NO: 4004109 - RNA, 14 nt, Human herpesvirus 8 [Kaposi`s sarcoma-associated h
acaugcugccacug

SEQ ID NO: 4004110 - RNA, 20 nt, Human herpesvirus 8 [Kaposi`s sarcoma-associated h
acauugugucaaccagggca

SEQ ID NO: 4004111 - RNA, 20 nt, Human herpesvirus 8 [Kaposi`s sarcoma-associated h
acauuuucucgugugcccuu

SEQ ID NO: 4004112 - RNA, 19 nt, Human herpesvirus 8 [Kaposi`s sarcoma-associated h
accaauaacgaagguaugu

SEQ ID NO: 4004113 - RNA, 17 nt, Human herpesvirus 8 [Kaposi`s sarcoma-associated h
aaaacauagugccucau

SEQ ID NO: 4004114 - RNA, 22 nt, Human herpesvirus 8 [Kaposi`s sarcoma-associated h
aaaaucuggcaugcugggauuu

SEQ ID NO: 4004115 - RNA, 22 nt, Human herpesvirus 8 [Kaposi`s sarcoma-associated h
aaacauuggcgggugugucuug

SEQ ID NO: 4004116 - RNA, 19 nt, Human herpesvirus 8 [Kaposi`s sarcoma-associated h
aaagccugguccaggccuc

SEQ ID NO: 4004117 - RNA, 16 nt, Human herpesvirus 8 [Kaposi`s sarcoma-associated h
aacaaggaaugcauau

SEQ ID NO: 4004118 - RNA, 15 nt, Human herpesvirus 8 [Kaposi`s sarcoma-associated h
aacagaagacccaga

SEQ ID NO: 4004119 - RNA, 21 nt, Human herpesvirus 8 [Kaposi`s sarcoma-associated h
aaccauuuuuuacggacaaua

SEQ ID NO: 4004120 - RNA, 14 nt, Human herpesvirus 8 [Kaposi`s sarcoma-associated h
aacugcgucaugua

SEQ ID NO: 4004121 - RNA, 17 nt, Human herpesvirus 8 [Kaposi`s sarcoma-associated h
aacuguuuacugcuguu

SEQ ID NO: 4004122 - RNA, 16 nt, Human herpesvirus 8 [Kaposi`s sarcoma-associated h
aagaaccaaaggacau

SEQ ID NO: 4004123 - RNA, 12 nt, Human herpesvirus 8 [Kaposi`s sarcoma-associated h
aagagggauggg

SEQ ID NO: 4004124 - RNA, 14 nt, Human herpesvirus 8 [Kaposi`s sarcoma-associated h
aagccgagcucggg

SEQ ID NO: 4004125 - RNA, 18 nt, Human herpesvirus 8 [Kaposi`s sarcoma-associated h
aagcggauugaguguaaa

SEQ ID NO: 4004126 - RNA, 21 nt, Human herpesvirus 8 [Kaposi`s sarcoma-associated h
aagcgucugggucguggcgcc

SEQ ID NO: 4004127 - RNA, 20 nt, Human herpesvirus 8 [Kaposi`s sarcoma-associated h
aagcuucaucguggugcccu

SEQ ID NO: 4004128 - RNA, 16 nt, Human herpesvirus 8 [Kaposi`s sarcoma-associated h
aagcuuugcagccagg

SEQ ID NO: 4004129 - RNA, 11 nt, Human herpesvirus 8 [Kaposi`s sarcoma-associated h
aauaaauguga

SEQ ID NO: 4004130 - RNA, 16 nt, Human herpesvirus 8 [Kaposi`s sarcoma-associated h
aauaacccgcuccgcc

SEQ ID NO: 4004131 - RNA, 13 nt, Human herpesvirus 8 [Kaposi`s sarcoma-associated h
aaucgaagccagg

SEQ ID NO: 4004132 - RNA, 22 nt, Human herpesvirus 8 [Kaposi`s sarcoma-associated h
aaugaagugcaaccugcugcag

SEQ ID NO: 4004133 - RNA, 13 nt, Human herpesvirus 8 [Kaposi`s sarcoma-associated h
aaugcggagagga

SEQ ID NO: 4004134 - RNA, 23 nt, Human herpesvirus 8 [Kaposi`s sarcoma-associated h
aauggccuccacccaccaagcua

SEQ ID NO: 4004135 - RNA, 12 nt, Human herpesvirus 8 [Kaposi`s sarcoma-associated h
aauguuuugguc

SEQ ID NO: 4004136 - RNA, 12 nt, Human herpesvirus 8 [Kaposi`s sarcoma-associated h
aauuggagcacu

SEQ ID NO: 4004137 - RNA, 18 nt, Human herpesvirus 8 [Kaposi`s sarcoma-associated h
aauuucuuauaacacuaa

SEQ ID NO: 4004138 - RNA, 18 nt, Human herpesvirus 8 [Kaposi`s sarcoma-associated h
acaacuauguuuccuagc

SEQ ID NO: 4004139 - RNA, 17 nt, Human herpesvirus 8 [Kaposi`s sarcoma-associated h
acaaucuggauguguau

SEQ ID NO: 4004140 - RNA, 20 nt, Human herpesvirus 8 [Kaposi`s sarcoma-associated h
acaaugaauggggaccagag

SEQ ID NO: 4004141 - RNA, 17 nt, Human herpesvirus 8 [Kaposi`s sarcoma-associated h
acacacggaaggcagug

SEQ ID NO: 4004142 - RNA, 18 nt, Human herpesvirus 8 [Kaposi`s sarcoma-associated h
acacuaaaagucuggccc

SEQ ID NO: 4004143 - RNA, 19 nt, Human herpesvirus 8 [Kaposi`s sarcoma-associated h
acagcccauaguauguaaa

SEQ ID NO: 4004144 - RNA, 21 nt, Human herpesvirus 8 [Kaposi`s sarcoma-associated h
acaggaagcggguuggacugg

SEQ ID NO: 4004145 - RNA, 16 nt, Human herpesvirus 8 [Kaposi`s sarcoma-associated h
acagucgagccgccag

SEQ ID NO: 4004146 - RNA, 18 nt, Human herpesvirus 8 [Kaposi`s sarcoma-associated h
acagucuguaaagaaagu

SEQ ID NO: 4004147 - RNA, 19 nt, Human herpesvirus 8 [Kaposi`s sarcoma-associated h
acaucccccccgcaggcca

SEQ ID NO: 4004148 - RNA, 16 nt, Human herpesvirus 8 [Kaposi`s sarcoma-associated h
accagacacugaggga

SEQ ID NO: 4004149 - RNA, 17 nt, Human herpesvirus 8 [Kaposi`s sarcoma-associated h
accagcgguaaaggcgc

SEQ ID NO: 4004150 - RNA, 16 nt, Human herpesvirus 8 [Kaposi`s sarcoma-associated h
acccaauaaaagagag

SEQ ID NO: 4004151 - RNA, 21 nt, Human herpesvirus 8 [Kaposi`s sarcoma-associated h
acccuuccuacccuacucccc

SEQ ID NO: 4004152 - RNA, 18 nt, Human herpesvirus 8 [Kaposi`s sarcoma-associated h
accgagcucugcugccug

SEQ ID NO: 4004153 - RNA, 16 nt, Human herpesvirus 8 [Kaposi`s sarcoma-associated h
accggaguagugcaag

SEQ ID NO: 4004154 - RNA, 16 nt, Human herpesvirus 8 [Kaposi`s sarcoma-associated h
accgucuaccugccgg

SEQ ID NO: 4004155 - RNA, 16 nt, Human herpesvirus 8 [Kaposi`s sarcoma-associated h
accugaugcaggccac

SEQ ID NO: 4004156 - RNA, 15 nt, Human herpesvirus 8 [Kaposi`s sarcoma-associated h
acgcaggcgccuaug

SEQ ID NO: 4004157 - RNA, 14 nt, Human herpesvirus 8 [Kaposi`s sarcoma-associated h
acgcagggugcggu

SEQ ID NO: 4004158 - RNA, 19 nt, Human herpesvirus 8 [Kaposi`s sarcoma-associated h
acgcccgggggccaggacu

SEQ ID NO: 4004159 - RNA, 19 nt, Human herpesvirus 8 [Kaposi`s sarcoma-associated h
acgcgcgacgcaucgucgc

SEQ ID NO: 4004160 - RNA, 20 nt, Human herpesvirus 8 [Kaposi`s sarcoma-associated h
acgggaggcuugguggccau

SEQ ID NO: 4004161 - RNA, 17 nt, Human herpesvirus 8 [Kaposi`s sarcoma-associated h
acgucuugaccucuccg

SEQ ID NO: 4004162 - RNA, 13 nt, Human herpesvirus 8 [Kaposi`s sarcoma-associated h
acuaaucaguguu

SEQ ID NO: 4004163 - RNA, 22 nt, Human herpesvirus 8 [Kaposi`s sarcoma-associated h
acuacagggaaguuucagagcc

SEQ ID NO: 4004164 - RNA, 21 nt, Human herpesvirus 8 [Kaposi`s sarcoma-associated h
acuaggaggaagagcacuguu

SEQ ID NO: 4004165 - RNA, 24 nt, Human herpesvirus 8 [Kaposi`s sarcoma-associated h
acuauagugcgcgguguggcagaa

SEQ ID NO: 4004166 - RNA, 20 nt, Human herpesvirus 8 [Kaposi`s sarcoma-associated h
acucacugggggucucggga

SEQ ID NO: 4004167 - RNA, 15 nt, Human herpesvirus 8 [Kaposi`s sarcoma-associated h
acucgcuguccugga

SEQ ID NO: 4004168 - RNA, 21 nt, Human herpesvirus 8 [Kaposi`s sarcoma-associated h
acugucuccagaagagcauuu

SEQ ID NO: 4004169 - RNA, 23 nt, Human herpesvirus 8 [Kaposi`s sarcoma-associated h
acuuaacgugucugaauguggaa

SEQ ID NO: 4004170 - RNA, 16 nt, Human herpesvirus 8 [Kaposi`s sarcoma-associated h
acuuauuaaaagcauu

SEQ ID NO: 4004171 - RNA, 20 nt, Human herpesvirus 8 [Kaposi`s sarcoma-associated h
acuuugcccuaaaugugaca

SEQ ID NO: 4004172 - RNA, 21 nt, Human herpesvirus 8 [Kaposi`s sarcoma-associated h
agaaaauuucuguuuccagug

SEQ ID NO: 4004173 - RNA, 20 nt, Human herpesvirus 8 [Kaposi`s sarcoma-associated h
agaacugucgagacauguca

SEQ ID NO: 4004174 - RNA, 14 nt, Human herpesvirus 8 [Kaposi`s sarcoma-associated h
agacacgcaaagua

SEQ ID NO: 4004175 - RNA, 18 nt, Human herpesvirus 8 [Kaposi`s sarcoma-associated h
agacaguuaaucuuuauu

SEQ ID NO: 4004176 - RNA, 18 nt, Human herpesvirus 8 [Kaposi`s sarcoma-associated h
agacuggugcgcacaggc

SEQ ID NO: 4004177 - RNA, 15 nt, Human herpesvirus 8 [Kaposi`s sarcoma-associated h
agagaauacagugcu

SEQ ID NO: 4004178 - RNA, 17 nt, Human herpesvirus 8 [Kaposi`s sarcoma-associated h
agagccagccuggacga

SEQ ID NO: 4004179 - RNA, 18 nt, Human herpesvirus 8 [Kaposi`s sarcoma-associated h
agauccuccacagagccu

SEQ ID NO: 4004180 - RNA, 15 nt, Human herpesvirus 8 [Kaposi`s sarcoma-associated h
agauuucgcaccagc

SEQ ID NO: 4004181 - RNA, 13 nt, Human herpesvirus 8 [Kaposi`s sarcoma-associated h
agcaaaacacaaa

SEQ ID NO: 4004182 - RNA, 15 nt, Human herpesvirus 8 [Kaposi`s sarcoma-associated h
agcaauaaagacaaa

SEQ ID NO: 4004183 - RNA, 17 nt, Human herpesvirus 8 [Kaposi`s sarcoma-associated h
agcacuagguuagguug

SEQ ID NO: 4004184 - RNA, 19 nt, Human herpesvirus 8 [Kaposi`s sarcoma-associated h
agcagggcggccacucuug

SEQ ID NO: 4004185 - RNA, 14 nt, Human herpesvirus 8 [Kaposi`s sarcoma-associated h
agcaguguuugcug

SEQ ID NO: 4004186 - RNA, 23 nt, Human herpesvirus 8 [Kaposi`s sarcoma-associated h
agcaugccugcgcugcgcauggc

SEQ ID NO: 4004187 - RNA, 13 nt, Human herpesvirus 8 [Kaposi`s sarcoma-associated h
agcaugcugauga

SEQ ID NO: 4004188 - RNA, 22 nt, Human herpesvirus 8 [Kaposi`s sarcoma-associated h
agccacaaacgccccucuuggc

SEQ ID NO: 4004189 - RNA, 15 nt, Human herpesvirus 8 [Kaposi`s sarcoma-associated h
agccaugugcugguu

SEQ ID NO: 4004190 - RNA, 19 nt, Human herpesvirus 8 [Kaposi`s sarcoma-associated h
agcccgagaucaucuuuuc

SEQ ID NO: 4004191 - RNA, 21 nt, Human herpesvirus 8 [Kaposi`s sarcoma-associated h
aaaacugucuccagaagagca

SEQ ID NO: 4004192 - RNA, 16 nt, Human herpesvirus 8 [Kaposi`s sarcoma-associated h
aaaaugggccaugaca

SEQ ID NO: 4004193 - RNA, 15 nt, Human herpesvirus 8 [Kaposi`s sarcoma-associated h
aaacagccuuggugc

SEQ ID NO: 4004194 - RNA, 23 nt, Human herpesvirus 8 [Kaposi`s sarcoma-associated h
aaaccccccucgucgacagagcc

SEQ ID NO: 4004195 - RNA, 21 nt, Human herpesvirus 8 [Kaposi`s sarcoma-associated h
aaagcagcgcccacuggugua

SEQ ID NO: 4004196 - RNA, 12 nt, Human herpesvirus 8 [Kaposi`s sarcoma-associated h
aaagcugucacu

SEQ ID NO: 4004197 - RNA, 22 nt, Human herpesvirus 8 [Kaposi`s sarcoma-associated h
aaaugaggggucugaucccaaa

SEQ ID NO: 4004198 - RNA, 21 nt, Human herpesvirus 8 [Kaposi`s sarcoma-associated h
aaauuguguguaccuagcccu

SEQ ID NO: 4004199 - RNA, 16 nt, Human herpesvirus 8 [Kaposi`s sarcoma-associated h
aacacguaccugaccu

SEQ ID NO: 4004200 - RNA, 19 nt, Human herpesvirus 8 [Kaposi`s sarcoma-associated h
aacaugcccuccugggcca

SEQ ID NO: 4004201 - RNA, 16 nt, Human herpesvirus 8 [Kaposi`s sarcoma-associated h
aacaugcugccacugc

SEQ ID NO: 4004202 - RNA, 13 nt, Human herpesvirus 8 [Kaposi`s sarcoma-associated h
aacaugugggcuu

SEQ ID NO: 4004203 - RNA, 16 nt, Human herpesvirus 8 [Kaposi`s sarcoma-associated h
aacccucuacucuucc

SEQ ID NO: 4004204 - RNA, 15 nt, Human herpesvirus 8 [Kaposi`s sarcoma-associated h
aacgugccugccaag

SEQ ID NO: 4004205 - RNA, 13 nt, Human herpesvirus 8 [Kaposi`s sarcoma-associated h
aagaggacccagg

SEQ ID NO: 4004206 - RNA, 12 nt, Human herpesvirus 8 [Kaposi`s sarcoma-associated h
aagcacuggcug

SEQ ID NO: 4004207 - RNA, 22 nt, Human herpesvirus 8 [Kaposi`s sarcoma-associated h
aagcacugggauccacugccga

SEQ ID NO: 4004208 - RNA, 13 nt, Human herpesvirus 8 [Kaposi`s sarcoma-associated h
aagcgcugacgaa

SEQ ID NO: 4004209 - RNA, 14 nt, Human herpesvirus 8 [Kaposi`s sarcoma-associated h
aagcuguacauaau

SEQ ID NO: 4004210 - RNA, 15 nt, Human herpesvirus 8 [Kaposi`s sarcoma-associated h
aaguagucagacauu

SEQ ID NO: 4004211 - RNA, 18 nt, Human herpesvirus 8 [Kaposi`s sarcoma-associated h
aaguccggccaccgugga

SEQ ID NO: 4004212 - RNA, 21 nt, Human herpesvirus 8 [Kaposi`s sarcoma-associated h
aagucguguaagaacauugga

SEQ ID NO: 4004213 - RNA, 12 nt, Human herpesvirus 8 [Kaposi`s sarcoma-associated h
aauacagugcua

SEQ ID NO: 4004214 - RNA, 18 nt, Human herpesvirus 8 [Kaposi`s sarcoma-associated h
aauccuuaagaaagugga

SEQ ID NO: 4004215 - RNA, 19 nt, Human herpesvirus 8 [Kaposi`s sarcoma-associated h
aaucuuuauugucuagaca

SEQ ID NO: 4004216 - RNA, 18 nt, Human herpesvirus 8 [Kaposi`s sarcoma-associated h
aaugaaauuguggcacug

SEQ ID NO: 4004217 - RNA, 22 nt, Human herpesvirus 8 [Kaposi`s sarcoma-associated h
aaugacauaggcgacaaaguga

SEQ ID NO: 4004218 - RNA, 21 nt, Human herpesvirus 8 [Kaposi`s sarcoma-associated h
aaugagucaggcguggucucu

SEQ ID NO: 4004219 - RNA, 15 nt, Human herpesvirus 8 [Kaposi`s sarcoma-associated h
acaacauauguuaaa

SEQ ID NO: 4004220 - RNA, 11 nt, Human herpesvirus 8 [Kaposi`s sarcoma-associated h
acaauaaagcc

SEQ ID NO: 4004221 - RNA, 13 nt, Human herpesvirus 8 [Kaposi`s sarcoma-associated h
acacacacaaaga

SEQ ID NO: 4004222 - RNA, 15 nt, Human herpesvirus 8 [Kaposi`s sarcoma-associated h
acacuuuacugugua

SEQ ID NO: 4004223 - RNA, 19 nt, Human herpesvirus 8 [Kaposi`s sarcoma-associated h
acauaaaacgaagcaaagu

SEQ ID NO: 4004224 - RNA, 20 nt, Human herpesvirus 8 [Kaposi`s sarcoma-associated h
acauaauccccggcagcacc

SEQ ID NO: 4004225 - RNA, 16 nt, Human herpesvirus 8 [Kaposi`s sarcoma-associated h
acaugugcuuuugcuu

SEQ ID NO: 4004226 - RNA, 14 nt, Human herpesvirus 8 [Kaposi`s sarcoma-associated h
acauuaaacacaua

SEQ ID NO: 4004227 - RNA, 16 nt, Human herpesvirus 8 [Kaposi`s sarcoma-associated h
accacggcacaggacc

SEQ ID NO: 4004228 - RNA, 16 nt, Human herpesvirus 8 [Kaposi`s sarcoma-associated h
accauguucagguggu

SEQ ID NO: 4004229 - RNA, 16 nt, Human herpesvirus 8 [Kaposi`s sarcoma-associated h
acccacgccgucacag

SEQ ID NO: 4004230 - RNA, 22 nt, Human herpesvirus 8 [Kaposi`s sarcoma-associated h
acccacgucacaucaccggacc

SEQ ID NO: 4004231 - RNA, 22 nt, Human herpesvirus 8 [Kaposi`s sarcoma-associated h
acccguaccacaagggccaagc

SEQ ID NO: 4004232 - RNA, 16 nt, Human herpesvirus 8 [Kaposi`s sarcoma-associated h
accgugggaacuguga

SEQ ID NO: 4004233 - RNA, 14 nt, Human herpesvirus 8 [Kaposi`s sarcoma-associated h
accuagcgggcaca

SEQ ID NO: 4004234 - RNA, 22 nt, Human herpesvirus 8 [Kaposi`s sarcoma-associated h
accucgggccuugggugcgaug

SEQ ID NO: 4004235 - RNA, 16 nt, Human herpesvirus 8 [Kaposi`s sarcoma-associated h
accugauacgccacgg

SEQ ID NO: 4004236 - RNA, 11 nt, Human herpesvirus 8 [Kaposi`s sarcoma-associated h
accugcacucc

SEQ ID NO: 4004237 - RNA, 20 nt, Human herpesvirus 8 [Kaposi`s sarcoma-associated h
accuguccaugucgcacacu

SEQ ID NO: 4004238 - RNA, 22 nt, Human herpesvirus 8 [Kaposi`s sarcoma-associated h
acgaaugcucaggucugucacu

SEQ ID NO: 4004239 - RNA, 22 nt, Human herpesvirus 8 [Kaposi`s sarcoma-associated h
gaauguauguaucugauuuaau

SEQ ID NO: 4004240 - RNA, 23 nt, Human herpesvirus 8 [Kaposi`s sarcoma-associated h
gaauuccacccauccuccucaga

SEQ ID NO: 4004241 - RNA, 21 nt, Human herpesvirus 8 [Kaposi`s sarcoma-associated h
gacaccuauaauggucuguau

SEQ ID NO: 4004242 - RNA, 16 nt, Human herpesvirus 8 [Kaposi`s sarcoma-associated h
gacagagccagccugg

SEQ ID NO: 4004243 - RNA, 17 nt, Human herpesvirus 8 [Kaposi`s sarcoma-associated h
gacagaguuguggaccu

SEQ ID NO: 4004244 - RNA, 15 nt, Human herpesvirus 8 [Kaposi`s sarcoma-associated h
gacaucagaagaugc

SEQ ID NO: 4004245 - RNA, 15 nt, Human herpesvirus 8 [Kaposi`s sarcoma-associated h
gacauguggagccac

SEQ ID NO: 4004246 - RNA, 12 nt, Human herpesvirus 8 [Kaposi`s sarcoma-associated h
gaccugcuucac

SEQ ID NO: 4004247 - RNA, 15 nt, Human herpesvirus 8 [Kaposi`s sarcoma-associated h
gaccugcuucacuua

SEQ ID NO: 4004248 - RNA, 12 nt, Human herpesvirus 8 [Kaposi`s sarcoma-associated h
gacgccacugcu

SEQ ID NO: 4004249 - RNA, 21 nt, Human herpesvirus 8 [Kaposi`s sarcoma-associated h
gacgcggccauccgcgagcca

SEQ ID NO: 4004250 - RNA, 16 nt, Human herpesvirus 8 [Kaposi`s sarcoma-associated h
gacuacgcucaccauc

SEQ ID NO: 4004251 - RNA, 17 nt, Human herpesvirus 8 [Kaposi`s sarcoma-associated h
gacugccacggccgccu

SEQ ID NO: 4004252 - RNA, 14 nt, Human herpesvirus 8 [Kaposi`s sarcoma-associated h
gagaccucuguggc

SEQ ID NO: 4004253 - RNA, 17 nt, Human herpesvirus 8 [Kaposi`s sarcoma-associated h
gagacgcgcaaaggggg

SEQ ID NO: 4004254 - RNA, 13 nt, Human herpesvirus 8 [Kaposi`s sarcoma-associated h
gagauagccacau

SEQ ID NO: 4004255 - RNA, 15 nt, Human herpesvirus 8 [Kaposi`s sarcoma-associated h
gagauggagaccccg

SEQ ID NO: 4004256 - RNA, 19 nt, Human herpesvirus 8 [Kaposi`s sarcoma-associated h
gagcaagacgccagacagc

SEQ ID NO: 4004257 - RNA, 13 nt, Human herpesvirus 8 [Kaposi`s sarcoma-associated h
gagccggcccuga

SEQ ID NO: 4004258 - RNA, 23 nt, Human herpesvirus 8 [Kaposi`s sarcoma-associated h
gagcguuucgugaaacgugccug

SEQ ID NO: 4004259 - RNA, 14 nt, Human herpesvirus 8 [Kaposi`s sarcoma-associated h
gagcucugcugccu

SEQ ID NO: 4004260 - RNA, 19 nt, Human herpesvirus 8 [Kaposi`s sarcoma-associated h
gagcugucccaccagagcg

SEQ ID NO: 4004261 - RNA, 20 nt, Human herpesvirus 8 [Kaposi`s sarcoma-associated h
gagggcauacccguggcuca

SEQ ID NO: 4004262 - RNA, 16 nt, Human herpesvirus 8 [Kaposi`s sarcoma-associated h
gaggggguggugcgag

SEQ ID NO: 4004263 - RNA, 18 nt, Human herpesvirus 8 [Kaposi`s sarcoma-associated h
gaggguggacagugccug

SEQ ID NO: 4004264 - RNA, 13 nt, Human herpesvirus 8 [Kaposi`s sarcoma-associated h
gagguuugaggcg

SEQ ID NO: 4004265 - RNA, 16 nt, Human herpesvirus 8 [Kaposi`s sarcoma-associated h
gaguauaucaggggaa

SEQ ID NO: 4004266 - RNA, 12 nt, Human herpesvirus 8 [Kaposi`s sarcoma-associated h
gagucaggcgug

SEQ ID NO: 4004267 - RNA, 19 nt, Human herpesvirus 8 [Kaposi`s sarcoma-associated h
gagucgccgguagcugccu

SEQ ID NO: 4004268 - RNA, 17 nt, Human herpesvirus 8 [Kaposi`s sarcoma-associated h
gagucuuucuagcagag

SEQ ID NO: 4004269 - RNA, 23 nt, Human herpesvirus 8 [Kaposi`s sarcoma-associated h
gagugucuucccguacuggggga

SEQ ID NO: 4004270 - RNA, 15 nt, Human herpesvirus 8 [Kaposi`s sarcoma-associated h
gauacacuacuuaug

SEQ ID NO: 4004271 - RNA, 16 nt, Human herpesvirus 8 [Kaposi`s sarcoma-associated h
gaucacggagccggcc

SEQ ID NO: 4004272 - RNA, 17 nt, Human herpesvirus 8 [Kaposi`s sarcoma-associated h
gauccaggagcgacugg

SEQ ID NO: 4004273 - RNA, 15 nt, Human herpesvirus 8 [Kaposi`s sarcoma-associated h
gauccgcaaugucag

SEQ ID NO: 4004274 - RNA, 20 nt, Human herpesvirus 8 [Kaposi`s sarcoma-associated h
gauuagccugcagugugggg

SEQ ID NO: 4004275 - RNA, 17 nt, Human herpesvirus 8 [Kaposi`s sarcoma-associated h
gauuccuccgcacagac

SEQ ID NO: 4004276 - RNA, 20 nt, Human herpesvirus 8 [Kaposi`s sarcoma-associated h
gauuuacgguggugugccug

SEQ ID NO: 4004277 - RNA, 17 nt, Human herpesvirus 8 [Kaposi`s sarcoma-associated h
gauuugauacagggaca

SEQ ID NO: 4004278 - RNA, 20 nt, Human herpesvirus 8 [Kaposi`s sarcoma-associated h
gauuuugauaugugugccca

SEQ ID NO: 4004279 - RNA, 20 nt, Human herpesvirus 8 [Kaposi`s sarcoma-associated h
gcaaaauacauuuuaugagg

SEQ ID NO: 4004280 - RNA, 17 nt, Human herpesvirus 8 [Kaposi`s sarcoma-associated h
gcaaccugcugcagcug

SEQ ID NO: 4004281 - RNA, 15 nt, Human herpesvirus 8 [Kaposi`s sarcoma-associated h
gcaacugaccauguu

SEQ ID NO: 4004282 - RNA, 21 nt, Human herpesvirus 8 [Kaposi`s sarcoma-associated h
gcaagccgggugaggccaaug

SEQ ID NO: 4004283 - RNA, 19 nt, Human herpesvirus 8 [Kaposi`s sarcoma-associated h
gcaccacggauggaauccg

SEQ ID NO: 4004284 - RNA, 14 nt, Human herpesvirus 8 [Kaposi`s sarcoma-associated h
gcaccgcaagcagc

SEQ ID NO: 4004285 - RNA, 23 nt, Human herpesvirus 8 [Kaposi`s sarcoma-associated h
gcacgugaaaucucgccuguccu

SEQ ID NO: 4004286 - RNA, 16 nt, Human herpesvirus 8 [Kaposi`s sarcoma-associated h
gcacuccuguuagcac

SEQ ID NO: 4004287 - RNA, 23 nt, Human herpesvirus 8 [Kaposi`s sarcoma-associated h
gcagaagaccgcguccuccaccc

SEQ ID NO: 4004288 - RNA, 18 nt, Human herpesvirus 8 [Kaposi`s sarcoma-associated h
gcagacgugcccagacac

SEQ ID NO: 4004289 - RNA, 13 nt, Human herpesvirus 8 [Kaposi`s sarcoma-associated h
gcaguggacacag

SEQ ID NO: 4004290 - RNA, 18 nt, Human herpesvirus 8 [Kaposi`s sarcoma-associated h
gcauccuaucgcacagac

SEQ ID NO: 4004291 - RNA, 18 nt, Human herpesvirus 8 [Kaposi`s sarcoma-associated h
gcaugugucugugcccug

SEQ ID NO: 4004292 - RNA, 13 nt, Human herpesvirus 8 [Kaposi`s sarcoma-associated h
gcauuaaagcacu

SEQ ID NO: 4004293 - RNA, 15 nt, Human herpesvirus 8 [Kaposi`s sarcoma-associated h
gccaagcuacuggcc

SEQ ID NO: 4004294 - RNA, 19 nt, Human herpesvirus 8 [Kaposi`s sarcoma-associated h
gccaauaaugcaaugcuuc

SEQ ID NO: 4004295 - RNA, 17 nt, Human herpesvirus 8 [Kaposi`s sarcoma-associated h
gccacgguggcccugcc

SEQ ID NO: 4004296 - RNA, 20 nt, Human herpesvirus 8 [Kaposi`s sarcoma-associated h
gccaggacccguaccacaag

SEQ ID NO: 4004297 - RNA, 17 nt, Human herpesvirus 8 [Kaposi`s sarcoma-associated h
gccaggcaccuguugga

SEQ ID NO: 4004298 - RNA, 15 nt, Human herpesvirus 8 [Kaposi`s sarcoma-associated h
gccaugaaagguggu

SEQ ID NO: 4004299 - RNA, 19 nt, Human herpesvirus 8 [Kaposi`s sarcoma-associated h
gccauggcagcccagccuc

SEQ ID NO: 4004300 - RNA, 13 nt, Human herpesvirus 8 [Kaposi`s sarcoma-associated h
gccauucgcacca

SEQ ID NO: 4004301 - RNA, 17 nt, Human herpesvirus 8 [Kaposi`s sarcoma-associated h
gcccgggggccaggacu

SEQ ID NO: 4004302 - RNA, 14 nt, Human herpesvirus 8 [Kaposi`s sarcoma-associated h
gcccuccugggcca

SEQ ID NO: 4004303 - RNA, 17 nt, Human herpesvirus 8 [Kaposi`s sarcoma-associated h
gcccuccugggccaggc

SEQ ID NO: 4004304 - RNA, 24 nt, Human herpesvirus 8 [Kaposi`s sarcoma-associated h
gccucacggacaacgccaugcagc

SEQ ID NO: 4004305 - RNA, 22 nt, Human herpesvirus 8 [Kaposi`s sarcoma-associated h
gccucccguucccaugaugcag

SEQ ID NO: 4004306 - RNA, 17 nt, Human herpesvirus 8 [Kaposi`s sarcoma-associated h
gccucgagggcggccag

SEQ ID NO: 4004307 - RNA, 13 nt, Human herpesvirus 8 [Kaposi`s sarcoma-associated h
gccucugaagcac

SEQ ID NO: 4004308 - RNA, 18 nt, Human herpesvirus 8 [Kaposi`s sarcoma-associated h
gccucugaagcaccacau

SEQ ID NO: 4004309 - RNA, 18 nt, Human herpesvirus 8 [Kaposi`s sarcoma-associated h
gccugcguuaacuuccca

SEQ ID NO: 4004310 - RNA, 15 nt, Human herpesvirus 8 [Kaposi`s sarcoma-associated h
gccuugggugcgaug

SEQ ID NO: 4004311 - RNA, 19 nt, Human herpesvirus 8 [Kaposi`s sarcoma-associated h
gcgacggaaguuggccucc

SEQ ID NO: 4004312 - RNA, 13 nt, Human herpesvirus 8 [Kaposi`s sarcoma-associated h
gcgacugcuggcu

SEQ ID NO: 4004313 - RNA, 22 nt, Human herpesvirus 8 [Kaposi`s sarcoma-associated h
gcgagaauggcgugccagugga

SEQ ID NO: 4004314 - RNA, 13 nt, Human herpesvirus 8 [Kaposi`s sarcoma-associated h
gcgcacccagcgu

SEQ ID NO: 4004315 - RNA, 20 nt, Human herpesvirus 8 [Kaposi`s sarcoma-associated h
gcgccucgcagacgaccccc

SEQ ID NO: 4004316 - RNA, 21 nt, Human herpesvirus 8 [Kaposi`s sarcoma-associated h
gcgcuguacagugccugcagu

SEQ ID NO: 4004317 - RNA, 19 nt, Human herpesvirus 8 [Kaposi`s sarcoma-associated h
gcggaagauugguguccag

SEQ ID NO: 4004318 - RNA, 14 nt, Human herpesvirus 8 [Kaposi`s sarcoma-associated h
uggacguggccagc

SEQ ID NO: 4004319 - RNA, 23 nt, Human herpesvirus 8 [Kaposi`s sarcoma-associated h
uggcacacgguuacuagcaccac

SEQ ID NO: 4004320 - RNA, 15 nt, Human herpesvirus 8 [Kaposi`s sarcoma-associated h
uggcagcccagccuc

SEQ ID NO: 4004321 - RNA, 19 nt, Human herpesvirus 8 [Kaposi`s sarcoma-associated h
uggcagcuuggugaagcag

SEQ ID NO: 4004322 - RNA, 20 nt, Human herpesvirus 8 [Kaposi`s sarcoma-associated h
uggcauuauaaacccauccc

SEQ ID NO: 4004323 - RNA, 18 nt, Human herpesvirus 8 [Kaposi`s sarcoma-associated h
uggccaaacucacugagu

SEQ ID NO: 4004324 - RNA, 19 nt, Human herpesvirus 8 [Kaposi`s sarcoma-associated h
uggccauucgcaccaggac

SEQ ID NO: 4004325 - RNA, 13 nt, Human herpesvirus 8 [Kaposi`s sarcoma-associated h
uggccgcauuugg

SEQ ID NO: 4004326 - RNA, 22 nt, Human herpesvirus 8 [Kaposi`s sarcoma-associated h
uggcgcggaaacugggcacgga

SEQ ID NO: 4004327 - RNA, 18 nt, Human herpesvirus 8 [Kaposi`s sarcoma-associated h
uggcucacggacuuuauu

SEQ ID NO: 4004328 - RNA, 14 nt, Human herpesvirus 8 [Kaposi`s sarcoma-associated h
uggcuguuacaaua

SEQ ID NO: 4004329 - RNA, 15 nt, Human herpesvirus 8 [Kaposi`s sarcoma-associated h
ugggaucgaacagaa

SEQ ID NO: 4004330 - RNA, 16 nt, Human herpesvirus 8 [Kaposi`s sarcoma-associated h
uggggggaggaggaaa

SEQ ID NO: 4004331 - RNA, 19 nt, Human herpesvirus 8 [Kaposi`s sarcoma-associated h
uggguuguggugacgcugu

SEQ ID NO: 4004332 - RNA, 18 nt, Human herpesvirus 8 [Kaposi`s sarcoma-associated h
uguacauggagggaaugg

SEQ ID NO: 4004333 - RNA, 19 nt, Human herpesvirus 8 [Kaposi`s sarcoma-associated h
uguccucgcccaacuuugu

SEQ ID NO: 4004334 - RNA, 17 nt, Human herpesvirus 8 [Kaposi`s sarcoma-associated h
ugucugaaacgggacau

SEQ ID NO: 4004335 - RNA, 14 nt, Human herpesvirus 8 [Kaposi`s sarcoma-associated h
ugugaaguuuacau

SEQ ID NO: 4004336 - RNA, 20 nt, Human herpesvirus 8 [Kaposi`s sarcoma-associated h
ugugacaaucuggaugugua

SEQ ID NO: 4004337 - RNA, 21 nt, Human herpesvirus 8 [Kaposi`s sarcoma-associated h
ugugagggacguuugcagaua

SEQ ID NO: 4004338 - RNA, 23 nt, Human herpesvirus 8 [Kaposi`s sarcoma-associated h
ugugcuguccagcguggggacag

SEQ ID NO: 4004339 - RNA, 21 nt, Human herpesvirus 8 [Kaposi`s sarcoma-associated h
ugugguuaagcuuugcagcca

SEQ ID NO: 4004340 - RNA, 21 nt, Human herpesvirus 8 [Kaposi`s sarcoma-associated h
uguucuuaauugcccaucauu

SEQ ID NO: 4004341 - RNA, 15 nt, Human herpesvirus 8 [Kaposi`s sarcoma-associated h
uguuuauaacaauga

SEQ ID NO: 4004342 - RNA, 11 nt, Human herpesvirus 8 [Kaposi`s sarcoma-associated h
uguuuccugca

SEQ ID NO: 4004343 - RNA, 14 nt, Human herpesvirus 8 [Kaposi`s sarcoma-associated h
uuaaaugaacauug

SEQ ID NO: 4004344 - RNA, 19 nt, Human herpesvirus 8 [Kaposi`s sarcoma-associated h
uuaacaguggaugaccaac

SEQ ID NO: 4004345 - RNA, 13 nt, Human herpesvirus 8 [Kaposi`s sarcoma-associated h
uuacauggaauac

SEQ ID NO: 4004346 - RNA, 22 nt, Human herpesvirus 8 [Kaposi`s sarcoma-associated h
uuaccaguauagugguuuacau

SEQ ID NO: 4004347 - RNA, 22 nt, Human herpesvirus 8 [Kaposi`s sarcoma-associated h
uuaccugcacuccaagccaguc

SEQ ID NO: 4004348 - RNA, 17 nt, Human herpesvirus 8 [Kaposi`s sarcoma-associated h
uuacgguggugugccug

SEQ ID NO: 4004349 - RNA, 21 nt, Human herpesvirus 8 [Kaposi`s sarcoma-associated h
uuacuugcaaaauugugugua

SEQ ID NO: 4004350 - RNA, 12 nt, Human herpesvirus 8 [Kaposi`s sarcoma-associated h
uuaugucaguuc

SEQ ID NO: 4004351 - RNA, 18 nt, Human herpesvirus 8 [Kaposi`s sarcoma-associated h
uucaaaacguauguuuau

SEQ ID NO: 4004352 - RNA, 19 nt, Human herpesvirus 8 [Kaposi`s sarcoma-associated h
uucauaccgggucugugcg

SEQ ID NO: 4004353 - RNA, 14 nt, Human herpesvirus 8 [Kaposi`s sarcoma-associated h
uucauuuguguaua

SEQ ID NO: 4004354 - RNA, 21 nt, Human herpesvirus 8 [Kaposi`s sarcoma-associated h
uucccuccugcauuuggacac

SEQ ID NO: 4004355 - RNA, 16 nt, Human herpesvirus 8 [Kaposi`s sarcoma-associated h
uuccggguauuggaga

SEQ ID NO: 4004356 - RNA, 17 nt, Human herpesvirus 8 [Kaposi`s sarcoma-associated h
uuccuccguugucgacu

SEQ ID NO: 4004357 - RNA, 19 nt, Human herpesvirus 8 [Kaposi`s sarcoma-associated h
uugaggaagaucuaagccu

SEQ ID NO: 4004358 - RNA, 22 nt, Human herpesvirus 8 [Kaposi`s sarcoma-associated h
uugcacucagaacauaaaacga

SEQ ID NO: 4004359 - RNA, 21 nt, Human herpesvirus 8 [Kaposi`s sarcoma-associated h
uuggacuagagcgacugcugg

SEQ ID NO: 4004360 - RNA, 20 nt, Human herpesvirus 8 [Kaposi`s sarcoma-associated h
uuggaugcucugcgugcugg

SEQ ID NO: 4004361 - RNA, 16 nt, Human herpesvirus 8 [Kaposi`s sarcoma-associated h
uugggaauggccgaac

SEQ ID NO: 4004362 - RNA, 19 nt, Human herpesvirus 8 [Kaposi`s sarcoma-associated h
uuggguugggaggugaccc

SEQ ID NO: 4004363 - RNA, 19 nt, Human herpesvirus 8 [Kaposi`s sarcoma-associated h
uuguggcaccugaggugcu

SEQ ID NO: 4004364 - RNA, 21 nt, Human herpesvirus 8 [Kaposi`s sarcoma-associated h
uuucagacguccaguuccccc

SEQ ID NO: 4004365 - RNA, 20 nt, Human herpesvirus 8 [Kaposi`s sarcoma-associated h
uuugaaggcgaauaaaacag

SEQ ID NO: 4004366 - RNA, 16 nt, Human herpesvirus 8 [Kaposi`s sarcoma-associated h
uuugggcaaaacacau

SEQ ID NO: 4004367 - RNA, 19 nt, Human herpesvirus 8 [Kaposi`s sarcoma-associated h
ccacaugauuugauacagg

SEQ ID NO: 4004368 - RNA, 18 nt, Human herpesvirus 8 [Kaposi`s sarcoma-associated h
ccacccuaauacauaaca

SEQ ID NO: 4004369 - RNA, 21 nt, Human herpesvirus 8 [Kaposi`s sarcoma-associated h
ccacccuauuggucacaucuc

SEQ ID NO: 4004370 - RNA, 21 nt, Human herpesvirus 8 [Kaposi`s sarcoma-associated h
ccaccggcaggcagccaagaa

SEQ ID NO: 4004371 - RNA, 21 nt, Human herpesvirus 8 [Kaposi`s sarcoma-associated h
ccaccuacacccgguucagcc

SEQ ID NO: 4004372 - RNA, 19 nt, Human herpesvirus 8 [Kaposi`s sarcoma-associated h
ccacgcccgggggccagga

SEQ ID NO: 4004373 - RNA, 20 nt, Human herpesvirus 8 [Kaposi`s sarcoma-associated h
ccacgcccgggggccaggac

SEQ ID NO: 4004374 - RNA, 23 nt, Human herpesvirus 8 [Kaposi`s sarcoma-associated h
ccacggugucguguaugccaaua

SEQ ID NO: 4004375 - RNA, 18 nt, Human herpesvirus 8 [Kaposi`s sarcoma-associated h
ccacuuugcccuaaaugu

SEQ ID NO: 4004376 - RNA, 14 nt, Human herpesvirus 8 [Kaposi`s sarcoma-associated h
ccagaagagcauuu

SEQ ID NO: 4004377 - RNA, 15 nt, Human herpesvirus 8 [Kaposi`s sarcoma-associated h
ccagacugguccaag

SEQ ID NO: 4004378 - RNA, 16 nt, Human herpesvirus 8 [Kaposi`s sarcoma-associated h
ccagaucacccagugu

SEQ ID NO: 4004379 - RNA, 16 nt, Human herpesvirus 8 [Kaposi`s sarcoma-associated h
ccagcaauaaacccac

SEQ ID NO: 4004380 - RNA, 23 nt, Human herpesvirus 8 [Kaposi`s sarcoma-associated h
ccagcaauaaacccacagcccau

SEQ ID NO: 4004381 - RNA, 13 nt, Human herpesvirus 8 [Kaposi`s sarcoma-associated h
ccagcaugccugc

SEQ ID NO: 4004382 - RNA, 15 nt, Human herpesvirus 8 [Kaposi`s sarcoma-associated h
ccagcgucggccaga

SEQ ID NO: 4004383 - RNA, 17 nt, Human herpesvirus 8 [Kaposi`s sarcoma-associated h
ccaggaugcggguuggg

SEQ ID NO: 4004384 - RNA, 14 nt, Human herpesvirus 8 [Kaposi`s sarcoma-associated h
ccagugccucagca

SEQ ID NO: 4004385 - RNA, 16 nt, Human herpesvirus 8 [Kaposi`s sarcoma-associated h
ccaguucccccacacc

SEQ ID NO: 4004386 - RNA, 22 nt, Human herpesvirus 8 [Kaposi`s sarcoma-associated h
ccaugguuauuggccaggacaa

SEQ ID NO: 4004387 - RNA, 15 nt, Human herpesvirus 8 [Kaposi`s sarcoma-associated h
ccauguucagguggu

SEQ ID NO: 4004388 - RNA, 21 nt, Human herpesvirus 8 [Kaposi`s sarcoma-associated h
cccacacauuugucuuuauug

SEQ ID NO: 4004389 - RNA, 16 nt, Human herpesvirus 8 [Kaposi`s sarcoma-associated h
cccaggccgccgacca

SEQ ID NO: 4004390 - RNA, 15 nt, Human herpesvirus 8 [Kaposi`s sarcoma-associated h
cccagugccucagca

SEQ ID NO: 4004391 - RNA, 23 nt, Human herpesvirus 8 [Kaposi`s sarcoma-associated h
cccaguuaaccggcuuguacagu

SEQ ID NO: 4004392 - RNA, 13 nt, Human herpesvirus 8 [Kaposi`s sarcoma-associated h
ccccuucuucugg

SEQ ID NO: 4004393 - RNA, 18 nt, Human herpesvirus 8 [Kaposi`s sarcoma-associated h
cccgacaaccggcugggg

SEQ ID NO: 4004394 - RNA, 14 nt, Human herpesvirus 8 [Kaposi`s sarcoma-associated h
cccgcccggggcgc

SEQ ID NO: 4004395 - RNA, 16 nt, Human herpesvirus 8 [Kaposi`s sarcoma-associated h
cccgugcccaggccgc

SEQ ID NO: 4004396 - RNA, 21 nt, Human herpesvirus 8 [Kaposi`s sarcoma-associated h
cccuggauggguuaacagugg

SEQ ID NO: 4004397 - RNA, 10 nt, Human herpesvirus 8 [Kaposi`s sarcoma-associated h
ccgcaucucu

SEQ ID NO: 4004398 - RNA, 16 nt, Human herpesvirus 8 [Kaposi`s sarcoma-associated h
ccgcccccuggugcuc

SEQ ID NO: 4004399 - RNA, 20 nt, Human herpesvirus 8 [Kaposi`s sarcoma-associated h
ccggaugcgggcgauuacag

SEQ ID NO: 4004400 - RNA, 17 nt, Human herpesvirus 8 [Kaposi`s sarcoma-associated h
ccgggccuucgcacccc

SEQ ID NO: 4004401 - RNA, 16 nt, Human herpesvirus 8 [Kaposi`s sarcoma-associated h
ccgguagcugccuggu

SEQ ID NO: 4004402 - RNA, 12 nt, Human herpesvirus 8 [Kaposi`s sarcoma-associated h
ccgucgcacccg

SEQ ID NO: 4004403 - RNA, 16 nt, Human herpesvirus 8 [Kaposi`s sarcoma-associated h
ccgucuccgccaggga

SEQ ID NO: 4004404 - RNA, 22 nt, Human herpesvirus 8 [Kaposi`s sarcoma-associated h
ccgucugugaagucucccugcg

SEQ ID NO: 4004405 - RNA, 21 nt, Human herpesvirus 8 [Kaposi`s sarcoma-associated h
ccucagugugcuguccagcgu

SEQ ID NO: 4004406 - RNA, 16 nt, Human herpesvirus 8 [Kaposi`s sarcoma-associated h
ccuccacccaccaagc

SEQ ID NO: 4004407 - RNA, 15 nt, Human herpesvirus 8 [Kaposi`s sarcoma-associated h
ccuccagcaaagcac

SEQ ID NO: 4004408 - RNA, 17 nt, Human herpesvirus 8 [Kaposi`s sarcoma-associated h
ccugccaaaugcccaga

SEQ ID NO: 4004409 - RNA, 23 nt, Human herpesvirus 8 [Kaposi`s sarcoma-associated h
ccugccaaaugcccagaaugaag

SEQ ID NO: 4004410 - RNA, 12 nt, Human herpesvirus 8 [Kaposi`s sarcoma-associated h
ccugcugucuau

SEQ ID NO: 4004411 - RNA, 22 nt, Human herpesvirus 8 [Kaposi`s sarcoma-associated h
ccuggauggguuaacaguggau

SEQ ID NO: 4004412 - RNA, 13 nt, Human herpesvirus 8 [Kaposi`s sarcoma-associated h
ccuuccucagcga

SEQ ID NO: 4004413 - RNA, 15 nt, Human herpesvirus 8 [Kaposi`s sarcoma-associated h
cgaacaucgccgugg

SEQ ID NO: 4004414 - RNA, 16 nt, Human herpesvirus 8 [Kaposi`s sarcoma-associated h
cgacagagccagccug

SEQ ID NO: 4004415 - RNA, 20 nt, Human herpesvirus 8 [Kaposi`s sarcoma-associated h
cgagaaagucgcccacggaa

SEQ ID NO: 4004416 - RNA, 22 nt, Human herpesvirus 8 [Kaposi`s sarcoma-associated h
cgauagggggaugagccagaau

SEQ ID NO: 4004417 - RNA, 11 nt, Human herpesvirus 8 [Kaposi`s sarcoma-associated h
cgauguccuga

SEQ ID NO: 4004418 - RNA, 19 nt, Human herpesvirus 8 [Kaposi`s sarcoma-associated h
cgauuucacugucacuuuc

SEQ ID NO: 4004419 - RNA, 13 nt, Human herpesvirus 8 [Kaposi`s sarcoma-associated h
cgcaagcacuuuu

SEQ ID NO: 4004420 - RNA, 19 nt, Human herpesvirus 8 [Kaposi`s sarcoma-associated h
cgcacccggccgcugcguc

SEQ ID NO: 4004421 - RNA, 14 nt, Human herpesvirus 8 [Kaposi`s sarcoma-associated h
cgcagaacaguacc

SEQ ID NO: 4004422 - RNA, 19 nt, Human herpesvirus 8 [Kaposi`s sarcoma-associated h
cgcaggagucagagcagug

SEQ ID NO: 4004423 - RNA, 20 nt, Human herpesvirus 8 [Kaposi`s sarcoma-associated h
cgccaacuguccccucggag

SEQ ID NO: 4004424 - RNA, 15 nt, Human herpesvirus 8 [Kaposi`s sarcoma-associated h
gauagacauggacau

SEQ ID NO: 4004425 - RNA, 19 nt, Human herpesvirus 8 [Kaposi`s sarcoma-associated h
gaucacgcccgugugcaug

SEQ ID NO: 4004426 - RNA, 13 nt, Human herpesvirus 8 [Kaposi`s sarcoma-associated h
gaucacggagccg

SEQ ID NO: 4004427 - RNA, 19 nt, Human herpesvirus 8 [Kaposi`s sarcoma-associated h
gauccaacccagcaugccu

SEQ ID NO: 4004428 - RNA, 14 nt, Human herpesvirus 8 [Kaposi`s sarcoma-associated h
gauccggagggaag

SEQ ID NO: 4004429 - RNA, 22 nt, Human herpesvirus 8 [Kaposi`s sarcoma-associated h
gaucuauuauuugucgcgccag

SEQ ID NO: 4004430 - RNA, 17 nt, Human herpesvirus 8 [Kaposi`s sarcoma-associated h
gaucucuggagacggcc

SEQ ID NO: 4004431 - RNA, 21 nt, Human herpesvirus 8 [Kaposi`s sarcoma-associated h
gaugccaguagcaugcugaug

SEQ ID NO: 4004432 - RNA, 16 nt, Human herpesvirus 8 [Kaposi`s sarcoma-associated h
gaugccgcgcuugggu

SEQ ID NO: 4004433 - RNA, 23 nt, Human herpesvirus 8 [Kaposi`s sarcoma-associated h
gauggguuaacaguggaugacca

SEQ ID NO: 4004434 - RNA, 10 nt, Human herpesvirus 8 [Kaposi`s sarcoma-associated h
gauuaagcaa

SEQ ID NO: 4004435 - RNA, 22 nt, Human herpesvirus 8 [Kaposi`s sarcoma-associated h
gauuuccuuucugagccucuca

SEQ ID NO: 4004436 - RNA, 14 nt, Human herpesvirus 8 [Kaposi`s sarcoma-associated h
gauuuuccagggac

SEQ ID NO: 4004437 - RNA, 16 nt, Human herpesvirus 8 [Kaposi`s sarcoma-associated h
gauuuuccagggacau

SEQ ID NO: 4004438 - RNA, 16 nt, Human herpesvirus 8 [Kaposi`s sarcoma-associated h
gcaaacuauacacaaa

SEQ ID NO: 4004439 - RNA, 19 nt, Human herpesvirus 8 [Kaposi`s sarcoma-associated h
gcaaggagcagccugcagg

SEQ ID NO: 4004440 - RNA, 22 nt, Human herpesvirus 8 [Kaposi`s sarcoma-associated h
gcacaagcgcugacgaaagcua

SEQ ID NO: 4004441 - RNA, 22 nt, Human herpesvirus 8 [Kaposi`s sarcoma-associated h
gcaccaagguaggccagcugcg

SEQ ID NO: 4004442 - RNA, 13 nt, Human herpesvirus 8 [Kaposi`s sarcoma-associated h
gcaccgcaagcag

SEQ ID NO: 4004443 - RNA, 13 nt, Human herpesvirus 8 [Kaposi`s sarcoma-associated h
gcaccuggacccc

SEQ ID NO: 4004444 - RNA, 16 nt, Human herpesvirus 8 [Kaposi`s sarcoma-associated h
gcaggagucagagcag

SEQ ID NO: 4004445 - RNA, 21 nt, Human herpesvirus 8 [Kaposi`s sarcoma-associated h
gcagggugcggugcugcccag

SEQ ID NO: 4004446 - RNA, 21 nt, Human herpesvirus 8 [Kaposi`s sarcoma-associated h
gcaguguuugcugcuguaguu

SEQ ID NO: 4004447 - RNA, 16 nt, Human herpesvirus 8 [Kaposi`s sarcoma-associated h
gcauaccacgugugug

SEQ ID NO: 4004448 - RNA, 20 nt, Human herpesvirus 8 [Kaposi`s sarcoma-associated h
gccaccagguggcacccaac

SEQ ID NO: 4004449 - RNA, 23 nt, Human herpesvirus 8 [Kaposi`s sarcoma-associated h
gccaggaacacgcgaaugcagca

SEQ ID NO: 4004450 - RNA, 16 nt, Human herpesvirus 8 [Kaposi`s sarcoma-associated h
gccaggaaguucaaug

SEQ ID NO: 4004451 - RNA, 18 nt, Human herpesvirus 8 [Kaposi`s sarcoma-associated h
gccauucgcaccaggacg

SEQ ID NO: 4004452 - RNA, 21 nt, Human herpesvirus 8 [Kaposi`s sarcoma-associated h
gcccaacucugcaagcuguug

SEQ ID NO: 4004453 - RNA, 14 nt, Human herpesvirus 8 [Kaposi`s sarcoma-associated h
gcccaggggcagac

SEQ ID NO: 4004454 - RNA, 18 nt, Human herpesvirus 8 [Kaposi`s sarcoma-associated h
gcccuccugggccaggca

SEQ ID NO: 4004455 - RNA, 18 nt, Human herpesvirus 8 [Kaposi`s sarcoma-associated h
gcccucuucuguugccag

SEQ ID NO: 4004456 - RNA, 19 nt, Human herpesvirus 8 [Kaposi`s sarcoma-associated h
gccgagccacaaaguacau

SEQ ID NO: 4004457 - RNA, 20 nt, Human herpesvirus 8 [Kaposi`s sarcoma-associated h
gccgcaaucaugccugugga

SEQ ID NO: 4004458 - RNA, 15 nt, Human herpesvirus 8 [Kaposi`s sarcoma-associated h
gccgguugguggugu

SEQ ID NO: 4004459 - RNA, 18 nt, Human herpesvirus 8 [Kaposi`s sarcoma-associated h
gccgucagggcccacggu

SEQ ID NO: 4004460 - RNA, 15 nt, Human herpesvirus 8 [Kaposi`s sarcoma-associated h
gccguucccaugagc

SEQ ID NO: 4004461 - RNA, 21 nt, Human herpesvirus 8 [Kaposi`s sarcoma-associated h
gccuaucaaucugagaaaagu

SEQ ID NO: 4004462 - RNA, 18 nt, Human herpesvirus 8 [Kaposi`s sarcoma-associated h
gccucccaacauguaaau

SEQ ID NO: 4004463 - RNA, 19 nt, Human herpesvirus 8 [Kaposi`s sarcoma-associated h
gccucugaagcaccacaua

SEQ ID NO: 4004464 - RNA, 20 nt, Human herpesvirus 8 [Kaposi`s sarcoma-associated h
gccugcguuaacuucccagg

SEQ ID NO: 4004465 - RNA, 13 nt, Human herpesvirus 8 [Kaposi`s sarcoma-associated h
gccugguggagca

SEQ ID NO: 4004466 - RNA, 22 nt, Human herpesvirus 8 [Kaposi`s sarcoma-associated h
gccuucgcaaguuuaucucaga

SEQ ID NO: 4004467 - RNA, 22 nt, Human herpesvirus 8 [Kaposi`s sarcoma-associated h
gcgaauucgcgugguccuggau

SEQ ID NO: 4004468 - RNA, 14 nt, Human herpesvirus 8 [Kaposi`s sarcoma-associated h
gcgacaugcugaug

SEQ ID NO: 4004469 - RNA, 19 nt, Human herpesvirus 8 [Kaposi`s sarcoma-associated h
gcgcaggagucagagcagu

SEQ ID NO: 4004470 - RNA, 23 nt, Human herpesvirus 8 [Kaposi`s sarcoma-associated h
gcgccacucccaccauguugaag

SEQ ID NO: 4004471 - RNA, 21 nt, Human herpesvirus 8 [Kaposi`s sarcoma-associated h
gcgccauuuuuguggcugccu

SEQ ID NO: 4004472 - RNA, 18 nt, Human herpesvirus 8 [Kaposi`s sarcoma-associated h
gcgcuguaugacugcccu

SEQ ID NO: 4004473 - RNA, 11 nt, Human herpesvirus 8 [Kaposi`s sarcoma-associated h
gcgcugugcuu

SEQ ID NO: 4004474 - RNA, 20 nt, Human herpesvirus 8 [Kaposi`s sarcoma-associated h
gcggaggcccgagaaacacu

SEQ ID NO: 4004475 - RNA, 16 nt, Human herpesvirus 8 [Kaposi`s sarcoma-associated h
gcggagggcuguucuc

SEQ ID NO: 4004476 - RNA, 18 nt, Human herpesvirus 8 [Kaposi`s sarcoma-associated h
gcggcuaagaauccccuu

SEQ ID NO: 4004477 - RNA, 14 nt, Human herpesvirus 8 [Kaposi`s sarcoma-associated h
cgucuaccugccgg

SEQ ID NO: 4004478 - RNA, 18 nt, Human herpesvirus 8 [Kaposi`s sarcoma-associated h
cgugaaugggggcagugc

SEQ ID NO: 4004479 - RNA, 21 nt, Human herpesvirus 8 [Kaposi`s sarcoma-associated h
cgugccuucgaggccaggccc

SEQ ID NO: 4004480 - RNA, 13 nt, Human herpesvirus 8 [Kaposi`s sarcoma-associated h
cuacccugccacu

SEQ ID NO: 4004481 - RNA, 14 nt, Human herpesvirus 8 [Kaposi`s sarcoma-associated h
cuacccugccacuc

SEQ ID NO: 4004482 - RNA, 12 nt, Human herpesvirus 8 [Kaposi`s sarcoma-associated h
cuaccugcaaac

SEQ ID NO: 4004483 - RNA, 18 nt, Human herpesvirus 8 [Kaposi`s sarcoma-associated h
cuagaauuggagcacuuu

SEQ ID NO: 4004484 - RNA, 16 nt, Human herpesvirus 8 [Kaposi`s sarcoma-associated h
cuagacacgcaaagua

SEQ ID NO: 4004485 - RNA, 16 nt, Human herpesvirus 8 [Kaposi`s sarcoma-associated h
cuagacuggcucugau

SEQ ID NO: 4004486 - RNA, 19 nt, Human herpesvirus 8 [Kaposi`s sarcoma-associated h
cuaggaggaagagcacugu

SEQ ID NO: 4004487 - RNA, 18 nt, Human herpesvirus 8 [Kaposi`s sarcoma-associated h
cuaucagcugcagccagg

SEQ ID NO: 4004488 - RNA, 17 nt, Human herpesvirus 8 [Kaposi`s sarcoma-associated h
cuaugacuaggaggaag

SEQ ID NO: 4004489 - RNA, 14 nt, Human herpesvirus 8 [Kaposi`s sarcoma-associated h
cuaugaucagggca

SEQ ID NO: 4004490 - RNA, 17 nt, Human herpesvirus 8 [Kaposi`s sarcoma-associated h
cuauugcaacugaccau

SEQ ID NO: 4004491 - RNA, 19 nt, Human herpesvirus 8 [Kaposi`s sarcoma-associated h
cucaucauuucugaaacag

SEQ ID NO: 4004492 - RNA, 13 nt, Human herpesvirus 8 [Kaposi`s sarcoma-associated h
cucggagacaaga

SEQ ID NO: 4004493 - RNA, 14 nt, Human herpesvirus 8 [Kaposi`s sarcoma-associated h
cucguguguuuucg

SEQ ID NO: 4004494 - RNA, 13 nt, Human herpesvirus 8 [Kaposi`s sarcoma-associated h
cucucacacccug

SEQ ID NO: 4004495 - RNA, 22 nt, Human herpesvirus 8 [Kaposi`s sarcoma-associated h
cucugcggcuuuguuaccuggc

SEQ ID NO: 4004496 - RNA, 24 nt, Human herpesvirus 8 [Kaposi`s sarcoma-associated h
cugaagucccgaugccacuguugu

SEQ ID NO: 4004497 - RNA, 17 nt, Human herpesvirus 8 [Kaposi`s sarcoma-associated h
cugacgacggucgccuc

SEQ ID NO: 4004498 - RNA, 22 nt, Human herpesvirus 8 [Kaposi`s sarcoma-associated h
cugaugaaaucgagugggcgga

SEQ ID NO: 4004499 - RNA, 15 nt, Human herpesvirus 8 [Kaposi`s sarcoma-associated h
cugauuagcacugua

SEQ ID NO: 4004500 - RNA, 12 nt, Human herpesvirus 8 [Kaposi`s sarcoma-associated h
cugcaauguacu

SEQ ID NO: 4004501 - RNA, 21 nt, Human herpesvirus 8 [Kaposi`s sarcoma-associated h
cugccuagaacuaaccacuca

SEQ ID NO: 4004502 - RNA, 19 nt, Human herpesvirus 8 [Kaposi`s sarcoma-associated h
cugccuggacaguauucuc

SEQ ID NO: 4004503 - RNA, 19 nt, Human herpesvirus 8 [Kaposi`s sarcoma-associated h
cugccugucagauuuacaa

SEQ ID NO: 4004504 - RNA, 17 nt, Human herpesvirus 8 [Kaposi`s sarcoma-associated h
cugcgcauuuccugccc

SEQ ID NO: 4004505 - RNA, 21 nt, Human herpesvirus 8 [Kaposi`s sarcoma-associated h
cugcggcgcaaaaacagcugg

SEQ ID NO: 4004506 - RNA, 13 nt, Human herpesvirus 8 [Kaposi`s sarcoma-associated h
cuggcaugcuggg

SEQ ID NO: 4004507 - RNA, 23 nt, Human herpesvirus 8 [Kaposi`s sarcoma-associated h
cugggacuugauaaucuccugga

SEQ ID NO: 4004508 - RNA, 15 nt, Human herpesvirus 8 [Kaposi`s sarcoma-associated h
cuggucgguucacug

SEQ ID NO: 4004509 - RNA, 17 nt, Human herpesvirus 8 [Kaposi`s sarcoma-associated h
cuggucgguucacugcu

SEQ ID NO: 4004510 - RNA, 18 nt, Human herpesvirus 8 [Kaposi`s sarcoma-associated h
cugguucaggauuucgaa

SEQ ID NO: 4004511 - RNA, 16 nt, Human herpesvirus 8 [Kaposi`s sarcoma-associated h
cuguuacaauaaagcu

SEQ ID NO: 4004512 - RNA, 16 nt, Human herpesvirus 8 [Kaposi`s sarcoma-associated h
cuguucucgccuggag

SEQ ID NO: 4004513 - RNA, 18 nt, Human herpesvirus 8 [Kaposi`s sarcoma-associated h
cuuaacgugucugaaugu

SEQ ID NO: 4004514 - RNA, 20 nt, Human herpesvirus 8 [Kaposi`s sarcoma-associated h
cuuaacuguuuacugcuguu

SEQ ID NO: 4004515 - RNA, 20 nt, Human herpesvirus 8 [Kaposi`s sarcoma-associated h
cuuacugucagauuucucua

SEQ ID NO: 4004516 - RNA, 20 nt, Human herpesvirus 8 [Kaposi`s sarcoma-associated h
cuuauugaagcauguugcgc

SEQ ID NO: 4004517 - RNA, 17 nt, Human herpesvirus 8 [Kaposi`s sarcoma-associated h
cuuccauuuuccaaggc

SEQ ID NO: 4004518 - RNA, 16 nt, Human herpesvirus 8 [Kaposi`s sarcoma-associated h
cuucuauaagcaccuu

SEQ ID NO: 4004519 - RNA, 18 nt, Human herpesvirus 8 [Kaposi`s sarcoma-associated h
cuucuugaccaaaaguug

SEQ ID NO: 4004520 - RNA, 15 nt, Human herpesvirus 8 [Kaposi`s sarcoma-associated h
cuugaggauggugcu

SEQ ID NO: 4004521 - RNA, 22 nt, Human herpesvirus 8 [Kaposi`s sarcoma-associated h
cuuggguuggcgagaagcccag

SEQ ID NO: 4004522 - RNA, 17 nt, Human herpesvirus 8 [Kaposi`s sarcoma-associated h
cuugguaacucccucaa

SEQ ID NO: 4004523 - RNA, 13 nt, Human herpesvirus 8 [Kaposi`s sarcoma-associated h
cuuguacaugugu

SEQ ID NO: 4004524 - RNA, 18 nt, Human herpesvirus 8 [Kaposi`s sarcoma-associated h
cuuuaacauugaggaccu

SEQ ID NO: 4004525 - RNA, 21 nt, Human herpesvirus 8 [Kaposi`s sarcoma-associated h
cuuugcagugucuaugucugu

SEQ ID NO: 4004526 - RNA, 19 nt, Human herpesvirus 8 [Kaposi`s sarcoma-associated h
cuuuggacaguuucuggag

SEQ ID NO: 4004527 - RNA, 18 nt, Human herpesvirus 8 [Kaposi`s sarcoma-associated h
gaaaaucuggcaugcugg

SEQ ID NO: 4004528 - RNA, 21 nt, Human herpesvirus 8 [Kaposi`s sarcoma-associated h
gaaagcuucaucguggugccc

SEQ ID NO: 4004529 - RNA, 16 nt, Human herpesvirus 8 [Kaposi`s sarcoma-associated h
gaacagaagacccaga

SEQ ID NO: 4004530 - RNA, 12 nt, Human herpesvirus 8 [Kaposi`s sarcoma-associated h
gaacaugcugga

SEQ ID NO: 4004531 - RNA, 19 nt, Human herpesvirus 8 [Kaposi`s sarcoma-associated h
gaacgccauggcccacggg

SEQ ID NO: 4004532 - RNA, 19 nt, Human herpesvirus 8 [Kaposi`s sarcoma-associated h
gaacuggccgcccuucagu

SEQ ID NO: 4004533 - RNA, 19 nt, Human herpesvirus 8 [Kaposi`s sarcoma-associated h
gaagagaauggagaggaga

SEQ ID NO: 4004534 - RNA, 13 nt, Human herpesvirus 8 [Kaposi`s sarcoma-associated h
gaagagguggccg

SEQ ID NO: 4004535 - RNA, 22 nt, Human herpesvirus 8 [Kaposi`s sarcoma-associated h
gaaucggugacuuuuugugaga

SEQ ID NO: 4004536 - RNA, 13 nt, Human herpesvirus 8 [Kaposi`s sarcoma-associated h
gaauggugucaau

SEQ ID NO: 4004537 - RNA, 13 nt, Human herpesvirus 8 [Kaposi`s sarcoma-associated h
gacaaccuucaga

SEQ ID NO: 4004538 - RNA, 15 nt, Human herpesvirus 8 [Kaposi`s sarcoma-associated h
gacaccaaagacaag

SEQ ID NO: 4004539 - RNA, 18 nt, Human herpesvirus 8 [Kaposi`s sarcoma-associated h
gacaccaccgucuggcug

SEQ ID NO: 4004540 - RNA, 23 nt, Human herpesvirus 8 [Kaposi`s sarcoma-associated h
gacagauguuagauagacccggc

SEQ ID NO: 4004541 - RNA, 17 nt, Human herpesvirus 8 [Kaposi`s sarcoma-associated h
gacagcaacacccagcu

SEQ ID NO: 4004542 - RNA, 15 nt, Human herpesvirus 8 [Kaposi`s sarcoma-associated h
gacauacaugagaga

SEQ ID NO: 4004543 - RNA, 13 nt, Human herpesvirus 8 [Kaposi`s sarcoma-associated h
gacaugugcuuuu

SEQ ID NO: 4004544 - RNA, 12 nt, Human herpesvirus 8 [Kaposi`s sarcoma-associated h
gacccagggugc

SEQ ID NO: 4004545 - RNA, 21 nt, Human herpesvirus 8 [Kaposi`s sarcoma-associated h
gacgcccuggguguuaugcac

SEQ ID NO: 4004546 - RNA, 17 nt, Human herpesvirus 8 [Kaposi`s sarcoma-associated h
gacggacggcaccaagg

SEQ ID NO: 4004547 - RNA, 21 nt, Human herpesvirus 8 [Kaposi`s sarcoma-associated h
gacgucuucgccgaggacacg

SEQ ID NO: 4004548 - RNA, 16 nt, Human herpesvirus 8 [Kaposi`s sarcoma-associated h
gacucuguauuuggga

SEQ ID NO: 4004549 - RNA, 19 nt, Human herpesvirus 8 [Kaposi`s sarcoma-associated h
gacuugauaaucuccugga

SEQ ID NO: 4004550 - RNA, 14 nt, Human herpesvirus 8 [Kaposi`s sarcoma-associated h
gaggaagaugaaga

SEQ ID NO: 4004551 - RNA, 14 nt, Human herpesvirus 8 [Kaposi`s sarcoma-associated h
gaggaaggaugugg

SEQ ID NO: 4004552 - RNA, 20 nt, Human herpesvirus 8 [Kaposi`s sarcoma-associated h
gaggagggggugggggagac

SEQ ID NO: 4004553 - RNA, 20 nt, Human herpesvirus 8 [Kaposi`s sarcoma-associated h
gaggugacccuuugugcucg

SEQ ID NO: 4004554 - RNA, 20 nt, Human herpesvirus 8 [Kaposi`s sarcoma-associated h
gaguccaaccuggcaagcag

SEQ ID NO: 4004555 - RNA, 20 nt, Human herpesvirus 8 [Kaposi`s sarcoma-associated h
gagucgccgguagcugccug

SEQ ID NO: 4004556 - RNA, 17 nt, Human immunodeficiency virus 1 (HIV-1)
aaaauaaccacagaaag

SEQ ID NO: 4004557 - RNA, 22 nt, Human immunodeficiency virus 1 (HIV-1)
aaacaauggccauugacagaag

SEQ ID NO: 4004558 - RNA, 19 nt, Human immunodeficiency virus 1 (HIV-1)
aaagcuugccuugagugcu

SEQ ID NO: 4004559 - RNA, 12 nt, Human immunodeficiency virus 1 (HIV-1)
aaauagaggagc

SEQ ID NO: 4004560 - RNA, 18 nt, Human immunodeficiency virus 1 (HIV-1)
aaauuaaagccaggaaug

SEQ ID NO: 4004561 - RNA, 14 nt, Human immunodeficiency virus 1 (HIV-1)
aaauuagcaggaag

SEQ ID NO: 4004562 - RNA, 22 nt, Human immunodeficiency virus 1 (HIV-1)
aaauuaggaaaagcaggauaug

SEQ ID NO: 4004563 - RNA, 15 nt, Human immunodeficiency virus 1 (HIV-1)
aacauggagcaauca

SEQ ID NO: 4004564 - RNA, 15 nt, Human immunodeficiency virus 1 (HIV-1)
aaccccgaggggacc

SEQ ID NO: 4004565 - RNA, 17 nt, Human immunodeficiency virus 1 (HIV-1)
aacuagggaacccacug

SEQ ID NO: 4004566 - RNA, 15 nt, Human immunodeficiency virus 1 (HIV-1)
aacugacagaggaua

SEQ ID NO: 4004567 - RNA, 13 nt, Human immunodeficiency virus 1 (HIV-1)
aagauagaagagg

SEQ ID NO: 4004568 - RNA, 22 nt, Human immunodeficiency virus 1 (HIV-1)
aagcaguaaguaguacauguaa

SEQ ID NO: 4004569 - RNA, 18 nt, Human immunodeficiency virus 1 (HIV-1)
aaguaguacaaggagcuu

SEQ ID NO: 4004570 - RNA, 19 nt, Human immunodeficiency virus 1 (HIV-1)
aauaacaccaaaaaagaua

SEQ ID NO: 4004571 - RNA, 20 nt, Human immunodeficiency virus 1 (HIV-1)
aauaccaauagauaaugaua

SEQ ID NO: 4004572 - RNA, 14 nt, Human immunodeficiency virus 1 (HIV-1)
aauagcaacaauga

SEQ ID NO: 4004573 - RNA, 16 nt, Human immunodeficiency virus 1 (HIV-1)
aaucuguggacauaaa

SEQ ID NO: 4004574 - RNA, 15 nt, Human immunodeficiency virus 1 (HIV-1)
aauuauauaaauaua

SEQ ID NO: 4004575 - RNA, 15 nt, Human immunodeficiency virus 1 (HIV-1)
acaagccccagaaga

SEQ ID NO: 4004576 - RNA, 21 nt, Human immunodeficiency virus 1 (HIV-1)
acaaucacccucccaugcaga

SEQ ID NO: 4004577 - RNA, 23 nt, Human immunodeficiency virus 1 (HIV-1)
acaauggccauugacagaagaaa

SEQ ID NO: 4004578 - RNA, 21 nt, Human immunodeficiency virus 1 (HIV-1)
acaguacuaaauggagaaaau

SEQ ID NO: 4004579 - RNA, 18 nt, Human immunodeficiency virus 1 (HIV-1)
accaaagcacuaacagaa

SEQ ID NO: 4004580 - RNA, 16 nt, Human immunodeficiency virus 1 (HIV-1)
accaaggcaaagagaa

SEQ ID NO: 4004581 - RNA, 22 nt, Human immunodeficiency virus 1 (HIV-1)
accagaucugagccugggagcu

SEQ ID NO: 4004582 - RNA, 21 nt, Human immunodeficiency virus 1 (HIV-1)
accuggauggagugggacaga

SEQ ID NO: 4004583 - RNA, 22 nt, Human immunodeficiency virus 1 (HIV-1)
acuuaauagcagaaauacagaa

SEQ ID NO: 4004584 - RNA, 19 nt, Human immunodeficiency virus 1 (HIV-1)
agacagggcuuggaaagga

SEQ ID NO: 4004585 - RNA, 20 nt, Human immunodeficiency virus 1 (HIV-1)
agagggagccacacaaugaa

SEQ ID NO: 4004586 - RNA, 15 nt, Human immunodeficiency virus 1 (HIV-1)
agauccuagacuaga

SEQ ID NO: 4004587 - RNA, 12 nt, Human immunodeficiency virus 1 (HIV-1)
agaucugagccu

SEQ ID NO: 4004588 - RNA, 14 nt, Human immunodeficiency virus 1 (HIV-1)
agauucuaaaagaa

SEQ ID NO: 4004589 - RNA, 19 nt, Human immunodeficiency virus 1 (HIV-1)
aaaaucugaaaacaggaaa

SEQ ID NO: 4004590 - RNA, 16 nt, Human immunodeficiency virus 1 (HIV-1)
aaagcacuaacagaag

SEQ ID NO: 4004591 - RNA, 15 nt, Human immunodeficiency virus 1 (HIV-1)
aaauaugcaagaaug

SEQ ID NO: 4004592 - RNA, 18 nt, Human immunodeficiency virus 1 (HIV-1)
aacaaauuauaaacaugu

SEQ ID NO: 4004593 - RNA, 13 nt, Human immunodeficiency virus 1 (HIV-1)
aacccacaagaag

SEQ ID NO: 4004594 - RNA, 23 nt, Human immunodeficiency virus 1 (HIV-1)
aacugcuuguaccaauugcuauu

SEQ ID NO: 4004595 - RNA, 20 nt, Human immunodeficiency virus 1 (HIV-1)
aagaaugagacgagcugagc

SEQ ID NO: 4004596 - RNA, 20 nt, Human immunodeficiency virus 1 (HIV-1)
aagauaauagugacauaaaa

SEQ ID NO: 4004597 - RNA, 15 nt, Human immunodeficiency virus 1 (HIV-1)
aagcacaagaggagg

SEQ ID NO: 4004598 - RNA, 19 nt, Human immunodeficiency virus 1 (HIV-1)
aagcuugccuugagugcuu

SEQ ID NO: 4004599 - RNA, 15 nt, Human immunodeficiency virus 1 (HIV-1)
aaggaguaguagaau

SEQ ID NO: 4004600 - RNA, 14 nt, Human immunodeficiency virus 1 (HIV-1)
aaggcagcuguaga

SEQ ID NO: 4004601 - RNA, 16 nt, Human immunodeficiency virus 1 (HIV-1)
aaguaagacaguauga

SEQ ID NO: 4004602 - RNA, 19 nt, Human immunodeficiency virus 1 (HIV-1)
aaguaguauugguaaaugu

SEQ ID NO: 4004603 - RNA, 15 nt, Human immunodeficiency virus 1 (HIV-1)
aaguuuaguaaaaca

SEQ ID NO: 4004604 - RNA, 16 nt, Human immunodeficiency virus 1 (HIV-1)
aauaaguucagaagua

SEQ ID NO: 4004605 - RNA, 22 nt, Human immunodeficiency virus 1 (HIV-1)
aaucuuagagccuuuuagaaaa

SEQ ID NO: 4004606 - RNA, 19 nt, Human immunodeficiency virus 1 (HIV-1)
aauuaggaaaagcaggaua

SEQ ID NO: 4004607 - RNA, 22 nt, Human immunodeficiency virus 1 (HIV-1)
aauuaugguaccaguuagagaa

SEQ ID NO: 4004608 - RNA, 16 nt, Human immunodeficiency virus 1 (HIV-1)
aauuauucauaaugau

SEQ ID NO: 4004609 - RNA, 17 nt, Human immunodeficiency virus 1 (HIV-1)
acaaaucagaagacuga

SEQ ID NO: 4004610 - RNA, 16 nt, Human immunodeficiency virus 1 (HIV-1)
acacaacaaaucagaa

SEQ ID NO: 4004611 - RNA, 18 nt, Human immunodeficiency virus 1 (HIV-1)
acaggagaaagagacugg

SEQ ID NO: 4004612 - RNA, 12 nt, Human immunodeficiency virus 1 (HIV-1)
acagggagacua

SEQ ID NO: 4004613 - RNA, 17 nt, Human immunodeficiency virus 1 (HIV-1)
acauaccuagaagaaua

SEQ ID NO: 4004614 - RNA, 18 nt, Human immunodeficiency virus 1 (HIV-1)
accaaugacuuacaaggc

SEQ ID NO: 4004615 - RNA, 18 nt, Human immunodeficiency virus 1 (HIV-1)
acgcagggggugggaagc

SEQ ID NO: 4004616 - RNA, 15 nt, Human immunodeficiency virus 1 (HIV-1)
acugcuguuaaaugg

SEQ ID NO: 4004617 - RNA, 20 nt, Human immunodeficiency virus 1 (HIV-1)
acugucaaugacauacagaa

SEQ ID NO: 4004618 - RNA, 14 nt, Human immunodeficiency virus 1 (HIV-1)
acuuuaaaacagau

SEQ ID NO: 4004619 - RNA, 15 nt, Human immunodeficiency virus 1 (HIV-1)
agaaaagaaugaaca

SEQ ID NO: 4004620 - RNA, 18 nt, Human immunodeficiency virus 1 (HIV-1)
agaacagucagacucauc

SEQ ID NO: 4004621 - RNA, 19 nt, Human immunodeficiency virus 1 (HIV-1)
agaagaggccaauaaagga

SEQ ID NO: 4004622 - RNA, 17 nt, Human immunodeficiency virus 1 (HIV-1)
agacauacaaacuaaag

SEQ ID NO: 4004623 - RNA, 15 nt, Human immunodeficiency virus 1 (HIV-1)
agacgagcugagcca

SEQ ID NO: 4004624 - RNA, 15 nt, Human immunodeficiency virus 1 (HIV-1)
agauaaaaaacugcu

SEQ ID NO: 4004625 - RNA, 19 nt, Human immunodeficiency virus 1 (HIV-1)
agcaaaauggaauaacacu

SEQ ID NO: 4004626 - RNA, 12 nt, Human immunodeficiency virus 1 (HIV-1)
agcaacaaugag

SEQ ID NO: 4004627 - RNA, 16 nt, Human immunodeficiency virus 1 (HIV-1)
agcaagaaaagaauga

SEQ ID NO: 4004628 - RNA, 14 nt, Human immunodeficiency virus 1 (HIV-1)
agccuaaaacugcu

SEQ ID NO: 4004629 - RNA, 14 nt, Human immunodeficiency virus 1 (HIV-1)
agcuaguaccaguu

SEQ ID NO: 4004630 - RNA, 16 nt, Human immunodeficiency virus 1 (HIV-1)
agcucaucagaacagu

SEQ ID NO: 4004631 - RNA, 13 nt, Human immunodeficiency virus 1 (HIV-1)
agcuuaagaauga

SEQ ID NO: 4004632 - RNA, 11 nt, Human immunodeficiency virus 1 (HIV-1)
aggaggggacc

SEQ ID NO: 4004633 - RNA, 19 nt, Human immunodeficiency virus 1 (HIV-1)
aggauauguuacuaauaga

SEQ ID NO: 4004634 - RNA, 19 nt, Human immunodeficiency virus 1 (HIV-1)
aggauuagaacauggaaaa

SEQ ID NO: 4004635 - RNA, 23 nt, Human immunodeficiency virus 1 (HIV-1)
aggccaauaaaggagagaacacc

SEQ ID NO: 4004636 - RNA, 13 nt, Human immunodeficiency virus 1 (HIV-1)
aggcguggccugg

SEQ ID NO: 4004637 - RNA, 21 nt, Human immunodeficiency virus 1 (HIV-1)
agggagacuaaauuaggaaaa

SEQ ID NO: 4004638 - RNA, 17 nt, Human immunodeficiency virus 1 (HIV-1)
aggguuaaaaaagaaaa

SEQ ID NO: 4004639 - RNA, 17 nt, Human immunodeficiency virus 1 (HIV-1)
aguaccaguugagccag

SEQ ID NO: 4004640 - RNA, 18 nt, Human immunodeficiency virus 1 (HIV-1)
aguaucaacucaacugcu

SEQ ID NO: 4004641 - RNA, 23 nt, Human immunodeficiency virus 1 (HIV-1)
agugccaagaagaaaagcaaaga

SEQ ID NO: 4004642 - RNA, 17 nt, Human immunodeficiency virus 1 (HIV-1)
auacuugggcaggagug

SEQ ID NO: 4004643 - RNA, 22 nt, Human immunodeficiency virus 1 (HIV-1)
aucaagcuucucuaucaaagca

SEQ ID NO: 4004644 - RNA, 15 nt, Human immunodeficiency virus 1 (HIV-1)
aucugacuuagaaau

SEQ ID NO: 4004645 - RNA, 17 nt, Human immunodeficiency virus 1 (HIV-1)
augcagaauaaaacaaa

SEQ ID NO: 4004646 - RNA, 22 nt, Human immunodeficiency virus 1 (HIV-1)
augcagaauaaaacaaauuaua

SEQ ID NO: 4004647 - RNA, 18 nt, Human immunodeficiency virus 1 (HIV-1)
auggaaaaggaagggaaa

SEQ ID NO: 4004648 - RNA, 13 nt, Human immunodeficiency virus 1 (HIV-1)
auuugaagaauga

SEQ ID NO: 4004649 - RNA, 14 nt, Human immunodeficiency virus 1 (HIV-1)
auuuucagaauugg

SEQ ID NO: 4004650 - RNA, 12 nt, Human immunodeficiency virus 1 (HIV-1)
caagaauuauug

SEQ ID NO: 4004651 - RNA, 13 nt, Human immunodeficiency virus 1 (HIV-1)
caagcauaagagg

SEQ ID NO: 4004652 - RNA, 15 nt, Human immunodeficiency virus 1 (HIV-1)
caauaguagcaauag

SEQ ID NO: 4004653 - RNA, 18 nt, Human immunodeficiency virus 1 (HIV-1)
caaugagagugaaggaga

SEQ ID NO: 4004654 - RNA, 21 nt, Human immunodeficiency virus 1 (HIV-1)
caaugcugcuugugccuggcu

SEQ ID NO: 4004655 - RNA, 17 nt, Human immunodeficiency virus 1 (HIV-1)
cacaaucacccucccau

SEQ ID NO: 4004656 - RNA, 12 nt, Human immunodeficiency virus 1 (HIV-1)
cagaaauuguaa

SEQ ID NO: 4004657 - RNA, 12 nt, Human immunodeficiency virus 1 (HIV-1)
cagaagaagagg

SEQ ID NO: 4004658 - RNA, 20 nt, Human immunodeficiency virus 1 (HIV-1)
cagaauaaaacaaauuauaa

SEQ ID NO: 4004659 - RNA, 16 nt, Human immunodeficiency virus 1 (HIV-1)
cagaccuggaggagga

SEQ ID NO: 4004660 - RNA, 19 nt, Human immunodeficiency virus 1 (HIV-1)
cagauaagauagaagaggc

SEQ ID NO: 4004661 - RNA, 17 nt, Human immunodeficiency virus 1 (HIV-1)
cagauagggugggagca

SEQ ID NO: 4004662 - RNA, 23 nt, Human immunodeficiency virus 1 (HIV-1)
cagcagcuaccaaugcugcuugu

SEQ ID NO: 4004663 - RNA, 16 nt, Human immunodeficiency virus 1 (HIV-1)
cagcuuguuacacccu

SEQ ID NO: 4004664 - RNA, 24 nt, Human immunodeficiency virus 1 (HIV-1)
caggaguggaagccauaauaagaa

SEQ ID NO: 4004665 - RNA, 21 nt, Human immunodeficiency virus 1 (HIV-1)
ccagggaggcguggccugggc

SEQ ID NO: 4004666 - RNA, 14 nt, Human immunodeficiency virus 1 (HIV-1)
cccauaguaggagc

SEQ ID NO: 4004667 - RNA, 11 nt, Human immunodeficiency virus 1 (HIV-1)
cccucagaucc

SEQ ID NO: 4004668 - RNA, 16 nt, Human immunodeficiency virus 1 (HIV-1)
ccugggagcucucugg

SEQ ID NO: 4004669 - RNA, 13 nt, Human immunodeficiency virus 1 (HIV-1)
ccugggcgggacu

SEQ ID NO: 4004670 - RNA, 12 nt, Human immunodeficiency virus 1 (HIV-1)
cgacagaggaga

SEQ ID NO: 4004671 - RNA, 11 nt, Human immunodeficiency virus 1 (HIV-1)
cgagcccucag

SEQ ID NO: 4004672 - RNA, 14 nt, Human immunodeficiency virus 1 (HIV-1)
cgagcugagccagc

SEQ ID NO: 4004673 - RNA, 19 nt, Human immunodeficiency virus 1 (HIV-1)
cuagagcuuuuagaggagc

SEQ ID NO: 4004674 - RNA, 14 nt, Human immunodeficiency virus 1 (HIV-1)
cucagauccugcau

SEQ ID NO: 4004675 - RNA, 15 nt, Human immunodeficiency virus 1 (HIV-1)
cucauccaagaauaa

SEQ ID NO: 4004676 - RNA, 13 nt, Human immunodeficiency virus 1 (HIV-1)
cugagccagcagc

SEQ ID NO: 4004677 - RNA, 21 nt, Human immunodeficiency virus 1 (HIV-1)
cuggcuagaagcacaagagga

SEQ ID NO: 4004678 - RNA, 21 nt, Human immunodeficiency virus 1 (HIV-1)
cugggacgaucugcggagccu

SEQ ID NO: 4004679 - RNA, 15 nt, Human immunodeficiency virus 1 (HIV-1)
cuggggcaucaagca

SEQ ID NO: 4004680 - RNA, 14 nt, Human immunodeficiency virus 1 (HIV-1)
cugggucucucugg

SEQ ID NO: 4004681 - RNA, 17 nt, Human immunodeficiency virus 1 (HIV-1)
cuguagaaauuaauugu

SEQ ID NO: 4004682 - RNA, 18 nt, Human immunodeficiency virus 1 (HIV-1)
cuguagaaauuaauugua

SEQ ID NO: 4004683 - RNA, 16 nt, Human immunodeficiency virus 1 (HIV-1)
aggcguggccugggcg

SEQ ID NO: 4004684 - RNA, 18 nt, Human immunodeficiency virus 1 (HIV-1)
aggcuugguagguuuaag

SEQ ID NO: 4004685 - RNA, 17 nt, Human immunodeficiency virus 1 (HIV-1)
agggacaauuggagaag

SEQ ID NO: 4004686 - RNA, 20 nt, Human immunodeficiency virus 1 (HIV-1)
agggcugcuauuaacaagag

SEQ ID NO: 4004687 - RNA, 15 nt, Human immunodeficiency virus 1 (HIV-1)
aguacuugguuuaau

SEQ ID NO: 4004688 - RNA, 19 nt, Human immunodeficiency virus 1 (HIV-1)
aguagugccaagaagaaaa

SEQ ID NO: 4004689 - RNA, 21 nt, Human immunodeficiency virus 1 (HIV-1)
agucacaccucagguaccuuu

SEQ ID NO: 4004690 - RNA, 20 nt, Human immunodeficiency virus 1 (HIV-1)
agucuccauagaauggagga

SEQ ID NO: 4004691 - RNA, 18 nt, Human immunodeficiency virus 1 (HIV-1)
aguugucacccuaacuga

SEQ ID NO: 4004692 - RNA, 21 nt, Human immunodeficiency virus 1 (HIV-1)
auaaaauuauucauaaugaua

SEQ ID NO: 4004693 - RNA, 14 nt, Human immunodeficiency virus 1 (HIV-1)
auacaaaaggaaac

SEQ ID NO: 4004694 - RNA, 14 nt, Human immunodeficiency virus 1 (HIV-1)
auaccacuaacaga

SEQ ID NO: 4004695 - RNA, 17 nt, Human immunodeficiency virus 1 (HIV-1)
auaggguuauagaagua

SEQ ID NO: 4004696 - RNA, 21 nt, Human immunodeficiency virus 1 (HIV-1)
auauaaaguaguaaaaauuga

SEQ ID NO: 4004697 - RNA, 20 nt, Human immunodeficiency virus 1 (HIV-1)
auaucagcacaagcauaaga

SEQ ID NO: 4004698 - RNA, 15 nt, Human immunodeficiency virus 1 (HIV-1)
aucacacgaccugga

SEQ ID NO: 4004699 - RNA, 10 nt, Human immunodeficiency virus 1 (HIV-1)
aucucuggaa

SEQ ID NO: 4004700 - RNA, 22 nt, Human immunodeficiency virus 1 (HIV-1)
augaauaaagaauuaaagaaaa

SEQ ID NO: 4004701 - RNA, 23 nt, Human immunodeficiency virus 1 (HIV-1)
augagggacaauuggagaaguga

SEQ ID NO: 4004702 - RNA, 20 nt, Human immunodeficiency virus 1 (HIV-1)
auggccuacuguaagggaaa

SEQ ID NO: 4004703 - RNA, 13 nt, Human immunodeficiency virus 1 (HIV-1)
auucauaaugaua

SEQ ID NO: 4004704 - RNA, 19 nt, Human immunodeficiency virus 1 (HIV-1)
auuugggguugcucuggaa

SEQ ID NO: 4004705 - RNA, 22 nt, Human immunodeficiency virus 1 (HIV-1)
cacaagaggaggaggagguggg

SEQ ID NO: 4004706 - RNA, 18 nt, Human immunodeficiency virus 1 (HIV-1)
cagaccuggaggaggaga

SEQ ID NO: 4004707 - RNA, 18 nt, Human immunodeficiency virus 1 (HIV-1)
cagacucugcuauaagaa

SEQ ID NO: 4004708 - RNA, 21 nt, Human immunodeficiency virus 1 (HIV-1)
cagacucugcuauaagaaagg

SEQ ID NO: 4004709 - RNA, 13 nt, Human immunodeficiency virus 1 (HIV-1)
cagaggagagcaa

SEQ ID NO: 4004710 - RNA, 12 nt, Human immunodeficiency virus 1 (HIV-1)
cagggacagcag

SEQ ID NO: 4004711 - RNA, 14 nt, Human immunodeficiency virus 1 (HIV-1)
caguauuagaagaa

SEQ ID NO: 4004712 - RNA, 20 nt, Human immunodeficiency virus 1 (HIV-1)
caguauuggagucaggaacu

SEQ ID NO: 4004713 - RNA, 19 nt, Human immunodeficiency virus 1 (HIV-1)
caguauuugccauaaagaa

SEQ ID NO: 4004714 - RNA, 21 nt, Human immunodeficiency virus 1 (HIV-1)
cagucuagcagaagaagaggu

SEQ ID NO: 4004715 - RNA, 20 nt, Human immunodeficiency virus 1 (HIV-1)
caguggauauauagaagcag

SEQ ID NO: 4004716 - RNA, 13 nt, Human immunodeficiency virus 1 (HIV-1)
caguugagccaga

SEQ ID NO: 4004717 - RNA, 15 nt, Human immunodeficiency virus 1 (HIV-1)
caucaagcagcucca

SEQ ID NO: 4004718 - RNA, 19 nt, Human immunodeficiency virus 1 (HIV-1)
cauuaucguuucagaccca

SEQ ID NO: 4004719 - RNA, 13 nt, Human immunodeficiency virus 1 (HIV-1)
ccaaugacuuaca

SEQ ID NO: 4004720 - RNA, 23 nt, Human immunodeficiency virus 1 (HIV-1)
ccagcaagaaaagaaugaacaag

SEQ ID NO: 4004721 - RNA, 23 nt, Human immunodeficiency virus 1 (HIV-1)
ccagcuuguuacacccugugagc

SEQ ID NO: 4004722 - RNA, 19 nt, Human immunodeficiency virus 1 (HIV-1)
ccggaguacuucaagaacu

SEQ ID NO: 4004723 - RNA, 13 nt, Human immunodeficiency virus 1 (HIV-1)
ccugagugggagu

SEQ ID NO: 4004724 - RNA, 16 nt, Human immunodeficiency virus 1 (HIV-1)
ccugauuagcagaacu

SEQ ID NO: 4004725 - RNA, 16 nt, Human immunodeficiency virus 1 (HIV-1)
cgagaucuucagaccu

SEQ ID NO: 4004726 - RNA, 23 nt, Human immunodeficiency virus 1 (HIV-1)
cgcagggggugggaagcccucaa

SEQ ID NO: 4004727 - RNA, 13 nt, Human immunodeficiency virus 1 (HIV-1)
cugggagcucucu

SEQ ID NO: 4004728 - RNA, 19 nt, Human immunodeficiency virus 1 (HIV-1)
cuggggaguggcgagcccu

SEQ ID NO: 4004729 - RNA, 10 nt, Human immunodeficiency virus 1 (HIV-1)
cuucugggac

SEQ ID NO: 4004730 - RNA, 22 nt, Human immunodeficiency virus 1 (HIV-1)
cuuuccagggaggcguggccug

SEQ ID NO: 4004731 - RNA, 14 nt, Human immunodeficiency virus 1 (HIV-1)
gaaacugacagagg

SEQ ID NO: 4004732 - RNA, 23 nt, Human immunodeficiency virus 1 (HIV-1)
gaagaaucgcaaaaccagcaaga

SEQ ID NO: 4004733 - RNA, 16 nt, Human immunodeficiency virus 1 (HIV-1)
gaauaaguucagaagu

SEQ ID NO: 4004734 - RNA, 15 nt, Human immunodeficiency virus 1 (HIV-1)
gacaauggcagcaau

SEQ ID NO: 4004735 - RNA, 18 nt, Human immunodeficiency virus 1 (HIV-1)
gaccagaucugagccugg

SEQ ID NO: 4004736 - RNA, 16 nt, Human immunodeficiency virus 1 (HIV-1)
gacccggagagagaag

SEQ ID NO: 4004737 - RNA, 10 nt, Human immunodeficiency virus 1 (HIV-1)
gacuggaagg

SEQ ID NO: 4004738 - RNA, 12 nt, Human immunodeficiency virus 1 (HIV-1)
gagaacaccagc

SEQ ID NO: 4004739 - RNA, 17 nt, Human immunodeficiency virus 1 (HIV-1)
gagagauucuaaaagaa

SEQ ID NO: 4004740 - RNA, 12 nt, Human immunodeficiency virus 1 (HIV-1)
gagcagcaucuc

SEQ ID NO: 4004741 - RNA, 19 nt, Human immunodeficiency virus 1 (HIV-1)
gagccagcagcagauaggg

SEQ ID NO: 4004742 - RNA, 19 nt, Human immunodeficiency virus 1 (HIV-1)
gaguaauaaaucucuggaa

SEQ ID NO: 4004743 - RNA, 22 nt, Human immunodeficiency virus 1 (HIV-1)
gauggaaaggaucaccagcaau

SEQ ID NO: 4004744 - RNA, 23 nt, Human immunodeficiency virus 1 (HIV-1)
gcacaagaggaggaggagguggg

SEQ ID NO: 4004745 - RNA, 14 nt, Human immunodeficiency virus 1 (HIV-1)
gcagaauaaaacaa

SEQ ID NO: 4004746 - RNA, 18 nt, Human immunodeficiency virus 1 (HIV-1)
gcagucuagcagaagaag

SEQ ID NO: 4004747 - RNA, 18 nt, Human immunodeficiency virus 1 (HIV-1)
gccacauaccuagaagaa

SEQ ID NO: 4004748 - RNA, 12 nt, Human immunodeficiency virus 1 (HIV-1)
ggaaggaagcaa

SEQ ID NO: 4004749 - RNA, 17 nt, Human immunodeficiency virus 1 (HIV-1)
ggagagagagacagaga

SEQ ID NO: 4004750 - RNA, 23 nt, Human immunodeficiency virus 1 (HIV-1)
ggaguagcacccaccaaggcaaa

SEQ ID NO: 4004751 - RNA, 12 nt, Human immunodeficiency virus 1 (HIV-1)
gggacuggaagg

SEQ ID NO: 4004752 - RNA, 23 nt, Human immunodeficiency virus 1 (HIV-1)
guaacgcacaguuuuaauugugg

SEQ ID NO: 4004753 - RNA, 18 nt, Human immunodeficiency virus 1 (HIV-1)
guacugggucucucuggu

SEQ ID NO: 4004754 - RNA, 14 nt, Human immunodeficiency virus 1 (HIV-1)
gugaacggauccuu

SEQ ID NO: 4004755 - RNA, 19 nt, Human immunodeficiency virus 1 (HIV-1)
gugggacagagaaauuaac

SEQ ID NO: 4004756 - RNA, 11 nt, Human immunodeficiency virus 1 (HIV-1)
uaaaauuauuc

SEQ ID NO: 4004757 - RNA, 17 nt, Human immunodeficiency virus 1 (HIV-1)
uacagagguacauaaug

SEQ ID NO: 4004758 - RNA, 17 nt, Human immunodeficiency virus 1 (HIV-1)
uacagcagcuaccaaug

SEQ ID NO: 4004759 - RNA, 21 nt, Human immunodeficiency virus 1 (HIV-1)
uagaaauagggcagcauagaa

SEQ ID NO: 4004760 - RNA, 21 nt, Human immunodeficiency virus 1 (HIV-1)
uagaaaucuguggacauaaag

SEQ ID NO: 4004761 - RNA, 21 nt, Human immunodeficiency virus 1 (HIV-1)
uagaccagaucugagccuggg

SEQ ID NO: 4004762 - RNA, 21 nt, Human immunodeficiency virus 1 (HIV-1)
uagcagaccaacuaauucauc

SEQ ID NO: 4004763 - RNA, 19 nt, Human immunodeficiency virus 1 (HIV-1)
ugagacaagcacauuguaa

SEQ ID NO: 4004764 - RNA, 13 nt, Human immunodeficiency virus 1 (HIV-1)
ugagccagcagca

SEQ ID NO: 4004765 - RNA, 16 nt, Human immunodeficiency virus 1 (HIV-1)
ugcagcagcagaacaa

SEQ ID NO: 4004766 - RNA, 11 nt, Human immunodeficiency virus 1 (HIV-1)
ugccaggaaga

SEQ ID NO: 4004767 - RNA, 12 nt, Human immunodeficiency virus 1 (HIV-1)
ugccccucccau

SEQ ID NO: 4004768 - RNA, 15 nt, Human immunodeficiency virus 1 (HIV-1)
ugcugcuugugccug

SEQ ID NO: 4004769 - RNA, 19 nt, Human immunodeficiency virus 1 (HIV-1)
uggaacagauuuggaauca

SEQ ID NO: 4004770 - RNA, 22 nt, Human immunodeficiency virus 1 (HIV-1)
uggcgagcccucagauccugca

SEQ ID NO: 4004771 - RNA, 17 nt, Human immunodeficiency virus 1 (HIV-1)
ugggguaccugugugga

SEQ ID NO: 4004772 - RNA, 23 nt, Human immunodeficiency virus 1 (HIV-1)
ugguuagaccagaucugagccug

SEQ ID NO: 4004773 - RNA, 21 nt, Human immunodeficiency virus 1 (HIV-1)
aacuggcagaaaacagagaga

SEQ ID NO: 4004774 - RNA, 20 nt, Human immunodeficiency virus 1 (HIV-1)
aagaauaguagacauaauag

SEQ ID NO: 4004775 - RNA, 15 nt, Human immunodeficiency virus 1 (HIV-1)
aagagaucaggcuga

SEQ ID NO: 4004776 - RNA, 23 nt, Human immunodeficiency virus 1 (HIV-1)
aagcauaagagguaaggugcaga

SEQ ID NO: 4004777 - RNA, 10 nt, Human immunodeficiency virus 1 (HIV-1)
aagcccucaa

SEQ ID NO: 4004778 - RNA, 15 nt, Human immunodeficiency virus 1 (HIV-1)
aaggaauagaagaag

SEQ ID NO: 4004779 - RNA, 15 nt, Human immunodeficiency virus 1 (HIV-1)
aaguagacaggauga

SEQ ID NO: 4004780 - RNA, 14 nt, Human immunodeficiency virus 1 (HIV-1)
aauagugacauaaa

SEQ ID NO: 4004781 - RNA, 19 nt, Human immunodeficiency virus 1 (HIV-1)
aauaucagcacaagcauaa

SEQ ID NO: 4004782 - RNA, 15 nt, Human immunodeficiency virus 1 (HIV-1)
aaugaacaagaauua

SEQ ID NO: 4004783 - RNA, 23 nt, Human immunodeficiency virus 1 (HIV-1)
aauuacaaaaacaaauuacaaaa

SEQ ID NO: 4004784 - RNA, 23 nt, Human immunodeficiency virus 1 (HIV-1)
aauucacucccaaagaagacaag

SEQ ID NO: 4004785 - RNA, 16 nt, Human immunodeficiency virus 1 (HIV-1)
aauuguggaggggaau

SEQ ID NO: 4004786 - RNA, 16 nt, Human immunodeficiency virus 1 (HIV-1)
acaaucacccucccau

SEQ ID NO: 4004787 - RNA, 22 nt, Human immunodeficiency virus 1 (HIV-1)
acaauuuggaaauaauaaaaca

SEQ ID NO: 4004788 - RNA, 17 nt, Human immunodeficiency virus 1 (HIV-1)
acagagaaauuaacaau

SEQ ID NO: 4004789 - RNA, 18 nt, Human immunodeficiency virus 1 (HIV-1)
acagagaaauuaacaauu

SEQ ID NO: 4004790 - RNA, 20 nt, Human immunodeficiency virus 1 (HIV-1)
acagagggagccacacaaug

SEQ ID NO: 4004791 - RNA, 14 nt, Human immunodeficiency virus 1 (HIV-1)
acaggagcagauga

SEQ ID NO: 4004792 - RNA, 19 nt, Human immunodeficiency virus 1 (HIV-1)
acaguggcaaugagaguga

SEQ ID NO: 4004793 - RNA, 14 nt, Human immunodeficiency virus 1 (HIV-1)
acaguuuuaauugu

SEQ ID NO: 4004794 - RNA, 18 nt, Human immunodeficiency virus 1 (HIV-1)
acauaccuagaagaauaa

SEQ ID NO: 4004795 - RNA, 17 nt, Human immunodeficiency virus 1 (HIV-1)
acauuaguagagcaaaa

SEQ ID NO: 4004796 - RNA, 19 nt, Human immunodeficiency virus 1 (HIV-1)
acccucccaugcagaauaa

SEQ ID NO: 4004797 - RNA, 16 nt, Human immunodeficiency virus 1 (HIV-1)
acgaucugcggagccu

SEQ ID NO: 4004798 - RNA, 13 nt, Human immunodeficiency virus 1 (HIV-1)
acuaauagaaaga

SEQ ID NO: 4004799 - RNA, 21 nt, Human immunodeficiency virus 1 (HIV-1)
acugaaggaagugacacaauc

SEQ ID NO: 4004800 - RNA, 23 nt, Human immunodeficiency virus 1 (HIV-1)
acuuuggaaaggaccagcaaagc

SEQ ID NO: 4004801 - RNA, 14 nt, Human immunodeficiency virus 1 (HIV-1)
agaaaagcaaagau

SEQ ID NO: 4004802 - RNA, 20 nt, Human immunodeficiency virus 1 (HIV-1)
agaacaauuuggaaauaaua

SEQ ID NO: 4004803 - RNA, 17 nt, Human immunodeficiency virus 1 (HIV-1)
agaaguaguacaaggag

SEQ ID NO: 4004804 - RNA, 22 nt, Human immunodeficiency virus 1 (HIV-1)
agaaucgcaaaaccagcaagaa

SEQ ID NO: 4004805 - RNA, 20 nt, Human immunodeficiency virus 1 (HIV-1)
agaauucugcaacaacugcu

SEQ ID NO: 4004806 - RNA, 16 nt, Human immunodeficiency virus 1 (HIV-1)
agacaucacuaugaaa

SEQ ID NO: 4004807 - RNA, 13 nt, Human immunodeficiency virus 1 (HIV-1)
agaccuggaggag

SEQ ID NO: 4004808 - RNA, 19 nt, Human immunodeficiency virus 1 (HIV-1)
agcaauacagcagcuacca

SEQ ID NO: 4004809 - RNA, 15 nt, Human immunodeficiency virus 1 (HIV-1)
agcacaagcauaaga

SEQ ID NO: 4004810 - RNA, 18 nt, Human immunodeficiency virus 1 (HIV-1)
agcacuaacagaaguaau

SEQ ID NO: 4004811 - RNA, 21 nt, Human immunodeficiency virus 1 (HIV-1)
agcagaacuacacaccagggc

SEQ ID NO: 4004812 - RNA, 14 nt, Human immunodeficiency virus 1 (HIV-1)
agcaguagcugagg

SEQ ID NO: 4004813 - RNA, 21 nt, Human immunodeficiency virus 1 (HIV-1)
agcaguuaauaaaaaaggaaa

SEQ ID NO: 4004814 - RNA, 14 nt, Human immunodeficiency virus 1 (HIV-1)
agcccucagauccu

SEQ ID NO: 4004815 - RNA, 14 nt, Human immunodeficiency virus 1 (HIV-1)
agcucaucagaaca

SEQ ID NO: 4004816 - RNA, 13 nt, Human immunodeficiency virus 1 (HIV-1)
agcugaggggaca

SEQ ID NO: 4004817 - RNA, 22 nt, Human immunodeficiency virus 1 (HIV-1)
aggaaccaaagcacuaacagaa

SEQ ID NO: 4004818 - RNA, 15 nt, Human immunodeficiency virus 1 (HIV-1)
agggauuauggaaaa

SEQ ID NO: 4004819 - RNA, 18 nt, Human immunodeficiency virus 1 (HIV-1)
aguacuucaagaacugcu

SEQ ID NO: 4004820 - RNA, 18 nt, Human immunodeficiency virus 1 (HIV-1)
agucaggaacuaaagaau

SEQ ID NO: 4004821 - RNA, 23 nt, Human immunodeficiency virus 1 (HIV-1)
aguccaggaauauggcaacuaga

SEQ ID NO: 4004822 - RNA, 21 nt, Human immunodeficiency virus 1 (HIV-1)
aguggaagccauaauaagaau

SEQ ID NO: 4004823 - RNA, 16 nt, Human immunodeficiency virus 1 (HIV-1)
aguggcgagcccucag

SEQ ID NO: 4004824 - RNA, 18 nt, Human immunodeficiency virus 1 (HIV-1)
agugggacagagaaauua

SEQ ID NO: 4004825 - RNA, 16 nt, Human immunodeficiency virus 1 (HIV-1)
auagaauauaggaaaa

SEQ ID NO: 4004826 - RNA, 13 nt, Human immunodeficiency virus 1 (HIV-1)
auagaggagcuga

SEQ ID NO: 4004827 - RNA, 21 nt, Human immunodeficiency virus 1 (HIV-1)
auaguaguagcgggagaauga

SEQ ID NO: 4004828 - RNA, 13 nt, Human immunodeficiency virus 1 (HIV-1)
aucaacagcuccu

SEQ ID NO: 4004829 - RNA, 14 nt, Human immunodeficiency virus 1 (HIV-1)
aucaagcagcucca

SEQ ID NO: 4004830 - RNA, 14 nt, Human immunodeficiency virus 1 (HIV-1)
aucaagcaggaauu

SEQ ID NO: 4004831 - RNA, 16 nt, Human immunodeficiency virus 1 (HIV-1)
aucagaugcuaaagca

SEQ ID NO: 4004832 - RNA, 15 nt, Human immunodeficiency virus 1 (HIV-1)
augacaugguagaac

SEQ ID NO: 4004833 - RNA, 18 nt, Human immunodeficiency virus 1 (HIV-1)
augagacgagcugagcca

SEQ ID NO: 4004834 - RNA, 23 nt, Human immunodeficiency virus 1 (HIV-1)
augcuccuugggauguugaugau

SEQ ID NO: 4004835 - RNA, 17 nt, Human immunodeficiency virus 1 (HIV-1)
auguaugccccucccau

SEQ ID NO: 4004836 - RNA, 14 nt, Human immunodeficiency virus 1 (HIV-1)
auuacaaaaacaaa

SEQ ID NO: 4004837 - RNA, 14 nt, Human immunodeficiency virus 1 (HIV-1)
auuuagaaggaaaa

SEQ ID NO: 4004838 - RNA, 14 nt, Human immunodeficiency virus 1 (HIV-1)
caacaauacaagaa

SEQ ID NO: 4004839 - RNA, 17 nt, Human immunodeficiency virus 1 (HIV-1)
caaggcaaagagaagag

SEQ ID NO: 4004840 - RNA, 14 nt, Human immunodeficiency virus 1 (HIV-1)
caauagauaaugau

SEQ ID NO: 4004841 - RNA, 20 nt, Human immunodeficiency virus 1 (HIV-1)
caaugcugcuugugccuggc

SEQ ID NO: 4004842 - RNA, 19 nt, Human immunodeficiency virus 1 (HIV-1)
caccaaggcaaagagaaga

SEQ ID NO: 4004843 - RNA, 23 nt, Human immunodeficiency virus 1 (HIV-1)
cacccugugagccugcaugggau

SEQ ID NO: 4004844 - RNA, 23 nt, Human immunodeficiency virus 1 (HIV-1)
cagaacuacacaccagggccagg

SEQ ID NO: 4004845 - RNA, 20 nt, Human immunodeficiency virus 1 (HIV-1)
cagacauacaaacuaaagaa

SEQ ID NO: 4004846 - RNA, 14 nt, Human immunodeficiency virus 1 (HIV-1)
cagagacagaucca

SEQ ID NO: 4004847 - RNA, 13 nt, Human immunodeficiency virus 1 (HIV-1)
cagauauccacug

SEQ ID NO: 4004848 - RNA, 18 nt, Human immunodeficiency virus 1 (HIV-1)
cagaucugagccugggag

SEQ ID NO: 4004849 - RNA, 18 nt, Human immunodeficiency virus 1 (HIV-1)
cagccuaaaacugcuugu

SEQ ID NO: 4004850 - RNA, 13 nt, Human immunodeficiency virus 1 (HIV-1)
caggaagaagcgg

SEQ ID NO: 4004851 - RNA, 21 nt, Human immunodeficiency virus 1 (HIV-1)
caggaagaagcggagacagcg

SEQ ID NO: 4004852 - RNA, 15 nt, Human immunodeficiency virus 1 (HIV-1)
cagggaggcguggcc

SEQ ID NO: 4004853 - RNA, 18 nt, Human immunodeficiency virus 1 (HIV-1)
cagggggugggaagcccu

SEQ ID NO: 4004854 - RNA, 13 nt, Human immunodeficiency virus 1 (HIV-1)
caggguuaaaaaa

SEQ ID NO: 4004855 - RNA, 21 nt, Human immunodeficiency virus 1 (HIV-1)
cauuagcccuauugagacugu

SEQ ID NO: 4004856 - RNA, 13 nt, Human immunodeficiency virus 1 (HIV-1)
ccagggagagcau

SEQ ID NO: 4004857 - RNA, 13 nt, Human immunodeficiency virus 1 (HIV-1)
ccuggcuagaagc

SEQ ID NO: 4004858 - RNA, 18 nt, Human immunodeficiency virus 1 (HIV-1)
cugagccugggagcucuc

SEQ ID NO: 4004859 - RNA, 22 nt, Human immunodeficiency virus 1 (HIV-1)
cuuaauacacuccuuaauugaa

SEQ ID NO: 4004860 - RNA, 22 nt, Human immunodeficiency virus 1 (HIV-1)
gaaccaaagcacuaacagaagu

SEQ ID NO: 4004861 - RNA, 16 nt, Human immunodeficiency virus 1 (HIV-1)
gaagcauccaggaagu

SEQ ID NO: 4004862 - RNA, 17 nt, Human immunodeficiency virus 1 (HIV-1)
gaaguaguacaaggagc

SEQ ID NO: 4004863 - RNA, 13 nt, Human immunodeficiency virus 1 (HIV-1)
gacaccagggauu

SEQ ID NO: 4004864 - RNA, 15 nt, Human immunodeficiency virus 1 (HIV-1)
gaccagaucugagcc

SEQ ID NO: 4004865 - RNA, 16 nt, Human immunodeficiency virus 1 (HIV-1)
gagcugagccagcagc

SEQ ID NO: 4004866 - RNA, 16 nt, Human immunodeficiency virus 1 (HIV-1)
gauggggcaccaugcu

SEQ ID NO: 4004867 - RNA, 14 nt, Human immunodeficiency virus 1 (HIV-1)
gcaaauuaagagaa

SEQ ID NO: 4004868 - RNA, 14 nt, Human immunodeficiency virus 1 (HIV-1)
gcaauacagcagcu

SEQ ID NO: 4004869 - RNA, 16 nt, Human immunodeficiency virus 1 (HIV-1)
gcagucuagcagaaga

SEQ ID NO: 4004870 - RNA, 21 nt, Human immunodeficiency virus 1 (HIV-1)
gcaucuccuauggcaggaaga

SEQ ID NO: 4004871 - RNA, 18 nt, Human immunodeficiency virus 1 (HIV-1)
gccucuucagcuaccacc

SEQ ID NO: 4004872 - RNA, 21 nt, Human immunodeficiency virus 1 (HIV-1)
gcuauugaggcgcaacagcau

SEQ ID NO: 4004873 - RNA, 12 nt, Human immunodeficiency virus 1 (HIV-1)
ggacagauaggg

SEQ ID NO: 4004874 - RNA, 21 nt, Human immunodeficiency virus 1 (HIV-1)
ggcuaacuagggaacccacug

SEQ ID NO: 4004875 - RNA, 9 nt, Human immunodeficiency virus 1 (HIV-1)
ggggggacu

SEQ ID NO: 4004876 - RNA, 16 nt, Human immunodeficiency virus 1 (HIV-1)
guaauaaaucucugga

SEQ ID NO: 4004877 - RNA, 15 nt, Human immunodeficiency virus 1 (HIV-1)
guaauaccacuaaca

SEQ ID NO: 4004878 - RNA, 14 nt, Human immunodeficiency virus 1 (HIV-1)
guaccaguugagcc

SEQ ID NO: 4004879 - RNA, 17 nt, Human immunodeficiency virus 1 (HIV-1)
guuacacccugugagcc

SEQ ID NO: 4004880 - RNA, 17 nt, Human immunodeficiency virus 1 (HIV-1)
uaaaauuagcaggaaga

SEQ ID NO: 4004881 - RNA, 20 nt, Human immunodeficiency virus 1 (HIV-1)
uaacaccaaaaaagauaaag

SEQ ID NO: 4004882 - RNA, 18 nt, Human immunodeficiency virus 1 (HIV-1)
uacaagacccaacaacaa

SEQ ID NO: 4004883 - RNA, 15 nt, Human immunodeficiency virus 1 (HIV-1)
uacaauguacacaug

SEQ ID NO: 4004884 - RNA, 18 nt, Human immunodeficiency virus 1 (HIV-1)
uagaaucuaugaauaaag

SEQ ID NO: 4004885 - RNA, 22 nt, Human immunodeficiency virus 1 (HIV-1)
uagaggaaccaaagcacuaaca

SEQ ID NO: 4004886 - RNA, 16 nt, Human immunodeficiency virus 1 (HIV-1)
uagcaauacagcagcu

SEQ ID NO: 4004887 - RNA, 22 nt, Human immunodeficiency virus 1 (HIV-1)
uagcagaacuacacaccagggc

SEQ ID NO: 4004888 - RNA, 22 nt, Human immunodeficiency virus 1 (HIV-1)
uagcaguagcugaggggacaga

SEQ ID NO: 4004889 - RNA, 19 nt, Human immunodeficiency virus 1 (HIV-1)
uaggaaaauauuaagacaa

SEQ ID NO: 4004890 - RNA, 23 nt, Human immunodeficiency virus 1 (HIV-1)
uaggaaaauauuaagacaaagaa

SEQ ID NO: 4004891 - RNA, 14 nt, Human immunodeficiency virus 1 (HIV-1)
uagggugggagcag

SEQ ID NO: 4004892 - RNA, 19 nt, Human immunodeficiency virus 1 (HIV-1)
uaguacagcugaacacauc

SEQ ID NO: 4004893 - RNA, 15 nt, Human immunodeficiency virus 1 (HIV-1)
uaguaucaacucaac

SEQ ID NO: 4004894 - RNA, 20 nt, Human immunodeficiency virus 1 (HIV-1)
ucaaugccacagccauagca

SEQ ID NO: 4004895 - RNA, 22 nt, Human immunodeficiency virus 1 (HIV-1)
uccagagaggaccagggagagc

SEQ ID NO: 4004896 - RNA, 16 nt, Human immunodeficiency virus 1 (HIV-1)
uccggaguacuucaag

SEQ ID NO: 4004897 - RNA, 23 nt, Human immunodeficiency virus 1 (HIV-1)
ugagccugcaugggauggaugac

SEQ ID NO: 4004898 - RNA, 18 nt, Human immunodeficiency virus 1 (HIV-1)
ugaggcgcaacagcaucu

SEQ ID NO: 4004899 - RNA, 15 nt, Human immunodeficiency virus 1 (HIV-1)
ugcagaauaaaacaa

SEQ ID NO: 4004900 - RNA, 21 nt, Human immunodeficiency virus 1 (HIV-1)
ugcagagagaaaaaagagcag

SEQ ID NO: 4004901 - RNA, 22 nt, Human immunodeficiency virus 1 (HIV-1)
ugccucuucagcuaccaccgcu

SEQ ID NO: 4004902 - RNA, 18 nt, Human immunodeficiency virus 1 (HIV-1)
ugccuggcuagaagcaca

SEQ ID NO: 4004903 - RNA, 21 nt, Human immunodeficiency virus 1 (HIV-1)
uggaaaaacauggagcaauca

SEQ ID NO: 4004904 - RNA, 13 nt, Human immunodeficiency virus 1 (HIV-1)
uggaaaacucauu

SEQ ID NO: 4004905 - RNA, 22 nt, Human immunodeficiency virus 1 (HIV-1)
uggaaagauaccuaaaggauca

SEQ ID NO: 4004906 - RNA, 22 nt, Human immunodeficiency virus 1 (HIV-1)
uggggaguggcgagcccucaga

SEQ ID NO: 4004907 - RNA, 19 nt, Human immunodeficiency virus 1 (HIV-1)
uguacagagauggaaaagg

SEQ ID NO: 4004908 - RNA, 15 nt, Human immunodeficiency virus 1 (HIV-1)
uguaguccaggaaua

SEQ ID NO: 4004909 - RNA, 18 nt, Human immunodeficiency virus 1 (HIV-1)
uuggaaauaauaaaacaa

SEQ ID NO: 4004910 - RNA, 15 nt, Human immunodeficiency virus 1 (HIV-1)
uuggcacuagcagca

SEQ ID NO: 4004911 - RNA, 21 nt, Human immunodeficiency virus 1 (HIV-1)
guaccaguugagccagauaag

SEQ ID NO: 4004912 - RNA, 12 nt, Human immunodeficiency virus 1 (HIV-1)
guagaaauuaau

SEQ ID NO: 4004913 - RNA, 13 nt, Human immunodeficiency virus 1 (HIV-1)
guguaaaauuaac

SEQ ID NO: 4004914 - RNA, 16 nt, Human immunodeficiency virus 1 (HIV-1)
uaaaaaguguugcuuu

SEQ ID NO: 4004915 - RNA, 15 nt, Human immunodeficiency virus 1 (HIV-1)
uaacaaauuggcugu

SEQ ID NO: 4004916 - RNA, 19 nt, Human immunodeficiency virus 1 (HIV-1)
uaagaauaguuuuugcugu

SEQ ID NO: 4004917 - RNA, 16 nt, Human immunodeficiency virus 1 (HIV-1)
uaauucaacacaacug

SEQ ID NO: 4004918 - RNA, 20 nt, Human immunodeficiency virus 1 (HIV-1)
uacaggccagacaauuauug

SEQ ID NO: 4004919 - RNA, 13 nt, Human immunodeficiency virus 1 (HIV-1)
uaccaaugcugcu

SEQ ID NO: 4004920 - RNA, 14 nt, Human immunodeficiency virus 1 (HIV-1)
uaccacacacaagg

SEQ ID NO: 4004921 - RNA, 15 nt, Human immunodeficiency virus 1 (HIV-1)
uaccacacacaaggc

SEQ ID NO: 4004922 - RNA, 20 nt, Human immunodeficiency virus 1 (HIV-1)
uacuguaagggaaagaauga

SEQ ID NO: 4004923 - RNA, 16 nt, Human immunodeficiency virus 1 (HIV-1)
uagaacauggaaaagu

SEQ ID NO: 4004924 - RNA, 17 nt, Human immunodeficiency virus 1 (HIV-1)
uagagcuauucgccaca

SEQ ID NO: 4004925 - RNA, 19 nt, Human immunodeficiency virus 1 (HIV-1)
uagcuugcucaaugccaca

SEQ ID NO: 4004926 - RNA, 22 nt, Human immunodeficiency virus 1 (HIV-1)
uauucgccacauaccuagaaga

SEQ ID NO: 4004927 - RNA, 20 nt, Human immunodeficiency virus 1 (HIV-1)
ucagguaccuuuaagaccaa

SEQ ID NO: 4004928 - RNA, 21 nt, Human immunodeficiency virus 1 (HIV-1)
uccuuggguucuugggagcag

SEQ ID NO: 4004929 - RNA, 18 nt, Human immunodeficiency virus 1 (HIV-1)
ucuccuauggcaggaaga

SEQ ID NO: 4004930 - RNA, 20 nt, Human immunodeficiency virus 1 (HIV-1)
ucucugguuagaccagaucu

SEQ ID NO: 4004931 - RNA, 22 nt, Human immunodeficiency virus 1 (HIV-1)
ucugagccugggagcucucugg

SEQ ID NO: 4004932 - RNA, 20 nt, Human immunodeficiency virus 1 (HIV-1)
ugcacugauuugaagaauga

SEQ ID NO: 4004933 - RNA, 18 nt, Human immunodeficiency virus 1 (HIV-1)
ugcgauucuaaaauguaa

SEQ ID NO: 4004934 - RNA, 16 nt, Human immunodeficiency virus 1 (HIV-1)
uggcccgagagcugca

SEQ ID NO: 4004935 - RNA, 11 nt, Human immunodeficiency virus 1 (HIV-1)
ugggaagcccu

SEQ ID NO: 4004936 - RNA, 16 nt, Human immunodeficiency virus 1 (HIV-1)
ugggcaaguuugugga

SEQ ID NO: 4004937 - RNA, 22 nt, Human immunodeficiency virus 1 (HIV-1)
uggggcaccaugcuccuuggga

SEQ ID NO: 4004938 - RNA, 19 nt, Human immunodeficiency virus 1 (HIV-1)
uuaauaaaaaaggaaaagg

SEQ ID NO: 4004939 - RNA, 23 nt, Human immunodeficiency virus 1 (HIV-1)
uugccuguacugggucucucugg

SEQ ID NO: 4004940 - RNA, 18 nt, Human immunodeficiency virus 1 (HIV-1)
uugugccuggcuagaagc

SEQ ID NO: 4004941 - RNA, 21 nt, Human immunodeficiency virus 1 (HIV-1)
uuuccagggaggcguggccug

SEQ ID NO: 4004942 - RNA, 13 nt, Human immunodeficiency virus 1 (HIV-1)
uuugacagccgcc

SEQ ID NO: 4004943 - RNA, 19 nt, Human immunodeficiency virus 1 (HIV-1)
uuuguggaauugguuuaac

SEQ ID NO: 4004944 - RNA, 16 nt, Human immunodeficiency virus 1 (HIV-1)
aaaauaaccacagaaa

SEQ ID NO: 4004945 - RNA, 16 nt, Human immunodeficiency virus 1 (HIV-1)
aaaggauuuugcuaua

SEQ ID NO: 4004946 - RNA, 16 nt, Human immunodeficiency virus 1 (HIV-1)
aaaguaagacaguaug

SEQ ID NO: 4004947 - RNA, 20 nt, Human immunodeficiency virus 1 (HIV-1)
aaaugucagcuaaaaggaga

SEQ ID NO: 4004948 - RNA, 17 nt, Human immunodeficiency virus 1 (HIV-1)
aaauuuguacagagaug

SEQ ID NO: 4004949 - RNA, 18 nt, Human immunodeficiency virus 1 (HIV-1)
aacauuaguagagcaaaa

SEQ ID NO: 4004950 - RNA, 20 nt, Human immunodeficiency virus 1 (HIV-1)
gaacaucuuaagacagcagu

SEQ ID NO: 4004951 - RNA, 21 nt, Human immunodeficiency virus 1 (HIV-1)
gaacccacugcuuaagccuca

SEQ ID NO: 4004952 - RNA, 14 nt, Human immunodeficiency virus 1 (HIV-1)
gaacuacacaccag

SEQ ID NO: 4004953 - RNA, 21 nt, Human immunodeficiency virus 1 (HIV-1)
gaacuacacaccagggccagg

SEQ ID NO: 4004954 - RNA, 16 nt, Human immunodeficiency virus 1 (HIV-1)
gaagacuucaggaagu

SEQ ID NO: 4004955 - RNA, 18 nt, Human immunodeficiency virus 1 (HIV-1)
gaauccguauccagagag

SEQ ID NO: 4004956 - RNA, 10 nt, Human immunodeficiency virus 1 (HIV-1)
gacagagaaa

SEQ ID NO: 4004957 - RNA, 13 nt, Human immunodeficiency virus 1 (HIV-1)
gagagauaaaaaa

SEQ ID NO: 4004958 - RNA, 14 nt, Human immunodeficiency virus 1 (HIV-1)
gagcaaucacaagu

SEQ ID NO: 4004959 - RNA, 18 nt, Human immunodeficiency virus 1 (HIV-1)
gagucaggaacuaaagaa

SEQ ID NO: 4004960 - RNA, 22 nt, Human immunodeficiency virus 1 (HIV-1)
gcaaucacaaguagcaauacag

SEQ ID NO: 4004961 - RNA, 22 nt, Human immunodeficiency virus 1 (HIV-1)
gcagcaucucgagaccuggaaa

SEQ ID NO: 4004962 - RNA, 16 nt, Human immunodeficiency virus 1 (HIV-1)
gccacuuuuuaaaaga

SEQ ID NO: 4004963 - RNA, 14 nt, Human immunodeficiency virus 1 (HIV-1)
gcuagcaaauuaag

SEQ ID NO: 4004964 - RNA, 19 nt, Human immunodeficiency virus 1 (HIV-1)
ggaacagauuuggaaucac

SEQ ID NO: 4004965 - RNA, 23 nt, Human immunodeficiency virus 1 (HIV-1)
ggagaaauaucagcacuugugga

SEQ ID NO: 4004966 - RNA, 19 nt, Human immunodeficiency virus 1 (HIV-1)
ggauggagugggacagaga

SEQ ID NO: 4004967 - RNA, 14 nt, Human immunodeficiency virus 1 (HIV-1)
gguucuugggagca

SEQ ID NO: 4004968 - RNA, 15 nt, Human immunodeficiency virus 1 (HIV-1)
gucagauauccacug

SEQ ID NO: 4004969 - RNA, 22 nt, Human immunodeficiency virus 1 (HIV-1)
guccaaagguauccuuugagcc

SEQ ID NO: 4004970 - RNA, 18 nt, Human immunodeficiency virus 1 (HIV-1)
gugccucuucagcuacca

SEQ ID NO: 4004971 - RNA, 14 nt, Human immunodeficiency virus 1 (HIV-1)
guggaucuaccaca

SEQ ID NO: 4004972 - RNA, 17 nt, Human immunodeficiency virus 1 (HIV-1)
guuacucgacagaggag

SEQ ID NO: 4004973 - RNA, 12 nt, Human immunodeficiency virus 1 (HIV-1)
guugcucuggaa

SEQ ID NO: 4004974 - RNA, 19 nt, Human immunodeficiency virus 1 (HIV-1)
uaaacugcccauacaaaag

SEQ ID NO: 4004975 - RNA, 15 nt, Human immunodeficiency virus 1 (HIV-1)
uaacaauuacacaag

SEQ ID NO: 4004976 - RNA, 20 nt, Human immunodeficiency virus 1 (HIV-1)
uaauagaggaagacaaaaag

SEQ ID NO: 4004977 - RNA, 17 nt, Human immunodeficiency virus 1 (HIV-1)
uacacccugugagccug

SEQ ID NO: 4004978 - RNA, 22 nt, Human immunodeficiency virus 1 (HIV-1)
uacacuccuuaauugaagaauc

SEQ ID NO: 4004979 - RNA, 16 nt, Human immunodeficiency virus 1 (HIV-1)
uagcacccaccaaggc

SEQ ID NO: 4004980 - RNA, 13 nt, Human immunodeficiency virus 1 (HIV-1)
uagugcagcagca

SEQ ID NO: 4004981 - RNA, 19 nt, Human immunodeficiency virus 1 (HIV-1)
uaucagcacuuguggagau

SEQ ID NO: 4004982 - RNA, 23 nt, Human immunodeficiency virus 1 (HIV-1)
ucaaauauuacagggcugcuauu

SEQ ID NO: 4004983 - RNA, 23 nt, Human immunodeficiency virus 1 (HIV-1)
uggcaggaagaagcggagacagc

SEQ ID NO: 4004984 - RNA, 11 nt, Human immunodeficiency virus 1 (HIV-1)
ugggagcagca

SEQ ID NO: 4004985 - RNA, 21 nt, Human immunodeficiency virus 1 (HIV-1)
uuaagaccaaugacuuacaag

SEQ ID NO: 4004986 - RNA, 20 nt, Human immunodeficiency virus 1 (HIV-1)
uuacucgacagaggagagca

SEQ ID NO: 4004987 - RNA, 11 nt, Human immunodeficiency virus 1 (HIV-1)
uuaggaaaagc

SEQ ID NO: 4004988 - RNA, 12 nt, Human immunodeficiency virus 1 (HIV-1)
uugggagcagca

SEQ ID NO: 4004989 - RNA, 20 nt, Human immunodeficiency virus 1 (HIV-1)
uugucugguauagugcagca

SEQ ID NO: 4004990 - RNA, 23 nt, Human immunodeficiency virus 1 (HIV-1)
aaaaguagugugauuggauggcc

SEQ ID NO: 4004991 - RNA, 22 nt, Human immunodeficiency virus 1 (HIV-1)
aaaguaggaaaagcaauguaug

SEQ ID NO: 4004992 - RNA, 16 nt, Human immunodeficiency virus 1 (HIV-1)
aacagauggcagguga

SEQ ID NO: 4004993 - RNA, 18 nt, Human immunodeficiency virus 1 (HIV-1)
aagaauaagacagggcuu

SEQ ID NO: 4004994 - RNA, 22 nt, Human immunodeficiency virus 1 (HIV-1)
aagggacuuuccgcuggggacu

SEQ ID NO: 4004995 - RNA, 20 nt, Human immunodeficiency virus 1 (HIV-1)
aauagacagguuaauugaua

SEQ ID NO: 4004996 - RNA, 14 nt, Human immunodeficiency virus 1 (HIV-1)
aaucaaauaauaga

SEQ ID NO: 4004997 - RNA, 22 nt, Human immunodeficiency virus 1 (HIV-1)
acaauuacacaagcuuaauaca

SEQ ID NO: 4004998 - RNA, 12 nt, Human immunodeficiency virus 1 (HIV-1)
acacaaugaaug

SEQ ID NO: 4004999 - RNA, 16 nt, Human immunodeficiency virus 1 (HIV-1)
acacaccagggccagg

SEQ ID NO: 4005000 - RNA, 13 nt, Human immunodeficiency virus 1 (HIV-1)
acacuuuaaaaca

SEQ ID NO: 4005001 - RNA, 19 nt, Human immunodeficiency virus 1 (HIV-1)
acagaaaauuuuaacaugu

SEQ ID NO: 4005002 - RNA, 22 nt, Human immunodeficiency virus 1 (HIV-1)
acagacauacaaacuaaagaau

SEQ ID NO: 4005003 - RNA, 16 nt, Human immunodeficiency virus 1 (HIV-1)
acaguauuagaagaaa

SEQ ID NO: 4005004 - RNA, 16 nt, Human immunodeficiency virus 1 (HIV-1)
acauaccuagaagaau

SEQ ID NO: 4005005 - RNA, 17 nt, Human immunodeficiency virus 1 (HIV-1)
accaauagauaaugaua

SEQ ID NO: 4005006 - RNA, 20 nt, Human immunodeficiency virus 1 (HIV-1)
accagcuauaaguugacaag

SEQ ID NO: 4005007 - RNA, 20 nt, Human immunodeficiency virus 1 (HIV-1)
gagccugggagcucucuggc

SEQ ID NO: 4005008 - RNA, 17 nt, Human immunodeficiency virus 1 (HIV-1)
gcaagaauccuggcugu

SEQ ID NO: 4005009 - RNA, 11 nt, Human immunodeficiency virus 1 (HIV-1)
gcaccacugcu

SEQ ID NO: 4005010 - RNA, 23 nt, Human immunodeficiency virus 1 (HIV-1)
gcacccaccaaggcaaagagaag

SEQ ID NO: 4005011 - RNA, 14 nt, Human immunodeficiency virus 1 (HIV-1)
gcaggggaaagaau

SEQ ID NO: 4005012 - RNA, 17 nt, Human immunodeficiency virus 1 (HIV-1)
gccacuuuuuaaaagaa

SEQ ID NO: 4005013 - RNA, 17 nt, Human immunodeficiency virus 1 (HIV-1)
gcuauaagauggguggc

SEQ ID NO: 4005014 - RNA, 22 nt, Human immunodeficiency virus 1 (HIV-1)
ggaaggaagcaaccaccacucu

SEQ ID NO: 4005015 - RNA, 17 nt, Human immunodeficiency virus 1 (HIV-1)
ggagcagcaggaagcac

SEQ ID NO: 4005016 - RNA, 23 nt, Human immunodeficiency virus 1 (HIV-1)
ggcuaacuagggaacccacugcu

SEQ ID NO: 4005017 - RNA, 21 nt, Human immunodeficiency virus 1 (HIV-1)
gggacgaucugcggagccugu

SEQ ID NO: 4005018 - RNA, 16 nt, Human immunodeficiency virus 1 (HIV-1)
acccugugagccugca

SEQ ID NO: 4005019 - RNA, 15 nt, Human immunodeficiency virus 1 (HIV-1)
acgagcugagccagc

SEQ ID NO: 4005020 - RNA, 16 nt, Human immunodeficiency virus 1 (HIV-1)
acuggcagaaaacaga

SEQ ID NO: 4005021 - RNA, 13 nt, Human immunodeficiency virus 1 (HIV-1)
agaaaaauugugg

SEQ ID NO: 4005022 - RNA, 18 nt, Human immunodeficiency virus 1 (HIV-1)
agaacagaugcaugagga

SEQ ID NO: 4005023 - RNA, 13 nt, Human immunodeficiency virus 1 (HIV-1)
agaagcacaagag

SEQ ID NO: 4005024 - RNA, 19 nt, Human immunodeficiency virus 1 (HIV-1)
agaaucuaugaauaaagaa

SEQ ID NO: 4005025 - RNA, 16 nt, Human immunodeficiency virus 1 (HIV-1)
agacaguggcaaugag

SEQ ID NO: 4005026 - RNA, 13 nt, Human immunodeficiency virus 1 (HIV-1)
agacuucaggaag

SEQ ID NO: 4005027 - RNA, 15 nt, Human immunodeficiency virus 1 (HIV-1)
agaucugagccuggg

SEQ ID NO: 4005028 - RNA, 19 nt, Human immunodeficiency virus 1 (HIV-1)
agcaaauuaagagaacaau

SEQ ID NO: 4005029 - RNA, 13 nt, Human immunodeficiency virus 1 (HIV-1)
agcaagaaaagaa

SEQ ID NO: 4005030 - RNA, 18 nt, Human immunodeficiency virus 1 (HIV-1)
agcaagaaauggagccag

SEQ ID NO: 4005031 - RNA, 18 nt, Human immunodeficiency virus 1 (HIV-1)
agcaggacauaacaaggu

SEQ ID NO: 4005032 - RNA, 21 nt, Human immunodeficiency virus 1 (HIV-1)
agcccucaaauauugguggaa

SEQ ID NO: 4005033 - RNA, 13 nt, Human immunodeficiency virus 1 (HIV-1)
agccucaauaaag

SEQ ID NO: 4005034 - RNA, 17 nt, Human immunodeficiency virus 1 (HIV-1)
aggaaaauaugcaagaa

SEQ ID NO: 4005035 - RNA, 14 nt, Human immunodeficiency virus 1 (HIV-1)
aggcguggccuggg

SEQ ID NO: 4005036 - RNA, 21 nt, Human immunodeficiency virus 1 (HIV-1)
agggauuauggaaaacagaug

SEQ ID NO: 4005037 - RNA, 23 nt, Human immunodeficiency virus 1 (HIV-1)
agggucaaauaacacugaaggaa

SEQ ID NO: 4005038 - RNA, 18 nt, Human immunodeficiency virus 1 (HIV-1)
aguaaacauaguaacaga

SEQ ID NO: 4005039 - RNA, 17 nt, Human immunodeficiency virus 1 (HIV-1)
aguacuucaagaacugc

SEQ ID NO: 4005040 - RNA, 18 nt, Human immunodeficiency virus 1 (HIV-1)
aguagugccaagaagaaa

SEQ ID NO: 4005041 - RNA, 23 nt, Human immunodeficiency virus 1 (HIV-1)
aguccgagaucuucagaccugga

SEQ ID NO: 4005042 - RNA, 19 nt, Human immunodeficiency virus 1 (HIV-1)
agugugauuggauggccua

SEQ ID NO: 4005043 - RNA, 13 nt, Human immunodeficiency virus 1 (HIV-1)
auaauagcaauag

SEQ ID NO: 4005044 - RNA, 15 nt, Human immunodeficiency virus 1 (HIV-1)
auacaagaaaaagaa

SEQ ID NO: 4005045 - RNA, 16 nt, Human immunodeficiency virus 1 (HIV-1)
auagaauggaggaaaa

SEQ ID NO: 4005046 - RNA, 14 nt, Human immunodeficiency virus 1 (HIV-1)
auauccacugaccu

SEQ ID NO: 4005047 - RNA, 23 nt, Human immunodeficiency virus 1 (HIV-1)
auauccacugaccuuuggauggu

SEQ ID NO: 4005048 - RNA, 15 nt, Human immunodeficiency virus 1 (HIV-1)
auauuaagacaaaga

SEQ ID NO: 4005049 - RNA, 17 nt, Human immunodeficiency virus 1 (HIV-1)
aucuccuauggcaggaa

SEQ ID NO: 4005050 - RNA, 15 nt, Human immunodeficiency virus 1 (HIV-1)
aucucgagaccugga

SEQ ID NO: 4005051 - RNA, 17 nt, Human immunodeficiency virus 1 (HIV-1)
augagagugaaggagaa

SEQ ID NO: 4005052 - RNA, 17 nt, Human immunodeficiency virus 1 (HIV-1)
augaguuugccaggaag

SEQ ID NO: 4005053 - RNA, 15 nt, Human immunodeficiency virus 1 (HIV-1)
augauaauggagaaa

SEQ ID NO: 4005054 - RNA, 16 nt, Human immunodeficiency virus 1 (HIV-1)
augcuaguuggaguaa

SEQ ID NO: 4005055 - RNA, 13 nt, Human immunodeficiency virus 1 (HIV-1)
auggaaaacagau

SEQ ID NO: 4005056 - RNA, 19 nt, Human immunodeficiency virus 1 (HIV-1)
augggauggaugacccgga

SEQ ID NO: 4005057 - RNA, 15 nt, Human immunodeficiency virus 1 (HIV-1)
auuaagagaacaauu

SEQ ID NO: 4005058 - RNA, 18 nt, Human immunodeficiency virus 1 (HIV-1)
caaggcaaagagaagagu

SEQ ID NO: 4005059 - RNA, 14 nt, Human immunodeficiency virus 1 (HIV-1)
caauuuuaaaagaa

SEQ ID NO: 4005060 - RNA, 12 nt, Human immunodeficiency virus 1 (HIV-1)
cacaagaggagg

SEQ ID NO: 4005061 - RNA, 16 nt, Human immunodeficiency virus 1 (HIV-1)
cacaauuuuaaaagaa

SEQ ID NO: 4005062 - RNA, 12 nt, Human immunodeficiency virus 1 (HIV-1)
caccagcaauau

SEQ ID NO: 4005063 - RNA, 14 nt, Human immunodeficiency virus 1 (HIV-1)
cacccugugagccu

SEQ ID NO: 4005064 - RNA, 16 nt, Human immunodeficiency virus 1 (HIV-1)
cagacccaccucccaa

SEQ ID NO: 4005065 - RNA, 20 nt, Human immunodeficiency virus 1 (HIV-1)
cagagaacuuaauaagagaa

SEQ ID NO: 4005066 - RNA, 14 nt, Human immunodeficiency virus 1 (HIV-1)
cagagaggaccagg

SEQ ID NO: 4005067 - RNA, 13 nt, Human immunodeficiency virus 1 (HIV-1)
cagaucugagccu

SEQ ID NO: 4005068 - RNA, 14 nt, Human immunodeficiency virus 1 (HIV-1)
cagcaagaaaagaa

SEQ ID NO: 4005069 - RNA, 17 nt, Human immunodeficiency virus 1 (HIV-1)
cagcuaccaccgcuuga

SEQ ID NO: 4005070 - RNA, 20 nt, Human immunodeficiency virus 1 (HIV-1)
cagggaggcguggccugggc

SEQ ID NO: 4005071 - RNA, 16 nt, Human immunodeficiency virus 1 (HIV-1)
cagggcuuggaaagga

SEQ ID NO: 4005072 - RNA, 16 nt, Human immunodeficiency virus 1 (HIV-1)
caguauuggagucagg

SEQ ID NO: 4005073 - RNA, 19 nt, Human immunodeficiency virus 1 (HIV-1)
caguggacaaauuagaugu

SEQ ID NO: 4005074 - RNA, 13 nt, Human immunodeficiency virus 1 (HIV-1)
ccagaucugagcc

SEQ ID NO: 4005075 - RNA, 20 nt, Human immunodeficiency virus 1 (HIV-1)
ccagcagcagauaggguggg

SEQ ID NO: 4005076 - RNA, 13 nt, Human immunodeficiency virus 1 (HIV-1)
ccauuuucagaau

SEQ ID NO: 4005077 - RNA, 18 nt, Human immunodeficiency virus 1 (HIV-1)
ccgcuugagagacuuacu

SEQ ID NO: 4005078 - RNA, 21 nt, Human immunodeficiency virus 1 (HIV-1)
cugaacaucuuaagacagcag

SEQ ID NO: 4005079 - RNA, 12 nt, Human immunodeficiency virus 1 (HIV-1)
cugagccuggga

SEQ ID NO: 4005080 - RNA, 14 nt, Human immunodeficiency virus 1 (HIV-1)
cugagccugggagc

SEQ ID NO: 4005081 - RNA, 14 nt, Human immunodeficiency virus 1 (HIV-1)
cugcuauuaacaag

SEQ ID NO: 4005082 - RNA, 16 nt, Human immunodeficiency virus 1 (HIV-1)
cugcugacaucgagcu

SEQ ID NO: 4005083 - RNA, 12 nt, Human immunodeficiency virus 1 (HIV-1)
cugcuuaagccu

SEQ ID NO: 4005084 - RNA, 20 nt, Human immunodeficiency virus 1 (HIV-1)
cugggacgaucugcggagcc

SEQ ID NO: 4005085 - RNA, 22 nt, Human immunodeficiency virus 1 (HIV-1)
cugguuagaccagaucugagcc

SEQ ID NO: 4005086 - RNA, 15 nt, Human immunodeficiency virus 1 (HIV-1)
cuguacugggucucu

SEQ ID NO: 4005087 - RNA, 19 nt, Human immunodeficiency virus 1 (HIV-1)
cuuggcacuuaucugggac

SEQ ID NO: 4005088 - RNA, 22 nt, Human immunodeficiency virus 1 (HIV-1)
gaaaaggggggacuggaagggc

SEQ ID NO: 4005089 - RNA, 16 nt, Human immunodeficiency virus 1 (HIV-1)
gaagccauaauaagaa

SEQ ID NO: 4005090 - RNA, 23 nt, Human immunodeficiency virus 1 (HIV-1)
gaauaggcguuacucgacagagg

SEQ ID NO: 4005091 - RNA, 16 nt, Human immunodeficiency virus 1 (HIV-1)
gaccagaucugagccu

SEQ ID NO: 4005092 - RNA, 20 nt, Human immunodeficiency virus 1 (HIV-1)
gacuagagcccuggaagcau

SEQ ID NO: 4005093 - RNA, 17 nt, Human immunodeficiency virus 1 (HIV-1)
gagcccucagauccugc

SEQ ID NO: 4005094 - RNA, 18 nt, Human immunodeficiency virus 1 (HIV-1)
ugugcuuccacagggaug

SEQ ID NO: 4005095 - RNA, 13 nt, Human immunodeficiency virus 1 (HIV-1)
uuacccagggauu

SEQ ID NO: 4005096 - RNA, 18 nt, Human immunodeficiency virus 1 (HIV-1)
uuguaacgaggauugugg

SEQ ID NO: 4005097 - RNA, 15 nt, Human immunodeficiency virus 1 (HIV-1)
uuuagaaggaaaagu

SEQ ID NO: 4005098 - RNA, 22 nt, Human immunodeficiency virus 1 (HIV-1)
uuuuagaggagcuuaagaauga

SEQ ID NO: 4005099 - RNA, 13 nt, Human immunodeficiency virus 1 [HIV-1]
aaaaagagcagug

SEQ ID NO: 4005100 - RNA, 17 nt, Human immunodeficiency virus 1 [HIV-1]
aaaaagagcagugggaa

SEQ ID NO: 4005101 - RNA, 12 nt, Human immunodeficiency virus 1 [HIV-1]
aaacaauacaua

SEQ ID NO: 4005102 - RNA, 20 nt, Human immunodeficiency virus 1 [HIV-1]
aaacagauagcuagcaaauu

SEQ ID NO: 4005103 - RNA, 20 nt, Human immunodeficiency virus 1 [HIV-1]
aaaccauaauaguacagcug

SEQ ID NO: 4005104 - RNA, 17 nt, Human immunodeficiency virus 1 [HIV-1]
aaagaaaaaagacagua

SEQ ID NO: 4005105 - RNA, 16 nt, Human immunodeficiency virus 1 [HIV-1]
aaagaaaaaaucagua

SEQ ID NO: 4005106 - RNA, 18 nt, Human immunodeficiency virus 1 [HIV-1]
aaagcuauagguacagua

SEQ ID NO: 4005107 - RNA, 15 nt, Human immunodeficiency virus 1 [HIV-1]
aaauaugcaagaaug

SEQ ID NO: 4005108 - RNA, 16 nt, Human immunodeficiency virus 1 [HIV-1]
aacacaucuguagaaa

SEQ ID NO: 4005109 - RNA, 16 nt, Human immunodeficiency virus 1 [HIV-1]
aacaccaaaaaagaua

SEQ ID NO: 4005110 - RNA, 20 nt, Human immunodeficiency virus 1 [HIV-1]
aacagacauacaaacuaaag

SEQ ID NO: 4005111 - RNA, 15 nt, Human immunodeficiency virus 1 [HIV-1]
aaccagcaagaaaag

SEQ ID NO: 4005112 - RNA, 13 nt, Human immunodeficiency virus 1 [HIV-1]
aacuaaagaauag

SEQ ID NO: 4005113 - RNA, 12 nt, Human immunodeficiency virus 1 [HIV-1]
aagaacugcuga

SEQ ID NO: 4005114 - RNA, 13 nt, Human immunodeficiency virus 1 [HIV-1]
aagaagguggaga

SEQ ID NO: 4005115 - RNA, 17 nt, Human immunodeficiency virus 1 [HIV-1]
aagacaagauauccuug

SEQ ID NO: 4005116 - RNA, 15 nt, Human immunodeficiency virus 1 [HIV-1]
aaggaucaacagcuc

SEQ ID NO: 4005117 - RNA, 19 nt, Human immunodeficiency virus 1 [HIV-1]
aaguuuguuucauaacaaa

SEQ ID NO: 4005118 - RNA, 16 nt, Human immunodeficiency virus 1 [HIV-1]
aauagugcuguuagcu

SEQ ID NO: 4005119 - RNA, 14 nt, Human immunodeficiency virus 1 [HIV-1]
aauuacaaaaacaa

SEQ ID NO: 4005120 - RNA, 14 nt, Human immunodeficiency virus 1 [HIV-1]
acaaauuauaaaca

SEQ ID NO: 4005121 - RNA, 24 nt, Human immunodeficiency virus 1 [HIV-1]
acaaauuauaaacauguggcagaa

SEQ ID NO: 4005122 - RNA, 16 nt, Human immunodeficiency virus 1 [HIV-1]
acaacuguuuaauagu

SEQ ID NO: 4005123 - RNA, 16 nt, Human immunodeficiency virus 1 [HIV-1]
acacauuuagaaggaa

SEQ ID NO: 4005124 - RNA, 23 nt, Human immunodeficiency virus 1 [HIV-1]
acaccagggauuagauaucagua

SEQ ID NO: 4005125 - RNA, 13 nt, Human immunodeficiency virus 1 [HIV-1]
acacccugugagc

SEQ ID NO: 4005126 - RNA, 14 nt, Human immunodeficiency virus 1 [HIV-1]
acacccugugagcc

SEQ ID NO: 4005127 - RNA, 22 nt, Human immunodeficiency virus 1 [HIV-1]
acaccucagguaccuuuaagac

SEQ ID NO: 4005128 - RNA, 21 nt, Human immunodeficiency virus 1 [HIV-1]
acagaagaaaaaauaaaagca

SEQ ID NO: 4005129 - RNA, 17 nt, Human immunodeficiency virus 1 [HIV-1]
acagauccauucgauua

SEQ ID NO: 4005130 - RNA, 20 nt, Human immunodeficiency virus 1 [HIV-1]
acaucagaaagaaccuccau

SEQ ID NO: 4005131 - RNA, 18 nt, Human immunodeficiency virus 1 [HIV-1]
accaaaaaagauaaagcc

SEQ ID NO: 4005132 - RNA, 21 nt, Human immunodeficiency virus 1 [HIV-1]
accaaugcugcuugugccugg

SEQ ID NO: 4005133 - RNA, 13 nt, Human immunodeficiency virus 1 [HIV-1]
accagcaagaaaa

SEQ ID NO: 4005134 - RNA, 23 nt, Human immunodeficiency virus 1 [HIV-1]
accagcuuguuacacccugugag

SEQ ID NO: 4005135 - RNA, 12 nt, Human immunodeficiency virus 1 [HIV-1]
accaguugagcc

SEQ ID NO: 4005136 - RNA, 18 nt, Human immunodeficiency virus 1 [HIV-1]
accauaauaguacagcug

SEQ ID NO: 4005137 - RNA, 14 nt, Human immunodeficiency virus 1 [HIV-1]
acccauaguaggag

SEQ ID NO: 4005138 - RNA, 19 nt, Human immunodeficiency virus 1 [HIV-1]
accuggauggagugggaca

SEQ ID NO: 4005139 - RNA, 23 nt, Human immunodeficiency virus 1 [HIV-1]
acuaaauggagaaaauuaguaga

SEQ ID NO: 4005140 - RNA, 20 nt, Human immunodeficiency virus 1 [HIV-1]
acuagagcuuuuagaggagc

SEQ ID NO: 4005141 - RNA, 17 nt, Human immunodeficiency virus 1 [HIV-1]
acucgacagaggagagc

SEQ ID NO: 4005142 - RNA, 20 nt, Human immunodeficiency virus 1 [HIV-1]
acugcccauacaaaaggaaa

SEQ ID NO: 4005143 - RNA, 14 nt, Human immunodeficiency virus 1 [HIV-1]
acugcugacaucga

SEQ ID NO: 4005144 - RNA, 23 nt, Human immunodeficiency virus 1 [HIV-1]
acugcuuaagccucaauaaagcu

SEQ ID NO: 4005145 - RNA, 19 nt, Human immunodeficiency virus 1 [HIV-1]
acuuucuauagugaauaga

SEQ ID NO: 4005146 - RNA, 13 nt, Human immunodeficiency virus 1 [HIV-1]
agaagaauaagac

SEQ ID NO: 4005147 - RNA, 16 nt, Human immunodeficiency virus 1 [HIV-1]
agaagaguggugcaga

SEQ ID NO: 4005148 - RNA, 21 nt, Human immunodeficiency virus 1 [HIV-1]
agaauggaggaaaaagagaua

SEQ ID NO: 4005149 - RNA, 16 nt, Human immunodeficiency virus 1 [HIV-1]
agaccagaucugagcc

SEQ ID NO: 4005150 - RNA, 20 nt, Human immunodeficiency virus 1 [HIV-1]
agaccagaucugagccuggg

SEQ ID NO: 4005151 - RNA, 15 nt, Human immunodeficiency virus 1 [HIV-1]
agacuaauagaaaga

SEQ ID NO: 4005152 - RNA, 22 nt, Human immunodeficiency virus 1 [HIV-1]
agacuguaccaguaaaauuaaa

SEQ ID NO: 4005153 - RNA, 18 nt, Human immunodeficiency virus 1 [HIV-1]
agagaaaaaagagcagug

SEQ ID NO: 4005154 - RNA, 16 nt, Human immunodeficiency virus 1 [HIV-1]
agagagaaaaaagagc

SEQ ID NO: 4005155 - RNA, 15 nt, Human immunodeficiency virus 1 [HIV-1]
agagcaagaaaugga

SEQ ID NO: 4005156 - RNA, 21 nt, Human immunodeficiency virus 1 [HIV-1]
agagcaguuaauaaaaaagga

SEQ ID NO: 4005157 - RNA, 18 nt, Human immunodeficiency virus 1 [HIV-1]
agaggccaauaaaggaga

SEQ ID NO: 4005158 - RNA, 21 nt, Human immunodeficiency virus 1 [HIV-1]
agaggccaauaaaggagagaa

SEQ ID NO: 4005159 - RNA, 13 nt, Human immunodeficiency virus 1 [HIV-1]
agaucugagccug

SEQ ID NO: 4005160 - RNA, 17 nt, Human immunodeficiency virus 1 [HIV-1]
agauuuacccagggauu

SEQ ID NO: 4005161 - RNA, 19 nt, Human immunodeficiency virus 1 [HIV-1]
agcaagaaauggagccagu

SEQ ID NO: 4005162 - RNA, 16 nt, Human immunodeficiency virus 1 [HIV-1]
agcaauaauaauagca

SEQ ID NO: 4005163 - RNA, 21 nt, Human immunodeficiency virus 1 [HIV-1]
agcaauacagcagcuaccaau

SEQ ID NO: 4005164 - RNA, 17 nt, Human immunodeficiency virus 1 [HIV-1]
agcagaagacaguggca

SEQ ID NO: 4005165 - RNA, 15 nt, Human immunodeficiency virus 1 [HIV-1]
agcagauaggguggg

SEQ ID NO: 4005166 - RNA, 21 nt, Human immunodeficiency virus 1 [HIV-1]
agcagcaucucgagaccugga

SEQ ID NO: 4005167 - RNA, 19 nt, Human immunodeficiency virus 1 [HIV-1]
agccucaauaaagcuugcc

SEQ ID NO: 4005168 - RNA, 17 nt, Human immunodeficiency virus 1 [HIV-1]
agccugggagcucucug

SEQ ID NO: 4005169 - RNA, 19 nt, Human immunodeficiency virus 1 [HIV-1]
agccugggagcucucuggc

SEQ ID NO: 4005170 - RNA, 20 nt, Human immunodeficiency virus 1 [HIV-1]
agccugggagcucucuggcu

SEQ ID NO: 4005171 - RNA, 22 nt, Human immunodeficiency virus 1 [HIV-1]
agccugugccucuucagcuacc

SEQ ID NO: 4005172 - RNA, 15 nt, Human immunodeficiency virus 1 [HIV-1]
agcuaguaccaguug

SEQ ID NO: 4005173 - RNA, 21 nt, Human immunodeficiency virus 1 [HIV-1]
agcuaguaccaguugagccag

SEQ ID NO: 4005174 - RNA, 20 nt, Human immunodeficiency virus 1 [HIV-1]
aggaaaauaugcaagaauga

SEQ ID NO: 4005175 - RNA, 14 nt, Human immunodeficiency virus 1 [HIV-1]
aggccaauaaagga

SEQ ID NO: 4005176 - RNA, 14 nt, Human immunodeficiency virus 1 [HIV-1]
agggauggaaagga

SEQ ID NO: 4005177 - RNA, 15 nt, Human immunodeficiency virus 1 [HIV-1]
agggcuuggaaagga

SEQ ID NO: 4005178 - RNA, 19 nt, Human immunodeficiency virus 1 [HIV-1]
aggggcaguaguaauacaa

SEQ ID NO: 4005179 - RNA, 13 nt, Human immunodeficiency virus 1 [HIV-1]
aguaaaaacaaua

SEQ ID NO: 4005180 - RNA, 16 nt, Human immunodeficiency virus 1 [HIV-1]
aguacauguaaugcaa

SEQ ID NO: 4005181 - RNA, 24 nt, Human immunodeficiency virus 1 [HIV-1]
agucaggaacuaaagaauagugcu

SEQ ID NO: 4005182 - RNA, 11 nt, Human immunodeficiency virus 1 [HIV-1]
agugaauagag

SEQ ID NO: 4005183 - RNA, 14 nt, Human immunodeficiency virus 1 [HIV-1]
aguggcgagcccuc

SEQ ID NO: 4005184 - RNA, 21 nt, Human immunodeficiency virus 1 [HIV-1]
aaaauaggaaauaugagacaa

SEQ ID NO: 4005185 - RNA, 22 nt, Human immunodeficiency virus 1 [HIV-1]
aaagaauagugcuguuagcuug

SEQ ID NO: 4005186 - RNA, 14 nt, Human immunodeficiency virus 1 [HIV-1]
auaaaaaaggaaaa

SEQ ID NO: 4005187 - RNA, 18 nt, Human immunodeficiency virus 1 [HIV-1]
auaaagaauuaaagaaaa

SEQ ID NO: 4005188 - RNA, 23 nt, Human immunodeficiency virus 1 [HIV-1]
auaaaugucagcuaaaaggagaa

SEQ ID NO: 4005189 - RNA, 13 nt, Human immunodeficiency virus 1 [HIV-1]
auaagcagcugcu

SEQ ID NO: 4005190 - RNA, 14 nt, Human immunodeficiency virus 1 [HIV-1]
auaauaaaacaaua

SEQ ID NO: 4005191 - RNA, 23 nt, Human immunodeficiency virus 1 [HIV-1]
auacagcagcuaccaaugcugcu

SEQ ID NO: 4005192 - RNA, 22 nt, Human immunodeficiency virus 1 [HIV-1]
auagacuaauagaaagagcaga

SEQ ID NO: 4005193 - RNA, 14 nt, Human immunodeficiency virus 1 [HIV-1]
auagugcagcagca

SEQ ID NO: 4005194 - RNA, 20 nt, Human immunodeficiency virus 1 [HIV-1]
auaucagcacuuguggagau

SEQ ID NO: 4005195 - RNA, 11 nt, Human immunodeficiency virus 1 [HIV-1]
aucaaaguaag

SEQ ID NO: 4005196 - RNA, 22 nt, Human immunodeficiency virus 1 [HIV-1]
auccugcauauaagcagcugcu

SEQ ID NO: 4005197 - RNA, 18 nt, Human immunodeficiency virus 1 [HIV-1]
aucuccuauggcaggaag

SEQ ID NO: 4005198 - RNA, 18 nt, Human immunodeficiency virus 1 [HIV-1]
aucuguggacauaaagcu

SEQ ID NO: 4005199 - RNA, 18 nt, Human immunodeficiency virus 1 [HIV-1]
aucuucagaccuggagga

SEQ ID NO: 4005200 - RNA, 18 nt, Human immunodeficiency virus 1 [HIV-1]
augacccggagagagaag

SEQ ID NO: 4005201 - RNA, 16 nt, Human immunodeficiency virus 1 [HIV-1]
augacuuacaaggcag

SEQ ID NO: 4005202 - RNA, 18 nt, Human immunodeficiency virus 1 [HIV-1]
augagagugaaggagaaa

SEQ ID NO: 4005203 - RNA, 16 nt, Human immunodeficiency virus 1 [HIV-1]
auggagaaaggagaga

SEQ ID NO: 4005204 - RNA, 14 nt, Human immunodeficiency virus 1 [HIV-1]
auggagccaguaga

SEQ ID NO: 4005205 - RNA, 15 nt, Human immunodeficiency virus 1 [HIV-1]
auggaggaaaaagag

SEQ ID NO: 4005206 - RNA, 19 nt, Human immunodeficiency virus 1 [HIV-1]
auggagugggacagagaaa

SEQ ID NO: 4005207 - RNA, 21 nt, Human immunodeficiency virus 1 [HIV-1]
auggcagucuagcagaagaag

SEQ ID NO: 4005208 - RNA, 23 nt, Human immunodeficiency virus 1 [HIV-1]
auggguaccagcacacaaaggaa

SEQ ID NO: 4005209 - RNA, 15 nt, Human immunodeficiency virus 1 [HIV-1]
auguggaaaaaugac

SEQ ID NO: 4005210 - RNA, 15 nt, Human immunodeficiency virus 1 [HIV-1]
auguggcagaaagua

SEQ ID NO: 4005211 - RNA, 23 nt, Human immunodeficiency virus 1 [HIV-1]
auucgauuagugaacggauccuu

SEQ ID NO: 4005212 - RNA, 15 nt, Human immunodeficiency virus 1 [HIV-1]
auugacagaagaaaa

SEQ ID NO: 4005213 - RNA, 13 nt, Human immunodeficiency virus 1 [HIV-1]
auuuuaaaagaaa

SEQ ID NO: 4005214 - RNA, 20 nt, Human immunodeficiency virus 1 [HIV-1]
caaaaccagcaagaaaagaa

SEQ ID NO: 4005215 - RNA, 22 nt, Human immunodeficiency virus 1 [HIV-1]
caaacuaaagaauuacaaaaac

SEQ ID NO: 4005216 - RNA, 21 nt, Human immunodeficiency virus 1 [HIV-1]
caaaugucagcacaguacaau

SEQ ID NO: 4005217 - RNA, 14 nt, Human immunodeficiency virus 1 [HIV-1]
caagagaugguggu

SEQ ID NO: 4005218 - RNA, 13 nt, Human immunodeficiency virus 1 [HIV-1]
caaguagacagga

SEQ ID NO: 4005219 - RNA, 17 nt, Human immunodeficiency virus 1 [HIV-1]
caaucacaaguagcaau

SEQ ID NO: 4005220 - RNA, 15 nt, Human immunodeficiency virus 1 [HIV-1]
cacaaguagcaauac

SEQ ID NO: 4005221 - RNA, 22 nt, Human immunodeficiency virus 1 [HIV-1]
cacacgaccuggauggaguggg

SEQ ID NO: 4005222 - RNA, 18 nt, Human immunodeficiency virus 1 [HIV-1]
caccaaggcaaagagaag

SEQ ID NO: 4005223 - RNA, 18 nt, Human immunodeficiency virus 1 [HIV-1]
cacccugugagccugcau

SEQ ID NO: 4005224 - RNA, 16 nt, Human immunodeficiency virus 1 [HIV-1]
cacuaugggcgcagcc

SEQ ID NO: 4005225 - RNA, 14 nt, Human immunodeficiency virus 1 [HIV-1]
cagaaauacagaag

SEQ ID NO: 4005226 - RNA, 18 nt, Human immunodeficiency virus 1 [HIV-1]
cagaacuacacaccaggg

SEQ ID NO: 4005227 - RNA, 22 nt, Human immunodeficiency virus 1 [HIV-1]
cagacaaaaaacaucagaaaga

SEQ ID NO: 4005228 - RNA, 21 nt, Human immunodeficiency virus 1 [HIV-1]
cagaggagagcaagaaaugga

SEQ ID NO: 4005229 - RNA, 19 nt, Human immunodeficiency virus 1 [HIV-1]
cagauagggugggagcagc

SEQ ID NO: 4005230 - RNA, 19 nt, Human immunodeficiency virus 1 [HIV-1]
cagauccugcauauaagca

SEQ ID NO: 4005231 - RNA, 21 nt, Human immunodeficiency virus 1 [HIV-1]
cagcagauagggugggagcag

SEQ ID NO: 4005232 - RNA, 12 nt, Human immunodeficiency virus 1 [HIV-1]
cagcagcagaac

SEQ ID NO: 4005233 - RNA, 19 nt, Human immunodeficiency virus 1 [HIV-1]
cagcuaccaccgcuugaga

SEQ ID NO: 4005234 - RNA, 23 nt, Human immunodeficiency virus 1 [HIV-1]
cagcuuguuacacccugugagcc

SEQ ID NO: 4005235 - RNA, 19 nt, Human immunodeficiency virus 1 [HIV-1]
caggaacuaaagaauagug

SEQ ID NO: 4005236 - RNA, 14 nt, Human immunodeficiency virus 1 [HIV-1]
caggaguggaagcc

SEQ ID NO: 4005237 - RNA, 21 nt, Human immunodeficiency virus 1 [HIV-1]
caggauauguuacuaauagag

SEQ ID NO: 4005238 - RNA, 20 nt, Human immunodeficiency virus 1 [HIV-1]
cagggaggcguggccugggc

SEQ ID NO: 4005239 - RNA, 22 nt, Human immunodeficiency virus 1 [HIV-1]
cagggagucuccauagaaugga

SEQ ID NO: 4005240 - RNA, 18 nt, Human immunodeficiency virus 1 [HIV-1]
caguaaguaguacaugua

SEQ ID NO: 4005241 - RNA, 21 nt, Human immunodeficiency virus 1 [HIV-1]
caguauuugccauaaagaaaa

SEQ ID NO: 4005242 - RNA, 17 nt, Human immunodeficiency virus 1 [HIV-1]
cagucuagcagaagaag

SEQ ID NO: 4005243 - RNA, 15 nt, Human immunodeficiency virus 1 [HIV-1]
caguugagccagaua

SEQ ID NO: 4005244 - RNA, 15 nt, Human immunodeficiency virus 1 [HIV-1]
cauaccuagaagaau

SEQ ID NO: 4005245 - RNA, 17 nt, Human immunodeficiency virus 1 [HIV-1]
caucacguggcccgaga

SEQ ID NO: 4005246 - RNA, 18 nt, Human immunodeficiency virus 1 [HIV-1]
ccaaagcacuaacagaag

SEQ ID NO: 4005247 - RNA, 18 nt, Human immunodeficiency virus 1 [HIV-1]
ccaaccccgaggggaccc

SEQ ID NO: 4005248 - RNA, 19 nt, Human immunodeficiency virus 1 [HIV-1]
ccaaugcugcuugugccug

SEQ ID NO: 4005249 - RNA, 16 nt, Human immunodeficiency virus 1 [HIV-1]
ccacagagggagccac

SEQ ID NO: 4005250 - RNA, 15 nt, Human immunodeficiency virus 1 [HIV-1]
ccagaucugagccug

SEQ ID NO: 4005251 - RNA, 22 nt, Human immunodeficiency virus 1 [HIV-1]
ccagcuuguuacacccugugag

SEQ ID NO: 4005252 - RNA, 15 nt, Human immunodeficiency virus 1 [HIV-1]
cccugauuagcagaa

SEQ ID NO: 4005253 - RNA, 21 nt, Human immunodeficiency virus 1 [HIV-1]
ccuaaaggaucaacagcuccu

SEQ ID NO: 4005254 - RNA, 15 nt, Human immunodeficiency virus 1 [HIV-1]
ccuugaucuguggau

SEQ ID NO: 4005255 - RNA, 12 nt, Human immunodeficiency virus 1 [HIV-1]
cgagaccuggaa

SEQ ID NO: 4005256 - RNA, 24 nt, Human immunodeficiency virus 1 [HIV-1]
cgccuagcauuucaucacguggcc

SEQ ID NO: 4005257 - RNA, 17 nt, Human immunodeficiency virus 1 [HIV-1]
cuaaagaauuacaaaaa

SEQ ID NO: 4005258 - RNA, 18 nt, Human immunodeficiency virus 1 [HIV-1]
cuaauaccaauaguagua

SEQ ID NO: 4005259 - RNA, 20 nt, Human immunodeficiency virus 1 [HIV-1]
cuaauagaggaagacaaaaa

SEQ ID NO: 4005260 - RNA, 21 nt, Human immunodeficiency virus 1 [HIV-1]
cuaauagaggaagacaaaaag

SEQ ID NO: 4005261 - RNA, 22 nt, Human immunodeficiency virus 1 [HIV-1]
cuacuucccugauuagcagaac

SEQ ID NO: 4005262 - RNA, 15 nt, Human immunodeficiency virus 1 [HIV-1]
cuauggcaggaagaa

SEQ ID NO: 4005263 - RNA, 21 nt, Human immunodeficiency virus 1 [HIV-1]
cucaauaaagcuugccuugag

SEQ ID NO: 4005264 - RNA, 16 nt, Human immunodeficiency virus 1 [HIV-1]
cucauccaagaauaag

SEQ ID NO: 4005265 - RNA, 15 nt, Human immunodeficiency virus 1 [HIV-1]
cuccauagaauggag

SEQ ID NO: 4005266 - RNA, 15 nt, Human immunodeficiency virus 1 [HIV-1]
cugagccagcagcag

SEQ ID NO: 4005267 - RNA, 18 nt, Human immunodeficiency virus 1 [HIV-1]
cugagccugggagcucuc

SEQ ID NO: 4005268 - RNA, 16 nt, Human immunodeficiency virus 1 [HIV-1]
cugcauacaggagaaa

SEQ ID NO: 4005269 - RNA, 17 nt, Human immunodeficiency virus 1 [HIV-1]
cugcauauaagcagcug

SEQ ID NO: 4005270 - RNA, 18 nt, Human immunodeficiency virus 1 [HIV-1]
cugcauauaagcagcugc

SEQ ID NO: 4005271 - RNA, 17 nt, Human immunodeficiency virus 1 [HIV-1]
cuggggacuuuccaggg

SEQ ID NO: 4005272 - RNA, 22 nt, Human immunodeficiency virus 1 [HIV-1]
cuguagugcuacagaaaaauug

SEQ ID NO: 4005273 - RNA, 14 nt, Human immunodeficiency virus 1 [HIV-1]
cuguguggaaggaa

SEQ ID NO: 4005274 - RNA, 19 nt, Human immunodeficiency virus 1 [HIV-1]
cuuaagccucaauaaagcu

SEQ ID NO: 4005275 - RNA, 16 nt, Human immunodeficiency virus 1 [HIV-1]
aaagcuugccuugagu

SEQ ID NO: 4005276 - RNA, 14 nt, Human immunodeficiency virus 1 [HIV-1]
aaaguaagacagua

SEQ ID NO: 4005277 - RNA, 14 nt, Human immunodeficiency virus 1 [HIV-1]
aaaguaguaaaaau

SEQ ID NO: 4005278 - RNA, 21 nt, Human immunodeficiency virus 1 [HIV-1]
aaagugcacugauuugaagaa

SEQ ID NO: 4005279 - RNA, 15 nt, Human immunodeficiency virus 1 [HIV-1]
aaauauuacagggcu

SEQ ID NO: 4005280 - RNA, 13 nt, Human immunodeficiency virus 1 [HIV-1]
aaaucucuggaac

SEQ ID NO: 4005281 - RNA, 15 nt, Human immunodeficiency virus 1 [HIV-1]
aaaugucagcuaaaa

SEQ ID NO: 4005282 - RNA, 16 nt, Human immunodeficiency virus 1 [HIV-1]
aaauuaagagaacaau

SEQ ID NO: 4005283 - RNA, 17 nt, Human immunodeficiency virus 1 [HIV-1]
aacaagaauuauuggaa

SEQ ID NO: 4005284 - RNA, 14 nt, Human immunodeficiency virus 1 [HIV-1]
aacacugaaggaag

SEQ ID NO: 4005285 - RNA, 18 nt, Human immunodeficiency virus 1 [HIV-1]
aacacuuuaaaacagaua

SEQ ID NO: 4005286 - RNA, 16 nt, Human immunodeficiency virus 1 [HIV-1]
aacauguggcagaaag

SEQ ID NO: 4005287 - RNA, 19 nt, Human immunodeficiency virus 1 [HIV-1]
aagaguggugcagagagaa

SEQ ID NO: 4005288 - RNA, 12 nt, Human immunodeficiency virus 1 [HIV-1]
aagcagcugcuu

SEQ ID NO: 4005289 - RNA, 16 nt, Human immunodeficiency virus 1 [HIV-1]
aagcauccaggaaguc

SEQ ID NO: 4005290 - RNA, 20 nt, Human immunodeficiency virus 1 [HIV-1]
aaguuuguggaauugguuua

SEQ ID NO: 4005291 - RNA, 16 nt, Human immunodeficiency virus 1 [HIV-1]
aauacuuggcacuagc

SEQ ID NO: 4005292 - RNA, 17 nt, Human immunodeficiency virus 1 [HIV-1]
aauagcagaaauacaga

SEQ ID NO: 4005293 - RNA, 21 nt, Human immunodeficiency virus 1 [HIV-1]
aauuaagagaacaauuuggaa

SEQ ID NO: 4005294 - RNA, 12 nt, Human immunodeficiency virus 1 [HIV-1]
acaauuggagaa

SEQ ID NO: 4005295 - RNA, 13 nt, Human immunodeficiency virus 1 [HIV-1]
acaccagcuuguu

SEQ ID NO: 4005296 - RNA, 18 nt, Human immunodeficiency virus 1 [HIV-1]
acacccugugagccugca

SEQ ID NO: 4005297 - RNA, 13 nt, Human immunodeficiency virus 1 [HIV-1]
acagauagcuagc

SEQ ID NO: 4005298 - RNA, 22 nt, Human immunodeficiency virus 1 [HIV-1]
acagauaggguuauagaaguag

SEQ ID NO: 4005299 - RNA, 23 nt, Human immunodeficiency virus 1 [HIV-1]
acagggagacuaaauuaggaaaa

SEQ ID NO: 4005300 - RNA, 14 nt, Human immunodeficiency virus 1 [HIV-1]
acauagcagaauag

SEQ ID NO: 4005301 - RNA, 14 nt, Human immunodeficiency virus 1 [HIV-1]
acaugguagaacag

SEQ ID NO: 4005302 - RNA, 19 nt, Human immunodeficiency virus 1 [HIV-1]
acauuguaacauuaguaga

SEQ ID NO: 4005303 - RNA, 18 nt, Human immunodeficiency virus 1 [HIV-1]
accagaucugagccuggg

SEQ ID NO: 4005304 - RNA, 14 nt, Human immunodeficiency virus 1 [HIV-1]
accuaguauaaaca

SEQ ID NO: 4005305 - RNA, 19 nt, Human immunodeficiency virus 1 [HIV-1]
accuguguggaaggaagca

SEQ ID NO: 4005306 - RNA, 17 nt, Human immunodeficiency virus 1 [HIV-1]
acgaucugcggagccug

SEQ ID NO: 4005307 - RNA, 17 nt, Human immunodeficiency virus 1 [HIV-1]
acuaaauggagaaaauu

SEQ ID NO: 4005308 - RNA, 19 nt, Human immunodeficiency virus 1 [HIV-1]
acuaacagaaguaauacca

SEQ ID NO: 4005309 - RNA, 16 nt, Human immunodeficiency virus 1 [HIV-1]
acuacacaccagggcc

SEQ ID NO: 4005310 - RNA, 19 nt, Human immunodeficiency virus 1 [HIV-1]
acucccaaagaagacaaga

SEQ ID NO: 4005311 - RNA, 20 nt, Human immunodeficiency virus 1 [HIV-1]
acuguaagggaaagaaugag

SEQ ID NO: 4005312 - RNA, 13 nt, Human immunodeficiency virus 1 [HIV-1]
acuuuuuaaaaga

SEQ ID NO: 4005313 - RNA, 22 nt, Human immunodeficiency virus 1 [HIV-1]
agaaaauuuuaacauguggaaa

SEQ ID NO: 4005314 - RNA, 14 nt, Human immunodeficiency virus 1 [HIV-1]
agaaagagcagaag

SEQ ID NO: 4005315 - RNA, 20 nt, Human immunodeficiency virus 1 [HIV-1]
agaaaggagagauaaaaaac

SEQ ID NO: 4005316 - RNA, 19 nt, Human immunodeficiency virus 1 [HIV-1]
agaaauuguaacgcacagu

SEQ ID NO: 4005317 - RNA, 18 nt, Human immunodeficiency virus 1 [HIV-1]
agaaauuuguacagagau

SEQ ID NO: 4005318 - RNA, 13 nt, Human immunodeficiency virus 1 [HIV-1]
agaacaccagcuu

SEQ ID NO: 4005319 - RNA, 16 nt, Human immunodeficiency virus 1 [HIV-1]
agaacaccagcuuguu

SEQ ID NO: 4005320 - RNA, 17 nt, Human immunodeficiency virus 1 [HIV-1]
agaaucuaugaauaaag

SEQ ID NO: 4005321 - RNA, 20 nt, Human immunodeficiency virus 1 [HIV-1]
agaaugagacgagcugagcc

SEQ ID NO: 4005322 - RNA, 18 nt, Human immunodeficiency virus 1 [HIV-1]
agaaugauacuaauacca

SEQ ID NO: 4005323 - RNA, 18 nt, Human immunodeficiency virus 1 [HIV-1]
agacaguaugaucagaua

SEQ ID NO: 4005324 - RNA, 17 nt, Human immunodeficiency virus 1 [HIV-1]
agaccagaucugagccu

SEQ ID NO: 4005325 - RNA, 19 nt, Human immunodeficiency virus 1 [HIV-1]
agacccaacaacaauacaa

SEQ ID NO: 4005326 - RNA, 14 nt, Human immunodeficiency virus 1 [HIV-1]
agacuuaauagcag

SEQ ID NO: 4005327 - RNA, 16 nt, Human immunodeficiency virus 1 [HIV-1]
agagaggaccagggag

SEQ ID NO: 4005328 - RNA, 15 nt, Human immunodeficiency virus 1 [HIV-1]
agagcaguuaauaaa

SEQ ID NO: 4005329 - RNA, 16 nt, Human immunodeficiency virus 1 [HIV-1]
agagguaaggugcaga

SEQ ID NO: 4005330 - RNA, 23 nt, Human immunodeficiency virus 1 [HIV-1]
agauagaagaggccaauaaagga

SEQ ID NO: 4005331 - RNA, 19 nt, Human immunodeficiency virus 1 [HIV-1]
agauccugcauauaagcag

SEQ ID NO: 4005332 - RNA, 14 nt, Human immunodeficiency virus 1 [HIV-1]
agcaaaagaaauag

SEQ ID NO: 4005333 - RNA, 17 nt, Human immunodeficiency virus 1 [HIV-1]
agcaauaauaauagcaa

SEQ ID NO: 4005334 - RNA, 15 nt, Human immunodeficiency virus 1 [HIV-1]
agcaauacagcagcu

SEQ ID NO: 4005335 - RNA, 18 nt, Human immunodeficiency virus 1 [HIV-1]
agcaauacagcagcuacc

SEQ ID NO: 4005336 - RNA, 13 nt, Human immunodeficiency virus 1 [HIV-1]
agcacuaacagaa

SEQ ID NO: 4005337 - RNA, 14 nt, Human immunodeficiency virus 1 [HIV-1]
agcagaacuacaca

SEQ ID NO: 4005338 - RNA, 16 nt, Human immunodeficiency virus 1 [HIV-1]
agcagaugauacagua

SEQ ID NO: 4005339 - RNA, 21 nt, Human immunodeficiency virus 1 [HIV-1]
agcaguuaauaaaaaaggaaa

SEQ ID NO: 4005340 - RNA, 18 nt, Human immunodeficiency virus 1 [HIV-1]
agccuuuuagaaaacaaa

SEQ ID NO: 4005341 - RNA, 16 nt, Human immunodeficiency virus 1 [HIV-1]
agcugagccagcagca

SEQ ID NO: 4005342 - RNA, 18 nt, Human immunodeficiency virus 1 [HIV-1]
agcugcuuuuugccugua

SEQ ID NO: 4005343 - RNA, 17 nt, Human immunodeficiency virus 1 [HIV-1]
aggaaauaugagacaag

SEQ ID NO: 4005344 - RNA, 18 nt, Human immunodeficiency virus 1 [HIV-1]
aggaagaagcggagacag

SEQ ID NO: 4005345 - RNA, 18 nt, Human immunodeficiency virus 1 [HIV-1]
aggagauaugagggacaa

SEQ ID NO: 4005346 - RNA, 15 nt, Human immunodeficiency virus 1 [HIV-1]
aggaggagauaugag

SEQ ID NO: 4005347 - RNA, 16 nt, Human immunodeficiency virus 1 [HIV-1]
aggaggaggagguggg

SEQ ID NO: 4005348 - RNA, 15 nt, Human immunodeficiency virus 1 [HIV-1]
aggaggggacccaga

SEQ ID NO: 4005349 - RNA, 17 nt, Human immunodeficiency virus 1 [HIV-1]
aggaucaacagcuccug

SEQ ID NO: 4005350 - RNA, 18 nt, Human immunodeficiency virus 1 [HIV-1]
aggccaauaaaggagaga

SEQ ID NO: 4005351 - RNA, 19 nt, Human immunodeficiency virus 1 [HIV-1]
agggaaagaaugagacgag

SEQ ID NO: 4005352 - RNA, 21 nt, Human immunodeficiency virus 1 [HIV-1]
agggagucuccauagaaugga

SEQ ID NO: 4005353 - RNA, 16 nt, Human immunodeficiency virus 1 [HIV-1]
agggccacagagggag

SEQ ID NO: 4005354 - RNA, 14 nt, Human immunodeficiency virus 1 [HIV-1]
aggguuauagaagu

SEQ ID NO: 4005355 - RNA, 18 nt, Human immunodeficiency virus 1 [HIV-1]
agguaaggugcagaaaga

SEQ ID NO: 4005356 - RNA, 21 nt, Human immunodeficiency virus 1 [HIV-1]
aggugcagaaagaauaugcau

SEQ ID NO: 4005357 - RNA, 18 nt, Human immunodeficiency virus 1 [HIV-1]
aguaauaaaucucuggaa

SEQ ID NO: 4005358 - RNA, 18 nt, Human immunodeficiency virus 1 [HIV-1]
aguaaucauagaauauag

SEQ ID NO: 4005359 - RNA, 18 nt, Human immunodeficiency virus 1 [HIV-1]
aguaccaguugagccaga

SEQ ID NO: 4005360 - RNA, 16 nt, Human immunodeficiency virus 1 [HIV-1]
aguagcaauacagcag

SEQ ID NO: 4005361 - RNA, 23 nt, Human immunodeficiency virus 1 [HIV-1]
agugccaagaagaaaagcaaaga

SEQ ID NO: 4005362 - RNA, 16 nt, Human immunodeficiency virus 1 [HIV-1]
aguggaagccauaaua

SEQ ID NO: 4005363 - RNA, 22 nt, Human immunodeficiency virus 1 [HIV-1]
aguggcaaugagagugaaggag

SEQ ID NO: 4005364 - RNA, 22 nt, Human immunodeficiency virus 1 [HIV-1]
aguggcgagcccucagauccug

SEQ ID NO: 4005365 - RNA, 13 nt, Human immunodeficiency virus 1 [HIV-1]
caugguggacaga

SEQ ID NO: 4005366 - RNA, 14 nt, Human immunodeficiency virus 1 [HIV-1]
cauguggaaaaaug

SEQ ID NO: 4005367 - RNA, 16 nt, Human immunodeficiency virus 1 [HIV-1]
ccaagaugaacaugag

SEQ ID NO: 4005368 - RNA, 21 nt, Human immunodeficiency virus 1 [HIV-1]
ccagaucugagccugggagcu

SEQ ID NO: 4005369 - RNA, 23 nt, Human immunodeficiency virus 1 [HIV-1]
ccagaucugagccugggagcucu

SEQ ID NO: 4005370 - RNA, 20 nt, Human immunodeficiency virus 1 [HIV-1]
ccaguggauauauagaagca

SEQ ID NO: 4005371 - RNA, 21 nt, Human immunodeficiency virus 1 [HIV-1]
ccauccugauaaauggacagu

SEQ ID NO: 4005372 - RNA, 18 nt, Human immunodeficiency virus 1 [HIV-1]
cccugugagccugcaugg

SEQ ID NO: 4005373 - RNA, 17 nt, Human immunodeficiency virus 1 [HIV-1]
ccgaaggaauagaagaa

SEQ ID NO: 4005374 - RNA, 19 nt, Human immunodeficiency virus 1 [HIV-1]
ccgcaggguuaaaaaagaa

SEQ ID NO: 4005375 - RNA, 18 nt, Human immunodeficiency virus 1 [HIV-1]
ccucaggaggggacccag

SEQ ID NO: 4005376 - RNA, 23 nt, Human immunodeficiency virus 1 [HIV-1]
ccuggggauuugggguugcucug

SEQ ID NO: 4005377 - RNA, 13 nt, Human immunodeficiency virus 1 [HIV-1]
ccugugagccugc

SEQ ID NO: 4005378 - RNA, 16 nt, Human immunodeficiency virus 1 [HIV-1]
ccugugagccugcaug

SEQ ID NO: 4005379 - RNA, 21 nt, Human immunodeficiency virus 1 [HIV-1]
ccuuggguucuugggagcagc

SEQ ID NO: 4005380 - RNA, 20 nt, Human immunodeficiency virus 1 [HIV-1]
cgaagagcucaucagaacag

SEQ ID NO: 4005381 - RNA, 22 nt, Human immunodeficiency virus 1 [HIV-1]
cgaucugcggagccugugccuc

SEQ ID NO: 4005382 - RNA, 17 nt, Human immunodeficiency virus 1 [HIV-1]
cgggaaucaagcaggaa

SEQ ID NO: 4005383 - RNA, 17 nt, Human immunodeficiency virus 1 [HIV-1]
cguggcccgagagcugc

SEQ ID NO: 4005384 - RNA, 13 nt, Human immunodeficiency virus 1 [HIV-1]
cguggccugggcg

SEQ ID NO: 4005385 - RNA, 17 nt, Human immunodeficiency virus 1 [HIV-1]
cuaaugauguaaaacaa

SEQ ID NO: 4005386 - RNA, 14 nt, Human immunodeficiency virus 1 [HIV-1]
cuacaguauuggag

SEQ ID NO: 4005387 - RNA, 22 nt, Human immunodeficiency virus 1 [HIV-1]
cuaccaaugcugcuugugccug

SEQ ID NO: 4005388 - RNA, 19 nt, Human immunodeficiency virus 1 [HIV-1]
cuauugaggcgcaacagca

SEQ ID NO: 4005389 - RNA, 21 nt, Human immunodeficiency virus 1 [HIV-1]
cucagauccugcauauaagca

SEQ ID NO: 4005390 - RNA, 15 nt, Human immunodeficiency virus 1 [HIV-1]
cucccaucaguggac

SEQ ID NO: 4005391 - RNA, 14 nt, Human immunodeficiency virus 1 [HIV-1]
cugacaauggcagc

SEQ ID NO: 4005392 - RNA, 20 nt, Human immunodeficiency virus 1 [HIV-1]
cugacacaacaaaucagaag

SEQ ID NO: 4005393 - RNA, 15 nt, Human immunodeficiency virus 1 [HIV-1]
cugaggggacagaua

SEQ ID NO: 4005394 - RNA, 13 nt, Human immunodeficiency virus 1 [HIV-1]
cugcuauaagaaa

SEQ ID NO: 4005395 - RNA, 18 nt, Human immunodeficiency virus 1 [HIV-1]
cuggauggagugggacag

SEQ ID NO: 4005396 - RNA, 15 nt, Human immunodeficiency virus 1 [HIV-1]
cuggcuagaagcaca

SEQ ID NO: 4005397 - RNA, 16 nt, Human immunodeficiency virus 1 [HIV-1]
cuggcuguggaaagau

SEQ ID NO: 4005398 - RNA, 17 nt, Human immunodeficiency virus 1 [HIV-1]
cuguagaucuuagccac

SEQ ID NO: 4005399 - RNA, 18 nt, Human immunodeficiency virus 1 [HIV-1]
cuguaguagcaaaagaaa

SEQ ID NO: 4005400 - RNA, 17 nt, Human immunodeficiency virus 1 [HIV-1]
cuuaagccucaauaaag

SEQ ID NO: 4005401 - RNA, 19 nt, Human immunodeficiency virus 1 [HIV-1]
cuuaccacaccagacaaaa

SEQ ID NO: 4005402 - RNA, 21 nt, Human immunodeficiency virus 1 [HIV-1]
cuuaccacaccagacaaaaaa

SEQ ID NO: 4005403 - RNA, 17 nt, Human immunodeficiency virus 1 [HIV-1]
cuuggcacuagcagcau

SEQ ID NO: 4005404 - RNA, 19 nt, Human immunodeficiency virus 1 [HIV-1]
cuuuuaaaauuagcaggaa

SEQ ID NO: 4005405 - RNA, 20 nt, Human immunodeficiency virus 1 [HIV-1]
cuuuuaaaauuagcaggaag

SEQ ID NO: 4005406 - RNA, 17 nt, Human immunodeficiency virus 1 [HIV-1]
gaaaaggggggacugga

SEQ ID NO: 4005407 - RNA, 18 nt, Human immunodeficiency virus 1 [HIV-1]
gaaaaguuuaguaaaaca

SEQ ID NO: 4005408 - RNA, 18 nt, Human immunodeficiency virus 1 [HIV-1]
gaaaguaggaaaagcaau

SEQ ID NO: 4005409 - RNA, 20 nt, Human immunodeficiency virus 1 [HIV-1]
gaaauaugagacaagcacau

SEQ ID NO: 4005410 - RNA, 13 nt, Human immunodeficiency virus 1 [HIV-1]
gaacccacugcuu

SEQ ID NO: 4005411 - RNA, 18 nt, Human immunodeficiency virus 1 [HIV-1]
gaacccacugcuuaagcc

SEQ ID NO: 4005412 - RNA, 16 nt, Human immunodeficiency virus 1 [HIV-1]
gaagacaguggcaaug

SEQ ID NO: 4005413 - RNA, 24 nt, Human immunodeficiency virus 1 [HIV-1]
gaagucagccuaaaacugcuugua

SEQ ID NO: 4005414 - RNA, 20 nt, Human immunodeficiency virus 1 [HIV-1]
gacaggaugaggauuagaac

SEQ ID NO: 4005415 - RNA, 16 nt, Human immunodeficiency virus 1 [HIV-1]
gacuuacaaggcagcu

SEQ ID NO: 4005416 - RNA, 20 nt, Human immunodeficiency virus 1 [HIV-1]
gacuuacucuugauuguaac

SEQ ID NO: 4005417 - RNA, 16 nt, Human immunodeficiency virus 1 [HIV-1]
gacuuuccgcugggga

SEQ ID NO: 4005418 - RNA, 14 nt, Human immunodeficiency virus 1 [HIV-1]
gagaaaggagagau

SEQ ID NO: 4005419 - RNA, 13 nt, Human immunodeficiency virus 1 [HIV-1]
gagacgagcugag

SEQ ID NO: 4005420 - RNA, 20 nt, Human immunodeficiency virus 1 [HIV-1]
gagcagcaucucgagaccug

SEQ ID NO: 4005421 - RNA, 15 nt, Human immunodeficiency virus 1 [HIV-1]
gagcauuuguuacaa

SEQ ID NO: 4005422 - RNA, 16 nt, Human immunodeficiency virus 1 [HIV-1]
gagccugcaugggaug

SEQ ID NO: 4005423 - RNA, 13 nt, Human immunodeficiency virus 1 [HIV-1]
gagcugagccagc

SEQ ID NO: 4005424 - RNA, 13 nt, Human immunodeficiency virus 1 [HIV-1]
gaggcguggccug

SEQ ID NO: 4005425 - RNA, 22 nt, Human immunodeficiency virus 1 [HIV-1]
gauaaagccaccuuugccuagu

SEQ ID NO: 4005426 - RNA, 20 nt, Human immunodeficiency virus 1 [HIV-1]
gauccugcauauaagcagcu

SEQ ID NO: 4005427 - RNA, 22 nt, Human immunodeficiency virus 1 [HIV-1]
gauccuuggcacuuaucuggga

SEQ ID NO: 4005428 - RNA, 15 nt, Human immunodeficiency virus 1 [HIV-1]
gaucugagccuggga

SEQ ID NO: 4005429 - RNA, 17 nt, Human immunodeficiency virus 1 [HIV-1]
gauggaugacccggaga

SEQ ID NO: 4005430 - RNA, 13 nt, Human immunodeficiency virus 1 [HIV-1]
gauuagcagaacu

SEQ ID NO: 4005431 - RNA, 18 nt, Human immunodeficiency virus 1 [HIV-1]
gcaaaaccagcaagaaaa

SEQ ID NO: 4005432 - RNA, 15 nt, Human immunodeficiency virus 1 [HIV-1]
gcaaauuaagagaac

SEQ ID NO: 4005433 - RNA, 16 nt, Human immunodeficiency virus 1 [HIV-1]
gcaauaauaauagcaa

SEQ ID NO: 4005434 - RNA, 20 nt, Human immunodeficiency virus 1 [HIV-1]
gcacaagaggaggaggaggu

SEQ ID NO: 4005435 - RNA, 13 nt, Human immunodeficiency virus 1 [HIV-1]
gcaccacugcugu

SEQ ID NO: 4005436 - RNA, 22 nt, Human immunodeficiency virus 1 [HIV-1]
gcacugauuugaagaaugauac

SEQ ID NO: 4005437 - RNA, 17 nt, Human immunodeficiency virus 1 [HIV-1]
gcacuuaucugggacga

SEQ ID NO: 4005438 - RNA, 16 nt, Human immunodeficiency virus 1 [HIV-1]
gcaggaagaagcggag

SEQ ID NO: 4005439 - RNA, 15 nt, Human immunodeficiency virus 1 [HIV-1]
gccaugcauggacaa

SEQ ID NO: 4005440 - RNA, 13 nt, Human immunodeficiency virus 1 [HIV-1]
gccucaauaaagc

SEQ ID NO: 4005441 - RNA, 20 nt, Human immunodeficiency virus 1 [HIV-1]
gccucaauaaagcuugccuu

SEQ ID NO: 4005442 - RNA, 16 nt, Human immunodeficiency virus 1 [HIV-1]
gccugggagcucucug

SEQ ID NO: 4005443 - RNA, 20 nt, Human immunodeficiency virus 1 [HIV-1]
gcugcuuuuugccuguacug

SEQ ID NO: 4005444 - RNA, 22 nt, Human immunodeficiency virus 1 [HIV-1]
gcuugcucaaugccacagccau

SEQ ID NO: 4005445 - RNA, 22 nt, Human immunodeficiency virus 1 [HIV-1]
ggaaaggugaaggggcaguagu

SEQ ID NO: 4005446 - RNA, 14 nt, Human immunodeficiency virus 1 [HIV-1]
ggaacaagccccag

SEQ ID NO: 4005447 - RNA, 23 nt, Human immunodeficiency virus 1 [HIV-1]
ggaauaacacuuuaaaacagaua

SEQ ID NO: 4005448 - RNA, 16 nt, Human immunodeficiency virus 1 [HIV-1]
ggagaaaggagagaua

SEQ ID NO: 4005449 - RNA, 12 nt, Human immunodeficiency virus 1 [HIV-1]
ggagucaggaac

SEQ ID NO: 4005450 - RNA, 14 nt, Human immunodeficiency virus 1 [HIV-1]
ggagugggacagag

SEQ ID NO: 4005451 - RNA, 22 nt, Human immunodeficiency virus 1 [HIV-1]
ggaucuaccacacacaaggcua

SEQ ID NO: 4005452 - RNA, 16 nt, Human immunodeficiency virus 1 [HIV-1]
ggcaaugagagugaag

SEQ ID NO: 4005453 - RNA, 14 nt, Human immunodeficiency virus 1 [HIV-1]
ggccaauggacaua

SEQ ID NO: 4005454 - RNA, 13 nt, Human immunodeficiency virus 1 [HIV-1]
ggccauugacaga

SEQ ID NO: 4005455 - RNA, 15 nt, Human immunodeficiency virus 1 [HIV-1]
ggcccgagagcugca

SEQ ID NO: 4005456 - RNA, 16 nt, Human immunodeficiency virus 1 [HIV-1]
ggcgcagccucaauga

SEQ ID NO: 4005457 - RNA, 22 nt, Human immunodeficiency virus 1 [HIV-1]
gggacgaucugcggagccugug

SEQ ID NO: 4005458 - RNA, 13 nt, Human immunodeficiency virus 1 [HIV-1]
ggugggagcagca

SEQ ID NO: 4005459 - RNA, 17 nt, Human immunodeficiency virus 1 [HIV-1]
guaccaguugagccaga

SEQ ID NO: 4005460 - RNA, 20 nt, Human immunodeficiency virus 1 [HIV-1]
guagacauaauagcaacaga

SEQ ID NO: 4005461 - RNA, 13 nt, Human immunodeficiency virus 1 [HIV-1]
guagacuguaguc

SEQ ID NO: 4005462 - RNA, 19 nt, Human immunodeficiency virus 1 [HIV-1]
guagcaauacagcagcuac

SEQ ID NO: 4005463 - RNA, 17 nt, Human immunodeficiency virus 1 [HIV-1]
guagcugaggggacaga

SEQ ID NO: 4005464 - RNA, 15 nt, Human immunodeficiency virus 1 [HIV-1]
guaugccccucccau

SEQ ID NO: 4005465 - RNA, 16 nt, Human immunodeficiency virus 1 [HIV-1]
guggaacuucugggac

SEQ ID NO: 4005466 - RNA, 23 nt, Human immunodeficiency virus 1 [HIV-1]
guggccugggcgggacuggggag

SEQ ID NO: 4005467 - RNA, 13 nt, Human immunodeficiency virus 1 [HIV-1]
gugguccauagua

SEQ ID NO: 4005468 - RNA, 17 nt, Human immunodeficiency virus 1 [HIV-1]
guuagcuugcucaaugc

SEQ ID NO: 4005469 - RNA, 18 nt, Human immunodeficiency virus 1 [HIV-1]
uaaaaaagaaaaaaucag

SEQ ID NO: 4005470 - RNA, 15 nt, Human immunodeficiency virus 1 [HIV-1]
uaaaauuaaagccag

SEQ ID NO: 4005471 - RNA, 23 nt, Human immunodeficiency virus 1 [HIV-1]
uaaaauuauucauaaugauagua

SEQ ID NO: 4005472 - RNA, 18 nt, Human immunodeficiency virus 1 [HIV-1]
uaaaguaguaaaaauuga

SEQ ID NO: 4005473 - RNA, 18 nt, Human immunodeficiency virus 1 [HIV-1]
uaaaucucuggaacagau

SEQ ID NO: 4005474 - RNA, 20 nt, Human immunodeficiency virus 1 [HIV-1]
uaacaaauuggcugugguau

SEQ ID NO: 4005475 - RNA, 16 nt, Human immunodeficiency virus 1 [HIV-1]
uaacauuaguagagca

SEQ ID NO: 4005476 - RNA, 15 nt, Human immunodeficiency virus 1 [HIV-1]
uaaccacagaaagca

SEQ ID NO: 4005477 - RNA, 12 nt, Human immunodeficiency virus 1 [HIV-1]
uaauaauagcaa

SEQ ID NO: 4005478 - RNA, 16 nt, Human immunodeficiency virus 1 [HIV-1]
uaauuggagagcaaug

SEQ ID NO: 4005479 - RNA, 18 nt, Human immunodeficiency virus 1 [HIV-1]
uacuaauaccaauaguag

SEQ ID NO: 4005480 - RNA, 21 nt, Human immunodeficiency virus 1 [HIV-1]
uacuucaagaacugcugacau

SEQ ID NO: 4005481 - RNA, 15 nt, Human immunodeficiency virus 1 [HIV-1]
uagaauauaggaaaa

SEQ ID NO: 4005482 - RNA, 13 nt, Human immunodeficiency virus 1 [HIV-1]
uagaucuuagcca

SEQ ID NO: 4005483 - RNA, 15 nt, Human immunodeficiency virus 1 [HIV-1]
uagcaauacagcagc

SEQ ID NO: 4005484 - RNA, 19 nt, Human immunodeficiency virus 1 [HIV-1]
uagcagaaauacagaagca

SEQ ID NO: 4005485 - RNA, 18 nt, Human immunodeficiency virus 1 [HIV-1]
uaguacaaggagcuugua

SEQ ID NO: 4005486 - RNA, 16 nt, Human immunodeficiency virus 1 [HIV-1]
uaguagcaaaagaaau

SEQ ID NO: 4005487 - RNA, 13 nt, Human immunodeficiency virus 1 [HIV-1]
uauaaaauuauuc

SEQ ID NO: 4005488 - RNA, 18 nt, Human immunodeficiency virus 1 [HIV-1]
uauaaauauaaaguagua

SEQ ID NO: 4005489 - RNA, 22 nt, Human immunodeficiency virus 1 [HIV-1]
uauccagagaggaccagggaga

SEQ ID NO: 4005490 - RNA, 18 nt, Human immunodeficiency virus 1 [HIV-1]
ucaaagcaguaaguagua

SEQ ID NO: 4005491 - RNA, 18 nt, Human immunodeficiency virus 1 [HIV-1]
ucaagcaggacauaacaa

SEQ ID NO: 4005492 - RNA, 12 nt, Human immunodeficiency virus 1 [HIV-1]
ucacccucccau

SEQ ID NO: 4005493 - RNA, 13 nt, Human immunodeficiency virus 1 [HIV-1]
ucagaacagucag

SEQ ID NO: 4005494 - RNA, 23 nt, Human immunodeficiency virus 1 [HIV-1]
ucagaagacugaguuacaagcaa

SEQ ID NO: 4005495 - RNA, 16 nt, Human immunodeficiency virus 1 [HIV-1]
ucagcacuuguggaga

SEQ ID NO: 4005496 - RNA, 21 nt, Human immunodeficiency virus 1 [HIV-1]
ucaucacguggcccgagagcu

SEQ ID NO: 4005497 - RNA, 13 nt, Human immunodeficiency virus 1 [HIV-1]
uccagucacaccu

SEQ ID NO: 4005498 - RNA, 15 nt, Human immunodeficiency virus 1 [HIV-1]
uccauuuucagaauu

SEQ ID NO: 4005499 - RNA, 20 nt, Human immunodeficiency virus 1 [HIV-1]
ucguuucagacccaccuccc

SEQ ID NO: 4005500 - RNA, 16 nt, Human immunodeficiency virus 1 [HIV-1]
ucucugguuagaccag

SEQ ID NO: 4005501 - RNA, 21 nt, Human immunodeficiency virus 1 [HIV-1]
ugaauugggcaagucagauuu

SEQ ID NO: 4005502 - RNA, 13 nt, Human immunodeficiency virus 1 [HIV-1]
ugagacaagcaca

SEQ ID NO: 4005503 - RNA, 22 nt, Human immunodeficiency virus 1 [HIV-1]
ugagacaagcacauuguaacau

SEQ ID NO: 4005504 - RNA, 14 nt, Human immunodeficiency virus 1 [HIV-1]
ugaggcgcaacagc

SEQ ID NO: 4005505 - RNA, 16 nt, Human immunodeficiency virus 1 [HIV-1]
ugaguuacaagcaauu

SEQ ID NO: 4005506 - RNA, 23 nt, Human immunodeficiency virus 1 [HIV-1]
ugauacuaccagcuauaaguuga

SEQ ID NO: 4005507 - RNA, 22 nt, Human immunodeficiency virus 1 [HIV-1]
ugauagacuaauagaaagagca

SEQ ID NO: 4005508 - RNA, 14 nt, Human immunodeficiency virus 1 [HIV-1]
ugccagaaaaagac

SEQ ID NO: 4005509 - RNA, 14 nt, Human immunodeficiency virus 1 [HIV-1]
ugcuuaagccucaa

SEQ ID NO: 4005510 - RNA, 16 nt, Human immunodeficiency virus 1 [HIV-1]
uggaacuucugggacg

SEQ ID NO: 4005511 - RNA, 20 nt, Human immunodeficiency virus 1 [HIV-1]
uggacaaauuagauguucau

SEQ ID NO: 4005512 - RNA, 16 nt, Human immunodeficiency virus 1 [HIV-1]
uggacauaucaaauuu

SEQ ID NO: 4005513 - RNA, 18 nt, Human immunodeficiency virus 1 [HIV-1]
uggauggugcuacaagcu

SEQ ID NO: 4005514 - RNA, 18 nt, Human immunodeficiency virus 1 [HIV-1]
uggcagaaaacagagaga

SEQ ID NO: 4005515 - RNA, 19 nt, Human immunodeficiency virus 1 [HIV-1]
uggccauugacagaagaaa

SEQ ID NO: 4005516 - RNA, 18 nt, Human immunodeficiency virus 1 [HIV-1]
uggggacuuuccagggag

SEQ ID NO: 4005517 - RNA, 20 nt, Human immunodeficiency virus 1 [HIV-1]
uuaacaagagauggugguaa

SEQ ID NO: 4005518 - RNA, 13 nt, Human immunodeficiency virus 1 [HIV-1]
uuaacauguggaa

SEQ ID NO: 4005519 - RNA, 14 nt, Human immunodeficiency virus 1 [HIV-1]
uuaauaacaccaaa

SEQ ID NO: 4005520 - RNA, 20 nt, Human immunodeficiency virus 1 [HIV-1]
uacagcagcuaccaaugcug

SEQ ID NO: 4005521 - RNA, 21 nt, Human immunodeficiency virus 1 [HIV-1]
uaccaauaguagcaauaguag

SEQ ID NO: 4005522 - RNA, 16 nt, Human immunodeficiency virus 1 [HIV-1]
uaccaguugagccaga

SEQ ID NO: 4005523 - RNA, 20 nt, Human immunodeficiency virus 1 [HIV-1]
uacccagggauuaaaguaag

SEQ ID NO: 4005524 - RNA, 19 nt, Human immunodeficiency virus 1 [HIV-1]
uagaacuggcagaaaacag

SEQ ID NO: 4005525 - RNA, 15 nt, Human immunodeficiency virus 1 [HIV-1]
uagacauaauagcaa

SEQ ID NO: 4005526 - RNA, 18 nt, Human immunodeficiency virus 1 [HIV-1]
uagaccagaucugagccu

SEQ ID NO: 4005527 - RNA, 18 nt, Human immunodeficiency virus 1 [HIV-1]
uagcaaauuaagagaaca

SEQ ID NO: 4005528 - RNA, 13 nt, Human immunodeficiency virus 1 [HIV-1]
uagcagaaauaca

SEQ ID NO: 4005529 - RNA, 15 nt, Human immunodeficiency virus 1 [HIV-1]
uaguaguagcaauaa

SEQ ID NO: 4005530 - RNA, 14 nt, Human immunodeficiency virus 1 [HIV-1]
ucaagcagcuccag

SEQ ID NO: 4005531 - RNA, 19 nt, Human immunodeficiency virus 1 [HIV-1]
ucaaucaaauaauagagca

SEQ ID NO: 4005532 - RNA, 17 nt, Human immunodeficiency virus 1 [HIV-1]
ucaaugacauacagaag

SEQ ID NO: 4005533 - RNA, 17 nt, Human immunodeficiency virus 1 [HIV-1]
ucagacccaccucccaa

SEQ ID NO: 4005534 - RNA, 14 nt, Human immunodeficiency virus 1 [HIV-1]
ucccacuaggggau

SEQ ID NO: 4005535 - RNA, 14 nt, Human immunodeficiency virus 1 [HIV-1]
ucuaaaagaaccag

SEQ ID NO: 4005536 - RNA, 18 nt, Human immunodeficiency virus 1 [HIV-1]
ucuuuaagcaauccucag

SEQ ID NO: 4005537 - RNA, 16 nt, Human immunodeficiency virus 1 [HIV-1]
ugaacaagaauuauug

SEQ ID NO: 4005538 - RNA, 21 nt, Human immunodeficiency virus 1 [HIV-1]
ugacaaguuguaacaccucag

SEQ ID NO: 4005539 - RNA, 17 nt, Human immunodeficiency virus 1 [HIV-1]
ugagacgagcugagcca

SEQ ID NO: 4005540 - RNA, 22 nt, Human immunodeficiency virus 1 [HIV-1]
ugagacgagcugagccagcagc

SEQ ID NO: 4005541 - RNA, 15 nt, Human immunodeficiency virus 1 [HIV-1]
ugagccugggagcuc

SEQ ID NO: 4005542 - RNA, 18 nt, Human immunodeficiency virus 1 [HIV-1]
ugauaauggagaaaggag

SEQ ID NO: 4005543 - RNA, 14 nt, Human immunodeficiency virus 1 [HIV-1]
ugccaccuguagua

SEQ ID NO: 4005544 - RNA, 16 nt, Human immunodeficiency virus 1 [HIV-1]
ugccuggcuagaagca

SEQ ID NO: 4005545 - RNA, 23 nt, Human immunodeficiency virus 1 [HIV-1]
ugcugacaucgagcuugcuacaa

SEQ ID NO: 4005546 - RNA, 11 nt, Human immunodeficiency virus 1 [HIV-1]
ugcugugccuu

SEQ ID NO: 4005547 - RNA, 16 nt, Human immunodeficiency virus 1 [HIV-1]
uggaggaaaaagagau

SEQ ID NO: 4005548 - RNA, 18 nt, Human immunodeficiency virus 1 [HIV-1]
uggcacuuaucugggacg

SEQ ID NO: 4005549 - RNA, 12 nt, Human immunodeficiency virus 1 [HIV-1]
uggccugggcgg

SEQ ID NO: 4005550 - RNA, 15 nt, Human immunodeficiency virus 1 [HIV-1]
uggcgagcccucaga

SEQ ID NO: 4005551 - RNA, 20 nt, Human immunodeficiency virus 1 [HIV-1]
ugggaagcccucaaauauug

SEQ ID NO: 4005552 - RNA, 16 nt, Human immunodeficiency virus 1 [HIV-1]
uguagaucuuagccac

SEQ ID NO: 4005553 - RNA, 15 nt, Human immunodeficiency virus 1 [HIV-1]
uguuagcuugcucaa

SEQ ID NO: 4005554 - RNA, 22 nt, Human immunodeficiency virus 1 [HIV-1]
uguuucauaacaaaagccuuag

SEQ ID NO: 4005555 - RNA, 22 nt, Human immunodeficiency virus 1 [HIV-1]
uuagaacauggaaaaguuuagu

SEQ ID NO: 4005556 - RNA, 20 nt, Human immunodeficiency virus 1 [HIV-1]
aaaacagauagcuagcaaau

SEQ ID NO: 4005557 - RNA, 21 nt, Human immunodeficiency virus 1 [HIV-1]
aaaaccauaauaguacagcug

SEQ ID NO: 4005558 - RNA, 16 nt, Human immunodeficiency virus 1 [HIV-1]
aaaaguuaaacaaugg

SEQ ID NO: 4005559 - RNA, 16 nt, Human immunodeficiency virus 1 [HIV-1]
aaacugcuuguaccaa

SEQ ID NO: 4005560 - RNA, 13 nt, Human immunodeficiency virus 1 [HIV-1]
aaagcuugccuug

SEQ ID NO: 4005561 - RNA, 16 nt, Human immunodeficiency virus 1 [HIV-1]
aagaagaaaagcaaag

SEQ ID NO: 4005562 - RNA, 14 nt, Human immunodeficiency virus 1 [HIV-1]
aaggaccagcaaag

SEQ ID NO: 4005563 - RNA, 16 nt, Human immunodeficiency virus 1 [HIV-1]
aauacaagaaaaagaa

SEQ ID NO: 4005564 - RNA, 14 nt, Human immunodeficiency virus 1 [HIV-1]
aauagaggaagaca

SEQ ID NO: 4005565 - RNA, 18 nt, Human immunodeficiency virus 1 [HIV-1]
aauugauagacuaauaga

SEQ ID NO: 4005566 - RNA, 14 nt, Human immunodeficiency virus 1 [HIV-1]
aauuuuaacaugug

SEQ ID NO: 4005567 - RNA, 15 nt, Human immunodeficiency virus 1 [HIV-1]
acaagcuuaauacac

SEQ ID NO: 4005568 - RNA, 22 nt, Human immunodeficiency virus 1 [HIV-1]
acaauuuggaaauaauaaaaca

SEQ ID NO: 4005569 - RNA, 17 nt, Human immunodeficiency virus 1 [HIV-1]
acaauuuuaaaagaaaa

SEQ ID NO: 4005570 - RNA, 22 nt, Human immunodeficiency virus 1 [HIV-1]
acacaaguagacccugaacuag

SEQ ID NO: 4005571 - RNA, 22 nt, Human immunodeficiency virus 1 [HIV-1]
acacgaccuggauggaguggga

SEQ ID NO: 4005572 - RNA, 15 nt, Human immunodeficiency virus 1 [HIV-1]
acagccauagcagua

SEQ ID NO: 4005573 - RNA, 13 nt, Human immunodeficiency virus 1 [HIV-1]
acaggaccaugua

SEQ ID NO: 4005574 - RNA, 19 nt, Human immunodeficiency virus 1 [HIV-1]
acaggccagacaauuauug

SEQ ID NO: 4005575 - RNA, 16 nt, Human immunodeficiency virus 1 [HIV-1]
acaguacaauguacac

SEQ ID NO: 4005576 - RNA, 22 nt, Human immunodeficiency virus 1 [HIV-1]
acauggaauuaggccaguagua

SEQ ID NO: 4005577 - RNA, 11 nt, Human immunodeficiency virus 1 [HIV-1]
acauguggaaa

SEQ ID NO: 4005578 - RNA, 17 nt, Human immunodeficiency virus 1 [HIV-1]
accaccgcuugagagac

SEQ ID NO: 4005579 - RNA, 20 nt, Human immunodeficiency virus 1 [HIV-1]
accagacaaaaaacaucaga

SEQ ID NO: 4005580 - RNA, 14 nt, Human immunodeficiency virus 1 [HIV-1]
accaguuagagaaa

SEQ ID NO: 4005581 - RNA, 17 nt, Human immunodeficiency virus 1 [HIV-1]
accugccaccuguagua

SEQ ID NO: 4005582 - RNA, 18 nt, Human immunodeficiency virus 1 [HIV-1]
acuaaauuaggaaaagca

SEQ ID NO: 4005583 - RNA, 14 nt, Human immunodeficiency virus 1 [HIV-1]
acucgacagaggag

SEQ ID NO: 4005584 - RNA, 23 nt, Human immunodeficiency virus 1 [HIV-1]
acuguuuaauaguacuugguuua

SEQ ID NO: 4005585 - RNA, 15 nt, Human immunodeficiency virus 1 [HIV-1]
acuuaauaagagaac

SEQ ID NO: 4005586 - RNA, 18 nt, Human immunodeficiency virus 1 [HIV-1]
agaaaagaaugaacaaga

SEQ ID NO: 4005587 - RNA, 22 nt, Human immunodeficiency virus 1 [HIV-1]
agaaaggagagauaaaaaacug

SEQ ID NO: 4005588 - RNA, 15 nt, Human immunodeficiency virus 1 [HIV-1]
agaagaagagguagu

SEQ ID NO: 4005589 - RNA, 20 nt, Human immunodeficiency virus 1 [HIV-1]
agaaguguuagaguggaggu

SEQ ID NO: 4005590 - RNA, 16 nt, Human immunodeficiency virus 1 [HIV-1]
agaauuauuggaauua

SEQ ID NO: 4005591 - RNA, 13 nt, Human immunodeficiency virus 1 [HIV-1]
agacaagcacauu

SEQ ID NO: 4005592 - RNA, 14 nt, Human immunodeficiency virus 1 [HIV-1]
agacauaauagcaa

SEQ ID NO: 4005593 - RNA, 20 nt, Human immunodeficiency virus 1 [HIV-1]
agacauaauagcaacagaca

SEQ ID NO: 4005594 - RNA, 16 nt, Human immunodeficiency virus 1 [HIV-1]
agacauacaaacuaaa

SEQ ID NO: 4005595 - RNA, 15 nt, Human immunodeficiency virus 1 [HIV-1]
agaccagaucugagc

SEQ ID NO: 4005596 - RNA, 22 nt, Human immunodeficiency virus 1 [HIV-1]
agaccagaucugagccugggag

SEQ ID NO: 4005597 - RNA, 16 nt, Human immunodeficiency virus 1 [HIV-1]
agacccaacaacaaua

SEQ ID NO: 4005598 - RNA, 21 nt, Human immunodeficiency virus 1 [HIV-1]
agacgagcugagccagcagca

SEQ ID NO: 4005599 - RNA, 13 nt, Human immunodeficiency virus 1 [HIV-1]
agagaaaaaagag

SEQ ID NO: 4005600 - RNA, 15 nt, Human immunodeficiency virus 1 [HIV-1]
agagaacaccagcuu

SEQ ID NO: 4005601 - RNA, 19 nt, Human immunodeficiency virus 1 [HIV-1]
agaggccaauaaaggagag

SEQ ID NO: 4005602 - RNA, 14 nt, Human immunodeficiency virus 1 [HIV-1]
agagguacauaaug

SEQ ID NO: 4005603 - RNA, 20 nt, Human immunodeficiency virus 1 [HIV-1]
agauauccuugaucugugga

SEQ ID NO: 4005604 - RNA, 16 nt, Human immunodeficiency virus 1 [HIV-1]
agauccuagacuagag

SEQ ID NO: 4005605 - RNA, 22 nt, Human immunodeficiency virus 1 [HIV-1]
agauccugcauauaagcagcug

SEQ ID NO: 4005606 - RNA, 13 nt, Human immunodeficiency virus 1 [HIV-1]
agauggaauagau

SEQ ID NO: 4005607 - RNA, 18 nt, Human immunodeficiency virus 1 [HIV-1]
agauggggcagcuaacag

SEQ ID NO: 4005608 - RNA, 16 nt, Human immunodeficiency virus 1 [HIV-1]
agcaaauuaagagaac

SEQ ID NO: 4005609 - RNA, 18 nt, Human immunodeficiency virus 1 [HIV-1]
agcaagaaauggagccag

SEQ ID NO: 4005610 - RNA, 21 nt, Human immunodeficiency virus 1 [HIV-1]
agcagcagauagggugggagc

SEQ ID NO: 4005611 - RNA, 12 nt, Human immunodeficiency virus 1 [HIV-1]
agcagcaggaag

SEQ ID NO: 4005612 - RNA, 13 nt, Human immunodeficiency virus 1 [HIV-1]
agcagcaggaagc

SEQ ID NO: 4005613 - RNA, 23 nt, Human immunodeficiency virus 1 [HIV-1]
uaccuaaaggaucaacagcuccu

SEQ ID NO: 4005614 - RNA, 13 nt, Human immunodeficiency virus 1 [HIV-1]
uaccuagaagaau

SEQ ID NO: 4005615 - RNA, 11 nt, Human immunodeficiency virus 1 [HIV-1]
uagaaggaaaa

SEQ ID NO: 4005616 - RNA, 13 nt, Human immunodeficiency virus 1 [HIV-1]
uagacuaauagaa

SEQ ID NO: 4005617 - RNA, 14 nt, Human immunodeficiency virus 1 [HIV-1]
uaguauaaacaaug

SEQ ID NO: 4005618 - RNA, 16 nt, Human immunodeficiency virus 1 [HIV-1]
uggcaaguagacagga

SEQ ID NO: 4005619 - RNA, 18 nt, Human immunodeficiency virus 1 [HIV-1]
uggcagaaaguaggaaaa

SEQ ID NO: 4005620 - RNA, 22 nt, Human immunodeficiency virus 1 [HIV-1]
uggcaguauucauccacaauuu

SEQ ID NO: 4005621 - RNA, 22 nt, Human immunodeficiency virus 1 [HIV-1]
ugguuagaccagaucugagccu

SEQ ID NO: 4005622 - RNA, 19 nt, Human immunodeficiency virus 1 [HIV-1]
uguaacauuaguagagcaa

SEQ ID NO: 4005623 - RNA, 19 nt, Human immunodeficiency virus 1 [HIV-1]
uuaaacugcccauacaaaa

SEQ ID NO: 4005624 - RNA, 13 nt, Human immunodeficiency virus 1 [HIV-1]
uuaagacaaagaa

SEQ ID NO: 4005625 - RNA, 13 nt, Human immunodeficiency virus 1 [HIV-1]
uuaagaccaauga

SEQ ID NO: 4005626 - RNA, 13 nt, Human immunodeficiency virus 1 [HIV-1]
uuaauuguggagg

SEQ ID NO: 4005627 - RNA, 21 nt, Human immunodeficiency virus 1 [HIV-1]
uuagagccuuuuagaaaacaa

SEQ ID NO: 4005628 - RNA, 22 nt, Human immunodeficiency virus 1 [HIV-1]
uuaguaguagcaauaauaauag

SEQ ID NO: 4005629 - RNA, 20 nt, Human immunodeficiency virus 1 [HIV-1]
uuguuacacccugugagccu

SEQ ID NO: 4005630 - RNA, 14 nt, Human immunodeficiency virus 1 [HIV-1]
aaaacaaaauccag

SEQ ID NO: 4005631 - RNA, 22 nt, Human immunodeficiency virus 1 [HIV-1]
aaaaguagugugauuggauggc

SEQ ID NO: 4005632 - RNA, 15 nt, Human immunodeficiency virus 1 [HIV-1]
aaaauauuaagacaa

SEQ ID NO: 4005633 - RNA, 15 nt, Human immunodeficiency virus 1 [HIV-1]
aaaauuagcaggaag

SEQ ID NO: 4005634 - RNA, 21 nt, Human immunodeficiency virus 1 [HIV-1]
aaacaauaaucuuuaagcaau

SEQ ID NO: 4005635 - RNA, 19 nt, Human immunodeficiency virus 1 [HIV-1]
aaacagauagcuagcaaau

SEQ ID NO: 4005636 - RNA, 15 nt, Human immunodeficiency virus 1 [HIV-1]
aaacagggcaggaaa

SEQ ID NO: 4005637 - RNA, 23 nt, Human immunodeficiency virus 1 [HIV-1]
aaacugcccauacaaaaggaaac

SEQ ID NO: 4005638 - RNA, 13 nt, Human immunodeficiency virus 1 [HIV-1]
aaagaaaaaagac

SEQ ID NO: 4005639 - RNA, 19 nt, Human immunodeficiency virus 1 [HIV-1]
aaagcauaugauacagagg

SEQ ID NO: 4005640 - RNA, 13 nt, Human immunodeficiency virus 1 [HIV-1]
aaaggaagggaaa

SEQ ID NO: 4005641 - RNA, 12 nt, Human immunodeficiency virus 1 [HIV-1]
aaaucucuggaa

SEQ ID NO: 4005642 - RNA, 13 nt, Human immunodeficiency virus 1 [HIV-1]
aacaacugcuguu

SEQ ID NO: 4005643 - RNA, 13 nt, Human immunodeficiency virus 1 [HIV-1]
aacagauuuggaa

SEQ ID NO: 4005644 - RNA, 21 nt, Human immunodeficiency virus 1 [HIV-1]
aacaugagaaauaucacagua

SEQ ID NO: 4005645 - RNA, 13 nt, Human immunodeficiency virus 1 [HIV-1]
aagacuuaauagc

SEQ ID NO: 4005646 - RNA, 15 nt, Human immunodeficiency virus 1 [HIV-1]
aaggugcagaaagaa

SEQ ID NO: 4005647 - RNA, 21 nt, Human immunodeficiency virus 1 [HIV-1]
aaguuuguuucauaacaaaag

SEQ ID NO: 4005648 - RNA, 13 nt, Human immunodeficiency virus 1 [HIV-1]
aauacagcagcua

SEQ ID NO: 4005649 - RNA, 18 nt, Human immunodeficiency virus 1 [HIV-1]
aauagacagguuaauuga

SEQ ID NO: 4005650 - RNA, 16 nt, Human immunodeficiency virus 1 [HIV-1]
aauggaggaaaaagag

SEQ ID NO: 4005651 - RNA, 18 nt, Human immunodeficiency virus 1 [HIV-1]
aauugugggucacagucu

SEQ ID NO: 4005652 - RNA, 11 nt, Human immunodeficiency virus 1 [HIV-1]
acaaaaacaaa

SEQ ID NO: 4005653 - RNA, 23 nt, Human immunodeficiency virus 1 [HIV-1]
acaaauuauaaacauguggcaga

SEQ ID NO: 4005654 - RNA, 17 nt, Human immunodeficiency virus 1 [HIV-1]
acaacaauacaagaaaa

SEQ ID NO: 4005655 - RNA, 13 nt, Human immunodeficiency virus 1 [HIV-1]
acaagaauuauug

SEQ ID NO: 4005656 - RNA, 18 nt, Human immunodeficiency virus 1 [HIV-1]
acaaguagcaauacagca

SEQ ID NO: 4005657 - RNA, 22 nt, Human immunodeficiency virus 1 [HIV-1]
acaauuacacaagcuuaauaca

SEQ ID NO: 4005658 - RNA, 14 nt, Human immunodeficiency virus 1 [HIV-1]
acaauuuuaaaaga

SEQ ID NO: 4005659 - RNA, 14 nt, Human immunodeficiency virus 1 [HIV-1]
acaccaaaaaagau

SEQ ID NO: 4005660 - RNA, 21 nt, Human immunodeficiency virus 1 [HIV-1]
acacccugugagccugcaugg

SEQ ID NO: 4005661 - RNA, 19 nt, Human immunodeficiency virus 1 [HIV-1]
acagccauagcaguagcug

SEQ ID NO: 4005662 - RNA, 20 nt, Human immunodeficiency virus 1 [HIV-1]
acagucuggggcaucaagca

SEQ ID NO: 4005663 - RNA, 15 nt, Human immunodeficiency virus 1 [HIV-1]
accacuaacagaaga

SEQ ID NO: 4005664 - RNA, 21 nt, Human immunodeficiency virus 1 [HIV-1]
accagaucugagccugggagc

SEQ ID NO: 4005665 - RNA, 22 nt, Human immunodeficiency virus 1 [HIV-1]
accagaucugagccugggagcu

SEQ ID NO: 4005666 - RNA, 15 nt, Human immunodeficiency virus 1 [HIV-1]
acccacaagaaguag

SEQ ID NO: 4005667 - RNA, 13 nt, Human immunodeficiency virus 1 [HIV-1]
acccggagagaga

SEQ ID NO: 4005668 - RNA, 13 nt, Human immunodeficiency virus 1 [HIV-1]
acccugugagccu

SEQ ID NO: 4005669 - RNA, 16 nt, Human immunodeficiency virus 1 [HIV-1]
acccugugagccugca

SEQ ID NO: 4005670 - RNA, 14 nt, Human immunodeficiency virus 1 [HIV-1]
accgcuugagagac

SEQ ID NO: 4005671 - RNA, 19 nt, Human immunodeficiency virus 1 [HIV-1]
acgagcugagccagcagca

SEQ ID NO: 4005672 - RNA, 19 nt, Human immunodeficiency virus 1 [HIV-1]
acgaucugcggagccugug

SEQ ID NO: 4005673 - RNA, 18 nt, Human immunodeficiency virus 1 [HIV-1]
acgcagggggugggaagc

SEQ ID NO: 4005674 - RNA, 19 nt, Human immunodeficiency virus 1 [HIV-1]
acgcagggggugggaagcc

SEQ ID NO: 4005675 - RNA, 17 nt, Human immunodeficiency virus 1 [HIV-1]
acuagcagcauuaauaa

SEQ ID NO: 4005676 - RNA, 19 nt, Human immunodeficiency virus 1 [HIV-1]
acugcccauacaaaaggaa

SEQ ID NO: 4005677 - RNA, 19 nt, Human immunodeficiency virus 1 [HIV-1]
acugcuuaagccucaauaa

SEQ ID NO: 4005678 - RNA, 15 nt, Human immunodeficiency virus 1 [HIV-1]
uucaagaacugcuga

SEQ ID NO: 4005679 - RNA, 11 nt, Human immunodeficiency virus 1 [HIV-1]
uuccagggagg

SEQ ID NO: 4005680 - RNA, 17 nt, Human immunodeficiency virus 1 [HIV-1]
uugcucaaugccacagc

SEQ ID NO: 4005681 - RNA, 22 nt, Human immunodeficiency virus 1 [HIV-1]
uauagugcagcagcagaacaau

SEQ ID NO: 4005682 - RNA, 14 nt, Human immunodeficiency virus 1 [HIV-1]
ucaagcacaaccag

SEQ ID NO: 4005683 - RNA, 18 nt, Human immunodeficiency virus 1 [HIV-1]
ucacucccaaagaagaca

SEQ ID NO: 4005684 - RNA, 22 nt, Human immunodeficiency virus 1 [HIV-1]
ucagguaccuuuaagaccaaug

SEQ ID NO: 4005685 - RNA, 13 nt, Human immunodeficiency virus 1 [HIV-1]
ucauagaaaucug

SEQ ID NO: 4005686 - RNA, 23 nt, Human immunodeficiency virus 1 [HIV-1]
uccaagaauaaguucagaaguac

SEQ ID NO: 4005687 - RNA, 14 nt, Human immunodeficiency virus 1 [HIV-1]
ucuaaaauguaaua

SEQ ID NO: 4005688 - RNA, 22 nt, Human immunodeficiency virus 1 [HIV-1]
ucugcauacaggagaaagagac

SEQ ID NO: 4005689 - RNA, 17 nt, Human immunodeficiency virus 1 [HIV-1]
ucuggcuaacuagggaa

SEQ ID NO: 4005690 - RNA, 19 nt, Human immunodeficiency virus 1 [HIV-1]
ugaacacaucuguagaaau

SEQ ID NO: 4005691 - RNA, 18 nt, Human immunodeficiency virus 1 [HIV-1]
ugacaauggcagcaauuu

SEQ ID NO: 4005692 - RNA, 18 nt, Human immunodeficiency virus 1 [HIV-1]
ugacaugguagaacagau

SEQ ID NO: 4005693 - RNA, 17 nt, Human immunodeficiency virus 1 [HIV-1]
ugagggacaauuggaga

SEQ ID NO: 4005694 - RNA, 23 nt, Human immunodeficiency virus 1 [HIV-1]
uggcaggaagaagcggagacagc

SEQ ID NO: 4005695 - RNA, 14 nt, Human immunodeficiency virus 1 [HIV-1]
uggcccgagagcug

SEQ ID NO: 4005696 - RNA, 15 nt, Human immunodeficiency virus 1 [HIV-1]
uggggacuuuccagg

SEQ ID NO: 4005697 - RNA, 18 nt, Human immunodeficiency virus 1 [HIV-1]
ugggguaccuguguggaa

SEQ ID NO: 4005698 - RNA, 13 nt, Human immunodeficiency virus 1 [HIV-1]
uggguuuuccagu

SEQ ID NO: 4005699 - RNA, 16 nt, Human immunodeficiency virus 1 [HIV-1]
uguaugccccucccau

SEQ ID NO: 4005700 - RNA, 20 nt, Human immunodeficiency virus 1 [HIV-1]
ugugagccugcaugggaugg

SEQ ID NO: 4005701 - RNA, 21 nt, Human immunodeficiency virus 1 [HIV-1]
ugugccuggcuagaagcacaa

SEQ ID NO: 4005702 - RNA, 20 nt, Human immunodeficiency virus 1 [HIV-1]
uuagaccagaucugagccug

SEQ ID NO: 4005703 - RNA, 15 nt, Human immunodeficiency virus 1 [HIV-1]
uuaucugggacgauc

SEQ ID NO: 4005704 - RNA, 18 nt, Human immunodeficiency virus 1 [HIV-1]
uucugcaacaacugcugu

SEQ ID NO: 4005705 - RNA, 14 nt, Human immunodeficiency virus 1 [HIV-1]
uuggaagaaaucug

SEQ ID NO: 4005706 - RNA, 19 nt, Human immunodeficiency virus 1 [HIV-1]
uuuagaaggaaaaguuauc

SEQ ID NO: 4005707 - RNA, 15 nt, Human immunodeficiency virus 1 [HIV-1]
cuaacugacacaaca

SEQ ID NO: 4005708 - RNA, 18 nt, Human immunodeficiency virus 1 [HIV-1]
cuacaguauuggagucag

SEQ ID NO: 4005709 - RNA, 19 nt, Human immunodeficiency virus 1 [HIV-1]
cuacuucccugauuagcag

SEQ ID NO: 4005710 - RNA, 18 nt, Human immunodeficiency virus 1 [HIV-1]
cuauaccaauaguagcaa

SEQ ID NO: 4005711 - RNA, 14 nt, Human immunodeficiency virus 1 [HIV-1]
cuauagugaauaga

SEQ ID NO: 4005712 - RNA, 21 nt, Human immunodeficiency virus 1 [HIV-1]
cuaugaauaaagaauuaaaga

SEQ ID NO: 4005713 - RNA, 15 nt, Human immunodeficiency virus 1 [HIV-1]
cucaggaggggaccc

SEQ ID NO: 4005714 - RNA, 23 nt, Human immunodeficiency virus 1 [HIV-1]
cuccaggcaagaauccuggcugu

SEQ ID NO: 4005715 - RNA, 17 nt, Human immunodeficiency virus 1 [HIV-1]
cucccaugcagaauaaa

SEQ ID NO: 4005716 - RNA, 17 nt, Human immunodeficiency virus 1 [HIV-1]
cucucugguuagaccag

SEQ ID NO: 4005717 - RNA, 16 nt, Human immunodeficiency virus 1 [HIV-1]
cugaccuuuggauggu

SEQ ID NO: 4005718 - RNA, 12 nt, Human immunodeficiency virus 1 [HIV-1]
cugagccuggga

SEQ ID NO: 4005719 - RNA, 19 nt, Human immunodeficiency virus 1 [HIV-1]
cugcauacaggagaaagag

SEQ ID NO: 4005720 - RNA, 22 nt, Human immunodeficiency virus 1 [HIV-1]
cugcucuuucaauaucagcaca

SEQ ID NO: 4005721 - RNA, 19 nt, Human immunodeficiency virus 1 [HIV-1]
cuguacugggucucucugg

SEQ ID NO: 4005722 - RNA, 19 nt, Human immunodeficiency virus 1 [HIV-1]
cuguagugcuacagaaaaa

SEQ ID NO: 4005723 - RNA, 19 nt, Human immunodeficiency virus 1 [HIV-1]
cuguuagcuugcucaaugc

SEQ ID NO: 4005724 - RNA, 16 nt, Human immunodeficiency virus 1 [HIV-1]
cuucccugauuagcag

SEQ ID NO: 4005725 - RNA, 18 nt, Human immunodeficiency virus 1 [HIV-1]
cuucccugauuagcagaa

SEQ ID NO: 4005726 - RNA, 12 nt, Human immunodeficiency virus 1 [HIV-1]
cuuggaaaggau

SEQ ID NO: 4005727 - RNA, 13 nt, Human immunodeficiency virus 1 [HIV-1]
gaaaaaagagcag

SEQ ID NO: 4005728 - RNA, 20 nt, Human immunodeficiency virus 1 [HIV-1]
gaaaaaauaaaagcauuagu

SEQ ID NO: 4005729 - RNA, 13 nt, Human immunodeficiency virus 1 [HIV-1]
gaaauggagccag

SEQ ID NO: 4005730 - RNA, 15 nt, Human immunodeficiency virus 1 [HIV-1]
gaacaauuuggaaau

SEQ ID NO: 4005731 - RNA, 20 nt, Human immunodeficiency virus 1 [HIV-1]
gaacuacacaccagggccag

SEQ ID NO: 4005732 - RNA, 17 nt, Human immunodeficiency virus 1 [HIV-1]
gaaugagacgagcugag

SEQ ID NO: 4005733 - RNA, 18 nt, Human immunodeficiency virus 1 [HIV-1]
gacaaguagacuguaguc

SEQ ID NO: 4005734 - RNA, 22 nt, Human immunodeficiency virus 1 [HIV-1]
gacagagaaauuaacaauuaca

SEQ ID NO: 4005735 - RNA, 13 nt, Human immunodeficiency virus 1 [HIV-1]
gacagguaagaga

SEQ ID NO: 4005736 - RNA, 22 nt, Human immunodeficiency virus 1 [HIV-1]
gacauaauagcaacagacauac

SEQ ID NO: 4005737 - RNA, 11 nt, Human immunodeficiency virus 1 [HIV-1]
gaccaaugacu

SEQ ID NO: 4005738 - RNA, 19 nt, Human immunodeficiency virus 1 [HIV-1]
gaccagaucugagccuggg

SEQ ID NO: 4005739 - RNA, 16 nt, Human immunodeficiency virus 1 [HIV-1]
gacccggagagagaag

SEQ ID NO: 4005740 - RNA, 13 nt, Human immunodeficiency virus 1 [HIV-1]
gacuagagcccug

SEQ ID NO: 4005741 - RNA, 10 nt, Human immunodeficiency virus 1 [HIV-1]
gacuggggag

SEQ ID NO: 4005742 - RNA, 19 nt, Human immunodeficiency virus 1 [HIV-1]
gacuuaauagcagaaauac

SEQ ID NO: 4005743 - RNA, 14 nt, Human immunodeficiency virus 1 [HIV-1]
gacuuuccagggag

SEQ ID NO: 4005744 - RNA, 21 nt, Human immunodeficiency virus 1 [HIV-1]
gagagaaguguuagaguggag

SEQ ID NO: 4005745 - RNA, 14 nt, Human immunodeficiency virus 1 [HIV-1]
gagccagcagcaga

SEQ ID NO: 4005746 - RNA, 19 nt, Human immunodeficiency virus 1 [HIV-1]
gagcuugcuacaagggacu

SEQ ID NO: 4005747 - RNA, 22 nt, Human immunodeficiency virus 1 [HIV-1]
gaggccaauaaaggagagaaca

SEQ ID NO: 4005748 - RNA, 15 nt, Human immunodeficiency virus 1 [HIV-1]
gaggcguggccuggg

SEQ ID NO: 4005749 - RNA, 14 nt, Human immunodeficiency virus 1 [HIV-1]
gagugggacagaga

SEQ ID NO: 4005750 - RNA, 15 nt, Human immunodeficiency virus 1 [HIV-1]
gauauccacugaccu

SEQ ID NO: 4005751 - RNA, 14 nt, Human immunodeficiency virus 1 [HIV-1]
gaucaacagcuccu

SEQ ID NO: 4005752 - RNA, 16 nt, Human immunodeficiency virus 1 [HIV-1]
gaugacccggagagag

SEQ ID NO: 4005753 - RNA, 21 nt, Human immunodeficiency virus 1 [HIV-1]
gauggaacaagccccagaaga

SEQ ID NO: 4005754 - RNA, 14 nt, Human immunodeficiency virus 1 [HIV-1]
gcaaauuaagagaa

SEQ ID NO: 4005755 - RNA, 18 nt, Human immunodeficiency virus 1 [HIV-1]
gcacaagcauaagaggua

SEQ ID NO: 4005756 - RNA, 12 nt, Human immunodeficiency virus 1 [HIV-1]
gcacauuguaac

SEQ ID NO: 4005757 - RNA, 12 nt, Human immunodeficiency virus 1 [HIV-1]
gcagaaguuauu

SEQ ID NO: 4005758 - RNA, 14 nt, Human immunodeficiency virus 1 [HIV-1]
gcagauaggguggg

SEQ ID NO: 4005759 - RNA, 21 nt, Human immunodeficiency virus 1 [HIV-1]
gcagcagauagggugggagca

SEQ ID NO: 4005760 - RNA, 14 nt, Human immunodeficiency virus 1 [HIV-1]
gcagcagcagaaca

SEQ ID NO: 4005761 - RNA, 14 nt, Human immunodeficiency virus 1 [HIV-1]
gcaucaagcagcuc

SEQ ID NO: 4005762 - RNA, 14 nt, Human immunodeficiency virus 1 [HIV-1]
gcaucucgagaccu

SEQ ID NO: 4005763 - RNA, 17 nt, Human immunodeficiency virus 1 [HIV-1]
gccaagaagaaaagcaa

SEQ ID NO: 4005764 - RNA, 18 nt, Human immunodeficiency virus 1 [HIV-1]
gcccgagagcugcauccg

SEQ ID NO: 4005765 - RNA, 18 nt, Human immunodeficiency virus 1 [HIV-1]
gcccucagauccugcaua

SEQ ID NO: 4005766 - RNA, 15 nt, Human immunodeficiency virus 1 [HIV-1]
gcuaccaaugcugcu

SEQ ID NO: 4005767 - RNA, 22 nt, Human immunodeficiency virus 1 [HIV-1]
gcugacaucgagcuugcuacaa

SEQ ID NO: 4005768 - RNA, 14 nt, Human immunodeficiency virus 1 [HIV-1]
gcugcuugugccug

SEQ ID NO: 4005769 - RNA, 17 nt, Human immunodeficiency virus 1 [HIV-1]
gcugcuugugccuggcu

SEQ ID NO: 4005770 - RNA, 14 nt, Human immunodeficiency virus 1 [HIV-1]
gcuugugccuggcu

SEQ ID NO: 4005771 - RNA, 14 nt, Human immunodeficiency virus 1 [HIV-1]
ggaacuucugggac

SEQ ID NO: 4005772 - RNA, 20 nt, Human immunodeficiency virus 1 [HIV-1]
ggacgaucugcggagccugu

SEQ ID NO: 4005773 - RNA, 12 nt, Human immunodeficiency virus 1 [HIV-1]
ggacuuuccagg

SEQ ID NO: 4005774 - RNA, 17 nt, Human immunodeficiency virus 1 [HIV-1]
ggagagagagacagaga

SEQ ID NO: 4005775 - RNA, 16 nt, Human immunodeficiency virus 1 [HIV-1]
ggaguacuucaagaac

SEQ ID NO: 4005776 - RNA, 21 nt, Human immunodeficiency virus 1 [HIV-1]
ggcaucuccuauggcaggaag

SEQ ID NO: 4005777 - RNA, 16 nt, Human immunodeficiency virus 1 [HIV-1]
gggaggcguggccugg

SEQ ID NO: 4005778 - RNA, 17 nt, Human immunodeficiency virus 1 [HIV-1]
gggaggcguggccuggg

SEQ ID NO: 4005779 - RNA, 17 nt, Human immunodeficiency virus 1 [HIV-1]
gggcaaguuuguggaau

SEQ ID NO: 4005780 - RNA, 16 nt, Human immunodeficiency virus 1 [HIV-1]
gguaccuguguggaag

SEQ ID NO: 4005781 - RNA, 21 nt, Human immunodeficiency virus 1 [HIV-1]
gguauagugcagcagcagaac

SEQ ID NO: 4005782 - RNA, 21 nt, Human immunodeficiency virus 1 [HIV-1]
gguggagagagagacagagac

SEQ ID NO: 4005783 - RNA, 13 nt, Human immunodeficiency virus 1 [HIV-1]
gguugcucuggaa

SEQ ID NO: 4005784 - RNA, 21 nt, Human immunodeficiency virus 1 [HIV-1]
gguuuuccagucacaccucag

SEQ ID NO: 4005785 - RNA, 15 nt, Human immunodeficiency virus 1 [HIV-1]
guacacauuuagaag

SEQ ID NO: 4005786 - RNA, 17 nt, Human immunodeficiency virus 1 [HIV-1]
guacacauuuagaagga

SEQ ID NO: 4005787 - RNA, 16 nt, Human immunodeficiency virus 1 [HIV-1]
guacuucaagaacugc

SEQ ID NO: 4005788 - RNA, 20 nt, Human immunodeficiency virus 1 [HIV-1]
guagacccugaacuagcaga

SEQ ID NO: 4005789 - RNA, 16 nt, Human immunodeficiency virus 1 [HIV-1]
gugaauaucaagcagg

SEQ ID NO: 4005790 - RNA, 13 nt, Human immunodeficiency virus 1 [HIV-1]
guucuugggagca

SEQ ID NO: 4005791 - RNA, 16 nt, Human immunodeficiency virus 1 [HIV-1]
uaaagaauuacaaaaa

SEQ ID NO: 4005792 - RNA, 15 nt, Human immunodeficiency virus 1 [HIV-1]
uaaagccauguguaa

SEQ ID NO: 4005793 - RNA, 18 nt, Human immunodeficiency virus 1 [HIV-1]
uaacacuuuaaaacagau

SEQ ID NO: 4005794 - RNA, 14 nt, Human immunodeficiency virus 1 [HIV-1]
uaacagaagaagca

SEQ ID NO: 4005795 - RNA, 18 nt, Human immunodeficiency virus 1 [HIV-1]
uaagagaacaauuuggaa

SEQ ID NO: 4005796 - RNA, 21 nt, Human immunodeficiency virus 1 [HIV-1]
uaauaguacagcugaacacau

SEQ ID NO: 4005797 - RNA, 16 nt, Human immunodeficiency virus 1 [HIV-1]
uaaucauagaauauag

SEQ ID NO: 4005798 - RNA, 23 nt, Human immunodeficiency virus 1 [HIV-1]
agcaguagcugaggggacagaua

SEQ ID NO: 4005799 - RNA, 13 nt, Human immunodeficiency virus 1 [HIV-1]
agcauccaggaag

SEQ ID NO: 4005800 - RNA, 16 nt, Human immunodeficiency virus 1 [HIV-1]
agcaucucgagaccug

SEQ ID NO: 4005801 - RNA, 23 nt, Human immunodeficiency virus 1 [HIV-1]
agccaguggauauauagaagcag

SEQ ID NO: 4005802 - RNA, 17 nt, Human immunodeficiency virus 1 [HIV-1]
agccugcaugggaugga

SEQ ID NO: 4005803 - RNA, 21 nt, Human immunodeficiency virus 1 [HIV-1]
agccugcaugggauggaugac

SEQ ID NO: 4005804 - RNA, 14 nt, Human immunodeficiency virus 1 [HIV-1]
aggaccauguacaa

SEQ ID NO: 4005805 - RNA, 17 nt, Human immunodeficiency virus 1 [HIV-1]
aggccagacaauuauug

SEQ ID NO: 4005806 - RNA, 16 nt, Human immunodeficiency virus 1 [HIV-1]
agggagucuccauaga

SEQ ID NO: 4005807 - RNA, 18 nt, Human immunodeficiency virus 1 [HIV-1]
agggcuaauucacuccca

SEQ ID NO: 4005808 - RNA, 18 nt, Human immunodeficiency virus 1 [HIV-1]
agguauccuuugagccaa

SEQ ID NO: 4005809 - RNA, 14 nt, Human immunodeficiency virus 1 [HIV-1]
aguauaaacaauga

SEQ ID NO: 4005810 - RNA, 18 nt, Human immunodeficiency virus 1 [HIV-1]
aguauugguaaaugugac

SEQ ID NO: 4005811 - RNA, 19 nt, Human immunodeficiency virus 1 [HIV-1]
agugcugccagaaaaagac

SEQ ID NO: 4005812 - RNA, 20 nt, Human immunodeficiency virus 1 [HIV-1]
auaaacuugauauaauacca

SEQ ID NO: 4005813 - RNA, 21 nt, Human immunodeficiency virus 1 [HIV-1]
auaagacagggcuuggaaagg

SEQ ID NO: 4005814 - RNA, 19 nt, Human immunodeficiency virus 1 [HIV-1]
auaccacuaacagaagaag

SEQ ID NO: 4005815 - RNA, 20 nt, Human immunodeficiency virus 1 [HIV-1]
aucaaauuuaucaagagcca

SEQ ID NO: 4005816 - RNA, 16 nt, Human immunodeficiency virus 1 [HIV-1]
aucuuaagacagcagu

SEQ ID NO: 4005817 - RNA, 11 nt, Human immunodeficiency virus 1 [HIV-1]
augaacuccau

SEQ ID NO: 4005818 - RNA, 13 nt, Human immunodeficiency virus 1 [HIV-1]
augcaagaaugag

SEQ ID NO: 4005819 - RNA, 12 nt, Human immunodeficiency virus 1 [HIV-1]
auggaaaaggaa

SEQ ID NO: 4005820 - RNA, 17 nt, Human immunodeficiency virus 1 [HIV-1]
auggaaaccaaaaauga

SEQ ID NO: 4005821 - RNA, 16 nt, Human immunodeficiency virus 1 [HIV-1]
auggcccaaaaguuaa

SEQ ID NO: 4005822 - RNA, 15 nt, Human immunodeficiency virus 1 [HIV-1]
auguaauaauaagac

SEQ ID NO: 4005823 - RNA, 17 nt, Human immunodeficiency virus 1 [HIV-1]
augucagcuaaaaggag

SEQ ID NO: 4005824 - RNA, 13 nt, Human immunodeficiency virus 1 [HIV-1]
auuaaagaaaauu

SEQ ID NO: 4005825 - RNA, 22 nt, Human immunodeficiency virus 1 [HIV-1]
auuaagacaaagaaaaauagac

SEQ ID NO: 4005826 - RNA, 19 nt, Human immunodeficiency virus 1 [HIV-1]
auuagaacauggaaaaguu

SEQ ID NO: 4005827 - RNA, 18 nt, Human immunodeficiency virus 1 [HIV-1]
auuagggauuauggaaaa

SEQ ID NO: 4005828 - RNA, 13 nt, Human immunodeficiency virus 1 [HIV-1]
auuaguagaaauu

SEQ ID NO: 4005829 - RNA, 18 nt, Human immunodeficiency virus 1 [HIV-1]
auugggugucgacauagc

SEQ ID NO: 4005830 - RNA, 22 nt, Human immunodeficiency virus 1 [HIV-1]
auugguuuaacauaacaaauug

SEQ ID NO: 4005831 - RNA, 17 nt, Human immunodeficiency virus 1 [HIV-1]
auuuagaaggaaaaguu

SEQ ID NO: 4005832 - RNA, 16 nt, Human immunodeficiency virus 1 [HIV-1]
auuugccauaaagaaa

SEQ ID NO: 4005833 - RNA, 19 nt, Human immunodeficiency virus 1 [HIV-1]
auuugggguugcucuggaa

SEQ ID NO: 4005834 - RNA, 14 nt, Human immunodeficiency virus 1 [HIV-1]
caaauuacaaaaau

SEQ ID NO: 4005835 - RNA, 16 nt, Human immunodeficiency virus 1 [HIV-1]
caagaauaaguucaga

SEQ ID NO: 4005836 - RNA, 14 nt, Human immunodeficiency virus 1 [HIV-1]
caagaauuauugga

SEQ ID NO: 4005837 - RNA, 13 nt, Human immunodeficiency virus 1 [HIV-1]
caauaguagcaau

SEQ ID NO: 4005838 - RNA, 15 nt, Human immunodeficiency virus 1 [HIV-1]
caauaguagcaauag

SEQ ID NO: 4005839 - RNA, 21 nt, Human immunodeficiency virus 1 [HIV-1]
cacaaguagcaauacagcagc

SEQ ID NO: 4005840 - RNA, 17 nt, Human immunodeficiency virus 1 [HIV-1]
cacaccagacaaaaaac

SEQ ID NO: 4005841 - RNA, 13 nt, Human immunodeficiency virus 1 [HIV-1]
cacagagggagcc

SEQ ID NO: 4005842 - RNA, 13 nt, Human immunodeficiency virus 1 [HIV-1]
cacauuguaacau

SEQ ID NO: 4005843 - RNA, 15 nt, Human immunodeficiency virus 1 [HIV-1]
cacugaccuuuggau

SEQ ID NO: 4005844 - RNA, 15 nt, Human immunodeficiency virus 1 [HIV-1]
cacuuguggagaugg

SEQ ID NO: 4005845 - RNA, 14 nt, Human immunodeficiency virus 1 [HIV-1]
cagaaacagggcag

SEQ ID NO: 4005846 - RNA, 15 nt, Human immunodeficiency virus 1 [HIV-1]
cagaagacaguggca

SEQ ID NO: 4005847 - RNA, 22 nt, Human immunodeficiency virus 1 [HIV-1]
cagacucugcuauaagaaaggc

SEQ ID NO: 4005848 - RNA, 20 nt, Human immunodeficiency virus 1 [HIV-1]
cagaucaaagugaaucagag

SEQ ID NO: 4005849 - RNA, 17 nt, Human immunodeficiency virus 1 [HIV-1]
cagaucugagccuggga

SEQ ID NO: 4005850 - RNA, 21 nt, Human immunodeficiency virus 1 [HIV-1]
caggaagucagccuaaaacug

SEQ ID NO: 4005851 - RNA, 12 nt, Human immunodeficiency virus 1 [HIV-1]
caggagaaagag

SEQ ID NO: 4005852 - RNA, 19 nt, Human immunodeficiency virus 1 [HIV-1]
caggcccgaaggaauagaa

SEQ ID NO: 4005853 - RNA, 15 nt, Human immunodeficiency virus 1 [HIV-1]
cagggacagcagaaa

SEQ ID NO: 4005854 - RNA, 18 nt, Human immunodeficiency virus 1 [HIV-1]
caguauuagaagaaauga

SEQ ID NO: 4005855 - RNA, 20 nt, Human immunodeficiency virus 1 [HIV-1]
cagucacaccucagguaccu

SEQ ID NO: 4005856 - RNA, 16 nt, Human immunodeficiency virus 1 [HIV-1]
cagucuagcagaagaa

SEQ ID NO: 4005857 - RNA, 14 nt, Human immunodeficiency virus 1 [HIV-1]
caguuagagaaaga

SEQ ID NO: 4005858 - RNA, 11 nt, Human immunodeficiency virus 1 [HIV-1]
cauagcagaau

SEQ ID NO: 4005859 - RNA, 17 nt, Human immunodeficiency virus 1 [HIV-1]
cauaguaggagcagaaa

SEQ ID NO: 4005860 - RNA, 15 nt, Human immunodeficiency virus 1 [HIV-1]
caucaagcagcucca

SEQ ID NO: 4005861 - RNA, 12 nt, Human immunodeficiency virus 1 [HIV-1]
caugacaaaaau

SEQ ID NO: 4005862 - RNA, 23 nt, Human immunodeficiency virus 1 [HIV-1]
cauggguaccagcacacaaagga

SEQ ID NO: 4005863 - RNA, 20 nt, Human immunodeficiency virus 1 [HIV-1]
ccaaagaagacaagauaucc

SEQ ID NO: 4005864 - RNA, 13 nt, Human immunodeficiency virus 1 [HIV-1]
ccacuaacagaag

SEQ ID NO: 4005865 - RNA, 18 nt, Human immunodeficiency virus 1 [HIV-1]
ccacugcuuaagccucaa

SEQ ID NO: 4005866 - RNA, 20 nt, Human immunodeficiency virus 1 [HIV-1]
ccacugcuuaagccucaaua

SEQ ID NO: 4005867 - RNA, 18 nt, Human immunodeficiency virus 1 [HIV-1]
ccagggaggcguggccug

SEQ ID NO: 4005868 - RNA, 16 nt, Human immunodeficiency virus 1 [HIV-1]
ccaguuagagaaagaa

SEQ ID NO: 4005869 - RNA, 15 nt, Human immunodeficiency virus 1 [HIV-1]
ccauagcaguagcug

SEQ ID NO: 4005870 - RNA, 15 nt, Human immunodeficiency virus 1 [HIV-1]
cccgagagcugcauc

SEQ ID NO: 4005871 - RNA, 20 nt, Human immunodeficiency virus 1 [HIV-1]
ccguauccagagaggaccag

SEQ ID NO: 4005872 - RNA, 18 nt, Human immunodeficiency virus 1 [HIV-1]
ccugauuagcagaacuac

SEQ ID NO: 4005873 - RNA, 22 nt, Human immunodeficiency virus 1 [HIV-1]
ccuggaaaaacauggagcaauc

SEQ ID NO: 4005874 - RNA, 16 nt, Human immunodeficiency virus 1 [HIV-1]
ccuguguggaaggaag

SEQ ID NO: 4005875 - RNA, 13 nt, Human immunodeficiency virus 1 [HIV-1]
cgaaggaauagaa

SEQ ID NO: 4005876 - RNA, 23 nt, Human immunodeficiency virus 1 [HIV-1]
cgccacauaccuagaagaauaag

SEQ ID NO: 4005877 - RNA, 15 nt, Human immunodeficiency virus 1 [HIV-1]
auaaagaaaaaagac

SEQ ID NO: 4005878 - RNA, 14 nt, Human immunodeficiency virus 1 [HIV-1]
auaaaggagagaac

SEQ ID NO: 4005879 - RNA, 20 nt, Human immunodeficiency virus 1 [HIV-1]
auaagagguaaggugcagaa

SEQ ID NO: 4005880 - RNA, 13 nt, Human immunodeficiency virus 1 [HIV-1]
auacuaccagcua

SEQ ID NO: 4005881 - RNA, 13 nt, Human immunodeficiency virus 1 [HIV-1]
auagaagcagaag

SEQ ID NO: 4005882 - RNA, 20 nt, Human immunodeficiency virus 1 [HIV-1]
auauaaaguaguaaaaauug

SEQ ID NO: 4005883 - RNA, 16 nt, Human immunodeficiency virus 1 [HIV-1]
auauguuacuaauaga

SEQ ID NO: 4005884 - RNA, 17 nt, Human immunodeficiency virus 1 [HIV-1]
auauuaagacaaagaaa

SEQ ID NO: 4005885 - RNA, 14 nt, Human immunodeficiency virus 1 [HIV-1]
aucaaaguaagaca

SEQ ID NO: 4005886 - RNA, 16 nt, Human immunodeficiency virus 1 [HIV-1]
aucaaauaauagagca

SEQ ID NO: 4005887 - RNA, 16 nt, Human immunodeficiency virus 1 [HIV-1]
aucagaugcuaaagca

SEQ ID NO: 4005888 - RNA, 22 nt, Human immunodeficiency virus 1 [HIV-1]
aucccgcaggguuaaaaaagaa

SEQ ID NO: 4005889 - RNA, 13 nt, Human immunodeficiency virus 1 [HIV-1]
auccuagacuaga

SEQ ID NO: 4005890 - RNA, 23 nt, Human immunodeficiency virus 1 [HIV-1]
aucgcaaaaccagcaagaaaaga

SEQ ID NO: 4005891 - RNA, 15 nt, Human immunodeficiency virus 1 [HIV-1]
augagacaccaggga

SEQ ID NO: 4005892 - RNA, 17 nt, Human immunodeficiency virus 1 [HIV-1]
augagagugaaggagaa

SEQ ID NO: 4005893 - RNA, 16 nt, Human immunodeficiency virus 1 [HIV-1]
augaguuugccaggaa

SEQ ID NO: 4005894 - RNA, 14 nt, Human immunodeficiency virus 1 [HIV-1]
auggagaaaggaga

SEQ ID NO: 4005895 - RNA, 23 nt, Human immunodeficiency virus 1 [HIV-1]
auggccuacuguaagggaaagaa

SEQ ID NO: 4005896 - RNA, 16 nt, Human immunodeficiency virus 1 [HIV-1]
auggugguaauagcaa

SEQ ID NO: 4005897 - RNA, 16 nt, Human immunodeficiency virus 1 [HIV-1]
augucagcuaaaagga

SEQ ID NO: 4005898 - RNA, 13 nt, Human immunodeficiency virus 1 [HIV-1]
auguggaaaaaug

SEQ ID NO: 4005899 - RNA, 23 nt, Human immunodeficiency virus 1 [HIV-1]
auguuacuaauagaggaagacaa

SEQ ID NO: 4005900 - RNA, 16 nt, Human immunodeficiency virus 1 [HIV-1]
auuaagacaaagaaaa

SEQ ID NO: 4005901 - RNA, 20 nt, Human immunodeficiency virus 1 [HIV-1]
auuugggguugcucuggaaa

SEQ ID NO: 4005902 - RNA, 19 nt, Human immunodeficiency virus 1 [HIV-1]
caaaaaacaucagaaagaa

SEQ ID NO: 4005903 - RNA, 17 nt, Human immunodeficiency virus 1 [HIV-1]
caaauuaagagaacaau

SEQ ID NO: 4005904 - RNA, 18 nt, Human immunodeficiency virus 1 [HIV-1]
caagaaguaguauuggua

SEQ ID NO: 4005905 - RNA, 20 nt, Human immunodeficiency virus 1 [HIV-1]
caagcagcuccaggcaagaa

SEQ ID NO: 4005906 - RNA, 20 nt, Human immunodeficiency virus 1 [HIV-1]
caauaguaguagcgggagaa

SEQ ID NO: 4005907 - RNA, 16 nt, Human immunodeficiency virus 1 [HIV-1]
caaucaaauaauagag

SEQ ID NO: 4005908 - RNA, 16 nt, Human immunodeficiency virus 1 [HIV-1]
caauccucaggagggg

SEQ ID NO: 4005909 - RNA, 12 nt, Human immunodeficiency virus 1 [HIV-1]
cacaagaaguag

SEQ ID NO: 4005910 - RNA, 23 nt, Human immunodeficiency virus 1 [HIV-1]
cacaaguagcaauacagcagcua

SEQ ID NO: 4005911 - RNA, 17 nt, Human immunodeficiency virus 1 [HIV-1]
cacaaucacccucccau

SEQ ID NO: 4005912 - RNA, 22 nt, Human immunodeficiency virus 1 [HIV-1]
cacacuaaugauguaaaacaau

SEQ ID NO: 4005913 - RNA, 14 nt, Human immunodeficiency virus 1 [HIV-1]
caccagcuuguuac

SEQ ID NO: 4005914 - RNA, 20 nt, Human immunodeficiency virus 1 [HIV-1]
cacuagagcuuuuagaggag

SEQ ID NO: 4005915 - RNA, 14 nt, Human immunodeficiency virus 1 [HIV-1]
cacugcuuaagccu

SEQ ID NO: 4005916 - RNA, 14 nt, Human immunodeficiency virus 1 [HIV-1]
cagaaaacagagag

SEQ ID NO: 4005917 - RNA, 15 nt, Human immunodeficiency virus 1 [HIV-1]
cagaacuacacacca

SEQ ID NO: 4005918 - RNA, 22 nt, Human immunodeficiency virus 1 [HIV-1]
cagaacuacacaccagggccag

SEQ ID NO: 4005919 - RNA, 19 nt, Human immunodeficiency virus 1 [HIV-1]
cagagaggaccagggagag

SEQ ID NO: 4005920 - RNA, 16 nt, Human immunodeficiency virus 1 [HIV-1]
cagagauggaaaagga

SEQ ID NO: 4005921 - RNA, 19 nt, Human immunodeficiency virus 1 [HIV-1]
cagagcuagaacuggcaga

SEQ ID NO: 4005922 - RNA, 21 nt, Human immunodeficiency virus 1 [HIV-1]
caggcccgaaggaauagaaga

SEQ ID NO: 4005923 - RNA, 23 nt, Human immunodeficiency virus 1 [HIV-1]
caggcccgaaggaauagaagaag

SEQ ID NO: 4005924 - RNA, 18 nt, Human immunodeficiency virus 1 [HIV-1]
cagggaaagcuaggggau

SEQ ID NO: 4005925 - RNA, 16 nt, Human immunodeficiency virus 1 [HIV-1]
cagggcuuggaaagga

SEQ ID NO: 4005926 - RNA, 18 nt, Human immunodeficiency virus 1 [HIV-1]
caguagcugaggggacag

SEQ ID NO: 4005927 - RNA, 15 nt, Human immunodeficiency virus 1 [HIV-1]
caguauuagaagaaa

SEQ ID NO: 4005928 - RNA, 14 nt, Human immunodeficiency virus 1 [HIV-1]
caguugagccagau

SEQ ID NO: 4005929 - RNA, 14 nt, Human immunodeficiency virus 1 [HIV-1]
cauagaaaucugug

SEQ ID NO: 4005930 - RNA, 15 nt, Human immunodeficiency virus 1 [HIV-1]
cauagaauauaggaa

SEQ ID NO: 4005931 - RNA, 13 nt, Human immunodeficiency virus 1 [HIV-1]
caucaagcagcuc

SEQ ID NO: 4005932 - RNA, 13 nt, Human immunodeficiency virus 1 [HIV-1]
cauuguaacauua

SEQ ID NO: 4005933 - RNA, 23 nt, Human immunodeficiency virus 1 [HIV-1]
ccaaguuuguuucauaacaaaag

SEQ ID NO: 4005934 - RNA, 18 nt, Human immunodeficiency virus 1 [HIV-1]
ccaccaaggcaaagagaa

SEQ ID NO: 4005935 - RNA, 15 nt, Human immunodeficiency virus 1 [HIV-1]
ccacugcugugccuu

SEQ ID NO: 4005936 - RNA, 10 nt, Human immunodeficiency virus 1 [HIV-1]
ccagggaggc

SEQ ID NO: 4005937 - RNA, 17 nt, Human immunodeficiency virus 1 [HIV-1]
ccaggggucagauaucc

SEQ ID NO: 4005938 - RNA, 19 nt, Human immunodeficiency virus 1 [HIV-1]
ccaguauuugccauaaaga

SEQ ID NO: 4005939 - RNA, 13 nt, Human immunodeficiency virus 1 [HIV-1]
ccaguugagccag

SEQ ID NO: 4005940 - RNA, 12 nt, Human immunodeficiency virus 1 [HIV-1]
cccaccucccaa

SEQ ID NO: 4005941 - RNA, 16 nt, Human immunodeficiency virus 1 [HIV-1]
cccucagauccugcau

SEQ ID NO: 4005942 - RNA, 19 nt, Human immunodeficiency virus 1 [HIV-1]
ccugggcgggacuggggag

SEQ ID NO: 4005943 - RNA, 18 nt, Human immunodeficiency virus 1 [HIV-1]
ccuuuuagaaaacaaaau

SEQ ID NO: 4005944 - RNA, 19 nt, Human immunodeficiency virus 1 [HIV-1]
cgcaggguuaaaaaagaaa

SEQ ID NO: 4005945 - RNA, 14 nt, Human immunodeficiency virus 1 [HIV-1]
cgggaaucaagcag

SEQ ID NO: 4005946 - RNA, 15 nt, Human immunodeficiency virus 1 [HIV-1]
cuaaagccaugugua

SEQ ID NO: 4005947 - RNA, 13 nt, Human immunodeficiency virus 1 [HIV-1]
cuaauagaaagag

SEQ ID NO: 4005948 - RNA, 16 nt, Human immunodeficiency virus 1 [HIV-1]
cuaauagaaagagcag

SEQ ID NO: 4005949 - RNA, 19 nt, Human immunodeficiency virus 1 [HIV-1]
cuaauagaggaagacaaaa

SEQ ID NO: 4005950 - RNA, 15 nt, Human immunodeficiency virus 1 [HIV-1]
cuacacaccagggcc

SEQ ID NO: 4005951 - RNA, 18 nt, Human immunodeficiency virus 1 [HIV-1]
cuacuguaagggaaagaa

SEQ ID NO: 4005952 - RNA, 19 nt, Human immunodeficiency virus 1 [HIV-1]
cuagaacuggcagaaaaca

SEQ ID NO: 4005953 - RNA, 13 nt, Human immunodeficiency virus 1 [HIV-1]
cucuucagcuacc

SEQ ID NO: 4005954 - RNA, 23 nt, Human immunodeficiency virus 1 [HIV-1]
cugaccuuuggauggugcuacaa

SEQ ID NO: 4005955 - RNA, 14 nt, Human immunodeficiency virus 1 [HIV-1]
cugagccagcagca

SEQ ID NO: 4005956 - RNA, 16 nt, Human immunodeficiency virus 1 [HIV-1]
cugagccagcagcaga

SEQ ID NO: 4005957 - RNA, 21 nt, Human immunodeficiency virus 1 [HIV-1]
cugagccugggagcucucugg

SEQ ID NO: 4005958 - RNA, 21 nt, Human immunodeficiency virus 1 [HIV-1]
cuggcuaacuagggaacccac

SEQ ID NO: 4005959 - RNA, 17 nt, Human immunodeficiency virus 1 [HIV-1]
cugggcgggacugggga

SEQ ID NO: 4005960 - RNA, 18 nt, Human immunodeficiency virus 1 [HIV-1]
cugguauagugcagcagc

SEQ ID NO: 4005961 - RNA, 20 nt, Human immunodeficiency virus 1 [HIV-1]
cugguauagugcagcagcag

SEQ ID NO: 4005962 - RNA, 21 nt, Human immunodeficiency virus 1 [HIV-1]
cugugguauauaaaauuauuc

SEQ ID NO: 4005963 - RNA, 20 nt, Human immunodeficiency virus 1 [HIV-1]
cuucccugauuagcagaacu

SEQ ID NO: 4005964 - RNA, 14 nt, Human immunodeficiency virus 1 [HIV-1]
cuugggagcagcag

SEQ ID NO: 4005965 - RNA, 18 nt, Human immunodeficiency virus 1 [HIV-1]
cuuguuacacccugugag

SEQ ID NO: 4005966 - RNA, 17 nt, Human immunodeficiency virus 1 [HIV-1]
cuuuaaaacagauagcu

SEQ ID NO: 4005967 - RNA, 23 nt, Human immunodeficiency virus 1 [HIV-1]
gaaaaagaauccguauccagaga

SEQ ID NO: 4005968 - RNA, 15 nt, Human immunodeficiency virus 1 [HIV-1]
gaaaauauuaagaca

SEQ ID NO: 4005969 - RNA, 19 nt, Human immunodeficiency virus 1 [HIV-1]
gaacaccagcuuguuacac

SEQ ID NO: 4005970 - RNA, 15 nt, Human immunodeficiency virus 1 [HIV-1]
gaacaucuuaagaca

SEQ ID NO: 4005971 - RNA, 13 nt, Human immunodeficiency virus 1 [HIV-1]
gaacuucugggac

SEQ ID NO: 4005972 - RNA, 17 nt, Human immunodeficiency virus 1 [HIV-1]
gaagaagguggagagag

SEQ ID NO: 4005973 - RNA, 23 nt, Human immunodeficiency virus 1 [HIV-1]
gaagcagaaguuauuccagcaga

SEQ ID NO: 4005974 - RNA, 22 nt, Human immunodeficiency virus 1 [HIV-1]
gaaguaguauugguaaauguga

SEQ ID NO: 4005975 - RNA, 18 nt, Human immunodeficiency virus 1 [HIV-1]
gaauccuggcuguggaaa

SEQ ID NO: 4005976 - RNA, 16 nt, Human immunodeficiency virus 1 [HIV-1]
gacaguggcaaugaga

SEQ ID NO: 4005977 - RNA, 22 nt, Human immunodeficiency virus 1 [HIV-1]
gaccagggagagcauuuguuac

SEQ ID NO: 4005978 - RNA, 14 nt, Human immunodeficiency virus 1 [HIV-1]
gacgagcugagcca

SEQ ID NO: 4005979 - RNA, 17 nt, Human immunodeficiency virus 1 [HIV-1]
gacuaauagaaagagca

SEQ ID NO: 4005980 - RNA, 19 nt, Human immunodeficiency virus 1 [HIV-1]
gagaaauaucagcacuugu

SEQ ID NO: 4005981 - RNA, 21 nt, Human immunodeficiency virus 1 [HIV-1]
gagaacaccagcuuguuacac

SEQ ID NO: 4005982 - RNA, 19 nt, Human immunodeficiency virus 1 [HIV-1]
gagaagaguggugcagaga

SEQ ID NO: 4005983 - RNA, 14 nt, Human immunodeficiency virus 1 [HIV-1]
gagagagacagaga

SEQ ID NO: 4005984 - RNA, 20 nt, Human immunodeficiency virus 1 [HIV-1]
gagcaagaaauggagccagu

SEQ ID NO: 4005985 - RNA, 10 nt, Human immunodeficiency virus 1 [HIV-1]
gagcagcagg

SEQ ID NO: 4005986 - RNA, 21 nt, Human immunodeficiency virus 1 [HIV-1]
gaggagauaugagggacaauu

SEQ ID NO: 4005987 - RNA, 17 nt, Human immunodeficiency virus 1 [HIV-1]
gaggaggaggagguggg

SEQ ID NO: 4005988 - RNA, 14 nt, Human immunodeficiency virus 1 [HIV-1]
gaggauuguggaac

SEQ ID NO: 4005989 - RNA, 17 nt, Human immunodeficiency virus 1 [HIV-1]
gagguaaggugcagaaa

SEQ ID NO: 4005990 - RNA, 15 nt, Human immunodeficiency virus 1 [HIV-1]
gaguggcgagcccuc

SEQ ID NO: 4005991 - RNA, 23 nt, Human immunodeficiency virus 1 [HIV-1]
gauagcuagcaaauuaagagaac

SEQ ID NO: 4005992 - RNA, 13 nt, Human immunodeficiency virus 1 [HIV-1]
gaucugagccugg

SEQ ID NO: 4005993 - RNA, 21 nt, Human immunodeficiency virus 1 [HIV-1]
gaucugcggagccugugccuc

SEQ ID NO: 4005994 - RNA, 16 nt, Human immunodeficiency virus 1 [HIV-1]
gauucgggauuagaag

SEQ ID NO: 4005995 - RNA, 19 nt, Human immunodeficiency virus 1 [HIV-1]
gcaacagcaucuguugcaa

SEQ ID NO: 4005996 - RNA, 23 nt, Human immunodeficiency virus 1 [HIV-1]
gcaaucacaaguagcaauacagc

SEQ ID NO: 4005997 - RNA, 17 nt, Human immunodeficiency virus 1 [HIV-1]
gcacaguacaauguaca

SEQ ID NO: 4005998 - RNA, 20 nt, Human immunodeficiency virus 1 [HIV-1]
gcagaaaguaggaaaagcaa

SEQ ID NO: 4005999 - RNA, 17 nt, Human immunodeficiency virus 1 [HIV-1]
gcagaagacaguggcaa

SEQ ID NO: 4006000 - RNA, 17 nt, Human immunodeficiency virus 1 [HIV-1]
gcagcagauaggguggg

SEQ ID NO: 4006001 - RNA, 17 nt, Human immunodeficiency virus 1 [HIV-1]
gcaucaagcagcuccag

SEQ ID NO: 4006002 - RNA, 23 nt, Human immunodeficiency virus 1 [HIV-1]
gcauuucaucacguggcccgaga

SEQ ID NO: 4006003 - RNA, 17 nt, Human immunodeficiency virus 1 [HIV-1]
gccucuucagcuaccac

SEQ ID NO: 4006004 - RNA, 17 nt, Human immunodeficiency virus 1 [HIV-1]
gcgcagccucaaugacg

SEQ ID NO: 4006005 - RNA, 15 nt, Human immunodeficiency virus 1 [HIV-1]
gcuuaagccucaaua

SEQ ID NO: 4006006 - RNA, 23 nt, Human immunodeficiency virus 1 [HIV-1]
ggacuggggaguggcgagcccuc

SEQ ID NO: 4006007 - RNA, 15 nt, Human immunodeficiency virus 1 [HIV-1]
ggacuuuccagggag

SEQ ID NO: 4006008 - RNA, 15 nt, Human immunodeficiency virus 1 [HIV-1]
ggagagagagacaga

SEQ ID NO: 4006009 - RNA, 21 nt, Human immunodeficiency virus 1 [HIV-1]
ggaguacuucaagaacugcug

SEQ ID NO: 4006010 - RNA, 17 nt, Human immunodeficiency virus 1 [HIV-1]
ggagugggacagagaaa

SEQ ID NO: 4006011 - RNA, 21 nt, Human immunodeficiency virus 1 [HIV-1]
ggcgagcccucagauccugca

SEQ ID NO: 4006012 - RNA, 16 nt, Human immunodeficiency virus 1 [HIV-1]
ggcguuacucgacaga

SEQ ID NO: 4006013 - RNA, 14 nt, Human immunodeficiency virus 1 [HIV-1]
gggaacccacugcu

SEQ ID NO: 4006014 - RNA, 21 nt, Human immunodeficiency virus 1 [HIV-1]
ggugugaauaucaagcaggac

SEQ ID NO: 4006015 - RNA, 21 nt, Human immunodeficiency virus 1 [HIV-1]
gguuagaccagaucugagccu

SEQ ID NO: 4006016 - RNA, 18 nt, Human immunodeficiency virus 1 [HIV-1]
guaaacuccuuagaggaa

SEQ ID NO: 4006017 - RNA, 21 nt, Human immunodeficiency virus 1 [HIV-1]
guaauaccacuaacagaagaa

SEQ ID NO: 4006018 - RNA, 15 nt, Human immunodeficiency virus 1 [HIV-1]
guacaguauuaguag

SEQ ID NO: 4006019 - RNA, 19 nt, Human immunodeficiency virus 1 [HIV-1]
guagacuguaguccaggaa

SEQ ID NO: 4006020 - RNA, 23 nt, Human immunodeficiency virus 1 [HIV-1]
guaguaucaacucaacugcuguu

SEQ ID NO: 4006021 - RNA, 21 nt, Human immunodeficiency virus 1 [HIV-1]
gugacacaaucacccucccau

SEQ ID NO: 4006022 - RNA, 15 nt, Human immunodeficiency virus 1 [HIV-1]
guggaacuucuggga

SEQ ID NO: 4006023 - RNA, 16 nt, Human immunodeficiency virus 1 [HIV-1]
guucuugggagcagca

SEQ ID NO: 4006024 - RNA, 20 nt, Human immunodeficiency virus 1 [HIV-1]
guuucagacccaccucccaa

SEQ ID NO: 4006025 - RNA, 17 nt, Human immunodeficiency virus 1 [HIV-1]
uaaaaaucugaaaacag

SEQ ID NO: 4006026 - RNA, 20 nt, Human immunodeficiency virus 1 [HIV-1]
uaaaacaauuaacagaggca

SEQ ID NO: 4006027 - RNA, 12 nt, Human immunodeficiency virus 1 [HIV-1]
uaacauguggaa

SEQ ID NO: 4006028 - RNA, 17 nt, Human immunodeficiency virus 1 [HIV-1]
uaacgaggauuguggaa

SEQ ID NO: 4006029 - RNA, 19 nt, Human immunodeficiency virus 1 [HIV-1]
uaauacacuccuuaauuga

SEQ ID NO: 4006030 - RNA, 17 nt, Human immunodeficiency virus 1 [HIV-1]
uacacaccagggccagg

SEQ ID NO: 4006031 - RNA, 20 nt, Human immunodeficiency virus 1 [HIV-1]
uacacccugugagccugcau

SEQ ID NO: 4006032 - RNA, 19 nt, Human immunodeficiency virus 1 [HIV-1]
uacaguauuagaagaaaug

SEQ ID NO: 4006033 - RNA, 15 nt, Human immunodeficiency virus 1 [HIV-1]
uaccagcacacaaag

SEQ ID NO: 4006034 - RNA, 15 nt, Human immunodeficiency virus 1 [HIV-1]
uagaagaggccaaua

SEQ ID NO: 4006035 - RNA, 18 nt, Human immunodeficiency virus 1 [HIV-1]
uagaagaggccaauaaag

SEQ ID NO: 4006036 - RNA, 22 nt, Human immunodeficiency virus 1 [HIV-1]
uauccacugaccuuuggauggu

SEQ ID NO: 4006037 - RNA, 14 nt, Human immunodeficiency virus 1 [HIV-1]
uaugccccucccau

SEQ ID NO: 4006038 - RNA, 21 nt, Human immunodeficiency virus 1 [HIV-1]
uccaaaguagcaugacaaaaa

SEQ ID NO: 4006039 - RNA, 16 nt, Human immunodeficiency virus 1 [HIV-1]
uccagucacaccucag

SEQ ID NO: 4006040 - RNA, 23 nt, Human immunodeficiency virus 1 [HIV-1]
ucccgcaggguuaaaaaagaaaa

SEQ ID NO: 4006041 - RNA, 23 nt, Human immunodeficiency virus 1 [HIV-1]
ucuaaaagaaccaguacauggag

SEQ ID NO: 4006042 - RNA, 14 nt, Human immunodeficiency virus 1 [HIV-1]
ucugagccugggag

SEQ ID NO: 4006043 - RNA, 19 nt, Human immunodeficiency virus 1 [HIV-1]
ucugcggagccugugccuc

SEQ ID NO: 4006044 - RNA, 19 nt, Human immunodeficiency virus 1 [HIV-1]
ugaacaucuuaagacagca

SEQ ID NO: 4006045 - RNA, 15 nt, Human immunodeficiency virus 1 [HIV-1]
ugacauacagaaguu

SEQ ID NO: 4006046 - RNA, 13 nt, Human immunodeficiency virus 1 [HIV-1]
ugagccugggagc

SEQ ID NO: 4006047 - RNA, 12 nt, Human immunodeficiency virus 1 [HIV-1]
ugcagagagaaa

SEQ ID NO: 4006048 - RNA, 19 nt, Human immunodeficiency virus 1 [HIV-1]
ugcauccggaguacuucaa

SEQ ID NO: 4006049 - RNA, 14 nt, Human immunodeficiency virus 1 [HIV-1]
ugcaugggauggau

SEQ ID NO: 4006050 - RNA, 13 nt, Human immunodeficiency virus 1 [HIV-1]
ugccaagaagaaa

SEQ ID NO: 4006051 - RNA, 12 nt, Human immunodeficiency virus 1 [HIV-1]
ugccccucccau

SEQ ID NO: 4006052 - RNA, 16 nt, Human immunodeficiency virus 1 [HIV-1]
uggaagcauccaggaa

SEQ ID NO: 4006053 - RNA, 16 nt, Human immunodeficiency virus 1 [HIV-1]
uggaaucuccuacagu

SEQ ID NO: 4006054 - RNA, 14 nt, Human immunodeficiency virus 1 [HIV-1]
uggagugggacaga

SEQ ID NO: 4006055 - RNA, 22 nt, Human immunodeficiency virus 1 [HIV-1]
uggauauauagaagcagaaguu

SEQ ID NO: 4006056 - RNA, 16 nt, Human immunodeficiency virus 1 [HIV-1]
cuuacaaggcagcugu

SEQ ID NO: 4006057 - RNA, 20 nt, Human immunodeficiency virus 1 [HIV-1]
cuugugccuggcuagaagca

SEQ ID NO: 4006058 - RNA, 20 nt, Human immunodeficiency virus 1 [HIV-1]
cuuuccagggaggcguggcc

SEQ ID NO: 4006059 - RNA, 16 nt, Human immunodeficiency virus 1 [HIV-1]
gaaaagcaaagaucau

SEQ ID NO: 4006060 - RNA, 16 nt, Human immunodeficiency virus 1 [HIV-1]
gaaagaauaguagaca

SEQ ID NO: 4006061 - RNA, 16 nt, Human immunodeficiency virus 1 [HIV-1]
gaaagagcagaagaca

SEQ ID NO: 4006062 - RNA, 21 nt, Human immunodeficiency virus 1 [HIV-1]
gaacaagccccagaagaccaa

SEQ ID NO: 4006063 - RNA, 15 nt, Human immunodeficiency virus 1 [HIV-1]
gaacaugagaaauau

SEQ ID NO: 4006064 - RNA, 14 nt, Human immunodeficiency virus 1 [HIV-1]
gaagaagguggaga

SEQ ID NO: 4006065 - RNA, 18 nt, Human immunodeficiency virus 1 [HIV-1]
gaagaagguggagagaga

SEQ ID NO: 4006066 - RNA, 13 nt, Human immunodeficiency virus 1 [HIV-1]
gaagaauaagaca

SEQ ID NO: 4006067 - RNA, 19 nt, Human immunodeficiency virus 1 [HIV-1]
gaagaguggugcagagaga

SEQ ID NO: 4006068 - RNA, 15 nt, Human immunodeficiency virus 1 [HIV-1]
gaagcacaagaggag

SEQ ID NO: 4006069 - RNA, 15 nt, Human immunodeficiency virus 1 [HIV-1]
gaauaagacagggcu

SEQ ID NO: 4006070 - RNA, 17 nt, Human immunodeficiency virus 1 [HIV-1]
gaauaguuuuugcugua

SEQ ID NO: 4006071 - RNA, 18 nt, Human immunodeficiency virus 1 [HIV-1]
gaaugaagcuguuagaca

SEQ ID NO: 4006072 - RNA, 14 nt, Human immunodeficiency virus 1 [HIV-1]
gacagagacagauc

SEQ ID NO: 4006073 - RNA, 15 nt, Human immunodeficiency virus 1 [HIV-1]
gacagccgccuagca

SEQ ID NO: 4006074 - RNA, 18 nt, Human immunodeficiency virus 1 [HIV-1]
gacagcgacgaagagcuc

SEQ ID NO: 4006075 - RNA, 18 nt, Human immunodeficiency virus 1 [HIV-1]
gacaugguagaacagaug

SEQ ID NO: 4006076 - RNA, 17 nt, Human immunodeficiency virus 1 [HIV-1]
gaccagaucugagccug

SEQ ID NO: 4006077 - RNA, 17 nt, Human immunodeficiency virus 1 [HIV-1]
gacccagaaauuguaac

SEQ ID NO: 4006078 - RNA, 18 nt, Human immunodeficiency virus 1 [HIV-1]
gacgaucugcggagccug

SEQ ID NO: 4006079 - RNA, 15 nt, Human immunodeficiency virus 1 [HIV-1]
gagacaccagggauu

SEQ ID NO: 4006080 - RNA, 15 nt, Human immunodeficiency virus 1 [HIV-1]
gagagaacaccagcu

SEQ ID NO: 4006081 - RNA, 19 nt, Human immunodeficiency virus 1 [HIV-1]
gagaucuucagaccuggag

SEQ ID NO: 4006082 - RNA, 13 nt, Human immunodeficiency virus 1 [HIV-1]
gagcagcaggaag

SEQ ID NO: 4006083 - RNA, 19 nt, Human immunodeficiency virus 1 [HIV-1]
gagcagcaggaagcacuau

SEQ ID NO: 4006084 - RNA, 13 nt, Human immunodeficiency virus 1 [HIV-1]
gagccagcagcag

SEQ ID NO: 4006085 - RNA, 21 nt, Human immunodeficiency virus 1 [HIV-1]
gagcuagaacuggcagaaaac

SEQ ID NO: 4006086 - RNA, 13 nt, Human immunodeficiency virus 1 [HIV-1]
gaggaccagggag

SEQ ID NO: 4006087 - RNA, 15 nt, Human immunodeficiency virus 1 [HIV-1]
gaggccaauaaagga

SEQ ID NO: 4006088 - RNA, 17 nt, Human immunodeficiency virus 1 [HIV-1]
gauaaaaaacugcucuu

SEQ ID NO: 4006089 - RNA, 16 nt, Human immunodeficiency virus 1 [HIV-1]
gauaauggagaaagga

SEQ ID NO: 4006090 - RNA, 16 nt, Human immunodeficiency virus 1 [HIV-1]
gauacaguauuagaag

SEQ ID NO: 4006091 - RNA, 20 nt, Human immunodeficiency virus 1 [HIV-1]
gauauccuugaucuguggau

SEQ ID NO: 4006092 - RNA, 20 nt, Human immunodeficiency virus 1 [HIV-1]
gaucugcggagccugugccu

SEQ ID NO: 4006093 - RNA, 14 nt, Human immunodeficiency virus 1 [HIV-1]
gaugacccggagag

SEQ ID NO: 4006094 - RNA, 16 nt, Human immunodeficiency virus 1 [HIV-1]
gauuaaaguaaggcaa

SEQ ID NO: 4006095 - RNA, 15 nt, Human immunodeficiency virus 1 [HIV-1]
gauuagaaguaaaca

SEQ ID NO: 4006096 - RNA, 15 nt, Human immunodeficiency virus 1 [HIV-1]
gauuagcagaacuac

SEQ ID NO: 4006097 - RNA, 17 nt, Human immunodeficiency virus 1 [HIV-1]
gcaaucacaaguagcaa

SEQ ID NO: 4006098 - RNA, 21 nt, Human immunodeficiency virus 1 [HIV-1]
gcaaucacaaguagcaauaca

SEQ ID NO: 4006099 - RNA, 14 nt, Human immunodeficiency virus 1 [HIV-1]
gcaccacugcugug

SEQ ID NO: 4006100 - RNA, 16 nt, Human immunodeficiency virus 1 [HIV-1]
gcacccaccaaggcaa

SEQ ID NO: 4006101 - RNA, 14 nt, Human immunodeficiency virus 1 [HIV-1]
gcagcuccaggcaa

SEQ ID NO: 4006102 - RNA, 16 nt, Human immunodeficiency virus 1 [HIV-1]
gcaucaagcagcucca

SEQ ID NO: 4006103 - RNA, 15 nt, Human immunodeficiency virus 1 [HIV-1]
gcauggacaaguaga

SEQ ID NO: 4006104 - RNA, 23 nt, Human immunodeficiency virus 1 [HIV-1]
gcauuaguagaaauuuguacaga

SEQ ID NO: 4006105 - RNA, 13 nt, Human immunodeficiency virus 1 [HIV-1]
gcauuuguuacaa

SEQ ID NO: 4006106 - RNA, 16 nt, Human immunodeficiency virus 1 [HIV-1]
gccaaguuuguuucau

SEQ ID NO: 4006107 - RNA, 17 nt, Human immunodeficiency virus 1 [HIV-1]
gccaauaaaggagagaa

SEQ ID NO: 4006108 - RNA, 17 nt, Human immunodeficiency virus 1 [HIV-1]
gccaggggucagauauc

SEQ ID NO: 4006109 - RNA, 20 nt, Human immunodeficiency virus 1 [HIV-1]
gccuguacugggucucucug

SEQ ID NO: 4006110 - RNA, 13 nt, Human immunodeficiency virus 1 [HIV-1]
gcgagcccucaga

SEQ ID NO: 4006111 - RNA, 16 nt, Human immunodeficiency virus 1 [HIV-1]
gcgggaaucaagcagg

SEQ ID NO: 4006112 - RNA, 15 nt, Human immunodeficiency virus 1 [HIV-1]
gcugaggggacagau

SEQ ID NO: 4006113 - RNA, 14 nt, Human immunodeficiency virus 1 [HIV-1]
gcuuguagagcuau

SEQ ID NO: 4006114 - RNA, 13 nt, Human immunodeficiency virus 1 [HIV-1]
ggaaaagcaggau

SEQ ID NO: 4006115 - RNA, 20 nt, Human immunodeficiency virus 1 [HIV-1]
ggaacuaaagaauagugcug

SEQ ID NO: 4006116 - RNA, 18 nt, Human immunodeficiency virus 1 [HIV-1]
ggacuuuccgcuggggac

SEQ ID NO: 4006117 - RNA, 14 nt, Human immunodeficiency virus 1 [HIV-1]
ggagagaacaccag

SEQ ID NO: 4006118 - RNA, 14 nt, Human immunodeficiency virus 1 [HIV-1]
ggagagcaagaaau

SEQ ID NO: 4006119 - RNA, 15 nt, Human immunodeficiency virus 1 [HIV-1]
ggaggaggagguggg

SEQ ID NO: 4006120 - RNA, 20 nt, Human immunodeficiency virus 1 [HIV-1]
ggaguaauaaaucucuggaa

SEQ ID NO: 4006121 - RNA, 16 nt, Human immunodeficiency virus 1 [HIV-1]
ggcacuuaucugggac

SEQ ID NO: 4006122 - RNA, 13 nt, Human immunodeficiency virus 1 [HIV-1]
ggcgcagccucaa

SEQ ID NO: 4006123 - RNA, 14 nt, Human immunodeficiency virus 1 [HIV-1]
ggcuguggaaagau

SEQ ID NO: 4006124 - RNA, 15 nt, Human immunodeficiency virus 1 [HIV-1]
gggaggcguggccug

SEQ ID NO: 4006125 - RNA, 22 nt, Human immunodeficiency virus 1 [HIV-1]
gggcaguaguaauacaagauaa

SEQ ID NO: 4006126 - RNA, 18 nt, Human immunodeficiency virus 1 [HIV-1]
gggcaucaagcagcucca

SEQ ID NO: 4006127 - RNA, 21 nt, Human immunodeficiency virus 1 [HIV-1]
gggcgggaaucaagcaggaau

SEQ ID NO: 4006128 - RNA, 13 nt, Human immunodeficiency virus 1 [HIV-1]
gggcgggacuggg

SEQ ID NO: 4006129 - RNA, 23 nt, Human immunodeficiency virus 1 [HIV-1]
ggggauuugggguugcucuggaa

SEQ ID NO: 4006130 - RNA, 20 nt, Human immunodeficiency virus 1 [HIV-1]
ggggcaucaagcagcuccag

SEQ ID NO: 4006131 - RNA, 16 nt, Human immunodeficiency virus 1 [HIV-1]
gggugggagcagcauc

SEQ ID NO: 4006132 - RNA, 22 nt, Human immunodeficiency virus 1 [HIV-1]
guacaaggagcuuguagagcua

SEQ ID NO: 4006133 - RNA, 19 nt, Human immunodeficiency virus 1 [HIV-1]
guagcugaggggacagaua

SEQ ID NO: 4006134 - RNA, 19 nt, Human immunodeficiency virus 1 [HIV-1]
guaucaacucaacugcugu

SEQ ID NO: 4006135 - RNA, 11 nt, Human immunodeficiency virus 1 [HIV-1]
gucucucuggu

SEQ ID NO: 4006136 - RNA, 17 nt, Human immunodeficiency virus 1 [HIV-1]
gugcuuccacagggaug

SEQ ID NO: 4006137 - RNA, 19 nt, Human immunodeficiency virus 1 [HIV-1]
guggauauauagaagcaga

SEQ ID NO: 4006138 - RNA, 14 nt, Human immunodeficiency virus 1 [HIV-1]
guggguuuuccagu

SEQ ID NO: 4006139 - RNA, 17 nt, Human immunodeficiency virus 1 [HIV-1]
guuagaccagaucugag

SEQ ID NO: 4006140 - RNA, 22 nt, Human immunodeficiency virus 1 [HIV-1]
guuagaccagaucugagccugg

SEQ ID NO: 4006141 - RNA, 17 nt, Human immunodeficiency virus 1 [HIV-1]
uaaaaggagaagccaug

SEQ ID NO: 4006142 - RNA, 21 nt, Human immunodeficiency virus 1 [HIV-1]
uaaauggcagucuagcagaag

SEQ ID NO: 4006143 - RNA, 15 nt, Human immunodeficiency virus 1 [HIV-1]
uaauagcaacaauga

SEQ ID NO: 4006144 - RNA, 20 nt, Human immunodeficiency virus 1 [HIV-1]
uaauagcagaaauacagaag

SEQ ID NO: 4006145 - RNA, 17 nt, Human immunodeficiency virus 1 [HIV-1]
uacaaaugucagcacag

SEQ ID NO: 4006146 - RNA, 13 nt, Human immunodeficiency virus 1 [HIV-1]
uacaauaggaaaa

SEQ ID NO: 4006147 - RNA, 21 nt, Human immunodeficiency virus 1 [HIV-1]
acuuacaaggcagcuguagau

SEQ ID NO: 4006148 - RNA, 19 nt, Human immunodeficiency virus 1 [HIV-1]
acuugggcaggaguggaag

SEQ ID NO: 4006149 - RNA, 12 nt, Human immunodeficiency virus 1 [HIV-1]
agaaagcauagu

SEQ ID NO: 4006150 - RNA, 15 nt, Human immunodeficiency virus 1 [HIV-1]
agaaauuaacaauua

SEQ ID NO: 4006151 - RNA, 15 nt, Human immunodeficiency virus 1 [HIV-1]
agaacaaaaauagag

SEQ ID NO: 4006152 - RNA, 22 nt, Human immunodeficiency virus 1 [HIV-1]
agaacaauuuggaaauaauaaa

SEQ ID NO: 4006153 - RNA, 21 nt, Human immunodeficiency virus 1 [HIV-1]
agaacuggcagaaaacagaga

SEQ ID NO: 4006154 - RNA, 21 nt, Human immunodeficiency virus 1 [HIV-1]
agaagguggagagagagacag

SEQ ID NO: 4006155 - RNA, 17 nt, Human immunodeficiency virus 1 [HIV-1]
agacgagcugagccagc

SEQ ID NO: 4006156 - RNA, 14 nt, Human immunodeficiency virus 1 [HIV-1]
agacuagagcccug

SEQ ID NO: 4006157 - RNA, 21 nt, Human immunodeficiency virus 1 [HIV-1]
agagaaaaaagagcaguggga

SEQ ID NO: 4006158 - RNA, 23 nt, Human immunodeficiency virus 1 [HIV-1]
agagagaaaaaagagcaguggga

SEQ ID NO: 4006159 - RNA, 20 nt, Human immunodeficiency virus 1 [HIV-1]
agauaggggggcaacuaaag

SEQ ID NO: 4006160 - RNA, 14 nt, Human immunodeficiency virus 1 [HIV-1]
agauagggugggag

SEQ ID NO: 4006161 - RNA, 14 nt, Human immunodeficiency virus 1 [HIV-1]
agauccugcauaua

SEQ ID NO: 4006162 - RNA, 17 nt, Human immunodeficiency virus 1 [HIV-1]
agaucugagccugggag

SEQ ID NO: 4006163 - RNA, 24 nt, Human immunodeficiency virus 1 [HIV-1]
agaucugagccugggagcucucug

SEQ ID NO: 4006164 - RNA, 19 nt, Human immunodeficiency virus 1 [HIV-1]
agcagcaucucgagaccug

SEQ ID NO: 4006165 - RNA, 12 nt, Human immunodeficiency virus 1 [HIV-1]
agcauaugauac

SEQ ID NO: 4006166 - RNA, 14 nt, Human immunodeficiency virus 1 [HIV-1]
aggaccagcaaagc

SEQ ID NO: 4006167 - RNA, 14 nt, Human immunodeficiency virus 1 [HIV-1]
aggagaaauaucag

SEQ ID NO: 4006168 - RNA, 20 nt, Human immunodeficiency virus 1 [HIV-1]
aggagagcaagaaauggagc

SEQ ID NO: 4006169 - RNA, 22 nt, Human immunodeficiency virus 1 [HIV-1]
aggaucaacagcuccuggggau

SEQ ID NO: 4006170 - RNA, 13 nt, Human immunodeficiency virus 1 [HIV-1]
aggcaaagagaag

SEQ ID NO: 4006171 - RNA, 19 nt, Human immunodeficiency virus 1 [HIV-1]
aggcaucuccuauggcagg

SEQ ID NO: 4006172 - RNA, 16 nt, Human immunodeficiency virus 1 [HIV-1]
aggcguggccugggcg

SEQ ID NO: 4006173 - RNA, 20 nt, Human immunodeficiency virus 1 [HIV-1]
agggacuuuccgcuggggac

SEQ ID NO: 4006174 - RNA, 19 nt, Human immunodeficiency virus 1 [HIV-1]
agguggagagagagacaga

SEQ ID NO: 4006175 - RNA, 17 nt, Human immunodeficiency virus 1 [HIV-1]
aguacaaggagcuugua

SEQ ID NO: 4006176 - RNA, 17 nt, Human immunodeficiency virus 1 [HIV-1]
aguuaauaaaaaaggaa

SEQ ID NO: 4006177 - RNA, 23 nt, Human immunodeficiency virus 1 [HIV-1]
aguuggaguaauaaaucucugga

SEQ ID NO: 4006178 - RNA, 11 nt, Human immunodeficiency virus 1 [HIV-1]
auaagaaaggc

SEQ ID NO: 4006179 - RNA, 15 nt, Human immunodeficiency virus 1 [HIV-1]
auacaagaaaaagaa

SEQ ID NO: 4006180 - RNA, 12 nt, Human immunodeficiency virus 1 [HIV-1]
auacagcagcua

SEQ ID NO: 4006181 - RNA, 16 nt, Human immunodeficiency virus 1 [HIV-1]
auacagcagcuaccaa

SEQ ID NO: 4006182 - RNA, 15 nt, Human immunodeficiency virus 1 [HIV-1]
auagaagcagaaguu

SEQ ID NO: 4006183 - RNA, 20 nt, Human immunodeficiency virus 1 [HIV-1]
auagaggaagacaaaaaguu

SEQ ID NO: 4006184 - RNA, 22 nt, Human immunodeficiency virus 1 [HIV-1]
auagugcugccagaaaaagaca

SEQ ID NO: 4006185 - RNA, 21 nt, Human immunodeficiency virus 1 [HIV-1]
aucaaaagacuuaauagcaga

SEQ ID NO: 4006186 - RNA, 15 nt, Human immunodeficiency virus 1 [HIV-1]
aucagaacagucaga

SEQ ID NO: 4006187 - RNA, 16 nt, Human immunodeficiency virus 1 [HIV-1]
aucucuggaacagauu

SEQ ID NO: 4006188 - RNA, 14 nt, Human immunodeficiency virus 1 [HIV-1]
aucugcggagccug

SEQ ID NO: 4006189 - RNA, 21 nt, Human immunodeficiency virus 1 [HIV-1]
augaauaaagaauuaaagaaa

SEQ ID NO: 4006190 - RNA, 18 nt, Human immunodeficiency virus 1 [HIV-1]
augagacgagcugagcca

SEQ ID NO: 4006191 - RNA, 22 nt, Human immunodeficiency virus 1 [HIV-1]
augaggauuagaacauggaaaa

SEQ ID NO: 4006192 - RNA, 12 nt, Human immunodeficiency virus 1 [HIV-1]
auggagaaagga

SEQ ID NO: 4006193 - RNA, 15 nt, Human immunodeficiency virus 1 [HIV-1]
auggagaaaggagag

SEQ ID NO: 4006194 - RNA, 18 nt, Human immunodeficiency virus 1 [HIV-1]
auggaggaaaaagagaua

SEQ ID NO: 4006195 - RNA, 22 nt, Human immunodeficiency virus 1 [HIV-1]
auggguaccagcacacaaagga

SEQ ID NO: 4006196 - RNA, 21 nt, Human immunodeficiency virus 1 [HIV-1]
augguaccaguuagagaaaga

SEQ ID NO: 4006197 - RNA, 14 nt, Human immunodeficiency virus 1 [HIV-1]
auguaaaacaauua

SEQ ID NO: 4006198 - RNA, 21 nt, Human immunodeficiency virus 1 [HIV-1]
auuaauaacaccaaaaaagau

SEQ ID NO: 4006199 - RNA, 17 nt, Human immunodeficiency virus 1 [HIV-1]
auuacagggacagcaga

SEQ ID NO: 4006200 - RNA, 15 nt, Human immunodeficiency virus 1 [HIV-1]
auuucacggacaaug

SEQ ID NO: 4006201 - RNA, 21 nt, Human immunodeficiency virus 1 [HIV-1]
caaaagacuuaauagcagaaa

SEQ ID NO: 4006202 - RNA, 16 nt, Human immunodeficiency virus 1 [HIV-1]
caaagaagacaagaua

SEQ ID NO: 4006203 - RNA, 13 nt, Human immunodeficiency virus 1 [HIV-1]
caaauuaagagaa

SEQ ID NO: 4006204 - RNA, 17 nt, Human immunodeficiency virus 1 [HIV-1]
caaauuauaaacaugug

SEQ ID NO: 4006205 - RNA, 13 nt, Human immunodeficiency virus 1 [HIV-1]
caacucacagucu

SEQ ID NO: 4006206 - RNA, 14 nt, Human immunodeficiency virus 1 [HIV-1]
caauacagcagcua

SEQ ID NO: 4006207 - RNA, 13 nt, Human immunodeficiency virus 1 [HIV-1]
caaugccacagcc

SEQ ID NO: 4006208 - RNA, 20 nt, Human immunodeficiency virus 1 [HIV-1]
caauggaacaggaccaugua

SEQ ID NO: 4006209 - RNA, 22 nt, Human immunodeficiency virus 1 [HIV-1]
cacaaguagcaauacagcagcu

SEQ ID NO: 4006210 - RNA, 17 nt, Human immunodeficiency virus 1 [HIV-1]
cacacgaccuggaugga

SEQ ID NO: 4006211 - RNA, 22 nt, Human immunodeficiency virus 1 [HIV-1]
cacaguuuuaauuguggagggg

SEQ ID NO: 4006212 - RNA, 12 nt, Human immunodeficiency virus 1 [HIV-1]
caccagcaauau

SEQ ID NO: 4006213 - RNA, 12 nt, Human immunodeficiency virus 1 [HIV-1]
cacugaaggaag

SEQ ID NO: 4006214 - RNA, 16 nt, Human immunodeficiency virus 1 [HIV-1]
cacuuuaaaacagaua

SEQ ID NO: 4006215 - RNA, 17 nt, Human immunodeficiency virus 1 [HIV-1]
cagaaauacagaagcag

SEQ ID NO: 4006216 - RNA, 22 nt, Human immunodeficiency virus 1 [HIV-1]
cagaaauccacuuuggaaagga

SEQ ID NO: 4006217 - RNA, 18 nt, Human immunodeficiency virus 1 [HIV-1]
cagaagaagcagagcuag

SEQ ID NO: 4006218 - RNA, 16 nt, Human immunodeficiency virus 1 [HIV-1]
cagacccaccucccaa

SEQ ID NO: 4006219 - RNA, 16 nt, Human immunodeficiency virus 1 [HIV-1]
cagauaagauagaaga

SEQ ID NO: 4006220 - RNA, 21 nt, Human immunodeficiency virus 1 [HIV-1]
cagauaggguuauagaaguag

SEQ ID NO: 4006221 - RNA, 23 nt, Human immunodeficiency virus 1 [HIV-1]
cagauccugcauauaagcagcug

SEQ ID NO: 4006222 - RNA, 16 nt, Human immunodeficiency virus 1 [HIV-1]
cagaucugagccuggg

SEQ ID NO: 4006223 - RNA, 15 nt, Human immunodeficiency virus 1 [HIV-1]
cagggauggaaagga

SEQ ID NO: 4006224 - RNA, 13 nt, Human immunodeficiency virus 1 [HIV-1]
caguaaaaacaau

SEQ ID NO: 4006225 - RNA, 16 nt, Human immunodeficiency virus 1 [HIV-1]
caguacaaauggcagu

SEQ ID NO: 4006226 - RNA, 17 nt, Human immunodeficiency virus 1 [HIV-1]
caguuaauaaaaaagga

SEQ ID NO: 4006227 - RNA, 21 nt, Human immunodeficiency virus 1 [HIV-1]
cauaauuggaagaaaucuguu

SEQ ID NO: 4006228 - RNA, 13 nt, Human immunodeficiency virus 1 [HIV-1]
cauagaacaaaaa

SEQ ID NO: 4006229 - RNA, 14 nt, Human immunodeficiency virus 1 [HIV-1]
cauagaacaaaaau

SEQ ID NO: 4006230 - RNA, 16 nt, Human immunodeficiency virus 1 [HIV-1]
cauagcaguagcugag

SEQ ID NO: 4006231 - RNA, 19 nt, Human immunodeficiency virus 2 (HIV-2)
ucacucuguacccagaaga

SEQ ID NO: 4006232 - RNA, 15 nt, Human immunodeficiency virus 2 (HIV-2)
ucaggcagggagcag

SEQ ID NO: 4006233 - RNA, 16 nt, Human immunodeficiency virus 2 (HIV-2)
ucccugcuggacucuc

SEQ ID NO: 4006234 - RNA, 15 nt, Human immunodeficiency virus 2 (HIV-2)
uccuguuacaccaag

SEQ ID NO: 4006235 - RNA, 20 nt, Human immunodeficiency virus 2 (HIV-2)
uccuugcccagcugcaccga

SEQ ID NO: 4006236 - RNA, 11 nt, Human immunodeficiency virus 2 (HIV-2)
ucuaacagcaa

SEQ ID NO: 4006237 - RNA, 21 nt, Human immunodeficiency virus 2 (HIV-2)
ucuaacagcaaucagggacug

SEQ ID NO: 4006238 - RNA, 20 nt, Human immunodeficiency virus 2 (HIV-2)
ugacuuaaccuccuggguca

SEQ ID NO: 4006239 - RNA, 12 nt, Human immunodeficiency virus 2 (HIV-2)
ugcggagaggcu

SEQ ID NO: 4006240 - RNA, 17 nt, Human immunodeficiency virus 2 (HIV-2)
uggcaauagauauguca

SEQ ID NO: 4006241 - RNA, 14 nt, Human immunodeficiency virus 2 (HIV-2)
uucccaucucuccu

SEQ ID NO: 4006242 - RNA, 12 nt, Human immunodeficiency virus 2 (HIV-2)
aaaaccuccagg

SEQ ID NO: 4006243 - RNA, 14 nt, Human immunodeficiency virus 2 (HIV-2)
aaaagggggacugc

SEQ ID NO: 4006244 - RNA, 18 nt, Human immunodeficiency virus 2 (HIV-2)
aaaaugacagaccccaga

SEQ ID NO: 4006245 - RNA, 17 nt, Human immunodeficiency virus 2 (HIV-2)
aaagcagauaauuaaua

SEQ ID NO: 4006246 - RNA, 19 nt, Human immunodeficiency virus 2 (HIV-2)
aacaagcagacaugaugau

SEQ ID NO: 4006247 - RNA, 12 nt, Human immunodeficiency virus 2 (HIV-2)
aaggagaagaac

SEQ ID NO: 4006248 - RNA, 14 nt, Human immunodeficiency virus 2 (HIV-2)
aaggcaaaacugaa

SEQ ID NO: 4006249 - RNA, 23 nt, Human immunodeficiency virus 2 (HIV-2)
aauaucagucaaaguuuagaaga

SEQ ID NO: 4006250 - RNA, 14 nt, Human immunodeficiency virus 2 (HIV-2)
acaacaagaaaugu

SEQ ID NO: 4006251 - RNA, 14 nt, Human immunodeficiency virus 2 (HIV-2)
acaagaaaagaaua

SEQ ID NO: 4006252 - RNA, 20 nt, Human immunodeficiency virus 2 (HIV-2)
acaagacccuggucuguuag

SEQ ID NO: 4006253 - RNA, 18 nt, Human immunodeficiency virus 2 (HIV-2)
acagaaagauuuguauag

SEQ ID NO: 4006254 - RNA, 19 nt, Human immunodeficiency virus 2 (HIV-2)
acagaggcuuuugaugcau

SEQ ID NO: 4006255 - RNA, 17 nt, Human immunodeficiency virus 2 (HIV-2)
acagcccauggagaaac

SEQ ID NO: 4006256 - RNA, 15 nt, Human immunodeficiency virus 2 (HIV-2)
acagcugaggcugca

SEQ ID NO: 4006257 - RNA, 16 nt, Human immunodeficiency virus 2 (HIV-2)
acguagucaagagaca

SEQ ID NO: 4006258 - RNA, 14 nt, Human immunodeficiency virus 2 (HIV-2)
acuacaaauuaaua

SEQ ID NO: 4006259 - RNA, 20 nt, Human immunodeficiency virus 2 (HIV-2)
acuucuaacugcauagaaaa

SEQ ID NO: 4006260 - RNA, 14 nt, Human immunodeficiency virus 2 (HIV-2)
agaaaagaauaugu

SEQ ID NO: 4006261 - RNA, 19 nt, Human immunodeficiency virus 2 (HIV-2)
agauuuguauaggcagcaa

SEQ ID NO: 4006262 - RNA, 23 nt, Human immunodeficiency virus 2 (HIV-2)
aggcucagacccggaaguggcau

SEQ ID NO: 4006263 - RNA, 24 nt, Human immunodeficiency virus 2 (HIV-2)
agucaggauugccagagaaagaau

SEQ ID NO: 4006264 - RNA, 21 nt, Human immunodeficiency virus 2 (HIV-2)
auaaauuggcaauagauaugu

SEQ ID NO: 4006265 - RNA, 13 nt, Human immunodeficiency virus 2 (HIV-2)
aucaaugauacag

SEQ ID NO: 4006266 - RNA, 20 nt, Human immunodeficiency virus 2 (HIV-2)
augaacagcccauggagaaa

SEQ ID NO: 4006267 - RNA, 15 nt, Human immunodeficiency virus 2 (HIV-2)
auggagaaacccagc

SEQ ID NO: 4006268 - RNA, 14 nt, Human immunodeficiency virus 2 (HIV-2)
caacaagaaaagaa

SEQ ID NO: 4006269 - RNA, 15 nt, Human immunodeficiency virus 2 (HIV-2)
caacagcaacagcug

SEQ ID NO: 4006270 - RNA, 22 nt, Human immunodeficiency virus 2 (HIV-2)
caagucaggauugccagagaaa

SEQ ID NO: 4006271 - RNA, 17 nt, Human immunodeficiency virus 2 (HIV-2)
caauaaacuaugugcag

SEQ ID NO: 4006272 - RNA, 15 nt, Human immunodeficiency virus 2 (HIV-2)
caaucaacacaaggc

SEQ ID NO: 4006273 - RNA, 16 nt, Human immunodeficiency virus 2 (HIV-2)
cagaucgagcccugag

SEQ ID NO: 4006274 - RNA, 21 nt, Human immunodeficiency virus 2 (HIV-2)
cagcaaucagggacuggcuga

SEQ ID NO: 4006275 - RNA, 22 nt, Human immunodeficiency virus 2 (HIV-2)
cagcaaucagggacuggcugag

SEQ ID NO: 4006276 - RNA, 17 nt, Human immunodeficiency virus 2 (HIV-2)
cagcaguaucagcaggg

SEQ ID NO: 4006277 - RNA, 19 nt, Human immunodeficiency virus 2 (HIV-2)
cagucaaaguuuagaagaa

SEQ ID NO: 4006278 - RNA, 15 nt, Human immunodeficiency virus 2 (HIV-2)
caucugcagagacuu

SEQ ID NO: 4006279 - RNA, 18 nt, Human immunodeficiency virus 2 (HIV-2)
caugaugaugagcauggg

SEQ ID NO: 4006280 - RNA, 21 nt, Human immunodeficiency virus 2 (HIV-2)
caugcuggccuauaacuacaa

SEQ ID NO: 4006281 - RNA, 22 nt, Human immunodeficiency virus 2 (HIV-2)
cccauggagaaacccagcaaca

SEQ ID NO: 4006282 - RNA, 20 nt, Human immunodeficiency virus 2 (HIV-2)
ccccgguuaucuccaacaga

SEQ ID NO: 4006283 - RNA, 21 nt, Human immunodeficiency virus 2 (HIV-2)
cccuaguaguaguacaacaaa

SEQ ID NO: 4006284 - RNA, 13 nt, Human immunodeficiency virus 2 (HIV-2)
ccuagaaaaagag

SEQ ID NO: 4006285 - RNA, 19 nt, Human immunodeficiency virus 2 (HIV-2)
cuaugagguuuagauacug

SEQ ID NO: 4006286 - RNA, 17 nt, Human immunodeficiency virus 2 (HIV-2)
cucgcaguuccaagaag

SEQ ID NO: 4006287 - RNA, 23 nt, Human immunodeficiency virus 2 (HIV-2)
cugcagggacuuuccagaagggg

SEQ ID NO: 4006288 - RNA, 19 nt, Human immunodeficiency virus 2 (HIV-2)
cugcggagaggcuggcaga

SEQ ID NO: 4006289 - RNA, 16 nt, Human immunodeficiency virus 2 (HIV-2)
cugugagggacagcag

SEQ ID NO: 4006290 - RNA, 17 nt, Human immunodeficiency virus 2 (HIV-2)
cuucugcaccagacaag

SEQ ID NO: 4006291 - RNA, 23 nt, Human immunodeficiency virus 2 (HIV-2)
cuuggguuuucucgcgacagcag

SEQ ID NO: 4006292 - RNA, 11 nt, Human immunodeficiency virus 2 (HIV-2)
gaaaaauauga

SEQ ID NO: 4006293 - RNA, 13 nt, Human immunodeficiency virus 2 (HIV-2)
gaaaccgggagca

SEQ ID NO: 4006294 - RNA, 21 nt, Human immunodeficiency virus 2 (HIV-2)
gaagcuaguaucaguagaacu

SEQ ID NO: 4006295 - RNA, 23 nt, Human immunodeficiency virus 2 (HIV-2)
gcaaugugaguucaauaugaagg

SEQ ID NO: 4006296 - RNA, 19 nt, Human immunodeficiency virus 2 (HIV-2)
gcagagacuuacuauccaa

SEQ ID NO: 4006297 - RNA, 15 nt, Human immunodeficiency virus 2 (HIV-2)
gcagggacuuuccag

SEQ ID NO: 4006298 - RNA, 17 nt, Human immunodeficiency virus 2 (HIV-2)
gcaguuccaagaagaau

SEQ ID NO: 4006299 - RNA, 22 nt, Human immunodeficiency virus 2 (HIV-2)
gcauuguauucagucgcucugc

SEQ ID NO: 4006300 - RNA, 13 nt, Human immunodeficiency virus 2 (HIV-2)
gccccgagagcuc

SEQ ID NO: 4006301 - RNA, 17 nt, Human immunodeficiency virus 2 (HIV-2)
gcuaaacaaggagaaga

SEQ ID NO: 4006302 - RNA, 22 nt, Human immunodeficiency virus 2 (HIV-2)
gcuacuaagaaacagcugaggc

SEQ ID NO: 4006303 - RNA, 18 nt, Human immunodeficiency virus 2 (HIV-2)
gcuauacaacaucugcag

SEQ ID NO: 4006304 - RNA, 14 nt, Human immunodeficiency virus 2 (HIV-2)
gcugaggcugcagg

SEQ ID NO: 4006305 - RNA, 14 nt, Human immunodeficiency virus 2 (HIV-2)
aaacaguggagaag

SEQ ID NO: 4006306 - RNA, 13 nt, Human immunodeficiency virus 2 (HIV-2)
aaguaagaagagc

SEQ ID NO: 4006307 - RNA, 20 nt, Human immunodeficiency virus 2 (HIV-2)
aauaugaagggguuagaaca

SEQ ID NO: 4006308 - RNA, 20 nt, Human immunodeficiency virus 2 (HIV-2)
aauauguaugaauuacaaaa

SEQ ID NO: 4006309 - RNA, 18 nt, Human immunodeficiency virus 2 (HIV-2)
acaaaggaaucaaugaua

SEQ ID NO: 4006310 - RNA, 20 nt, Human immunodeficiency virus 2 (HIV-2)
acuaagaaacagcugaggcu

SEQ ID NO: 4006311 - RNA, 18 nt, Human immunodeficiency virus 2 (HIV-2)
acuagcagguagagccug

SEQ ID NO: 4006312 - RNA, 22 nt, Human immunodeficiency virus 2 (HIV-2)
agaaacaaguccgcuaccuaga

SEQ ID NO: 4006313 - RNA, 16 nt, Human immunodeficiency virus 2 (HIV-2)
agaauauguaugaauu

SEQ ID NO: 4006314 - RNA, 13 nt, Human immunodeficiency virus 2 (HIV-2)
agaguacaugaac

SEQ ID NO: 4006315 - RNA, 15 nt, Human immunodeficiency virus 2 (HIV-2)
agaucgagcccugag

SEQ ID NO: 4006316 - RNA, 17 nt, Human immunodeficiency virus 2 (HIV-2)
aggcagggagcagaacu

SEQ ID NO: 4006317 - RNA, 15 nt, Human immunodeficiency virus 2 (HIV-2)
aggcgccagagagcu

SEQ ID NO: 4006318 - RNA, 14 nt, Human immunodeficiency virus 2 (HIV-2)
agggguuagaacaa

SEQ ID NO: 4006319 - RNA, 23 nt, Human immunodeficiency virus 2 (HIV-2)
caacagauccauauccacaagga

SEQ ID NO: 4006320 - RNA, 16 nt, Human immunodeficiency virus 2 (HIV-2)
caagcaguagaagaug

SEQ ID NO: 4006321 - RNA, 12 nt, Human immunodeficiency virus 2 (HIV-2)
cagcaaucaggg

SEQ ID NO: 4006322 - RNA, 15 nt, Human immunodeficiency virus 2 (HIV-2)
cagccagccaacgaa

SEQ ID NO: 4006323 - RNA, 21 nt, Human immunodeficiency virus 2 (HIV-2)
cagcuguguuucucgaaaaag

SEQ ID NO: 4006324 - RNA, 19 nt, Human immunodeficiency virus 2 (HIV-2)
cagggacuuuccagaaggg

SEQ ID NO: 4006325 - RNA, 20 nt, Human immunodeficiency virus 2 (HIV-2)
cauaugagcgaaagggcaga

SEQ ID NO: 4006326 - RNA, 20 nt, Human immunodeficiency virus 2 (HIV-2)
cccugacgcugucagcccag

SEQ ID NO: 4006327 - RNA, 12 nt, Human immunodeficiency virus 2 (HIV-2)
ccuagggaaggg

SEQ ID NO: 4006328 - RNA, 19 nt, Human immunodeficiency virus 2 (HIV-2)
ccugagagguucucuccag

SEQ ID NO: 4006329 - RNA, 14 nt, Human immunodeficiency virus 2 (HIV-2)
cuaccuagaggcaa

SEQ ID NO: 4006330 - RNA, 17 nt, Human immunodeficiency virus 2 (HIV-2)
cugagagguucucucca

SEQ ID NO: 4006331 - RNA, 16 nt, Human immunodeficiency virus 2 (HIV-2)
cugaggcugcagggac

SEQ ID NO: 4006332 - RNA, 14 nt, Human immunodeficiency virus 2 (HIV-2)
cugcagaggagaau

SEQ ID NO: 4006333 - RNA, 21 nt, Human immunodeficiency virus 2 (HIV-2)
cugcagggacuuuccagaagg

SEQ ID NO: 4006334 - RNA, 21 nt, Human immunodeficiency virus 2 (HIV-2)
gaagccuuaaacagggaggca

SEQ ID NO: 4006335 - RNA, 12 nt, Human immunodeficiency virus 2 (HIV-2)
gacaaugaugau

SEQ ID NO: 4006336 - RNA, 14 nt, Human immunodeficiency virus 2 (HIV-2)
gacugaucucccag

SEQ ID NO: 4006337 - RNA, 19 nt, Human immunodeficiency virus 2 (HIV-2)
gacuuacuauccaagaacu

SEQ ID NO: 4006338 - RNA, 21 nt, Human immunodeficiency virus 2 (HIV-2)
gagacuuacuauccaagaacu

SEQ ID NO: 4006339 - RNA, 16 nt, Human immunodeficiency virus 2 (HIV-2)
gagggacaugggagga

SEQ ID NO: 4006340 - RNA, 14 nt, Human immunodeficiency virus 2 (HIV-2)
gauugccagagaaa

SEQ ID NO: 4006341 - RNA, 15 nt, Human immunodeficiency virus 2 (HIV-2)
gcagaaguggcagaa

SEQ ID NO: 4006342 - RNA, 13 nt, Human immunodeficiency virus 2 (HIV-2)
gcagagacuuacu

SEQ ID NO: 4006343 - RNA, 14 nt, Human immunodeficiency virus 2 (HIV-2)
gcagaggaagauga

SEQ ID NO: 4006344 - RNA, 15 nt, Human immunodeficiency virus 2 (HIV-2)
gcagaucgagcccug

SEQ ID NO: 4006345 - RNA, 21 nt, Human immunodeficiency virus 2 (HIV-2)
gcaguuuccauugccagcugu

SEQ ID NO: 4006346 - RNA, 21 nt, Human immunodeficiency virus 2 (HIV-2)
gcccugagagguucucuccag

SEQ ID NO: 4006347 - RNA, 21 nt, Human immunodeficiency virus 2 (HIV-2)
gcuggccuauaacuacaaggc

SEQ ID NO: 4006348 - RNA, 17 nt, Human immunodeficiency virus 2 (HIV-2)
ggaaacaguggagaaga

SEQ ID NO: 4006349 - RNA, 15 nt, Human immunodeficiency virus 2 (HIV-2)
ggacuacgagagaga

SEQ ID NO: 4006350 - RNA, 18 nt, Human immunodeficiency virus 2 (HIV-2)
ggcagacggcuccacgcu

SEQ ID NO: 4006351 - RNA, 19 nt, Human immunodeficiency virus 2 (HIV-2)
ggcaguuugacuccaugcu

SEQ ID NO: 4006352 - RNA, 12 nt, Human immunodeficiency virus 2 (HIV-2)
ggcauggcagag

SEQ ID NO: 4006353 - RNA, 15 nt, Human immunodeficiency virus 2 (HIV-2)
ggcgccagagagcuc

SEQ ID NO: 4006354 - RNA, 20 nt, Human immunodeficiency virus 2 (HIV-2)
guagcugcuucaugcacaag

SEQ ID NO: 4006355 - RNA, 19 nt, Human immunodeficiency virus 2 (HIV-2)
guuccaagaagaaucaggc

SEQ ID NO: 4006356 - RNA, 14 nt, Human immunodeficiency virus 2 (HIV-2)
aaaugugacagagg

SEQ ID NO: 4006357 - RNA, 17 nt, Human immunodeficiency virus 2 (HIV-2)
aacagcccauggagaaa

SEQ ID NO: 4006358 - RNA, 15 nt, Human immunodeficiency virus 2 (HIV-2)
aacagcugaggcugc

SEQ ID NO: 4006359 - RNA, 18 nt, Human immunodeficiency virus 2 (HIV-2)
aacccagcaacagaaaga

SEQ ID NO: 4006360 - RNA, 20 nt, Human immunodeficiency virus 2 (HIV-2)
aagaauggaaggcaaaacug

SEQ ID NO: 4006361 - RNA, 18 nt, Human immunodeficiency virus 2 (HIV-2)
aagcaguagaagaugucu

SEQ ID NO: 4006362 - RNA, 17 nt, Human immunodeficiency virus 2 (HIV-2)
acaagaaaagaauaugu

SEQ ID NO: 4006363 - RNA, 18 nt, Human immunodeficiency virus 2 (HIV-2)
acaaggaccggggacagc

SEQ ID NO: 4006364 - RNA, 15 nt, Human immunodeficiency virus 2 (HIV-2)
acaagucaggauugc

SEQ ID NO: 4006365 - RNA, 15 nt, Human immunodeficiency virus 2 (HIV-2)
acaucccagauacaa

SEQ ID NO: 4006366 - RNA, 22 nt, Human immunodeficiency virus 2 (HIV-2)
acauggcaggagugggagaaac

SEQ ID NO: 4006367 - RNA, 20 nt, Human immunodeficiency virus 2 (HIV-2)
accggggacagccagccaac

SEQ ID NO: 4006368 - RNA, 16 nt, Human immunodeficiency virus 2 (HIV-2)
acuacaaauuaauaga

SEQ ID NO: 4006369 - RNA, 16 nt, Human immunodeficiency virus 2 (HIV-2)
acuacgagagagacuc

SEQ ID NO: 4006370 - RNA, 17 nt, Human immunodeficiency virus 2 (HIV-2)
acugcaauaugggugcg

SEQ ID NO: 4006371 - RNA, 18 nt, Human immunodeficiency virus 2 (HIV-2)
acuuaaccuccuggguca

SEQ ID NO: 4006372 - RNA, 16 nt, Human immunodeficiency virus 2 (HIV-2)
acuuagggagugacug

SEQ ID NO: 4006373 - RNA, 15 nt, Human immunodeficiency virus 2 (HIV-2)
agaguuugggcacaa

SEQ ID NO: 4006374 - RNA, 22 nt, Human immunodeficiency virus 2 (HIV-2)
agcugguggggaacgcccucau

SEQ ID NO: 4006375 - RNA, 16 nt, Human immunodeficiency virus 2 (HIV-2)
aggcagcaaaauaugg

SEQ ID NO: 4006376 - RNA, 12 nt, Human immunodeficiency virus 2 (HIV-2)
agggacagcagu

SEQ ID NO: 4006377 - RNA, 15 nt, Human immunodeficiency virus 2 (HIV-2)
agucgcucugcggag

SEQ ID NO: 4006378 - RNA, 19 nt, Human immunodeficiency virus 2 (HIV-2)
agugcaauuguuaaguaga

SEQ ID NO: 4006379 - RNA, 14 nt, Human immunodeficiency virus 2 (HIV-2)
aucugcagagacuu

SEQ ID NO: 4006380 - RNA, 17 nt, Human immunodeficiency virus 2 (HIV-2)
auucaauauggagugca

SEQ ID NO: 4006381 - RNA, 18 nt, Human immunodeficiency virus 2 (HIV-2)
auuucaagagagggugca

SEQ ID NO: 4006382 - RNA, 19 nt, Human immunodeficiency virus 2 (HIV-2)
caaaacugaaagcaagagg

SEQ ID NO: 4006383 - RNA, 19 nt, Human immunodeficiency virus 2 (HIV-2)
caaaauauggaugauguag

SEQ ID NO: 4006384 - RNA, 21 nt, Human immunodeficiency virus 2 (HIV-2)
caagaguaccacggagagaaa

SEQ ID NO: 4006385 - RNA, 15 nt, Human immunodeficiency virus 2 (HIV-2)
caagauaagaaaagg

SEQ ID NO: 4006386 - RNA, 14 nt, Human immunodeficiency virus 2 (HIV-2)
cacuagagcagaaa

SEQ ID NO: 4006387 - RNA, 15 nt, Human immunodeficiency virus 2 (HIV-2)
cagaggaagaugagg

SEQ ID NO: 4006388 - RNA, 20 nt, Human immunodeficiency virus 2 (HIV-2)
caggaaacaguggagaagag

SEQ ID NO: 4006389 - RNA, 18 nt, Human immunodeficiency virus 2 (HIV-2)
cagugaggaacaaaagag

SEQ ID NO: 4006390 - RNA, 18 nt, Human immunodeficiency virus 2 (HIV-2)
cauggcaggagugggaga

SEQ ID NO: 4006391 - RNA, 23 nt, Human immunodeficiency virus 2 (HIV-2)
cccuagagccaugcacuaacaaa

SEQ ID NO: 4006392 - RNA, 22 nt, Human immunodeficiency virus 2 (HIV-2)
ccuggguguucccugcuggacu

SEQ ID NO: 4006393 - RNA, 17 nt, Human immunodeficiency virus 2 (HIV-2)
cgaguggauccaagaag

SEQ ID NO: 4006394 - RNA, 24 nt, Human immunodeficiency virus 2 (HIV-2)
cggagaggcuggcagaucgagccc

SEQ ID NO: 4006395 - RNA, 14 nt, Human immunodeficiency virus 2 (HIV-2)
cgguacugggcaga

SEQ ID NO: 4006396 - RNA, 16 nt, Human immunodeficiency virus 2 (HIV-2)
cuaaugcaaaaagcua

SEQ ID NO: 4006397 - RNA, 22 nt, Human immunodeficiency virus 2 (HIV-2)
cuagcagguagagccugggugu

SEQ ID NO: 4006398 - RNA, 12 nt, Human immunodeficiency virus 2 (HIV-2)
cucucagccaau

SEQ ID NO: 4006399 - RNA, 14 nt, Human immunodeficiency virus 2 (HIV-2)
cuguacccagaaga

SEQ ID NO: 4006400 - RNA, 16 nt, Human immunodeficiency virus 2 (HIV-2)
cuguacccagaagagu

SEQ ID NO: 4006401 - RNA, 23 nt, Human immunodeficiency virus 2 (HIV-2)
cuguaccgauuagaacugggaga

SEQ ID NO: 4006402 - RNA, 16 nt, Human immunodeficiency virus 2 (HIV-2)
cuuaguacacccagca

SEQ ID NO: 4006403 - RNA, 23 nt, Human immunodeficiency virus 2 (HIV-2)
gaacucucacaagaggcagagga

SEQ ID NO: 4006404 - RNA, 13 nt, Human immunodeficiency virus 2 (HIV-2)
gaacugggagacu

SEQ ID NO: 4006405 - RNA, 14 nt, Human immunodeficiency virus 2 (HIV-2)
gaaguggcagaacu

SEQ ID NO: 4006406 - RNA, 18 nt, Human immunodeficiency virus 2 (HIV-2)
gacaagugaguauggagc

SEQ ID NO: 4006407 - RNA, 17 nt, Human immunodeficiency virus 2 (HIV-2)
gacagaaagauuuguau

SEQ ID NO: 4006408 - RNA, 22 nt, Human immunodeficiency virus 2 (HIV-2)
gacagcaguaucagcagggaga

SEQ ID NO: 4006409 - RNA, 18 nt, Human immunodeficiency virus 2 (HIV-2)
gacaugggaggagcuggu

SEQ ID NO: 4006410 - RNA, 18 nt, Human immunodeficiency virus 2 (HIV-2)
gacuggguaauagaaacu

SEQ ID NO: 4006411 - RNA, 18 nt, Human immunodeficiency virus 2 (HIV-2)
gagguucucuccagcacu

SEQ ID NO: 4006412 - RNA, 14 nt, Human immunodeficiency virus 2 (HIV-2)
gauagugcagcaac

SEQ ID NO: 4006413 - RNA, 15 nt, Human immunodeficiency virus 2 (HIV-2)
gauguagauucugau

SEQ ID NO: 4006414 - RNA, 15 nt, Human immunodeficiency virus 2 (HIV-2)
gauucugaugaugau

SEQ ID NO: 4006415 - RNA, 18 nt, Human immunodeficiency virus 2 (HIV-2)
gcaaugugaguucaauau

SEQ ID NO: 4006416 - RNA, 20 nt, Human immunodeficiency virus 2 (HIV-2)
gcaccuacagaucagagaag

SEQ ID NO: 4006417 - RNA, 13 nt, Human immunodeficiency virus 2 (HIV-2)
gcagacggcucca

SEQ ID NO: 4006418 - RNA, 18 nt, Human immunodeficiency virus 2 (HIV-2)
gccuggguguucccugcu

SEQ ID NO: 4006419 - RNA, 16 nt, Human immunodeficiency virus 2 (HIV-2)
gccuucugcaccagac

SEQ ID NO: 4006420 - RNA, 19 nt, Human immunodeficiency virus 2 (HIV-2)
gcucugcggagaggcuggc

SEQ ID NO: 4006421 - RNA, 16 nt, Human immunodeficiency virus 2 (HIV-2)
gcugcaccgaccccua

SEQ ID NO: 4006422 - RNA, 16 nt, Human immunodeficiency virus 2 (HIV-2)
ggaauaucauaugagc

SEQ ID NO: 4006423 - RNA, 23 nt, Human immunodeficiency virus 2 (HIV-2)
ggcacaagucaggauugccagag

SEQ ID NO: 4006424 - RNA, 22 nt, Human immunodeficiency virus 2 (HIV-2)
ggcuagagaggaccauagaagc

SEQ ID NO: 4006425 - RNA, 20 nt, Human immunodeficiency virus 2 (HIV-2)
gggacagcaguaucagcagg

SEQ ID NO: 4006426 - RNA, 20 nt, Human immunodeficiency virus 2 (HIV-2)
guacuuggccgguacugggc

SEQ ID NO: 4006427 - RNA, 16 nt, Human immunodeficiency virus 2 (HIV-2)
gugggagaaacaaguc

SEQ ID NO: 4006428 - RNA, 19 nt, Human immunodeficiency virus 2 (HIV-2)
guucaucugaguaacaaga

SEQ ID NO: 4006429 - RNA, 13 nt, Human immunodeficiency virus 2 (HIV-2)
uaaacagggaggc

SEQ ID NO: 4006430 - RNA, 16 nt, Human immunodeficiency virus 2 (HIV-2)
uacagugacagaacaa

SEQ ID NO: 4006431 - RNA, 19 nt, Human immunodeficiency virus 2 (HIV-2)
uagaacucucacaagaggc

SEQ ID NO: 4006432 - RNA, 15 nt, Human immunodeficiency virus 2 (HIV-2)
uaguacaacaaaaug

SEQ ID NO: 4006433 - RNA, 19 nt, Human immunodeficiency virus 2 (HIV-2)
ggaaacaguggagaagaga

SEQ ID NO: 4006434 - RNA, 18 nt, Human immunodeficiency virus 2 (HIV-2)
ggaagccaugcaggaggu

SEQ ID NO: 4006435 - RNA, 20 nt, Human immunodeficiency virus 2 (HIV-2)
ggaauaauacagugacagaa

SEQ ID NO: 4006436 - RNA, 21 nt, Human immunodeficiency virus 2 (HIV-2)
ggacagcaguaucagcaggga

SEQ ID NO: 4006437 - RNA, 16 nt, Human immunodeficiency virus 2 (HIV-2)
ggagaggcuggcagau

SEQ ID NO: 4006438 - RNA, 19 nt, Human immunodeficiency virus 2 (HIV-2)
ggcagacgaagaaggacuc

SEQ ID NO: 4006439 - RNA, 16 nt, Human immunodeficiency virus 2 (HIV-2)
gggacuuagggaguga

SEQ ID NO: 4006440 - RNA, 14 nt, Human immunodeficiency virus 2 (HIV-2)
guauaggcagcaaa

SEQ ID NO: 4006441 - RNA, 15 nt, Human immunodeficiency virus 2 (HIV-2)
gucuguuaggacccu

SEQ ID NO: 4006442 - RNA, 23 nt, Human immunodeficiency virus 2 (HIV-2)
guggcaaugaauuguagcagggu

SEQ ID NO: 4006443 - RNA, 16 nt, Human immunodeficiency virus 2 (HIV-2)
guggggaacgcccuca

SEQ ID NO: 4006444 - RNA, 18 nt, Human immunodeficiency virus 2 (HIV-2)
uaccacggagagaaauga

SEQ ID NO: 4006445 - RNA, 21 nt, Human immunodeficiency virus 2 (HIV-2)
uacuuggccgguacugggcag

SEQ ID NO: 4006446 - RNA, 22 nt, Human immunodeficiency virus 2 (HIV-2)
uaggcagcaaaauauggaugau

SEQ ID NO: 4006447 - RNA, 14 nt, Human immunodeficiency virus 2 (HIV-2)
uagugcagcaacag

SEQ ID NO: 4006448 - RNA, 14 nt, Human immunodeficiency virus 2 (HIV-2)
uauaaggacacaug

SEQ ID NO: 4006449 - RNA, 16 nt, Human immunodeficiency virus 2 (HIV-2)
uauaccuagaaaaaga

SEQ ID NO: 4006450 - RNA, 14 nt, Human immunodeficiency virus 2 (HIV-2)
uauaggcagcaaaa

SEQ ID NO: 4006451 - RNA, 12 nt, Human immunodeficiency virus 2 (HIV-2)
ucaggcagggag

SEQ ID NO: 4006452 - RNA, 13 nt, Human immunodeficiency virus 2 (HIV-2)
ucaggcagggagc

SEQ ID NO: 4006453 - RNA, 15 nt, Human immunodeficiency virus 2 (HIV-2)
ucgccuucugcacca

SEQ ID NO: 4006454 - RNA, 14 nt, Human immunodeficiency virus 2 (HIV-2)
ugaaagcaagaggg

SEQ ID NO: 4006455 - RNA, 19 nt, Human immunodeficiency virus 2 (HIV-2)
ugaacagcccauggagaaa

SEQ ID NO: 4006456 - RNA, 17 nt, Human immunodeficiency virus 2 (HIV-2)
ugcuggacucucaccag

SEQ ID NO: 4006457 - RNA, 23 nt, Human immunodeficiency virus 2 (HIV-2)
uggacguagucaagagacaacaa

SEQ ID NO: 4006458 - RNA, 18 nt, Human immunodeficiency virus 2 (HIV-2)
uggcaggagugggagaaa

SEQ ID NO: 4006459 - RNA, 20 nt, Human immunodeficiency virus 2 (HIV-2)
uggcauaaaguagggaaaaa

SEQ ID NO: 4006460 - RNA, 21 nt, Human immunodeficiency virus 2 (HIV-2)
uggcauacccgcguggaaaaa

SEQ ID NO: 4006461 - RNA, 15 nt, Human immunodeficiency virus 2 (HIV-2)
uucaacaagaaaaga

SEQ ID NO: 4006462 - RNA, 15 nt, Human immunodeficiency virus 2 (HIV-2)
uucucuccagcacua

SEQ ID NO: 4006463 - RNA, 21 nt, Human immunodeficiency virus 2 (HIV-2)
uuuaucgccugacuggaaaaa

SEQ ID NO: 4006464 - RNA, 16 nt, Human immunodeficiency virus 2 (HIV-2)
uacuuggucaaggcag

SEQ ID NO: 4006465 - RNA, 21 nt, Human immunodeficiency virus 2 (HIV-2)
uagaagccuuaaacagggagg

SEQ ID NO: 4006466 - RNA, 14 nt, Human immunodeficiency virus 2 (HIV-2)
uagauucugaugau

SEQ ID NO: 4006467 - RNA, 14 nt, Human immunodeficiency virus 2 (HIV-2)
uaguaguacaacaa

SEQ ID NO: 4006468 - RNA, 21 nt, Human immunodeficiency virus 2 (HIV-2)
uauagugaauaacaggaacaa

SEQ ID NO: 4006469 - RNA, 20 nt, Human immunodeficiency virus 2 (HIV-2)
ucccuuauuuugugcaacua

SEQ ID NO: 4006470 - RNA, 14 nt, Human immunodeficiency virus 2 (HIV-2)
uccugcugcaacua

SEQ ID NO: 4006471 - RNA, 20 nt, Human immunodeficiency virus 2 (HIV-2)
ucucagccaaucaacacaag

SEQ ID NO: 4006472 - RNA, 12 nt, Human immunodeficiency virus 2 (HIV-2)
ugggcacaaguc

SEQ ID NO: 4006473 - RNA, 14 nt, Human immunodeficiency virus 2 (HIV-2)
uuacaguaggagga

SEQ ID NO: 4006474 - RNA, 22 nt, Human immunodeficiency virus 2 (HIV-2)
uuauacucaugggccaggagua

SEQ ID NO: 4006475 - RNA, 19 nt, Human immunodeficiency virus 2 (HIV-2)
uucgaguggcuagagagga

SEQ ID NO: 4006476 - RNA, 15 nt, Human immunodeficiency virus 2 (HIV-2)
uugcuggggggagga

SEQ ID NO: 4006477 - RNA, 13 nt, Human immunodeficiency virus 2 (HIV-2)
aaagaauauguau

SEQ ID NO: 4006478 - RNA, 12 nt, Human immunodeficiency virus 2 (HIV-2)
aacaaggagaag

SEQ ID NO: 4006479 - RNA, 16 nt, Human immunodeficiency virus 2 (HIV-2)
aacagaaagacagaaa

SEQ ID NO: 4006480 - RNA, 15 nt, Human immunodeficiency virus 2 (HIV-2)
aaggaacagaagaag

SEQ ID NO: 4006481 - RNA, 23 nt, Human immunodeficiency virus 2 (HIV-2)
aaguagcuacuaagaaacagcug

SEQ ID NO: 4006482 - RNA, 22 nt, Human immunodeficiency virus 2 (HIV-2)
aauuguuaaguagauuuagaaa

SEQ ID NO: 4006483 - RNA, 21 nt, Human immunodeficiency virus 2 (HIV-2)
acagaguuucccccagaagau

SEQ ID NO: 4006484 - RNA, 23 nt, Human immunodeficiency virus 2 (HIV-2)
accucuauguguggcaaugaauu

SEQ ID NO: 4006485 - RNA, 17 nt, Human immunodeficiency virus 2 (HIV-2)
acuaaaaauagagacac

SEQ ID NO: 4006486 - RNA, 22 nt, Human immunodeficiency virus 2 (HIV-2)
acugcauagaaaacaacacaug

SEQ ID NO: 4006487 - RNA, 13 nt, Human immunodeficiency virus 2 (HIV-2)
acuuacuguauaa

SEQ ID NO: 4006488 - RNA, 21 nt, Human immunodeficiency virus 2 (HIV-2)
agaacaagcaguagaagaugu

SEQ ID NO: 4006489 - RNA, 23 nt, Human immunodeficiency virus 2 (HIV-2)
agaagaacuccuugcccagcugc

SEQ ID NO: 4006490 - RNA, 16 nt, Human immunodeficiency virus 2 (HIV-2)
agaagaaucaggcagg

SEQ ID NO: 4006491 - RNA, 15 nt, Human immunodeficiency virus 2 (HIV-2)
agacauauaccuaga

SEQ ID NO: 4006492 - RNA, 15 nt, Human immunodeficiency virus 2 (HIV-2)
agaguuucccccaga

SEQ ID NO: 4006493 - RNA, 13 nt, Human immunodeficiency virus 2 (HIV-2)
agcaguagaagau

SEQ ID NO: 4006494 - RNA, 20 nt, Human immunodeficiency virus 2 (HIV-2)
agccaucagaggggaaaagu

SEQ ID NO: 4006495 - RNA, 14 nt, Human immunodeficiency virus 2 (HIV-2)
aggagaugaugcaa

SEQ ID NO: 4006496 - RNA, 23 nt, Human immunodeficiency virus 2 (HIV-2)
agggauaauaccagauuggcaga

SEQ ID NO: 4006497 - RNA, 12 nt, Human immunodeficiency virus 2 (HIV-2)
aguacacccagc

SEQ ID NO: 4006498 - RNA, 17 nt, Human immunodeficiency virus 2 (HIV-2)
aguaccacggagagaaa

SEQ ID NO: 4006499 - RNA, 19 nt, Human immunodeficiency virus 2 (HIV-2)
agucaaaguuuagaagaag

SEQ ID NO: 4006500 - RNA, 19 nt, Human immunodeficiency virus 2 (HIV-2)
auaaaguagggaaaaaugu

SEQ ID NO: 4006501 - RNA, 22 nt, Human immunodeficiency virus 2 (HIV-2)
auacagugcuugccagacaaug

SEQ ID NO: 4006502 - RNA, 14 nt, Human immunodeficiency virus 2 (HIV-2)
auauccauaauaga

SEQ ID NO: 4006503 - RNA, 21 nt, Human immunodeficiency virus 2 (HIV-2)
augcacaaggaugauggaaac

SEQ ID NO: 4006504 - RNA, 17 nt, Human immunodeficiency virus 2 (HIV-2)
caaaaauuaaauagcug

SEQ ID NO: 4006505 - RNA, 21 nt, Human immunodeficiency virus 2 (HIV-2)
caacaucccagauacaaagga

SEQ ID NO: 4006506 - RNA, 12 nt, Human immunodeficiency virus 2 (HIV-2)
caacgagcccuc

SEQ ID NO: 4006507 - RNA, 11 nt, Human immunodeficiency virus 2 (HIV-2)
caagaaaagaa

SEQ ID NO: 4006508 - RNA, 17 nt, Human immunodeficiency virus 2 (HIV-2)
cacauuuuauaaaagaa

SEQ ID NO: 4006509 - RNA, 18 nt, Human immunodeficiency virus 2 (HIV-2)
cacuagagcagaaaauag

SEQ ID NO: 4006510 - RNA, 22 nt, Human immunodeficiency virus 2 (HIV-2)
cacuagcagguagagccugggu

SEQ ID NO: 4006511 - RNA, 17 nt, Human immunodeficiency virus 2 (HIV-2)
cagaccccagagaaagg

SEQ ID NO: 4006512 - RNA, 22 nt, Human immunodeficiency virus 2 (HIV-2)
cagagacuuacuauccaagaac

SEQ ID NO: 4006513 - RNA, 13 nt, Human immunodeficiency virus 2 (HIV-2)
cagauuggcagaa

SEQ ID NO: 4006514 - RNA, 19 nt, Human immunodeficiency virus 2 (HIV-2)
cagcaguaucagcagggag

SEQ ID NO: 4006515 - RNA, 14 nt, Human immunodeficiency virus 2 (HIV-2)
caucagaggggaaa

SEQ ID NO: 4006516 - RNA, 20 nt, Human immunodeficiency virus 2 (HIV-2)
caucugaguaacaagacccu

SEQ ID NO: 4006517 - RNA, 22 nt, Human immunodeficiency virus 2 (HIV-2)
caugaugaugagcauggggaga

SEQ ID NO: 4006518 - RNA, 17 nt, Human immunodeficiency virus 2 (HIV-2)
cauggagaaacccagca

SEQ ID NO: 4006519 - RNA, 22 nt, Human immunodeficiency virus 2 (HIV-2)
ccaagcauucgcgaggacuacg

SEQ ID NO: 4006520 - RNA, 18 nt, Human immunodeficiency virus 2 (HIV-2)
cccuagagccaugcacua

SEQ ID NO: 4006521 - RNA, 19 nt, Human immunodeficiency virus 2 (HIV-2)
ccugcuggacucucaccag

SEQ ID NO: 4006522 - RNA, 21 nt, Human immunodeficiency virus 2 (HIV-2)
cuccugugagggacagcagua

SEQ ID NO: 4006523 - RNA, 15 nt, Human immunodeficiency virus 2 (HIV-2)
cugaccgucugggga

SEQ ID NO: 4006524 - RNA, 15 nt, Human immunodeficiency virus 2 (HIV-2)
cuucaugcacaagga

SEQ ID NO: 4006525 - RNA, 19 nt, Human immunodeficiency virus 2 (HIV-2)
gaaacccagcaacagaaag

SEQ ID NO: 4006526 - RNA, 20 nt, Human immunodeficiency virus 2 (HIV-2)
gaagaaucaggcagggagca

SEQ ID NO: 4006527 - RNA, 12 nt, Human immunodeficiency virus 2 (HIV-2)
gaagcuuuccaa

SEQ ID NO: 4006528 - RNA, 14 nt, Human immunodeficiency virus 2 (HIV-2)
gaaucaggcaggga

SEQ ID NO: 4006529 - RNA, 23 nt, Human immunodeficiency virus 2 (HIV-2)
gacacccuugaaggcgccagaga

SEQ ID NO: 4006530 - RNA, 20 nt, Human immunodeficiency virus 2 (HIV-2)
gacagcaguaucagcaggga

SEQ ID NO: 4006531 - RNA, 17 nt, Human immunodeficiency virus 2 (HIV-2)
gaccauuggagaggccu

SEQ ID NO: 4006532 - RNA, 13 nt, Human immunodeficiency virus 2 (HIV-2)
gaccccagagaaa

SEQ ID NO: 4006533 - RNA, 17 nt, Human immunodeficiency virus 2 (HIV-2)
gacuacgagagagacuc

SEQ ID NO: 4006534 - RNA, 16 nt, Human immunodeficiency virus 2 (HIV-2)
gacucucaccaguacu

SEQ ID NO: 4006535 - RNA, 18 nt, Human immunodeficiency virus 2 (HIV-2)
gacuggcugagacuuaag

SEQ ID NO: 4006536 - RNA, 20 nt, Human immunodeficiency virus 2 (HIV-2)
gagacuacaaauuaauagaa

SEQ ID NO: 4006537 - RNA, 15 nt, Human immunodeficiency virus 2 (HIV-2)
gagcauggggagaca

SEQ ID NO: 4006538 - RNA, 19 nt, Human immunodeficiency virus 2 (HIV-2)
gaggacuacgagagagacu

SEQ ID NO: 4006539 - RNA, 20 nt, Human immunodeficiency virus 2 (HIV-2)
gaugugcguuuagacagguc

SEQ ID NO: 4006540 - RNA, 17 nt, Human immunodeficiency virus 2 (HIV-2)
gcaacagaaagacagaa

SEQ ID NO: 4006541 - RNA, 23 nt, Human immunodeficiency virus 2 (HIV-2)
gcacaagucaggauugccagaga

SEQ ID NO: 4006542 - RNA, 21 nt, Human immunodeficiency virus 2 (HIV-2)
gcagccuccauaauaaaugaa

SEQ ID NO: 4006543 - RNA, 23 nt, Human immunodeficiency virus 2 (HIV-2)
gcgacugaccgucuggggaacga

SEQ ID NO: 4006544 - RNA, 18 nt, Human immunodeficiency virus 2 (HIV-2)
ggacuacgagagagacuc

SEQ ID NO: 4006545 - RNA, 21 nt, Human immunodeficiency virus 2 (HIV-2)
ggagaagagaccauuggagag

SEQ ID NO: 4006546 - RNA, 19 nt, Human immunodeficiency virus 2 (HIV-2)
ggagcagaacucgcccucc

SEQ ID NO: 4006547 - RNA, 16 nt, Human immunodeficiency virus 2 (HIV-2)
ggcaagagucacugcu

SEQ ID NO: 4006548 - RNA, 14 nt, Human immunodeficiency virus 2 (HIV-2)
ggcagacggcucca

SEQ ID NO: 4006549 - RNA, 17 nt, Human immunodeficiency virus 2 (HIV-2)
gggaaauaaaggaagaa

SEQ ID NO: 4006550 - RNA, 13 nt, Human immunodeficiency virus 2 (HIV-2)
gggccgggaagga

SEQ ID NO: 4006551 - RNA, 20 nt, Human immunodeficiency virus 2 (HIV-2)
ggggaugguuaugggaagca

SEQ ID NO: 4006552 - RNA, 17 nt, Human immunodeficiency virus 2 (HIV-2)
guacugggcagacggcu

SEQ ID NO: 4006553 - RNA, 14 nt, Human immunodeficiency virus 2 (HIV-2)
guaugaggagauga

SEQ ID NO: 4006554 - RNA, 17 nt, Human immunodeficiency virus 2 (HIV-2)
guggcuagagaggacca

SEQ ID NO: 4006555 - RNA, 13 nt, Human immunodeficiency virus 2 (HIV-2)
guuugggcacaag

SEQ ID NO: 4006556 - RNA, 19 nt, Human immunodeficiency virus 2 (HIV-2)
uaaauagcugggauauucu

SEQ ID NO: 4006557 - RNA, 20 nt, Human immunodeficiency virus 2 (HIV-2)
uacaacaucugcagagacuu

SEQ ID NO: 4006558 - RNA, 15 nt, Human immunodeficiency virus 2 (HIV-2)
uauaaucucacaaug

SEQ ID NO: 4006559 - RNA, 14 nt, Human immunodeficiency virus 2 (HIV-2)
ucaaggcaggaagu

SEQ ID NO: 4006560 - RNA, 17 nt, Human immunodeficiency virus 2 (HIV-2)
ucaguagaacucucaca

SEQ ID NO: 4006561 - RNA, 12 nt, Human immunodeficiency virus 2 (HIV-2)
ucccccuccagg

SEQ ID NO: 4006562 - RNA, 12 nt, Human immunodeficiency virus 2 (HIV-2)
ucccugcuggac

SEQ ID NO: 4006563 - RNA, 14 nt, Human immunodeficiency virus 2 (HIV-2)
uccugauccaccua

SEQ ID NO: 4006564 - RNA, 16 nt, Human immunodeficiency virus 2 (HIV-2)
uccugugagggacagc

SEQ ID NO: 4006565 - RNA, 18 nt, Human immunodeficiency virus 2 (HIV-2)
uccugugagggacagcag

SEQ ID NO: 4006566 - RNA, 14 nt, Human immunodeficiency virus 2 (HIV-2)
ugcagcaacagcaa

SEQ ID NO: 4006567 - RNA, 21 nt, Human immunodeficiency virus 2 (HIV-2)
ugcuucaugcacaaggaugau

SEQ ID NO: 4006568 - RNA, 19 nt, Human immunodeficiency virus 2 (HIV-2)
uggagaaacccagcaacag

SEQ ID NO: 4006569 - RNA, 18 nt, Human immunodeficiency virus 2 (HIV-2)
ugggaauccaaggcagga

SEQ ID NO: 4006570 - RNA, 14 nt, Human immunodeficiency virus 2 (HIV-2)
uggucaaggcagga

SEQ ID NO: 4006571 - RNA, 17 nt, Human immunodeficiency virus 2 (HIV-2)
uguaccgauuagaacug

SEQ ID NO: 4006572 - RNA, 22 nt, Human immunodeficiency virus 2 (HIV-2)
uguguguucccaucucuccuag

SEQ ID NO: 4006573 - RNA, 18 nt, Human immunodeficiency virus 2 (HIV-2)
uguucccaucucuccuag

SEQ ID NO: 4006574 - RNA, 20 nt, Human immunodeficiency virus 2 (HIV-2)
uucccugcuggacucucacc

SEQ ID NO: 4006575 - RNA, 17 nt, Human immunodeficiency virus 2 (HIV-2)
uuggucaaggcaggaag

SEQ ID NO: 4006576 - RNA, 16 nt, Human immunodeficiency virus 2 [HIV-2]
aaaauaugacauggca

SEQ ID NO: 4006577 - RNA, 20 nt, Human immunodeficiency virus 2 [HIV-2]
aaaauaugacauggcaggag

SEQ ID NO: 4006578 - RNA, 11 nt, Human immunodeficiency virus 2 [HIV-2]
aaagcugccag

SEQ ID NO: 4006579 - RNA, 19 nt, Human immunodeficiency virus 2 [HIV-2]
aacagcaaucagggacugg

SEQ ID NO: 4006580 - RNA, 20 nt, Human immunodeficiency virus 2 [HIV-2]
aacagcaaucagggacuggc

SEQ ID NO: 4006581 - RNA, 18 nt, Human immunodeficiency virus 2 [HIV-2]
aacaucugcagagacuua

SEQ ID NO: 4006582 - RNA, 12 nt, Human immunodeficiency virus 2 [HIV-2]
aaccaagggagg

SEQ ID NO: 4006583 - RNA, 16 nt, Human immunodeficiency virus 2 [HIV-2]
aacgcccucauacuua

SEQ ID NO: 4006584 - RNA, 21 nt, Human immunodeficiency virus 2 [HIV-2]
aagaauuggcuaaacaaggag

SEQ ID NO: 4006585 - RNA, 20 nt, Human immunodeficiency virus 2 [HIV-2]
aagcugccaguuagaagcaa

SEQ ID NO: 4006586 - RNA, 14 nt, Human immunodeficiency virus 2 [HIV-2]
aaguaagaagagcc

SEQ ID NO: 4006587 - RNA, 14 nt, Human immunodeficiency virus 2 [HIV-2]
aauaaagcugccag

SEQ ID NO: 4006588 - RNA, 22 nt, Human immunodeficiency virus 2 [HIV-2]
aaucagggacuggcugagacuu

SEQ ID NO: 4006589 - RNA, 13 nt, Human immunodeficiency virus 2 [HIV-2]
acaacgagcccuc

SEQ ID NO: 4006590 - RNA, 17 nt, Human immunodeficiency virus 2 [HIV-2]
acaaggccuaggcaggc

SEQ ID NO: 4006591 - RNA, 18 nt, Human immunodeficiency virus 2 [HIV-2]
acaaguccgcuaccuaga

SEQ ID NO: 4006592 - RNA, 19 nt, Human immunodeficiency virus 2 [HIV-2]
aaaaaccuccaggcaagag

SEQ ID NO: 4006593 - RNA, 20 nt, Human immunodeficiency virus 2 [HIV-2]
aaaaagggggacugcaaggg

SEQ ID NO: 4006594 - RNA, 22 nt, Human immunodeficiency virus 2 [HIV-2]
aaagcagauaauuaauaccugg

SEQ ID NO: 4006595 - RNA, 19 nt, Human immunodeficiency virus 2 [HIV-2]
aaagcuauauuuacacauu

SEQ ID NO: 4006596 - RNA, 21 nt, Human immunodeficiency virus 2 [HIV-2]
aacaacacaugcgcaggauua

SEQ ID NO: 4006597 - RNA, 20 nt, Human immunodeficiency virus 2 [HIV-2]
aacacaucaaucaucaaaga

SEQ ID NO: 4006598 - RNA, 18 nt, Human immunodeficiency virus 2 [HIV-2]
aagaagccuuaagacauu

SEQ ID NO: 4006599 - RNA, 15 nt, Human immunodeficiency virus 2 [HIV-2]
aagaauauguaugaa

SEQ ID NO: 4006600 - RNA, 20 nt, Human immunodeficiency virus 2 [HIV-2]
aagaauggaaggcaaaacug

SEQ ID NO: 4006601 - RNA, 13 nt, Human immunodeficiency virus 2 [HIV-2]
aagagaccaggaa

SEQ ID NO: 4006602 - RNA, 16 nt, Human immunodeficiency virus 2 [HIV-2]
aagaguaccacggaga

SEQ ID NO: 4006603 - RNA, 16 nt, Human immunodeficiency virus 2 [HIV-2]
aauaaaggaagaagcc

SEQ ID NO: 4006604 - RNA, 22 nt, Human immunodeficiency virus 2 [HIV-2]
aauaacacuuaugucaggauua

SEQ ID NO: 4006605 - RNA, 13 nt, Human immunodeficiency virus 2 [HIV-2]
aauagaacauaua

SEQ ID NO: 4006606 - RNA, 15 nt, Human immunodeficiency virus 2 [HIV-2]
acaccaauuggcuuc

SEQ ID NO: 4006607 - RNA, 15 nt, Human immunodeficiency virus 2 [HIV-2]
acagcaaucagggac

SEQ ID NO: 4006608 - RNA, 21 nt, Human immunodeficiency virus 2 [HIV-2]
acagcaaucagggacuggcug

SEQ ID NO: 4006609 - RNA, 21 nt, Human immunodeficiency virus 2 [HIV-2]
acagcaguaucagcagggaga

SEQ ID NO: 4006610 - RNA, 14 nt, Human immunodeficiency virus 2 [HIV-2]
acagcugaggcugc

SEQ ID NO: 4006611 - RNA, 16 nt, Human immunodeficiency virus 2 [HIV-2]
acauguuacaugagac

SEQ ID NO: 4006612 - RNA, 13 nt, Human immunodeficiency virus 2 [HIV-2]
acauugacauaga

SEQ ID NO: 4006613 - RNA, 22 nt, Human immunodeficiency virus 2 [HIV-2]
accauacuuggucaaggcagga

SEQ ID NO: 4006614 - RNA, 19 nt, Human immunodeficiency virus 2 [HIV-2]
acggcgcaacuauugccau

SEQ ID NO: 4006615 - RNA, 17 nt, Human immunodeficiency virus 2 [HIV-2]
acggcuccacgcuugcu

SEQ ID NO: 4006616 - RNA, 13 nt, Human immunodeficiency virus 2 [HIV-2]
acuaacugcagag

SEQ ID NO: 4006617 - RNA, 17 nt, Human immunodeficiency virus 2 [HIV-2]
acuaacugcagaggaga

SEQ ID NO: 4006618 - RNA, 18 nt, Human immunodeficiency virus 2 [HIV-2]
acuuacuguauaaaugua

SEQ ID NO: 4006619 - RNA, 22 nt, Human immunodeficiency virus 2 [HIV-2]
agaacucucacaagaggcagag

SEQ ID NO: 4006620 - RNA, 16 nt, Human immunodeficiency virus 2 [HIV-2]
agaagagccaucagag

SEQ ID NO: 4006621 - RNA, 22 nt, Human immunodeficiency virus 2 [HIV-2]
agaaguaccuaaagcaucaggc

SEQ ID NO: 4006622 - RNA, 13 nt, Human immunodeficiency virus 2 [HIV-2]
agaggcuggcaga

SEQ ID NO: 4006623 - RNA, 16 nt, Human immunodeficiency virus 2 [HIV-2]
agagggauaccauaua

SEQ ID NO: 4006624 - RNA, 14 nt, Human immunodeficiency virus 2 [HIV-2]
agauguaaugauac

SEQ ID NO: 4006625 - RNA, 14 nt, Human immunodeficiency virus 2 [HIV-2]
agcaaucagggacu

SEQ ID NO: 4006626 - RNA, 21 nt, Human immunodeficiency virus 2 [HIV-2]
agcacuagcagguagagccug

SEQ ID NO: 4006627 - RNA, 15 nt, Human immunodeficiency virus 2 [HIV-2]
agcagguagagccug

SEQ ID NO: 4006628 - RNA, 19 nt, Human immunodeficiency virus 2 [HIV-2]
agcuacuaagaaacagcug

SEQ ID NO: 4006629 - RNA, 21 nt, Human immunodeficiency virus 2 [HIV-2]
agcuacuaagaaacagcugag

SEQ ID NO: 4006630 - RNA, 13 nt, Human immunodeficiency virus 2 [HIV-2]
aggaaauaagaca

SEQ ID NO: 4006631 - RNA, 12 nt, Human immunodeficiency virus 2 [HIV-2]
aggacaugggcc

SEQ ID NO: 4006632 - RNA, 21 nt, Human immunodeficiency virus 2 [HIV-2]
aggaccggggacagccagcca

SEQ ID NO: 4006633 - RNA, 14 nt, Human immunodeficiency virus 2 [HIV-2]
aggcaaaacugaaa

SEQ ID NO: 4006634 - RNA, 21 nt, Human immunodeficiency virus 2 [HIV-2]
aggcuggcagaucgagcccug

SEQ ID NO: 4006635 - RNA, 23 nt, Human immunodeficiency virus 2 [HIV-2]
aggcuuugaaccuaagugcacua

SEQ ID NO: 4006636 - RNA, 23 nt, Human immunodeficiency virus 2 [HIV-2]
agguacuccucaacuccagugag

SEQ ID NO: 4006637 - RNA, 13 nt, Human immunodeficiency virus 2 [HIV-2]
agguagagccugg

SEQ ID NO: 4006638 - RNA, 15 nt, Human immunodeficiency virus 2 [HIV-2]
aguacacccagcaca

SEQ ID NO: 4006639 - RNA, 16 nt, Human immunodeficiency virus 2 [HIV-2]
aguaccacggagagaa

SEQ ID NO: 4006640 - RNA, 14 nt, Human immunodeficiency virus 2 [HIV-2]
aguggauccaagaa

SEQ ID NO: 4006641 - RNA, 17 nt, Human immunodeficiency virus 2 [HIV-2]
aguguuucacucucagc

SEQ ID NO: 4006642 - RNA, 14 nt, Human immunodeficiency virus 2 [HIV-2]
auaauacagugaca

SEQ ID NO: 4006643 - RNA, 12 nt, Human immunodeficiency virus 2 [HIV-2]
auaauaggacua

SEQ ID NO: 4006644 - RNA, 19 nt, Human immunodeficiency virus 2 [HIV-2]
auacagugcuugccagaca

SEQ ID NO: 4006645 - RNA, 17 nt, Human immunodeficiency virus 2 [HIV-2]
auacuuggucaaggcag

SEQ ID NO: 4006646 - RNA, 21 nt, Human immunodeficiency virus 2 [HIV-2]
auagcaaucuauguagugcaa

SEQ ID NO: 4006647 - RNA, 14 nt, Human immunodeficiency virus 2 [HIV-2]
aucaggcagggagc

SEQ ID NO: 4006648 - RNA, 18 nt, Human immunodeficiency virus 2 [HIV-2]
auccauaauagacaugga

SEQ ID NO: 4006649 - RNA, 14 nt, Human immunodeficiency virus 2 [HIV-2]
auccuagacauaua

SEQ ID NO: 4006650 - RNA, 12 nt, Human immunodeficiency virus 2 [HIV-2]
aucucccagagu

SEQ ID NO: 4006651 - RNA, 20 nt, Human immunodeficiency virus 2 [HIV-2]
aucugaguaacaagacccug

SEQ ID NO: 4006652 - RNA, 13 nt, Human immunodeficiency virus 2 [HIV-2]
augacauggcagg

SEQ ID NO: 4006653 - RNA, 18 nt, Human immunodeficiency virus 2 [HIV-2]
auggagggaagccaugca

SEQ ID NO: 4006654 - RNA, 13 nt, Human immunodeficiency virus 2 [HIV-2]
augggccaggagu

SEQ ID NO: 4006655 - RNA, 21 nt, Human immunodeficiency virus 2 [HIV-2]
auuacaaaaauuaaauagcug

SEQ ID NO: 4006656 - RNA, 20 nt, Human immunodeficiency virus 2 [HIV-2]
auuggcaugaugaacaaggg

SEQ ID NO: 4006657 - RNA, 14 nt, Human immunodeficiency virus 2 [HIV-2]
caaacaagcagaca

SEQ ID NO: 4006658 - RNA, 19 nt, Human immunodeficiency virus 2 [HIV-2]
caagaagaaucaggcaggg

SEQ ID NO: 4006659 - RNA, 17 nt, Human immunodeficiency virus 2 [HIV-2]
caagagacaacaagaaa

SEQ ID NO: 4006660 - RNA, 16 nt, Human immunodeficiency virus 2 [HIV-2]
caagcagacaugauga

SEQ ID NO: 4006661 - RNA, 12 nt, Human immunodeficiency virus 2 [HIV-2]
caaggcaggaag

SEQ ID NO: 4006662 - RNA, 19 nt, Human immunodeficiency virus 2 [HIV-2]
caaucaucaaagagucaug

SEQ ID NO: 4006663 - RNA, 21 nt, Human immunodeficiency virus 2 [HIV-2]
cacccuugaaggcgccagaga

SEQ ID NO: 4006664 - RNA, 16 nt, Human immunodeficiency virus 2 [HIV-2]
cagaaagacagaaaga

SEQ ID NO: 4006665 - RNA, 13 nt, Human immunodeficiency virus 2 [HIV-2]
cagaaguggcaga

SEQ ID NO: 4006666 - RNA, 21 nt, Human immunodeficiency virus 2 [HIV-2]
cagacaagugaguauggagcc

SEQ ID NO: 4006667 - RNA, 18 nt, Human immunodeficiency virus 2 [HIV-2]
cagaccccagagaaaggg

SEQ ID NO: 4006668 - RNA, 14 nt, Human immunodeficiency virus 2 [HIV-2]
cagacgaagaagga

SEQ ID NO: 4006669 - RNA, 14 nt, Human immunodeficiency virus 2 [HIV-2]
cagaggaagaugag

SEQ ID NO: 4006670 - RNA, 13 nt, Human immunodeficiency virus 2 [HIV-2]
cagauacaaagga

SEQ ID NO: 4006671 - RNA, 14 nt, Human immunodeficiency virus 2 [HIV-2]
cagaucgagcccug

SEQ ID NO: 4006672 - RNA, 22 nt, Human immunodeficiency virus 2 [HIV-2]
cagcacaaacaagcagacauga

SEQ ID NO: 4006673 - RNA, 18 nt, Human immunodeficiency virus 2 [HIV-2]
cagcaguaucagcaggga

SEQ ID NO: 4006674 - RNA, 20 nt, Human immunodeficiency virus 2 [HIV-2]
cagcaguaucagcagggaga

SEQ ID NO: 4006675 - RNA, 21 nt, Human immunodeficiency virus 2 [HIV-2]
cagcaguaucagcagggagag

SEQ ID NO: 4006676 - RNA, 13 nt, Human immunodeficiency virus 2 [HIV-2]
caggaacaaccau

SEQ ID NO: 4006677 - RNA, 20 nt, Human immunodeficiency virus 2 [HIV-2]
caggauuaguguuucacucu

SEQ ID NO: 4006678 - RNA, 15 nt, Human immunodeficiency virus 2 [HIV-2]
caggauugccagaga

SEQ ID NO: 4006679 - RNA, 19 nt, Human immunodeficiency virus 2 [HIV-2]
caggauugccagagaaaga

SEQ ID NO: 4006680 - RNA, 16 nt, Human immunodeficiency virus 2 [HIV-2]
caguaaccagcauaau

SEQ ID NO: 4006681 - RNA, 24 nt, Human immunodeficiency virus 2 [HIV-2]
caguagaacucucacaagaggcag

SEQ ID NO: 4006682 - RNA, 13 nt, Human immunodeficiency virus 2 [HIV-2]
caguaugugacug

SEQ ID NO: 4006683 - RNA, 21 nt, Human immunodeficiency virus 2 [HIV-2]
cagugaggaacaaaagaggug

SEQ ID NO: 4006684 - RNA, 15 nt, Human immunodeficiency virus 2 [HIV-2]
cauaccaacauuacc

SEQ ID NO: 4006685 - RNA, 23 nt, Human immunodeficiency virus 2 [HIV-2]
cauauaucuauuggcauggcaga

SEQ ID NO: 4006686 - RNA, 18 nt, Human immunodeficiency virus 2 [HIV-2]
cauuuuacuaacaagugc

SEQ ID NO: 4006687 - RNA, 14 nt, Human immunodeficiency virus 2 [HIV-2]
ccaccuacugacuc

SEQ ID NO: 4006688 - RNA, 16 nt, Human immunodeficiency virus 2 [HIV-2]
ccgccgacugaucucc

SEQ ID NO: 4006689 - RNA, 16 nt, Human immunodeficiency virus 2 [HIV-2]
ccuagaaaaagaggaa

SEQ ID NO: 4006690 - RNA, 16 nt, Human immunodeficiency virus 2 [HIV-2]
cgaaggaacagaagaa

SEQ ID NO: 4006691 - RNA, 22 nt, Human immunodeficiency virus 2 [HIV-2]
cgcaggauuaggguaugaggag

SEQ ID NO: 4006692 - RNA, 18 nt, Human immunodeficiency virus 2 [HIV-2]
cggcaggugaaguaagaa

SEQ ID NO: 4006693 - RNA, 18 nt, Human immunodeficiency virus 2 [HIV-2]
cgggauagugcagcaaca

SEQ ID NO: 4006694 - RNA, 21 nt, Human immunodeficiency virus 2 [HIV-2]
cuaagaaacagcugaggcugc

SEQ ID NO: 4006695 - RNA, 14 nt, Human immunodeficiency virus 2 [HIV-2]
cucacaagaggcag

SEQ ID NO: 4006696 - RNA, 18 nt, Human immunodeficiency virus 2 [HIV-2]
cucgcaguuccaagaaga

SEQ ID NO: 4006697 - RNA, 22 nt, Human immunodeficiency virus 2 [HIV-2]
cucgcccuccugugagggacag

SEQ ID NO: 4006698 - RNA, 17 nt, Human immunodeficiency virus 2 [HIV-2]
cucuucaauaaagcugc

SEQ ID NO: 4006699 - RNA, 17 nt, Human immunodeficiency virus 2 [HIV-2]
cugagagguucucucca

SEQ ID NO: 4006700 - RNA, 13 nt, Human immunodeficiency virus 2 [HIV-2]
cugugagggacag

SEQ ID NO: 4006701 - RNA, 20 nt, Human immunodeficiency virus 2 [HIV-2]
cuguuacaccaagaguacca

SEQ ID NO: 4006702 - RNA, 17 nt, Human immunodeficiency virus 2 [HIV-2]
cuuaguacacccagcac

SEQ ID NO: 4006703 - RNA, 16 nt, Human immunodeficiency virus 2 [HIV-2]
cuuggucaaggcagga

SEQ ID NO: 4006704 - RNA, 17 nt, Human immunodeficiency virus 2 [HIV-2]
gaagaagccuuaagaca

SEQ ID NO: 4006705 - RNA, 16 nt, Human immunodeficiency virus 2 [HIV-2]
gaaggcgccagagagc

SEQ ID NO: 4006706 - RNA, 18 nt, Human immunodeficiency virus 2 [HIV-2]
gaauaauacagugacaga

SEQ ID NO: 4006707 - RNA, 16 nt, Human immunodeficiency virus 2 [HIV-2]
gaaucaggcagggagc

SEQ ID NO: 4006708 - RNA, 15 nt, Human immunodeficiency virus 2 [HIV-2]
gaauccaaggcagga

SEQ ID NO: 4006709 - RNA, 15 nt, Human immunodeficiency virus 2 [HIV-2]
gacaacacaacagcu

SEQ ID NO: 4006710 - RNA, 22 nt, Human immunodeficiency virus 2 [HIV-2]
gagccuggguguucccugcugg

SEQ ID NO: 4006711 - RNA, 13 nt, Human immunodeficiency virus 2 [HIV-2]
gaggcuggcagau

SEQ ID NO: 4006712 - RNA, 13 nt, Human immunodeficiency virus 2 [HIV-2]
gagucaugugaua

SEQ ID NO: 4006713 - RNA, 23 nt, Human immunodeficiency virus 2 [HIV-2]
gagugcauauaguagugggaaua

SEQ ID NO: 4006714 - RNA, 17 nt, Human immunodeficiency virus 2 [HIV-2]
gaguuggccugugaauc

SEQ ID NO: 4006715 - RNA, 21 nt, Human immunodeficiency virus 2 [HIV-2]
gauaauaccagauuggcagaa

SEQ ID NO: 4006716 - RNA, 11 nt, Human immunodeficiency virus 2 [HIV-2]
gaucagagaag

SEQ ID NO: 4006717 - RNA, 17 nt, Human immunodeficiency virus 2 [HIV-2]
gaugauuaucaggaaau

SEQ ID NO: 4006718 - RNA, 13 nt, Human immunodeficiency virus 2 [HIV-2]
gaugcauggaaua

SEQ ID NO: 4006719 - RNA, 15 nt, Human immunodeficiency virus 2 [HIV-2]
gcacaaacaagcaga

SEQ ID NO: 4006720 - RNA, 14 nt, Human immunodeficiency virus 2 [HIV-2]
gcagaaguggcaga

SEQ ID NO: 4006721 - RNA, 16 nt, Human immunodeficiency virus 2 [HIV-2]
gcaggaggugaagcaa

SEQ ID NO: 4006722 - RNA, 14 nt, Human immunodeficiency virus 2 [HIV-2]
gcaggagugggaga

SEQ ID NO: 4006723 - RNA, 23 nt, Human immunodeficiency virus 2 [HIV-2]
gccagccaacgaaggaacagaag

SEQ ID NO: 4006724 - RNA, 18 nt, Human immunodeficiency virus 2 [HIV-2]
gccaggaaacaguggaga

SEQ ID NO: 4006725 - RNA, 18 nt, Human immunodeficiency virus 2 [HIV-2]
gccgggauagugcagcaa

SEQ ID NO: 4006726 - RNA, 17 nt, Human immunodeficiency virus 2 [HIV-2]
gccgguacugggcagac

SEQ ID NO: 4006727 - RNA, 13 nt, Human immunodeficiency virus 2 [HIV-2]
gcgaaagggcaga

SEQ ID NO: 4006728 - RNA, 14 nt, Human immunodeficiency virus 2 [HIV-2]
gcgaaagggcagac

SEQ ID NO: 4006729 - RNA, 21 nt, Human immunodeficiency virus 2 [HIV-2]
gcucugcggagaggcuggcag

SEQ ID NO: 4006730 - RNA, 12 nt, Human immunodeficiency virus 2 [HIV-2]
gcugcagggacu

SEQ ID NO: 4006731 - RNA, 20 nt, Human immunodeficiency virus 2 [HIV-2]
gcuggacucucaccaguacu

SEQ ID NO: 4006732 - RNA, 22 nt, Human immunodeficiency virus 2 [HIV-2]
ggaaaaauaugacauggcagga

SEQ ID NO: 4006733 - RNA, 15 nt, Human immunodeficiency virus 2 [HIV-2]
ggaagccaugcagga

SEQ ID NO: 4006734 - RNA, 16 nt, Human immunodeficiency virus 2 [HIV-2]
ggaauccaaggcagga

SEQ ID NO: 4006735 - RNA, 12 nt, Human immunodeficiency virus 2 [HIV-2]
ggaggacauggg

SEQ ID NO: 4006736 - RNA, 22 nt, Human immunodeficiency virus 2 [HIV-2]
ggauaauaccagauuggcagaa

SEQ ID NO: 4006737 - RNA, 19 nt, Human immunodeficiency virus 2 [HIV-2]
ggaugguuaugggaagcag

SEQ ID NO: 4006738 - RNA, 22 nt, Human immunodeficiency virus 2 [HIV-2]
ggcagcaaaauauggaugaugu

SEQ ID NO: 4006739 - RNA, 19 nt, Human immunodeficiency virus 2 [HIV-2]
ggcaugaugaacaagggau

SEQ ID NO: 4006740 - RNA, 13 nt, Human immunodeficiency virus 2 [HIV-2]
ggcauggcagaga

SEQ ID NO: 4006741 - RNA, 17 nt, Human immunodeficiency virus 2 [HIV-2]
gggaagccaugcaggag

SEQ ID NO: 4006742 - RNA, 17 nt, Human immunodeficiency virus 2 [HIV-2]
gggaauccaaggcagga

SEQ ID NO: 4006743 - RNA, 13 nt, Human immunodeficiency virus 2 [HIV-2]
gggaggcagugaa

SEQ ID NO: 4006744 - RNA, 13 nt, Human immunodeficiency virus 2 [HIV-2]
gggcgcgugggga

SEQ ID NO: 4006745 - RNA, 23 nt, Human immunodeficiency virus 2 [HIV-2]
ggggaauacucgcaguuccaaga

SEQ ID NO: 4006746 - RNA, 15 nt, Human immunodeficiency virus 2 [HIV-2]
ggucaaggcaggaag

SEQ ID NO: 4006747 - RNA, 14 nt, Human immunodeficiency virus 2 [HIV-2]
guacccaauguacu

SEQ ID NO: 4006748 - RNA, 19 nt, Human immunodeficiency virus 2 [HIV-2]
guagagccuggguguuccc

SEQ ID NO: 4006749 - RNA, 21 nt, Human immunodeficiency virus 2 [HIV-2]
guagcuacuaagaaacagcug

SEQ ID NO: 4006750 - RNA, 16 nt, Human immunodeficiency virus 2 [HIV-2]
gucaggauugccagag

SEQ ID NO: 4006751 - RNA, 17 nt, Human immunodeficiency virus 2 [HIV-2]
gucaggauugccagaga

SEQ ID NO: 4006752 - RNA, 18 nt, Human immunodeficiency virus 2 [HIV-2]
gugacaacacaacagcug

SEQ ID NO: 4006753 - RNA, 17 nt, Human immunodeficiency virus 2 [HIV-2]
gugacagaacaagcagu

SEQ ID NO: 4006754 - RNA, 11 nt, Human immunodeficiency virus 2 [HIV-2]
gugagggacag

SEQ ID NO: 4006755 - RNA, 17 nt, Human immunodeficiency virus 2 [HIV-2]
guggacuaacugcagag

SEQ ID NO: 4006756 - RNA, 21 nt, Human immunodeficiency virus 2 [HIV-2]
guggggaugguuaugggaagc

SEQ ID NO: 4006757 - RNA, 24 nt, Human immunodeficiency virus 2 [HIV-2]
uaaccaagggagggacaugggagg

SEQ ID NO: 4006758 - RNA, 16 nt, Human immunodeficiency virus 2 [HIV-2]
uacaaggccuucacuc

SEQ ID NO: 4006759 - RNA, 21 nt, Human immunodeficiency virus 2 [HIV-2]
uacuccucaacuccagugagg

SEQ ID NO: 4006760 - RNA, 14 nt, Human immunodeficiency virus 2 [HIV-2]
uaugugacuguuuu

SEQ ID NO: 4006761 - RNA, 13 nt, Human immunodeficiency virus 2 [HIV-2]
uauucccuuauuu

SEQ ID NO: 4006762 - RNA, 22 nt, Human immunodeficiency virus 2 [HIV-2]
ucaauaccuagcccuaguagua

SEQ ID NO: 4006763 - RNA, 15 nt, Human immunodeficiency virus 2 [HIV-2]
uccauugccagcugu

SEQ ID NO: 4006764 - RNA, 19 nt, Human immunodeficiency virus 2 [HIV-2]
uccugugagggacagcagu

SEQ ID NO: 4006765 - RNA, 16 nt, Human immunodeficiency virus 2 [HIV-2]
ugaaggcgccagagag

SEQ ID NO: 4006766 - RNA, 14 nt, Human immunodeficiency virus 2 [HIV-2]
ugacuccaugcugg

SEQ ID NO: 4006767 - RNA, 19 nt, Human immunodeficiency virus 2 [HIV-2]
ugcauagaaaacaacacau

SEQ ID NO: 4006768 - RNA, 19 nt, Human immunodeficiency virus 2 [HIV-2]
uggaaaaauaugacauggc

SEQ ID NO: 4006769 - RNA, 15 nt, Human immunodeficiency virus 2 [HIV-2]
uggagaaacccagca

SEQ ID NO: 4006770 - RNA, 18 nt, Human immunodeficiency virus 2 [HIV-2]
ugggggaccauacagugc

SEQ ID NO: 4006771 - RNA, 17 nt, Human immunodeficiency virus 2 [HIV-2]
uggguguucccugcugg

SEQ ID NO: 4006772 - RNA, 16 nt, Human immunodeficiency virus 2 [HIV-2]
uguggacuaacugcag

SEQ ID NO: 4006773 - RNA, 13 nt, Human immunodeficiency virus 2 [HIV-2]
uuccaagaagaau

SEQ ID NO: 4006774 - RNA, 22 nt, Human immunodeficiency virus 2 [HIV-2]
uuccucaauuggguagaagaca

SEQ ID NO: 4006775 - RNA, 19 nt, Human immunodeficiency virus 2 [HIV-2]
uuguaagagaccaggaaau

SEQ ID NO: 4006776 - RNA, 15 nt, Human immunodeficiency virus 2 [HIV-2]
uugugccuaaugcaa

SEQ ID NO: 4006777 - RNA, 23 nt, Human immunodeficiency virus 2 [HIV-2]
uuuccagaaggggcuguaaccaa

SEQ ID NO: 4006778 - RNA, 14 nt, Human immunodeficiency virus 2 [HIV-2]
ggagcuggugggga

SEQ ID NO: 4006779 - RNA, 13 nt, Human immunodeficiency virus 2 [HIV-2]
ggcaauagauaug

SEQ ID NO: 4006780 - RNA, 16 nt, Human immunodeficiency virus 2 [HIV-2]
ggcagaucgagcccug

SEQ ID NO: 4006781 - RNA, 18 nt, Human immunodeficiency virus 2 [HIV-2]
ggccgguacugggcagac

SEQ ID NO: 4006782 - RNA, 13 nt, Human immunodeficiency virus 2 [HIV-2]
gggaagccaugca

SEQ ID NO: 4006783 - RNA, 22 nt, Human immunodeficiency virus 2 [HIV-2]
gggaauacucgcaguuccaaga

SEQ ID NO: 4006784 - RNA, 19 nt, Human immunodeficiency virus 2 [HIV-2]
gggaauccaaggcaggaaa

SEQ ID NO: 4006785 - RNA, 14 nt, Human immunodeficiency virus 2 [HIV-2]
ggguaccgccagga

SEQ ID NO: 4006786 - RNA, 12 nt, Human immunodeficiency virus 2 [HIV-2]
guacacccagca

SEQ ID NO: 4006787 - RNA, 23 nt, Human immunodeficiency virus 2 [HIV-2]
guagaacucucacaagaggcaga

SEQ ID NO: 4006788 - RNA, 17 nt, Human immunodeficiency virus 2 [HIV-2]
guauaaauguacccgcu

SEQ ID NO: 4006789 - RNA, 15 nt, Human immunodeficiency virus 2 [HIV-2]
guauuuagaagaugu

SEQ ID NO: 4006790 - RNA, 12 nt, Human immunodeficiency virus 2 [HIV-2]
gucaaggcagga

SEQ ID NO: 4006791 - RNA, 21 nt, Human immunodeficiency virus 2 [HIV-2]
gugcaacuaaaaauagagaca

SEQ ID NO: 4006792 - RNA, 17 nt, Human immunodeficiency virus 2 [HIV-2]
gugcagaaguggcagaa

SEQ ID NO: 4006793 - RNA, 23 nt, Human immunodeficiency virus 2 [HIV-2]
guguucccugcuggacucucacc

SEQ ID NO: 4006794 - RNA, 13 nt, Human immunodeficiency virus 2 [HIV-2]
guuuggaggcaga

SEQ ID NO: 4006795 - RNA, 23 nt, Human immunodeficiency virus 2 [HIV-2]
guuugugacaacacaacagcugg

SEQ ID NO: 4006796 - RNA, 16 nt, Human immunodeficiency virus 2 [HIV-2]
uaaacagggaggcagu

SEQ ID NO: 4006797 - RNA, 21 nt, Human immunodeficiency virus 2 [HIV-2]
uaaccaagggagggacauggg

SEQ ID NO: 4006798 - RNA, 20 nt, Human immunodeficiency virus 2 [HIV-2]
uaaugcaaaaagcuauauuu

SEQ ID NO: 4006799 - RNA, 21 nt, Human immunodeficiency virus 2 [HIV-2]
uagaacucucacaagaggcag

SEQ ID NO: 4006800 - RNA, 14 nt, Human immunodeficiency virus 2 [HIV-2]
uaggcagcaaaaua

SEQ ID NO: 4006801 - RNA, 21 nt, Human immunodeficiency virus 2 [HIV-2]
uaguacacccagcacaaacaa

SEQ ID NO: 4006802 - RNA, 14 nt, Human immunodeficiency virus 2 [HIV-2]
ucaagagacaacaa

SEQ ID NO: 4006803 - RNA, 22 nt, Human immunodeficiency virus 2 [HIV-2]
ucaauauggagugcauauagua

SEQ ID NO: 4006804 - RNA, 20 nt, Human immunodeficiency virus 2 [HIV-2]
ucagucaaaguuuagaagaa

SEQ ID NO: 4006805 - RNA, 15 nt, Human immunodeficiency virus 2 [HIV-2]
ucaucugaguaacaa

SEQ ID NO: 4006806 - RNA, 14 nt, Human immunodeficiency virus 2 [HIV-2]
ucgguguucaucug

SEQ ID NO: 4006807 - RNA, 15 nt, Human immunodeficiency virus 2 [HIV-2]
ucucacaagaggcag

SEQ ID NO: 4006808 - RNA, 13 nt, Human immunodeficiency virus 2 [HIV-2]
ucuccagcacuag

SEQ ID NO: 4006809 - RNA, 14 nt, Human immunodeficiency virus 2 [HIV-2]
ucucgcgacagcag

SEQ ID NO: 4006810 - RNA, 15 nt, Human immunodeficiency virus 2 [HIV-2]
ucucgcgacagcagg

SEQ ID NO: 4006811 - RNA, 12 nt, Human immunodeficiency virus 2 [HIV-2]
ucugcggagagg

SEQ ID NO: 4006812 - RNA, 16 nt, Human immunodeficiency virus 2 [HIV-2]
ucugcggagaggcugg

SEQ ID NO: 4006813 - RNA, 18 nt, Human immunodeficiency virus 2 [HIV-2]
ucuugcauuguauucagu

SEQ ID NO: 4006814 - RNA, 20 nt, Human immunodeficiency virus 2 [HIV-2]
ugaaccaucugccccgagag

SEQ ID NO: 4006815 - RNA, 20 nt, Human immunodeficiency virus 2 [HIV-2]
ugaauaacaggaacaaccau

SEQ ID NO: 4006816 - RNA, 20 nt, Human immunodeficiency virus 2 [HIV-2]
ugcgggcgcguggggauggu

SEQ ID NO: 4006817 - RNA, 13 nt, Human immunodeficiency virus 2 [HIV-2]
uggacuaacugca

SEQ ID NO: 4006818 - RNA, 16 nt, Human immunodeficiency virus 2 [HIV-2]
uggccuauaacuacaa

SEQ ID NO: 4006819 - RNA, 20 nt, Human immunodeficiency virus 2 [HIV-2]
uguaagagaccaggaaauaa

SEQ ID NO: 4006820 - RNA, 22 nt, Human immunodeficiency virus 2 [HIV-2]
ugugcaacuaaaaauagagaca

SEQ ID NO: 4006821 - RNA, 14 nt, Human immunodeficiency virus 2 [HIV-2]
ugugccuaaugcaa

SEQ ID NO: 4006822 - RNA, 14 nt, Human immunodeficiency virus 2 [HIV-2]
uguucccugcugga

SEQ ID NO: 4006823 - RNA, 22 nt, Human immunodeficiency virus 2 [HIV-2]
uuaguacacccagcacaaacaa

SEQ ID NO: 4006824 - RNA, 12 nt, Human immunodeficiency virus 2 [HIV-2]
uuaucaggaaau

SEQ ID NO: 4006825 - RNA, 12 nt, Human immunodeficiency virus 2 [HIV-2]
uucuaacugcau

SEQ ID NO: 4006826 - RNA, 22 nt, Human immunodeficiency virus 2 [HIV-2]
uuguauucagucgcucugcgga

SEQ ID NO: 4006827 - RNA, 16 nt, Human immunodeficiency virus 2 [HIV-2]
uuuacaguaggaggag

SEQ ID NO: 4006828 - RNA, 21 nt, Human immunodeficiency virus 2 [HIV-2]
auaauaccagauuggcagaau

SEQ ID NO: 4006829 - RNA, 14 nt, Human immunodeficiency virus 2 [HIV-2]
aucugcagagacuu

SEQ ID NO: 4006830 - RNA, 12 nt, Human immunodeficiency virus 2 [HIV-2]
augacauggcag

SEQ ID NO: 4006831 - RNA, 18 nt, Human immunodeficiency virus 2 [HIV-2]
augcaguuuccauugcca

SEQ ID NO: 4006832 - RNA, 22 nt, Human immunodeficiency virus 2 [HIV-2]
auuaacuuuacgaaaccgggag

SEQ ID NO: 4006833 - RNA, 16 nt, Human immunodeficiency virus 2 [HIV-2]
auuaccuuuagugcag

SEQ ID NO: 4006834 - RNA, 16 nt, Human immunodeficiency virus 2 [HIV-2]
auugccagcuguguuu

SEQ ID NO: 4006835 - RNA, 16 nt, Human immunodeficiency virus 2 [HIV-2]
auuggcuaaacaagga

SEQ ID NO: 4006836 - RNA, 17 nt, Human immunodeficiency virus 2 [HIV-2]
caaaacugaaagcaaga

SEQ ID NO: 4006837 - RNA, 17 nt, Human immunodeficiency virus 2 [HIV-2]
caaacaagcagacauga

SEQ ID NO: 4006838 - RNA, 14 nt, Human immunodeficiency virus 2 [HIV-2]
caaaugcuauugua

SEQ ID NO: 4006839 - RNA, 17 nt, Human immunodeficiency virus 2 [HIV-2]
caagagagggugcacuu

SEQ ID NO: 4006840 - RNA, 12 nt, Human immunodeficiency virus 2 [HIV-2]
caaggagaagaa

SEQ ID NO: 4006841 - RNA, 16 nt, Human immunodeficiency virus 2 [HIV-2]
caaggccuaggcaggc

SEQ ID NO: 4006842 - RNA, 21 nt, Human immunodeficiency virus 2 [HIV-2]
caauauggagugcauauagua

SEQ ID NO: 4006843 - RNA, 14 nt, Human immunodeficiency virus 2 [HIV-2]
caaucuauguagug

SEQ ID NO: 4006844 - RNA, 23 nt, Human immunodeficiency virus 2 [HIV-2]
cacaaggaugauggaaacgcaaa

SEQ ID NO: 4006845 - RNA, 20 nt, Human immunodeficiency virus 2 [HIV-2]
cacaagucaggauugccaga

SEQ ID NO: 4006846 - RNA, 14 nt, Human immunodeficiency virus 2 [HIV-2]
cagaaagacagaaa

SEQ ID NO: 4006847 - RNA, 19 nt, Human immunodeficiency virus 2 [HIV-2]
cagaaguggcagaacugua

SEQ ID NO: 4006848 - RNA, 18 nt, Human immunodeficiency virus 2 [HIV-2]
cagauggagggaagccau

SEQ ID NO: 4006849 - RNA, 14 nt, Human immunodeficiency virus 2 [HIV-2]
cagcaaucagggac

SEQ ID NO: 4006850 - RNA, 16 nt, Human immunodeficiency virus 2 [HIV-2]
cagcaaucagggacug

SEQ ID NO: 4006851 - RNA, 19 nt, Human immunodeficiency virus 2 [HIV-2]
cagcagggagaguacauga

SEQ ID NO: 4006852 - RNA, 21 nt, Human immunodeficiency virus 2 [HIV-2]
caggagugggagaaacaaguc

SEQ ID NO: 4006853 - RNA, 16 nt, Human immunodeficiency virus 2 [HIV-2]
caggcaagagucacug

SEQ ID NO: 4006854 - RNA, 16 nt, Human immunodeficiency virus 2 [HIV-2]
caggcagggagcagaa

SEQ ID NO: 4006855 - RNA, 21 nt, Human immunodeficiency virus 2 [HIV-2]
cauacuuacuguauaaaugua

SEQ ID NO: 4006856 - RNA, 17 nt, Human immunodeficiency virus 2 [HIV-2]
caucccagauacaaagg

SEQ ID NO: 4006857 - RNA, 17 nt, Human immunodeficiency virus 2 [HIV-2]
caugcacuaacaaaugc

SEQ ID NO: 4006858 - RNA, 21 nt, Human immunodeficiency virus 2 [HIV-2]
cauguuacaugagacauugca

SEQ ID NO: 4006859 - RNA, 22 nt, Human immunodeficiency virus 2 [HIV-2]
ccaacagaguuucccccagaag

SEQ ID NO: 4006860 - RNA, 13 nt, Human immunodeficiency virus 2 [HIV-2]
ccaaggcaggaaa

SEQ ID NO: 4006861 - RNA, 12 nt, Human immunodeficiency virus 2 [HIV-2]
ccagagaaagaa

SEQ ID NO: 4006862 - RNA, 20 nt, Human immunodeficiency virus 2 [HIV-2]
ccagccaacgaaggaacaga

SEQ ID NO: 4006863 - RNA, 21 nt, Human immunodeficiency virus 2 [HIV-2]
ccauauagugaauaacaggaa

SEQ ID NO: 4006864 - RNA, 20 nt, Human immunodeficiency virus 2 [HIV-2]
ccaucacuucaauaccuagc

SEQ ID NO: 4006865 - RNA, 19 nt, Human immunodeficiency virus 2 [HIV-2]
ccauggagaaacccagcaa

SEQ ID NO: 4006866 - RNA, 15 nt, Human immunodeficiency virus 2 [HIV-2]
ccgccgacugaucuc

SEQ ID NO: 4006867 - RNA, 21 nt, Human immunodeficiency virus 2 [HIV-2]
cgaagaaggacuccaaggaaa

SEQ ID NO: 4006868 - RNA, 17 nt, Human immunodeficiency virus 2 [HIV-2]
cgaguggcuagagagga

SEQ ID NO: 4006869 - RNA, 13 nt, Human immunodeficiency virus 2 [HIV-2]
cggagaggcuggc

SEQ ID NO: 4006870 - RNA, 16 nt, Human immunodeficiency virus 2 [HIV-2]
cggagaggcuggcaga

SEQ ID NO: 4006871 - RNA, 17 nt, Human immunodeficiency virus 2 [HIV-2]
cuagacauauaccuaga

SEQ ID NO: 4006872 - RNA, 13 nt, Human immunodeficiency virus 2 [HIV-2]
cuagagaggacca

SEQ ID NO: 4006873 - RNA, 19 nt, Human immunodeficiency virus 2 [HIV-2]
cuagcagguagagccuggg

SEQ ID NO: 4006874 - RNA, 16 nt, Human immunodeficiency virus 2 [HIV-2]
cugcagggacuuucca

SEQ ID NO: 4006875 - RNA, 15 nt, Human immunodeficiency virus 2 [HIV-2]
cugcggagaggcugg

SEQ ID NO: 4006876 - RNA, 23 nt, Human immunodeficiency virus 2 [HIV-2]
cuggaaaaauaugacauggcagg

SEQ ID NO: 4006877 - RNA, 22 nt, Human immunodeficiency virus 2 [HIV-2]
cuggggaacgaaaaaccuccag

SEQ ID NO: 4006878 - RNA, 22 nt, Human immunodeficiency virus 2 [HIV-2]
cuggucauucgguguucaucug

SEQ ID NO: 4006879 - RNA, 21 nt, Human immunodeficiency virus 2 [HIV-2]
cuuaaggcggcccaacugcaa

SEQ ID NO: 4006880 - RNA, 19 nt, Human immunodeficiency virus 2 [HIV-2]
cuuacuguauaaauguacc

SEQ ID NO: 4006881 - RNA, 13 nt, Human immunodeficiency virus 2 [HIV-2]
cuugcccagcugc

SEQ ID NO: 4006882 - RNA, 19 nt, Human immunodeficiency virus 2 [HIV-2]
cuugcgggcgcguggggau

SEQ ID NO: 4006883 - RNA, 23 nt, Human immunodeficiency virus 2 [HIV-2]
cuuuaauggcacuagagcagaaa

SEQ ID NO: 4006884 - RNA, 20 nt, Human immunodeficiency virus 2 [HIV-2]
gaaaauagaacauauaucua

SEQ ID NO: 4006885 - RNA, 23 nt, Human immunodeficiency virus 2 [HIV-2]
gaaauaauuuuaaaugugacaga

SEQ ID NO: 4006886 - RNA, 15 nt, Human immunodeficiency virus 2 [HIV-2]
gaacaaccauacuug

SEQ ID NO: 4006887 - RNA, 17 nt, Human immunodeficiency virus 2 [HIV-2]
gaacaagauaagaaaag

SEQ ID NO: 4006888 - RNA, 16 nt, Human immunodeficiency virus 2 [HIV-2]
gaacagcccauggaga

SEQ ID NO: 4006889 - RNA, 20 nt, Human immunodeficiency virus 2 [HIV-2]
gaagaugugguuugugacaa

SEQ ID NO: 4006890 - RNA, 18 nt, Human immunodeficiency virus 2 [HIV-2]
gaagccuuaaacagggag

SEQ ID NO: 4006891 - RNA, 14 nt, Human immunodeficiency virus 2 [HIV-2]
gaagcuuuccaagc

SEQ ID NO: 4006892 - RNA, 24 nt, Human immunodeficiency virus 2 [HIV-2]
gaagggguuagaacaagauaagaa

SEQ ID NO: 4006893 - RNA, 13 nt, Human immunodeficiency virus 2 [HIV-2]
gaauccaaggcag

SEQ ID NO: 4006894 - RNA, 13 nt, Human immunodeficiency virus 2 [HIV-2]
gaauggaaggcaa

SEQ ID NO: 4006895 - RNA, 13 nt, Human immunodeficiency virus 2 [HIV-2]
gacaacaagaaau

SEQ ID NO: 4006896 - RNA, 17 nt, Human immunodeficiency virus 2 [HIV-2]
gacagaccccagagaaa

SEQ ID NO: 4006897 - RNA, 18 nt, Human immunodeficiency virus 2 [HIV-2]
gagacuuacuauccaaga

SEQ ID NO: 4006898 - RNA, 13 nt, Human immunodeficiency virus 2 [HIV-2]
gagaggcuggcag

SEQ ID NO: 4006899 - RNA, 14 nt, Human immunodeficiency virus 2 [HIV-2]
gagaggcuggcaga

SEQ ID NO: 4006900 - RNA, 16 nt, Human immunodeficiency virus 2 [HIV-2]
gaggaccauagaagcc

SEQ ID NO: 4006901 - RNA, 19 nt, Human immunodeficiency virus 2 [HIV-2]
gaugugcguuuagacaggu

SEQ ID NO: 4006902 - RNA, 16 nt, Human immunodeficiency virus 2 [HIV-2]
gcaacagaaagacaga

SEQ ID NO: 4006903 - RNA, 21 nt, Human immunodeficiency virus 2 [HIV-2]
gcaaguuaaguguguguuccc

SEQ ID NO: 4006904 - RNA, 15 nt, Human immunodeficiency virus 2 [HIV-2]
gcacaaggaugaugg

SEQ ID NO: 4006905 - RNA, 16 nt, Human immunodeficiency virus 2 [HIV-2]
gcagacaugaugauga

SEQ ID NO: 4006906 - RNA, 13 nt, Human immunodeficiency virus 2 [HIV-2]
gcaugaugaacaa

SEQ ID NO: 4006907 - RNA, 14 nt, Human immunodeficiency virus 2 [HIV-2]
gccaaucaacacaa

SEQ ID NO: 4006908 - RNA, 24 nt, Human immunodeficiency virus 2 [HIV-2]
gccaaucaacacaaggccuaggca

SEQ ID NO: 4006909 - RNA, 12 nt, Human immunodeficiency virus 2 [HIV-2]
gccuaggcaggc

SEQ ID NO: 4006910 - RNA, 20 nt, Human immunodeficiency virus 2 [HIV-2]
gcuacacaaaguauagauau

SEQ ID NO: 4006911 - RNA, 17 nt, Human immunodeficiency virus 2 [HIV-2]
gcuaguaucaguagaac

SEQ ID NO: 4006912 - RNA, 19 nt, Human immunodeficiency virus 2 [HIV-2]
gcugccaguuagaagcaag

SEQ ID NO: 4006913 - RNA, 16 nt, Human immunodeficiency virus 2 [HIV-2]
gcuugcuuaguauauu

SEQ ID NO: 4006914 - RNA, 17 nt, Human immunodeficiency virus 2 [HIV-2]
ggaccggggacagccag

SEQ ID NO: 4006915 - RNA, 14 nt, Human immunodeficiency virus 2 [HIV-2]
ggacuccaaggaaa

SEQ ID NO: 4006916 - RNA, 14 nt, Human immunodeficiency virus 2 [HIV-2]
ggagaaacccagca

SEQ ID NO: 4006917 - RNA, 19 nt, Human immunodeficiency virus 2 [HIV-2]
ggagacauuaguguggcag

SEQ ID NO: 4006918 - RNA, 19 nt, Human immunodeficiency virus 2 [HIV-2]
aaaauauggaugauguaga

SEQ ID NO: 4006919 - RNA, 23 nt, Human immunodeficiency virus 2 [HIV-2]
aaagaauggaaggcaaaacugaa

SEQ ID NO: 4006920 - RNA, 18 nt, Human immunodeficiency virus 2 [HIV-2]
aaaguagggaaaaaugua

SEQ ID NO: 4006921 - RNA, 23 nt, Human immunodeficiency virus 2 [HIV-2]
aaauauggaugauguagauucug

SEQ ID NO: 4006922 - RNA, 18 nt, Human immunodeficiency virus 2 [HIV-2]
aaauucauggggaugugc

SEQ ID NO: 4006923 - RNA, 17 nt, Human immunodeficiency virus 2 [HIV-2]
aacaagacccuggucug

SEQ ID NO: 4006924 - RNA, 15 nt, Human immunodeficiency virus 2 [HIV-2]
aaccaagggagggac

SEQ ID NO: 4006925 - RNA, 21 nt, Human immunodeficiency virus 2 [HIV-2]
aagaaacagcugaggcugcag

SEQ ID NO: 4006926 - RNA, 17 nt, Human immunodeficiency virus 2 [HIV-2]
aagaaucaggcagggag

SEQ ID NO: 4006927 - RNA, 18 nt, Human immunodeficiency virus 2 [HIV-2]
aagcuaguaucaguagaa

SEQ ID NO: 4006928 - RNA, 21 nt, Human immunodeficiency virus 2 [HIV-2]
aaggacacaugguauuuagaa

SEQ ID NO: 4006929 - RNA, 14 nt, Human immunodeficiency virus 2 [HIV-2]
aaggauuggaagac

SEQ ID NO: 4006930 - RNA, 20 nt, Human immunodeficiency virus 2 [HIV-2]
aaggcgccagagagcucauu

SEQ ID NO: 4006931 - RNA, 19 nt, Human immunodeficiency virus 2 [HIV-2]
aaguagcuacuaagaaaca

SEQ ID NO: 4006932 - RNA, 23 nt, Human immunodeficiency virus 2 [HIV-2]
aagugcuugcuuaguauauugua

SEQ ID NO: 4006933 - RNA, 17 nt, Human immunodeficiency virus 2 [HIV-2]
aauauguaugaauuaca

SEQ ID NO: 4006934 - RNA, 14 nt, Human immunodeficiency virus 2 [HIV-2]
aaucaggcagggag

SEQ ID NO: 4006935 - RNA, 16 nt, Human immunodeficiency virus 2 [HIV-2]
acacauuucaagagag

SEQ ID NO: 4006936 - RNA, 20 nt, Human immunodeficiency virus 2 [HIV-2]
acaguaggaggagacauaga

SEQ ID NO: 4006937 - RNA, 16 nt, Human immunodeficiency virus 2 [HIV-2]
acaugagacauugcaa

SEQ ID NO: 4006938 - RNA, 14 nt, Human immunodeficiency virus 2 [HIV-2]
accacggagagaaa

SEQ ID NO: 4006939 - RNA, 20 nt, Human immunodeficiency virus 2 [HIV-2]
accauacagugcuugccaga

SEQ ID NO: 4006940 - RNA, 20 nt, Human immunodeficiency virus 2 [HIV-2]
accgauuagaacugggagac

SEQ ID NO: 4006941 - RNA, 21 nt, Human immunodeficiency virus 2 [HIV-2]
acgcuugcuugcuuaaagacc

SEQ ID NO: 4006942 - RNA, 18 nt, Human immunodeficiency virus 2 [HIV-2]
acuacaaauuaauagaaa

SEQ ID NO: 4006943 - RNA, 18 nt, Human immunodeficiency virus 2 [HIV-2]
acuagcagguagagccug

SEQ ID NO: 4006944 - RNA, 20 nt, Human immunodeficiency virus 2 [HIV-2]
acuccagugaggaacaaaag

SEQ ID NO: 4006945 - RNA, 14 nt, Human immunodeficiency virus 2 [HIV-2]
acugaaagcaagag

SEQ ID NO: 4006946 - RNA, 19 nt, Human immunodeficiency virus 2 [HIV-2]
acuggccgggauagugcag

SEQ ID NO: 4006947 - RNA, 15 nt, Human immunodeficiency virus 2 [HIV-2]
agaaauaacaccaau

SEQ ID NO: 4006948 - RNA, 13 nt, Human immunodeficiency virus 2 [HIV-2]
agaagaugucugg

SEQ ID NO: 4006949 - RNA, 19 nt, Human immunodeficiency virus 2 [HIV-2]
agaagccuuaaacagggag

SEQ ID NO: 4006950 - RNA, 13 nt, Human immunodeficiency virus 2 [HIV-2]
agaaucaggcagg

SEQ ID NO: 4006951 - RNA, 14 nt, Human immunodeficiency virus 2 [HIV-2]
agaaucaggcaggg

SEQ ID NO: 4006952 - RNA, 22 nt, Human immunodeficiency virus 2 [HIV-2]
agaaucaggcagggagcagaac

SEQ ID NO: 4006953 - RNA, 13 nt, Human immunodeficiency virus 2 [HIV-2]
agacaaugaugau

SEQ ID NO: 4006954 - RNA, 19 nt, Human immunodeficiency virus 2 [HIV-2]
agacuuacuauccaagaac

SEQ ID NO: 4006955 - RNA, 21 nt, Human immunodeficiency virus 2 [HIV-2]
agagaaaggguaccgccagga

SEQ ID NO: 4006956 - RNA, 18 nt, Human immunodeficiency virus 2 [HIV-2]
agagccaucagaggggaa

SEQ ID NO: 4006957 - RNA, 20 nt, Human immunodeficiency virus 2 [HIV-2]
agaguacaugaacagcccau

SEQ ID NO: 4006958 - RNA, 13 nt, Human immunodeficiency virus 2 [HIV-2]
agcaagcuacaca

SEQ ID NO: 4006959 - RNA, 22 nt, Human immunodeficiency virus 2 [HIV-2]
agcccauggagaaacccagcaa

SEQ ID NO: 4006960 - RNA, 18 nt, Human immunodeficiency virus 2 [HIV-2]
agcccucuucgugcacuu

SEQ ID NO: 4006961 - RNA, 23 nt, Human immunodeficiency virus 2 [HIV-2]
agcgcgacgcaucgggaggggaa

SEQ ID NO: 4006962 - RNA, 14 nt, Human immunodeficiency virus 2 [HIV-2]
agcugaggcugcag

SEQ ID NO: 4006963 - RNA, 14 nt, Human immunodeficiency virus 2 [HIV-2]
aggaaucaaugaua

SEQ ID NO: 4006964 - RNA, 12 nt, Human immunodeficiency virus 2 [HIV-2]
agggagggacau

SEQ ID NO: 4006965 - RNA, 23 nt, Human immunodeficiency virus 2 [HIV-2]
agggagugacuggguaauagaaa

SEQ ID NO: 4006966 - RNA, 15 nt, Human immunodeficiency virus 2 [HIV-2]
agggcuauaggccug

SEQ ID NO: 4006967 - RNA, 14 nt, Human immunodeficiency virus 2 [HIV-2]
aguagaacucucac

SEQ ID NO: 4006968 - RNA, 14 nt, Human immunodeficiency virus 2 [HIV-2]
agucaggauugcca

SEQ ID NO: 4006969 - RNA, 20 nt, Human immunodeficiency virus 2 [HIV-2]
agucaggauugccagagaaa

SEQ ID NO: 4006970 - RNA, 17 nt, Human immunodeficiency virus 2 [HIV-2]
agucgccgccuggucau

SEQ ID NO: 4006971 - RNA, 17 nt, Human immunodeficiency virus 2 [HIV-2]
agugcagaaguggcaga

SEQ ID NO: 4006972 - RNA, 19 nt, Human immunodeficiency virus 2 [HIV-2]
auaagcacuauugggaugc

SEQ ID NO: 4006973 - RNA, 12 nt, Human immunodeficiency virus 2 [HIV-2]
caaugaauugua

SEQ ID NO: 4006974 - RNA, 15 nt, Human immunodeficiency virus 2 [HIV-2]
cacaagaggcagagg

SEQ ID NO: 4006975 - RNA, 20 nt, Human immunodeficiency virus 2 [HIV-2]
cacgaccccgaaucccagga

SEQ ID NO: 4006976 - RNA, 15 nt, Human immunodeficiency virus 2 [HIV-2]
cacuagcagguagag

SEQ ID NO: 4006977 - RNA, 24 nt, Human immunodeficiency virus 2 [HIV-2]
cacucucagccaaucaacacaagg

SEQ ID NO: 4006978 - RNA, 17 nt, Human immunodeficiency virus 2 [HIV-2]
cagagucuaacagcaau

SEQ ID NO: 4006979 - RNA, 14 nt, Human immunodeficiency virus 2 [HIV-2]
cagauggagggaag

SEQ ID NO: 4006980 - RNA, 18 nt, Human immunodeficiency virus 2 [HIV-2]
cagcugaggcugcaggga

SEQ ID NO: 4006981 - RNA, 21 nt, Human immunodeficiency virus 2 [HIV-2]
caggaaguagcuacuaagaaa

SEQ ID NO: 4006982 - RNA, 18 nt, Human immunodeficiency virus 2 [HIV-2]
caggaggugaagcaaacc

SEQ ID NO: 4006983 - RNA, 18 nt, Human immunodeficiency virus 2 [HIV-2]
cagggaggcagugaacca

SEQ ID NO: 4006984 - RNA, 17 nt, Human immunodeficiency virus 2 [HIV-2]
caguaucagcagggaga

SEQ ID NO: 4006985 - RNA, 20 nt, Human immunodeficiency virus 2 [HIV-2]
cagucaaaguuuagaagaag

SEQ ID NO: 4006986 - RNA, 13 nt, Human immunodeficiency virus 2 [HIV-2]
cagucgcucugcg

SEQ ID NO: 4006987 - RNA, 15 nt, Human immunodeficiency virus 2 [HIV-2]
caguuagaagcaagu

SEQ ID NO: 4006988 - RNA, 19 nt, Human immunodeficiency virus 2 [HIV-2]
cauauagugaauaacagga

SEQ ID NO: 4006989 - RNA, 21 nt, Human immunodeficiency virus 2 [HIV-2]
cauauaucuauuggcauggca

SEQ ID NO: 4006990 - RNA, 22 nt, Human immunodeficiency virus 2 [HIV-2]
cauauaucuauuggcauggcag

SEQ ID NO: 4006991 - RNA, 21 nt, Human immunodeficiency virus 2 [HIV-2]
cauaugagcgaaagggcagac

SEQ ID NO: 4006992 - RNA, 18 nt, Human immunodeficiency virus 2 [HIV-2]
cauggaauaauacaguga

SEQ ID NO: 4006993 - RNA, 21 nt, Human immunodeficiency virus 2 [HIV-2]
cauggaauaauacagugacag

SEQ ID NO: 4006994 - RNA, 13 nt, Human immunodeficiency virus 2 [HIV-2]
cauugccagcugu

SEQ ID NO: 4006995 - RNA, 19 nt, Human immunodeficiency virus 2 [HIV-2]
ccaacgaaggaacagaaga

SEQ ID NO: 4006996 - RNA, 20 nt, Human immunodeficiency virus 2 [HIV-2]
ccaagaagaaucaggcaggg

SEQ ID NO: 4006997 - RNA, 14 nt, Human immunodeficiency virus 2 [HIV-2]
ccaaggcaggaaaa

SEQ ID NO: 4006998 - RNA, 14 nt, Human immunodeficiency virus 2 [HIV-2]
ccagaaggggcugu

SEQ ID NO: 4006999 - RNA, 13 nt, Human immunodeficiency virus 2 [HIV-2]
ccagcaacagaaa

SEQ ID NO: 4007000 - RNA, 18 nt, Human immunodeficiency virus 2 [HIV-2]
ccagcaacagaaagacag

SEQ ID NO: 4007001 - RNA, 20 nt, Human immunodeficiency virus 2 [HIV-2]
ccagcaacagaaagacagaa

SEQ ID NO: 4007002 - RNA, 11 nt, Human immunodeficiency virus 2 [HIV-2]
ccauacagugc

SEQ ID NO: 4007003 - RNA, 18 nt, Human immunodeficiency virus 2 [HIV-2]
cccagcaacagaaagaca

SEQ ID NO: 4007004 - RNA, 18 nt, Human immunodeficiency virus 2 [HIV-2]
ccuaaagcaucaggcaca

SEQ ID NO: 4007005 - RNA, 17 nt, Human immunodeficiency virus 2 [HIV-2]
ccuagaaaaagaggaag

SEQ ID NO: 4007006 - RNA, 19 nt, Human immunodeficiency virus 2 [HIV-2]
cggacuuuacuggccggga

SEQ ID NO: 4007007 - RNA, 12 nt, Human immunodeficiency virus 2 [HIV-2]
cggagaggcugg

SEQ ID NO: 4007008 - RNA, 13 nt, Human immunodeficiency virus 2 [HIV-2]
cgguuaucuccaa

SEQ ID NO: 4007009 - RNA, 18 nt, Human immunodeficiency virus 2 [HIV-2]
cuaacugcagaggagaau

SEQ ID NO: 4007010 - RNA, 20 nt, Human immunodeficiency virus 2 [HIV-2]
cuaagugcacuaaaguagua

SEQ ID NO: 4007011 - RNA, 18 nt, Human immunodeficiency virus 2 [HIV-2]
cuacaaggccuucacucu

SEQ ID NO: 4007012 - RNA, 15 nt, Human immunodeficiency virus 2 [HIV-2]
cuccugugagggaca

SEQ ID NO: 4007013 - RNA, 16 nt, Human immunodeficiency virus 2 [HIV-2]
cuccuugcccagcugc

SEQ ID NO: 4007014 - RNA, 19 nt, Human immunodeficiency virus 2 [HIV-2]
cucugcggagaggcuggca

SEQ ID NO: 4007015 - RNA, 19 nt, Human immunodeficiency virus 2 [HIV-2]
cucuucaauaaagcugcca

SEQ ID NO: 4007016 - RNA, 18 nt, Human immunodeficiency virus 2 [HIV-2]
cugagagguucucuccag

SEQ ID NO: 4007017 - RNA, 17 nt, Human immunodeficiency virus 2 [HIV-2]
cugcaccagacaaguga

SEQ ID NO: 4007018 - RNA, 17 nt, Human immunodeficiency virus 2 [HIV-2]
cugccaguuagaagcaa

SEQ ID NO: 4007019 - RNA, 15 nt, Human immunodeficiency virus 2 [HIV-2]
cugggagacuacaaa

SEQ ID NO: 4007020 - RNA, 11 nt, Human immunodeficiency virus 2 [HIV-2]
cugguggggaa

SEQ ID NO: 4007021 - RNA, 23 nt, Human immunodeficiency virus 2 [HIV-2]
cuucgaguggcuagagaggacca

SEQ ID NO: 4007022 - RNA, 16 nt, Human immunodeficiency virus 2 [HIV-2]
cuuuccagaaggggcu

SEQ ID NO: 4007023 - RNA, 23 nt, Human immunodeficiency virus 2 [HIV-2]
gaaacagcugaggcugcagggac

SEQ ID NO: 4007024 - RNA, 23 nt, Human immunodeficiency virus 2 [HIV-2]
gaacucgcccuccugugagggac

SEQ ID NO: 4007025 - RNA, 17 nt, Human immunodeficiency virus 2 [HIV-2]
gaagaaucaggcaggga

SEQ ID NO: 4007026 - RNA, 22 nt, Human immunodeficiency virus 2 [HIV-2]
gaagcccaaauucaacaagaaa

SEQ ID NO: 4007027 - RNA, 19 nt, Human immunodeficiency virus 2 [HIV-2]
gaaucaacaguaaccagca

SEQ ID NO: 4007028 - RNA, 15 nt, Human immunodeficiency virus 2 [HIV-2]
gaaucaggcagggag

SEQ ID NO: 4007029 - RNA, 13 nt, Human immunodeficiency virus 2 [HIV-2]
gacaagaaccaaa

SEQ ID NO: 4007030 - RNA, 17 nt, Human immunodeficiency virus 2 [HIV-2]
gacagaacaagcaguag

SEQ ID NO: 4007031 - RNA, 22 nt, Human immunodeficiency virus 2 [HIV-2]
gacagcaguaucagcagggaga

SEQ ID NO: 4007032 - RNA, 20 nt, Human immunodeficiency virus 2 [HIV-2]
gacaugggaggagcuggugg

SEQ ID NO: 4007033 - RNA, 17 nt, Human immunodeficiency virus 2 [HIV-2]
gacauuaguguggcagu

SEQ ID NO: 4007034 - RNA, 23 nt, Human immunodeficiency virus 2 [HIV-2]
gaccucuucaauaaagcugccag

SEQ ID NO: 4007035 - RNA, 15 nt, Human immunodeficiency virus 2 [HIV-2]
gagaccauuggagag

SEQ ID NO: 4007036 - RNA, 17 nt, Human immunodeficiency virus 2 [HIV-2]
gaggcagaggaagauga

SEQ ID NO: 4007037 - RNA, 22 nt, Human immunodeficiency virus 2 [HIV-2]
gaguaccacggagagaaaugac

SEQ ID NO: 4007038 - RNA, 19 nt, Human immunodeficiency virus 2 [HIV-2]
gaguuucccccagaagaug

SEQ ID NO: 4007039 - RNA, 22 nt, Human immunodeficiency virus 2 [HIV-2]
gaugcuaugagguuuagauacu

SEQ ID NO: 4007040 - RNA, 14 nt, Human immunodeficiency virus 2 [HIV-2]
gcaagcuacacaaa

SEQ ID NO: 4007041 - RNA, 17 nt, Human immunodeficiency virus 2 [HIV-2]
gcaauagauaugucaca

SEQ ID NO: 4007042 - RNA, 21 nt, Human immunodeficiency virus 2 [HIV-2]
gcacagcuaaauucaugggga

SEQ ID NO: 4007043 - RNA, 19 nt, Human immunodeficiency virus 2 [HIV-2]
gcagacaugaugaugagca

SEQ ID NO: 4007044 - RNA, 18 nt, Human immunodeficiency virus 2 [HIV-2]
gcagcaacagcaacagcu

SEQ ID NO: 4007045 - RNA, 19 nt, Human immunodeficiency virus 2 [HIV-2]
gcagcaacagcaacagcug

SEQ ID NO: 4007046 - RNA, 22 nt, Human immunodeficiency virus 2 [HIV-2]
gcaggcucagacccggaagugg

SEQ ID NO: 4007047 - RNA, 21 nt, Human immunodeficiency virus 2 [HIV-2]
gcccaaauucaacaagaaaag

SEQ ID NO: 4007048 - RNA, 20 nt, Human immunodeficiency virus 2 [HIV-2]
gcccauggagaaacccagca

SEQ ID NO: 4007049 - RNA, 16 nt, Human immunodeficiency virus 2 [HIV-2]
gcgaaagggcagacga

SEQ ID NO: 4007050 - RNA, 17 nt, Human immunodeficiency virus 2 [HIV-2]
gcugccaguuagaagca

SEQ ID NO: 4007051 - RNA, 13 nt, Human immunodeficiency virus 2 [HIV-2]
gcuggacucucac

SEQ ID NO: 4007052 - RNA, 23 nt, Human immunodeficiency virus 2 [HIV-2]
ggaaauaauuuuaaaugugacag

SEQ ID NO: 4007053 - RNA, 22 nt, Human immunodeficiency virus 2 [HIV-2]
ggacagcaguaucagcagggag

SEQ ID NO: 4007054 - RNA, 23 nt, Human immunodeficiency virus 2 [HIV-2]
ggaggcagauggagggaagccau

SEQ ID NO: 4007055 - RNA, 20 nt, Human immunodeficiency virus 2 [HIV-2]
ggagggacaugggaggagcu

SEQ ID NO: 4007056 - RNA, 14 nt, Human immunodeficiency virus 2 [HIV-2]
ggcaggaaguagcu

SEQ ID NO: 4007057 - RNA, 13 nt, Human immunodeficiency virus 2 [HIV-2]
ggcagggagcaga

SEQ ID NO: 4007058 - RNA, 20 nt, Human immunodeficiency virus 2 [HIV-2]
ggcuggcagaucgagcccug

SEQ ID NO: 4007059 - RNA, 14 nt, Human immunodeficiency virus 2 [HIV-2]
gggacagccagcca

SEQ ID NO: 4007060 - RNA, 15 nt, Human immunodeficiency virus 2 [HIV-2]
gggacugcaagggau

SEQ ID NO: 4007061 - RNA, 16 nt, Human immunodeficiency virus 2 [HIV-2]
gguagaagacaagaac

SEQ ID NO: 4007062 - RNA, 21 nt, Human immunodeficiency virus 2 [HIV-2]
guacuucggguggcuguggaa

SEQ ID NO: 4007063 - RNA, 21 nt, Human immunodeficiency virus 2 [HIV-2]
gucuaacagcaaucagggacu

SEQ ID NO: 4007064 - RNA, 15 nt, Human immunodeficiency virus 2 [HIV-2]
guucucuccagcacu

SEQ ID NO: 4007065 - RNA, 19 nt, Human immunodeficiency virus 2 [HIV-2]
guuggacguagucaagaga

SEQ ID NO: 4007066 - RNA, 19 nt, Human immunodeficiency virus 2 [HIV-2]
guuugggcacaagucagga

SEQ ID NO: 4007067 - RNA, 19 nt, Human immunodeficiency virus 2 [HIV-2]
uacaaauuaauagaaauaa

SEQ ID NO: 4007068 - RNA, 12 nt, Human immunodeficiency virus 2 [HIV-2]
uagaacaagaua

SEQ ID NO: 4007069 - RNA, 15 nt, Human immunodeficiency virus 2 [HIV-2]
uagaagccuuaaaca

SEQ ID NO: 4007070 - RNA, 21 nt, Human immunodeficiency virus 2 [HIV-2]
uaguaucaguagaacucucac

SEQ ID NO: 4007071 - RNA, 19 nt, Human immunodeficiency virus 2 [HIV-2]
uauaaauuggcaauagaua

SEQ ID NO: 4007072 - RNA, 22 nt, Human immunodeficiency virus 2 [HIV-2]
uauaccuagaaaaagaggaagg

SEQ ID NO: 4007073 - RNA, 14 nt, Human immunodeficiency virus 2 [HIV-2]
uaucagcagggaga

SEQ ID NO: 4007074 - RNA, 14 nt, Human immunodeficiency virus 2 [HIV-2]
ucaacuccagugag

SEQ ID NO: 4007075 - RNA, 23 nt, Human immunodeficiency virus 2 [HIV-2]
ucaaggcaggaaguagcuacuaa

SEQ ID NO: 4007076 - RNA, 12 nt, Human immunodeficiency virus 2 [HIV-2]
uccaaggcagga

SEQ ID NO: 4007077 - RNA, 17 nt, Human immunodeficiency virus 2 [HIV-2]
uccauaauagacaugga

SEQ ID NO: 4007078 - RNA, 20 nt, Human immunodeficiency virus 2 [HIV-2]
ucuaacugcauagaaaacaa

SEQ ID NO: 4007079 - RNA, 17 nt, Human immunodeficiency virus 2 [HIV-2]
ugacagaccccagagaa

SEQ ID NO: 4007080 - RNA, 14 nt, Human immunodeficiency virus 2 [HIV-2]
ugaggagaugaugc

SEQ ID NO: 4007081 - RNA, 23 nt, Human immunodeficiency virus 2 [HIV-2]
ugaugcauggaauaauacaguga

SEQ ID NO: 4007082 - RNA, 21 nt, Human immunodeficiency virus 2 [HIV-2]
ugauggaaacgcaaacuucua

SEQ ID NO: 4007083 - RNA, 22 nt, Human immunodeficiency virus 2 [HIV-2]
ugcaguuuccauugccagcugu

SEQ ID NO: 4007084 - RNA, 18 nt, Human immunodeficiency virus 2 [HIV-2]
ugcuuaguacacccagca

SEQ ID NO: 4007085 - RNA, 21 nt, Human immunodeficiency virus 2 [HIV-2]
uggcuaaacaaggagaagaac

SEQ ID NO: 4007086 - RNA, 13 nt, Human immunodeficiency virus 2 [HIV-2]
uggguagaagaca

SEQ ID NO: 4007087 - RNA, 23 nt, Human immunodeficiency virus 2 [HIV-2]
ugugcaacuaaaaauagagacac

SEQ ID NO: 4007088 - RNA, 19 nt, Human immunodeficiency virus 2 [HIV-2]
uguggaagcuaguaucagu

SEQ ID NO: 4007089 - RNA, 17 nt, Human immunodeficiency virus 2 [HIV-2]
uuagaagcaaguuaagu

SEQ ID NO: 4007090 - RNA, 21 nt, Human immunodeficiency virus 2 [HIV-2]
gaacucucacaagaggcagag

SEQ ID NO: 4007091 - RNA, 14 nt, Human immunodeficiency virus 2 [HIV-2]
gaaggcgccagaga

SEQ ID NO: 4007092 - RNA, 11 nt, Human immunodeficiency virus 2 [HIV-2]
gacaacacaac

SEQ ID NO: 4007093 - RNA, 15 nt, Human immunodeficiency virus 2 [HIV-2]
gacagaccccagaga

SEQ ID NO: 4007094 - RNA, 17 nt, Human immunodeficiency virus 2 [HIV-2]
gagaaguaccuaaagca

SEQ ID NO: 4007095 - RNA, 18 nt, Human immunodeficiency virus 2 [HIV-2]
gagaccauuggagaggcc

SEQ ID NO: 4007096 - RNA, 20 nt, Human immunodeficiency virus 2 [HIV-2]
gagagguucucuccagcacu

SEQ ID NO: 4007097 - RNA, 23 nt, Human immunodeficiency virus 2 [HIV-2]
gagccuggguguucccugcugga

SEQ ID NO: 4007098 - RNA, 24 nt, Human immunodeficiency virus 2 [HIV-2]
gagccuggguguucccugcuggac

SEQ ID NO: 4007099 - RNA, 18 nt, Human immunodeficiency virus 2 [HIV-2]
gaggacuacgagagagac

SEQ ID NO: 4007100 - RNA, 22 nt, Human immunodeficiency virus 2 [HIV-2]
gagggauaccauauagugaaua

SEQ ID NO: 4007101 - RNA, 22 nt, Human immunodeficiency virus 2 [HIV-2]
aaaagggggacugcaagggaug

SEQ ID NO: 4007102 - RNA, 17 nt, Human immunodeficiency virus 2 [HIV-2]
aaacaguggagaagaga

SEQ ID NO: 4007103 - RNA, 14 nt, Human immunodeficiency virus 2 [HIV-2]
aaagcaagagggau

SEQ ID NO: 4007104 - RNA, 24 nt, Human immunodeficiency virus 2 [HIV-2]
aagagucaugugauaagcacuauu

SEQ ID NO: 4007105 - RNA, 22 nt, Human immunodeficiency virus 2 [HIV-2]
aagauuuguauaggcagcaaaa

SEQ ID NO: 4007106 - RNA, 23 nt, Human immunodeficiency virus 2 [HIV-2]
aagccuuaaacagggaggcagug

SEQ ID NO: 4007107 - RNA, 18 nt, Human immunodeficiency virus 2 [HIV-2]
aaguagauuuagaaaggg

SEQ ID NO: 4007108 - RNA, 17 nt, Human immunodeficiency virus 2 [HIV-2]
aauugcuaacauugaca

SEQ ID NO: 4007109 - RNA, 16 nt, Human immunodeficiency virus 2 [HIV-2]
acaagaggcagaggaa

SEQ ID NO: 4007110 - RNA, 17 nt, Human immunodeficiency virus 2 [HIV-2]
acaagaggcagaggaag

SEQ ID NO: 4007111 - RNA, 21 nt, Human immunodeficiency virus 2 [HIV-2]
acaagcaguagaagaugucug

SEQ ID NO: 4007112 - RNA, 17 nt, Human immunodeficiency virus 2 [HIV-2]
acaaguauuauaaucuc

SEQ ID NO: 4007113 - RNA, 22 nt, Human immunodeficiency virus 2 [HIV-2]
acacuugggggaccauacagug

SEQ ID NO: 4007114 - RNA, 20 nt, Human immunodeficiency virus 2 [HIV-2]
acagaguuucccccagaaga

SEQ ID NO: 4007115 - RNA, 20 nt, Human immunodeficiency virus 2 [HIV-2]
acagcaguaucagcagggag

SEQ ID NO: 4007116 - RNA, 18 nt, Human immunodeficiency virus 2 [HIV-2]
acagcugaggcugcaggg

SEQ ID NO: 4007117 - RNA, 17 nt, Human immunodeficiency virus 2 [HIV-2]
acaugggaggagcuggu

SEQ ID NO: 4007118 - RNA, 14 nt, Human immunodeficiency virus 2 [HIV-2]
accagauuggcaga

SEQ ID NO: 4007119 - RNA, 17 nt, Human immunodeficiency virus 2 [HIV-2]
accagcauaauugcuaa

SEQ ID NO: 4007120 - RNA, 15 nt, Human immunodeficiency virus 2 [HIV-2]
acccagcaacagaaa

SEQ ID NO: 4007121 - RNA, 22 nt, Human immunodeficiency virus 2 [HIV-2]
accgccaggaaacaguggagaa

SEQ ID NO: 4007122 - RNA, 16 nt, Human immunodeficiency virus 2 [HIV-2]
acguagucaagagaca

SEQ ID NO: 4007123 - RNA, 13 nt, Human immunodeficiency virus 2 [HIV-2]
acuacgagagaga

SEQ ID NO: 4007124 - RNA, 17 nt, Human immunodeficiency virus 2 [HIV-2]
acucaugggccaggagu

SEQ ID NO: 4007125 - RNA, 18 nt, Human immunodeficiency virus 2 [HIV-2]
acucgcaguuccaagaag

SEQ ID NO: 4007126 - RNA, 23 nt, Human immunodeficiency virus 2 [HIV-2]
acucucacaagaggcagaggaag

SEQ ID NO: 4007127 - RNA, 19 nt, Human immunodeficiency virus 2 [HIV-2]
acugaucucccagagucua

SEQ ID NO: 4007128 - RNA, 13 nt, Human immunodeficiency virus 2 [HIV-2]
acugcagaggaga

SEQ ID NO: 4007129 - RNA, 15 nt, Human immunodeficiency virus 2 [HIV-2]
acuggguaauagaaa

SEQ ID NO: 4007130 - RNA, 16 nt, Human immunodeficiency virus 2 [HIV-2]
agaaaaagaggaaggg

SEQ ID NO: 4007131 - RNA, 14 nt, Human immunodeficiency virus 2 [HIV-2]
agaaaaagggggac

SEQ ID NO: 4007132 - RNA, 19 nt, Human immunodeficiency virus 2 [HIV-2]
agaaaacaacacaugcgca

SEQ ID NO: 4007133 - RNA, 19 nt, Human immunodeficiency virus 2 [HIV-2]
agaacuguaccgauuagaa

SEQ ID NO: 4007134 - RNA, 16 nt, Human immunodeficiency virus 2 [HIV-2]
agaaucaggcagggag

SEQ ID NO: 4007135 - RNA, 20 nt, Human immunodeficiency virus 2 [HIV-2]
agaauuggcuaaacaaggag

SEQ ID NO: 4007136 - RNA, 21 nt, Human immunodeficiency virus 2 [HIV-2]
agaauuggcuaaacaaggaga

SEQ ID NO: 4007137 - RNA, 12 nt, Human immunodeficiency virus 2 [HIV-2]
agaggcuggcag

SEQ ID NO: 4007138 - RNA, 23 nt, Human immunodeficiency virus 2 [HIV-2]
agaggcuggcagaucgagcccug

SEQ ID NO: 4007139 - RNA, 22 nt, Human immunodeficiency virus 2 [HIV-2]
agaguaccacggagagaaauga

SEQ ID NO: 4007140 - RNA, 18 nt, Human immunodeficiency virus 2 [HIV-2]
agauauuggcaugaugaa

SEQ ID NO: 4007141 - RNA, 18 nt, Human immunodeficiency virus 2 [HIV-2]
agaucgagcccugagagg

SEQ ID NO: 4007142 - RNA, 16 nt, Human immunodeficiency virus 2 [HIV-2]
agauucugaugaugau

SEQ ID NO: 4007143 - RNA, 14 nt, Human immunodeficiency virus 2 [HIV-2]
agcaacagaaagac

SEQ ID NO: 4007144 - RNA, 15 nt, Human immunodeficiency virus 2 [HIV-2]
agcaacagaaagaca

SEQ ID NO: 4007145 - RNA, 16 nt, Human immunodeficiency virus 2 [HIV-2]
agcacaaacaagcaga

SEQ ID NO: 4007146 - RNA, 18 nt, Human immunodeficiency virus 2 [HIV-2]
agcaguaucagcagggag

SEQ ID NO: 4007147 - RNA, 14 nt, Human immunodeficiency virus 2 [HIV-2]
agccaugcaggagg

SEQ ID NO: 4007148 - RNA, 17 nt, Human immunodeficiency virus 2 [HIV-2]
agccuuaaacagggagg

SEQ ID NO: 4007149 - RNA, 16 nt, Human immunodeficiency virus 2 [HIV-2]
agcgcgacgcaucggg

SEQ ID NO: 4007150 - RNA, 17 nt, Human immunodeficiency virus 2 [HIV-2]
aggacuacgagagagac

SEQ ID NO: 4007151 - RNA, 13 nt, Human immunodeficiency virus 2 [HIV-2]
aggagugggagaa

SEQ ID NO: 4007152 - RNA, 14 nt, Human immunodeficiency virus 2 [HIV-2]
aggauugccagaga

SEQ ID NO: 4007153 - RNA, 23 nt, Human immunodeficiency virus 2 [HIV-2]
aggcucagacccggaaguggcau

SEQ ID NO: 4007154 - RNA, 14 nt, Human immunodeficiency virus 2 [HIV-2]
agggacaugggagg

SEQ ID NO: 4007155 - RNA, 14 nt, Human immunodeficiency virus 2 [HIV-2]
agggagggacaugg

SEQ ID NO: 4007156 - RNA, 15 nt, Human immunodeficiency virus 2 [HIV-2]
aggguaugaggagau

SEQ ID NO: 4007157 - RNA, 15 nt, Human immunodeficiency virus 2 [HIV-2]
aguaacaagacccug

SEQ ID NO: 4007158 - RNA, 21 nt, Human immunodeficiency virus 2 [HIV-2]
aguaucaguagaacucucaca

SEQ ID NO: 4007159 - RNA, 20 nt, Human immunodeficiency virus 2 [HIV-2]
agucaaaguuuagaagaagc

SEQ ID NO: 4007160 - RNA, 21 nt, Human immunodeficiency virus 2 [HIV-2]
agucaaaguuuagaagaagcc

SEQ ID NO: 4007161 - RNA, 22 nt, Human immunodeficiency virus 2 [HIV-2]
agucgcucugcggagaggcugg

SEQ ID NO: 4007162 - RNA, 17 nt, Human immunodeficiency virus 2 [HIV-2]
agugaguauggagccug

SEQ ID NO: 4007163 - RNA, 17 nt, Human immunodeficiency virus 2 [HIV-2]
aguggauccaagaagcu

SEQ ID NO: 4007164 - RNA, 15 nt, Human immunodeficiency virus 2 [HIV-2]
auaccauauagugaa

SEQ ID NO: 4007165 - RNA, 18 nt, Human immunodeficiency virus 2 [HIV-2]
auacuuggucaaggcagg

SEQ ID NO: 4007166 - RNA, 19 nt, Human immunodeficiency virus 2 [HIV-2]
auagagacacuugggggac

SEQ ID NO: 4007167 - RNA, 19 nt, Human immunodeficiency virus 2 [HIV-2]
auaucuauuggcauggcag

SEQ ID NO: 4007168 - RNA, 20 nt, Human immunodeficiency virus 2 [HIV-2]
aucaacacaaggccuaggca

SEQ ID NO: 4007169 - RNA, 21 nt, Human immunodeficiency virus 2 [HIV-2]
aucaacacaaggccuaggcag

SEQ ID NO: 4007170 - RNA, 19 nt, Human immunodeficiency virus 2 [HIV-2]
aucaacaguaaccagcaua

SEQ ID NO: 4007171 - RNA, 19 nt, Human immunodeficiency virus 2 [HIV-2]
aucuauuggcauggcagag

SEQ ID NO: 4007172 - RNA, 16 nt, Human immunodeficiency virus 2 [HIV-2]
auggcacuagagcaga

SEQ ID NO: 4007173 - RNA, 17 nt, Human immunodeficiency virus 2 [HIV-2]
auggcaggagugggaga

SEQ ID NO: 4007174 - RNA, 14 nt, Human immunodeficiency virus 2 [HIV-2]
auuggcauggcaga

SEQ ID NO: 4007175 - RNA, 20 nt, Human immunodeficiency virus 2 [HIV-2]
caaaauauggaugauguaga

SEQ ID NO: 4007176 - RNA, 14 nt, Human immunodeficiency virus 2 [HIV-2]
caacaucugcagag

SEQ ID NO: 4007177 - RNA, 20 nt, Human immunodeficiency virus 2 [HIV-2]
caagggagggacaugggagg

SEQ ID NO: 4007178 - RNA, 20 nt, Human immunodeficiency virus 2 [HIV-2]
caauaacacuuaugucagga

SEQ ID NO: 4007179 - RNA, 19 nt, Human immunodeficiency virus 2 [HIV-2]
acagcaguaucagcaggga

SEQ ID NO: 4007180 - RNA, 22 nt, Human immunodeficiency virus 2 [HIV-2]
acagcaguaucagcagggagag

SEQ ID NO: 4007181 - RNA, 17 nt, Human immunodeficiency virus 2 [HIV-2]
accuagaaaaagaggaa

SEQ ID NO: 4007182 - RNA, 22 nt, Human immunodeficiency virus 2 [HIV-2]
acgaagaaggacuccaaggaaa

SEQ ID NO: 4007183 - RNA, 19 nt, Human immunodeficiency virus 2 [HIV-2]
acucugagggaaauaaagg

SEQ ID NO: 4007184 - RNA, 22 nt, Human immunodeficiency virus 2 [HIV-2]
acucugagggaaauaaaggaag

SEQ ID NO: 4007185 - RNA, 17 nt, Human immunodeficiency virus 2 [HIV-2]
acucuguacccagaaga

SEQ ID NO: 4007186 - RNA, 17 nt, Human immunodeficiency virus 2 [HIV-2]
acuucuaacugcauaga

SEQ ID NO: 4007187 - RNA, 16 nt, Human immunodeficiency virus 2 [HIV-2]
agaacaagcaguagaa

SEQ ID NO: 4007188 - RNA, 21 nt, Human immunodeficiency virus 2 [HIV-2]
agaagaugggaccccacggag

SEQ ID NO: 4007189 - RNA, 21 nt, Human immunodeficiency virus 2 [HIV-2]
agaagccuuaaacagggaggc

SEQ ID NO: 4007190 - RNA, 12 nt, Human immunodeficiency virus 2 [HIV-2]
agaaucaggcag

SEQ ID NO: 4007191 - RNA, 17 nt, Human immunodeficiency virus 2 [HIV-2]
agaaucaggcagggagc

SEQ ID NO: 4007192 - RNA, 12 nt, Human immunodeficiency virus 2 [HIV-2]
agacaugaugau

SEQ ID NO: 4007193 - RNA, 23 nt, Human immunodeficiency virus 2 [HIV-2]
agacaugaugaugagcaugggga

SEQ ID NO: 4007194 - RNA, 14 nt, Human immunodeficiency virus 2 [HIV-2]
agacgaagaaggac

SEQ ID NO: 4007195 - RNA, 19 nt, Human immunodeficiency virus 2 [HIV-2]
agaggcuuuugaugcaugg

SEQ ID NO: 4007196 - RNA, 14 nt, Human immunodeficiency virus 2 [HIV-2]
agauaagaaaagga

SEQ ID NO: 4007197 - RNA, 17 nt, Human immunodeficiency virus 2 [HIV-2]
agcagguagagccuggg

SEQ ID NO: 4007198 - RNA, 16 nt, Human immunodeficiency virus 2 [HIV-2]
agcaguaucagcaggg

SEQ ID NO: 4007199 - RNA, 19 nt, Human immunodeficiency virus 2 [HIV-2]
agcugaggcugcagggacu

SEQ ID NO: 4007200 - RNA, 23 nt, Human immunodeficiency virus 2 [HIV-2]
aguacuuggccgguacugggcag

SEQ ID NO: 4007201 - RNA, 13 nt, Human immunodeficiency virus 2 [HIV-2]
aguaggaggagac

SEQ ID NO: 4007202 - RNA, 22 nt, Human immunodeficiency virus 2 [HIV-2]
aguuagaagcaaguuaagugug

SEQ ID NO: 4007203 - RNA, 21 nt, Human immunodeficiency virus 2 [HIV-2]
aguuccuguuacaccaagagu

SEQ ID NO: 4007204 - RNA, 22 nt, Human immunodeficiency virus 2 [HIV-2]
auaguagugggaauaauagcuu

SEQ ID NO: 4007205 - RNA, 17 nt, Human immunodeficiency virus 2 [HIV-2]
aucagcagggagaguac

SEQ ID NO: 4007206 - RNA, 12 nt, Human immunodeficiency virus 2 [HIV-2]
aucaggcaggga

SEQ ID NO: 4007207 - RNA, 22 nt, Human immunodeficiency virus 2 [HIV-2]
aucucccagagucuaacagcaa

SEQ ID NO: 4007208 - RNA, 19 nt, Human immunodeficiency virus 2 [HIV-2]
augaacagcccauggagaa

SEQ ID NO: 4007209 - RNA, 19 nt, Human immunodeficiency virus 2 [HIV-2]
augacagaccccagagaaa

SEQ ID NO: 4007210 - RNA, 19 nt, Human immunodeficiency virus 2 [HIV-2]
augaugagcauggggagac

SEQ ID NO: 4007211 - RNA, 23 nt, Human immunodeficiency virus 2 [HIV-2]
augcaaaaagcuauauuuacaca

SEQ ID NO: 4007212 - RNA, 20 nt, Human immunodeficiency virus 2 [HIV-2]
augcauggaauaauacagug

SEQ ID NO: 4007213 - RNA, 16 nt, Human immunodeficiency virus 2 [HIV-2]
auuuuacuaacaagug

SEQ ID NO: 4007214 - RNA, 16 nt, Human immunodeficiency virus 2 [HIV-2]
caaaaagcuauauuua

SEQ ID NO: 4007215 - RNA, 15 nt, Human immunodeficiency virus 2 [HIV-2]
caacaaaaugacaga

SEQ ID NO: 4007216 - RNA, 16 nt, Human immunodeficiency virus 2 [HIV-2]
caacacaugcgcagga

SEQ ID NO: 4007217 - RNA, 13 nt, Human immunodeficiency virus 2 [HIV-2]
caagaaccaaaca

SEQ ID NO: 4007218 - RNA, 12 nt, Human immunodeficiency virus 2 [HIV-2]
caagaggcagag

SEQ ID NO: 4007219 - RNA, 20 nt, Human immunodeficiency virus 2 [HIV-2]
caaggaccggggacagccag

SEQ ID NO: 4007220 - RNA, 12 nt, Human immunodeficiency virus 2 [HIV-2]
caaggcaggaaa

SEQ ID NO: 4007221 - RNA, 15 nt, Human immunodeficiency virus 2 [HIV-2]
caaggccuaggcagg

SEQ ID NO: 4007222 - RNA, 17 nt, Human immunodeficiency virus 2 [HIV-2]
cacaaacaagcagacau

SEQ ID NO: 4007223 - RNA, 17 nt, Human immunodeficiency virus 2 [HIV-2]
cagaaagacagaaagau

SEQ ID NO: 4007224 - RNA, 12 nt, Human immunodeficiency virus 2 [HIV-2]
cagaagaagacg

SEQ ID NO: 4007225 - RNA, 22 nt, Human immunodeficiency virus 2 [HIV-2]
cagaagaguuugggcacaaguc

SEQ ID NO: 4007226 - RNA, 20 nt, Human immunodeficiency virus 2 [HIV-2]
cagaauuauacucaugggcc

SEQ ID NO: 4007227 - RNA, 13 nt, Human immunodeficiency virus 2 [HIV-2]
caggcagggagca

SEQ ID NO: 4007228 - RNA, 18 nt, Human immunodeficiency virus 2 [HIV-2]
caggugaaguaagaagag

SEQ ID NO: 4007229 - RNA, 22 nt, Human immunodeficiency virus 2 [HIV-2]
caggugaaguaagaagagccau

SEQ ID NO: 4007230 - RNA, 17 nt, Human immunodeficiency virus 2 [HIV-2]
caguggagaagagacca

SEQ ID NO: 4007231 - RNA, 20 nt, Human immunodeficiency virus 2 [HIV-2]
cauaauaaaugaaacuucua

SEQ ID NO: 4007232 - RNA, 14 nt, Human immunodeficiency virus 2 [HIV-2]
cauauaaagcagau

SEQ ID NO: 4007233 - RNA, 19 nt, Human immunodeficiency virus 2 [HIV-2]
caugaacagcccauggaga

SEQ ID NO: 4007234 - RNA, 18 nt, Human immunodeficiency virus 2 [HIV-2]
cauuagcuuaaacaagua

SEQ ID NO: 4007235 - RNA, 17 nt, Human immunodeficiency virus 2 [HIV-2]
ccaaauucaacaagaaa

SEQ ID NO: 4007236 - RNA, 23 nt, Human immunodeficiency virus 2 [HIV-2]
ccaagaguaccacggagagaaau

SEQ ID NO: 4007237 - RNA, 16 nt, Human immunodeficiency virus 2 [HIV-2]
ccagcaacagaaagac

SEQ ID NO: 4007238 - RNA, 17 nt, Human immunodeficiency virus 2 [HIV-2]
ccagcacaaacaagcag

SEQ ID NO: 4007239 - RNA, 15 nt, Human immunodeficiency virus 2 [HIV-2]
ccagugaggaacaaa

SEQ ID NO: 4007240 - RNA, 14 nt, Human immunodeficiency virus 2 [HIV-2]
ccauugccagcugu

SEQ ID NO: 4007241 - RNA, 23 nt, Human immunodeficiency virus 2 [HIV-2]
cccaauguacuucggguggcugu

SEQ ID NO: 4007242 - RNA, 21 nt, Human immunodeficiency virus 2 [HIV-2]
cccagcacaaacaagcagaca

SEQ ID NO: 4007243 - RNA, 17 nt, Human immunodeficiency virus 2 [HIV-2]
ccgguuuggaggcagau

SEQ ID NO: 4007244 - RNA, 16 nt, Human immunodeficiency virus 2 [HIV-2]
ccgucuggggaacgaa

SEQ ID NO: 4007245 - RNA, 14 nt, Human immunodeficiency virus 2 [HIV-2]
ccuugcccagcugc

SEQ ID NO: 4007246 - RNA, 21 nt, Human immunodeficiency virus 2 [HIV-2]
cgggcuauacaacaucugcag

SEQ ID NO: 4007247 - RNA, 15 nt, Human immunodeficiency virus 2 [HIV-2]
cuaaauucaugggga

SEQ ID NO: 4007248 - RNA, 20 nt, Human immunodeficiency virus 2 [HIV-2]
cuagagccaugcacuaacaa

SEQ ID NO: 4007249 - RNA, 14 nt, Human immunodeficiency virus 2 [HIV-2]
cuagaggcaaauau

SEQ ID NO: 4007250 - RNA, 23 nt, Human immunodeficiency virus 2 [HIV-2]
cucuccagcacuagcagguagag

SEQ ID NO: 4007251 - RNA, 15 nt, Human immunodeficiency virus 2 [HIV-2]
cugaggcugcaggga

SEQ ID NO: 4007252 - RNA, 21 nt, Human immunodeficiency virus 2 [HIV-2]
cugagggaaauaaaggaagaa

SEQ ID NO: 4007253 - RNA, 16 nt, Human immunodeficiency virus 2 [HIV-2]
cugcggagaggcuggc

SEQ ID NO: 4007254 - RNA, 23 nt, Human immunodeficiency virus 2 [HIV-2]
cuguguuucucgaaaaaggggcu

SEQ ID NO: 4007255 - RNA, 14 nt, Human immunodeficiency virus 2 [HIV-2]
cuuaaacagggagg

SEQ ID NO: 4007256 - RNA, 17 nt, Human immunodeficiency virus 2 [HIV-2]
cuuguacaacaucccag

SEQ ID NO: 4007257 - RNA, 17 nt, Human immunodeficiency virus 2 [HIV-2]
gaggggaauacucgcag

SEQ ID NO: 4007258 - RNA, 14 nt, Human immunodeficiency virus 2 [HIV-2]
gagguauaaggaca

SEQ ID NO: 4007259 - RNA, 15 nt, Human immunodeficiency virus 2 [HIV-2]
gaguaccacggagag

SEQ ID NO: 4007260 - RNA, 15 nt, Human immunodeficiency virus 2 [HIV-2]
gaguauggagccugg

SEQ ID NO: 4007261 - RNA, 17 nt, Human immunodeficiency virus 2 [HIV-2]
gcaacagcaacagcugu

SEQ ID NO: 4007262 - RNA, 20 nt, Human immunodeficiency virus 2 [HIV-2]
gcaccuacagaucagagaag

SEQ ID NO: 4007263 - RNA, 15 nt, Human immunodeficiency virus 2 [HIV-2]
gcagaaguggcagaa

SEQ ID NO: 4007264 - RNA, 14 nt, Human immunodeficiency virus 2 [HIV-2]
gcaguagaagaugu

SEQ ID NO: 4007265 - RNA, 22 nt, Human immunodeficiency virus 2 [HIV-2]
gccaacgaaggaacagaagaag

SEQ ID NO: 4007266 - RNA, 13 nt, Human immunodeficiency virus 2 [HIV-2]
gcccucauacuua

SEQ ID NO: 4007267 - RNA, 20 nt, Human immunodeficiency virus 2 [HIV-2]
gccgguuuggaggcagaugg

SEQ ID NO: 4007268 - RNA, 13 nt, Human immunodeficiency virus 2 [HIV-2]
gccugugaaucaa

SEQ ID NO: 4007269 - RNA, 19 nt, Human immunodeficiency virus 2 [HIV-2]
gcuacuaagaaacagcuga

SEQ ID NO: 4007270 - RNA, 16 nt, Human immunodeficiency virus 2 [HIV-2]
gcuauacaacaucugc

SEQ ID NO: 4007271 - RNA, 23 nt, Human immunodeficiency virus 2 [HIV-2]
gcuauacaacaucugcagagacu

SEQ ID NO: 4007272 - RNA, 18 nt, Human immunodeficiency virus 2 [HIV-2]
gcugagacuuaaggcggc

SEQ ID NO: 4007273 - RNA, 19 nt, Human immunodeficiency virus 2 [HIV-2]
gcuuaguacacccagcaca

SEQ ID NO: 4007274 - RNA, 22 nt, Human immunodeficiency virus 2 [HIV-2]
gcuuugggaauccaaggcagga

SEQ ID NO: 4007275 - RNA, 20 nt, Human immunodeficiency virus 2 [HIV-2]
ggaaucaaugauacagggaa

SEQ ID NO: 4007276 - RNA, 19 nt, Human immunodeficiency virus 2 [HIV-2]
ggaauccaaggcaggaaaa

SEQ ID NO: 4007277 - RNA, 15 nt, Human immunodeficiency virus 2 [HIV-2]
ggacuaacugcagag

SEQ ID NO: 4007278 - RNA, 18 nt, Human immunodeficiency virus 2 [HIV-2]
ggacuuagggagugacug

SEQ ID NO: 4007279 - RNA, 18 nt, Human immunodeficiency virus 2 [HIV-2]
ggagacauuaguguggca

SEQ ID NO: 4007280 - RNA, 13 nt, Human immunodeficiency virus 2 [HIV-2]
ggaggcagugaac

SEQ ID NO: 4007281 - RNA, 17 nt, Human immunodeficiency virus 2 [HIV-2]
ggcacuagagcagaaaa

SEQ ID NO: 4007282 - RNA, 13 nt, Human immunodeficiency virus 2 [HIV-2]
ggcccaacugcaa

SEQ ID NO: 4007283 - RNA, 13 nt, Human immunodeficiency virus 2 [HIV-2]
ggccuaggcaggc

SEQ ID NO: 4007284 - RNA, 15 nt, Human immunodeficiency virus 2 [HIV-2]
ggcuguggaagcuag

SEQ ID NO: 4007285 - RNA, 22 nt, Human immunodeficiency virus 2 [HIV-2]
gggaacgaaaaaccuccaggca

SEQ ID NO: 4007286 - RNA, 12 nt, Human immunodeficiency virus 2 [HIV-2]
gguagagccugg

SEQ ID NO: 4007287 - RNA, 13 nt, Human immunodeficiency virus 2 [HIV-2]
ggucaaggcagga

SEQ ID NO: 4007288 - RNA, 17 nt, Human immunodeficiency virus 2 [HIV-2]
guaagagaccaggaaau

SEQ ID NO: 4007289 - RNA, 14 nt, Human immunodeficiency virus 2 [HIV-2]
guacacccagcaca

SEQ ID NO: 4007290 - RNA, 15 nt, Human immunodeficiency virus 2 [HIV-2]
guaccacggagagaa

SEQ ID NO: 4007291 - RNA, 17 nt, Human immunodeficiency virus 2 [HIV-2]
guagauucugaugauga

SEQ ID NO: 4007292 - RNA, 20 nt, Human immunodeficiency virus 2 [HIV-2]
gucaggauugccagagaaag

SEQ ID NO: 4007293 - RNA, 17 nt, Human immunodeficiency virus 2 [HIV-2]
gucuaaugacugaagca

SEQ ID NO: 4007294 - RNA, 21 nt, Human immunodeficiency virus 2 [HIV-2]
gugcaauuguuaaguagauuu

SEQ ID NO: 4007295 - RNA, 20 nt, Human immunodeficiency virus 2 [HIV-2]
guggcaaagguccuggagau

SEQ ID NO: 4007296 - RNA, 23 nt, Human immunodeficiency virus 2 [HIV-2]
guuccaagaagaaucaggcaggg

SEQ ID NO: 4007297 - RNA, 21 nt, Human immunodeficiency virus 2 [HIV-2]
uaacaggaacaaccauacuug

SEQ ID NO: 4007298 - RNA, 18 nt, Human immunodeficiency virus 2 [HIV-2]
uaagguacccaauguacu

SEQ ID NO: 4007299 - RNA, 14 nt, Human immunodeficiency virus 2 [HIV-2]
uauaaagcagauaa

SEQ ID NO: 4007300 - RNA, 12 nt, Human immunodeficiency virus 2 [HIV-2]
uauaaggacaca

SEQ ID NO: 4007301 - RNA, 14 nt, Human immunodeficiency virus 2 [HIV-2]
uauaggccuguuuu

SEQ ID NO: 4007302 - RNA, 13 nt, Human immunodeficiency virus 2 [HIV-2]
uaucagcagggag

SEQ ID NO: 4007303 - RNA, 17 nt, Human immunodeficiency virus 2 [HIV-2]
uaucauuagcuuaaaca

SEQ ID NO: 4007304 - RNA, 13 nt, Human immunodeficiency virus 2 [HIV-2]
ucagcagggagag

SEQ ID NO: 4007305 - RNA, 23 nt, Human immunodeficiency virus 2 [HIV-2]
ucagcagggagaguacaugaaca

SEQ ID NO: 4007306 - RNA, 20 nt, Human immunodeficiency virus 2 [HIV-2]
ucgggcuauacaacaucugc

SEQ ID NO: 4007307 - RNA, 13 nt, Human immunodeficiency virus 2 [HIV-2]
ucucuccagcacu

SEQ ID NO: 4007308 - RNA, 16 nt, Human immunodeficiency virus 2 [HIV-2]
ucuugcuuuacggcag

SEQ ID NO: 4007309 - RNA, 14 nt, Human immunodeficiency virus 2 [HIV-2]
ugaauuacaaaaau

SEQ ID NO: 4007310 - RNA, 17 nt, Human immunodeficiency virus 2 [HIV-2]
ugaguaacaagacccug

SEQ ID NO: 4007311 - RNA, 19 nt, Human immunodeficiency virus 2 [HIV-2]
ugaucgggcuauacaacau

SEQ ID NO: 4007312 - RNA, 20 nt, Human immunodeficiency virus 2 [HIV-2]
ugcagggacuuuccagaagg

SEQ ID NO: 4007313 - RNA, 11 nt, Human immunodeficiency virus 2 [HIV-2]
ugcccagcugc

SEQ ID NO: 4007314 - RNA, 15 nt, Human immunodeficiency virus 2 [HIV-2]
ugccuaaugcaaaaa

SEQ ID NO: 4007315 - RNA, 17 nt, Human immunodeficiency virus 2 [HIV-2]
ugcgaguggauccaaga

SEQ ID NO: 4007316 - RNA, 14 nt, Human immunodeficiency virus 2 [HIV-2]
ugcuggacucucac

SEQ ID NO: 4007317 - RNA, 20 nt, Human immunodeficiency virus 2 [HIV-2]
uggacguagucaagagacaa

SEQ ID NO: 4007318 - RNA, 18 nt, Human immunodeficiency virus 2 [HIV-2]
uggccgguacugggcaga

SEQ ID NO: 4007319 - RNA, 15 nt, Human immunodeficiency virus 2 [HIV-2]
ugggaauccaaggca

SEQ ID NO: 4007320 - RNA, 13 nt, Human immunodeficiency virus 2 [HIV-2]
uguacccagaaga

SEQ ID NO: 4007321 - RNA, 17 nt, Human immunodeficiency virus 2 [HIV-2]
uguaugaauuacaaaaa

SEQ ID NO: 4007322 - RNA, 23 nt, Human immunodeficiency virus 2 [HIV-2]
uuauacucaugggccaggaguaa

SEQ ID NO: 4007323 - RNA, 21 nt, Human immunodeficiency virus 2 [HIV-2]
uuccaagaagaaucaggcagg

SEQ ID NO: 4007324 - RNA, 12 nt, Human immunodeficiency virus 2 [HIV-2]
uuuggaggcaga

SEQ ID NO: 4007325 - RNA, 12 nt, Human metapneumovirus
aaaaacagaauu

SEQ ID NO: 4007326 - RNA, 22 nt, Human metapneumovirus
aaaaacugaaucagacaaaaag

SEQ ID NO: 4007327 - RNA, 14 nt, Human metapneumovirus
aaaaagaccaauga

SEQ ID NO: 4007328 - RNA, 19 nt, Human metapneumovirus
aaaacugaaauaaagcaag

SEQ ID NO: 4007329 - RNA, 17 nt, Human metapneumovirus
aaaagaccaaugaagca

SEQ ID NO: 4007330 - RNA, 17 nt, Human metapneumovirus
aaaagacugugaaacaa

SEQ ID NO: 4007331 - RNA, 22 nt, Human metapneumovirus
aaaagcugcagccuguuacagu

SEQ ID NO: 4007332 - RNA, 14 nt, Human metapneumovirus
aaaauaaaaauuug

SEQ ID NO: 4007333 - RNA, 19 nt, Human metapneumovirus
aaaaugacucuucauaugc

SEQ ID NO: 4007334 - RNA, 16 nt, Human metapneumovirus
aggacccacagcagca

SEQ ID NO: 4007335 - RNA, 20 nt, Human metapneumovirus
aggagcaccuccagagcuga

SEQ ID NO: 4007336 - RNA, 20 nt, Human metapneumovirus
agggaaagcagcagaaauga

SEQ ID NO: 4007337 - RNA, 19 nt, Human metapneumovirus
agggaucaucaagcaacug

SEQ ID NO: 4007338 - RNA, 21 nt, Human metapneumovirus
agucaaaggagugcaacauaa

SEQ ID NO: 4007339 - RNA, 14 nt, Human metapneumovirus
agucaagaagauga

SEQ ID NO: 4007340 - RNA, 21 nt, Human metapneumovirus
agucaaguuuccugaagauca

SEQ ID NO: 4007341 - RNA, 18 nt, Human metapneumovirus
agugcacuaagagagcuc

SEQ ID NO: 4007342 - RNA, 11 nt, Human metapneumovirus
agugcagugag

SEQ ID NO: 4007343 - RNA, 13 nt, Human metapneumovirus
aguggaaaacaau

SEQ ID NO: 4007344 - RNA, 15 nt, Human metapneumovirus
auaaacagugacaca

SEQ ID NO: 4007345 - RNA, 16 nt, Human metapneumovirus
auaaagaaaacaaaga

SEQ ID NO: 4007346 - RNA, 18 nt, Human metapneumovirus
auaacaaacuaucugaca

SEQ ID NO: 4007347 - RNA, 22 nt, Human metapneumovirus
auaagcaaaauaugcaagacuu

SEQ ID NO: 4007348 - RNA, 17 nt, Human metapneumovirus
auagaaaaggaccuguu

SEQ ID NO: 4007349 - RNA, 15 nt, Human metapneumovirus
auaugcaagacuugg

SEQ ID NO: 4007350 - RNA, 16 nt, Human metapneumovirus
auauuuugaaaacaag

SEQ ID NO: 4007351 - RNA, 11 nt, Human metapneumovirus
aucacaaaaau

SEQ ID NO: 4007352 - RNA, 16 nt, Human metapneumovirus
aucauaauaaagaaaa

SEQ ID NO: 4007353 - RNA, 18 nt, Human metapneumovirus
aucaucaagcaacugaac

SEQ ID NO: 4007354 - RNA, 18 nt, Human metapneumovirus
auccggcuugaaagugaa

SEQ ID NO: 4007355 - RNA, 18 nt, Human metapneumovirus
aucugaagacacaaaaac

SEQ ID NO: 4007356 - RNA, 20 nt, Human metapneumovirus
augauaaccaaagcauaaca

SEQ ID NO: 4007357 - RNA, 19 nt, Human metapneumovirus
augcagacaccaacaaugg

SEQ ID NO: 4007358 - RNA, 20 nt, Human metapneumovirus
augcccucaaaaagaccaau

SEQ ID NO: 4007359 - RNA, 22 nt, Human metapneumovirus
auggaucccauugaagaagaag

SEQ ID NO: 4007360 - RNA, 17 nt, Human metapneumovirus
auggaucuagaaaagaa

SEQ ID NO: 4007361 - RNA, 21 nt, Human metapneumovirus
auggaugcugucaaauuaaac

SEQ ID NO: 4007362 - RNA, 17 nt, Human metapneumovirus
auggcccaaaauuaaaa

SEQ ID NO: 4007363 - RNA, 21 nt, Human metapneumovirus
augggaaaaccccugcagaaa

SEQ ID NO: 4007364 - RNA, 17 nt, Human metapneumovirus
augggucuucaaaaaca

SEQ ID NO: 4007365 - RNA, 14 nt, Human metapneumovirus
augguauuaaauga

SEQ ID NO: 4007366 - RNA, 19 nt, Human metapneumovirus
augucauucccugaaggaa

SEQ ID NO: 4007367 - RNA, 15 nt, Human metapneumovirus
auuaacagaaaaagc

SEQ ID NO: 4007368 - RNA, 19 nt, Human metapneumovirus
auuagaugucauuaaaagu

SEQ ID NO: 4007369 - RNA, 21 nt, Human metapneumovirus
auuaguuaauuaaaaauaaag

SEQ ID NO: 4007370 - RNA, 19 nt, Human metapneumovirus
auuccuuacacagcagcug

SEQ ID NO: 4007371 - RNA, 19 nt, Human metapneumovirus
auuggcguaagagaggaau

SEQ ID NO: 4007372 - RNA, 21 nt, Human metapneumovirus
auuugcucucagauaaugaag

SEQ ID NO: 4007373 - RNA, 18 nt, Human metapneumovirus
caaaaaauuugaagucaa

SEQ ID NO: 4007374 - RNA, 12 nt, Human metapneumovirus
caaaacaacacc

SEQ ID NO: 4007375 - RNA, 12 nt, Human metapneumovirus
caaaauugcacc

SEQ ID NO: 4007376 - RNA, 21 nt, Human metapneumovirus
caaacucacagucugugaagu

SEQ ID NO: 4007377 - RNA, 21 nt, Human metapneumovirus
caacacggucuuaaagagagc

SEQ ID NO: 4007378 - RNA, 23 nt, Human metapneumovirus
caacagaagguuccuaaauguug

SEQ ID NO: 4007379 - RNA, 20 nt, Human metapneumovirus
caacaugccaacaucugcag

SEQ ID NO: 4007380 - RNA, 14 nt, Human metapneumovirus
caacccacaaaaac

SEQ ID NO: 4007381 - RNA, 18 nt, Human metapneumovirus
caacugaacaaaggcugc

SEQ ID NO: 4007382 - RNA, 16 nt, Human metapneumovirus
caacugcagcugcagu

SEQ ID NO: 4007383 - RNA, 20 nt, Human metapneumovirus
caagaauuaaaucaaucaag

SEQ ID NO: 4007384 - RNA, 12 nt, Human metapneumovirus
caagcaccuugg

SEQ ID NO: 4007385 - RNA, 21 nt, Human metapneumovirus
caagucauaguagaacuagga

SEQ ID NO: 4007386 - RNA, 23 nt, Human metapneumovirus
caaguugaucuaauagaaaagga

SEQ ID NO: 4007387 - RNA, 23 nt, Human metapneumovirus
caauagacaacacuguauaccag

SEQ ID NO: 4007388 - RNA, 12 nt, Human metapneumovirus
caauagaggaga

SEQ ID NO: 4007389 - RNA, 14 nt, Human metapneumovirus
caauuauauaaaag

SEQ ID NO: 4007390 - RNA, 15 nt, Human metapneumovirus
cacacaaaaaacaac

SEQ ID NO: 4007391 - RNA, 21 nt, Human metapneumovirus
cacaugcuggaaaauaaacag

SEQ ID NO: 4007392 - RNA, 12 nt, Human metapneumovirus
cacuaagagagc

SEQ ID NO: 4007393 - RNA, 22 nt, Human metapneumovirus
cacucgguguugcaacugcagc

SEQ ID NO: 4007394 - RNA, 17 nt, Human metapneumovirus
cacuggcuucaucauug

SEQ ID NO: 4007395 - RNA, 14 nt, Human metapneumovirus
cagaaaaagcaaaa

SEQ ID NO: 4007396 - RNA, 18 nt, Human metapneumovirus
cagaauccuaagcagugc

SEQ ID NO: 4007397 - RNA, 21 nt, Human metapneumovirus
cagaauccuaagcagugcaga

SEQ ID NO: 4007398 - RNA, 23 nt, Human metapneumovirus
cagaccaagcucuaacacaggcc

SEQ ID NO: 4007399 - RNA, 16 nt, Human metapneumovirus
cagagaugcaaugauu

SEQ ID NO: 4007400 - RNA, 16 nt, Human metapneumovirus
cagcaggugcugaaaa

SEQ ID NO: 4007401 - RNA, 19 nt, Human metapneumovirus
cagcuuaauaaaaacagaa

SEQ ID NO: 4007402 - RNA, 23 nt, Human metapneumovirus
caggaaucaauguugcugagcag

SEQ ID NO: 4007403 - RNA, 18 nt, Human metapneumovirus
caggacccacagcagcaa

SEQ ID NO: 4007404 - RNA, 21 nt, Human metapneumovirus
caggccaacacaccaccagca

SEQ ID NO: 4007405 - RNA, 16 nt, Human metapneumovirus
cagguguugcaauugc

SEQ ID NO: 4007406 - RNA, 12 nt, Human metapneumovirus
cagucaaaaacu

SEQ ID NO: 4007407 - RNA, 13 nt, Human metapneumovirus
cagucaaaaacug

SEQ ID NO: 4007408 - RNA, 14 nt, Human metapneumovirus
cagucuacauaaua

SEQ ID NO: 4007409 - RNA, 20 nt, Human metapneumovirus
caguuucaaucaaagagagu

SEQ ID NO: 4007410 - RNA, 14 nt, Human metapneumovirus
cauaccacauaauu

SEQ ID NO: 4007411 - RNA, 22 nt, Human metapneumovirus
cauauguccaggcugaaagcau

SEQ ID NO: 4007412 - RNA, 13 nt, Human metapneumovirus
caucaaaucaguu

SEQ ID NO: 4007413 - RNA, 21 nt, Human metapneumovirus
caucagcccaaggugcagcaa

SEQ ID NO: 4007414 - RNA, 17 nt, Human metapneumovirus
caugaucuaaucgcacu

SEQ ID NO: 4007415 - RNA, 19 nt, Human metapneumovirus
cauguuagacucaaaaaug

SEQ ID NO: 4007416 - RNA, 14 nt, Human metapneumovirus
ccaauacucaaagu

SEQ ID NO: 4007417 - RNA, 12 nt, Human metapneumovirus
ccaaugaagcag

SEQ ID NO: 4007418 - RNA, 21 nt, Human metapneumovirus
ccacaggagcaccuccagagc

SEQ ID NO: 4007419 - RNA, 23 nt, Human metapneumovirus
ccagagcugaguggugucacaaa

SEQ ID NO: 4007420 - RNA, 19 nt, Human metapneumovirus
ccagcuuaauaaaaacaga

SEQ ID NO: 4007421 - RNA, 17 nt, Human metapneumovirus
ccagugucaagcagcuu

SEQ ID NO: 4007422 - RNA, 21 nt, Human metapneumovirus
ccaugcaaaguuagcacagga

SEQ ID NO: 4007423 - RNA, 14 nt, Human metapneumovirus
ccucuuaagagaag

SEQ ID NO: 4007424 - RNA, 13 nt, Human metapneumovirus
ccuuacacagcag

SEQ ID NO: 4007425 - RNA, 17 nt, Human metapneumovirus
ccuuacacagcagcugu

SEQ ID NO: 4007426 - RNA, 22 nt, Human metapneumovirus
ccuucuuguucaggaaaaaagg

SEQ ID NO: 4007427 - RNA, 20 nt, Human metapneumovirus
cgacacacacacaacaccac

SEQ ID NO: 4007428 - RNA, 19 nt, Human metapneumovirus
cgacacagcagcaggaauc

SEQ ID NO: 4007429 - RNA, 18 nt, Human metapneumovirus
cgagagcauugagaacag

SEQ ID NO: 4007430 - RNA, 19 nt, Human metapneumovirus
cguguguuggcaacugcag

SEQ ID NO: 4007431 - RNA, 18 nt, Human metapneumovirus
cuaaagggaaagcagcag

SEQ ID NO: 4007432 - RNA, 14 nt, Human metapneumovirus
cuacucuaaaucau

SEQ ID NO: 4007433 - RNA, 14 nt, Human metapneumovirus
cuaggagcaauagc

SEQ ID NO: 4007434 - RNA, 18 nt, Human metapneumovirus
cuaggagcaauagcacuc

SEQ ID NO: 4007435 - RNA, 21 nt, Human metapneumovirus
cuaucugacagcaaacaugua

SEQ ID NO: 4007436 - RNA, 22 nt, Human metapneumovirus
cucaaaaagaccaaugaagcag

SEQ ID NO: 4007437 - RNA, 23 nt, Human metapneumovirus
cucaaagugaaugcaucagccca

SEQ ID NO: 4007438 - RNA, 15 nt, Human metapneumovirus
cucagccaaaucagu

SEQ ID NO: 4007439 - RNA, 20 nt, Human metapneumovirus
cugaagaucaauucaauguu

SEQ ID NO: 4007440 - RNA, 13 nt, Human metapneumovirus
cugcagaaaagaa

SEQ ID NO: 4007441 - RNA, 20 nt, Human metapneumovirus
cugcagaaaagaaacugaaa

SEQ ID NO: 4007442 - RNA, 17 nt, Human metapneumovirus
cuguuacaauaccagca

SEQ ID NO: 4007443 - RNA, 23 nt, Human metapneumovirus
cuguuccauuggcagcaacagag

SEQ ID NO: 4007444 - RNA, 19 nt, Human metapneumovirus
cuuuucauggguaaugaag

SEQ ID NO: 4007445 - RNA, 18 nt, Human metapneumovirus
gaaaaucccagacaaucu

SEQ ID NO: 4007446 - RNA, 22 nt, Human metapneumovirus
gaaacaaaccaaaaccagcagu

SEQ ID NO: 4007447 - RNA, 17 nt, Human metapneumovirus
gaaagugaaguaacagc

SEQ ID NO: 4007448 - RNA, 15 nt, Human metapneumovirus
gaagaagaagaagaa

SEQ ID NO: 4007449 - RNA, 14 nt, Human metapneumovirus
gaagaagaagaugc

SEQ ID NO: 4007450 - RNA, 17 nt, Human metapneumovirus
gaaggcgaacagcaugu

SEQ ID NO: 4007451 - RNA, 17 nt, Human metapneumovirus
gaaucaauagaggagaa

SEQ ID NO: 4007452 - RNA, 13 nt, Human metapneumovirus
gaauccuaagcag

SEQ ID NO: 4007453 - RNA, 20 nt, Human metapneumovirus
gacaacacuguauaccagcu

SEQ ID NO: 4007454 - RNA, 23 nt, Human metapneumovirus
gacaacucagacaccaacucaag

SEQ ID NO: 4007455 - RNA, 21 nt, Human metapneumovirus
gaccaaaagugcacuaagaga

SEQ ID NO: 4007456 - RNA, 22 nt, Human metapneumovirus
gaccaaaagugcacuaagagag

SEQ ID NO: 4007457 - RNA, 21 nt, Human metapneumovirus
gaccaagcucuaacacaggcc

SEQ ID NO: 4007458 - RNA, 21 nt, Human metapneumovirus
gacccacagcagcaagagaug

SEQ ID NO: 4007459 - RNA, 14 nt, Human metapneumovirus
gagcagucaaagga

SEQ ID NO: 4007460 - RNA, 12 nt, Human metapneumovirus
gauaaugaagaa

SEQ ID NO: 4007461 - RNA, 13 nt, Human metapneumovirus
gauaaugaagaag

SEQ ID NO: 4007462 - RNA, 15 nt, Human metapneumovirus
gauaaugaagaagaa

SEQ ID NO: 4007463 - RNA, 20 nt, Human metapneumovirus
gauacuucaucauuaagcau

SEQ ID NO: 4007464 - RNA, 17 nt, Human metapneumovirus
gaucaacuggcaagaga

SEQ ID NO: 4007465 - RNA, 16 nt, Human metapneumovirus
gaucaaucaaacagaa

SEQ ID NO: 4007466 - RNA, 16 nt, Human metapneumovirus
gaucagagaugcaaug

SEQ ID NO: 4007467 - RNA, 16 nt, Human metapneumovirus
gaucuaauagaaaagg

SEQ ID NO: 4007468 - RNA, 19 nt, Human metapneumovirus
gcaaaaaaacacaugaucu

SEQ ID NO: 4007469 - RNA, 13 nt, Human metapneumovirus
gcaacugcaguga

SEQ ID NO: 4007470 - RNA, 20 nt, Human metapneumovirus
gcaggacccacagcagcaag

SEQ ID NO: 4007471 - RNA, 15 nt, Human metapneumovirus
gccucuuaagagaag

SEQ ID NO: 4007472 - RNA, 19 nt, Human metapneumovirus
gccuugguggaucaaucaa

SEQ ID NO: 4007473 - RNA, 18 nt, Human metapneumovirus
gcuauaagcagugaagca

SEQ ID NO: 4007474 - RNA, 21 nt, Human metapneumovirus
gcuauuaagaacacucaacau

SEQ ID NO: 4007475 - RNA, 19 nt, Human metapneumovirus
gcucucagauaaugaagaa

SEQ ID NO: 4007476 - RNA, 21 nt, Human metapneumovirus
gcugaaagauuuugugagcaa

SEQ ID NO: 4007477 - RNA, 17 nt, Human metapneumovirus
gcugaaagcauaagcaa

SEQ ID NO: 4007478 - RNA, 20 nt, Human metapneumovirus
gcugaucaacuggcaagaga

SEQ ID NO: 4007479 - RNA, 14 nt, Human metapneumovirus
gcugucaaauuaaa

SEQ ID NO: 4007480 - RNA, 14 nt, Human metapneumovirus
gcuucauaccacau

SEQ ID NO: 4007481 - RNA, 22 nt, Human metapneumovirus
gcuugaaagugaaguaacagca

SEQ ID NO: 4007482 - RNA, 17 nt, Human metapneumovirus
ggacggcacgcagaacc

SEQ ID NO: 4007483 - RNA, 18 nt, Human metapneumovirus
ggagaaauuaagcaugau

SEQ ID NO: 4007484 - RNA, 13 nt, Human metapneumovirus
ggaucuagaaaag

SEQ ID NO: 4007485 - RNA, 15 nt, Human metapneumovirus
ggaucuagaaaagaa

SEQ ID NO: 4007486 - RNA, 14 nt, Human metapneumovirus
ggcaacaacaccau

SEQ ID NO: 4007487 - RNA, 12 nt, Human metapneumovirus
ggccaacacacc

SEQ ID NO: 4007488 - RNA, 21 nt, Human metapneumovirus
ggccagugucaagcagcuuug

SEQ ID NO: 4007489 - RNA, 22 nt, Human metapneumovirus
guaaagugcuuauuguacuuaa

SEQ ID NO: 4007490 - RNA, 19 nt, Human metapneumovirus
guaaauuaaaauaaauuaa

SEQ ID NO: 4007491 - RNA, 16 nt, Human metapneumovirus
guaauaauuaauugcu

SEQ ID NO: 4007492 - RNA, 12 nt, Human metapneumovirus
guaaugaagcag

SEQ ID NO: 4007493 - RNA, 16 nt, Human metapneumovirus
guaaugaagcagcaaa

SEQ ID NO: 4007494 - RNA, 16 nt, Human metapneumovirus
guagcacucgaugaau

SEQ ID NO: 4007495 - RNA, 14 nt, Human metapneumovirus
guauuuuaaaaguu

SEQ ID NO: 4007496 - RNA, 16 nt, Human metapneumovirus
gucaaggcuuacuuaa

SEQ ID NO: 4007497 - RNA, 21 nt, Human metapneumovirus
guccaauacucaaagugaaug

SEQ ID NO: 4007498 - RNA, 15 nt, Human metapneumovirus
gucucauacuaacau

SEQ ID NO: 4007499 - RNA, 17 nt, Human metapneumovirus
gugagagagcugaaaga

SEQ ID NO: 4007500 - RNA, 11 nt, Human metapneumovirus
gugcaaucaac

SEQ ID NO: 4007501 - RNA, 16 nt, Human metapneumovirus
gugcacuaagagagcu

SEQ ID NO: 4007502 - RNA, 17 nt, Human metapneumovirus
gugcacuaagagagcuc

SEQ ID NO: 4007503 - RNA, 18 nt, Human metapneumovirus
guggaucaaucaaacaga

SEQ ID NO: 4007504 - RNA, 20 nt, Human metapneumovirus
guguuggcaacugcagugag

SEQ ID NO: 4007505 - RNA, 19 nt, Human metapneumovirus
guuacagcagguguugcaa

SEQ ID NO: 4007506 - RNA, 19 nt, Human metapneumovirus
guuauauaaaaaucaaguu

SEQ ID NO: 4007507 - RNA, 11 nt, Human metapneumovirus
guugaagauga

SEQ ID NO: 4007508 - RNA, 19 nt, Human metapneumovirus
guuggagaaccgugcaaug

SEQ ID NO: 4007509 - RNA, 14 nt, Human metapneumovirus
guuuccaacaugcc

SEQ ID NO: 4007510 - RNA, 14 nt, Human metapneumovirus
uaacaaaauuaaaa

SEQ ID NO: 4007511 - RNA, 14 nt, Human metapneumovirus
uaagaucaaauuau

SEQ ID NO: 4007512 - RNA, 14 nt, Human metapneumovirus
uaagcagugaagca

SEQ ID NO: 4007513 - RNA, 14 nt, Human metapneumovirus
uaauaaaaacagaa

SEQ ID NO: 4007514 - RNA, 17 nt, Human metapneumovirus
uaauaaaaauaaacaau

SEQ ID NO: 4007515 - RNA, 12 nt, Human metapneumovirus
uacacagcagcu

SEQ ID NO: 4007516 - RNA, 23 nt, Human metapneumovirus
uagauacuuauuaauaagaucaa

SEQ ID NO: 4007517 - RNA, 15 nt, Human metapneumovirus
uagaucauaaaguca

SEQ ID NO: 4007518 - RNA, 19 nt, Human metapneumovirus
uagcacucgguguugcaac

SEQ ID NO: 4007519 - RNA, 15 nt, Human metapneumovirus
uaggagcauaugucc

SEQ ID NO: 4007520 - RNA, 18 nt, Human metapneumovirus
uauaaaaguggaaaacaa

SEQ ID NO: 4007521 - RNA, 23 nt, Human metapneumovirus
uauacaaacucugcaauaaacag

SEQ ID NO: 4007522 - RNA, 20 nt, Human metapneumovirus
uaucaaaauuugugagcuca

SEQ ID NO: 4007523 - RNA, 15 nt, Human metapneumovirus
uauugucaaaaugca

SEQ ID NO: 4007524 - RNA, 12 nt, Human metapneumovirus
uauuuugaaaac

SEQ ID NO: 4007525 - RNA, 15 nt, Human metapneumovirus
ucaaaaacugaauca

SEQ ID NO: 4007526 - RNA, 15 nt, Human metapneumovirus
ucaaaaagcuuggag

SEQ ID NO: 4007527 - RNA, 23 nt, Human metapneumovirus
ucaacaccagauacaacaaaccg

SEQ ID NO: 4007528 - RNA, 22 nt, Human metapneumovirus
ucaacuggcaagagaggagcaa

SEQ ID NO: 4007529 - RNA, 19 nt, Human metapneumovirus
ucaagaacgggacaaauaa

SEQ ID NO: 4007530 - RNA, 20 nt, Human metapneumovirus
ucaaucaaacagaauccuaa

SEQ ID NO: 4007531 - RNA, 15 nt, Human metapneumovirus
ucaaugcacaaauau

SEQ ID NO: 4007532 - RNA, 17 nt, Human metapneumovirus
ucaauguugcugagcag

SEQ ID NO: 4007533 - RNA, 13 nt, Human metapneumovirus
ucacaaacaaugg

SEQ ID NO: 4007534 - RNA, 15 nt, Human metapneumovirus
ucacagucugugaag

SEQ ID NO: 4007535 - RNA, 18 nt, Human metapneumovirus
ucagauaaugaagaagaa

SEQ ID NO: 4007536 - RNA, 18 nt, Human metapneumovirus
ucaucaagcaacugaaca

SEQ ID NO: 4007537 - RNA, 23 nt, Human metapneumovirus
ucauggaucccauugaagaagaa

SEQ ID NO: 4007538 - RNA, 14 nt, Human metapneumovirus
uccauuggcagcaa

SEQ ID NO: 4007539 - RNA, 13 nt, Human metapneumovirus
uccgaagaagaag

SEQ ID NO: 4007540 - RNA, 16 nt, Human metapneumovirus
uccuaagcagugcaga

SEQ ID NO: 4007541 - RNA, 19 nt, Human metapneumovirus
ucuagaaaagaacacaccu

SEQ ID NO: 4007542 - RNA, 18 nt, Human metapneumovirus
ucucagauaaugaagaag

SEQ ID NO: 4007543 - RNA, 20 nt, Human metapneumovirus
ucugaagacacaaaaaccaa

SEQ ID NO: 4007544 - RNA, 19 nt, Human metapneumovirus
ucugugaaguaaaaacagu

SEQ ID NO: 4007545 - RNA, 23 nt, Human metapneumovirus
ucugugaaguaaaaacaguuuac

SEQ ID NO: 4007546 - RNA, 22 nt, Human metapneumovirus
ugaaaaagacugugaaacaaga

SEQ ID NO: 4007547 - RNA, 14 nt, Human metapneumovirus
ugaagcagaccaag

SEQ ID NO: 4007548 - RNA, 21 nt, Human metapneumovirus
ugaagcugcuauaagcaguga

SEQ ID NO: 4007549 - RNA, 21 nt, Human metapneumovirus
ugaaguccagauaacaaccaa

SEQ ID NO: 4007550 - RNA, 19 nt, Human metapneumovirus
ugaagucucauacuaacau

SEQ ID NO: 4007551 - RNA, 17 nt, Human metapneumovirus
ugacaaacucacagucu

SEQ ID NO: 4007552 - RNA, 14 nt, Human metapneumovirus
ugacacaugcugga

SEQ ID NO: 4007553 - RNA, 16 nt, Human metapneumovirus
ugagagagcugaaaga

SEQ ID NO: 4007554 - RNA, 19 nt, Human metapneumovirus
ugaguggugucacaaacaa

SEQ ID NO: 4007555 - RNA, 16 nt, Human metapneumovirus
ugcaacugcagcugca

SEQ ID NO: 4007556 - RNA, 22 nt, Human metapneumovirus
ugcagcugcaguuacagcaggu

SEQ ID NO: 4007557 - RNA, 23 nt, Human metapneumovirus
ugccucuuaagagaagaccaagg

SEQ ID NO: 4007558 - RNA, 14 nt, Human metapneumovirus
uggcagcaacagag

SEQ ID NO: 4007559 - RNA, 17 nt, Human metapneumovirus
aaacaagaggagaccau

SEQ ID NO: 4007560 - RNA, 13 nt, Human metapneumovirus
aaacaaucugcaa

SEQ ID NO: 4007561 - RNA, 12 nt, Human metapneumovirus
aaacccugacaa

SEQ ID NO: 4007562 - RNA, 17 nt, Human metapneumovirus
aaagcagcagaaaugau

SEQ ID NO: 4007563 - RNA, 19 nt, Human metapneumovirus
aaaggcauauucaaaaagc

SEQ ID NO: 4007564 - RNA, 13 nt, Human metapneumovirus
aaagugaaguaac

SEQ ID NO: 4007565 - RNA, 22 nt, Human metapneumovirus
aaaguugaaggcgaacagcaug

SEQ ID NO: 4007566 - RNA, 20 nt, Human metapneumovirus
aaauuagcaaagcucauaau

SEQ ID NO: 4007567 - RNA, 12 nt, Human metapneumovirus
aaauuugaaguc

SEQ ID NO: 4007568 - RNA, 15 nt, Human metapneumovirus
aaauuugaagucaau

SEQ ID NO: 4007569 - RNA, 13 nt, Human metapneumovirus
aacaaaaacaagu

SEQ ID NO: 4007570 - RNA, 17 nt, Human metapneumovirus
aacaaucugcaaauaug

SEQ ID NO: 4007571 - RNA, 16 nt, Human metapneumovirus
aacaugccaacaucug

SEQ ID NO: 4007572 - RNA, 23 nt, Human metapneumovirus
aaccgugcaaugguaagaagaaa

SEQ ID NO: 4007573 - RNA, 20 nt, Human metapneumovirus
aacgaucaaaaauaggaaau

SEQ ID NO: 4007574 - RNA, 23 nt, Human metapneumovirus
aacuauucaauuuaaaaaguaaa

SEQ ID NO: 4007575 - RNA, 12 nt, Human metapneumovirus
aacuuaaaagug

SEQ ID NO: 4007576 - RNA, 19 nt, Human metapneumovirus
aacuuuuaaggaacacuga

SEQ ID NO: 4007577 - RNA, 16 nt, Human metapneumovirus
aagaagaagaagaacc

SEQ ID NO: 4007578 - RNA, 17 nt, Human metapneumovirus
aagagcucaacaaaauu

SEQ ID NO: 4007579 - RNA, 18 nt, Human metapneumovirus
aagauaugucuugaaguc

SEQ ID NO: 4007580 - RNA, 18 nt, Human metapneumovirus
aagaucaauucaauguug

SEQ ID NO: 4007581 - RNA, 22 nt, Human metapneumovirus
aagcacuaaucaagugcaguga

SEQ ID NO: 4007582 - RNA, 14 nt, Human metapneumovirus
aagcagcagaaaug

SEQ ID NO: 4007583 - RNA, 16 nt, Human metapneumovirus
aagcagugcagagaaa

SEQ ID NO: 4007584 - RNA, 14 nt, Human metapneumovirus
aagcauaagcaaaa

SEQ ID NO: 4007585 - RNA, 22 nt, Human metapneumovirus
aaggaagcuaaagggaaagcag

SEQ ID NO: 4007586 - RNA, 22 nt, Human metapneumovirus
aaggcauuccuuacacagcagc

SEQ ID NO: 4007587 - RNA, 18 nt, Human metapneumovirus
aagggacaagauaugucu

SEQ ID NO: 4007588 - RNA, 16 nt, Human metapneumovirus
aagggagugagcuguu

SEQ ID NO: 4007589 - RNA, 19 nt, Human metapneumovirus
aaguaauaauuaauugcuu

SEQ ID NO: 4007590 - RNA, 16 nt, Human metapneumovirus
aagucucauacuaaca

SEQ ID NO: 4007591 - RNA, 20 nt, Human metapneumovirus
aagucucauacuaacauuua

SEQ ID NO: 4007592 - RNA, 22 nt, Human metapneumovirus
aagugcacuaagagagcucaga

SEQ ID NO: 4007593 - RNA, 11 nt, Human metapneumovirus
aagugcaguga

SEQ ID NO: 4007594 - RNA, 14 nt, Human metapneumovirus
aaguggaaaacaau

SEQ ID NO: 4007595 - RNA, 15 nt, Human metapneumovirus
aaguuggaaaaagau

SEQ ID NO: 4007596 - RNA, 15 nt, Human metapneumovirus
aauaaaggaagcuaa

SEQ ID NO: 4007597 - RNA, 14 nt, Human metapneumovirus
aauauaaucaaaca

SEQ ID NO: 4007598 - RNA, 14 nt, Human metapneumovirus
aaucaaacagaauc

SEQ ID NO: 4007599 - RNA, 19 nt, Human metapneumovirus
aaucaaugcacaaauauaa

SEQ ID NO: 4007600 - RNA, 17 nt, Human metapneumovirus
aaucaguuggcaaaaaa

SEQ ID NO: 4007601 - RNA, 19 nt, Human metapneumovirus
aaucucccuggaaaaaaca

SEQ ID NO: 4007602 - RNA, 20 nt, Human metapneumovirus
aauuaguuaauuaaaaauaa

SEQ ID NO: 4007603 - RNA, 20 nt, Human metapneumovirus
acaaaaaggacucaucauca

SEQ ID NO: 4007604 - RNA, 15 nt, Human metapneumovirus
acaaaccaaaaccag

SEQ ID NO: 4007605 - RNA, 20 nt, Human metapneumovirus
acaaacucugcaauaaacag

SEQ ID NO: 4007606 - RNA, 19 nt, Human metapneumovirus
acaagggagugagcuguuc

SEQ ID NO: 4007607 - RNA, 16 nt, Human metapneumovirus
acaaguaaaaauggag

SEQ ID NO: 4007608 - RNA, 15 nt, Human metapneumovirus
acaaucugcaaauau

SEQ ID NO: 4007609 - RNA, 19 nt, Human metapneumovirus
acacacaagacaauaguca

SEQ ID NO: 4007610 - RNA, 14 nt, Human metapneumovirus
acagaaaaagcaaa

SEQ ID NO: 4007611 - RNA, 18 nt, Human metapneumovirus
acagaauccuaagcagug

SEQ ID NO: 4007612 - RNA, 16 nt, Human metapneumovirus
acaguauuuuaaaagu

SEQ ID NO: 4007613 - RNA, 18 nt, Human metapneumovirus
acagucugugaaguaaaa

SEQ ID NO: 4007614 - RNA, 19 nt, Human metapneumovirus
acaucugcaggacaaauaa

SEQ ID NO: 4007615 - RNA, 22 nt, Human metapneumovirus
accaagacgcagacacagugac

SEQ ID NO: 4007616 - RNA, 23 nt, Human metapneumovirus
accaugucuuuugcgacacagca

SEQ ID NO: 4007617 - RNA, 20 nt, Human metapneumovirus
acccaaaugaaaaagacugu

SEQ ID NO: 4007618 - RNA, 20 nt, Human metapneumovirus
accucaaaaaaauaauuaaa

SEQ ID NO: 4007619 - RNA, 15 nt, Human metapneumovirus
acggcacgcagaacc

SEQ ID NO: 4007620 - RNA, 18 nt, Human metapneumovirus
acggucuuaaagagagcu

SEQ ID NO: 4007621 - RNA, 21 nt, Human metapneumovirus
acugaaucagacaaaaaggac

SEQ ID NO: 4007622 - RNA, 22 nt, Human metapneumovirus
acugccgagagagaaacugaaa

SEQ ID NO: 4007623 - RNA, 16 nt, Human metapneumovirus
acuguugaagcugcua

SEQ ID NO: 4007624 - RNA, 20 nt, Human metapneumovirus
agaaaucaaugcacaaauau

SEQ ID NO: 4007625 - RNA, 15 nt, Human metapneumovirus
agaacgggacaaaua

SEQ ID NO: 4007626 - RNA, 16 nt, Human metapneumovirus
agaacgggacaaauaa

SEQ ID NO: 4007627 - RNA, 21 nt, Human metapneumovirus
agacacagugacaauagacaa

SEQ ID NO: 4007628 - RNA, 18 nt, Human metapneumovirus
agaccugaccaaaagugc

SEQ ID NO: 4007629 - RNA, 14 nt, Human metapneumovirus
agauagauacuuau

SEQ ID NO: 4007630 - RNA, 19 nt, Human metapneumovirus
agcaaaagagcucaacaaa

SEQ ID NO: 4007631 - RNA, 15 nt, Human metapneumovirus
agcaccuccagagcu

SEQ ID NO: 4007632 - RNA, 21 nt, Human metapneumovirus
agcacuaaucaagugcaguga

SEQ ID NO: 4007633 - RNA, 22 nt, Human metapneumovirus
agcacuaaucaagugcagugag

SEQ ID NO: 4007634 - RNA, 15 nt, Human metapneumovirus
agcagucaaaggagu

SEQ ID NO: 4007635 - RNA, 22 nt, Human metapneumovirus
agcauauguccaggcugaaagc

SEQ ID NO: 4007636 - RNA, 18 nt, Human metapneumovirus
agcauucaucaaaucagu

SEQ ID NO: 4007637 - RNA, 17 nt, Human metapneumovirus
agcucagccaaaucagu

SEQ ID NO: 4007638 - RNA, 16 nt, Human metapneumovirus
agcugcuauaagcagu

SEQ ID NO: 4007639 - RNA, 15 nt, Human metapneumovirus
agcugggacucaagu

SEQ ID NO: 4007640 - RNA, 21 nt, Human metapneumovirus
agcuuugacccagucaaguuu

SEQ ID NO: 4007641 - RNA, 22 nt, Human metapneumovirus
aggaaucaauguugcugagcag

SEQ ID NO: 4007642 - RNA, 21 nt, Human metapneumovirus
acuguuuacuacccaaaugaa

SEQ ID NO: 4007643 - RNA, 22 nt, Human metapneumovirus
acuuaaguuaguaaaaacacau

SEQ ID NO: 4007644 - RNA, 14 nt, Human metapneumovirus
acuuuauuaaaugg

SEQ ID NO: 4007645 - RNA, 12 nt, Human metapneumovirus
agaaacugaaaa

SEQ ID NO: 4007646 - RNA, 17 nt, Human metapneumovirus
agaauuaaaucaaucaa

SEQ ID NO: 4007647 - RNA, 17 nt, Human metapneumovirus
agaauuagaccugacca

SEQ ID NO: 4007648 - RNA, 14 nt, Human metapneumovirus
agacucaaaaaugc

SEQ ID NO: 4007649 - RNA, 16 nt, Human metapneumovirus
agagagcucagaacag

SEQ ID NO: 4007650 - RNA, 16 nt, Human metapneumovirus
agagcucaacaaaauu

SEQ ID NO: 4007651 - RNA, 19 nt, Human metapneumovirus
agaggaagugagugcaagu

SEQ ID NO: 4007652 - RNA, 14 nt, Human metapneumovirus
agauaaugaagaag

SEQ ID NO: 4007653 - RNA, 18 nt, Human metapneumovirus
agaugacauuuaccaguu

SEQ ID NO: 4007654 - RNA, 22 nt, Human metapneumovirus
agcaacagaguagggaucauca

SEQ ID NO: 4007655 - RNA, 15 nt, Human metapneumovirus
agcaagaaucuaaca

SEQ ID NO: 4007656 - RNA, 16 nt, Human metapneumovirus
agcaccuccagagcug

SEQ ID NO: 4007657 - RNA, 21 nt, Human metapneumovirus
agcacucgguguugcaacugc

SEQ ID NO: 4007658 - RNA, 16 nt, Human metapneumovirus
agcagcaaaauuagca

SEQ ID NO: 4007659 - RNA, 22 nt, Human metapneumovirus
agcagcaaaauuagcagaagcu

SEQ ID NO: 4007660 - RNA, 17 nt, Human metapneumovirus
agcagcuuugacccagu

SEQ ID NO: 4007661 - RNA, 19 nt, Human metapneumovirus
agcauguuauaaaaggaag

SEQ ID NO: 4007662 - RNA, 16 nt, Human metapneumovirus
agcauucaucaaauca

SEQ ID NO: 4007663 - RNA, 17 nt, Human metapneumovirus
agcuucagucaauucaa

SEQ ID NO: 4007664 - RNA, 17 nt, Human metapneumovirus
aggaaacacuggcuuca

SEQ ID NO: 4007665 - RNA, 16 nt, Human metapneumovirus
aggagaaaaagugaau

SEQ ID NO: 4007666 - RNA, 23 nt, Human metapneumovirus
aggagcaccuccagagcugagug

SEQ ID NO: 4007667 - RNA, 12 nt, Human metapneumovirus
aggugcagcaau

SEQ ID NO: 4007668 - RNA, 22 nt, Human metapneumovirus
aguaaguuucuaugauacuuca

SEQ ID NO: 4007669 - RNA, 17 nt, Human metapneumovirus
aguccacacaaaaaaca

SEQ ID NO: 4007670 - RNA, 14 nt, Human metapneumovirus
agugagagagcuga

SEQ ID NO: 4007671 - RNA, 23 nt, Human metapneumovirus
agugaguguuuuuaucauaauaa

SEQ ID NO: 4007672 - RNA, 10 nt, Human metapneumovirus
agugcaguga

SEQ ID NO: 4007673 - RNA, 18 nt, Human metapneumovirus
aguguaaaauuaacagaa

SEQ ID NO: 4007674 - RNA, 15 nt, Human metapneumovirus
agugucaagcagcuu

SEQ ID NO: 4007675 - RNA, 17 nt, Human metapneumovirus
aguuagcauggacagau

SEQ ID NO: 4007676 - RNA, 19 nt, Human metapneumovirus
aguuggcaaaaaaacacau

SEQ ID NO: 4007677 - RNA, 22 nt, Human metapneumovirus
aguuuucgagagcauugagaac

SEQ ID NO: 4007678 - RNA, 13 nt, Human metapneumovirus
auaacaccagcaa

SEQ ID NO: 4007679 - RNA, 16 nt, Human metapneumovirus
auaagcagugaagcag

SEQ ID NO: 4007680 - RNA, 10 nt, Human metapneumovirus
auaauuaaag

SEQ ID NO: 4007681 - RNA, 19 nt, Human metapneumovirus
auagaaauuauauauguca

SEQ ID NO: 4007682 - RNA, 17 nt, Human metapneumovirus
auauaaaaaucaaguua

SEQ ID NO: 4007683 - RNA, 19 nt, Human metapneumovirus
auauaacaacauacaaauu

SEQ ID NO: 4007684 - RNA, 17 nt, Human metapneumovirus
aucaagggacaagauau

SEQ ID NO: 4007685 - RNA, 23 nt, Human metapneumovirus
aucaauagaggagaaauuaagca

SEQ ID NO: 4007686 - RNA, 21 nt, Human metapneumovirus
aucaguuucaaucaaagagag

SEQ ID NO: 4007687 - RNA, 16 nt, Human metapneumovirus
aucaucaagcaacuga

SEQ ID NO: 4007688 - RNA, 19 nt, Human metapneumovirus
aucuagaaaagaacacacc

SEQ ID NO: 4007689 - RNA, 11 nt, Human metapneumovirus
augaaaaagac

SEQ ID NO: 4007690 - RNA, 14 nt, Human metapneumovirus
augauggaagagga

SEQ ID NO: 4007691 - RNA, 22 nt, Human metapneumovirus
augcugaacuagccagagcugu

SEQ ID NO: 4007692 - RNA, 13 nt, Human metapneumovirus
auggaagaggaaa

SEQ ID NO: 4007693 - RNA, 20 nt, Human metapneumovirus
auggguaaugaagcagcaaa

SEQ ID NO: 4007694 - RNA, 14 nt, Human metapneumovirus
augguaagaagaaa

SEQ ID NO: 4007695 - RNA, 15 nt, Human metapneumovirus
augguaucaaaauuu

SEQ ID NO: 4007696 - RNA, 23 nt, Human metapneumovirus
auuaaaacaguuuuuaacaagga

SEQ ID NO: 4007697 - RNA, 23 nt, Human metapneumovirus
auuaagaaugcccucaaaaagac

SEQ ID NO: 4007698 - RNA, 20 nt, Human metapneumovirus
auuagcuuuacuaacauuuc

SEQ ID NO: 4007699 - RNA, 18 nt, Human metapneumovirus
auuauaggagaaaaagug

SEQ ID NO: 4007700 - RNA, 20 nt, Human metapneumovirus
auucaaagguauacaaacuc

SEQ ID NO: 4007701 - RNA, 22 nt, Human metapneumovirus
auucuuuucauggguaaugaag

SEQ ID NO: 4007702 - RNA, 17 nt, Human metapneumovirus
auuggcguaagagagga

SEQ ID NO: 4007703 - RNA, 14 nt, Human metapneumovirus
auuuugaaaacaag

SEQ ID NO: 4007704 - RNA, 12 nt, Human metapneumovirus
caaaaacaugua

SEQ ID NO: 4007705 - RNA, 19 nt, Human metapneumovirus
caaaacugaaauaaagcaa

SEQ ID NO: 4007706 - RNA, 21 nt, Human metapneumovirus
caaaauaugcaagacuuggag

SEQ ID NO: 4007707 - RNA, 19 nt, Human metapneumovirus
caaacuaguuaacaaaaaa

SEQ ID NO: 4007708 - RNA, 17 nt, Human metapneumovirus
caaagaaacccacagga

SEQ ID NO: 4007709 - RNA, 20 nt, Human metapneumovirus
caaauuauuuauuaaaucaa

SEQ ID NO: 4007710 - RNA, 13 nt, Human metapneumovirus
caacaaaaacaag

SEQ ID NO: 4007711 - RNA, 17 nt, Human metapneumovirus
caacacggucuuaaaga

SEQ ID NO: 4007712 - RNA, 18 nt, Human metapneumovirus
caacaucugcaggacaaa

SEQ ID NO: 4007713 - RNA, 22 nt, Human metapneumovirus
caacaugccaacaucugcagga

SEQ ID NO: 4007714 - RNA, 19 nt, Human metapneumovirus
caacucaagcccacagcau

SEQ ID NO: 4007715 - RNA, 18 nt, Human metapneumovirus
caacugcagugagagagc

SEQ ID NO: 4007716 - RNA, 18 nt, Human metapneumovirus
caacuggcaagagaggag

SEQ ID NO: 4007717 - RNA, 19 nt, Human metapneumovirus
caacuggcaagagaggagc

SEQ ID NO: 4007718 - RNA, 18 nt, Human metapneumovirus
caagaaucuaacacgugc

SEQ ID NO: 4007719 - RNA, 22 nt, Human metapneumovirus
caagaaucuaacacgugcaauc

SEQ ID NO: 4007720 - RNA, 15 nt, Human metapneumovirus
caagagcaacaaaag

SEQ ID NO: 4007721 - RNA, 16 nt, Human metapneumovirus
caagcucuaacacagg

SEQ ID NO: 4007722 - RNA, 19 nt, Human metapneumovirus
caaggaugguauugucaaa

SEQ ID NO: 4007723 - RNA, 21 nt, Human metapneumovirus
caaggcauuccuuacacagca

SEQ ID NO: 4007724 - RNA, 22 nt, Human metapneumovirus
caaggcauuccuuacacagcag

SEQ ID NO: 4007725 - RNA, 23 nt, Human metapneumovirus
caaggcauuccuuacacagcagc

SEQ ID NO: 4007726 - RNA, 17 nt, Human metapneumovirus
caaggcuccgugcaaau

SEQ ID NO: 4007727 - RNA, 17 nt, Human metapneumovirus
caaggugcagcaauguc

SEQ ID NO: 4007728 - RNA, 21 nt, Human metapneumovirus
caaguaguuauggaggugaaa

SEQ ID NO: 4007729 - RNA, 12 nt, Human metapneumovirus
caagugcaguga

SEQ ID NO: 4007730 - RNA, 18 nt, Human metapneumovirus
caaguugaucuaauagaa

SEQ ID NO: 4007731 - RNA, 14 nt, Human metapneumovirus
caauagaggagaaa

SEQ ID NO: 4007732 - RNA, 12 nt, Human metapneumovirus
caaucaaagaga

SEQ ID NO: 4007733 - RNA, 19 nt, Human metapneumovirus
caaucuauuauaggagaaa

SEQ ID NO: 4007734 - RNA, 21 nt, Human metapneumovirus
caauguuuuuacacuggaggu

SEQ ID NO: 4007735 - RNA, 16 nt, Human metapneumovirus
caauucaauguugcac

SEQ ID NO: 4007736 - RNA, 23 nt, Human metapneumovirus
caauuuaaaaaguaaaaaacaau

SEQ ID NO: 4007737 - RNA, 22 nt, Human metapneumovirus
cacaggagcaccuccagagcug

SEQ ID NO: 4007738 - RNA, 16 nt, Human metapneumovirus
caccagcagugcugcu

SEQ ID NO: 4007739 - RNA, 15 nt, Human metapneumovirus
cacucgguguugcaa

SEQ ID NO: 4007740 - RNA, 20 nt, Human metapneumovirus
cagaauccuaagcagugcag

SEQ ID NO: 4007741 - RNA, 15 nt, Human metapneumovirus
cagagaaaggaaaca

SEQ ID NO: 4007742 - RNA, 16 nt, Human metapneumovirus
cagauaaugaagaaga

SEQ ID NO: 4007743 - RNA, 18 nt, Human metapneumovirus
cagauuuaugcagaaaca

SEQ ID NO: 4007744 - RNA, 21 nt, Human metapneumovirus
cagcaagagaugggaucagag

SEQ ID NO: 4007745 - RNA, 12 nt, Human metapneumovirus
cagcagcuguuc

SEQ ID NO: 4007746 - RNA, 13 nt, Human metapneumovirus
caggagcaggcag

SEQ ID NO: 4007747 - RNA, 14 nt, Human metapneumovirus
cagguguugcaauu

SEQ ID NO: 4007748 - RNA, 20 nt, Human metapneumovirus
cagucugugaaguaaaaaca

SEQ ID NO: 4007749 - RNA, 16 nt, Human metapneumovirus
cagugcagagaaagga

SEQ ID NO: 4007750 - RNA, 16 nt, Human metapneumovirus
cauaauaaagaaaaca

SEQ ID NO: 4007751 - RNA, 14 nt, Human metapneumovirus
cauacuaacauuua

SEQ ID NO: 4007752 - RNA, 16 nt, Human metapneumovirus
cauauguccaggcuga

SEQ ID NO: 4007753 - RNA, 14 nt, Human metapneumovirus
aaaaaaacacauga

SEQ ID NO: 4007754 - RNA, 19 nt, Human metapneumovirus
aaaaagugggacaagucaa

SEQ ID NO: 4007755 - RNA, 15 nt, Human metapneumovirus
aaaaggcaacaacac

SEQ ID NO: 4007756 - RNA, 16 nt, Human metapneumovirus
aaaaguaaaaaacaau

SEQ ID NO: 4007757 - RNA, 14 nt, Human metapneumovirus
aaaauaaacaaugg

SEQ ID NO: 4007758 - RNA, 15 nt, Human metapneumovirus
aaaauuguugaagau

SEQ ID NO: 4007759 - RNA, 17 nt, Human metapneumovirus
aaacaaaccaaaaccag

SEQ ID NO: 4007760 - RNA, 20 nt, Human metapneumovirus
aaacaaugggacaaguaaaa

SEQ ID NO: 4007761 - RNA, 22 nt, Human metapneumovirus
aaacaguuuacuuaacaaccau

SEQ ID NO: 4007762 - RNA, 20 nt, Human metapneumovirus
aaacugaaaaaauuagcaaa

SEQ ID NO: 4007763 - RNA, 12 nt, Human metapneumovirus
aaauaaagcaag

SEQ ID NO: 4007764 - RNA, 14 nt, Human metapneumovirus
aaauaaagcaagca

SEQ ID NO: 4007765 - RNA, 20 nt, Human metapneumovirus
aaauaauuaaagaccacucu

SEQ ID NO: 4007766 - RNA, 18 nt, Human metapneumovirus
aaaucaguuucaaucaaa

SEQ ID NO: 4007767 - RNA, 19 nt, Human metapneumovirus
aaaugaaaaagacugugaa

SEQ ID NO: 4007768 - RNA, 18 nt, Human metapneumovirus
aaauuguugaagaugaaa

SEQ ID NO: 4007769 - RNA, 14 nt, Human metapneumovirus
aacacaccaccagc

SEQ ID NO: 4007770 - RNA, 16 nt, Human metapneumovirus
aacaguuuacuuaaca

SEQ ID NO: 4007771 - RNA, 18 nt, Human metapneumovirus
aaccaacaucaacaccag

SEQ ID NO: 4007772 - RNA, 21 nt, Human metapneumovirus
aaccauaccgucagaaccaaa

SEQ ID NO: 4007773 - RNA, 23 nt, Human metapneumovirus
aaccauccggcuugaaagugaag

SEQ ID NO: 4007774 - RNA, 22 nt, Human metapneumovirus
aacuaucugacagcaaacaugu

SEQ ID NO: 4007775 - RNA, 11 nt, Human metapneumovirus
aagaaaacaaa

SEQ ID NO: 4007776 - RNA, 15 nt, Human metapneumovirus
aagaacacaccuguu

SEQ ID NO: 4007777 - RNA, 14 nt, Human metapneumovirus
aagacacaaaaacc

SEQ ID NO: 4007778 - RNA, 18 nt, Human metapneumovirus
aagacuacucuaaaucau

SEQ ID NO: 4007779 - RNA, 13 nt, Human metapneumovirus
aagaugaaagcac

SEQ ID NO: 4007780 - RNA, 22 nt, Human metapneumovirus
aagaugaaagcacaaguggaga

SEQ ID NO: 4007781 - RNA, 23 nt, Human metapneumovirus
aagauuuugugagcaagaaucua

SEQ ID NO: 4007782 - RNA, 17 nt, Human metapneumovirus
aagcaaaauaugcaaga

SEQ ID NO: 4007783 - RNA, 22 nt, Human metapneumovirus
aagcagcaaaauuagcagaagc

SEQ ID NO: 4007784 - RNA, 17 nt, Human metapneumovirus
aagcagugaagcagacc

SEQ ID NO: 4007785 - RNA, 13 nt, Human metapneumovirus
aaggaaacacugg

SEQ ID NO: 4007786 - RNA, 18 nt, Human metapneumovirus
aaggcuccgugcaaauau

SEQ ID NO: 4007787 - RNA, 22 nt, Human metapneumovirus
aaguuagcauggacagauaaag

SEQ ID NO: 4007788 - RNA, 23 nt, Human metapneumovirus
aaguuucuaugauacuucauaau

SEQ ID NO: 4007789 - RNA, 15 nt, Human metapneumovirus
aauaaaaaugucuug

SEQ ID NO: 4007790 - RNA, 11 nt, Human metapneumovirus
aauaaaguaaa

SEQ ID NO: 4007791 - RNA, 14 nt, Human metapneumovirus
aauacucaaaguga

SEQ ID NO: 4007792 - RNA, 18 nt, Human metapneumovirus
aauagaaaaggaccuguu

SEQ ID NO: 4007793 - RNA, 21 nt, Human metapneumovirus
aauaggaaaugguaguguaaa

SEQ ID NO: 4007794 - RNA, 13 nt, Human metapneumovirus
aauauagcaaacu

SEQ ID NO: 4007795 - RNA, 15 nt, Human metapneumovirus
aaucaugauaucaca

SEQ ID NO: 4007796 - RNA, 13 nt, Human metapneumovirus
aaucccaaaggca

SEQ ID NO: 4007797 - RNA, 19 nt, Human metapneumovirus
aauuacccaugcaaaguua

SEQ ID NO: 4007798 - RNA, 19 nt, Human metapneumovirus
aauuacuuaccugagaaaa

SEQ ID NO: 4007799 - RNA, 15 nt, Human metapneumovirus
aauuauauaaaagug

SEQ ID NO: 4007800 - RNA, 24 nt, Human metapneumovirus
acaaaauuguugaagaugaaagca

SEQ ID NO: 4007801 - RNA, 11 nt, Human metapneumovirus
acaaacaaugg

SEQ ID NO: 4007802 - RNA, 15 nt, Human metapneumovirus
acaaacuaucugaca

SEQ ID NO: 4007803 - RNA, 19 nt, Human metapneumovirus
acaagaauuaaaucaauca

SEQ ID NO: 4007804 - RNA, 16 nt, Human metapneumovirus
acaaggacuuaaaaga

SEQ ID NO: 4007805 - RNA, 17 nt, Human metapneumovirus
acaagugcgacauugcu

SEQ ID NO: 4007806 - RNA, 17 nt, Human metapneumovirus
acaauagacaacacugu

SEQ ID NO: 4007807 - RNA, 19 nt, Human metapneumovirus
acaauggcuucauaccaca

SEQ ID NO: 4007808 - RNA, 14 nt, Human metapneumovirus
acacacaacaccac

SEQ ID NO: 4007809 - RNA, 15 nt, Human metapneumovirus
acacaccaccagcag

SEQ ID NO: 4007810 - RNA, 16 nt, Human metapneumovirus
acacaggccaaaauug

SEQ ID NO: 4007811 - RNA, 14 nt, Human metapneumovirus
acacaucugaauca

SEQ ID NO: 4007812 - RNA, 13 nt, Human metapneumovirus
acaccaaaaagaa

SEQ ID NO: 4007813 - RNA, 14 nt, Human metapneumovirus
acaccaaaaagaag

SEQ ID NO: 4007814 - RNA, 22 nt, Human metapneumovirus
acacgugcaaucaacaaaaaca

SEQ ID NO: 4007815 - RNA, 11 nt, Human metapneumovirus
acagaaaucaa

SEQ ID NO: 4007816 - RNA, 13 nt, Human metapneumovirus
acagcagcuguuc

SEQ ID NO: 4007817 - RNA, 21 nt, Human metapneumovirus
acagcauguuauaaaaggaag

SEQ ID NO: 4007818 - RNA, 14 nt, Human metapneumovirus
acagucuacauaau

SEQ ID NO: 4007819 - RNA, 16 nt, Human metapneumovirus
acagugacaauagaca

SEQ ID NO: 4007820 - RNA, 17 nt, Human metapneumovirus
acauaucuacuacuaau

SEQ ID NO: 4007821 - RNA, 15 nt, Human metapneumovirus
acauggugcaacugc

SEQ ID NO: 4007822 - RNA, 21 nt, Human metapneumovirus
acauuagaugucauuaaaagu

SEQ ID NO: 4007823 - RNA, 17 nt, Human metapneumovirus
acccaaaugaaaaagac

SEQ ID NO: 4007824 - RNA, 18 nt, Human metapneumovirus
acccaugcaaaguuagca

SEQ ID NO: 4007825 - RNA, 14 nt, Human metapneumovirus
accugcaaaaccaa

SEQ ID NO: 4007826 - RNA, 16 nt, Human metapneumovirus
acgcagacacagugac

SEQ ID NO: 4007827 - RNA, 13 nt, Human metapneumovirus
acuauaacugaag

SEQ ID NO: 4007828 - RNA, 16 nt, Human metapneumovirus
acucugguaaagugcu

SEQ ID NO: 4007829 - RNA, 18 nt, Human metapneumovirus
acuguaucagaaacauug

SEQ ID NO: 4007830 - RNA, 16 nt, Human metapneumovirus
aaaaugcaaaaaaaca

SEQ ID NO: 4007831 - RNA, 14 nt, Human metapneumovirus
aaaauuaacagaaa

SEQ ID NO: 4007832 - RNA, 23 nt, Human metapneumovirus
aaacucacagucugugaaguaaa

SEQ ID NO: 4007833 - RNA, 23 nt, Human metapneumovirus
aaagaccaaugaagcaguaucua

SEQ ID NO: 4007834 - RNA, 16 nt, Human metapneumovirus
aaagauuuugugagca

SEQ ID NO: 4007835 - RNA, 16 nt, Human metapneumovirus
aaaguuagcacaggaa

SEQ ID NO: 4007836 - RNA, 13 nt, Human metapneumovirus
aaaugaaaaagac

SEQ ID NO: 4007837 - RNA, 17 nt, Human metapneumovirus
aaaugauggaagaggaa

SEQ ID NO: 4007838 - RNA, 12 nt, Human metapneumovirus
aaauuaagcaug

SEQ ID NO: 4007839 - RNA, 16 nt, Human metapneumovirus
aaauuugaagucaaug

SEQ ID NO: 4007840 - RNA, 21 nt, Human metapneumovirus
aaauuugggacaaaucauaau

SEQ ID NO: 4007841 - RNA, 23 nt, Human metapneumovirus
aacaauugugauaaacugacaga

SEQ ID NO: 4007842 - RNA, 19 nt, Human metapneumovirus
aacucugcaauaaacagug

SEQ ID NO: 4007843 - RNA, 16 nt, Human metapneumovirus
aacugggcaaaacaac

SEQ ID NO: 4007844 - RNA, 16 nt, Human metapneumovirus
aagaaacugaaaccau

SEQ ID NO: 4007845 - RNA, 18 nt, Human metapneumovirus
aagaacgggacaaauaaa

SEQ ID NO: 4007846 - RNA, 16 nt, Human metapneumovirus
aagaagaugcagaauc

SEQ ID NO: 4007847 - RNA, 15 nt, Human metapneumovirus
aagacuuggagccau

SEQ ID NO: 4007848 - RNA, 22 nt, Human metapneumovirus
aagaucaauucaauguugcacu

SEQ ID NO: 4007849 - RNA, 16 nt, Human metapneumovirus
uggaaaacaaucugca

SEQ ID NO: 4007850 - RNA, 17 nt, Human metapneumovirus
uggaucccauugaagaa

SEQ ID NO: 4007851 - RNA, 13 nt, Human metapneumovirus
uggggaauggagu

SEQ ID NO: 4007852 - RNA, 12 nt, Human metapneumovirus
ugguaucaaaau

SEQ ID NO: 4007853 - RNA, 14 nt, Human metapneumovirus
ugucaaaaugcagg

SEQ ID NO: 4007854 - RNA, 16 nt, Human metapneumovirus
ugucaagcagcuuuga

SEQ ID NO: 4007855 - RNA, 17 nt, Human metapneumovirus
uguccaggcugaaagca

SEQ ID NO: 4007856 - RNA, 22 nt, Human metapneumovirus
uguugaagcugcuauaagcagu

SEQ ID NO: 4007857 - RNA, 17 nt, Human metapneumovirus
uuacuuaaguuaguaaa

SEQ ID NO: 4007858 - RNA, 21 nt, Human metapneumovirus
uuauggaucuagaaaagaaca

SEQ ID NO: 4007859 - RNA, 17 nt, Human metapneumovirus
uucaaaaagcuuggagc

SEQ ID NO: 4007860 - RNA, 15 nt, Human metapneumovirus
uugaagaugaaagca

SEQ ID NO: 4007861 - RNA, 18 nt, Human metapneumovirus
uugaagaugaaagcacaa

SEQ ID NO: 4007862 - RNA, 18 nt, Human metapneumovirus
uuuucauggguaaugaag

SEQ ID NO: 4007863 - RNA, 16 nt, Human metapneumovirus
cauauucaaaaagcuu

SEQ ID NO: 4007864 - RNA, 15 nt, Human metapneumovirus
cauuguauauacaca

SEQ ID NO: 4007865 - RNA, 12 nt, Human metapneumovirus
cauuguuaauaa

SEQ ID NO: 4007866 - RNA, 19 nt, Human metapneumovirus
ccaaacuaguuaacaaaaa

SEQ ID NO: 4007867 - RNA, 15 nt, Human metapneumovirus
ccaaaugaaaaagac

SEQ ID NO: 4007868 - RNA, 18 nt, Human metapneumovirus
ccaagcucuaacacaggc

SEQ ID NO: 4007869 - RNA, 14 nt, Human metapneumovirus
ccagucaaguuucc

SEQ ID NO: 4007870 - RNA, 18 nt, Human metapneumovirus
ccggcuugaaagugaagu

SEQ ID NO: 4007871 - RNA, 18 nt, Human metapneumovirus
ccuaaauguuaacaccag

SEQ ID NO: 4007872 - RNA, 15 nt, Human metapneumovirus
ccugaaggaaaagau

SEQ ID NO: 4007873 - RNA, 13 nt, Human metapneumovirus
ccugcaaaaccaa

SEQ ID NO: 4007874 - RNA, 14 nt, Human metapneumovirus
ccuuacacagcagc

SEQ ID NO: 4007875 - RNA, 20 nt, Human metapneumovirus
cgacauugcugaccugaaaa

SEQ ID NO: 4007876 - RNA, 15 nt, Human metapneumovirus
cuaagcagugcagag

SEQ ID NO: 4007877 - RNA, 19 nt, Human metapneumovirus
cuaagcagugcagagaaag

SEQ ID NO: 4007878 - RNA, 17 nt, Human metapneumovirus
cuaaucaagugcaguga

SEQ ID NO: 4007879 - RNA, 14 nt, Human metapneumovirus
cucagauaaugaag

SEQ ID NO: 4007880 - RNA, 17 nt, Human metapneumovirus
cucagccaaaucaguug

SEQ ID NO: 4007881 - RNA, 23 nt, Human metapneumovirus
cuccguaauuuacauggugcaac

SEQ ID NO: 4007882 - RNA, 21 nt, Human metapneumovirus
cucgguguugcaacugcagcu

SEQ ID NO: 4007883 - RNA, 16 nt, Human metapneumovirus
cucuguaugcugcauc

SEQ ID NO: 4007884 - RNA, 15 nt, Human metapneumovirus
cugcucgaucagcua

SEQ ID NO: 4007885 - RNA, 19 nt, Human metapneumovirus
cugcugaucaacuggcaag

SEQ ID NO: 4007886 - RNA, 16 nt, Human metapneumovirus
cuggauaguaaaagca

SEQ ID NO: 4007887 - RNA, 17 nt, Human metapneumovirus
cuguuaguucaacaauu

SEQ ID NO: 4007888 - RNA, 14 nt, Human metapneumovirus
cuguuuccaacaug

SEQ ID NO: 4007889 - RNA, 22 nt, Human metapneumovirus
cuugaaagugaaguaacagcaa

SEQ ID NO: 4007890 - RNA, 14 nt, Human metapneumovirus
gaaaagaaacugaa

SEQ ID NO: 4007891 - RNA, 18 nt, Human metapneumovirus
gaaagauuuugugagcaa

SEQ ID NO: 4007892 - RNA, 12 nt, Human metapneumovirus
gaaauuaagcau

SEQ ID NO: 4007893 - RNA, 16 nt, Human metapneumovirus
gaacuagccagagcug

SEQ ID NO: 4007894 - RNA, 20 nt, Human metapneumovirus
gaagagucuaccgagaagaa

SEQ ID NO: 4007895 - RNA, 14 nt, Human metapneumovirus
gaaguaacagcaau

SEQ ID NO: 4007896 - RNA, 13 nt, Human metapneumovirus
gaaucuucaaucu

SEQ ID NO: 4007897 - RNA, 16 nt, Human metapneumovirus
gaauuaaaucaaucaa

SEQ ID NO: 4007898 - RNA, 22 nt, Human metapneumovirus
gaauuagaccugaccaaaagug

SEQ ID NO: 4007899 - RNA, 16 nt, Human metapneumovirus
gacaaacucacagucu

SEQ ID NO: 4007900 - RNA, 15 nt, Human metapneumovirus
gagaaccgugcaaug

SEQ ID NO: 4007901 - RNA, 23 nt, Human metapneumovirus
gauauggacucacaaggacuuaa

SEQ ID NO: 4007902 - RNA, 19 nt, Human metapneumovirus
gaucccauugaagaagaag

SEQ ID NO: 4007903 - RNA, 16 nt, Human metapneumovirus
gaugucauuaaaagug

SEQ ID NO: 4007904 - RNA, 16 nt, Human metapneumovirus
gauguuggagaaccgu

SEQ ID NO: 4007905 - RNA, 12 nt, Human metapneumovirus
gcaaaacaacac

SEQ ID NO: 4007906 - RNA, 16 nt, Human metapneumovirus
gcaaaguuagcacagg

SEQ ID NO: 4007907 - RNA, 18 nt, Human metapneumovirus
gcaaaguuagcacaggaa

SEQ ID NO: 4007908 - RNA, 15 nt, Human metapneumovirus
gcaaccaaaacugaa

SEQ ID NO: 4007909 - RNA, 20 nt, Human metapneumovirus
gcacuaaucaagugcaguga

SEQ ID NO: 4007910 - RNA, 17 nt, Human metapneumovirus
gcagcaggaaucaaugu

SEQ ID NO: 4007911 - RNA, 15 nt, Human metapneumovirus
gcagugagagagcug

SEQ ID NO: 4007912 - RNA, 18 nt, Human metapneumovirus
gcauucaucaaaucaguu

SEQ ID NO: 4007913 - RNA, 18 nt, Human metapneumovirus
gcauuccuuacacagcag

SEQ ID NO: 4007914 - RNA, 16 nt, Human metapneumovirus
gcccaaggugcagcaa

SEQ ID NO: 4007915 - RNA, 18 nt, Human metapneumovirus
gcgaacagcauguuauaa

SEQ ID NO: 4007916 - RNA, 12 nt, Human metapneumovirus
gcggcaauuuuc

SEQ ID NO: 4007917 - RNA, 22 nt, Human metapneumovirus
gcugaucaacuggcaagagagg

SEQ ID NO: 4007918 - RNA, 23 nt, Human metapneumovirus
gcuggaaaauaaacagaaaucaa

SEQ ID NO: 4007919 - RNA, 23 nt, Human metapneumovirus
gcuugaaagugaaguaacagcaa

SEQ ID NO: 4007920 - RNA, 18 nt, Human metapneumovirus
ggaauaacaccagcaaua

SEQ ID NO: 4007921 - RNA, 21 nt, Human metapneumovirus
ggaauaacaccagcaauaucu

SEQ ID NO: 4007922 - RNA, 23 nt, Human metapneumovirus
ggagcauauguccaggcugaaag

SEQ ID NO: 4007923 - RNA, 19 nt, Human metapneumovirus
ggaucccauugaagaagaa

SEQ ID NO: 4007924 - RNA, 18 nt, Human metapneumovirus
ggcaacugcagugagaga

SEQ ID NO: 4007925 - RNA, 21 nt, Human metapneumovirus
ggcaauuuucagacaacgcug

SEQ ID NO: 4007926 - RNA, 11 nt, Human metapneumovirus
ggugcagcaau

SEQ ID NO: 4007927 - RNA, 18 nt, Human metapneumovirus
guaauaauucuaauugcu

SEQ ID NO: 4007928 - RNA, 17 nt, Human metapneumovirus
gucaaguuuccugaaga

SEQ ID NO: 4007929 - RNA, 17 nt, Human metapneumovirus
gugaagcagaccaagcu

SEQ ID NO: 4007930 - RNA, 19 nt, Human metapneumovirus
gugacaauagacaacacug

SEQ ID NO: 4007931 - RNA, 13 nt, Human metapneumovirus
gugcacuaagaga

SEQ ID NO: 4007932 - RNA, 21 nt, Human metapneumovirus
gugcagagaaaggaaacacug

SEQ ID NO: 4007933 - RNA, 14 nt, Human metapneumovirus
guggaucaaucaaa

SEQ ID NO: 4007934 - RNA, 16 nt, Human metapneumovirus
guuucaaucaaagaga

SEQ ID NO: 4007935 - RNA, 23 nt, Human metapneumovirus
guuucugcugaucaacuggcaag

SEQ ID NO: 4007936 - RNA, 12 nt, Human metapneumovirus
uaaaaaacaaua

SEQ ID NO: 4007937 - RNA, 15 nt, Human metapneumovirus
uaaaaauaaacaaug

SEQ ID NO: 4007938 - RNA, 11 nt, Human metapneumovirus
uaaaaaugucu

SEQ ID NO: 4007939 - RNA, 11 nt, Human metapneumovirus
uaaaauuaaaa

SEQ ID NO: 4007940 - RNA, 16 nt, Human metapneumovirus
uaaagggaaagcagca

SEQ ID NO: 4007941 - RNA, 22 nt, Human metapneumovirus
uaaccacucuguaugcugcauc

SEQ ID NO: 4007942 - RNA, 15 nt, Human metapneumovirus
uaaccuuugaagaaa

SEQ ID NO: 4007943 - RNA, 16 nt, Human metapneumovirus
uaagaacacucaacau

SEQ ID NO: 4007944 - RNA, 14 nt, Human metapneumovirus
uaaucaagugcagu

SEQ ID NO: 4007945 - RNA, 21 nt, Human metapneumovirus
uacagcaggacccacagcagc

SEQ ID NO: 4007946 - RNA, 16 nt, Human metapneumovirus
uacuacccaaaugaaa

SEQ ID NO: 4007947 - RNA, 22 nt, Human metapneumovirus
uacuuaacaaccaugaaaccau

SEQ ID NO: 4007948 - RNA, 17 nt, Human metapneumovirus
uagaacaagaauuaaau

SEQ ID NO: 4007949 - RNA, 20 nt, Human metapneumovirus
uagauucguucuaggagcaa

SEQ ID NO: 4007950 - RNA, 12 nt, Human metapneumovirus
uaguucaacaau

SEQ ID NO: 4007951 - RNA, 15 nt, Human metapneumovirus
uaucaggagcaggca

SEQ ID NO: 4007952 - RNA, 23 nt, Human metapneumovirus
uaugugauuggcugcaguuaaag

SEQ ID NO: 4007953 - RNA, 21 nt, Human metapneumovirus
uauuauaggagaaaaagugaa

SEQ ID NO: 4007954 - RNA, 21 nt, Human metapneumovirus
ucaaaaagcuuggagcuggga

SEQ ID NO: 4007955 - RNA, 16 nt, Human metapneumovirus
ucaaauuaaacaauga

SEQ ID NO: 4007956 - RNA, 21 nt, Human metapneumovirus
ucaagcaacugaacaaaggcu

SEQ ID NO: 4007957 - RNA, 17 nt, Human metapneumovirus
ucacaguaacaaucacc

SEQ ID NO: 4007958 - RNA, 18 nt, Human metapneumovirus
ucagcccaaggugcagca

SEQ ID NO: 4007959 - RNA, 15 nt, Human metapneumovirus
ucaguguucugagga

SEQ ID NO: 4007960 - RNA, 15 nt, Human metapneumovirus
ucaguuucaaucaaa

SEQ ID NO: 4007961 - RNA, 12 nt, Human metapneumovirus
ucaucaaaucag

SEQ ID NO: 4007962 - RNA, 18 nt, Human metapneumovirus
ucauuuacaccaaaugaa

SEQ ID NO: 4007963 - RNA, 19 nt, Human metapneumovirus
uccacacaaaaaacaaccc

SEQ ID NO: 4007964 - RNA, 19 nt, Human metapneumovirus
uccggcuugaaagugaagu

SEQ ID NO: 4007965 - RNA, 19 nt, Human metapneumovirus
uccuaaauguuaacaccag

SEQ ID NO: 4007966 - RNA, 16 nt, Human metapneumovirus
ucugaagacacaaaaa

SEQ ID NO: 4007967 - RNA, 22 nt, Human metapneumovirus
ugaaacccaauccuaaauguua

SEQ ID NO: 4007968 - RNA, 18 nt, Human metapneumovirus
ugacaauagacaacacug

SEQ ID NO: 4007969 - RNA, 12 nt, Human metapneumovirus
ugauaaacugac

SEQ ID NO: 4007970 - RNA, 14 nt, Human metapneumovirus
ugauguuggagaac

SEQ ID NO: 4007971 - RNA, 14 nt, Human metapneumovirus
ugcaauaaacagug

SEQ ID NO: 4007972 - RNA, 19 nt, Human metapneumovirus
ugcagaaaagaaacugaaa

SEQ ID NO: 4007973 - RNA, 15 nt, Human metapneumovirus
ugcaguuacagcagg

SEQ ID NO: 4007974 - RNA, 21 nt, Human metapneumovirus
ugcucucagauaaugaagaag

SEQ ID NO: 4007975 - RNA, 14 nt, Human metapneumovirus
aaaaaccaacaauu

SEQ ID NO: 4007976 - RNA, 16 nt, Human metapneumovirus
aaaaauuugaagucaa

SEQ ID NO: 4007977 - RNA, 18 nt, Human metapneumovirus
aaaagcaaaagagcucaa

SEQ ID NO: 4007978 - RNA, 16 nt, Human metapneumovirus
aaaaguggaaaacaau

SEQ ID NO: 4007979 - RNA, 18 nt, Human metapneumovirus
aaaaguggaaaacaaucu

SEQ ID NO: 4007980 - RNA, 20 nt, Human metapneumovirus
aaaauauuuugaaaacaagu

SEQ ID NO: 4007981 - RNA, 17 nt, Human metapneumovirus
aaaaucaaguuagaaca

SEQ ID NO: 4007982 - RNA, 14 nt, Human metapneumovirus
aaaauuugugagcu

SEQ ID NO: 4007983 - RNA, 13 nt, Human metapneumovirus
aaaccagcaguug

SEQ ID NO: 4007984 - RNA, 19 nt, Human metapneumovirus
aaacccugacaauaaccac

SEQ ID NO: 4007985 - RNA, 20 nt, Human metapneumovirus
aaagcaagcaaucaaaguca

SEQ ID NO: 4007986 - RNA, 14 nt, Human metapneumovirus
aaaggcaacaacac

SEQ ID NO: 4007987 - RNA, 13 nt, Human metapneumovirus
aaaguaaaaaaca

SEQ ID NO: 4007988 - RNA, 20 nt, Human metapneumovirus
aaaguuggaaaaagaugcuc

SEQ ID NO: 4007989 - RNA, 20 nt, Human metapneumovirus
aaauauaacaacauacaaau

SEQ ID NO: 4007990 - RNA, 20 nt, Human metapneumovirus
aaaucaguuggcaaaaaaac

SEQ ID NO: 4007991 - RNA, 13 nt, Human metapneumovirus
aaaucccagacaa

SEQ ID NO: 4007992 - RNA, 17 nt, Human metapneumovirus
aacaaccaugaaaccau

SEQ ID NO: 4007993 - RNA, 12 nt, Human metapneumovirus
aacaagaggaga

SEQ ID NO: 4007994 - RNA, 18 nt, Human metapneumovirus
aacacaccaccagcagug

SEQ ID NO: 4007995 - RNA, 17 nt, Human metapneumovirus
aacagaaaaagcaaaag

SEQ ID NO: 4007996 - RNA, 21 nt, Human metapneumovirus
aacaucugcaggacaaauaaa

SEQ ID NO: 4007997 - RNA, 21 nt, Human metapneumovirus
aaccaccccaagaaaaaaacu

SEQ ID NO: 4007998 - RNA, 13 nt, Human metapneumovirus
aaccuuugaagaa

SEQ ID NO: 4007999 - RNA, 18 nt, Human metapneumovirus
aacuauucaauuuaaaaa

SEQ ID NO: 4008000 - RNA, 11 nt, Human metapneumovirus
aacugaacaaa

SEQ ID NO: 4008001 - RNA, 13 nt, Human metapneumovirus
aacugcagugaga

SEQ ID NO: 4008002 - RNA, 15 nt, Human metapneumovirus
aacugccaaucuuug

SEQ ID NO: 4008003 - RNA, 17 nt, Human metapneumovirus
aacuggaauuugacaaa

SEQ ID NO: 4008004 - RNA, 23 nt, Human metapneumovirus
aagaaaaaaacugggcaaaacaa

SEQ ID NO: 4008005 - RNA, 23 nt, Human metapneumovirus
aagagaggaauuaauagcagaca

SEQ ID NO: 4008006 - RNA, 17 nt, Human metapneumovirus
aagcaccuuggccaaga

SEQ ID NO: 4008007 - RNA, 23 nt, Human metapneumovirus
aagccuaacaauaugguucccuu

SEQ ID NO: 4008008 - RNA, 19 nt, Human metapneumovirus
aagcuaaagggaaagcagc

SEQ ID NO: 4008009 - RNA, 16 nt, Human metapneumovirus
aagcuuuccagaaauc

SEQ ID NO: 4008010 - RNA, 22 nt, Human metapneumovirus
aaggaaggccagugucaagcag

SEQ ID NO: 4008011 - RNA, 16 nt, Human metapneumovirus
aaggcaacaacaccau

SEQ ID NO: 4008012 - RNA, 21 nt, Human metapneumovirus
aaggccagugucaagcagcuu

SEQ ID NO: 4008013 - RNA, 17 nt, Human metapneumovirus
aaggcgaacagcauguu

SEQ ID NO: 4008014 - RNA, 18 nt, Human metapneumovirus
aauaaaguaaauuaaaau

SEQ ID NO: 4008015 - RNA, 22 nt, Human metapneumovirus
aauaccagcauucaucaaauca

SEQ ID NO: 4008016 - RNA, 20 nt, Human metapneumovirus
aauacucaaagugaaugcau

SEQ ID NO: 4008017 - RNA, 15 nt, Human metapneumovirus
aauagacaacacugu

SEQ ID NO: 4008018 - RNA, 13 nt, Human metapneumovirus
aauaggaaauggu

SEQ ID NO: 4008019 - RNA, 19 nt, Human metapneumovirus
aauauuuugaaaacaagua

SEQ ID NO: 4008020 - RNA, 16 nt, Human metapneumovirus
aaucaacaaaaacaag

SEQ ID NO: 4008021 - RNA, 21 nt, Human metapneumovirus
aauccuaaauguuaacaccag

SEQ ID NO: 4008022 - RNA, 13 nt, Human metapneumovirus
aaugaagaagaag

SEQ ID NO: 4008023 - RNA, 22 nt, Human metapneumovirus
aaugagucaacgaucaaaaaua

SEQ ID NO: 4008024 - RNA, 18 nt, Human metapneumovirus
aaugauggaagaggaaau

SEQ ID NO: 4008025 - RNA, 15 nt, Human metapneumovirus
aauuaaaauuaaaaa

SEQ ID NO: 4008026 - RNA, 23 nt, Human metapneumovirus
aauuauacuauauauuuagaaua

SEQ ID NO: 4008027 - RNA, 15 nt, Human metapneumovirus
aauugccaaaaccau

SEQ ID NO: 4008028 - RNA, 16 nt, Human metapneumovirus
aauuguuauuuagaaa

SEQ ID NO: 4008029 - RNA, 13 nt, Human metapneumovirus
acaauaccagcau

SEQ ID NO: 4008030 - RNA, 17 nt, Human metapneumovirus
acacaccaccagcagug

SEQ ID NO: 4008031 - RNA, 12 nt, Human metapneumovirus
acacagcagcug

SEQ ID NO: 4008032 - RNA, 21 nt, Human metapneumovirus
acaccuaucaaggcauuccuu

SEQ ID NO: 4008033 - RNA, 17 nt, Human metapneumovirus
acagaauccuaagcagu

SEQ ID NO: 4008034 - RNA, 17 nt, Human metapneumovirus
acagcaauuaagaaugc

SEQ ID NO: 4008035 - RNA, 17 nt, Human metapneumovirus
acagcaggacccacagc

SEQ ID NO: 4008036 - RNA, 17 nt, Human metapneumovirus
acagcauccaacucaac

SEQ ID NO: 4008037 - RNA, 13 nt, Human metapneumovirus
acaggccaaaauu

SEQ ID NO: 4008038 - RNA, 13 nt, Human metapneumovirus
accaaaacugaaa

SEQ ID NO: 4008039 - RNA, 23 nt, Human metapneumovirus
accaacaauugugauaaacugac

SEQ ID NO: 4008040 - RNA, 21 nt, Human metapneumovirus
accaaugaagcaguaucuaca

SEQ ID NO: 4008041 - RNA, 22 nt, Human metapneumovirus
accacauaauuaguuaauuaaa

SEQ ID NO: 4008042 - RNA, 14 nt, Human metapneumovirus
accaccagcagugc

SEQ ID NO: 4008043 - RNA, 13 nt, Human metapneumovirus
accuuugaagaaa

SEQ ID NO: 4008044 - RNA, 17 nt, Human metapneumovirus
acuaacaccaaaaagaa

SEQ ID NO: 4008045 - RNA, 22 nt, Human metapneumovirus
acuaugcuugccucuuaagaga

SEQ ID NO: 4008046 - RNA, 15 nt, Human metapneumovirus
acucaagcccacagc

SEQ ID NO: 4008047 - RNA, 20 nt, Human metapneumovirus
acuccaacgguccccacaga

SEQ ID NO: 4008048 - RNA, 20 nt, Human metapneumovirus
acucuaaaucaugauaucac

SEQ ID NO: 4008049 - RNA, 16 nt, Human metapneumovirus
acugaaauaaagcaag

SEQ ID NO: 4008050 - RNA, 15 nt, Human metapneumovirus
acuguauaccagcua

SEQ ID NO: 4008051 - RNA, 23 nt, Human metapneumovirus
acuuauuaauaagaucaaauuau

SEQ ID NO: 4008052 - RNA, 16 nt, Human metapneumovirus
acuucccaaaaaauuu

SEQ ID NO: 4008053 - RNA, 16 nt, Human metapneumovirus
agaaaauaaaaaaucg

SEQ ID NO: 4008054 - RNA, 15 nt, Human metapneumovirus
agaaacccacaggag

SEQ ID NO: 4008055 - RNA, 16 nt, Human metapneumovirus
agaaccuuacaugugc

SEQ ID NO: 4008056 - RNA, 14 nt, Human metapneumovirus
agaacuaggagcau

SEQ ID NO: 4008057 - RNA, 17 nt, Human metapneumovirus
agaauccuaagcagugc

SEQ ID NO: 4008058 - RNA, 16 nt, Human metapneumovirus
agacaaauaacaaugg

SEQ ID NO: 4008059 - RNA, 15 nt, Human metapneumovirus
agagagaaacugaaa

SEQ ID NO: 4008060 - RNA, 15 nt, Human metapneumovirus
agagagcuacuuaga

SEQ ID NO: 4008061 - RNA, 11 nt, Human metapneumovirus
agagagcucag

SEQ ID NO: 4008062 - RNA, 13 nt, Human metapneumovirus
agagagcugaaag

SEQ ID NO: 4008063 - RNA, 14 nt, Human metapneumovirus
agagagcugaaaga

SEQ ID NO: 4008064 - RNA, 23 nt, Human metapneumovirus
agauuuaugcagaaacaaaccaa

SEQ ID NO: 4008065 - RNA, 20 nt, Human metapneumovirus
agcagacauaauaaaggaag

SEQ ID NO: 4008066 - RNA, 13 nt, Human metapneumovirus
agcagcaaaauua

SEQ ID NO: 4008067 - RNA, 15 nt, Human metapneumovirus
agcagcagaaaugau

SEQ ID NO: 4008068 - RNA, 17 nt, Human metapneumovirus
agcagcuguucaaguug

SEQ ID NO: 4008069 - RNA, 21 nt, Human metapneumovirus
agcaggacccacagcagcaag

SEQ ID NO: 4008070 - RNA, 15 nt, Human metapneumovirus
agcaggugcugaaaa

SEQ ID NO: 4008071 - RNA, 14 nt, Human metapneumovirus
agcagugaagcaga

SEQ ID NO: 4008072 - RNA, 16 nt, Human metapneumovirus
agcagugcagagaaag

SEQ ID NO: 4008073 - RNA, 15 nt, Human metapneumovirus
agcucaacaaaauug

SEQ ID NO: 4008074 - RNA, 19 nt, Human metapneumovirus
aggaacacugauagagcug

SEQ ID NO: 4008075 - RNA, 17 nt, Human metapneumovirus
aggagcaccuccagagc

SEQ ID NO: 4008076 - RNA, 22 nt, Human metapneumovirus
aggagcaccuccagagcugagu

SEQ ID NO: 4008077 - RNA, 23 nt, Human metapneumovirus
aggcauuccuuacacagcagcug

SEQ ID NO: 4008078 - RNA, 20 nt, Human metapneumovirus
aggccagugucaagcagcuu

SEQ ID NO: 4008079 - RNA, 13 nt, Human metapneumovirus
aguaaaaaacaau

SEQ ID NO: 4008080 - RNA, 15 nt, Human metapneumovirus
agucaaaaacugaau

SEQ ID NO: 4008081 - RNA, 19 nt, Human metapneumovirus
agucaaugcgacuguagca

SEQ ID NO: 4008082 - RNA, 22 nt, Human metapneumovirus
agucagcuacuguugaagcugc

SEQ ID NO: 4008083 - RNA, 19 nt, Human metapneumovirus
aguccacacaaaaaacaac

SEQ ID NO: 4008084 - RNA, 20 nt, Human metapneumovirus
aguccuaccuaguagacacc

SEQ ID NO: 4008085 - RNA, 18 nt, Human metapneumovirus
agugaaguaacagcaauu

SEQ ID NO: 4008086 - RNA, 18 nt, Human metapneumovirus
agugaagucucauacuaa

SEQ ID NO: 4008087 - RNA, 19 nt, Human metapneumovirus
agugcacuaagagagcuca

SEQ ID NO: 4008088 - RNA, 21 nt, Human metapneumovirus
aguucguguguuggcaacugc

SEQ ID NO: 4008089 - RNA, 14 nt, Human metapneumovirus
aguuggaaaaagau

SEQ ID NO: 4008090 - RNA, 17 nt, Human metapneumovirus
auaaaaauaaacaaugg

SEQ ID NO: 4008091 - RNA, 14 nt, Human metapneumovirus
auaaaugacaauga

SEQ ID NO: 4008092 - RNA, 15 nt, Human metapneumovirus
auaaaugacaaugau

SEQ ID NO: 4008093 - RNA, 11 nt, Human metapneumovirus
auaaauuaaaa

SEQ ID NO: 4008094 - RNA, 15 nt, Human metapneumovirus
auaacaccagcaaua

SEQ ID NO: 4008095 - RNA, 18 nt, Human metapneumovirus
auauuagcuuuacuaaca

SEQ ID NO: 4008096 - RNA, 22 nt, Human metapneumovirus
aucaacuaacaccaaaaagaag

SEQ ID NO: 4008097 - RNA, 15 nt, Human metapneumovirus
aucaaucaaacagaa

SEQ ID NO: 4008098 - RNA, 19 nt, Human metapneumovirus
aucaauguugcugagcagu

SEQ ID NO: 4008099 - RNA, 18 nt, Human metapneumovirus
aucaugacuaugaacaau

SEQ ID NO: 4008100 - RNA, 14 nt, Human metapneumovirus
aucuacuacuaauu

SEQ ID NO: 4008101 - RNA, 16 nt, Human metapneumovirus
aucucaagagacugcc

SEQ ID NO: 4008102 - RNA, 16 nt, Human metapneumovirus
aucugcaggacaaaua

SEQ ID NO: 4008103 - RNA, 21 nt, Human metapneumovirus
augaagaagaagaugcagaau

SEQ ID NO: 4008104 - RNA, 16 nt, Human metapneumovirus
augcacaaauauaaca

SEQ ID NO: 4008105 - RNA, 18 nt, Human metapneumovirus
auggaucccauugaagaa

SEQ ID NO: 4008106 - RNA, 20 nt, Human metapneumovirus
auggaucuagaaaagaacac

SEQ ID NO: 4008107 - RNA, 14 nt, Human metapneumovirus
augggacaaguaaa

SEQ ID NO: 4008108 - RNA, 19 nt, Human metapneumovirus
auguugcacuugaccaagu

SEQ ID NO: 4008109 - RNA, 12 nt, Human metapneumovirus
auuaaaagugau

SEQ ID NO: 4008110 - RNA, 18 nt, Human metapneumovirus
auuaaacaaugaaaucac

SEQ ID NO: 4008111 - RNA, 18 nt, Human metapneumovirus
auuaaucaauaaaaacuu

SEQ ID NO: 4008112 - RNA, 17 nt, Human metapneumovirus
auuccuuacacagcagc

SEQ ID NO: 4008113 - RNA, 20 nt, Human metapneumovirus
auugaaaaucccagacaauc

SEQ ID NO: 4008114 - RNA, 17 nt, Human metapneumovirus
auugaugauaaccaaag

SEQ ID NO: 4008115 - RNA, 12 nt, Human metapneumovirus
auuguugaagau

SEQ ID NO: 4008116 - RNA, 17 nt, Human metapneumovirus
auuuacaccaaaugaac

SEQ ID NO: 4008117 - RNA, 13 nt, Human metapneumovirus
caaaaacaagugc

SEQ ID NO: 4008118 - RNA, 23 nt, Human metapneumovirus
caaaaugucauucccugaaggaa

SEQ ID NO: 4008119 - RNA, 19 nt, Human metapneumovirus
caaacuggaauuugacaaa

SEQ ID NO: 4008120 - RNA, 16 nt, Human metapneumovirus
caaaguuagcacagga

SEQ ID NO: 4008121 - RNA, 20 nt, Human metapneumovirus
caaauaaaaaugucuuggaa

SEQ ID NO: 4008122 - RNA, 12 nt, Human metapneumovirus
caacaacaaaag

SEQ ID NO: 4008123 - RNA, 14 nt, Human metapneumovirus
caacugaacaaagg

SEQ ID NO: 4008124 - RNA, 17 nt, Human metapneumovirus
caacuggcaagagagga

SEQ ID NO: 4008125 - RNA, 16 nt, Human metapneumovirus
caaguuagaacaagaa

SEQ ID NO: 4008126 - RNA, 18 nt, Human metapneumovirus
caaguuuucgagagcauu

SEQ ID NO: 4008127 - RNA, 13 nt, Human metapneumovirus
caaucaaacagaa

SEQ ID NO: 4008128 - RNA, 21 nt, Human metapneumovirus
caaucuuaaccuuugaagaaa

SEQ ID NO: 4008129 - RNA, 14 nt, Human metapneumovirus
caaugauaacauua

SEQ ID NO: 4008130 - RNA, 13 nt, Human metapneumovirus
caauuaacaaaau

SEQ ID NO: 4008131 - RNA, 13 nt, Human metapneumovirus
caauucaacagaa

SEQ ID NO: 4008132 - RNA, 15 nt, Human metapneumovirus
caauucaacagaagg

SEQ ID NO: 4008133 - RNA, 16 nt, Human metapneumovirus
cacaaaaaacaaccca

SEQ ID NO: 4008134 - RNA, 14 nt, Human metapneumovirus
cacaaauauaacaa

SEQ ID NO: 4008135 - RNA, 23 nt, Human metapneumovirus
cacaugcuggaaaauaaacagaa

SEQ ID NO: 4008136 - RNA, 17 nt, Human metapneumovirus
caccagcagugcugcuc

SEQ ID NO: 4008137 - RNA, 16 nt, Human metapneumovirus
caccuaucaaggcauu

SEQ ID NO: 4008138 - RNA, 14 nt, Human metapneumovirus
caccuccagagcug

SEQ ID NO: 4008139 - RNA, 21 nt, Human metapneumovirus
cacgugcaaucaacaaaaaca

SEQ ID NO: 4008140 - RNA, 13 nt, Human metapneumovirus
cagaaacaaacca

SEQ ID NO: 4008141 - RNA, 19 nt, Human metapneumovirus
cagaaaugauggaagagga

SEQ ID NO: 4008142 - RNA, 16 nt, Human metapneumovirus
cagacacagugacaau

SEQ ID NO: 4008143 - RNA, 20 nt, Human metapneumovirus
cagcccaaggugcagcaaug

SEQ ID NO: 4008144 - RNA, 15 nt, Human metapneumovirus
caggacccacagcag

SEQ ID NO: 4008145 - RNA, 14 nt, Human metapneumovirus
caguguucugagga

SEQ ID NO: 4008146 - RNA, 17 nt, Human metapneumovirus
cauaacaaaagcugcag

SEQ ID NO: 4008147 - RNA, 18 nt, Human metapneumovirus
cauauucaaaaagcuugg

SEQ ID NO: 4008148 - RNA, 14 nt, Human metapneumovirus
cauugaagaagaag

SEQ ID NO: 4008149 - RNA, 17 nt, Human metapneumovirus
ccaaagcauaacaaaag

SEQ ID NO: 4008150 - RNA, 16 nt, Human metapneumovirus
ccaacaucaacaccag

SEQ ID NO: 4008151 - RNA, 19 nt, Human metapneumovirus
ccaacaucugcaggacaaa

SEQ ID NO: 4008152 - RNA, 17 nt, Human metapneumovirus
ccaagacgcagacacag

SEQ ID NO: 4008153 - RNA, 13 nt, Human metapneumovirus
ccaccagcagugc

SEQ ID NO: 4008154 - RNA, 17 nt, Human metapneumovirus
ccagcagugcugcucga

SEQ ID NO: 4008155 - RNA, 16 nt, Human metapneumovirus
ccauggaauccagcag

SEQ ID NO: 4008156 - RNA, 23 nt, Human metapneumovirus
ccaugucuuuugcgacacagcag

SEQ ID NO: 4008157 - RNA, 11 nt, Human metapneumovirus
cccaauccuaa

SEQ ID NO: 4008158 - RNA, 21 nt, Human metapneumovirus
cccacaaacaucugcaagcac

SEQ ID NO: 4008159 - RNA, 11 nt, Human metapneumovirus
cccugcagaaa

SEQ ID NO: 4008160 - RNA, 17 nt, Human metapneumovirus
ccuaagcagugcagaga

SEQ ID NO: 4008161 - RNA, 16 nt, Human metapneumovirus
ccucaaaaagaccaau

SEQ ID NO: 4008162 - RNA, 13 nt, Human metapneumovirus
ccugcagaaaaga

SEQ ID NO: 4008163 - RNA, 14 nt, Human metapneumovirus
ccugcagaaaagaa

SEQ ID NO: 4008164 - RNA, 14 nt, Human metapneumovirus
ccuuggccaagagc

SEQ ID NO: 4008165 - RNA, 11 nt, Human metapneumovirus
cgugcaauggu

SEQ ID NO: 4008166 - RNA, 17 nt, Human metapneumovirus
cguguguuggcaacugc

SEQ ID NO: 4008167 - RNA, 14 nt, Human metapneumovirus
cuaagcagugcaga

SEQ ID NO: 4008168 - RNA, 17 nt, Human metapneumovirus
cuacauaauauaaucaa

SEQ ID NO: 4008169 - RNA, 22 nt, Human metapneumovirus
cuacauaauauaaucaaacaac

SEQ ID NO: 4008170 - RNA, 17 nt, Human metapneumovirus
cuagagauaacaaacua

SEQ ID NO: 4008171 - RNA, 19 nt, Human metapneumovirus
cuaggagcauauguccagg

SEQ ID NO: 4008172 - RNA, 20 nt, Human metapneumovirus
cuaucaguagaccugcaaaa

SEQ ID NO: 4008173 - RNA, 21 nt, Human metapneumovirus
cuaugaacaaucccaaaggca

SEQ ID NO: 4008174 - RNA, 14 nt, Human metapneumovirus
cucaaaaagaccaa

SEQ ID NO: 4008175 - RNA, 19 nt, Human metapneumovirus
cucaguguucugaggacag

SEQ ID NO: 4008176 - RNA, 19 nt, Human metapneumovirus
cucgguguugcaacugcag

SEQ ID NO: 4008177 - RNA, 22 nt, Human metapneumovirus
cucucagauaaugaagaagaag

SEQ ID NO: 4008178 - RNA, 13 nt, Human metapneumovirus
cugaaaaaaccaa

SEQ ID NO: 4008179 - RNA, 13 nt, Human metapneumovirus
cugaccaaaagug

SEQ ID NO: 4008180 - RNA, 22 nt, Human metapneumovirus
cugaucaauuaacaaaauuaaa

SEQ ID NO: 4008181 - RNA, 21 nt, Human metapneumovirus
cugcaucuuuaaucaacaauc

SEQ ID NO: 4008182 - RNA, 17 nt, Human metapneumovirus
cuggaaaauaaacagaa

SEQ ID NO: 4008183 - RNA, 14 nt, Human metapneumovirus
cugggacucaaguc

SEQ ID NO: 4008184 - RNA, 21 nt, Human metapneumovirus
cugugaaacaagaggagacca

SEQ ID NO: 4008185 - RNA, 21 nt, Human metapneumovirus
cuguugaagcugcuauaagca

SEQ ID NO: 4008186 - RNA, 18 nt, Human metapneumovirus
cuuaauaaaaacagaauu

SEQ ID NO: 4008187 - RNA, 16 nt, Human metapneumovirus
cuuacacagcagcugu

SEQ ID NO: 4008188 - RNA, 20 nt, Human metapneumovirus
cuuacacagcagcuguucaa

SEQ ID NO: 4008189 - RNA, 14 nt, Human metapneumovirus
cuugaaguccagau

SEQ ID NO: 4008190 - RNA, 15 nt, Human metapneumovirus
cuuugggguuauaga

SEQ ID NO: 4008191 - RNA, 15 nt, Human metapneumovirus
cuuuguuucaggcca

SEQ ID NO: 4008192 - RNA, 21 nt, Human metapneumovirus
cuuuugcgacacagcagcagg

SEQ ID NO: 4008193 - RNA, 16 nt, Human metapneumovirus
gaaagugaaguaacag

SEQ ID NO: 4008194 - RNA, 16 nt, Human metapneumovirus
gaagaagaugcagaau

SEQ ID NO: 4008195 - RNA, 20 nt, Human metapneumovirus
gaagcuuuccagaaaucauu

SEQ ID NO: 4008196 - RNA, 20 nt, Human metapneumovirus
gaaggccagugucaagcagc

SEQ ID NO: 4008197 - RNA, 16 nt, Human metapneumovirus
gaauaacaccagcaau

SEQ ID NO: 4008198 - RNA, 17 nt, Human metapneumovirus
gaauaacaccagcaaua

SEQ ID NO: 4008199 - RNA, 15 nt, Human metapneumovirus
gaauccgaagaagaa

SEQ ID NO: 4008200 - RNA, 19 nt, Human metapneumovirus
gacacaaaaaccaacaauu

SEQ ID NO: 4008201 - RNA, 22 nt, Human metapneumovirus
gacagugaaagcacuaaucaag

SEQ ID NO: 4008202 - RNA, 16 nt, Human metapneumovirus
gacauaauaaaggaag

SEQ ID NO: 4008203 - RNA, 14 nt, Human metapneumovirus
gagaccaugucuuu

SEQ ID NO: 4008204 - RNA, 13 nt, Human metapneumovirus
gagagaaacugaa

SEQ ID NO: 4008205 - RNA, 17 nt, Human metapneumovirus
gagcaccuccagagcug

SEQ ID NO: 4008206 - RNA, 17 nt, Human metapneumovirus
gagcauauguccaggcu

SEQ ID NO: 4008207 - RNA, 14 nt, Human metapneumovirus
gagcucagaacagu

SEQ ID NO: 4008208 - RNA, 21 nt, Human metapneumovirus
gauacuuauuaauaagaucaa

SEQ ID NO: 4008209 - RNA, 15 nt, Human metapneumovirus
gauauggacucacaa

SEQ ID NO: 4008210 - RNA, 17 nt, Human metapneumovirus
gaucaauuaacaaaauu

SEQ ID NO: 4008211 - RNA, 17 nt, Human metapneumovirus
gauggcccaaaauuaaa

SEQ ID NO: 4008212 - RNA, 23 nt, Human metapneumovirus
gcaacugcagcugcaguuacagc

SEQ ID NO: 4008213 - RNA, 23 nt, Human metapneumovirus
gcaagaaucuaacacgugcaauc

SEQ ID NO: 4008214 - RNA, 22 nt, Human metapneumovirus
gccaacacaccaccagcagugc

SEQ ID NO: 4008215 - RNA, 13 nt, Human metapneumovirus
gccagagcuguuu

SEQ ID NO: 4008216 - RNA, 20 nt, Human metapneumovirus
ggaagcuaaagggaaagcag

SEQ ID NO: 4008217 - RNA, 16 nt, Human metapneumovirus
ggaauaacaccagcaa

SEQ ID NO: 4008218 - RNA, 18 nt, Human metapneumovirus
ggagaauccgaagaagaa

SEQ ID NO: 4008219 - RNA, 17 nt, Human metapneumovirus
ggaucccauugaagaag

SEQ ID NO: 4008220 - RNA, 16 nt, Human metapneumovirus
ggcaacugcagugaga

SEQ ID NO: 4008221 - RNA, 18 nt, Human metapneumovirus
ggcauuccuuacacagca

SEQ ID NO: 4008222 - RNA, 16 nt, Human metapneumovirus
gggcuauuaagaacac

SEQ ID NO: 4008223 - RNA, 13 nt, Human metapneumovirus
ggguaaugaagca

SEQ ID NO: 4008224 - RNA, 23 nt, Human metapneumovirus
gguaucaaaauuugugagcucag

SEQ ID NO: 4008225 - RNA, 12 nt, Human metapneumovirus
ggugcagcaaug

SEQ ID NO: 4008226 - RNA, 10 nt, Human metapneumovirus
guaaauuaaa

SEQ ID NO: 4008227 - RNA, 13 nt, Human metapneumovirus
gucaaaaacugaa

SEQ ID NO: 4008228 - RNA, 21 nt, Human metapneumovirus
gucaaguuuccugaagaucaa

SEQ ID NO: 4008229 - RNA, 15 nt, Human metapneumovirus
gucccugaaaaaacc

SEQ ID NO: 4008230 - RNA, 16 nt, Human metapneumovirus
gucuuaaagagagcua

SEQ ID NO: 4008231 - RNA, 15 nt, Human metapneumovirus
gugggacaagucaaa

SEQ ID NO: 4008232 - RNA, 19 nt, Human metapneumovirus
guguuggcaacugcaguga

SEQ ID NO: 4008233 - RNA, 11 nt, Human metapneumovirus
guuagcacagg

SEQ ID NO: 4008234 - RNA, 15 nt, Human metapneumovirus
guuagcacaggaaga

SEQ ID NO: 4008235 - RNA, 12 nt, Human metapneumovirus
guuauagacacg

SEQ ID NO: 4008236 - RNA, 19 nt, Human metapneumovirus
guugaaggcgaacagcaug

SEQ ID NO: 4008237 - RNA, 17 nt, Human metapneumovirus
guugcaacugcagcugc

SEQ ID NO: 4008238 - RNA, 13 nt, Human metapneumovirus
guuggcaacugca

SEQ ID NO: 4008239 - RNA, 16 nt, Human metapneumovirus
uaaaaauaaaaauuug

SEQ ID NO: 4008240 - RNA, 19 nt, Human metapneumovirus
uaaagggaaagcagcagaa

SEQ ID NO: 4008241 - RNA, 15 nt, Human metapneumovirus
uaaaguaaauuaaaa

SEQ ID NO: 4008242 - RNA, 17 nt, Human metapneumovirus
uaacaaccaugaaacca

SEQ ID NO: 4008243 - RNA, 13 nt, Human metapneumovirus
uaagaaaaccagg

SEQ ID NO: 4008244 - RNA, 13 nt, Human metapneumovirus
uaagcagugcaga

SEQ ID NO: 4008245 - RNA, 21 nt, Human metapneumovirus
uagaaugccauuguauauaca

SEQ ID NO: 4008246 - RNA, 16 nt, Human metapneumovirus
uagaggagaaauuaag

SEQ ID NO: 4008247 - RNA, 13 nt, Human metapneumovirus
uaguuaauuaaaa

SEQ ID NO: 4008248 - RNA, 21 nt, Human metapneumovirus
uaucaaggcauuccuuacaca

SEQ ID NO: 4008249 - RNA, 17 nt, Human metapneumovirus
uaucugacagcaaacau

SEQ ID NO: 4008250 - RNA, 23 nt, Human metapneumovirus
ucaaaggagugcaacauaaacau

SEQ ID NO: 4008251 - RNA, 21 nt, Human metapneumovirus
ucaagagacugccgagagaga

SEQ ID NO: 4008252 - RNA, 22 nt, Human metapneumovirus
ucaaucuuaaccuuugaagaaa

SEQ ID NO: 4008253 - RNA, 18 nt, Human metapneumovirus
ucagacaacgcuggaaua

SEQ ID NO: 4008254 - RNA, 17 nt, Human metapneumovirus
ucaggccaacacaccac

SEQ ID NO: 4008255 - RNA, 18 nt, Human metapneumovirus
ucauaauaaagaaaacaa

SEQ ID NO: 4008256 - RNA, 16 nt, Human metapneumovirus
ucaucaagcaacugaa

SEQ ID NO: 4008257 - RNA, 16 nt, Human metapneumovirus
uccagauaacaaccaa

SEQ ID NO: 4008258 - RNA, 22 nt, Human metapneumovirus
uccccaaaaaggcaacaacacc

SEQ ID NO: 4008259 - RNA, 15 nt, Human metapneumovirus
uccuuacacagcagc

SEQ ID NO: 4008260 - RNA, 22 nt, Human metapneumovirus
ucuacauaauauaaucaaacaa

SEQ ID NO: 4008261 - RNA, 15 nt, Human metapneumovirus
ucucagauaaugaag

SEQ ID NO: 4008262 - RNA, 15 nt, Human metapneumovirus
ugaaaaagacuguga

SEQ ID NO: 4008263 - RNA, 15 nt, Human metapneumovirus
ugaagcagaccaagc

SEQ ID NO: 4008264 - RNA, 11 nt, Human metapneumovirus
ugaagcagcaa

SEQ ID NO: 4008265 - RNA, 18 nt, Human metapneumovirus
ugaauauagcaaacugga

SEQ ID NO: 4008266 - RNA, 21 nt, Human metapneumovirus
ugacaaacucacagucuguga

SEQ ID NO: 4008267 - RNA, 13 nt, Human metapneumovirus
ugacagaugcuga

SEQ ID NO: 4008268 - RNA, 16 nt, Human metapneumovirus
ugaccaaaagugcacu

SEQ ID NO: 4008269 - RNA, 20 nt, Human metapneumovirus
ugaccaaguuuucgagagca

SEQ ID NO: 4008270 - RNA, 14 nt, Human metapneumovirus
ugacuaugaacaau

SEQ ID NO: 4008271 - RNA, 18 nt, Human metapneumovirus
ugagcucagccaaaucag

SEQ ID NO: 4008272 - RNA, 20 nt, Human metapneumovirus
ugauggaagaggaaaugagu

SEQ ID NO: 4008273 - RNA, 17 nt, Human metapneumovirus
ugaugggauagugaagu

SEQ ID NO: 4008274 - RNA, 20 nt, Human metapneumovirus
ugaugggucuucaaaaacau

SEQ ID NO: 4008275 - RNA, 15 nt, Human metapneumovirus
ugcaaaaaaacacau

SEQ ID NO: 4008276 - RNA, 15 nt, Human metapneumovirus
ugcaagacuuggagc

SEQ ID NO: 4008277 - RNA, 13 nt, Human metapneumovirus
ugcaaucaacaaa

SEQ ID NO: 4008278 - RNA, 19 nt, Human metapneumovirus
ugcacaaauauaacaacau

SEQ ID NO: 4008279 - RNA, 22 nt, Human metapneumovirus
ugcagaaacaaaccaaaaccag

SEQ ID NO: 4008280 - RNA, 23 nt, Human metapneumovirus
ugcagagaaaggaaacacuggcu

SEQ ID NO: 4008281 - RNA, 14 nt, Human metapneumovirus
ugccaacaucugca

SEQ ID NO: 4008282 - RNA, 15 nt, Human metapneumovirus
ugcgacacagcagca

SEQ ID NO: 4008283 - RNA, 17 nt, Human metapneumovirus
ugcuggaaaauaaacag

SEQ ID NO: 4008284 - RNA, 18 nt, Human metapneumovirus
uggaucccauugaagaag

SEQ ID NO: 4008285 - RNA, 22 nt, Human metapneumovirus
uggcaacugcagugagagagcu

SEQ ID NO: 4008286 - RNA, 13 nt, Human metapneumovirus
uggcaagagagga

SEQ ID NO: 4008287 - RNA, 14 nt, Human metapneumovirus
uggggcaaccaaaa

SEQ ID NO: 4008288 - RNA, 12 nt, Human metapneumovirus
uguagagaaccu

SEQ ID NO: 4008289 - RNA, 19 nt, Human metapneumovirus
uguuuacuacccaaaugaa

SEQ ID NO: 4008290 - RNA, 18 nt, Human metapneumovirus
uuaaaaaguaaaaaacaa

SEQ ID NO: 4008291 - RNA, 13 nt, Human metapneumovirus
uuaagaaaaccag

SEQ ID NO: 4008292 - RNA, 14 nt, Human metapneumovirus
uucaucaaaucagu

SEQ ID NO: 4008293 - RNA, 18 nt, Human metapneumovirus
uugagaacagucaggccu

SEQ ID NO: 4008294 - RNA, 13 nt, Human metapneumovirus
uuggcaacugcag

SEQ ID NO: 4008295 - RNA, 19 nt, Human metapneumovirus
uugugagcucagccaaauc

SEQ ID NO: 4008296 - RNA, 21 nt, Human metapneumovirus
uuucugcugaucaacuggcaa

SEQ ID NO: 4008297 - RNA, 23 nt, Human metapneumovirus
uuuucauggguaaugaagcagca

SEQ ID NO: 4008298 - RNA, 13 nt, Human metapneumovirus
aaaaacagaauua

SEQ ID NO: 4008299 - RNA, 21 nt, Human metapneumovirus
aaaaaucaaguuagaacaaga

SEQ ID NO: 4008300 - RNA, 22 nt, Human metapneumovirus
aaaacaaucugcaaauaugcca

SEQ ID NO: 4008301 - RNA, 14 nt, Human metapneumovirus
aaaaccaacaauug

SEQ ID NO: 4008302 - RNA, 14 nt, Human metapneumovirus
aaaagaaacugaaa

SEQ ID NO: 4008303 - RNA, 19 nt, Human metapneumovirus
aaaauuugggacaaaucau

SEQ ID NO: 4008304 - RNA, 21 nt, Human metapneumovirus
uggccguuagcuucagucaau

SEQ ID NO: 4008305 - RNA, 21 nt, Human metapneumovirus
ugggacaaguaaaaauggagu

SEQ ID NO: 4008306 - RNA, 20 nt, Human metapneumovirus
uguccuagguuccaccaaug

SEQ ID NO: 4008307 - RNA, 21 nt, Human metapneumovirus
ugugagcucagccaaaucagu

SEQ ID NO: 4008308 - RNA, 16 nt, Human metapneumovirus
uguuggcaacugcagu

SEQ ID NO: 4008309 - RNA, 15 nt, Human metapneumovirus
uguuuuaaaucugaa

SEQ ID NO: 4008310 - RNA, 18 nt, Human metapneumovirus
uguuuuaaaucugaagac

SEQ ID NO: 4008311 - RNA, 21 nt, Human metapneumovirus
uuagagaaugcugcugaauua

SEQ ID NO: 4008312 - RNA, 18 nt, Human metapneumovirus
uuagggcuauuaagaaca

SEQ ID NO: 4008313 - RNA, 13 nt, Human metapneumovirus
uugcaacugcagc

SEQ ID NO: 4008314 - RNA, 12 nt, Human metapneumovirus
uuggcaacugca

SEQ ID NO: 4008315 - RNA, 14 nt, Human metapneumovirus
uugucaaaaugcag

SEQ ID NO: 4008316 - RNA, 16 nt, Human metapneumovirus
uuuacaccaaaugaac

SEQ ID NO: 4008317 - RNA, 13 nt, Human metapneumovirus
uaaugaagcagca

SEQ ID NO: 4008318 - RNA, 20 nt, Human metapneumovirus
uacacuggagguaggcgaug

SEQ ID NO: 4008319 - RNA, 22 nt, Human metapneumovirus
uacagcaggacccacagcagca

SEQ ID NO: 4008320 - RNA, 16 nt, Human metapneumovirus
uaccagcuaagcaaag

SEQ ID NO: 4008321 - RNA, 15 nt, Human metapneumovirus
uaccguguuagaaaa

SEQ ID NO: 4008322 - RNA, 17 nt, Human metapneumovirus
uacucaaagugaaugca

SEQ ID NO: 4008323 - RNA, 17 nt, Human metapneumovirus
uagaccugcaaaaccaa

SEQ ID NO: 4008324 - RNA, 19 nt, Human metapneumovirus
uagcacuauaacugaagga

SEQ ID NO: 4008325 - RNA, 19 nt, Human metapneumovirus
uagcacucucaaauuaaau

SEQ ID NO: 4008326 - RNA, 20 nt, Human metapneumovirus
uaggaguuuacggaagcucc

SEQ ID NO: 4008327 - RNA, 15 nt, Human metapneumovirus
uauaacaacauacaa

SEQ ID NO: 4008328 - RNA, 16 nt, Human metapneumovirus
uauaagcagugaagca

SEQ ID NO: 4008329 - RNA, 17 nt, Human metapneumovirus
uauaagcagugaagcag

SEQ ID NO: 4008330 - RNA, 11 nt, Human metapneumovirus
uaucaggagca

SEQ ID NO: 4008331 - RNA, 16 nt, Human metapneumovirus
ucaaaaaaauaauuaa

SEQ ID NO: 4008332 - RNA, 16 nt, Human metapneumovirus
ucaaaggagugcaaca

SEQ ID NO: 4008333 - RNA, 17 nt, Human metapneumovirus
ucaaagguauacaaacu

SEQ ID NO: 4008334 - RNA, 14 nt, Human metapneumovirus
ucaaaucaguuuca

SEQ ID NO: 4008335 - RNA, 21 nt, Human metapneumovirus
ucaacacggucuuaaagagag

SEQ ID NO: 4008336 - RNA, 23 nt, Human metapneumovirus
ucaacacggucuuaaagagagcu

SEQ ID NO: 4008337 - RNA, 18 nt, Human metapneumovirus
ucaagaacgggacaaaua

SEQ ID NO: 4008338 - RNA, 14 nt, Human metapneumovirus
ucaaucaaagagag

SEQ ID NO: 4008339 - RNA, 21 nt, Human metapneumovirus
ucaaucuuaaccuuugaagaa

SEQ ID NO: 4008340 - RNA, 16 nt, Human metapneumovirus
ucagauaaugaagaag

SEQ ID NO: 4008341 - RNA, 16 nt, Human metapneumovirus
ucaucaaauaccacau

SEQ ID NO: 4008342 - RNA, 16 nt, Human metapneumovirus
ucaugacuaugaacaa

SEQ ID NO: 4008343 - RNA, 16 nt, Human metapneumovirus
ucauuaagaaaaccag

SEQ ID NO: 4008344 - RNA, 20 nt, Human metapneumovirus
uccagaaaucauuaagaaaa

SEQ ID NO: 4008345 - RNA, 22 nt, Human metapneumovirus
ucccaaaaaauuugaagucaau

SEQ ID NO: 4008346 - RNA, 13 nt, Human metapneumovirus
uccuaagcagugc

SEQ ID NO: 4008347 - RNA, 19 nt, Human metapneumovirus
ucgacacacacacaacacc

SEQ ID NO: 4008348 - RNA, 17 nt, Human metapneumovirus
ucgguguugcaacugca

SEQ ID NO: 4008349 - RNA, 23 nt, Human metapneumovirus
ucuucaaaaacauguacucaccu

SEQ ID NO: 4008350 - RNA, 16 nt, Human metapneumovirus
ugaacaaaggcugcuc

SEQ ID NO: 4008351 - RNA, 17 nt, Human metapneumovirus
ugaacuagccagagcug

SEQ ID NO: 4008352 - RNA, 18 nt, Human metapneumovirus
ugaagacacaaaaaccaa

SEQ ID NO: 4008353 - RNA, 22 nt, Human metapneumovirus
ugagcagucaaaggagugcaac

SEQ ID NO: 4008354 - RNA, 21 nt, Human metapneumovirus
ugagcuguuccauuggcagca

SEQ ID NO: 4008355 - RNA, 15 nt, Human metapneumovirus
ugcacuaagagagcu

SEQ ID NO: 4008356 - RNA, 15 nt, Human metapneumovirus
ugcuauaagcaguga

SEQ ID NO: 4008357 - RNA, 16 nt, Human metapneumovirus
uggaaaauaaacagaa

SEQ ID NO: 4008358 - RNA, 21 nt, Human metapneumovirus
uggaauuugacaaacucacag

SEQ ID NO: 4008359 - RNA, 18 nt, Human metapneumovirus
uggaucaaucaaacagaa

SEQ ID NO: 4008360 - RNA, 23 nt, Human metapneumovirus
ugggaaaaccccugcagaaaaga

SEQ ID NO: 4008361 - RNA, 15 nt, Human metapneumovirus
ugguauugucaaaau

SEQ ID NO: 4008362 - RNA, 15 nt, Human metapneumovirus
uguagacaacaacaa

SEQ ID NO: 4008363 - RNA, 14 nt, Human metapneumovirus
ugucacaaacaaug

SEQ ID NO: 4008364 - RNA, 13 nt, Human metapneumovirus
uguuggagaaccg

SEQ ID NO: 4008365 - RNA, 21 nt, Human metapneumovirus
uuaaaaauauuuugaaaacaa

SEQ ID NO: 4008366 - RNA, 12 nt, Human metapneumovirus
uuaaucaacaau

SEQ ID NO: 4008367 - RNA, 19 nt, Human metapneumovirus
uuacauggugcaacugcca

SEQ ID NO: 4008368 - RNA, 21 nt, Human metapneumovirus
uuaugaucaugacuaugaaca

SEQ ID NO: 4008369 - RNA, 19 nt, Human metapneumovirus
uucauggguaaugaagcag

SEQ ID NO: 4008370 - RNA, 15 nt, Human metapneumovirus
uucccugaaggaaaa

SEQ ID NO: 4008371 - RNA, 22 nt, Human metapneumovirus
uucuaguuauauaaaaaucaag

SEQ ID NO: 4008372 - RNA, 14 nt, Human metapneumovirus
uuggcaacugcagu

SEQ ID NO: 4008373 - RNA, 17 nt, Human metapneumovirus
uuucaggccaacacacc

SEQ ID NO: 4008374 - RNA, 15 nt, Human metapneumovirus
aagcaagcaaucaaa

SEQ ID NO: 4008375 - RNA, 22 nt, Human metapneumovirus
aagcacaaguggagaauccgaa

SEQ ID NO: 4008376 - RNA, 13 nt, Human metapneumovirus
aagcagcaaaauu

SEQ ID NO: 4008377 - RNA, 23 nt, Human metapneumovirus
aagcagcuuugacccagucaagu

SEQ ID NO: 4008378 - RNA, 16 nt, Human metapneumovirus
aagcgcaagcagaaca

SEQ ID NO: 4008379 - RNA, 16 nt, Human metapneumovirus
aagcuuggagcuggga

SEQ ID NO: 4008380 - RNA, 13 nt, Human metapneumovirus
aaggaagcuaaag

SEQ ID NO: 4008381 - RNA, 20 nt, Human metapneumovirus
aagggaaagcagcagaaaug

SEQ ID NO: 4008382 - RNA, 22 nt, Human metapneumovirus
aagguuucauuuacaccaaaug

SEQ ID NO: 4008383 - RNA, 17 nt, Human metapneumovirus
aaguaacagcaauuaag

SEQ ID NO: 4008384 - RNA, 12 nt, Human metapneumovirus
aagugcagugag

SEQ ID NO: 4008385 - RNA, 20 nt, Human metapneumovirus
aagugggacaagucaaaaug

SEQ ID NO: 4008386 - RNA, 19 nt, Human metapneumovirus
aauacuguaucagaaacau

SEQ ID NO: 4008387 - RNA, 17 nt, Human metapneumovirus
aauaucuuuggacuuaa

SEQ ID NO: 4008388 - RNA, 15 nt, Human metapneumovirus
aaucaacaaucucaa

SEQ ID NO: 4008389 - RNA, 15 nt, Human metapneumovirus
aaucaauaaaaacuu

SEQ ID NO: 4008390 - RNA, 13 nt, Human metapneumovirus
aaucugcaaauau

SEQ ID NO: 4008391 - RNA, 22 nt, Human metapneumovirus
aaugaagaagaagaugcagaau

SEQ ID NO: 4008392 - RNA, 17 nt, Human metapneumovirus
aaugcccucaaaaagac

SEQ ID NO: 4008393 - RNA, 18 nt, Human metapneumovirus
aauuaaaaacuuaaaagu

SEQ ID NO: 4008394 - RNA, 17 nt, Human metapneumovirus
aauuagaccugaccaaa

SEQ ID NO: 4008395 - RNA, 17 nt, Human metapneumovirus
aauuaguuaauuaaaaa

SEQ ID NO: 4008396 - RNA, 17 nt, Human metapneumovirus
aauuguuauuuagaaaa

SEQ ID NO: 4008397 - RNA, 17 nt, Human metapneumovirus
aauuugggacaaaucau

SEQ ID NO: 4008398 - RNA, 14 nt, Human metapneumovirus
acaaauaaaaaugu

SEQ ID NO: 4008399 - RNA, 22 nt, Human metapneumovirus
acaagucaaaaugucauucccu

SEQ ID NO: 4008400 - RNA, 16 nt, Human metapneumovirus
acaaugauaacauuag

SEQ ID NO: 4008401 - RNA, 23 nt, Human metapneumovirus
acaauggcuucauaccacauaau

SEQ ID NO: 4008402 - RNA, 13 nt, Human metapneumovirus
acacaaaaaccaa

SEQ ID NO: 4008403 - RNA, 14 nt, Human metapneumovirus
acacaguuaaaugg

SEQ ID NO: 4008404 - RNA, 14 nt, Human metapneumovirus
acaccaccagcagu

SEQ ID NO: 4008405 - RNA, 15 nt, Human metapneumovirus
acaccaccagcagug

SEQ ID NO: 4008406 - RNA, 12 nt, Human metapneumovirus
acaccagcaaua

SEQ ID NO: 4008407 - RNA, 18 nt, Human metapneumovirus
acacggucuuaaagagag

SEQ ID NO: 4008408 - RNA, 19 nt, Human metapneumovirus
acagaagguuccuaaaugu

SEQ ID NO: 4008409 - RNA, 20 nt, Human metapneumovirus
acagcauguuauaaaaggaa

SEQ ID NO: 4008410 - RNA, 23 nt, Human metapneumovirus
acagucugugaaguaaaaacagu

SEQ ID NO: 4008411 - RNA, 22 nt, Human metapneumovirus
acaucagagugggauaaaugac

SEQ ID NO: 4008412 - RNA, 20 nt, Human metapneumovirus
accaaaacugaaauaaagca

SEQ ID NO: 4008413 - RNA, 19 nt, Human metapneumovirus
accaagcucuaacacaggc

SEQ ID NO: 4008414 - RNA, 16 nt, Human metapneumovirus
accagcagugcugcuc

SEQ ID NO: 4008415 - RNA, 13 nt, Human metapneumovirus
acccacaggagca

SEQ ID NO: 4008416 - RNA, 20 nt, Human metapneumovirus
acccaugcaaaguuagcaca

SEQ ID NO: 4008417 - RNA, 19 nt, Human metapneumovirus
accccugcagaaaagaaac

SEQ ID NO: 4008418 - RNA, 19 nt, Human metapneumovirus
acggucuuaaagagagcua

SEQ ID NO: 4008419 - RNA, 17 nt, Human metapneumovirus
acucgaugaauauagca

SEQ ID NO: 4008420 - RNA, 14 nt, Human metapneumovirus
acugccaaucuuug

SEQ ID NO: 4008421 - RNA, 21 nt, Human metapneumovirus
acuggcaagagaggagcaaau

SEQ ID NO: 4008422 - RNA, 18 nt, Human metapneumovirus
acugugaaacaagaggag

SEQ ID NO: 4008423 - RNA, 12 nt, Human metapneumovirus
agaaaaagcaaa

SEQ ID NO: 4008424 - RNA, 16 nt, Human metapneumovirus
agaagaaccaaaagac

SEQ ID NO: 4008425 - RNA, 15 nt, Human metapneumovirus
agaagauaggacaca

SEQ ID NO: 4008426 - RNA, 16 nt, Human metapneumovirus
agaauccuaagcagug

SEQ ID NO: 4008427 - RNA, 22 nt, Human metapneumovirus
agaaugccauuguauauacaca

SEQ ID NO: 4008428 - RNA, 23 nt, Human metapneumovirus
agacaacgcuggaauaacaccag

SEQ ID NO: 4008429 - RNA, 22 nt, Human metapneumovirus
agacagugaaagcacuaaucaa

SEQ ID NO: 4008430 - RNA, 20 nt, Human metapneumovirus
agaccuuaccuaaaaaauga

SEQ ID NO: 4008431 - RNA, 15 nt, Human metapneumovirus
agacugugaaacaag

SEQ ID NO: 4008432 - RNA, 19 nt, Human metapneumovirus
agacugugaaacaagagga

SEQ ID NO: 4008433 - RNA, 15 nt, Human metapneumovirus
agagaagauaggaca

SEQ ID NO: 4008434 - RNA, 20 nt, Human metapneumovirus
agagaggagcaaauugaaaa

SEQ ID NO: 4008435 - RNA, 22 nt, Human metapneumovirus
agagauacuucaucauuaagca

SEQ ID NO: 4008436 - RNA, 13 nt, Human metapneumovirus
agauaacaaacua

SEQ ID NO: 4008437 - RNA, 14 nt, Human metapneumovirus
agaucauaaaguca

SEQ ID NO: 4008438 - RNA, 18 nt, Human metapneumovirus
agcagacauaauaaagga

SEQ ID NO: 4008439 - RNA, 20 nt, Human metapneumovirus
agcagcaggaaucaauguug

SEQ ID NO: 4008440 - RNA, 15 nt, Human metapneumovirus
agcaggaaucaaugu

SEQ ID NO: 4008441 - RNA, 17 nt, Human metapneumovirus
agcagucaaaggagugc

SEQ ID NO: 4008442 - RNA, 15 nt, Human metapneumovirus
agcauaagcaaaaua

SEQ ID NO: 4008443 - RNA, 19 nt, Human metapneumovirus
agcccaaggugcagcaaug

SEQ ID NO: 4008444 - RNA, 16 nt, Human metapneumovirus
agcucagccaaaucag

SEQ ID NO: 4008445 - RNA, 20 nt, Human metapneumovirus
aggaacacugauagagcuga

SEQ ID NO: 4008446 - RNA, 22 nt, Human metapneumovirus
aggacagguugguacaccaaug

SEQ ID NO: 4008447 - RNA, 18 nt, Human metapneumovirus
aggacccacagcagcaag

SEQ ID NO: 4008448 - RNA, 18 nt, Human metapneumovirus
aggaccuguuaccugcaa

SEQ ID NO: 4008449 - RNA, 19 nt, Human metapneumovirus
agggacaagauaugucuug

SEQ ID NO: 4008450 - RNA, 13 nt, Human metapneumovirus
aguaacagcaauu

SEQ ID NO: 4008451 - RNA, 18 nt, Human metapneumovirus
aguacuagauuuagaaau

SEQ ID NO: 4008452 - RNA, 14 nt, Human metapneumovirus
agucagcuacuguu

SEQ ID NO: 4008453 - RNA, 23 nt, Human metapneumovirus
agucauggaucccauugaagaag

SEQ ID NO: 4008454 - RNA, 22 nt, Human metapneumovirus
agugcugcucgaucagcuaaaa

SEQ ID NO: 4008455 - RNA, 22 nt, Human metapneumovirus
aguggagaauccgaagaagaag

SEQ ID NO: 4008456 - RNA, 15 nt, Human metapneumovirus
aguggugaucauuuu

SEQ ID NO: 4008457 - RNA, 13 nt, Human metapneumovirus
aguuauuuaaaaa

SEQ ID NO: 4008458 - RNA, 15 nt, Human metapneumovirus
aguuuccugaagauc

SEQ ID NO: 4008459 - RNA, 12 nt, Human metapneumovirus
auaaaaacagaa

SEQ ID NO: 4008460 - RNA, 20 nt, Human metapneumovirus
auagcagacauaauaaagga

SEQ ID NO: 4008461 - RNA, 23 nt, Human metapneumovirus
aucaacuggcaagagaggagcaa

SEQ ID NO: 4008462 - RNA, 15 nt, Human metapneumovirus
aucaagcaacugaac

SEQ ID NO: 4008463 - RNA, 16 nt, Human metapneumovirus
aucaagugcagugagc

SEQ ID NO: 4008464 - RNA, 13 nt, Human metapneumovirus
aucacaaaauggu

SEQ ID NO: 4008465 - RNA, 13 nt, Human metapneumovirus
aucagacaaaaag

SEQ ID NO: 4008466 - RNA, 22 nt, Human metapneumovirus
aucagcaggugcugaaaaugac

SEQ ID NO: 4008467 - RNA, 20 nt, Human metapneumovirus
aucaguuggcaaaaaaacac

SEQ ID NO: 4008468 - RNA, 17 nt, Human metapneumovirus
aucuaauagaaaaggac

SEQ ID NO: 4008469 - RNA, 23 nt, Human metapneumovirus
aucuagaaaagaacacaccuguu

SEQ ID NO: 4008470 - RNA, 18 nt, Human metapneumovirus
augcugcaucacaaaaug

SEQ ID NO: 4008471 - RNA, 16 nt, Human metapneumovirus
auggaucuagaaaaga

SEQ ID NO: 4008472 - RNA, 21 nt, Human metapneumovirus
augguaguguaaaauuaacag

SEQ ID NO: 4008473 - RNA, 14 nt, Human metapneumovirus
auuaagaaaaccag

SEQ ID NO: 4008474 - RNA, 15 nt, Human metapneumovirus
caaaaaauuugaagu

SEQ ID NO: 4008475 - RNA, 20 nt, Human metapneumovirus
caaaaugcagggucaacugu

SEQ ID NO: 4008476 - RNA, 20 nt, Human metapneumovirus
caaaaugucauucccugaag

SEQ ID NO: 4008477 - RNA, 14 nt, Human metapneumovirus
caaaccaaaaccag

SEQ ID NO: 4008478 - RNA, 21 nt, Human metapneumovirus
caaacuaucugacagcaaaca

SEQ ID NO: 4008479 - RNA, 17 nt, Human metapneumovirus
caaaugcaauagaggaa

SEQ ID NO: 4008480 - RNA, 18 nt, Human metapneumovirus
caacaaaauuguugaaga

SEQ ID NO: 4008481 - RNA, 21 nt, Human metapneumovirus
caacaauugugauaaacugac

SEQ ID NO: 4008482 - RNA, 17 nt, Human metapneumovirus
caacgguccccacagac

SEQ ID NO: 4008483 - RNA, 13 nt, Human metapneumovirus
caacugcagcugc

SEQ ID NO: 4008484 - RNA, 12 nt, Human metapneumovirus
caacugcaguga

SEQ ID NO: 4008485 - RNA, 14 nt, Human metapneumovirus
caagaaaaaaacug

SEQ ID NO: 4008486 - RNA, 22 nt, Human metapneumovirus
caagagacugccgagagagaaa

SEQ ID NO: 4008487 - RNA, 14 nt, Human metapneumovirus
caagagaggagcaa

SEQ ID NO: 4008488 - RNA, 12 nt, Human metapneumovirus
caagcaacugaa

SEQ ID NO: 4008489 - RNA, 14 nt, Human metapneumovirus
caagcccacagcau

SEQ ID NO: 4008490 - RNA, 22 nt, Human metapneumovirus
caaguggagaauccgaagaaga

SEQ ID NO: 4008491 - RNA, 17 nt, Human metapneumovirus
caauagacaacacugua

SEQ ID NO: 4008492 - RNA, 14 nt, Human metapneumovirus
caaucccaaaggca

SEQ ID NO: 4008493 - RNA, 19 nt, Human metapneumovirus
caaugcgacuguagcacuc

SEQ ID NO: 4008494 - RNA, 14 nt, Human metapneumovirus
cacaccuguuacaa

SEQ ID NO: 4008495 - RNA, 21 nt, Human metapneumovirus
cacagcagcaggaaucaaugu

SEQ ID NO: 4008496 - RNA, 16 nt, Human metapneumovirus
cacagcagcuguucaa

SEQ ID NO: 4008497 - RNA, 19 nt, Human metapneumovirus
cacaggagcaccuccagag

SEQ ID NO: 4008498 - RNA, 17 nt, Human metapneumovirus
caccagcaauaucuuug

SEQ ID NO: 4008499 - RNA, 15 nt, Human metapneumovirus
caccagcagugcugc

SEQ ID NO: 4008500 - RNA, 17 nt, Human metapneumovirus
caccccaagaaaaaaac

SEQ ID NO: 4008501 - RNA, 22 nt, Human metapneumovirus
caccuguuacaauaccagcauu

SEQ ID NO: 4008502 - RNA, 17 nt, Human metapneumovirus
cagaaaugauggaagag

SEQ ID NO: 4008503 - RNA, 22 nt, Human metapneumovirus
cagaagcuuuccagaaaucauu

SEQ ID NO: 4008504 - RNA, 19 nt, Human metapneumovirus
cagcaagcucaccagagac

SEQ ID NO: 4008505 - RNA, 16 nt, Human metapneumovirus
cagcccaaggugcagc

SEQ ID NO: 4008506 - RNA, 14 nt, Human metapneumovirus
caggaaucaauguu

SEQ ID NO: 4008507 - RNA, 16 nt, Human metapneumovirus
caguagaccugcaaaa

SEQ ID NO: 4008508 - RNA, 18 nt, Human metapneumovirus
caguagaccugcaaaacc

SEQ ID NO: 4008509 - RNA, 19 nt, Human metapneumovirus
cagucaaguuuccugaaga

SEQ ID NO: 4008510 - RNA, 16 nt, Human metapneumovirus
caguccacacaaaaaa

SEQ ID NO: 4008511 - RNA, 21 nt, Human metapneumovirus
caguuacagcagguguugcaa

SEQ ID NO: 4008512 - RNA, 17 nt, Human metapneumovirus
caguuggcaaaaaaaca

SEQ ID NO: 4008513 - RNA, 13 nt, Human metapneumovirus
caguuucaaucaa

SEQ ID NO: 4008514 - RNA, 18 nt, Human metapneumovirus
cauaauaaagaaaacaaa

SEQ ID NO: 4008515 - RNA, 20 nt, Human metapneumovirus
cauaauaaagaaaacaaaga

SEQ ID NO: 4008516 - RNA, 20 nt, Human metapneumovirus
cauaauaauaaguaauaauu

SEQ ID NO: 4008517 - RNA, 15 nt, Human metapneumovirus
caucacaacauuauu

SEQ ID NO: 4008518 - RNA, 16 nt, Human metapneumovirus
caucauuguaauaauu

SEQ ID NO: 4008519 - RNA, 17 nt, Human metapneumovirus
cauggguaaugaagcag

SEQ ID NO: 4008520 - RNA, 19 nt, Human metapneumovirus
cauuccuuacacagcagcu

SEQ ID NO: 4008521 - RNA, 21 nt, Human metapneumovirus
ccaaaugaaaaagacugugaa

SEQ ID NO: 4008522 - RNA, 17 nt, Human metapneumovirus
ccaagcucuaacacagg

SEQ ID NO: 4008523 - RNA, 19 nt, Human metapneumovirus
ccaagcucuaacacaggcc

SEQ ID NO: 4008524 - RNA, 15 nt, Human metapneumovirus
ccacaggagcaccuc

SEQ ID NO: 4008525 - RNA, 20 nt, Human metapneumovirus
ccaccagcagugcugcucga

SEQ ID NO: 4008526 - RNA, 20 nt, Human metapneumovirus
ccagcauucaucaaaucagu

SEQ ID NO: 4008527 - RNA, 20 nt, Human metapneumovirus
ccauaccgucagaaccaaag

SEQ ID NO: 4008528 - RNA, 17 nt, Human metapneumovirus
ccaugauccuagugagu

SEQ ID NO: 4008529 - RNA, 21 nt, Human metapneumovirus
ccaugucuuuugcgacacagc

SEQ ID NO: 4008530 - RNA, 24 nt, Human metapneumovirus
ccaugucuuuugcgacacagcagc

SEQ ID NO: 4008531 - RNA, 22 nt, Human metapneumovirus
cccaaaaaauuugaagucaaug

SEQ ID NO: 4008532 - RNA, 21 nt, Human metapneumovirus
cccagcuuaauaaaaacagaa

SEQ ID NO: 4008533 - RNA, 23 nt, Human metapneumovirus
ccgaagaagaagaagaaccaaaa

SEQ ID NO: 4008534 - RNA, 13 nt, Human metapneumovirus
ccguccacagcau

SEQ ID NO: 4008535 - RNA, 15 nt, Human metapneumovirus
ccuaagcagugcaga

SEQ ID NO: 4008536 - RNA, 16 nt, Human metapneumovirus
ccuuacacagcagcug

SEQ ID NO: 4008537 - RNA, 12 nt, Human metapneumovirus
cgacacagcagc

SEQ ID NO: 4008538 - RNA, 18 nt, Human metapneumovirus
cgagagagaaacugaaaa

SEQ ID NO: 4008539 - RNA, 19 nt, Human metapneumovirus
cgcuggaauaacaccagca

SEQ ID NO: 4008540 - RNA, 17 nt, Human metapneumovirus
cggcuugaaagugaagu

SEQ ID NO: 4008541 - RNA, 13 nt, Human metapneumovirus
cuaagcaaaguug

SEQ ID NO: 4008542 - RNA, 17 nt, Human metapneumovirus
cuaggagcaauagcacu

SEQ ID NO: 4008543 - RNA, 15 nt, Human metapneumovirus
cucaaaaaaauaauu

SEQ ID NO: 4008544 - RNA, 11 nt, Human metapneumovirus
cucaaauuaaa

SEQ ID NO: 4008545 - RNA, 14 nt, Human metapneumovirus
cucagaacaguuuc

SEQ ID NO: 4008546 - RNA, 21 nt, Human metapneumovirus
cucagaacaguuucugcugau

SEQ ID NO: 4008547 - RNA, 16 nt, Human metapneumovirus
cucagccaaaucaguu

SEQ ID NO: 4008548 - RNA, 15 nt, Human metapneumovirus
cucuaacacaggcca

SEQ ID NO: 4008549 - RNA, 21 nt, Human metapneumovirus
cugaagaucaauucaauguug

SEQ ID NO: 4008550 - RNA, 20 nt, Human metapneumovirus
cugaguggugucacaaacaa

SEQ ID NO: 4008551 - RNA, 14 nt, Human metapneumovirus
cugcaggacaaaua

SEQ ID NO: 4008552 - RNA, 17 nt, Human metapneumovirus
cuuaagagaagaccaag

SEQ ID NO: 4008553 - RNA, 21 nt, Human metapneumovirus
cuuacaugugccgauggaccc

SEQ ID NO: 4008554 - RNA, 23 nt, Human metapneumovirus
cuuagaagagucauguagcacua
